United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 51

SEQ ID NO: 1817986 - RNA, 16 nt, Salmonella typhimurium LT2
uaaucgaaucgccuca

SEQ ID NO: 1817987 - RNA, 15 nt, Salmonella typhimurium LT2
uaaucgaaucgccuc

SEQ ID NO: 1817988 - RNA, 22 nt, Salmonella typhimurium LT2
uaaucccuugcuggcgacggcg

SEQ ID NO: 1817989 - RNA, 13 nt, Salmonella typhimurium LT2
uaaugacauccag

SEQ ID NO: 1817990 - RNA, 22 nt, Salmonella typhimurium LT2
uaaucguauucauugccguaaa

SEQ ID NO: 1817991 - RNA, 13 nt, Salmonella typhimurium LT2
uaaucgaucccgc

SEQ ID NO: 1817992 - RNA, 16 nt, Salmonella typhimurium LT2
uaacacggcuggcaau

SEQ ID NO: 1817993 - RNA, 22 nt, Salmonella typhimurium LT2
uaaccggcggcgucuggcgaaa

SEQ ID NO: 1817994 - RNA, 14 nt, Salmonella typhimurium LT2
uaacagaugacagu

SEQ ID NO: 1817995 - RNA, 21 nt, Salmonella typhimurium LT2
uaaccguucaucuaucgccag

SEQ ID NO: 1817996 - RNA, 22 nt, Salmonella typhimurium LT2
uaaccgucuggcugccaucggc

SEQ ID NO: 1817997 - RNA, 20 nt, Salmonella typhimurium LT2
uaaccucaaugauuuccgca

SEQ ID NO: 1817998 - RNA, 21 nt, Salmonella typhimurium LT2
uaaauuuggcgaugcuaucgg

SEQ ID NO: 1817999 - RNA, 17 nt, Salmonella typhimurium LT2
uaaauugggaugaugcc

SEQ ID NO: 1818000 - RNA, 17 nt, Salmonella typhimurium LT2
uaaauugcacgcccaua

SEQ ID NO: 1818001 - RNA, 13 nt, Salmonella typhimurium LT2
uaaauccggccuc

SEQ ID NO: 1818002 - RNA, 11 nt, Salmonella typhimurium LT2
uaaaucguccg

SEQ ID NO: 1818003 - RNA, 21 nt, Salmonella typhimurium LT2
uaaaucugccgucaucgacuu

SEQ ID NO: 1818004 - RNA, 14 nt, Salmonella typhimurium LT2
uaaaugacgcgcga

SEQ ID NO: 1818005 - RNA, 20 nt, Salmonella typhimurium LT2
uaaaugcuccccgccgcaca

SEQ ID NO: 1818006 - RNA, 15 nt, Salmonella typhimurium LT2
uaaaucaaccugcug

SEQ ID NO: 1818007 - RNA, 14 nt, Salmonella typhimurium LT2
uaaaucaaacgcac

SEQ ID NO: 1818008 - RNA, 24 nt, Salmonella typhimurium LT2
uaaauauugaguucaauaagcgaa

SEQ ID NO: 1818009 - RNA, 13 nt, Salmonella typhimurium LT2
uaaauaccaggca

SEQ ID NO: 1818010 - RNA, 18 nt, Salmonella typhimurium LT2
uaaauacccaggccauca

SEQ ID NO: 1818011 - RNA, 23 nt, Salmonella typhimurium LT2
uaaauaacgggcgcgcgcgcaga

SEQ ID NO: 1818012 - RNA, 16 nt, Salmonella typhimurium LT2
uaaauaaacagcgccu

SEQ ID NO: 1818013 - RNA, 13 nt, Salmonella typhimurium LT2
uaaacucagcgcc

SEQ ID NO: 1818014 - RNA, 17 nt, Salmonella typhimurium LT2
uaaacagcguuuucaua

SEQ ID NO: 1818015 - RNA, 18 nt, Salmonella typhimurium LT2
uaaacagaaucaacgcca

SEQ ID NO: 1818016 - RNA, 23 nt, Salmonella typhimurium LT2
uaaacgucccgacgaauaacaaa

SEQ ID NO: 1818017 - RNA, 17 nt, Salmonella typhimurium LT2
uaaagcaccaucgcaaa

SEQ ID NO: 1818018 - RNA, 18 nt, Salmonella typhimurium LT2
uaaagguuucgauacagc

SEQ ID NO: 1818019 - RNA, 16 nt, Salmonella typhimurium LT2
uaaaguuauucacgua

SEQ ID NO: 1818020 - RNA, 22 nt, Salmonella typhimurium LT2
guuucauuucgcccaucgcuuu

SEQ ID NO: 1818021 - RNA, 22 nt, Salmonella typhimurium LT2
guuucacuguggugacgggcaa

SEQ ID NO: 1818022 - RNA, 14 nt, Salmonella typhimurium LT2
guuucaccgccaga

SEQ ID NO: 1818023 - RNA, 23 nt, Salmonella typhimurium LT2
guuuccagauucggaacgcggcg

SEQ ID NO: 1818024 - RNA, 20 nt, Salmonella typhimurium LT2
uaaaacggcuuuucuucauc

SEQ ID NO: 1818025 - RNA, 23 nt, Salmonella typhimurium LT2
uaaaacggaucagccugagcgcc

SEQ ID NO: 1818026 - RNA, 16 nt, Salmonella typhimurium LT2
uaaaagacgaagccga

SEQ ID NO: 1818027 - RNA, 17 nt, Salmonella typhimurium LT2
agccgucaaacaucgcg

SEQ ID NO: 1818028 - RNA, 18 nt, Salmonella typhimurium LT2
agccguacacaaucaucg

SEQ ID NO: 1818029 - RNA, 21 nt, Salmonella typhimurium LT2
agccuguuccagcugcgacag

SEQ ID NO: 1818030 - RNA, 20 nt, Salmonella typhimurium LT2
agccugcccugcggcaggca

SEQ ID NO: 1818031 - RNA, 13 nt, Salmonella typhimurium LT2
agcgaagaauucg

SEQ ID NO: 1818032 - RNA, 19 nt, Salmonella typhimurium LT2
agcgaaaaaauaauccgcu

SEQ ID NO: 1818033 - RNA, 17 nt, Salmonella typhimurium LT2
agcgaaaugcgaauccg

SEQ ID NO: 1818034 - RNA, 17 nt, Salmonella typhimurium LT2
agcgacguaaugaucag

SEQ ID NO: 1818035 - RNA, 20 nt, Salmonella typhimurium LT2
agccgguauccagcgcguaa

SEQ ID NO: 1818036 - RNA, 16 nt, Salmonella typhimurium LT2
agccgggccagacgcu

SEQ ID NO: 1818037 - RNA, 20 nt, Salmonella typhimurium LT2
agccaccgccagcaguagcc

SEQ ID NO: 1818038 - RNA, 22 nt, Salmonella typhimurium LT2
agcccggcggauaaaucaucau

SEQ ID NO: 1818039 - RNA, 23 nt, Salmonella typhimurium LT2
agcccggcggcgcaucgcucacc

SEQ ID NO: 1818040 - RNA, 16 nt, Salmonella typhimurium LT2
agccggauaucgcuau

SEQ ID NO: 1818041 - RNA, 23 nt, Salmonella typhimurium LT2
agccgccguguugugugccgcgc

SEQ ID NO: 1818042 - RNA, 21 nt, Salmonella typhimurium LT2
agccgccaaaaauaucgccgu

SEQ ID NO: 1818043 - RNA, 14 nt, Salmonella typhimurium LT2
agccgcaguugcca

SEQ ID NO: 1818044 - RNA, 16 nt, Salmonella typhimurium LT2
agcgcaaacgcgcgau

SEQ ID NO: 1818045 - RNA, 23 nt, Salmonella typhimurium LT2
agcgccgacaaauccuccggcgc

SEQ ID NO: 1818046 - RNA, 15 nt, Salmonella typhimurium LT2
agcgccauccggcaa

SEQ ID NO: 1818047 - RNA, 17 nt, Salmonella typhimurium LT2
agcgccaucaggcauaa

SEQ ID NO: 1818048 - RNA, 13 nt, Salmonella typhimurium LT2
agcgccuuaucca

SEQ ID NO: 1818049 - RNA, 16 nt, Salmonella typhimurium LT2
agcgccgcgcaggcga

SEQ ID NO: 1818050 - RNA, 17 nt, Salmonella typhimurium LT2
agcgcgccgcagcgccg

SEQ ID NO: 1818051 - RNA, 19 nt, Salmonella typhimurium LT2
agcgcgccgccaacgccaa

SEQ ID NO: 1818052 - RNA, 18 nt, Salmonella typhimurium LT2
agcgcgccgcagcgccga

SEQ ID NO: 1818053 - RNA, 13 nt, Salmonella typhimurium LT2
agcgcgaacuaca

SEQ ID NO: 1818054 - RNA, 22 nt, Salmonella typhimurium LT2
agcgcgaacauuacauccucaa

SEQ ID NO: 1818055 - RNA, 13 nt, Salmonella typhimurium LT2
agcgcgaauuugc

SEQ ID NO: 1818056 - RNA, 19 nt, Salmonella typhimurium LT2
agcgcgcccagcagggcca

SEQ ID NO: 1818057 - RNA, 17 nt, Salmonella typhimurium LT2
agcgcgcccaugccgcc

SEQ ID NO: 1818058 - RNA, 15 nt, Salmonella typhimurium LT2
agcgcgccagcgcca

SEQ ID NO: 1818059 - RNA, 20 nt, Salmonella typhimurium LT2
agcgcugcuguaacagacgc

SEQ ID NO: 1818060 - RNA, 20 nt, Salmonella typhimurium LT2
agcgcugaugcaggcaauau

SEQ ID NO: 1818061 - RNA, 15 nt, Salmonella typhimurium LT2
agcguaccagcguca

SEQ ID NO: 1818062 - RNA, 20 nt, Salmonella typhimurium LT2
agcguauccauucucaucag

SEQ ID NO: 1818063 - RNA, 22 nt, Salmonella typhimurium LT2
agcguaacuguugccccgcuuu

SEQ ID NO: 1818064 - RNA, 12 nt, Salmonella typhimurium LT2
agcguaccagcg

SEQ ID NO: 1818065 - RNA, 15 nt, Salmonella typhimurium LT2
agcguaauuucuggu

SEQ ID NO: 1818066 - RNA, 13 nt, Salmonella typhimurium LT2
agcguacaggcgg

SEQ ID NO: 1818067 - RNA, 21 nt, Salmonella typhimurium LT2
agcguaaugcgccaggcagca

SEQ ID NO: 1818068 - RNA, 15 nt, Salmonella typhimurium LT2
agcgucauccggcaa

SEQ ID NO: 1818069 - RNA, 17 nt, Salmonella typhimurium LT2
agcgucaggguuaucgu

SEQ ID NO: 1818070 - RNA, 15 nt, Salmonella typhimurium LT2
agcgguacccggucc

SEQ ID NO: 1818071 - RNA, 14 nt, Salmonella typhimurium LT2
agcggucagcgaug

SEQ ID NO: 1818072 - RNA, 16 nt, Salmonella typhimurium LT2
agcggcccgcgcugaa

SEQ ID NO: 1818073 - RNA, 23 nt, Salmonella typhimurium LT2
agcggcgacuagucgcccgcuaa

SEQ ID NO: 1818074 - RNA, 16 nt, Salmonella typhimurium LT2
agcggcggcacggcgu

SEQ ID NO: 1818075 - RNA, 15 nt, Salmonella typhimurium LT2
agcggacacccgcag

SEQ ID NO: 1818076 - RNA, 22 nt, Salmonella typhimurium LT2
agcggauaagcgcagcgccauc

SEQ ID NO: 1818077 - RNA, 12 nt, Salmonella typhimurium LT2
agcggcagcgca

SEQ ID NO: 1818078 - RNA, 13 nt, Salmonella typhimurium LT2
agcaagcgccauc

SEQ ID NO: 1818079 - RNA, 17 nt, Salmonella typhimurium LT2
agcaauacaauuauugc

SEQ ID NO: 1818080 - RNA, 12 nt, Salmonella typhimurium LT2
agcaaagcgcca

SEQ ID NO: 1818081 - RNA, 14 nt, Salmonella typhimurium LT2
agcaaagcgccauc

SEQ ID NO: 1818082 - RNA, 16 nt, Salmonella typhimurium LT2
agcacaauggucagcg

SEQ ID NO: 1818083 - RNA, 18 nt, Salmonella typhimurium LT2
agcacaauggucagcgcc

SEQ ID NO: 1818084 - RNA, 15 nt, Salmonella typhimurium LT2
agcacaaucagcgcg

SEQ ID NO: 1818085 - RNA, 20 nt, Salmonella typhimurium LT2
agauuguggaacuuuaucgc

SEQ ID NO: 1818086 - RNA, 12 nt, Salmonella typhimurium LT2
agaucaggcgca

SEQ ID NO: 1818087 - RNA, 20 nt, Salmonella typhimurium LT2
agauccaucgccugcggcgu

SEQ ID NO: 1818088 - RNA, 15 nt, Salmonella typhimurium LT2
agauccggcgucagc

SEQ ID NO: 1818089 - RNA, 17 nt, Salmonella typhimurium LT2
agauugauaaucagcaa

SEQ ID NO: 1818090 - RNA, 18 nt, Salmonella typhimurium LT2
agcacuucuccacgcgau

SEQ ID NO: 1818091 - RNA, 16 nt, Salmonella typhimurium LT2
agcagaagacggaaac

SEQ ID NO: 1818092 - RNA, 18 nt, Salmonella typhimurium LT2
agcacgcaggcauccggu

SEQ ID NO: 1818093 - RNA, 18 nt, Salmonella typhimurium LT2
agcaccucaauaugaaau

SEQ ID NO: 1818094 - RNA, 18 nt, Salmonella typhimurium LT2
agcaccugcucaggcuga

SEQ ID NO: 1818095 - RNA, 16 nt, Salmonella typhimurium LT2
agccacagaaugccgu

SEQ ID NO: 1818096 - RNA, 15 nt, Salmonella typhimurium LT2
agcauugggccgaua

SEQ ID NO: 1818097 - RNA, 16 nt, Salmonella typhimurium LT2
agcaucuuaugcgcaa

SEQ ID NO: 1818098 - RNA, 17 nt, Salmonella typhimurium LT2
agcauggcgucucagcg

SEQ ID NO: 1818099 - RNA, 12 nt, Salmonella typhimurium LT2
agcauauccacc

SEQ ID NO: 1818100 - RNA, 17 nt, Salmonella typhimurium LT2
agcaucgcccgggcaau

SEQ ID NO: 1818101 - RNA, 15 nt, Salmonella typhimurium LT2
agcauaucgauagca

SEQ ID NO: 1818102 - RNA, 14 nt, Salmonella typhimurium LT2
agcauagcgccauc

SEQ ID NO: 1818103 - RNA, 14 nt, Salmonella typhimurium LT2
agcauagcgcugaa

SEQ ID NO: 1818104 - RNA, 16 nt, Salmonella typhimurium LT2
agcauaagcacagaua

SEQ ID NO: 1818105 - RNA, 14 nt, Salmonella typhimurium LT2
agcaguucguaauu

SEQ ID NO: 1818106 - RNA, 17 nt, Salmonella typhimurium LT2
agcaggccauaaugcag

SEQ ID NO: 1818107 - RNA, 21 nt, Salmonella typhimurium LT2
agcaggccaaaaaagccgcuc

SEQ ID NO: 1818108 - RNA, 14 nt, Salmonella typhimurium LT2
agcaggaacggcag

SEQ ID NO: 1818109 - RNA, 16 nt, Salmonella typhimurium LT2
agcagcuuauccggcc

SEQ ID NO: 1818110 - RNA, 20 nt, Salmonella typhimurium LT2
agacgaauaaucucaucgcc

SEQ ID NO: 1818111 - RNA, 17 nt, Salmonella typhimurium LT2
agacgaaaaugcgccuu

SEQ ID NO: 1818112 - RNA, 14 nt, Salmonella typhimurium LT2
agacgaugauaaua

SEQ ID NO: 1818113 - RNA, 13 nt, Salmonella typhimurium LT2
agacgaucagcgc

SEQ ID NO: 1818114 - RNA, 15 nt, Salmonella typhimurium LT2
agacgccauaucgcc

SEQ ID NO: 1818115 - RNA, 15 nt, Salmonella typhimurium LT2
agaccggcaucucau

SEQ ID NO: 1818116 - RNA, 16 nt, Salmonella typhimurium LT2
agaccguggauaagau

SEQ ID NO: 1818117 - RNA, 19 nt, Salmonella typhimurium LT2
agaccauucaaccagccga

SEQ ID NO: 1818118 - RNA, 16 nt, Salmonella typhimurium LT2
agaccgccaagcgcgg

SEQ ID NO: 1818119 - RNA, 20 nt, Salmonella typhimurium LT2
agaccccaguaauccggcaa

SEQ ID NO: 1818120 - RNA, 20 nt, Salmonella typhimurium LT2
agaccagauuaaucagcaga

SEQ ID NO: 1818121 - RNA, 21 nt, Salmonella typhimurium LT2
agagcggugacgauauuccgc

SEQ ID NO: 1818122 - RNA, 22 nt, Salmonella typhimurium LT2
agagcggcuacgccugauaagc

SEQ ID NO: 1818123 - RNA, 17 nt, Salmonella typhimurium LT2
agagcgccugcaggcga

SEQ ID NO: 1818124 - RNA, 11 nt, Salmonella typhimurium LT2
agagcgcauca

SEQ ID NO: 1818125 - RNA, 20 nt, Salmonella typhimurium LT2
agauaaaauacgugcggagu

SEQ ID NO: 1818126 - RNA, 19 nt, Salmonella typhimurium LT2
agagugacgacgccaggcg

SEQ ID NO: 1818127 - RNA, 17 nt, Salmonella typhimurium LT2
agauaauagcugcggcu

SEQ ID NO: 1818128 - RNA, 14 nt, Salmonella typhimurium LT2
agauacauggcuau

SEQ ID NO: 1818129 - RNA, 15 nt, Salmonella typhimurium LT2
agauaaucgggaaua

SEQ ID NO: 1818130 - RNA, 18 nt, Salmonella typhimurium LT2
agauagcuuccaugccga

SEQ ID NO: 1818131 - RNA, 18 nt, Salmonella typhimurium LT2
agauacugcgaucgccgg

SEQ ID NO: 1818132 - RNA, 15 nt, Salmonella typhimurium LT2
agacuucaaugccgc

SEQ ID NO: 1818133 - RNA, 14 nt, Salmonella typhimurium LT2
agacugugauggcg

SEQ ID NO: 1818134 - RNA, 15 nt, Salmonella typhimurium LT2
agagcaguacgccaa

SEQ ID NO: 1818135 - RNA, 19 nt, Salmonella typhimurium LT2
agacgcugauagccacggc

SEQ ID NO: 1818136 - RNA, 18 nt, Salmonella typhimurium LT2
agacgcuaucguccuggc

SEQ ID NO: 1818137 - RNA, 13 nt, Salmonella typhimurium LT2
agacggcagcgcc

SEQ ID NO: 1818138 - RNA, 19 nt, Salmonella typhimurium LT2
agacgguuucagugauaaa

SEQ ID NO: 1818139 - RNA, 20 nt, Salmonella typhimurium LT2
agaauguggguauccacgcc

SEQ ID NO: 1818140 - RNA, 16 nt, Salmonella typhimurium LT2
agacaaccagcagggc

SEQ ID NO: 1818141 - RNA, 18 nt, Salmonella typhimurium LT2
agacaacccgucaccgcc

SEQ ID NO: 1818142 - RNA, 23 nt, Salmonella typhimurium LT2
agacaaaguugacuuuuacgcca

SEQ ID NO: 1818143 - RNA, 19 nt, Salmonella typhimurium LT2
agacaauccgcggcaaauc

SEQ ID NO: 1818144 - RNA, 17 nt, Salmonella typhimurium LT2
agacagcagaugaaaac

SEQ ID NO: 1818145 - RNA, 17 nt, Salmonella typhimurium LT2
agacagccucucccgaa

SEQ ID NO: 1818146 - RNA, 24 nt, Salmonella typhimurium LT2
agacaguggccaucuuccagcauc

SEQ ID NO: 1818147 - RNA, 15 nt, Salmonella typhimurium LT2
agaauaucggcgucg

SEQ ID NO: 1818148 - RNA, 11 nt, Salmonella typhimurium LT2
agaaucagcgu

SEQ ID NO: 1818149 - RNA, 19 nt, Salmonella typhimurium LT2
agaaucagccgacggcgau

SEQ ID NO: 1818150 - RNA, 11 nt, Salmonella typhimurium LT2
agaaucgccgu

SEQ ID NO: 1818151 - RNA, 14 nt, Salmonella typhimurium LT2
agaaugcuauaugc

SEQ ID NO: 1818152 - RNA, 17 nt, Salmonella typhimurium LT2
agaaugauaaugccgcu

SEQ ID NO: 1818153 - RNA, 16 nt, Salmonella typhimurium LT2
agaaugcccaggccca

SEQ ID NO: 1818154 - RNA, 14 nt, Salmonella typhimurium LT2
agaaguagcguucg

SEQ ID NO: 1818155 - RNA, 21 nt, Salmonella typhimurium LT2
agaagcgcugguaaauccggc

SEQ ID NO: 1818156 - RNA, 19 nt, Salmonella typhimurium LT2
agaagcccggcggcgcauc

SEQ ID NO: 1818157 - RNA, 21 nt, Salmonella typhimurium LT2
agaagccuuuuuucaccaguu

SEQ ID NO: 1818158 - RNA, 16 nt, Salmonella typhimurium LT2
agaagaauaagccgga

SEQ ID NO: 1818159 - RNA, 23 nt, Salmonella typhimurium LT2
agaaccguugcgcccaucaucau

SEQ ID NO: 1818160 - RNA, 21 nt, Salmonella typhimurium LT2
agaacacccagaucgcgaucc

SEQ ID NO: 1818161 - RNA, 17 nt, Salmonella typhimurium LT2
agaacagggggcgcauc

SEQ ID NO: 1818162 - RNA, 15 nt, Salmonella typhimurium LT2
agaaauccgcgaaua

SEQ ID NO: 1818163 - RNA, 23 nt, Salmonella typhimurium LT2
agaaaucgccgggcuauccggcu

SEQ ID NO: 1818164 - RNA, 20 nt, Salmonella typhimurium LT2
agaaauacccuucacgguca

SEQ ID NO: 1818165 - RNA, 21 nt, Salmonella typhimurium LT2
acugcuuguuuaauggcagaa

SEQ ID NO: 1818166 - RNA, 19 nt, Salmonella typhimurium LT2
acuggaaaaagaccaauac

SEQ ID NO: 1818167 - RNA, 19 nt, Salmonella typhimurium LT2
acugcugacaaucagcaca

SEQ ID NO: 1818168 - RNA, 14 nt, Salmonella typhimurium LT2
acugcuggcgagca

SEQ ID NO: 1818169 - RNA, 21 nt, Salmonella typhimurium LT2
aguggcguagcguacugcagc

SEQ ID NO: 1818170 - RNA, 20 nt, Salmonella typhimurium LT2
aguguguaccagcaacgcca

SEQ ID NO: 1818171 - RNA, 21 nt, Salmonella typhimurium LT2
aguguguaccagcaacgccag

SEQ ID NO: 1818172 - RNA, 15 nt, Salmonella typhimurium LT2
aguuacgcacgccag

SEQ ID NO: 1818173 - RNA, 16 nt, Salmonella typhimurium LT2
aguuacguugcggcgu

SEQ ID NO: 1818174 - RNA, 14 nt, Salmonella typhimurium LT2
aguucacgguaaua

SEQ ID NO: 1818175 - RNA, 16 nt, Salmonella typhimurium LT2
aguucgcugaggcguu

SEQ ID NO: 1818176 - RNA, 15 nt, Salmonella typhimurium LT2
aguuucaucagcaca

SEQ ID NO: 1818177 - RNA, 18 nt, Salmonella typhimurium LT2
aguuggcuugccagcaga

SEQ ID NO: 1818178 - RNA, 18 nt, Salmonella typhimurium LT2
agugcgauuugacaucag

SEQ ID NO: 1818179 - RNA, 22 nt, Salmonella typhimurium LT2
aguggagaggccaccagcgcca

SEQ ID NO: 1818180 - RNA, 21 nt, Salmonella typhimurium LT2
aguggccaucuuccagcauca

SEQ ID NO: 1818181 - RNA, 12 nt, Salmonella typhimurium LT2
agugacggcaau

SEQ ID NO: 1818182 - RNA, 17 nt, Salmonella typhimurium LT2
agugaaucgacggcaau

SEQ ID NO: 1818183 - RNA, 21 nt, Salmonella typhimurium LT2
agugaauggauaacggcguua

SEQ ID NO: 1818184 - RNA, 22 nt, Salmonella typhimurium LT2
agugauuuccggguucacauca

SEQ ID NO: 1818185 - RNA, 20 nt, Salmonella typhimurium LT2
agugccaaguaacacggcga

SEQ ID NO: 1818186 - RNA, 16 nt, Salmonella typhimurium LT2
agugcaggaucaccgg

SEQ ID NO: 1818187 - RNA, 15 nt, Salmonella typhimurium LT2
agugcccagcgcgac

SEQ ID NO: 1818188 - RNA, 21 nt, Salmonella typhimurium LT2
agugaauacugcgcgucguca

SEQ ID NO: 1818189 - RNA, 22 nt, Salmonella typhimurium LT2
agugaauacugcgcgucgucag

SEQ ID NO: 1818190 - RNA, 14 nt, Salmonella typhimurium LT2
agucuggcugcggc

SEQ ID NO: 1818191 - RNA, 20 nt, Salmonella typhimurium LT2
agucuccugccgaugaaaua

SEQ ID NO: 1818192 - RNA, 22 nt, Salmonella typhimurium LT2
agucgugucauagucggcgcca

SEQ ID NO: 1818193 - RNA, 15 nt, Salmonella typhimurium LT2
agucgcuauggugcg

SEQ ID NO: 1818194 - RNA, 18 nt, Salmonella typhimurium LT2
agucgcugcgcucaucag

SEQ ID NO: 1818195 - RNA, 18 nt, Salmonella typhimurium LT2
aguccgucgagcgcggag

SEQ ID NO: 1818196 - RNA, 21 nt, Salmonella typhimurium LT2
agucgccuucguucaggacga

SEQ ID NO: 1818197 - RNA, 13 nt, Salmonella typhimurium LT2
aguccauauccgu

SEQ ID NO: 1818198 - RNA, 16 nt, Salmonella typhimurium LT2
agucagcguuacuggc

SEQ ID NO: 1818199 - RNA, 19 nt, Salmonella typhimurium LT2
agucagacaaguagccugc

SEQ ID NO: 1818200 - RNA, 14 nt, Salmonella typhimurium LT2
aguccggauggcag

SEQ ID NO: 1818201 - RNA, 22 nt, Salmonella typhimurium LT2
agucaaaacgacauaaccggca

SEQ ID NO: 1818202 - RNA, 13 nt, Salmonella typhimurium LT2
agucaaacccuuc

SEQ ID NO: 1818203 - RNA, 15 nt, Salmonella typhimurium LT2
agucaccagcagcac

SEQ ID NO: 1818204 - RNA, 15 nt, Salmonella typhimurium LT2
aguauuggcugccga

SEQ ID NO: 1818205 - RNA, 18 nt, Salmonella typhimurium LT2
aguacgggucugaauagc

SEQ ID NO: 1818206 - RNA, 20 nt, Salmonella typhimurium LT2
aguacggcgcgaaucccgcg

SEQ ID NO: 1818207 - RNA, 17 nt, Salmonella typhimurium LT2
aguacgccucgcgcacc

SEQ ID NO: 1818208 - RNA, 23 nt, Salmonella typhimurium LT2
aguacgccuuucaccaucagcau

SEQ ID NO: 1818209 - RNA, 20 nt, Salmonella typhimurium LT2
aguagguggcccauuuuggc

SEQ ID NO: 1818210 - RNA, 19 nt, Salmonella typhimurium LT2
aguaggccggauaaggcgu

SEQ ID NO: 1818211 - RNA, 11 nt, Salmonella typhimurium LT2
aguagcagcga

SEQ ID NO: 1818212 - RNA, 16 nt, Salmonella typhimurium LT2
auacggaugccgauuu

SEQ ID NO: 1818213 - RNA, 16 nt, Salmonella typhimurium LT2
auacggcuccagcaca

SEQ ID NO: 1818214 - RNA, 14 nt, Salmonella typhimurium LT2
auacgguagcgauc

SEQ ID NO: 1818215 - RNA, 17 nt, Salmonella typhimurium LT2
auacggaaggauagccg

SEQ ID NO: 1818216 - RNA, 18 nt, Salmonella typhimurium LT2
auacgcugcgucaggcga

SEQ ID NO: 1818217 - RNA, 23 nt, Salmonella typhimurium LT2
auacgcugcgucaggcgauagcc

SEQ ID NO: 1818218 - RNA, 15 nt, Salmonella typhimurium LT2
auacgcugcggccug

SEQ ID NO: 1818219 - RNA, 21 nt, Salmonella typhimurium LT2
auacgcuucggcuccagcgcc

SEQ ID NO: 1818220 - RNA, 13 nt, Salmonella typhimurium LT2
auacgccagcaga

SEQ ID NO: 1818221 - RNA, 21 nt, Salmonella typhimurium LT2
auacgccauacccgauaucgc

SEQ ID NO: 1818222 - RNA, 20 nt, Salmonella typhimurium LT2
auaccuaacucuuccgcaau

SEQ ID NO: 1818223 - RNA, 20 nt, Salmonella typhimurium LT2
auaccguccaccagcacagg

SEQ ID NO: 1818224 - RNA, 15 nt, Salmonella typhimurium LT2
auaccggucggcaaa

SEQ ID NO: 1818225 - RNA, 21 nt, Salmonella typhimurium LT2
auaccggcguaauugcgccug

SEQ ID NO: 1818226 - RNA, 23 nt, Salmonella typhimurium LT2
auacgaccgccgacaaucgucac

SEQ ID NO: 1818227 - RNA, 23 nt, Salmonella typhimurium LT2
auacgaaaauccucuuucgccau

SEQ ID NO: 1818228 - RNA, 16 nt, Salmonella typhimurium LT2
auacgauccucgccau

SEQ ID NO: 1818229 - RNA, 12 nt, Salmonella typhimurium LT2
auaccaggcacu

SEQ ID NO: 1818230 - RNA, 22 nt, Salmonella typhimurium LT2
auaccggaggagugcgccaguu

SEQ ID NO: 1818231 - RNA, 15 nt, Salmonella typhimurium LT2
auacacgcgacaaug

SEQ ID NO: 1818232 - RNA, 17 nt, Salmonella typhimurium LT2
auaauauguuuauuugc

SEQ ID NO: 1818233 - RNA, 22 nt, Salmonella typhimurium LT2
auacacgauuaaccucacgcaa

SEQ ID NO: 1818234 - RNA, 15 nt, Salmonella typhimurium LT2
auaauacgccggcau

SEQ ID NO: 1818235 - RNA, 19 nt, Salmonella typhimurium LT2
auaaggguaagcaauaugg

SEQ ID NO: 1818236 - RNA, 15 nt, Salmonella typhimurium LT2
auaagagucaggauc

SEQ ID NO: 1818237 - RNA, 23 nt, Salmonella typhimurium LT2
auaacgggguauaacucagcggc

SEQ ID NO: 1818238 - RNA, 14 nt, Salmonella typhimurium LT2
auaacguuaacgcc

SEQ ID NO: 1818239 - RNA, 17 nt, Salmonella typhimurium LT2
auaauaaaacggcucau

SEQ ID NO: 1818240 - RNA, 19 nt, Salmonella typhimurium LT2
aguuugcgauaagcgcguu

SEQ ID NO: 1818241 - RNA, 16 nt, Salmonella typhimurium LT2
aguuuggugaugcgau

SEQ ID NO: 1818242 - RNA, 20 nt, Salmonella typhimurium LT2
aguuugguuaauuccgcauc

SEQ ID NO: 1818243 - RNA, 16 nt, Salmonella typhimurium LT2
aguuugaccagcaaua

SEQ ID NO: 1818244 - RNA, 18 nt, Salmonella typhimurium LT2
auaacgcaacgucagcga

SEQ ID NO: 1818245 - RNA, 19 nt, Salmonella typhimurium LT2
auaacgccgauaaccagcg

SEQ ID NO: 1818246 - RNA, 18 nt, Salmonella typhimurium LT2
auaacgcggguuagcgcc

SEQ ID NO: 1818247 - RNA, 12 nt, Salmonella typhimurium LT2
auaacgcgcugg

SEQ ID NO: 1818248 - RNA, 19 nt, Salmonella typhimurium LT2
auaacgaccccaauagcga

SEQ ID NO: 1818249 - RNA, 16 nt, Salmonella typhimurium LT2
auaaccucucaccgcc

SEQ ID NO: 1818250 - RNA, 19 nt, Salmonella typhimurium LT2
auaaccuggaugacacagg

SEQ ID NO: 1818251 - RNA, 21 nt, Salmonella typhimurium LT2
auaaccggacgauuuaagcuu

SEQ ID NO: 1818252 - RNA, 23 nt, Salmonella typhimurium LT2
auagaccacgccaucaacagcgg

SEQ ID NO: 1818253 - RNA, 20 nt, Salmonella typhimurium LT2
auagaaccgaacaacgccag

SEQ ID NO: 1818254 - RNA, 19 nt, Salmonella typhimurium LT2
auagacgccggucaugcca

SEQ ID NO: 1818255 - RNA, 13 nt, Salmonella typhimurium LT2
auagcgucaacgc

SEQ ID NO: 1818256 - RNA, 22 nt, Salmonella typhimurium LT2
auagcgcugucgcuaauccggc

SEQ ID NO: 1818257 - RNA, 15 nt, Salmonella typhimurium LT2
auagcgcugcgccag

SEQ ID NO: 1818258 - RNA, 18 nt, Salmonella typhimurium LT2
auagcugugagaauucug

SEQ ID NO: 1818259 - RNA, 16 nt, Salmonella typhimurium LT2
auagcugguaaauaac

SEQ ID NO: 1818260 - RNA, 12 nt, Salmonella typhimurium LT2
auaggccagcgu

SEQ ID NO: 1818261 - RNA, 12 nt, Salmonella typhimurium LT2
auaggccaggcu

SEQ ID NO: 1818262 - RNA, 18 nt, Salmonella typhimurium LT2
auaggaucugaaaggcgu

SEQ ID NO: 1818263 - RNA, 15 nt, Salmonella typhimurium LT2
auaguugagcagcgc

SEQ ID NO: 1818264 - RNA, 19 nt, Salmonella typhimurium LT2
auaguguaaacgcgccauc

SEQ ID NO: 1818265 - RNA, 17 nt, Salmonella typhimurium LT2
auagucgccgcggcgca

SEQ ID NO: 1818266 - RNA, 14 nt, Salmonella typhimurium LT2
auagucuccgccac

SEQ ID NO: 1818267 - RNA, 15 nt, Salmonella typhimurium LT2
auaucugcgccgcca

SEQ ID NO: 1818268 - RNA, 15 nt, Salmonella typhimurium LT2
auaucguugccgccg

SEQ ID NO: 1818269 - RNA, 18 nt, Salmonella typhimurium LT2
auaucguaaccgcuaaac

SEQ ID NO: 1818270 - RNA, 14 nt, Salmonella typhimurium LT2
auaucuuccagcgc

SEQ ID NO: 1818271 - RNA, 20 nt, Salmonella typhimurium LT2
auaucuucccgacgcuggcg

SEQ ID NO: 1818272 - RNA, 17 nt, Salmonella typhimurium LT2
auauuccggcgcuggcg

SEQ ID NO: 1818273 - RNA, 18 nt, Salmonella typhimurium LT2
auauuccaucaauaaucc

SEQ ID NO: 1818274 - RNA, 13 nt, Salmonella typhimurium LT2
auauucucuggcg

SEQ ID NO: 1818275 - RNA, 17 nt, Salmonella typhimurium LT2
auauagcuuuucaugac

SEQ ID NO: 1818276 - RNA, 18 nt, Salmonella typhimurium LT2
auauaaacgcccgaccac

SEQ ID NO: 1818277 - RNA, 14 nt, Salmonella typhimurium LT2
auauccuccaccuc

SEQ ID NO: 1818278 - RNA, 17 nt, Salmonella typhimurium LT2
auauccugaugcgccuc

SEQ ID NO: 1818279 - RNA, 12 nt, Salmonella typhimurium LT2
auauaugaaauc

SEQ ID NO: 1818280 - RNA, 14 nt, Salmonella typhimurium LT2
agcuucgccagaug

SEQ ID NO: 1818281 - RNA, 15 nt, Salmonella typhimurium LT2
agcuucggcggcauc

SEQ ID NO: 1818282 - RNA, 21 nt, Salmonella typhimurium LT2
agcuuuuggcguaauggcggg

SEQ ID NO: 1818283 - RNA, 16 nt, Salmonella typhimurium LT2
agcuuucuguuaucag

SEQ ID NO: 1818284 - RNA, 21 nt, Salmonella typhimurium LT2
agcuuguuuacgcccucaucg

SEQ ID NO: 1818285 - RNA, 18 nt, Salmonella typhimurium LT2
aggacaaccccuacgcag

SEQ ID NO: 1818286 - RNA, 13 nt, Salmonella typhimurium LT2
aggaaauccagca

SEQ ID NO: 1818287 - RNA, 20 nt, Salmonella typhimurium LT2
aggaaauccuuccagcgcca

SEQ ID NO: 1818288 - RNA, 16 nt, Salmonella typhimurium LT2
aggaaauaacaugcca

SEQ ID NO: 1818289 - RNA, 17 nt, Salmonella typhimurium LT2
agcugcguuaagccgug

SEQ ID NO: 1818290 - RNA, 22 nt, Salmonella typhimurium LT2
agcuuauuggcaaucgcgguau

SEQ ID NO: 1818291 - RNA, 18 nt, Salmonella typhimurium LT2
agcuuaggauucgccauu

SEQ ID NO: 1818292 - RNA, 14 nt, Salmonella typhimurium LT2
agcuucaucaucag

SEQ ID NO: 1818293 - RNA, 20 nt, Salmonella typhimurium LT2
aggcagggcgaugcgcgagc

SEQ ID NO: 1818294 - RNA, 19 nt, Salmonella typhimurium LT2
aggauuugucucaucugau

SEQ ID NO: 1818295 - RNA, 17 nt, Salmonella typhimurium LT2
aggcaacaauuucuacu

SEQ ID NO: 1818296 - RNA, 22 nt, Salmonella typhimurium LT2
aggcaauacguccauuugauga

SEQ ID NO: 1818297 - RNA, 20 nt, Salmonella typhimurium LT2
aggcaauauaccgucagcac

SEQ ID NO: 1818298 - RNA, 16 nt, Salmonella typhimurium LT2
aggcagcguggcgagc

SEQ ID NO: 1818299 - RNA, 16 nt, Salmonella typhimurium LT2
aggcacgccggcaauc

SEQ ID NO: 1818300 - RNA, 17 nt, Salmonella typhimurium LT2
aggaggcaaaaugccag

SEQ ID NO: 1818301 - RNA, 17 nt, Salmonella typhimurium LT2
aggaggauauucgucca

SEQ ID NO: 1818302 - RNA, 18 nt, Salmonella typhimurium LT2
aggaucugaaaggcguca

SEQ ID NO: 1818303 - RNA, 21 nt, Salmonella typhimurium LT2
aggaucuucaucccauccggg

SEQ ID NO: 1818304 - RNA, 20 nt, Salmonella typhimurium LT2
aggaugaaaaguauggcggu

SEQ ID NO: 1818305 - RNA, 14 nt, Salmonella typhimurium LT2
aggacauacgccgc

SEQ ID NO: 1818306 - RNA, 19 nt, Salmonella typhimurium LT2
aggacauucagcacgcuuu

SEQ ID NO: 1818307 - RNA, 22 nt, Salmonella typhimurium LT2
aggcuucgcgcagccagcgccc

SEQ ID NO: 1818308 - RNA, 19 nt, Salmonella typhimurium LT2
aggcuugccaaagcgggca

SEQ ID NO: 1818309 - RNA, 14 nt, Salmonella typhimurium LT2
agggccgcguuaac

SEQ ID NO: 1818310 - RNA, 18 nt, Salmonella typhimurium LT2
agggcgauucccgaucuu

SEQ ID NO: 1818311 - RNA, 19 nt, Salmonella typhimurium LT2
agggcgauauccagcgcca

SEQ ID NO: 1818312 - RNA, 16 nt, Salmonella typhimurium LT2
agggcgugaaccagca

SEQ ID NO: 1818313 - RNA, 23 nt, Salmonella typhimurium LT2
agggcgugacgcgccagcaaaau

SEQ ID NO: 1818314 - RNA, 23 nt, Salmonella typhimurium LT2
agguaucgauacagacgccaacg

SEQ ID NO: 1818315 - RNA, 18 nt, Salmonella typhimurium LT2
agguaucauaugugccga

SEQ ID NO: 1818316 - RNA, 17 nt, Salmonella typhimurium LT2
agguaaauuagcgcgaa

SEQ ID NO: 1818317 - RNA, 17 nt, Salmonella typhimurium LT2
agguaaagagcggcuua

SEQ ID NO: 1818318 - RNA, 17 nt, Salmonella typhimurium LT2
aggguuuugccgucaca

SEQ ID NO: 1818319 - RNA, 23 nt, Salmonella typhimurium LT2
agggugauuucgcccgcauucgc

SEQ ID NO: 1818320 - RNA, 20 nt, Salmonella typhimurium LT2
agggugaauaccagcggcaa

SEQ ID NO: 1818321 - RNA, 15 nt, Salmonella typhimurium LT2
aggggcauuuuccgg

SEQ ID NO: 1818322 - RNA, 20 nt, Salmonella typhimurium LT2
aggggaucgugcaguaaugc

SEQ ID NO: 1818323 - RNA, 13 nt, Salmonella typhimurium LT2
aggcggcuaccgc

SEQ ID NO: 1818324 - RNA, 17 nt, Salmonella typhimurium LT2
aggcgguuuauccggcg

SEQ ID NO: 1818325 - RNA, 22 nt, Salmonella typhimurium LT2
aggcggcuuuuucaucaucggc

SEQ ID NO: 1818326 - RNA, 17 nt, Salmonella typhimurium LT2
aggcgcgaccucaucaa

SEQ ID NO: 1818327 - RNA, 18 nt, Salmonella typhimurium LT2
aggcggcaaucagcgccc

SEQ ID NO: 1818328 - RNA, 14 nt, Salmonella typhimurium LT2
aggcgucacggcga

SEQ ID NO: 1818329 - RNA, 18 nt, Salmonella typhimurium LT2
aggcgucacggcgacggc

SEQ ID NO: 1818330 - RNA, 21 nt, Salmonella typhimurium LT2
aggcgacucauuacgccacgu

SEQ ID NO: 1818331 - RNA, 17 nt, Salmonella typhimurium LT2
aggcgcaaacgcgugcu

SEQ ID NO: 1818332 - RNA, 21 nt, Salmonella typhimurium LT2
aggcgcagccgccauccggca

SEQ ID NO: 1818333 - RNA, 21 nt, Salmonella typhimurium LT2
aggcgcagcaaacggcauagc

SEQ ID NO: 1818334 - RNA, 22 nt, Salmonella typhimurium LT2
aggcgcaguugaaaacauuguc

SEQ ID NO: 1818335 - RNA, 17 nt, Salmonella typhimurium LT2
aggcgccuuauccggcc

SEQ ID NO: 1818336 - RNA, 12 nt, Salmonella typhimurium LT2
cacaguacgccc

SEQ ID NO: 1818337 - RNA, 16 nt, Salmonella typhimurium LT2
cacaggcugcggcacg

SEQ ID NO: 1818338 - RNA, 22 nt, Salmonella typhimurium LT2
cacaggcgucccggucggcgca

SEQ ID NO: 1818339 - RNA, 21 nt, Salmonella typhimurium LT2
cacaucaaagccccauaaccg

SEQ ID NO: 1818340 - RNA, 13 nt, Salmonella typhimurium LT2
cacaucagaccgc

SEQ ID NO: 1818341 - RNA, 14 nt, Salmonella typhimurium LT2
cacaugaccagcgc

SEQ ID NO: 1818342 - RNA, 22 nt, Salmonella typhimurium LT2
cacaucgcgacgggaugcgaug

SEQ ID NO: 1818343 - RNA, 17 nt, Salmonella typhimurium LT2
cacauucugaccgcguu

SEQ ID NO: 1818344 - RNA, 16 nt, Salmonella typhimurium LT2
cacauuuagcgcagua

SEQ ID NO: 1818345 - RNA, 14 nt, Salmonella typhimurium LT2
cacauuuuauccgg

SEQ ID NO: 1818346 - RNA, 19 nt, Salmonella typhimurium LT2
cacauugcugccuuauccg

SEQ ID NO: 1818347 - RNA, 18 nt, Salmonella typhimurium LT2
cacauucaggcgguaaua

SEQ ID NO: 1818348 - RNA, 19 nt, Salmonella typhimurium LT2
caccacaaaggcgcguagu

SEQ ID NO: 1818349 - RNA, 22 nt, Salmonella typhimurium LT2
caccacgaaggaaacgccaggc

SEQ ID NO: 1818350 - RNA, 22 nt, Salmonella typhimurium LT2
caccacgccuaaugaagcgcgu

SEQ ID NO: 1818351 - RNA, 15 nt, Salmonella typhimurium LT2
cacaacccaaaggcc

SEQ ID NO: 1818352 - RNA, 12 nt, Salmonella typhimurium LT2
cacagcggaaua

SEQ ID NO: 1818353 - RNA, 19 nt, Salmonella typhimurium LT2
caaugagacaacggcgacc

SEQ ID NO: 1818354 - RNA, 20 nt, Salmonella typhimurium LT2
caaugcgcccggagcgguga

SEQ ID NO: 1818355 - RNA, 18 nt, Salmonella typhimurium LT2
caaugaaaccgccggaug

SEQ ID NO: 1818356 - RNA, 23 nt, Salmonella typhimurium LT2
caauuauauucguccuuuaucag

SEQ ID NO: 1818357 - RNA, 20 nt, Salmonella typhimurium LT2
caaugcuggcaggcgcgacc

SEQ ID NO: 1818358 - RNA, 14 nt, Salmonella typhimurium LT2
caccacgucauccg

SEQ ID NO: 1818359 - RNA, 13 nt, Salmonella typhimurium LT2
caccacguuaccg

SEQ ID NO: 1818360 - RNA, 14 nt, Salmonella typhimurium LT2
caccaucgccggag

SEQ ID NO: 1818361 - RNA, 13 nt, Salmonella typhimurium LT2
caccauccggcaa

SEQ ID NO: 1818362 - RNA, 18 nt, Salmonella typhimurium LT2
caccaguucacgguaaua

SEQ ID NO: 1818363 - RNA, 15 nt, Salmonella typhimurium LT2
caccauuaacaucag

SEQ ID NO: 1818364 - RNA, 20 nt, Salmonella typhimurium LT2
cacccgaacaacaauacgcg

SEQ ID NO: 1818365 - RNA, 16 nt, Salmonella typhimurium LT2
cacccggauacgcggc

SEQ ID NO: 1818366 - RNA, 13 nt, Salmonella typhimurium LT2
caccgccagcguc

SEQ ID NO: 1818367 - RNA, 16 nt, Salmonella typhimurium LT2
caccgcauagacgugc

SEQ ID NO: 1818368 - RNA, 14 nt, Salmonella typhimurium LT2
caccgccagcagua

SEQ ID NO: 1818369 - RNA, 16 nt, Salmonella typhimurium LT2
caccgcaaauucgucg

SEQ ID NO: 1818370 - RNA, 15 nt, Salmonella typhimurium LT2
cacccugcgaggccu

SEQ ID NO: 1818371 - RNA, 16 nt, Salmonella typhimurium LT2
cacccugccccgguga

SEQ ID NO: 1818372 - RNA, 21 nt, Salmonella typhimurium LT2
caacgcgcaucaacgccaggc

SEQ ID NO: 1818373 - RNA, 18 nt, Salmonella typhimurium LT2
caacgccguacuccagcc

SEQ ID NO: 1818374 - RNA, 22 nt, Salmonella typhimurium LT2
caacgcgaagcagcuuauccgg

SEQ ID NO: 1818375 - RNA, 18 nt, Salmonella typhimurium LT2
caacgccgcuuuaccgcc

SEQ ID NO: 1818376 - RNA, 20 nt, Salmonella typhimurium LT2
caacgcccagauauccgcgc

SEQ ID NO: 1818377 - RNA, 22 nt, Salmonella typhimurium LT2
caacgcauuggcaaugaaaccg

SEQ ID NO: 1818378 - RNA, 15 nt, Salmonella typhimurium LT2
caacgccaaccggcu

SEQ ID NO: 1818379 - RNA, 16 nt, Salmonella typhimurium LT2
caacgaaaaucauccg

SEQ ID NO: 1818380 - RNA, 15 nt, Salmonella typhimurium LT2
caacagcucgccaug

SEQ ID NO: 1818381 - RNA, 17 nt, Salmonella typhimurium LT2
caacagcggcggcagua

SEQ ID NO: 1818382 - RNA, 18 nt, Salmonella typhimurium LT2
caacagcgcggcaggccg

SEQ ID NO: 1818383 - RNA, 14 nt, Salmonella typhimurium LT2
caacagcaccagca

SEQ ID NO: 1818384 - RNA, 22 nt, Salmonella typhimurium LT2
caacagaccgacgauaaccgga

SEQ ID NO: 1818385 - RNA, 22 nt, Salmonella typhimurium LT2
caacagauacgucuuacgccau

SEQ ID NO: 1818386 - RNA, 23 nt, Salmonella typhimurium LT2
caacauacgggcuuuugcgccga

SEQ ID NO: 1818387 - RNA, 22 nt, Salmonella typhimurium LT2
caacaggauggauauaacauuu

SEQ ID NO: 1818388 - RNA, 21 nt, Salmonella typhimurium LT2
caacaucagcgcuaccagcgc

SEQ ID NO: 1818389 - RNA, 16 nt, Salmonella typhimurium LT2
caaccagugcaacgcc

SEQ ID NO: 1818390 - RNA, 15 nt, Salmonella typhimurium LT2
caagaaucacgccga

SEQ ID NO: 1818391 - RNA, 23 nt, Salmonella typhimurium LT2
caacuuccagaacaucuaccgca

SEQ ID NO: 1818392 - RNA, 16 nt, Salmonella typhimurium LT2
caacuggaaaagcgac

SEQ ID NO: 1818393 - RNA, 18 nt, Salmonella typhimurium LT2
caacugggugugaucgcc

SEQ ID NO: 1818394 - RNA, 19 nt, Salmonella typhimurium LT2
caacguaccggcaaccggu

SEQ ID NO: 1818395 - RNA, 21 nt, Salmonella typhimurium LT2
caacucuuuacccagcgggug

SEQ ID NO: 1818396 - RNA, 11 nt, Salmonella typhimurium LT2
caacugagcga

SEQ ID NO: 1818397 - RNA, 17 nt, Salmonella typhimurium LT2
caacgggcaguccggcg

SEQ ID NO: 1818398 - RNA, 15 nt, Salmonella typhimurium LT2
caacgguacgacgcc

SEQ ID NO: 1818399 - RNA, 23 nt, Salmonella typhimurium LT2
caacgguacgacgccguuuccgg

SEQ ID NO: 1818400 - RNA, 18 nt, Salmonella typhimurium LT2
caagcggcaucucgccaa

SEQ ID NO: 1818401 - RNA, 19 nt, Salmonella typhimurium LT2
caagcgggaauauccugcc

SEQ ID NO: 1818402 - RNA, 14 nt, Salmonella typhimurium LT2
caagcgcggcagca

SEQ ID NO: 1818403 - RNA, 14 nt, Salmonella typhimurium LT2
caagcguugaauuc

SEQ ID NO: 1818404 - RNA, 24 nt, Salmonella typhimurium LT2
caagauuacucccuugccagcgca

SEQ ID NO: 1818405 - RNA, 12 nt, Salmonella typhimurium LT2
caaacagaauau

SEQ ID NO: 1818406 - RNA, 15 nt, Salmonella typhimurium LT2
caaacagagcgccgg

SEQ ID NO: 1818407 - RNA, 19 nt, Salmonella typhimurium LT2
caaaaucuuuccagcucca

SEQ ID NO: 1818408 - RNA, 19 nt, Salmonella typhimurium LT2
caaaaucgcccaggucuga

SEQ ID NO: 1818409 - RNA, 12 nt, Salmonella typhimurium LT2
caaaaucacgcg

SEQ ID NO: 1818410 - RNA, 16 nt, Salmonella typhimurium LT2
caaaauauuacgccau

SEQ ID NO: 1818411 - RNA, 15 nt, Salmonella typhimurium LT2
caaaauaauaucgcg

SEQ ID NO: 1818412 - RNA, 17 nt, Salmonella typhimurium LT2
caaaaggauacagcgcc

SEQ ID NO: 1818413 - RNA, 14 nt, Salmonella typhimurium LT2
caaaaggcgacaua

SEQ ID NO: 1818414 - RNA, 22 nt, Salmonella typhimurium LT2
caaaaauucuuuuacgaucgcc

SEQ ID NO: 1818415 - RNA, 16 nt, Salmonella typhimurium LT2
caaaacgcauccagcg

SEQ ID NO: 1818416 - RNA, 16 nt, Salmonella typhimurium LT2
caaaacgcgccaggua

SEQ ID NO: 1818417 - RNA, 21 nt, Salmonella typhimurium LT2
caaaacgcucgcgcuguucgc

SEQ ID NO: 1818418 - RNA, 16 nt, Salmonella typhimurium LT2
caaacggaauagcgcc

SEQ ID NO: 1818419 - RNA, 17 nt, Salmonella typhimurium LT2
caaagcaucugccggca

SEQ ID NO: 1818420 - RNA, 17 nt, Salmonella typhimurium LT2
caaacaucgcgcuccag

SEQ ID NO: 1818421 - RNA, 14 nt, Salmonella typhimurium LT2
caaaccaaacugau

SEQ ID NO: 1818422 - RNA, 21 nt, Salmonella typhimurium LT2
caaacgccugcuccguccacg

SEQ ID NO: 1818423 - RNA, 14 nt, Salmonella typhimurium LT2
caaacgauaccgac

SEQ ID NO: 1818424 - RNA, 16 nt, Salmonella typhimurium LT2
caaaaaagcugcgauc

SEQ ID NO: 1818425 - RNA, 19 nt, Salmonella typhimurium LT2
auuuugucaggccgcgugg

SEQ ID NO: 1818426 - RNA, 20 nt, Salmonella typhimurium LT2
auuuuuaauguccagcagug

SEQ ID NO: 1818427 - RNA, 17 nt, Salmonella typhimurium LT2
auuuucgaugcacgcca

SEQ ID NO: 1818428 - RNA, 13 nt, Salmonella typhimurium LT2
auuuugccuucaa

SEQ ID NO: 1818429 - RNA, 12 nt, Salmonella typhimurium LT2
auuuugcgccua

SEQ ID NO: 1818430 - RNA, 19 nt, Salmonella typhimurium LT2
auuuuauccaacagcgcaa

SEQ ID NO: 1818431 - RNA, 16 nt, Salmonella typhimurium LT2
auuuuauccggcguca

SEQ ID NO: 1818432 - RNA, 11 nt, Salmonella typhimurium LT2
auuuuauucau

SEQ ID NO: 1818433 - RNA, 16 nt, Salmonella typhimurium LT2
auuuuccaggccgcca

SEQ ID NO: 1818434 - RNA, 13 nt, Salmonella typhimurium LT2
auuugcggcgucg

SEQ ID NO: 1818435 - RNA, 20 nt, Salmonella typhimurium LT2
auuugcaauucgaggagcgc

SEQ ID NO: 1818436 - RNA, 14 nt, Salmonella typhimurium LT2
auuugucgcgcauu

SEQ ID NO: 1818437 - RNA, 24 nt, Salmonella typhimurium LT2
auuugugagacaaaaaagcugcga

SEQ ID NO: 1818438 - RNA, 23 nt, Salmonella typhimurium LT2
auuuguucggcgcgauagcgaua

SEQ ID NO: 1818439 - RNA, 17 nt, Salmonella typhimurium LT2
auuuuaagcauccagga

SEQ ID NO: 1818440 - RNA, 22 nt, Salmonella typhimurium LT2
auuucuccugcgccagccggau

SEQ ID NO: 1818441 - RNA, 15 nt, Salmonella typhimurium LT2
auuucuccugcgcca

SEQ ID NO: 1818442 - RNA, 16 nt, Salmonella typhimurium LT2
auuucuccugcgccag

SEQ ID NO: 1818443 - RNA, 18 nt, Salmonella typhimurium LT2
auuucucaaagugcgccg

SEQ ID NO: 1818444 - RNA, 17 nt, Salmonella typhimurium LT2
auuucuugcaauagcgc

SEQ ID NO: 1818445 - RNA, 19 nt, Salmonella typhimurium LT2
auuugaacaaggcuacgaa

SEQ ID NO: 1818446 - RNA, 14 nt, Salmonella typhimurium LT2
auuucuuuaugggc

SEQ ID NO: 1818447 - RNA, 16 nt, Salmonella typhimurium LT2
auuucuuuauucuggc

SEQ ID NO: 1818448 - RNA, 17 nt, Salmonella typhimurium LT2
auuucgaugaugaccga

SEQ ID NO: 1818449 - RNA, 13 nt, Salmonella typhimurium LT2
auuucggcaauga

SEQ ID NO: 1818450 - RNA, 21 nt, Salmonella typhimurium LT2
auuucaccgggccaaugccgc

SEQ ID NO: 1818451 - RNA, 16 nt, Salmonella typhimurium LT2
auuuccuccgccgaua

SEQ ID NO: 1818452 - RNA, 20 nt, Salmonella typhimurium LT2
auuucaggguagcauugccg

SEQ ID NO: 1818453 - RNA, 16 nt, Salmonella typhimurium LT2
auucccccauccgcgc

SEQ ID NO: 1818454 - RNA, 13 nt, Salmonella typhimurium LT2
auucccagcgccc

SEQ ID NO: 1818455 - RNA, 17 nt, Salmonella typhimurium LT2
auuuacugugauccacc

SEQ ID NO: 1818456 - RNA, 16 nt, Salmonella typhimurium LT2
aucccacccagcaaua

SEQ ID NO: 1818457 - RNA, 15 nt, Salmonella typhimurium LT2
aucccaccggaaaug

SEQ ID NO: 1818458 - RNA, 16 nt, Salmonella typhimurium LT2
aucccacgccgcugau

SEQ ID NO: 1818459 - RNA, 19 nt, Salmonella typhimurium LT2
aucccaauugaucggccag

SEQ ID NO: 1818460 - RNA, 20 nt, Salmonella typhimurium LT2
auccccccuuuuuugcuggc

SEQ ID NO: 1818461 - RNA, 17 nt, Salmonella typhimurium LT2
auccccagucuuccugc

SEQ ID NO: 1818462 - RNA, 22 nt, Salmonella typhimurium LT2
auccaugccggcuuuccgcacc

SEQ ID NO: 1818463 - RNA, 13 nt, Salmonella typhimurium LT2
auccaucagccag

SEQ ID NO: 1818464 - RNA, 13 nt, Salmonella typhimurium LT2
auccaucagcgcg

SEQ ID NO: 1818465 - RNA, 18 nt, Salmonella typhimurium LT2
auccauuaaaugcgccag

SEQ ID NO: 1818466 - RNA, 20 nt, Salmonella typhimurium LT2
auccauguugccaugaucca

SEQ ID NO: 1818467 - RNA, 21 nt, Salmonella typhimurium LT2
auccagcaccucaucccccag

SEQ ID NO: 1818468 - RNA, 15 nt, Salmonella typhimurium LT2
auccagcaguaaaua

SEQ ID NO: 1818469 - RNA, 18 nt, Salmonella typhimurium LT2
auccacugagcgcgccau

SEQ ID NO: 1818470 - RNA, 15 nt, Salmonella typhimurium LT2
auccagacagccgac

SEQ ID NO: 1818471 - RNA, 14 nt, Salmonella typhimurium LT2
auccagacgcugac

SEQ ID NO: 1818472 - RNA, 18 nt, Salmonella typhimurium LT2
auccagcgguaaaucgcu

SEQ ID NO: 1818473 - RNA, 20 nt, Salmonella typhimurium LT2
auccagcgguagcggcacgu

SEQ ID NO: 1818474 - RNA, 22 nt, Salmonella typhimurium LT2
auccagcgguugcgcuucggcg

SEQ ID NO: 1818475 - RNA, 16 nt, Salmonella typhimurium LT2
auccagcgcgcugagc

SEQ ID NO: 1818476 - RNA, 17 nt, Salmonella typhimurium LT2
auccaggucuuccgccg

SEQ ID NO: 1818477 - RNA, 21 nt, Salmonella typhimurium LT2
auccaggguuuacugccagua

SEQ ID NO: 1818478 - RNA, 22 nt, Salmonella typhimurium LT2
auccggccuguaaacagaugcu

SEQ ID NO: 1818479 - RNA, 11 nt, Salmonella typhimurium LT2
auccggcgcug

SEQ ID NO: 1818480 - RNA, 19 nt, Salmonella typhimurium LT2
auccggcgcugugcggcgu

SEQ ID NO: 1818481 - RNA, 21 nt, Salmonella typhimurium LT2
auccggcgcugugcggcgugc

SEQ ID NO: 1818482 - RNA, 13 nt, Salmonella typhimurium LT2
auccggcgaggcg

SEQ ID NO: 1818483 - RNA, 14 nt, Salmonella typhimurium LT2
auccggcacgguca

SEQ ID NO: 1818484 - RNA, 21 nt, Salmonella typhimurium LT2
auccgcggauagacgauauag

SEQ ID NO: 1818485 - RNA, 15 nt, Salmonella typhimurium LT2
auccggcaucacagg

SEQ ID NO: 1818486 - RNA, 16 nt, Salmonella typhimurium LT2
aucccugaucggccag

SEQ ID NO: 1818487 - RNA, 23 nt, Salmonella typhimurium LT2
aucccggcuggguucauccagca

SEQ ID NO: 1818488 - RNA, 19 nt, Salmonella typhimurium LT2
aucccggucgcgccagcga

SEQ ID NO: 1818489 - RNA, 14 nt, Salmonella typhimurium LT2
aucccgcucgccag

SEQ ID NO: 1818490 - RNA, 21 nt, Salmonella typhimurium LT2
auccccucuuccaucagccag

SEQ ID NO: 1818491 - RNA, 13 nt, Salmonella typhimurium LT2
aucccgcaucacc

SEQ ID NO: 1818492 - RNA, 14 nt, Salmonella typhimurium LT2
aucccgcgcugcgc

SEQ ID NO: 1818493 - RNA, 16 nt, Salmonella typhimurium LT2
aucccgccuugcggcg

SEQ ID NO: 1818494 - RNA, 12 nt, Salmonella typhimurium LT2
auauugccgccu

SEQ ID NO: 1818495 - RNA, 20 nt, Salmonella typhimurium LT2
auauugcccaucgcgccaug

SEQ ID NO: 1818496 - RNA, 16 nt, Salmonella typhimurium LT2
aucagcuuugcggcca

SEQ ID NO: 1818497 - RNA, 17 nt, Salmonella typhimurium LT2
aucagcuucggcggcau

SEQ ID NO: 1818498 - RNA, 22 nt, Salmonella typhimurium LT2
aucaggcaauaaacaucagcca

SEQ ID NO: 1818499 - RNA, 19 nt, Salmonella typhimurium LT2
aucaggcgcaaacgcgugc

SEQ ID NO: 1818500 - RNA, 21 nt, Salmonella typhimurium LT2
aucaggugcgagagcuguccu

SEQ ID NO: 1818501 - RNA, 15 nt, Salmonella typhimurium LT2
aucagucgcagcggc

SEQ ID NO: 1818502 - RNA, 14 nt, Salmonella typhimurium LT2
aucaguaacugacg

SEQ ID NO: 1818503 - RNA, 10 nt, Salmonella typhimurium LT2
aucaguagcu

SEQ ID NO: 1818504 - RNA, 20 nt, Salmonella typhimurium LT2
aucagguaucccgccagcgg

SEQ ID NO: 1818505 - RNA, 16 nt, Salmonella typhimurium LT2
aucauauucgcagcuc

SEQ ID NO: 1818506 - RNA, 21 nt, Salmonella typhimurium LT2
aucauauuuuaucuccauauc

SEQ ID NO: 1818507 - RNA, 16 nt, Salmonella typhimurium LT2
aucauacauagcaggc

SEQ ID NO: 1818508 - RNA, 20 nt, Salmonella typhimurium LT2
aucaguucucgguauccagc

SEQ ID NO: 1818509 - RNA, 14 nt, Salmonella typhimurium LT2
aucaguuugcgaag

SEQ ID NO: 1818510 - RNA, 22 nt, Salmonella typhimurium LT2
aucaguccccagcguaccacgc

SEQ ID NO: 1818511 - RNA, 13 nt, Salmonella typhimurium LT2
auccacagcgcca

SEQ ID NO: 1818512 - RNA, 16 nt, Salmonella typhimurium LT2
auccacagcgaauucc

SEQ ID NO: 1818513 - RNA, 16 nt, Salmonella typhimurium LT2
auccaacgguacgacg

SEQ ID NO: 1818514 - RNA, 17 nt, Salmonella typhimurium LT2
aucauuuucuuucauca

SEQ ID NO: 1818515 - RNA, 15 nt, Salmonella typhimurium LT2
aucauuagcgucaua

SEQ ID NO: 1818516 - RNA, 15 nt, Salmonella typhimurium LT2
aucauucuuauucgu

SEQ ID NO: 1818517 - RNA, 14 nt, Salmonella typhimurium LT2
aucauugcgccaag

SEQ ID NO: 1818518 - RNA, 23 nt, Salmonella typhimurium LT2
aucaugcuaaaagcgacuucacc

SEQ ID NO: 1818519 - RNA, 13 nt, Salmonella typhimurium LT2
aucaugcccggca

SEQ ID NO: 1818520 - RNA, 19 nt, Salmonella typhimurium LT2
aucaucucccaggccgcca

SEQ ID NO: 1818521 - RNA, 14 nt, Salmonella typhimurium LT2
aucaucuuuaucca

SEQ ID NO: 1818522 - RNA, 16 nt, Salmonella typhimurium LT2
aucaucggcacagcca

SEQ ID NO: 1818523 - RNA, 19 nt, Salmonella typhimurium LT2
aucaucgcuuaacggccca

SEQ ID NO: 1818524 - RNA, 23 nt, Salmonella typhimurium LT2
aucaucgauauaccaugccgcca

SEQ ID NO: 1818525 - RNA, 22 nt, Salmonella typhimurium LT2
aucaucgccgauuucuucuggc

SEQ ID NO: 1818526 - RNA, 19 nt, Salmonella typhimurium LT2
aucaucaucggcacagcca

SEQ ID NO: 1818527 - RNA, 16 nt, Salmonella typhimurium LT2
aucaucaggaacaucc

SEQ ID NO: 1818528 - RNA, 21 nt, Salmonella typhimurium LT2
aucgucagacggcuccagcgc

SEQ ID NO: 1818529 - RNA, 20 nt, Salmonella typhimurium LT2
aucgucauccauccacggca

SEQ ID NO: 1818530 - RNA, 21 nt, Salmonella typhimurium LT2
aucgucgauaaucauacagcg

SEQ ID NO: 1818531 - RNA, 13 nt, Salmonella typhimurium LT2
aucguaugcgccu

SEQ ID NO: 1818532 - RNA, 17 nt, Salmonella typhimurium LT2
aucguagucaggcagca

SEQ ID NO: 1818533 - RNA, 16 nt, Salmonella typhimurium LT2
aucgucagccgccagu

SEQ ID NO: 1818534 - RNA, 22 nt, Salmonella typhimurium LT2
aucgucggacaacguaccggca

SEQ ID NO: 1818535 - RNA, 19 nt, Salmonella typhimurium LT2
aucgucggacaacguaccg

SEQ ID NO: 1818536 - RNA, 23 nt, Salmonella typhimurium LT2
aucgucgccagacccagcgcuaa

SEQ ID NO: 1818537 - RNA, 21 nt, Salmonella typhimurium LT2
aucguuaguguaguuagcgcc

SEQ ID NO: 1818538 - RNA, 18 nt, Salmonella typhimurium LT2
aucguuauccagcagcca

SEQ ID NO: 1818539 - RNA, 14 nt, Salmonella typhimurium LT2
aucguuauccagca

SEQ ID NO: 1818540 - RNA, 17 nt, Salmonella typhimurium LT2
aucguuauccagcagcc

SEQ ID NO: 1818541 - RNA, 14 nt, Salmonella typhimurium LT2
aucucuuccagcgu

SEQ ID NO: 1818542 - RNA, 20 nt, Salmonella typhimurium LT2
aucggcaggccggagcugau

SEQ ID NO: 1818543 - RNA, 19 nt, Salmonella typhimurium LT2
aucgcuuacagcauacgcc

SEQ ID NO: 1818544 - RNA, 17 nt, Salmonella typhimurium LT2
aucggaagacuggcgca

SEQ ID NO: 1818545 - RNA, 20 nt, Salmonella typhimurium LT2
aucgggcgggcauuauacgc

SEQ ID NO: 1818546 - RNA, 21 nt, Salmonella typhimurium LT2
aucggccagcgccagcguagu

SEQ ID NO: 1818547 - RNA, 13 nt, Salmonella typhimurium LT2
aucggccagcagu

SEQ ID NO: 1818548 - RNA, 20 nt, Salmonella typhimurium LT2
aucggcuugagcaccacgcg

SEQ ID NO: 1818549 - RNA, 22 nt, Salmonella typhimurium LT2
aucggcuuuggcaaacggcgcc

SEQ ID NO: 1818550 - RNA, 16 nt, Salmonella typhimurium LT2
aucggcuugccuucau

SEQ ID NO: 1818551 - RNA, 16 nt, Salmonella typhimurium LT2
aucgguuucgcggcgu

SEQ ID NO: 1818552 - RNA, 17 nt, Salmonella typhimurium LT2
aucgguucugacgcgac

SEQ ID NO: 1818553 - RNA, 17 nt, Salmonella typhimurium LT2
aucgggcuuccagcguu

SEQ ID NO: 1818554 - RNA, 14 nt, Salmonella typhimurium LT2
aucgggaucagcgc

SEQ ID NO: 1818555 - RNA, 20 nt, Salmonella typhimurium LT2
aucgguaaaggucgccgcau

SEQ ID NO: 1818556 - RNA, 14 nt, Salmonella typhimurium LT2
aucgcaaacgccag

SEQ ID NO: 1818557 - RNA, 19 nt, Salmonella typhimurium LT2
aucgaugaccauacggcca

SEQ ID NO: 1818558 - RNA, 15 nt, Salmonella typhimurium LT2
aucgauauaagcgcc

SEQ ID NO: 1818559 - RNA, 15 nt, Salmonella typhimurium LT2
aucgaggcuggucgc

SEQ ID NO: 1818560 - RNA, 14 nt, Salmonella typhimurium LT2
aucgccauccugca

SEQ ID NO: 1818561 - RNA, 23 nt, Salmonella typhimurium LT2
aucgccaucgcgaauuucaaucg

SEQ ID NO: 1818562 - RNA, 18 nt, Salmonella typhimurium LT2
aucgcccguaucacugau

SEQ ID NO: 1818563 - RNA, 17 nt, Salmonella typhimurium LT2
aucgccaggaucgccgc

SEQ ID NO: 1818564 - RNA, 12 nt, Salmonella typhimurium LT2
aucgccacgcca

SEQ ID NO: 1818565 - RNA, 18 nt, Salmonella typhimurium LT2
aucgccaccacauucagg

SEQ ID NO: 1818566 - RNA, 20 nt, Salmonella typhimurium LT2
aucgccacggugagccacug

SEQ ID NO: 1818567 - RNA, 14 nt, Salmonella typhimurium LT2
aucgcagauagcaa

SEQ ID NO: 1818568 - RNA, 12 nt, Salmonella typhimurium LT2
aucgcacggcga

SEQ ID NO: 1818569 - RNA, 24 nt, Salmonella typhimurium LT2
aucgccaaacgccaucacuucgcg

SEQ ID NO: 1818570 - RNA, 20 nt, Salmonella typhimurium LT2
aucgcaugacuacgaaucgc

SEQ ID NO: 1818571 - RNA, 21 nt, Salmonella typhimurium LT2
aucgcagucagccuugaccgc

SEQ ID NO: 1818572 - RNA, 17 nt, Salmonella typhimurium LT2
aucgccgaagcggcagu

SEQ ID NO: 1818573 - RNA, 16 nt, Salmonella typhimurium LT2
aucgccgacccggcga

SEQ ID NO: 1818574 - RNA, 16 nt, Salmonella typhimurium LT2
aucgccugaugaccgc

SEQ ID NO: 1818575 - RNA, 20 nt, Salmonella typhimurium LT2
aucgccuucgacuuccgcau

SEQ ID NO: 1818576 - RNA, 13 nt, Salmonella typhimurium LT2
aucgccuucaucc

SEQ ID NO: 1818577 - RNA, 19 nt, Salmonella typhimurium LT2
aucgcguacaggaugucca

SEQ ID NO: 1818578 - RNA, 17 nt, Salmonella typhimurium LT2
aucgcgauagcgcugag

SEQ ID NO: 1818579 - RNA, 20 nt, Salmonella typhimurium LT2
aucgcggcgcaaaucgccau

SEQ ID NO: 1818580 - RNA, 14 nt, Salmonella typhimurium LT2
aucgcuuccagcgc

SEQ ID NO: 1818581 - RNA, 17 nt, Salmonella typhimurium LT2
aucgcgucugacagcgc

SEQ ID NO: 1818582 - RNA, 15 nt, Salmonella typhimurium LT2
auggugauagcgcgc

SEQ ID NO: 1818583 - RNA, 22 nt, Salmonella typhimurium LT2
auggugcccauaaaaaucccaa

SEQ ID NO: 1818584 - RNA, 23 nt, Salmonella typhimurium LT2
auggcuuacgguuguuucagcca

SEQ ID NO: 1818585 - RNA, 21 nt, Salmonella typhimurium LT2
auggcuauuuugaucccacug

SEQ ID NO: 1818586 - RNA, 12 nt, Salmonella typhimurium LT2
auggucagcgcc

SEQ ID NO: 1818587 - RNA, 20 nt, Salmonella typhimurium LT2
augucccaucguaacgccgu

SEQ ID NO: 1818588 - RNA, 18 nt, Salmonella typhimurium LT2
auguagcgcggcagcgcg

SEQ ID NO: 1818589 - RNA, 13 nt, Salmonella typhimurium LT2
auguagcgcugaa

SEQ ID NO: 1818590 - RNA, 15 nt, Salmonella typhimurium LT2
auguaggguggcgcc

SEQ ID NO: 1818591 - RNA, 15 nt, Salmonella typhimurium LT2
auguaccgucaucgc

SEQ ID NO: 1818592 - RNA, 14 nt, Salmonella typhimurium LT2
augucgacgcgcuc

SEQ ID NO: 1818593 - RNA, 17 nt, Salmonella typhimurium LT2
auggccgcagcgccaua

SEQ ID NO: 1818594 - RNA, 21 nt, Salmonella typhimurium LT2
augcuccuuccgucgcugcgu

SEQ ID NO: 1818595 - RNA, 15 nt, Salmonella typhimurium LT2
augcucaacuuccag

SEQ ID NO: 1818596 - RNA, 17 nt, Salmonella typhimurium LT2
auggcuaauauccagcc

SEQ ID NO: 1818597 - RNA, 15 nt, Salmonella typhimurium LT2
auggcggucagcuuu

SEQ ID NO: 1818598 - RNA, 22 nt, Salmonella typhimurium LT2
auggcgcgacgcuuaucagccc

SEQ ID NO: 1818599 - RNA, 24 nt, Salmonella typhimurium LT2
auggcgcuucgcuuaucgggccua

SEQ ID NO: 1818600 - RNA, 22 nt, Salmonella typhimurium LT2
auggcgcugcgcuuaucaggcc

SEQ ID NO: 1818601 - RNA, 23 nt, Salmonella typhimurium LT2
auggcggcgaaacgccuuauccg

SEQ ID NO: 1818602 - RNA, 24 nt, Salmonella typhimurium LT2
auggcggcgaaacgccuuauccgg

SEQ ID NO: 1818603 - RNA, 17 nt, Salmonella typhimurium LT2
auucaaaacgaucauug

SEQ ID NO: 1818604 - RNA, 22 nt, Salmonella typhimurium LT2
auuauccacaaacuccagacga

SEQ ID NO: 1818605 - RNA, 22 nt, Salmonella typhimurium LT2
auuauacuuauuuguaugacaa

SEQ ID NO: 1818606 - RNA, 15 nt, Salmonella typhimurium LT2
auuaucuccaucuug

SEQ ID NO: 1818607 - RNA, 19 nt, Salmonella typhimurium LT2
auuccaguagcgcgcccau

SEQ ID NO: 1818608 - RNA, 23 nt, Salmonella typhimurium LT2
auuccagccacacgacgguauug

SEQ ID NO: 1818609 - RNA, 16 nt, Salmonella typhimurium LT2
auuccagauagcgcug

SEQ ID NO: 1818610 - RNA, 17 nt, Salmonella typhimurium LT2
auuacgccugucgcgcc

SEQ ID NO: 1818611 - RNA, 14 nt, Salmonella typhimurium LT2
auuacgcaccacgc

SEQ ID NO: 1818612 - RNA, 13 nt, Salmonella typhimurium LT2
auuacguacguca

SEQ ID NO: 1818613 - RNA, 20 nt, Salmonella typhimurium LT2
auuaggcuuuucauucagcg

SEQ ID NO: 1818614 - RNA, 19 nt, Salmonella typhimurium LT2
auuagccguugaguuugac

SEQ ID NO: 1818615 - RNA, 19 nt, Salmonella typhimurium LT2
auuaucaauggcuucaaug

SEQ ID NO: 1818616 - RNA, 15 nt, Salmonella typhimurium LT2
auguuugccgucauc

SEQ ID NO: 1818617 - RNA, 19 nt, Salmonella typhimurium LT2
auuaagcaggccgauauug

SEQ ID NO: 1818618 - RNA, 14 nt, Salmonella typhimurium LT2
auguuuaccaucgc

SEQ ID NO: 1818619 - RNA, 20 nt, Salmonella typhimurium LT2
auguuuccugaauagcaggc

SEQ ID NO: 1818620 - RNA, 18 nt, Salmonella typhimurium LT2
auguuugacaagcagcgg

SEQ ID NO: 1818621 - RNA, 22 nt, Salmonella typhimurium LT2
augucgcggauaugcagcagcc

SEQ ID NO: 1818622 - RNA, 15 nt, Salmonella typhimurium LT2
auuacccuucaugca

SEQ ID NO: 1818623 - RNA, 13 nt, Salmonella typhimurium LT2
auuaccgccaaca

SEQ ID NO: 1818624 - RNA, 20 nt, Salmonella typhimurium LT2
auuacgcccauuaugccgca

SEQ ID NO: 1818625 - RNA, 14 nt, Salmonella typhimurium LT2
auuacgacugcacc

SEQ ID NO: 1818626 - RNA, 22 nt, Salmonella typhimurium LT2
auuacccucccuuucuucucaa

SEQ ID NO: 1818627 - RNA, 17 nt, Salmonella typhimurium LT2
auuacagauauccaccg

SEQ ID NO: 1818628 - RNA, 22 nt, Salmonella typhimurium LT2
auuacaggcaucuuccagcguc

SEQ ID NO: 1818629 - RNA, 19 nt, Salmonella typhimurium LT2
auuaaugucaugaagcuca

SEQ ID NO: 1818630 - RNA, 22 nt, Salmonella typhimurium LT2
auuaauugauuacaaagggcaa

SEQ ID NO: 1818631 - RNA, 23 nt, Salmonella typhimurium LT2
auuaauaaccccagcugcggcau

SEQ ID NO: 1818632 - RNA, 20 nt, Salmonella typhimurium LT2
auuaaucaagcccagcucag

SEQ ID NO: 1818633 - RNA, 18 nt, Salmonella typhimurium LT2
augccaccagcgccauaa

SEQ ID NO: 1818634 - RNA, 15 nt, Salmonella typhimurium LT2
augccacucgauucc

SEQ ID NO: 1818635 - RNA, 17 nt, Salmonella typhimurium LT2
augccagcucaaaucgc

SEQ ID NO: 1818636 - RNA, 13 nt, Salmonella typhimurium LT2
augcaaacgacac

SEQ ID NO: 1818637 - RNA, 20 nt, Salmonella typhimurium LT2
augcacaugguguacguugc

SEQ ID NO: 1818638 - RNA, 15 nt, Salmonella typhimurium LT2
augcaacuggcaagc

SEQ ID NO: 1818639 - RNA, 21 nt, Salmonella typhimurium LT2
augcaaugucuuuauccgcca

SEQ ID NO: 1818640 - RNA, 14 nt, Salmonella typhimurium LT2
augcacaaccagcg

SEQ ID NO: 1818641 - RNA, 15 nt, Salmonella typhimurium LT2
augcccaauugacgg

SEQ ID NO: 1818642 - RNA, 14 nt, Salmonella typhimurium LT2
augcccgauggcgc

SEQ ID NO: 1818643 - RNA, 20 nt, Salmonella typhimurium LT2
augcccuucuaccgucagca

SEQ ID NO: 1818644 - RNA, 16 nt, Salmonella typhimurium LT2
augacgcuugagcgcc

SEQ ID NO: 1818645 - RNA, 14 nt, Salmonella typhimurium LT2
augacguucaauuc

SEQ ID NO: 1818646 - RNA, 15 nt, Salmonella typhimurium LT2
aucugaaaggcguca

SEQ ID NO: 1818647 - RNA, 15 nt, Salmonella typhimurium LT2
augaugagcgccaua

SEQ ID NO: 1818648 - RNA, 17 nt, Salmonella typhimurium LT2
augaugaucuucagccc

SEQ ID NO: 1818649 - RNA, 18 nt, Salmonella typhimurium LT2
augaugaccgaagcaggc

SEQ ID NO: 1818650 - RNA, 16 nt, Salmonella typhimurium LT2
augacuuuuuugccaa

SEQ ID NO: 1818651 - RNA, 14 nt, Salmonella typhimurium LT2
augacuucaucgcc

SEQ ID NO: 1818652 - RNA, 18 nt, Salmonella typhimurium LT2
augagcgguaagucaacc

SEQ ID NO: 1818653 - RNA, 21 nt, Salmonella typhimurium LT2
augcguguucagguuggcgac

SEQ ID NO: 1818654 - RNA, 17 nt, Salmonella typhimurium LT2
augcggaugcugcgcca

SEQ ID NO: 1818655 - RNA, 23 nt, Salmonella typhimurium LT2
augcgcuccagcuucaucaucag

SEQ ID NO: 1818656 - RNA, 16 nt, Salmonella typhimurium LT2
augcgcguugccgcca

SEQ ID NO: 1818657 - RNA, 16 nt, Salmonella typhimurium LT2
augcgcguuuagcgcc

SEQ ID NO: 1818658 - RNA, 17 nt, Salmonella typhimurium LT2
augcgcguuuagcgcca

SEQ ID NO: 1818659 - RNA, 12 nt, Salmonella typhimurium LT2
augccuucgccg

SEQ ID NO: 1818660 - RNA, 23 nt, Salmonella typhimurium LT2
augccuugcgaauggagaagcgc

SEQ ID NO: 1818661 - RNA, 16 nt, Salmonella typhimurium LT2
augccugacgccacca

SEQ ID NO: 1818662 - RNA, 20 nt, Salmonella typhimurium LT2
augccugauggcgcagcgcc

SEQ ID NO: 1818663 - RNA, 14 nt, Salmonella typhimurium LT2
augccugcgccaug

SEQ ID NO: 1818664 - RNA, 20 nt, Salmonella typhimurium LT2
augcgcgcguuuaucaccgu

SEQ ID NO: 1818665 - RNA, 14 nt, Salmonella typhimurium LT2
augcgaauccggcg

SEQ ID NO: 1818666 - RNA, 13 nt, Salmonella typhimurium LT2
augcgacgcgcac

SEQ ID NO: 1818667 - RNA, 16 nt, Salmonella typhimurium LT2
augcgaauaacaucau

SEQ ID NO: 1818668 - RNA, 15 nt, Salmonella typhimurium LT2
augcgaacgauacca

SEQ ID NO: 1818669 - RNA, 17 nt, Salmonella typhimurium LT2
augcgacugaaaaucaa

SEQ ID NO: 1818670 - RNA, 19 nt, Salmonella typhimurium LT2
augcgagaaugucgccaug

SEQ ID NO: 1818671 - RNA, 15 nt, Salmonella typhimurium LT2
augcgaguagcaaau

SEQ ID NO: 1818672 - RNA, 17 nt, Salmonella typhimurium LT2
augcgauaaccguauug

SEQ ID NO: 1818673 - RNA, 16 nt, Salmonella typhimurium LT2
augccgccauccggca

SEQ ID NO: 1818674 - RNA, 17 nt, Salmonella typhimurium LT2
augccgccauccggcaa

SEQ ID NO: 1818675 - RNA, 16 nt, Salmonella typhimurium LT2
augccgaucaccagcg

SEQ ID NO: 1818676 - RNA, 19 nt, Salmonella typhimurium LT2
augccgccgacaaccagcg

SEQ ID NO: 1818677 - RNA, 19 nt, Salmonella typhimurium LT2
augccgucauucugguagu

SEQ ID NO: 1818678 - RNA, 18 nt, Salmonella typhimurium LT2
augccgucgacgccgaua

SEQ ID NO: 1818679 - RNA, 16 nt, Salmonella typhimurium LT2
cccguaucacugauau

SEQ ID NO: 1818680 - RNA, 17 nt, Salmonella typhimurium LT2
cccggguaaugcugcag

SEQ ID NO: 1818681 - RNA, 20 nt, Salmonella typhimurium LT2
cccggugaaaaacaucggca

SEQ ID NO: 1818682 - RNA, 16 nt, Salmonella typhimurium LT2
cccgguuuauccccgc

SEQ ID NO: 1818683 - RNA, 13 nt, Salmonella typhimurium LT2
cccggaucaccgg

SEQ ID NO: 1818684 - RNA, 18 nt, Salmonella typhimurium LT2
cccguuccucguccugau

SEQ ID NO: 1818685 - RNA, 12 nt, Salmonella typhimurium LT2
cccguuccagcu

SEQ ID NO: 1818686 - RNA, 19 nt, Salmonella typhimurium LT2
cccgugcgcgucgccugaa

SEQ ID NO: 1818687 - RNA, 15 nt, Salmonella typhimurium LT2
cccgugacgcaggcg

SEQ ID NO: 1818688 - RNA, 13 nt, Salmonella typhimurium LT2
cccugcgccagac

SEQ ID NO: 1818689 - RNA, 14 nt, Salmonella typhimurium LT2
cccucgguuuaucc

SEQ ID NO: 1818690 - RNA, 20 nt, Salmonella typhimurium LT2
ccgaacaacaauacgcguca

SEQ ID NO: 1818691 - RNA, 13 nt, Salmonella typhimurium LT2
ccgaaaucgguac

SEQ ID NO: 1818692 - RNA, 22 nt, Salmonella typhimurium LT2
cccugguuaacccgguuuaucc

SEQ ID NO: 1818693 - RNA, 12 nt, Salmonella typhimurium LT2
ccgaaucaggcg

SEQ ID NO: 1818694 - RNA, 22 nt, Salmonella typhimurium LT2
ccgaaugacgggccuacgcgca

SEQ ID NO: 1818695 - RNA, 19 nt, Salmonella typhimurium LT2
cccgauggcgcugcgcgca

SEQ ID NO: 1818696 - RNA, 13 nt, Salmonella typhimurium LT2
cccgauaaccgcg

SEQ ID NO: 1818697 - RNA, 16 nt, Salmonella typhimurium LT2
cccgauaagcgcuggc

SEQ ID NO: 1818698 - RNA, 15 nt, Salmonella typhimurium LT2
cccgauaccgccagc

SEQ ID NO: 1818699 - RNA, 17 nt, Salmonella typhimurium LT2
cccgccaucguccagcc

SEQ ID NO: 1818700 - RNA, 14 nt, Salmonella typhimurium LT2
cccgccaucuucac

SEQ ID NO: 1818701 - RNA, 13 nt, Salmonella typhimurium LT2
cccgccaucgccg

SEQ ID NO: 1818702 - RNA, 13 nt, Salmonella typhimurium LT2
cccgccagaugca

SEQ ID NO: 1818703 - RNA, 16 nt, Salmonella typhimurium LT2
cccgcuucccgaugcc

SEQ ID NO: 1818704 - RNA, 23 nt, Salmonella typhimurium LT2
ccccuuuagcggcauauccggcg

SEQ ID NO: 1818705 - RNA, 13 nt, Salmonella typhimurium LT2
ccccuccagccag

SEQ ID NO: 1818706 - RNA, 19 nt, Salmonella typhimurium LT2
ccccuccagccagcgccag

SEQ ID NO: 1818707 - RNA, 12 nt, Salmonella typhimurium LT2
cccgaaccugcg

SEQ ID NO: 1818708 - RNA, 14 nt, Salmonella typhimurium LT2
cccgacgcgcgaua

SEQ ID NO: 1818709 - RNA, 15 nt, Salmonella typhimurium LT2
cccacuaccgccacu

SEQ ID NO: 1818710 - RNA, 17 nt, Salmonella typhimurium LT2
cccacuuggcgaucacc

SEQ ID NO: 1818711 - RNA, 17 nt, Salmonella typhimurium LT2
cccacauuugaucucau

SEQ ID NO: 1818712 - RNA, 21 nt, Salmonella typhimurium LT2
cccagcgaauuaugacggaug

SEQ ID NO: 1818713 - RNA, 14 nt, Salmonella typhimurium LT2
cccagccgaugacc

SEQ ID NO: 1818714 - RNA, 22 nt, Salmonella typhimurium LT2
cccagcccaucggucgcgcgca

SEQ ID NO: 1818715 - RNA, 21 nt, Salmonella typhimurium LT2
cccaugaugggcaagcguagu

SEQ ID NO: 1818716 - RNA, 14 nt, Salmonella typhimurium LT2
cccaugaucaggcg

SEQ ID NO: 1818717 - RNA, 21 nt, Salmonella typhimurium LT2
cccaguuucaucaucgccgau

SEQ ID NO: 1818718 - RNA, 18 nt, Salmonella typhimurium LT2
cccaguuucaucaucgcc

SEQ ID NO: 1818719 - RNA, 21 nt, Salmonella typhimurium LT2
cccauaaugcauguggagaug

SEQ ID NO: 1818720 - RNA, 13 nt, Salmonella typhimurium LT2
cccaggccgggug

SEQ ID NO: 1818721 - RNA, 13 nt, Salmonella typhimurium LT2
cccaggcgcgcag

SEQ ID NO: 1818722 - RNA, 13 nt, Salmonella typhimurium LT2
cccagggaugcgc

SEQ ID NO: 1818723 - RNA, 13 nt, Salmonella typhimurium LT2
ccaucagcgucau

SEQ ID NO: 1818724 - RNA, 19 nt, Salmonella typhimurium LT2
ccaucacgguuuacgcgca

SEQ ID NO: 1818725 - RNA, 19 nt, Salmonella typhimurium LT2
ccaucuaaaucaaucacuu

SEQ ID NO: 1818726 - RNA, 20 nt, Salmonella typhimurium LT2
cccaauagcgaucgagauaa

SEQ ID NO: 1818727 - RNA, 22 nt, Salmonella typhimurium LT2
cccaauacgccagccuaucgcc

SEQ ID NO: 1818728 - RNA, 22 nt, Salmonella typhimurium LT2
cccaauaacuguggguugccau

SEQ ID NO: 1818729 - RNA, 15 nt, Salmonella typhimurium LT2
cccacaaccgacgca

SEQ ID NO: 1818730 - RNA, 22 nt, Salmonella typhimurium LT2
cccaaucagguuugagcggugg

SEQ ID NO: 1818731 - RNA, 19 nt, Salmonella typhimurium LT2
ccauugcgccacggauggc

SEQ ID NO: 1818732 - RNA, 23 nt, Salmonella typhimurium LT2
ccauuuugguuacuauuuuucac

SEQ ID NO: 1818733 - RNA, 21 nt, Salmonella typhimurium LT2
ccauuuuucgcccacaucugu

SEQ ID NO: 1818734 - RNA, 18 nt, Salmonella typhimurium LT2
ccaguacagcacgccgga

SEQ ID NO: 1818735 - RNA, 14 nt, Salmonella typhimurium LT2
ccaguaacgcgucc

SEQ ID NO: 1818736 - RNA, 21 nt, Salmonella typhimurium LT2
ccagguacuuacgcagccggu

SEQ ID NO: 1818737 - RNA, 21 nt, Salmonella typhimurium LT2
ccaggguuaaaaaucgcuaua

SEQ ID NO: 1818738 - RNA, 14 nt, Salmonella typhimurium LT2
ccaguuuacgcgua

SEQ ID NO: 1818739 - RNA, 13 nt, Salmonella typhimurium LT2
ccaguuuuuauac

SEQ ID NO: 1818740 - RNA, 22 nt, Salmonella typhimurium LT2
ccauaauauaaggaucggaaga

SEQ ID NO: 1818741 - RNA, 17 nt, Salmonella typhimurium LT2
ccaguaucgcgccgcca

SEQ ID NO: 1818742 - RNA, 16 nt, Salmonella typhimurium LT2
ccaguagucgcgccau

SEQ ID NO: 1818743 - RNA, 23 nt, Salmonella typhimurium LT2
ccaguauaauuucaggcugcuca

SEQ ID NO: 1818744 - RNA, 13 nt, Salmonella typhimurium LT2
ccagucauccggu

SEQ ID NO: 1818745 - RNA, 16 nt, Salmonella typhimurium LT2
ccagucaucgccgcua

SEQ ID NO: 1818746 - RNA, 12 nt, Salmonella typhimurium LT2
ccagugccgcca

SEQ ID NO: 1818747 - RNA, 19 nt, Salmonella typhimurium LT2
ccaguucauucgccaccag

SEQ ID NO: 1818748 - RNA, 13 nt, Salmonella typhimurium LT2
ccaggcgcgaugc

SEQ ID NO: 1818749 - RNA, 23 nt, Salmonella typhimurium LT2
ccaggcgcugcuggcagcgcuga

SEQ ID NO: 1818750 - RNA, 16 nt, Salmonella typhimurium LT2
ccaggcaaagcucaac

SEQ ID NO: 1818751 - RNA, 21 nt, Salmonella typhimurium LT2
ccaggcaaagauccaccaggu

SEQ ID NO: 1818752 - RNA, 17 nt, Salmonella typhimurium LT2
ccagcgugccugccgca

SEQ ID NO: 1818753 - RNA, 14 nt, Salmonella typhimurium LT2
ccaggccacggcug

SEQ ID NO: 1818754 - RNA, 14 nt, Salmonella typhimurium LT2
ccagacgcgcagca

SEQ ID NO: 1818755 - RNA, 23 nt, Salmonella typhimurium LT2
ccagacgccgcgccgcggcgucu

SEQ ID NO: 1818756 - RNA, 18 nt, Salmonella typhimurium LT2
ccagacgaccguaauagc

SEQ ID NO: 1818757 - RNA, 23 nt, Salmonella typhimurium LT2
ccagacccacuaacugccgcuga

SEQ ID NO: 1818758 - RNA, 13 nt, Salmonella typhimurium LT2
ccagauacgcacg

SEQ ID NO: 1818759 - RNA, 14 nt, Salmonella typhimurium LT2
ccagauaaaucagc

SEQ ID NO: 1818760 - RNA, 15 nt, Salmonella typhimurium LT2
ccagauaacgcgcau

SEQ ID NO: 1818761 - RNA, 23 nt, Salmonella typhimurium LT2
ccagauaagccugcgcgccugcu

SEQ ID NO: 1818762 - RNA, 14 nt, Salmonella typhimurium LT2
ccagauagcgcugc

SEQ ID NO: 1818763 - RNA, 18 nt, Salmonella typhimurium LT2
ccagauagcgcugcgcca

SEQ ID NO: 1818764 - RNA, 12 nt, Salmonella typhimurium LT2
ccagaugcgcca

SEQ ID NO: 1818765 - RNA, 12 nt, Salmonella typhimurium LT2
ccagaugcgcuu

SEQ ID NO: 1818766 - RNA, 22 nt, Salmonella typhimurium LT2
ccacgguguggcccagcgcggu

SEQ ID NO: 1818767 - RNA, 11 nt, Salmonella typhimurium LT2
ccacggcgucc

SEQ ID NO: 1818768 - RNA, 15 nt, Salmonella typhimurium LT2
ccacggcguccugcg

SEQ ID NO: 1818769 - RNA, 19 nt, Salmonella typhimurium LT2
ccacgccguagcugcgcgc

SEQ ID NO: 1818770 - RNA, 14 nt, Salmonella typhimurium LT2
ccacgccguccgga

SEQ ID NO: 1818771 - RNA, 21 nt, Salmonella typhimurium LT2
ccacgauuaaccccccggcga

SEQ ID NO: 1818772 - RNA, 18 nt, Salmonella typhimurium LT2
ccaccugaauaacccgca

SEQ ID NO: 1818773 - RNA, 11 nt, Salmonella typhimurium LT2
ccacgacaauc

SEQ ID NO: 1818774 - RNA, 18 nt, Salmonella typhimurium LT2
ccacgacagaacccggcu

SEQ ID NO: 1818775 - RNA, 20 nt, Salmonella typhimurium LT2
ccagcccggcgcacacccug

SEQ ID NO: 1818776 - RNA, 17 nt, Salmonella typhimurium LT2
ccagccgaucagcgcca

SEQ ID NO: 1818777 - RNA, 15 nt, Salmonella typhimurium LT2
ccagccgaucaucac

SEQ ID NO: 1818778 - RNA, 22 nt, Salmonella typhimurium LT2
ccagccgacaggcgcgaaacgc

SEQ ID NO: 1818779 - RNA, 23 nt, Salmonella typhimurium LT2
ccagccauggcccaaaagguagc

SEQ ID NO: 1818780 - RNA, 21 nt, Salmonella typhimurium LT2
ccagccauucgaauucugaua

SEQ ID NO: 1818781 - RNA, 13 nt, Salmonella typhimurium LT2
ccagccacgcgug

SEQ ID NO: 1818782 - RNA, 19 nt, Salmonella typhimurium LT2
ccagcauggucuccagcaa

SEQ ID NO: 1818783 - RNA, 11 nt, Salmonella typhimurium LT2
ccagcagcgcg

SEQ ID NO: 1818784 - RNA, 13 nt, Salmonella typhimurium LT2
ccagcaucacgug

SEQ ID NO: 1818785 - RNA, 21 nt, Salmonella typhimurium LT2
ccagcauauuuuccggcgucu

SEQ ID NO: 1818786 - RNA, 22 nt, Salmonella typhimurium LT2
ccagcauauuuuccggcgucug

SEQ ID NO: 1818787 - RNA, 22 nt, Salmonella typhimurium LT2
ccagcaucaauagcagcuucac

SEQ ID NO: 1818788 - RNA, 14 nt, Salmonella typhimurium LT2
ccagcauaaugagc

SEQ ID NO: 1818789 - RNA, 13 nt, Salmonella typhimurium LT2
ccagcagcgccag

SEQ ID NO: 1818790 - RNA, 14 nt, Salmonella typhimurium LT2
ccagcacuaacagc

SEQ ID NO: 1818791 - RNA, 15 nt, Salmonella typhimurium LT2
ccagaugucgccaga

SEQ ID NO: 1818792 - RNA, 16 nt, Salmonella typhimurium LT2
ccagaugucgccagau

SEQ ID NO: 1818793 - RNA, 20 nt, Salmonella typhimurium LT2
ccagauggcgguucgccaca

SEQ ID NO: 1818794 - RNA, 14 nt, Salmonella typhimurium LT2
ccagcgcgccgcca

SEQ ID NO: 1818795 - RNA, 15 nt, Salmonella typhimurium LT2
ccagcguacugccaa

SEQ ID NO: 1818796 - RNA, 20 nt, Salmonella typhimurium LT2
ccagcguaccacgccgcaca

SEQ ID NO: 1818797 - RNA, 23 nt, Salmonella typhimurium LT2
ccagcgucaacugcgccugcuca

SEQ ID NO: 1818798 - RNA, 19 nt, Salmonella typhimurium LT2
ccagcgguguuugccagac

SEQ ID NO: 1818799 - RNA, 20 nt, Salmonella typhimurium LT2
ccagcgggcuggcauucauu

SEQ ID NO: 1818800 - RNA, 17 nt, Salmonella typhimurium LT2
ccagccgaucaucacga

SEQ ID NO: 1818801 - RNA, 12 nt, Salmonella typhimurium LT2
ccagcgccggau

SEQ ID NO: 1818802 - RNA, 15 nt, Salmonella typhimurium LT2
caucguauauaccca

SEQ ID NO: 1818803 - RNA, 21 nt, Salmonella typhimurium LT2
caucguauaaauuuuuaccca

SEQ ID NO: 1818804 - RNA, 22 nt, Salmonella typhimurium LT2
caucggcuucgcuggucagcgc

SEQ ID NO: 1818805 - RNA, 18 nt, Salmonella typhimurium LT2
caucgucuguacggaaua

SEQ ID NO: 1818806 - RNA, 15 nt, Salmonella typhimurium LT2
caucgguaagcgcaa

SEQ ID NO: 1818807 - RNA, 17 nt, Salmonella typhimurium LT2
cauccgggccaacggca

SEQ ID NO: 1818808 - RNA, 18 nt, Salmonella typhimurium LT2
cauccgggccaacggcau

SEQ ID NO: 1818809 - RNA, 23 nt, Salmonella typhimurium LT2
cauccgucguguagccuucgccu

SEQ ID NO: 1818810 - RNA, 14 nt, Salmonella typhimurium LT2
caucucuuugcccg

SEQ ID NO: 1818811 - RNA, 19 nt, Salmonella typhimurium LT2
caucucuuugcccgucgcc

SEQ ID NO: 1818812 - RNA, 14 nt, Salmonella typhimurium LT2
caucugucaucgcc

SEQ ID NO: 1818813 - RNA, 22 nt, Salmonella typhimurium LT2
caugauccagcggaacucauca

SEQ ID NO: 1818814 - RNA, 17 nt, Salmonella typhimurium LT2
caugauacccagcgucc

SEQ ID NO: 1818815 - RNA, 17 nt, Salmonella typhimurium LT2
caugaccugggcgccag

SEQ ID NO: 1818816 - RNA, 15 nt, Salmonella typhimurium LT2
caugacuacgaaucg

SEQ ID NO: 1818817 - RNA, 15 nt, Salmonella typhimurium LT2
caugacgcuggaagu

SEQ ID NO: 1818818 - RNA, 17 nt, Salmonella typhimurium LT2
caugacuuuaccgguuu

SEQ ID NO: 1818819 - RNA, 20 nt, Salmonella typhimurium LT2
caugagauaaugcuuucgcc

SEQ ID NO: 1818820 - RNA, 16 nt, Salmonella typhimurium LT2
caugccgcaggccgga

SEQ ID NO: 1818821 - RNA, 16 nt, Salmonella typhimurium LT2
caugcagcucaagcgc

SEQ ID NO: 1818822 - RNA, 22 nt, Salmonella typhimurium LT2
caugccaagcggcaucucgcca

SEQ ID NO: 1818823 - RNA, 14 nt, Salmonella typhimurium LT2
caugcaucaauggc

SEQ ID NO: 1818824 - RNA, 17 nt, Salmonella typhimurium LT2
caugccgaccagggcgu

SEQ ID NO: 1818825 - RNA, 23 nt, Salmonella typhimurium LT2
caugcgacgugucgcguaacgcc

SEQ ID NO: 1818826 - RNA, 17 nt, Salmonella typhimurium LT2
cauggcaggcagcacaa

SEQ ID NO: 1818827 - RNA, 13 nt, Salmonella typhimurium LT2
cauggcagggcga

SEQ ID NO: 1818828 - RNA, 15 nt, Salmonella typhimurium LT2
caugguacucaacau

SEQ ID NO: 1818829 - RNA, 18 nt, Salmonella typhimurium LT2
ccaagaccgccuaacagc

SEQ ID NO: 1818830 - RNA, 15 nt, Salmonella typhimurium LT2
ccaacugcgccugaa

SEQ ID NO: 1818831 - RNA, 16 nt, Salmonella typhimurium LT2
ccaaguaacacggcga

SEQ ID NO: 1818832 - RNA, 15 nt, Salmonella typhimurium LT2
ccaacgccggcaaca

SEQ ID NO: 1818833 - RNA, 14 nt, Salmonella typhimurium LT2
ccaacggcgacgcc

SEQ ID NO: 1818834 - RNA, 16 nt, Salmonella typhimurium LT2
ccaacugcauuucaua

SEQ ID NO: 1818835 - RNA, 16 nt, Salmonella typhimurium LT2
ccaacgguacgacgcc

SEQ ID NO: 1818836 - RNA, 23 nt, Salmonella typhimurium LT2
ccaauacgccagccuaucgccau

SEQ ID NO: 1818837 - RNA, 14 nt, Salmonella typhimurium LT2
ccacaucagaccgc

SEQ ID NO: 1818838 - RNA, 19 nt, Salmonella typhimurium LT2
ccacaucagaccgccaagc

SEQ ID NO: 1818839 - RNA, 23 nt, Salmonella typhimurium LT2
ccacaucgcgauuuagcguaaau

SEQ ID NO: 1818840 - RNA, 21 nt, Salmonella typhimurium LT2
cauucugcaggcgggugcgca

SEQ ID NO: 1818841 - RNA, 21 nt, Salmonella typhimurium LT2
cauucucuuucgcuguaggcc

SEQ ID NO: 1818842 - RNA, 21 nt, Salmonella typhimurium LT2
cauuccggcgcgaucaucgca

SEQ ID NO: 1818843 - RNA, 14 nt, Salmonella typhimurium LT2
cauuccaucauguu

SEQ ID NO: 1818844 - RNA, 17 nt, Salmonella typhimurium LT2
cauucccgucccugcau

SEQ ID NO: 1818845 - RNA, 17 nt, Salmonella typhimurium LT2
cauucagggaaucagcg

SEQ ID NO: 1818846 - RNA, 17 nt, Salmonella typhimurium LT2
cauguccagaucuucac

SEQ ID NO: 1818847 - RNA, 17 nt, Salmonella typhimurium LT2
cauugaaacgcaucaca

SEQ ID NO: 1818848 - RNA, 13 nt, Salmonella typhimurium LT2
cauugccgccagu

SEQ ID NO: 1818849 - RNA, 13 nt, Salmonella typhimurium LT2
cauugcgccaaga

SEQ ID NO: 1818850 - RNA, 23 nt, Salmonella typhimurium LT2
cauugccuuucaauacuucgaca

SEQ ID NO: 1818851 - RNA, 17 nt, Salmonella typhimurium LT2
cauugcuauagcccacg

SEQ ID NO: 1818852 - RNA, 15 nt, Salmonella typhimurium LT2
cauuggcguuaccgg

SEQ ID NO: 1818853 - RNA, 16 nt, Salmonella typhimurium LT2
ccaaacccgccacagg

SEQ ID NO: 1818854 - RNA, 13 nt, Salmonella typhimurium LT2
cauuuucaauguc

SEQ ID NO: 1818855 - RNA, 20 nt, Salmonella typhimurium LT2
cauuuucggcagcgcgaaca

SEQ ID NO: 1818856 - RNA, 19 nt, Salmonella typhimurium LT2
cauugucauuaacgucgca

SEQ ID NO: 1818857 - RNA, 18 nt, Salmonella typhimurium LT2
cauugugaggaaccucuu

SEQ ID NO: 1818858 - RNA, 17 nt, Salmonella typhimurium LT2
cauuguucuguccggaa

SEQ ID NO: 1818859 - RNA, 15 nt, Salmonella typhimurium LT2
ccaaauagcgccaga

SEQ ID NO: 1818860 - RNA, 16 nt, Salmonella typhimurium LT2
ccaaauagcgccagac

SEQ ID NO: 1818861 - RNA, 18 nt, Salmonella typhimurium LT2
ccaaccguuuugcaaugc

SEQ ID NO: 1818862 - RNA, 15 nt, Salmonella typhimurium LT2
cagcgucguccagcc

SEQ ID NO: 1818863 - RNA, 23 nt, Salmonella typhimurium LT2
cagcgugcgguaagcguucagcg

SEQ ID NO: 1818864 - RNA, 22 nt, Salmonella typhimurium LT2
cagcgucuccagacaauccgcg

SEQ ID NO: 1818865 - RNA, 13 nt, Salmonella typhimurium LT2
cagcgucaacugc

SEQ ID NO: 1818866 - RNA, 21 nt, Salmonella typhimurium LT2
cagcgggugaugcgccagcca

SEQ ID NO: 1818867 - RNA, 22 nt, Salmonella typhimurium LT2
cagcucaaccgcgcggcguucu

SEQ ID NO: 1818868 - RNA, 22 nt, Salmonella typhimurium LT2
cagcucaggguuuucuaccgca

SEQ ID NO: 1818869 - RNA, 17 nt, Salmonella typhimurium LT2
cagcucauaaacgcgau

SEQ ID NO: 1818870 - RNA, 14 nt, Salmonella typhimurium LT2
cagcucauaacggc

SEQ ID NO: 1818871 - RNA, 14 nt, Salmonella typhimurium LT2
cagcguguacggcc

SEQ ID NO: 1818872 - RNA, 22 nt, Salmonella typhimurium LT2
cagcggcugcaaagcaucugcc

SEQ ID NO: 1818873 - RNA, 19 nt, Salmonella typhimurium LT2
cagcggcgccaucaccauc

SEQ ID NO: 1818874 - RNA, 14 nt, Salmonella typhimurium LT2
cagcggccagggca

SEQ ID NO: 1818875 - RNA, 16 nt, Salmonella typhimurium LT2
cagcggccacagccag

SEQ ID NO: 1818876 - RNA, 23 nt, Salmonella typhimurium LT2
cagcgcuuuugccgcgcccagcg

SEQ ID NO: 1818877 - RNA, 16 nt, Salmonella typhimurium LT2
cagcggacggcuaaua

SEQ ID NO: 1818878 - RNA, 22 nt, Salmonella typhimurium LT2
cagcggaugguauuucaggcca

SEQ ID NO: 1818879 - RNA, 22 nt, Salmonella typhimurium LT2
cagcgcugcuguaacagacgca

SEQ ID NO: 1818880 - RNA, 15 nt, Salmonella typhimurium LT2
cagcgcuccgacaaa

SEQ ID NO: 1818881 - RNA, 15 nt, Salmonella typhimurium LT2
cagcgcuuagcggca

SEQ ID NO: 1818882 - RNA, 15 nt, Salmonella typhimurium LT2
cagcgcuccacgcgu

SEQ ID NO: 1818883 - RNA, 18 nt, Salmonella typhimurium LT2
cagcgcgucggccggcac

SEQ ID NO: 1818884 - RNA, 16 nt, Salmonella typhimurium LT2
cagcgcgucgaccaua

SEQ ID NO: 1818885 - RNA, 20 nt, Salmonella typhimurium LT2
cagcgcguccuccagcgugc

SEQ ID NO: 1818886 - RNA, 15 nt, Salmonella typhimurium LT2
cagcgcgguacggcc

SEQ ID NO: 1818887 - RNA, 13 nt, Salmonella typhimurium LT2
cagcgcgcguggg

SEQ ID NO: 1818888 - RNA, 18 nt, Salmonella typhimurium LT2
cagcgcgccgccaacgcc

SEQ ID NO: 1818889 - RNA, 16 nt, Salmonella typhimurium LT2
cagcgcgccgccaacg

SEQ ID NO: 1818890 - RNA, 20 nt, Salmonella typhimurium LT2
cagcgacugcuuccccaauu

SEQ ID NO: 1818891 - RNA, 22 nt, Salmonella typhimurium LT2
caggaacaugacggcagucgcu

SEQ ID NO: 1818892 - RNA, 14 nt, Salmonella typhimurium LT2
cagcuuauacugau

SEQ ID NO: 1818893 - RNA, 21 nt, Salmonella typhimurium LT2
cagcuguccggcuacaggcgu

SEQ ID NO: 1818894 - RNA, 21 nt, Salmonella typhimurium LT2
cagcuucacgcgcuguaacuu

SEQ ID NO: 1818895 - RNA, 10 nt, Salmonella typhimurium LT2
cagcuuccag

SEQ ID NO: 1818896 - RNA, 16 nt, Salmonella typhimurium LT2
cagcuucaucaucagc

SEQ ID NO: 1818897 - RNA, 12 nt, Salmonella typhimurium LT2
caggacgcgcgc

SEQ ID NO: 1818898 - RNA, 22 nt, Salmonella typhimurium LT2
caggagauugccccccagccau

SEQ ID NO: 1818899 - RNA, 13 nt, Salmonella typhimurium LT2
caggcagaacgcu

SEQ ID NO: 1818900 - RNA, 14 nt, Salmonella typhimurium LT2
caggaugccaacca

SEQ ID NO: 1818901 - RNA, 21 nt, Salmonella typhimurium LT2
caggaucgggaucagcgcgcu

SEQ ID NO: 1818902 - RNA, 13 nt, Salmonella typhimurium LT2
caggccucuaucu

SEQ ID NO: 1818903 - RNA, 23 nt, Salmonella typhimurium LT2
caggccucuaucuucucaggcga

SEQ ID NO: 1818904 - RNA, 15 nt, Salmonella typhimurium LT2
caggcauggccaaug

SEQ ID NO: 1818905 - RNA, 22 nt, Salmonella typhimurium LT2
caggcaugaccugccggauggc

SEQ ID NO: 1818906 - RNA, 18 nt, Salmonella typhimurium LT2
caggcaucgacgccagcg

SEQ ID NO: 1818907 - RNA, 13 nt, Salmonella typhimurium LT2
caggcaucgcgcc

SEQ ID NO: 1818908 - RNA, 17 nt, Salmonella typhimurium LT2
caggccaagcagcgcca

SEQ ID NO: 1818909 - RNA, 18 nt, Salmonella typhimurium LT2
caggccaauggcucaacu

SEQ ID NO: 1818910 - RNA, 19 nt, Salmonella typhimurium LT2
caggccagauagcuuuacg

SEQ ID NO: 1818911 - RNA, 14 nt, Salmonella typhimurium LT2
caggccaggcguug

SEQ ID NO: 1818912 - RNA, 22 nt, Salmonella typhimurium LT2
caggccaggguugcguucgcca

SEQ ID NO: 1818913 - RNA, 14 nt, Salmonella typhimurium LT2
caggccaucgacga

SEQ ID NO: 1818914 - RNA, 18 nt, Salmonella typhimurium LT2
caguaauuucuugcgcca

SEQ ID NO: 1818915 - RNA, 14 nt, Salmonella typhimurium LT2
cagguuuucaggcc

SEQ ID NO: 1818916 - RNA, 14 nt, Salmonella typhimurium LT2
cagguugucauagc

SEQ ID NO: 1818917 - RNA, 13 nt, Salmonella typhimurium LT2
cagucaucgcgcc

SEQ ID NO: 1818918 - RNA, 22 nt, Salmonella typhimurium LT2
cagguaucguauccggucaaua

SEQ ID NO: 1818919 - RNA, 20 nt, Salmonella typhimurium LT2
cagguauugaguaugccgua

SEQ ID NO: 1818920 - RNA, 20 nt, Salmonella typhimurium LT2
caggggcauuuuccggcgac

SEQ ID NO: 1818921 - RNA, 15 nt, Salmonella typhimurium LT2
cagggguuccggcaa

SEQ ID NO: 1818922 - RNA, 23 nt, Salmonella typhimurium LT2
caggguaucaucaauacgcgaca

SEQ ID NO: 1818923 - RNA, 20 nt, Salmonella typhimurium LT2
cagggcgauauccagcgcca

SEQ ID NO: 1818924 - RNA, 14 nt, Salmonella typhimurium LT2
cauaucaaucaacg

SEQ ID NO: 1818925 - RNA, 12 nt, Salmonella typhimurium LT2
cauauccagcgc

SEQ ID NO: 1818926 - RNA, 14 nt, Salmonella typhimurium LT2
cauauggcguuccg

SEQ ID NO: 1818927 - RNA, 22 nt, Salmonella typhimurium LT2
cauauuguauuggucuaucgcu

SEQ ID NO: 1818928 - RNA, 20 nt, Salmonella typhimurium LT2
caucacaucguaaaucagcg

SEQ ID NO: 1818929 - RNA, 20 nt, Salmonella typhimurium LT2
caucaaauaauacgccggca

SEQ ID NO: 1818930 - RNA, 21 nt, Salmonella typhimurium LT2
caucauaucuucccgauaacu

SEQ ID NO: 1818931 - RNA, 18 nt, Salmonella typhimurium LT2
caucaucggcacagccag

SEQ ID NO: 1818932 - RNA, 14 nt, Salmonella typhimurium LT2
caucaucugccauu

SEQ ID NO: 1818933 - RNA, 16 nt, Salmonella typhimurium LT2
caucacuggcguauug

SEQ ID NO: 1818934 - RNA, 19 nt, Salmonella typhimurium LT2
caucagauggcgauucaua

SEQ ID NO: 1818935 - RNA, 15 nt, Salmonella typhimurium LT2
caucauuacaggcga

SEQ ID NO: 1818936 - RNA, 14 nt, Salmonella typhimurium LT2
caucauugcuguua

SEQ ID NO: 1818937 - RNA, 21 nt, Salmonella typhimurium LT2
caucauuuccggcggcaaccc

SEQ ID NO: 1818938 - RNA, 14 nt, Salmonella typhimurium LT2
caucccguagcguc

SEQ ID NO: 1818939 - RNA, 20 nt, Salmonella typhimurium LT2
cauaccacaacagaaucgcg

SEQ ID NO: 1818940 - RNA, 17 nt, Salmonella typhimurium LT2
cauaccacgcagcggca

SEQ ID NO: 1818941 - RNA, 12 nt, Salmonella typhimurium LT2
cauaccagcgaa

SEQ ID NO: 1818942 - RNA, 17 nt, Salmonella typhimurium LT2
cauaaauugcagcgacc

SEQ ID NO: 1818943 - RNA, 17 nt, Salmonella typhimurium LT2
cauaacggcuacgcagc

SEQ ID NO: 1818944 - RNA, 15 nt, Salmonella typhimurium LT2
cauaacuugccgccu

SEQ ID NO: 1818945 - RNA, 12 nt, Salmonella typhimurium LT2
cauaaaucagau

SEQ ID NO: 1818946 - RNA, 20 nt, Salmonella typhimurium LT2
caguuugcguucacagcacc

SEQ ID NO: 1818947 - RNA, 18 nt, Salmonella typhimurium LT2
caguuuuccuucagcagc

SEQ ID NO: 1818948 - RNA, 22 nt, Salmonella typhimurium LT2
caguuucuucggcuucaccgau

SEQ ID NO: 1818949 - RNA, 20 nt, Salmonella typhimurium LT2
caguuucuucgcccacggca

SEQ ID NO: 1818950 - RNA, 16 nt, Salmonella typhimurium LT2
caguuuaaagccaauc

SEQ ID NO: 1818951 - RNA, 21 nt, Salmonella typhimurium LT2
caguuuacccagcgaaugcug

SEQ ID NO: 1818952 - RNA, 19 nt, Salmonella typhimurium LT2
cauacggguaaaggcauua

SEQ ID NO: 1818953 - RNA, 13 nt, Salmonella typhimurium LT2
cauacggucgaua

SEQ ID NO: 1818954 - RNA, 15 nt, Salmonella typhimurium LT2
cauaccaggcgcacc

SEQ ID NO: 1818955 - RNA, 12 nt, Salmonella typhimurium LT2
cauauaacagaa

SEQ ID NO: 1818956 - RNA, 24 nt, Salmonella typhimurium LT2
cagugccgguugccugauggcgcu

SEQ ID NO: 1818957 - RNA, 13 nt, Salmonella typhimurium LT2
cagucgccaggca

SEQ ID NO: 1818958 - RNA, 23 nt, Salmonella typhimurium LT2
caguucaauauucacuucgccca

SEQ ID NO: 1818959 - RNA, 18 nt, Salmonella typhimurium LT2
caguucaggaacaucagc

SEQ ID NO: 1818960 - RNA, 19 nt, Salmonella typhimurium LT2
caguuggcguaccaucagc

SEQ ID NO: 1818961 - RNA, 15 nt, Salmonella typhimurium LT2
caguugcgucagcgc

SEQ ID NO: 1818962 - RNA, 13 nt, Salmonella typhimurium LT2
caguugcagcacc

SEQ ID NO: 1818963 - RNA, 15 nt, Salmonella typhimurium LT2
caguugcagcguacg

SEQ ID NO: 1818964 - RNA, 15 nt, Salmonella typhimurium LT2
caguugccaggguuc

SEQ ID NO: 1818965 - RNA, 14 nt, Salmonella typhimurium LT2
caguucagccgcca

SEQ ID NO: 1818966 - RNA, 23 nt, Salmonella typhimurium LT2
cacgguuaucuggcgcaaccggc

SEQ ID NO: 1818967 - RNA, 11 nt, Salmonella typhimurium LT2
cacggcgcaca

SEQ ID NO: 1818968 - RNA, 19 nt, Salmonella typhimurium LT2
cacggcgucaauuccgcgc

SEQ ID NO: 1818969 - RNA, 14 nt, Salmonella typhimurium LT2
cacggcaacggauu

SEQ ID NO: 1818970 - RNA, 12 nt, Salmonella typhimurium LT2
cacggcaacgcc

SEQ ID NO: 1818971 - RNA, 22 nt, Salmonella typhimurium LT2
cacgcgcgcuuuucgccagcgc

SEQ ID NO: 1818972 - RNA, 20 nt, Salmonella typhimurium LT2
cacgcgcgcugcgccuggaa

SEQ ID NO: 1818973 - RNA, 13 nt, Salmonella typhimurium LT2
cacuucauccgga

SEQ ID NO: 1818974 - RNA, 15 nt, Salmonella typhimurium LT2
cacuucagccggaua

SEQ ID NO: 1818975 - RNA, 16 nt, Salmonella typhimurium LT2
cacuguucggcgggga

SEQ ID NO: 1818976 - RNA, 20 nt, Salmonella typhimurium LT2
cacugguuauccgggcugaa

SEQ ID NO: 1818977 - RNA, 13 nt, Salmonella typhimurium LT2
cacuguccugacg

SEQ ID NO: 1818978 - RNA, 19 nt, Salmonella typhimurium LT2
cacuggcgacggcaucggc

SEQ ID NO: 1818979 - RNA, 20 nt, Salmonella typhimurium LT2
cacuggcgacggcaucggca

SEQ ID NO: 1818980 - RNA, 17 nt, Salmonella typhimurium LT2
cagaacccggcuuaucg

SEQ ID NO: 1818981 - RNA, 14 nt, Salmonella typhimurium LT2
cagaagcgucauaa

SEQ ID NO: 1818982 - RNA, 23 nt, Salmonella typhimurium LT2
cagaaccguugcgcccaucauca

SEQ ID NO: 1818983 - RNA, 14 nt, Salmonella typhimurium LT2
cacugcccagagaa

SEQ ID NO: 1818984 - RNA, 19 nt, Salmonella typhimurium LT2
cacugcuguagcgucucau

SEQ ID NO: 1818985 - RNA, 20 nt, Salmonella typhimurium LT2
cacucgauggcuuucuaccu

SEQ ID NO: 1818986 - RNA, 22 nt, Salmonella typhimurium LT2
caccuguccgguguccaucagg

SEQ ID NO: 1818987 - RNA, 12 nt, Salmonella typhimurium LT2
caccuuauccgg

SEQ ID NO: 1818988 - RNA, 15 nt, Salmonella typhimurium LT2
caccuuauccggccu

SEQ ID NO: 1818989 - RNA, 13 nt, Salmonella typhimurium LT2
caccuuugacgcc

SEQ ID NO: 1818990 - RNA, 15 nt, Salmonella typhimurium LT2
caccuuguccggcgc

SEQ ID NO: 1818991 - RNA, 16 nt, Salmonella typhimurium LT2
caccugaauaacccgc

SEQ ID NO: 1818992 - RNA, 23 nt, Salmonella typhimurium LT2
caccugaauauccugaugcgccu

SEQ ID NO: 1818993 - RNA, 20 nt, Salmonella typhimurium LT2
cacgccagucaccagcagca

SEQ ID NO: 1818994 - RNA, 17 nt, Salmonella typhimurium LT2
cacgcccgcggcaugau

SEQ ID NO: 1818995 - RNA, 20 nt, Salmonella typhimurium LT2
cacgcccgccaucgccgccu

SEQ ID NO: 1818996 - RNA, 13 nt, Salmonella typhimurium LT2
cacgccgccgcgu

SEQ ID NO: 1818997 - RNA, 21 nt, Salmonella typhimurium LT2
cacgcgacaaugccauaaagc

SEQ ID NO: 1818998 - RNA, 14 nt, Salmonella typhimurium LT2
cacgccuuccuggu

SEQ ID NO: 1818999 - RNA, 14 nt, Salmonella typhimurium LT2
cacgccuuuaagcu

SEQ ID NO: 1819000 - RNA, 17 nt, Salmonella typhimurium LT2
cacgccagcgguugcgg

SEQ ID NO: 1819001 - RNA, 14 nt, Salmonella typhimurium LT2
cacgcauaucccac

SEQ ID NO: 1819002 - RNA, 11 nt, Salmonella typhimurium LT2
cacgccaauag

SEQ ID NO: 1819003 - RNA, 12 nt, Salmonella typhimurium LT2
cacgcagacgcc

SEQ ID NO: 1819004 - RNA, 18 nt, Salmonella typhimurium LT2
cacgauaaauugccugau

SEQ ID NO: 1819005 - RNA, 15 nt, Salmonella typhimurium LT2
cacgaguuaucgauu

SEQ ID NO: 1819006 - RNA, 23 nt, Salmonella typhimurium LT2
cacgaguaauuugugaucgucgc

SEQ ID NO: 1819007 - RNA, 15 nt, Salmonella typhimurium LT2
cacgacuuucaccag

SEQ ID NO: 1819008 - RNA, 23 nt, Salmonella typhimurium LT2
cacgacuuuuccuuccgccgcaa

SEQ ID NO: 1819009 - RNA, 19 nt, Salmonella typhimurium LT2
cacgauggucggcgcuggc

SEQ ID NO: 1819010 - RNA, 20 nt, Salmonella typhimurium LT2
cacgcacagcggauggcuga

SEQ ID NO: 1819011 - RNA, 14 nt, Salmonella typhimurium LT2
cacgcaacaggccg

SEQ ID NO: 1819012 - RNA, 13 nt, Salmonella typhimurium LT2
cacgcaaaccgcu

SEQ ID NO: 1819013 - RNA, 21 nt, Salmonella typhimurium LT2
cagauaguuagcuaucgcgcc

SEQ ID NO: 1819014 - RNA, 22 nt, Salmonella typhimurium LT2
cagauuaaagcagguagcgccu

SEQ ID NO: 1819015 - RNA, 19 nt, Salmonella typhimurium LT2
cagauggugauagcgcgcc

SEQ ID NO: 1819016 - RNA, 18 nt, Salmonella typhimurium LT2
cagauggcaaacgguaaa

SEQ ID NO: 1819017 - RNA, 19 nt, Salmonella typhimurium LT2
cagauggcggcugcgccuu

SEQ ID NO: 1819018 - RNA, 21 nt, Salmonella typhimurium LT2
cagaauuucuacacagcgcga

SEQ ID NO: 1819019 - RNA, 22 nt, Salmonella typhimurium LT2
cagauaauucucuuugacgacc

SEQ ID NO: 1819020 - RNA, 21 nt, Salmonella typhimurium LT2
cagauagucguuaaaacggua

SEQ ID NO: 1819021 - RNA, 15 nt, Salmonella typhimurium LT2
cagauagccugccag

SEQ ID NO: 1819022 - RNA, 19 nt, Salmonella typhimurium LT2
cagauagccugccagcacc

SEQ ID NO: 1819023 - RNA, 17 nt, Salmonella typhimurium LT2
cagauagagcauaauaa

SEQ ID NO: 1819024 - RNA, 13 nt, Salmonella typhimurium LT2
cagaauauugaca

SEQ ID NO: 1819025 - RNA, 20 nt, Salmonella typhimurium LT2
cagaaugcccugcuguucca

SEQ ID NO: 1819026 - RNA, 14 nt, Salmonella typhimurium LT2
cagcacaaucagcg

SEQ ID NO: 1819027 - RNA, 20 nt, Salmonella typhimurium LT2
cagcacaaucagcgcggcga

SEQ ID NO: 1819028 - RNA, 18 nt, Salmonella typhimurium LT2
cagcacaaagugcgcugu

SEQ ID NO: 1819029 - RNA, 17 nt, Salmonella typhimurium LT2
cagcaauguuucaaccu

SEQ ID NO: 1819030 - RNA, 13 nt, Salmonella typhimurium LT2
cagcacccaggca

SEQ ID NO: 1819031 - RNA, 16 nt, Salmonella typhimurium LT2
cagcaccgccagcgca

SEQ ID NO: 1819032 - RNA, 17 nt, Salmonella typhimurium LT2
cagcaccgccagcgcau

SEQ ID NO: 1819033 - RNA, 15 nt, Salmonella typhimurium LT2
cagcacgacagagau

SEQ ID NO: 1819034 - RNA, 17 nt, Salmonella typhimurium LT2
cagcaccuugccguccg

SEQ ID NO: 1819035 - RNA, 13 nt, Salmonella typhimurium LT2
cagcagcugcugu

SEQ ID NO: 1819036 - RNA, 16 nt, Salmonella typhimurium LT2
cagcagcuucgccaga

SEQ ID NO: 1819037 - RNA, 15 nt, Salmonella typhimurium LT2
cagcagcuccagagc

SEQ ID NO: 1819038 - RNA, 14 nt, Salmonella typhimurium LT2
cagcagcagcgcuu

SEQ ID NO: 1819039 - RNA, 19 nt, Salmonella typhimurium LT2
cagcagacaaccgacgcau

SEQ ID NO: 1819040 - RNA, 12 nt, Salmonella typhimurium LT2
cagcacgccgga

SEQ ID NO: 1819041 - RNA, 21 nt, Salmonella typhimurium LT2
cagccaacaaagaggcugcgc

SEQ ID NO: 1819042 - RNA, 19 nt, Salmonella typhimurium LT2
cagccaacaguauagaaau

SEQ ID NO: 1819043 - RNA, 20 nt, Salmonella typhimurium LT2
cagccacuggcuggucagcg

SEQ ID NO: 1819044 - RNA, 18 nt, Salmonella typhimurium LT2
cagccacuucuuccagcg

SEQ ID NO: 1819045 - RNA, 14 nt, Salmonella typhimurium LT2
cagccagcccagcg

SEQ ID NO: 1819046 - RNA, 17 nt, Salmonella typhimurium LT2
cagcaugcccgccagcg

SEQ ID NO: 1819047 - RNA, 13 nt, Salmonella typhimurium LT2
cagccaaacugcu

SEQ ID NO: 1819048 - RNA, 17 nt, Salmonella typhimurium LT2
cagcauugggccgauaa

SEQ ID NO: 1819049 - RNA, 22 nt, Salmonella typhimurium LT2
cagcaggacaaccccuacgcag

SEQ ID NO: 1819050 - RNA, 15 nt, Salmonella typhimurium LT2
cagcauauccagcgc

SEQ ID NO: 1819051 - RNA, 14 nt, Salmonella typhimurium LT2
cagcauauccagcg

SEQ ID NO: 1819052 - RNA, 13 nt, Salmonella typhimurium LT2
cagcauacgccgc

SEQ ID NO: 1819053 - RNA, 14 nt, Salmonella typhimurium LT2
cagcaggcagacgc

SEQ ID NO: 1819054 - RNA, 16 nt, Salmonella typhimurium LT2
cagcauauccagcgcc

SEQ ID NO: 1819055 - RNA, 19 nt, Salmonella typhimurium LT2
cagcauccacgccacaaua

SEQ ID NO: 1819056 - RNA, 20 nt, Salmonella typhimurium LT2
cagcccaaaacgcgccaggu

SEQ ID NO: 1819057 - RNA, 15 nt, Salmonella typhimurium LT2
cagccagcgccagcg

SEQ ID NO: 1819058 - RNA, 17 nt, Salmonella typhimurium LT2
cagcccgccagcaccag

SEQ ID NO: 1819059 - RNA, 12 nt, Salmonella typhimurium LT2
cagccgccagua

SEQ ID NO: 1819060 - RNA, 12 nt, Salmonella typhimurium LT2
cagccgccaguu

SEQ ID NO: 1819061 - RNA, 21 nt, Salmonella typhimurium LT2
cagccggaaaucaauuccggu

SEQ ID NO: 1819062 - RNA, 23 nt, Salmonella typhimurium LT2
cagccgcucaauaauauccugcc

SEQ ID NO: 1819063 - RNA, 19 nt, Salmonella typhimurium LT2
cagccugagcgccagcgug

SEQ ID NO: 1819064 - RNA, 12 nt, Salmonella typhimurium LT2
cagccugccguc

SEQ ID NO: 1819065 - RNA, 17 nt, Salmonella typhimurium LT2
cagcgacggaaccgucu

SEQ ID NO: 1819066 - RNA, 17 nt, Salmonella typhimurium LT2
cgcacgaacauaccgga

SEQ ID NO: 1819067 - RNA, 16 nt, Salmonella typhimurium LT2
cgcaccuucaucauuc

SEQ ID NO: 1819068 - RNA, 12 nt, Salmonella typhimurium LT2
cgcacgccagcg

SEQ ID NO: 1819069 - RNA, 18 nt, Salmonella typhimurium LT2
cgcacgcccaucggcaca

SEQ ID NO: 1819070 - RNA, 18 nt, Salmonella typhimurium LT2
cgcacugauagccgccag

SEQ ID NO: 1819071 - RNA, 14 nt, Salmonella typhimurium LT2
cgcacucgccgcca

SEQ ID NO: 1819072 - RNA, 18 nt, Salmonella typhimurium LT2
cgcacguucagcucagcg

SEQ ID NO: 1819073 - RNA, 16 nt, Salmonella typhimurium LT2
cgcagcgaaaauccag

SEQ ID NO: 1819074 - RNA, 20 nt, Salmonella typhimurium LT2
cgcagcgacuucaggcgcua

SEQ ID NO: 1819075 - RNA, 17 nt, Salmonella typhimurium LT2
cgcagccugauggcgac

SEQ ID NO: 1819076 - RNA, 15 nt, Salmonella typhimurium LT2
cgcagccacggcgca

SEQ ID NO: 1819077 - RNA, 18 nt, Salmonella typhimurium LT2
cgcagcaggccaucauug

SEQ ID NO: 1819078 - RNA, 22 nt, Salmonella typhimurium LT2
cgcagccaguacgcguucuacg

SEQ ID NO: 1819079 - RNA, 19 nt, Salmonella typhimurium LT2
cgcaggcccgauaagcgcc

SEQ ID NO: 1819080 - RNA, 16 nt, Salmonella typhimurium LT2
cgcaggcuaacgcgcc

SEQ ID NO: 1819081 - RNA, 20 nt, Salmonella typhimurium LT2
cgcaggcggucagcacagcg

SEQ ID NO: 1819082 - RNA, 21 nt, Salmonella typhimurium LT2
cgcaggucauuggggacgcgc

SEQ ID NO: 1819083 - RNA, 19 nt, Salmonella typhimurium LT2
cgcaggacggcccguaaua

SEQ ID NO: 1819084 - RNA, 14 nt, Salmonella typhimurium LT2
cgcagcgcgcgacc

SEQ ID NO: 1819085 - RNA, 15 nt, Salmonella typhimurium LT2
cgcaggcauccgguu

SEQ ID NO: 1819086 - RNA, 17 nt, Salmonella typhimurium LT2
cgcagcgcccagcagcu

SEQ ID NO: 1819087 - RNA, 19 nt, Salmonella typhimurium LT2
cgcagcgccaucaggccua

SEQ ID NO: 1819088 - RNA, 14 nt, Salmonella typhimurium LT2
cgcagcgccauccg

SEQ ID NO: 1819089 - RNA, 11 nt, Salmonella typhimurium LT2
cgcagcgccga

SEQ ID NO: 1819090 - RNA, 15 nt, Salmonella typhimurium LT2
cgccaagcugcagaa

SEQ ID NO: 1819091 - RNA, 16 nt, Salmonella typhimurium LT2
cgcauuuaaucgccug

SEQ ID NO: 1819092 - RNA, 17 nt, Salmonella typhimurium LT2
cgcauugguaucggcag

SEQ ID NO: 1819093 - RNA, 15 nt, Salmonella typhimurium LT2
cgcauuuuuaucaga

SEQ ID NO: 1819094 - RNA, 20 nt, Salmonella typhimurium LT2
cgccacccauuuuccgcugu

SEQ ID NO: 1819095 - RNA, 15 nt, Salmonella typhimurium LT2
cgccaccaugcuggu

SEQ ID NO: 1819096 - RNA, 15 nt, Salmonella typhimurium LT2
cgccaccagcgcagu

SEQ ID NO: 1819097 - RNA, 13 nt, Salmonella typhimurium LT2
cgccacaucauug

SEQ ID NO: 1819098 - RNA, 16 nt, Salmonella typhimurium LT2
cgccaccacucggcga

SEQ ID NO: 1819099 - RNA, 14 nt, Salmonella typhimurium LT2
cgcaugguaaacgc

SEQ ID NO: 1819100 - RNA, 15 nt, Salmonella typhimurium LT2
cgcauggcagggcga

SEQ ID NO: 1819101 - RNA, 17 nt, Salmonella typhimurium LT2
cgcauggcguggauagc

SEQ ID NO: 1819102 - RNA, 14 nt, Salmonella typhimurium LT2
cgcauggccugaua

SEQ ID NO: 1819103 - RNA, 23 nt, Salmonella typhimurium LT2
cgcaugaaacgccagaucguuaa

SEQ ID NO: 1819104 - RNA, 15 nt, Salmonella typhimurium LT2
cgcaucgggaaacgg

SEQ ID NO: 1819105 - RNA, 18 nt, Salmonella typhimurium LT2
cgcauccucuuuccguua

SEQ ID NO: 1819106 - RNA, 23 nt, Salmonella typhimurium LT2
cgcauccuguaccaccacgccuu

SEQ ID NO: 1819107 - RNA, 23 nt, Salmonella typhimurium LT2
cgcauccggcuacgggcgguuaa

SEQ ID NO: 1819108 - RNA, 18 nt, Salmonella typhimurium LT2
cgcauccggccagcgaca

SEQ ID NO: 1819109 - RNA, 22 nt, Salmonella typhimurium LT2
cgcaguaaucaccgucuccggc

SEQ ID NO: 1819110 - RNA, 18 nt, Salmonella typhimurium LT2
cgccagcggcgccaucac

SEQ ID NO: 1819111 - RNA, 22 nt, Salmonella typhimurium LT2
cgccagcgguguuugccagacg

SEQ ID NO: 1819112 - RNA, 23 nt, Salmonella typhimurium LT2
cgccagcuuaucgaccagcguua

SEQ ID NO: 1819113 - RNA, 17 nt, Salmonella typhimurium LT2
cgccagcggccagcgua

SEQ ID NO: 1819114 - RNA, 12 nt, Salmonella typhimurium LT2
cgccagcggcgc

SEQ ID NO: 1819115 - RNA, 17 nt, Salmonella typhimurium LT2
cgccagcgccagcagca

SEQ ID NO: 1819116 - RNA, 18 nt, Salmonella typhimurium LT2
cgccagccgaucaucgua

SEQ ID NO: 1819117 - RNA, 16 nt, Salmonella typhimurium LT2
cgccagccgcagcuca

SEQ ID NO: 1819118 - RNA, 15 nt, Salmonella typhimurium LT2
cgccagccaguccgu

SEQ ID NO: 1819119 - RNA, 13 nt, Salmonella typhimurium LT2
cgccagccauucg

SEQ ID NO: 1819120 - RNA, 15 nt, Salmonella typhimurium LT2
cgccagcagcggcga

SEQ ID NO: 1819121 - RNA, 23 nt, Salmonella typhimurium LT2
cgccagauuaucggccagcgcca

SEQ ID NO: 1819122 - RNA, 15 nt, Salmonella typhimurium LT2
cgccagauggcguca

SEQ ID NO: 1819123 - RNA, 23 nt, Salmonella typhimurium LT2
cgccagauguaggccugauaagc

SEQ ID NO: 1819124 - RNA, 15 nt, Salmonella typhimurium LT2
cgccacggucggcaa

SEQ ID NO: 1819125 - RNA, 14 nt, Salmonella typhimurium LT2
cgccacggcuuuua

SEQ ID NO: 1819126 - RNA, 19 nt, Salmonella typhimurium LT2
cgccagaaaaaaaagcgcc

SEQ ID NO: 1819127 - RNA, 15 nt, Salmonella typhimurium LT2
cgccacuuccgcuac

SEQ ID NO: 1819128 - RNA, 20 nt, Salmonella typhimurium LT2
cgccacuguccugacggcga

SEQ ID NO: 1819129 - RNA, 18 nt, Salmonella typhimurium LT2
cgccaccgcugcgcucac

SEQ ID NO: 1819130 - RNA, 22 nt, Salmonella typhimurium LT2
cgccacgccauugcugucgaca

SEQ ID NO: 1819131 - RNA, 16 nt, Salmonella typhimurium LT2
cgccacgcccagcgag

SEQ ID NO: 1819132 - RNA, 22 nt, Salmonella typhimurium LT2
cgaguucucgccggauggcgac

SEQ ID NO: 1819133 - RNA, 14 nt, Salmonella typhimurium LT2
cgauaccgguaauc

SEQ ID NO: 1819134 - RNA, 18 nt, Salmonella typhimurium LT2
cgaucaccagcgcaucgc

SEQ ID NO: 1819135 - RNA, 21 nt, Salmonella typhimurium LT2
cgaucacccacaucagcggca

SEQ ID NO: 1819136 - RNA, 14 nt, Salmonella typhimurium LT2
cgaucaccagcgca

SEQ ID NO: 1819137 - RNA, 18 nt, Salmonella typhimurium LT2
cgauacuccauugucggc

SEQ ID NO: 1819138 - RNA, 13 nt, Salmonella typhimurium LT2
cgauccagaccgg

SEQ ID NO: 1819139 - RNA, 18 nt, Salmonella typhimurium LT2
cgagugaaccggacgcuu

SEQ ID NO: 1819140 - RNA, 21 nt, Salmonella typhimurium LT2
cgaguagcaaaucccgguaaa

SEQ ID NO: 1819141 - RNA, 18 nt, Salmonella typhimurium LT2
cgaguauucgcgcccuca

SEQ ID NO: 1819142 - RNA, 17 nt, Salmonella typhimurium LT2
cgagguucccgccgcca

SEQ ID NO: 1819143 - RNA, 16 nt, Salmonella typhimurium LT2
cgaguaauuugugauc

SEQ ID NO: 1819144 - RNA, 14 nt, Salmonella typhimurium LT2
cgagcgggucagga

SEQ ID NO: 1819145 - RNA, 18 nt, Salmonella typhimurium LT2
cgagguacuugacgucgc

SEQ ID NO: 1819146 - RNA, 15 nt, Salmonella typhimurium LT2
cgauuugcgcucgcg

SEQ ID NO: 1819147 - RNA, 23 nt, Salmonella typhimurium LT2
cgauuucguucuuucugccaucg

SEQ ID NO: 1819148 - RNA, 19 nt, Salmonella typhimurium LT2
cgcaaauucgucgccgcca

SEQ ID NO: 1819149 - RNA, 17 nt, Salmonella typhimurium LT2
cgcaaaugaccagauca

SEQ ID NO: 1819150 - RNA, 19 nt, Salmonella typhimurium LT2
cgcaaaggcguugugcugc

SEQ ID NO: 1819151 - RNA, 22 nt, Salmonella typhimurium LT2
cgcaacaggccgcaucgggaaa

SEQ ID NO: 1819152 - RNA, 15 nt, Salmonella typhimurium LT2
cgauguuaaagguca

SEQ ID NO: 1819153 - RNA, 12 nt, Salmonella typhimurium LT2
cgauugaucgga

SEQ ID NO: 1819154 - RNA, 14 nt, Salmonella typhimurium LT2
cgauuuccagcgaa

SEQ ID NO: 1819155 - RNA, 22 nt, Salmonella typhimurium LT2
cgauuucacgaauaucgacguu

SEQ ID NO: 1819156 - RNA, 18 nt, Salmonella typhimurium LT2
cgauggagucgccgguug

SEQ ID NO: 1819157 - RNA, 14 nt, Salmonella typhimurium LT2
cgauguaucacguu

SEQ ID NO: 1819158 - RNA, 19 nt, Salmonella typhimurium LT2
cgauguaagaggccguagc

SEQ ID NO: 1819159 - RNA, 23 nt, Salmonella typhimurium LT2
cgaugcacaacacgcuuuucagc

SEQ ID NO: 1819160 - RNA, 12 nt, Salmonella typhimurium LT2
cgaugcacgcca

SEQ ID NO: 1819161 - RNA, 18 nt, Salmonella typhimurium LT2
cgaucguccgccuccggc

SEQ ID NO: 1819162 - RNA, 16 nt, Salmonella typhimurium LT2
cgaucucccagccggg

SEQ ID NO: 1819163 - RNA, 21 nt, Salmonella typhimurium LT2
cgaucgugauaaagcugacgc

SEQ ID NO: 1819164 - RNA, 19 nt, Salmonella typhimurium LT2
cgacgcguagguguuacgc

SEQ ID NO: 1819165 - RNA, 13 nt, Salmonella typhimurium LT2
cgacgccaggcgg

SEQ ID NO: 1819166 - RNA, 15 nt, Salmonella typhimurium LT2
cgacgcccaauccgg

SEQ ID NO: 1819167 - RNA, 14 nt, Salmonella typhimurium LT2
cgacgcccaccagu

SEQ ID NO: 1819168 - RNA, 16 nt, Salmonella typhimurium LT2
cgacgccgauaaagcc

SEQ ID NO: 1819169 - RNA, 22 nt, Salmonella typhimurium LT2
cgaccgcgauaaccaucaguuc

SEQ ID NO: 1819170 - RNA, 11 nt, Salmonella typhimurium LT2
cgaccggcagc

SEQ ID NO: 1819171 - RNA, 15 nt, Salmonella typhimurium LT2
cgaccggggcguuca

SEQ ID NO: 1819172 - RNA, 19 nt, Salmonella typhimurium LT2
cgaccggcucgcuguucgc

SEQ ID NO: 1819173 - RNA, 16 nt, Salmonella typhimurium LT2
cgacaucgcuuccgua

SEQ ID NO: 1819174 - RNA, 23 nt, Salmonella typhimurium LT2
cgagagugacgacgccaggcggu

SEQ ID NO: 1819175 - RNA, 15 nt, Salmonella typhimurium LT2
cgagcaguacgccug

SEQ ID NO: 1819176 - RNA, 12 nt, Salmonella typhimurium LT2
cgagcgccugau

SEQ ID NO: 1819177 - RNA, 15 nt, Salmonella typhimurium LT2
cgagcgccguaccgc

SEQ ID NO: 1819178 - RNA, 22 nt, Salmonella typhimurium LT2
cgagcggccaaagggagcagac

SEQ ID NO: 1819179 - RNA, 19 nt, Salmonella typhimurium LT2
cgacuuuuuccggcuguuu

SEQ ID NO: 1819180 - RNA, 21 nt, Salmonella typhimurium LT2
cgacuuucacgaaaccggcga

SEQ ID NO: 1819181 - RNA, 16 nt, Salmonella typhimurium LT2
cgacuuuccgccacca

SEQ ID NO: 1819182 - RNA, 16 nt, Salmonella typhimurium LT2
cgagaagcccagcuca

SEQ ID NO: 1819183 - RNA, 16 nt, Salmonella typhimurium LT2
cgagaacugcugcauc

SEQ ID NO: 1819184 - RNA, 14 nt, Salmonella typhimurium LT2
cgacucauucagca

SEQ ID NO: 1819185 - RNA, 14 nt, Salmonella typhimurium LT2
cgacucacgcgcgc

SEQ ID NO: 1819186 - RNA, 18 nt, Salmonella typhimurium LT2
cgacuggcgugaccgaua

SEQ ID NO: 1819187 - RNA, 15 nt, Salmonella typhimurium LT2
cgacguugccaggcg

SEQ ID NO: 1819188 - RNA, 13 nt, Salmonella typhimurium LT2
cgacgugacgcgc

SEQ ID NO: 1819189 - RNA, 23 nt, Salmonella typhimurium LT2
cgacgguacaaaccccacccgcu

SEQ ID NO: 1819190 - RNA, 16 nt, Salmonella typhimurium LT2
ccuggcugaaccaggc

SEQ ID NO: 1819191 - RNA, 12 nt, Salmonella typhimurium LT2
ccuggcggauac

SEQ ID NO: 1819192 - RNA, 17 nt, Salmonella typhimurium LT2
ccugccgcgaucgcggc

SEQ ID NO: 1819193 - RNA, 19 nt, Salmonella typhimurium LT2
ccugccguuuuccagccgu

SEQ ID NO: 1819194 - RNA, 12 nt, Salmonella typhimurium LT2
ccuggccggaaa

SEQ ID NO: 1819195 - RNA, 20 nt, Salmonella typhimurium LT2
ccuguaaccuuaaaaggcgc

SEQ ID NO: 1819196 - RNA, 22 nt, Salmonella typhimurium LT2
ccuggguauuuuuuagcgccaa

SEQ ID NO: 1819197 - RNA, 20 nt, Salmonella typhimurium LT2
ccugguaagcgcagcgccac

SEQ ID NO: 1819198 - RNA, 14 nt, Salmonella typhimurium LT2
ccugguacaucgcg

SEQ ID NO: 1819199 - RNA, 15 nt, Salmonella typhimurium LT2
cgaaagucuguucgu

SEQ ID NO: 1819200 - RNA, 20 nt, Salmonella typhimurium LT2
cgaaauacggacgccagaua

SEQ ID NO: 1819201 - RNA, 13 nt, Salmonella typhimurium LT2
cgaaacggcagcg

SEQ ID NO: 1819202 - RNA, 22 nt, Salmonella typhimurium LT2
ccuuucgguucgccgcgcgcau

SEQ ID NO: 1819203 - RNA, 17 nt, Salmonella typhimurium LT2
ccuucgcauagccggau

SEQ ID NO: 1819204 - RNA, 22 nt, Salmonella typhimurium LT2
ccuucauggcguucgccgcaug

SEQ ID NO: 1819205 - RNA, 19 nt, Salmonella typhimurium LT2
ccuucauuaauuuucacgc

SEQ ID NO: 1819206 - RNA, 22 nt, Salmonella typhimurium LT2
ccuucggucguuugccgugcau

SEQ ID NO: 1819207 - RNA, 19 nt, Salmonella typhimurium LT2
cgacagaauaugcauauuc

SEQ ID NO: 1819208 - RNA, 17 nt, Salmonella typhimurium LT2
cgacagagccaacagaa

SEQ ID NO: 1819209 - RNA, 12 nt, Salmonella typhimurium LT2
cgacacaggcgu

SEQ ID NO: 1819210 - RNA, 15 nt, Salmonella typhimurium LT2
cgacaauguccgcca

SEQ ID NO: 1819211 - RNA, 17 nt, Salmonella typhimurium LT2
cgacaauauuuuucagc

SEQ ID NO: 1819212 - RNA, 22 nt, Salmonella typhimurium LT2
cgacaauauuaccuucgcguaa

SEQ ID NO: 1819213 - RNA, 18 nt, Salmonella typhimurium LT2
cgacaauccgccacgcuc

SEQ ID NO: 1819214 - RNA, 19 nt, Salmonella typhimurium LT2
cgacagggguguuacgcca

SEQ ID NO: 1819215 - RNA, 13 nt, Salmonella typhimurium LT2
cgacaucacgcaa

SEQ ID NO: 1819216 - RNA, 23 nt, Salmonella typhimurium LT2
cgacauauuuucgaugcacgcca

SEQ ID NO: 1819217 - RNA, 17 nt, Salmonella typhimurium LT2
cgacaguaccagcagaa

SEQ ID NO: 1819218 - RNA, 19 nt, Salmonella typhimurium LT2
cgacaucagccagccgcca

SEQ ID NO: 1819219 - RNA, 12 nt, Salmonella typhimurium LT2
cgacauccgcca

SEQ ID NO: 1819220 - RNA, 16 nt, Salmonella typhimurium LT2
cgaaucacauccgcca

SEQ ID NO: 1819221 - RNA, 18 nt, Salmonella typhimurium LT2
cgaauagugauaccagcc

SEQ ID NO: 1819222 - RNA, 23 nt, Salmonella typhimurium LT2
cgaauagcgccuacgggcauucc

SEQ ID NO: 1819223 - RNA, 13 nt, Salmonella typhimurium LT2
cgaauagcgccag

SEQ ID NO: 1819224 - RNA, 15 nt, Salmonella typhimurium LT2
cgaauaaaauucagc

SEQ ID NO: 1819225 - RNA, 14 nt, Salmonella typhimurium LT2
cgaauaaaacugcc

SEQ ID NO: 1819226 - RNA, 22 nt, Salmonella typhimurium LT2
cgaaggcgacgcgauagcgcag

SEQ ID NO: 1819227 - RNA, 17 nt, Salmonella typhimurium LT2
cgaauuugccccagaua

SEQ ID NO: 1819228 - RNA, 14 nt, Salmonella typhimurium LT2
cgacaacaagucca

SEQ ID NO: 1819229 - RNA, 16 nt, Salmonella typhimurium LT2
cgacaacggaucgcaa

SEQ ID NO: 1819230 - RNA, 14 nt, Salmonella typhimurium LT2
cgaaucccgcguuc

SEQ ID NO: 1819231 - RNA, 20 nt, Salmonella typhimurium LT2
cgaaaugacagccaccagcg

SEQ ID NO: 1819232 - RNA, 18 nt, Salmonella typhimurium LT2
cgaaauuggccaucaggu

SEQ ID NO: 1819233 - RNA, 22 nt, Salmonella typhimurium LT2
cgaaccugcgccgguuccggca

SEQ ID NO: 1819234 - RNA, 18 nt, Salmonella typhimurium LT2
cgaacuccagcgcgacgc

SEQ ID NO: 1819235 - RNA, 15 nt, Salmonella typhimurium LT2
cgaaggaugaccggc

SEQ ID NO: 1819236 - RNA, 18 nt, Salmonella typhimurium LT2
cgaaggccagcaccagcg

SEQ ID NO: 1819237 - RNA, 22 nt, Salmonella typhimurium LT2
cgaagaccgcaucacggcagca

SEQ ID NO: 1819238 - RNA, 14 nt, Salmonella typhimurium LT2
cgaagaauucgcaa

SEQ ID NO: 1819239 - RNA, 19 nt, Salmonella typhimurium LT2
ccgcgauagaccacgccau

SEQ ID NO: 1819240 - RNA, 23 nt, Salmonella typhimurium LT2
ccgcgauagguugaauaaccaua

SEQ ID NO: 1819241 - RNA, 16 nt, Salmonella typhimurium LT2
ccgcgagaaucgccag

SEQ ID NO: 1819242 - RNA, 21 nt, Salmonella typhimurium LT2
ccgcgagugcaggaucaccgg

SEQ ID NO: 1819243 - RNA, 15 nt, Salmonella typhimurium LT2
ccgcgcauggccaua

SEQ ID NO: 1819244 - RNA, 15 nt, Salmonella typhimurium LT2
ccgcgcaguuucuua

SEQ ID NO: 1819245 - RNA, 15 nt, Salmonella typhimurium LT2
ccgcgcauagcuggc

SEQ ID NO: 1819246 - RNA, 14 nt, Salmonella typhimurium LT2
ccgcgccagaccgc

SEQ ID NO: 1819247 - RNA, 21 nt, Salmonella typhimurium LT2
ccgcgauguuugcucgccaua

SEQ ID NO: 1819248 - RNA, 22 nt, Salmonella typhimurium LT2
ccgcgaugaucgucgcgaucgc

SEQ ID NO: 1819249 - RNA, 14 nt, Salmonella typhimurium LT2
ccgccauccggcaa

SEQ ID NO: 1819250 - RNA, 15 nt, Salmonella typhimurium LT2
ccgccauccggcaag

SEQ ID NO: 1819251 - RNA, 15 nt, Salmonella typhimurium LT2
ccgccauccggcaau

SEQ ID NO: 1819252 - RNA, 19 nt, Salmonella typhimurium LT2
ccgccauccggcacgguca

SEQ ID NO: 1819253 - RNA, 15 nt, Salmonella typhimurium LT2
ccgccauccggcagu

SEQ ID NO: 1819254 - RNA, 14 nt, Salmonella typhimurium LT2
ccgccauccggcau

SEQ ID NO: 1819255 - RNA, 14 nt, Salmonella typhimurium LT2
ccgccauccggccu

SEQ ID NO: 1819256 - RNA, 15 nt, Salmonella typhimurium LT2
ccgccgcagauauuu

SEQ ID NO: 1819257 - RNA, 13 nt, Salmonella typhimurium LT2
ccgccgccggacu

SEQ ID NO: 1819258 - RNA, 19 nt, Salmonella typhimurium LT2
ccgccgcgacgaugccaau

SEQ ID NO: 1819259 - RNA, 15 nt, Salmonella typhimurium LT2
ccgcguuacccugcg

SEQ ID NO: 1819260 - RNA, 18 nt, Salmonella typhimurium LT2
ccgcgucacgaccggcga

SEQ ID NO: 1819261 - RNA, 16 nt, Salmonella typhimurium LT2
ccgcggcgguuauccu

SEQ ID NO: 1819262 - RNA, 17 nt, Salmonella typhimurium LT2
ccgcugcgugcgcgcca

SEQ ID NO: 1819263 - RNA, 17 nt, Salmonella typhimurium LT2
ccgcuaagggcaccagc

SEQ ID NO: 1819264 - RNA, 19 nt, Salmonella typhimurium LT2
ccgcuaaaugggcaggaga

SEQ ID NO: 1819265 - RNA, 17 nt, Salmonella typhimurium LT2
ccgcuccgggccgauac

SEQ ID NO: 1819266 - RNA, 23 nt, Salmonella typhimurium LT2
ccgcuauaaaaauuauaacguga

SEQ ID NO: 1819267 - RNA, 15 nt, Salmonella typhimurium LT2
ccgcucgaaucgcca

SEQ ID NO: 1819268 - RNA, 20 nt, Salmonella typhimurium LT2
ccgcgcgaaccaugaacgau

SEQ ID NO: 1819269 - RNA, 12 nt, Salmonella typhimurium LT2
ccgcgcucaccg

SEQ ID NO: 1819270 - RNA, 15 nt, Salmonella typhimurium LT2
ccgcggauagacgau

SEQ ID NO: 1819271 - RNA, 19 nt, Salmonella typhimurium LT2
ccgacggcuucuucacgca

SEQ ID NO: 1819272 - RNA, 22 nt, Salmonella typhimurium LT2
ccgacaagguauaucaacccgc

SEQ ID NO: 1819273 - RNA, 21 nt, Salmonella typhimurium LT2
ccgacaaccugaaugccaucc

SEQ ID NO: 1819274 - RNA, 21 nt, Salmonella typhimurium LT2
ccgacgccuguucgagguuca

SEQ ID NO: 1819275 - RNA, 13 nt, Salmonella typhimurium LT2
ccgacugccacca

SEQ ID NO: 1819276 - RNA, 13 nt, Salmonella typhimurium LT2
ccgacguuaucgc

SEQ ID NO: 1819277 - RNA, 20 nt, Salmonella typhimurium LT2
ccgacuauuccgcaaacgcc

SEQ ID NO: 1819278 - RNA, 20 nt, Salmonella typhimurium LT2
ccgauaaaguggcauccgaa

SEQ ID NO: 1819279 - RNA, 13 nt, Salmonella typhimurium LT2
ccgcacgccggug

SEQ ID NO: 1819280 - RNA, 18 nt, Salmonella typhimurium LT2
ccgcagcucauaacggcu

SEQ ID NO: 1819281 - RNA, 13 nt, Salmonella typhimurium LT2
ccgcauccccaua

SEQ ID NO: 1819282 - RNA, 23 nt, Salmonella typhimurium LT2
ccgcaucauucaucucgauaccg

SEQ ID NO: 1819283 - RNA, 14 nt, Salmonella typhimurium LT2
ccgcaucgaccaua

SEQ ID NO: 1819284 - RNA, 14 nt, Salmonella typhimurium LT2
ccgcauccggcaau

SEQ ID NO: 1819285 - RNA, 18 nt, Salmonella typhimurium LT2
ccgcauaauccagcaggu

SEQ ID NO: 1819286 - RNA, 20 nt, Salmonella typhimurium LT2
ccgccagaaaagaaccgacu

SEQ ID NO: 1819287 - RNA, 18 nt, Salmonella typhimurium LT2
ccgccauauccccgccau

SEQ ID NO: 1819288 - RNA, 13 nt, Salmonella typhimurium LT2
ccgccauagccua

SEQ ID NO: 1819289 - RNA, 15 nt, Salmonella typhimurium LT2
ccgccagcgucucag

SEQ ID NO: 1819290 - RNA, 18 nt, Salmonella typhimurium LT2
ccgcauugguuucgccua

SEQ ID NO: 1819291 - RNA, 17 nt, Salmonella typhimurium LT2
ccgcauuuucucgcgca

SEQ ID NO: 1819292 - RNA, 17 nt, Salmonella typhimurium LT2
ccgccaaacgccgcaac

SEQ ID NO: 1819293 - RNA, 16 nt, Salmonella typhimurium LT2
ccgccaaacgcgguca

SEQ ID NO: 1819294 - RNA, 21 nt, Salmonella typhimurium LT2
ccgcauuaacugccuguuaac

SEQ ID NO: 1819295 - RNA, 13 nt, Salmonella typhimurium LT2
ccgcaacgccgau

SEQ ID NO: 1819296 - RNA, 21 nt, Salmonella typhimurium LT2
ccgcaauccuggcuucaaccu

SEQ ID NO: 1819297 - RNA, 19 nt, Salmonella typhimurium LT2
ccgcaaucagcguuucgcc

SEQ ID NO: 1819298 - RNA, 23 nt, Salmonella typhimurium LT2
ccgcacagcagacaaccgacgca

SEQ ID NO: 1819299 - RNA, 23 nt, Salmonella typhimurium LT2
ccgcacaucggcaggaacagaua

SEQ ID NO: 1819300 - RNA, 13 nt, Salmonella typhimurium LT2
ccgcacagcagac

SEQ ID NO: 1819301 - RNA, 14 nt, Salmonella typhimurium LT2
ccgcacagaaucgc

SEQ ID NO: 1819302 - RNA, 17 nt, Salmonella typhimurium LT2
ccgcaauuaaaugaaug

SEQ ID NO: 1819303 - RNA, 18 nt, Salmonella typhimurium LT2
ccgaucguagcaucucuu

SEQ ID NO: 1819304 - RNA, 15 nt, Salmonella typhimurium LT2
ccgaugacucccagu

SEQ ID NO: 1819305 - RNA, 19 nt, Salmonella typhimurium LT2
ccgaugugcguauucagcg

SEQ ID NO: 1819306 - RNA, 23 nt, Salmonella typhimurium LT2
ccgaucaucguaccaauacccag

SEQ ID NO: 1819307 - RNA, 17 nt, Salmonella typhimurium LT2
ccgaucaggccgcagac

SEQ ID NO: 1819308 - RNA, 18 nt, Salmonella typhimurium LT2
ccgaucgcgauacgcgcg

SEQ ID NO: 1819309 - RNA, 22 nt, Salmonella typhimurium LT2
ccgaucacggcgaaucgccugu

SEQ ID NO: 1819310 - RNA, 18 nt, Salmonella typhimurium LT2
ccgauauuggucaugcgg

SEQ ID NO: 1819311 - RNA, 18 nt, Salmonella typhimurium LT2
ccgauaccgccagcccca

SEQ ID NO: 1819312 - RNA, 20 nt, Salmonella typhimurium LT2
ccgauaguguaaacgcgcca

SEQ ID NO: 1819313 - RNA, 21 nt, Salmonella typhimurium LT2
ccgauaguguaaacgcgccau

SEQ ID NO: 1819314 - RNA, 19 nt, Salmonella typhimurium LT2
ccgauaggugccgccgcac

SEQ ID NO: 1819315 - RNA, 12 nt, Salmonella typhimurium LT2
ccugaaacgcgg

SEQ ID NO: 1819316 - RNA, 17 nt, Salmonella typhimurium LT2
ccugaaaauagcgccau

SEQ ID NO: 1819317 - RNA, 15 nt, Salmonella typhimurium LT2
ccugaaccagcggca

SEQ ID NO: 1819318 - RNA, 17 nt, Salmonella typhimurium LT2
ccugaaccucuucaccg

SEQ ID NO: 1819319 - RNA, 13 nt, Salmonella typhimurium LT2
ccugaacgccgga

SEQ ID NO: 1819320 - RNA, 18 nt, Salmonella typhimurium LT2
ccugaaguaucgacgcag

SEQ ID NO: 1819321 - RNA, 18 nt, Salmonella typhimurium LT2
ccugaauaaucggcguca

SEQ ID NO: 1819322 - RNA, 14 nt, Salmonella typhimurium LT2
ccucuuucgccauu

SEQ ID NO: 1819323 - RNA, 17 nt, Salmonella typhimurium LT2
ccucuuccccggucagu

SEQ ID NO: 1819324 - RNA, 15 nt, Salmonella typhimurium LT2
ccucuuccagcgcca

SEQ ID NO: 1819325 - RNA, 16 nt, Salmonella typhimurium LT2
ccucuuccaucagcca

SEQ ID NO: 1819326 - RNA, 18 nt, Salmonella typhimurium LT2
ccucugccguagcguacu

SEQ ID NO: 1819327 - RNA, 13 nt, Salmonella typhimurium LT2
ccucggcgacguc

SEQ ID NO: 1819328 - RNA, 20 nt, Salmonella typhimurium LT2
ccugaauuucacgcugcagu

SEQ ID NO: 1819329 - RNA, 17 nt, Salmonella typhimurium LT2
ccugaaugcucucauau

SEQ ID NO: 1819330 - RNA, 18 nt, Salmonella typhimurium LT2
ccugaaucucuucgaccg

SEQ ID NO: 1819331 - RNA, 20 nt, Salmonella typhimurium LT2
ccugauaagcguagcgccau

SEQ ID NO: 1819332 - RNA, 22 nt, Salmonella typhimurium LT2
ccugauaagguaaagccgccau

SEQ ID NO: 1819333 - RNA, 20 nt, Salmonella typhimurium LT2
ccugauaagcgaagcgccau

SEQ ID NO: 1819334 - RNA, 20 nt, Salmonella typhimurium LT2
ccugauaagcauagcgccau

SEQ ID NO: 1819335 - RNA, 13 nt, Salmonella typhimurium LT2
ccugaucccacag

SEQ ID NO: 1819336 - RNA, 21 nt, Salmonella typhimurium LT2
ccugauccugcaacagcacca

SEQ ID NO: 1819337 - RNA, 22 nt, Salmonella typhimurium LT2
ccugauggcgacguuagcgcau

SEQ ID NO: 1819338 - RNA, 19 nt, Salmonella typhimurium LT2
ccugauggcgcagcgccau

SEQ ID NO: 1819339 - RNA, 19 nt, Salmonella typhimurium LT2
ccugauggcgcugcgccau

SEQ ID NO: 1819340 - RNA, 16 nt, Salmonella typhimurium LT2
ccugaugcugcgaggc

SEQ ID NO: 1819341 - RNA, 18 nt, Salmonella typhimurium LT2
ccugauuaaacgccugau

SEQ ID NO: 1819342 - RNA, 14 nt, Salmonella typhimurium LT2
ccugauuaaucagc

SEQ ID NO: 1819343 - RNA, 19 nt, Salmonella typhimurium LT2
ccugaugcgacgcuuaccg

SEQ ID NO: 1819344 - RNA, 22 nt, Salmonella typhimurium LT2
ccugaugcgcguuuagcgccag

SEQ ID NO: 1819345 - RNA, 14 nt, Salmonella typhimurium LT2
ccugcccgccugau

SEQ ID NO: 1819346 - RNA, 22 nt, Salmonella typhimurium LT2
ccugcacuuccagccacggcgu

SEQ ID NO: 1819347 - RNA, 21 nt, Salmonella typhimurium LT2
ccuaccagcgcgccagcgcca

SEQ ID NO: 1819348 - RNA, 16 nt, Salmonella typhimurium LT2
ccuacgugcucacggc

SEQ ID NO: 1819349 - RNA, 17 nt, Salmonella typhimurium LT2
ccguucaucggcauaca

SEQ ID NO: 1819350 - RNA, 16 nt, Salmonella typhimurium LT2
ccguucaucuaucgcc

SEQ ID NO: 1819351 - RNA, 16 nt, Salmonella typhimurium LT2
ccguucagaauggcgu

SEQ ID NO: 1819352 - RNA, 15 nt, Salmonella typhimurium LT2
ccuauaacagcgcca

SEQ ID NO: 1819353 - RNA, 13 nt, Salmonella typhimurium LT2
ccucagccacggu

SEQ ID NO: 1819354 - RNA, 14 nt, Salmonella typhimurium LT2
ccucagguaucaua

SEQ ID NO: 1819355 - RNA, 20 nt, Salmonella typhimurium LT2
ccucauacagcccgcgcaga

SEQ ID NO: 1819356 - RNA, 13 nt, Salmonella typhimurium LT2
ccucaucaccuac

SEQ ID NO: 1819357 - RNA, 16 nt, Salmonella typhimurium LT2
ccuccgccgaucagca

SEQ ID NO: 1819358 - RNA, 12 nt, Salmonella typhimurium LT2
ccuccugauauc

SEQ ID NO: 1819359 - RNA, 22 nt, Salmonella typhimurium LT2
ccgucccuuccgccaccagguu

SEQ ID NO: 1819360 - RNA, 18 nt, Salmonella typhimurium LT2
ccgucgaccagcguaccg

SEQ ID NO: 1819361 - RNA, 11 nt, Salmonella typhimurium LT2
ccgucgacgcc

SEQ ID NO: 1819362 - RNA, 20 nt, Salmonella typhimurium LT2
ccgucuuguacaggcgcuca

SEQ ID NO: 1819363 - RNA, 16 nt, Salmonella typhimurium LT2
ccguuaaggccuuauu

SEQ ID NO: 1819364 - RNA, 14 nt, Salmonella typhimurium LT2
ccguuauccggcaa

SEQ ID NO: 1819365 - RNA, 20 nt, Salmonella typhimurium LT2
ccguguugauuaaugcgaua

SEQ ID NO: 1819366 - RNA, 20 nt, Salmonella typhimurium LT2
ccguggcaaaucccguaccg

SEQ ID NO: 1819367 - RNA, 21 nt, Salmonella typhimurium LT2
ccguggaucucgucgccggug

SEQ ID NO: 1819368 - RNA, 21 nt, Salmonella typhimurium LT2
ccgguuuuacuauugccgaua

SEQ ID NO: 1819369 - RNA, 14 nt, Salmonella typhimurium LT2
ccguaauagcaaua

SEQ ID NO: 1819370 - RNA, 15 nt, Salmonella typhimurium LT2
ccguaccuccagcga

SEQ ID NO: 1819371 - RNA, 20 nt, Salmonella typhimurium LT2
ccguauucuuugcgccuuau

SEQ ID NO: 1819372 - RNA, 15 nt, Salmonella typhimurium LT2
ccgucaccacgcgca

SEQ ID NO: 1819373 - RNA, 23 nt, Salmonella typhimurium LT2
ccgucaaaaugaucagaccaucg

SEQ ID NO: 1819374 - RNA, 13 nt, Salmonella typhimurium LT2
ccgucauggugau

SEQ ID NO: 1819375 - RNA, 17 nt, Salmonella typhimurium LT2
ccgggcgauaucacgga

SEQ ID NO: 1819376 - RNA, 18 nt, Salmonella typhimurium LT2
ccgggucagcccccaguu

SEQ ID NO: 1819377 - RNA, 17 nt, Salmonella typhimurium LT2
ccggguauucaucggca

SEQ ID NO: 1819378 - RNA, 13 nt, Salmonella typhimurium LT2
ccggggcgcuggc

SEQ ID NO: 1819379 - RNA, 16 nt, Salmonella typhimurium LT2
ccggggccagcgccag

SEQ ID NO: 1819380 - RNA, 17 nt, Salmonella typhimurium LT2
ccggcguuuucagaucc

SEQ ID NO: 1819381 - RNA, 22 nt, Salmonella typhimurium LT2
ccggcuacaggcgucacggcga

SEQ ID NO: 1819382 - RNA, 13 nt, Salmonella typhimurium LT2
ccggcugccgaua

SEQ ID NO: 1819383 - RNA, 19 nt, Salmonella typhimurium LT2
ccggcugccauuaucacca

SEQ ID NO: 1819384 - RNA, 17 nt, Salmonella typhimurium LT2
ccggcuucuggcuaccg

SEQ ID NO: 1819385 - RNA, 20 nt, Salmonella typhimurium LT2
ccggcuuuuuuauaucaggc

SEQ ID NO: 1819386 - RNA, 22 nt, Salmonella typhimurium LT2
ccgggaaagcggaucggaacgc

SEQ ID NO: 1819387 - RNA, 22 nt, Salmonella typhimurium LT2
ccgggaacagaauaacgucgcg

SEQ ID NO: 1819388 - RNA, 13 nt, Salmonella typhimurium LT2
ccggcgugccgau

SEQ ID NO: 1819389 - RNA, 18 nt, Salmonella typhimurium LT2
ccggcgugguggcgucaa

SEQ ID NO: 1819390 - RNA, 19 nt, Salmonella typhimurium LT2
ccggcgugguggcgucaau

SEQ ID NO: 1819391 - RNA, 20 nt, Salmonella typhimurium LT2
ccggcgugcgcuuagccugc

SEQ ID NO: 1819392 - RNA, 19 nt, Salmonella typhimurium LT2
ccggccucgcccgcgauga

SEQ ID NO: 1819393 - RNA, 15 nt, Salmonella typhimurium LT2
ccggccugcaggcaa

SEQ ID NO: 1819394 - RNA, 15 nt, Salmonella typhimurium LT2
ccggccuuaucuucc

SEQ ID NO: 1819395 - RNA, 19 nt, Salmonella typhimurium LT2
ccggcgaaaaaccaggcaa

SEQ ID NO: 1819396 - RNA, 13 nt, Salmonella typhimurium LT2
ccggcgcagcgaa

SEQ ID NO: 1819397 - RNA, 19 nt, Salmonella typhimurium LT2
ccggcauuucaccgccaau

SEQ ID NO: 1819398 - RNA, 15 nt, Salmonella typhimurium LT2
ccgcuggcgcgggga

SEQ ID NO: 1819399 - RNA, 22 nt, Salmonella typhimurium LT2
ccgcuggcgucuucaucaacgu

SEQ ID NO: 1819400 - RNA, 13 nt, Salmonella typhimurium LT2
ccggaauacacaa

SEQ ID NO: 1819401 - RNA, 18 nt, Salmonella typhimurium LT2
ccggcauauggauauuca

SEQ ID NO: 1819402 - RNA, 20 nt, Salmonella typhimurium LT2
ccggcaugucgccagccagu

SEQ ID NO: 1819403 - RNA, 14 nt, Salmonella typhimurium LT2
cgcgccuaccgcca

SEQ ID NO: 1819404 - RNA, 20 nt, Salmonella typhimurium LT2
cgcgccguugaaaucgguaa

SEQ ID NO: 1819405 - RNA, 13 nt, Salmonella typhimurium LT2
cgcgccuccggcc

SEQ ID NO: 1819406 - RNA, 19 nt, Salmonella typhimurium LT2
cgcgcgcuuaaucgagagc

SEQ ID NO: 1819407 - RNA, 14 nt, Salmonella typhimurium LT2
cgcgcuuaaucgag

SEQ ID NO: 1819408 - RNA, 17 nt, Salmonella typhimurium LT2
cgcgcuguauaaucccg

SEQ ID NO: 1819409 - RNA, 19 nt, Salmonella typhimurium LT2
cgcgcuuuucgccagcgca

SEQ ID NO: 1819410 - RNA, 19 nt, Salmonella typhimurium LT2
cgcgcuuccugccaggccg

SEQ ID NO: 1819411 - RNA, 13 nt, Salmonella typhimurium LT2
cgcgcugccgccc

SEQ ID NO: 1819412 - RNA, 14 nt, Salmonella typhimurium LT2
cgcgcugaccgcac

SEQ ID NO: 1819413 - RNA, 23 nt, Salmonella typhimurium LT2
cgcgcucaguucauuauuucaug

SEQ ID NO: 1819414 - RNA, 14 nt, Salmonella typhimurium LT2
cgcgcguagcagca

SEQ ID NO: 1819415 - RNA, 14 nt, Salmonella typhimurium LT2
cgcggcagcgcugc

SEQ ID NO: 1819416 - RNA, 22 nt, Salmonella typhimurium LT2
cgcggcaauuucacugucgcca

SEQ ID NO: 1819417 - RNA, 15 nt, Salmonella typhimurium LT2
cgcggcaucagccug

SEQ ID NO: 1819418 - RNA, 18 nt, Salmonella typhimurium LT2
cgcggcauaaauccggug

SEQ ID NO: 1819419 - RNA, 16 nt, Salmonella typhimurium LT2
cgcggcgaaccggcau

SEQ ID NO: 1819420 - RNA, 20 nt, Salmonella typhimurium LT2
cgcggcgaaccggcaucggc

SEQ ID NO: 1819421 - RNA, 20 nt, Salmonella typhimurium LT2
cgcggcgcccauuccgccug

SEQ ID NO: 1819422 - RNA, 19 nt, Salmonella typhimurium LT2
cgcgcaucaggaucuucau

SEQ ID NO: 1819423 - RNA, 15 nt, Salmonella typhimurium LT2
cgcgcagcggcgcca

SEQ ID NO: 1819424 - RNA, 18 nt, Salmonella typhimurium LT2
cgcgcagaaucagcgugc

SEQ ID NO: 1819425 - RNA, 21 nt, Salmonella typhimurium LT2
cgcgcagagauagccagcgau

SEQ ID NO: 1819426 - RNA, 15 nt, Salmonella typhimurium LT2
cgcgcaccccggcca

SEQ ID NO: 1819427 - RNA, 17 nt, Salmonella typhimurium LT2
cgcgcacaugcagcgca

SEQ ID NO: 1819428 - RNA, 14 nt, Salmonella typhimurium LT2
cgcgcaaucagcac

SEQ ID NO: 1819429 - RNA, 19 nt, Salmonella typhimurium LT2
cgcgccaaaagaggcagca

SEQ ID NO: 1819430 - RNA, 18 nt, Salmonella typhimurium LT2
cgcgcauggcagggcgau

SEQ ID NO: 1819431 - RNA, 13 nt, Salmonella typhimurium LT2
cgcgccacgcaug

SEQ ID NO: 1819432 - RNA, 23 nt, Salmonella typhimurium LT2
cgcgccacgccauugcugucgac

SEQ ID NO: 1819433 - RNA, 17 nt, Salmonella typhimurium LT2
cgcgccacgucggauaa

SEQ ID NO: 1819434 - RNA, 12 nt, Salmonella typhimurium LT2
cgcgccagcaaa

SEQ ID NO: 1819435 - RNA, 13 nt, Salmonella typhimurium LT2
cgcgccagggcgc

SEQ ID NO: 1819436 - RNA, 12 nt, Salmonella typhimurium LT2
cgcgccagccaa

SEQ ID NO: 1819437 - RNA, 15 nt, Salmonella typhimurium LT2
cgcgccagcaggucg

SEQ ID NO: 1819438 - RNA, 13 nt, Salmonella typhimurium LT2
cgcgccagcacca

SEQ ID NO: 1819439 - RNA, 13 nt, Salmonella typhimurium LT2
cgcgccagcgucg

SEQ ID NO: 1819440 - RNA, 12 nt, Salmonella typhimurium LT2
cgcgccagcuca

SEQ ID NO: 1819441 - RNA, 13 nt, Salmonella typhimurium LT2
cgcgccagcggau

SEQ ID NO: 1819442 - RNA, 19 nt, Salmonella typhimurium LT2
cgcgccaugcgcggcauca

SEQ ID NO: 1819443 - RNA, 14 nt, Salmonella typhimurium LT2
cgcgcccagcagca

SEQ ID NO: 1819444 - RNA, 17 nt, Salmonella typhimurium LT2
cgcgcccagcagggcca

SEQ ID NO: 1819445 - RNA, 14 nt, Salmonella typhimurium LT2
cgcgcccagcgccg

SEQ ID NO: 1819446 - RNA, 19 nt, Salmonella typhimurium LT2
cgcgccgacaaucggcgga

SEQ ID NO: 1819447 - RNA, 15 nt, Salmonella typhimurium LT2
cgcgccgcagcgccg

SEQ ID NO: 1819448 - RNA, 20 nt, Salmonella typhimurium LT2
cgcguagguuggcugaggcg

SEQ ID NO: 1819449 - RNA, 20 nt, Salmonella typhimurium LT2
cgcguaucuuugauggagau

SEQ ID NO: 1819450 - RNA, 19 nt, Salmonella typhimurium LT2
cgcguaaauaccuuccggc

SEQ ID NO: 1819451 - RNA, 16 nt, Salmonella typhimurium LT2
cgcggucgucaucggc

SEQ ID NO: 1819452 - RNA, 17 nt, Salmonella typhimurium LT2
cgcgguccacaggccgu

SEQ ID NO: 1819453 - RNA, 12 nt, Salmonella typhimurium LT2
cgcgggcuggcu

SEQ ID NO: 1819454 - RNA, 18 nt, Salmonella typhimurium LT2
cgcgucagggcgauaaua

SEQ ID NO: 1819455 - RNA, 14 nt, Salmonella typhimurium LT2
cgcgucagggcgau

SEQ ID NO: 1819456 - RNA, 20 nt, Salmonella typhimurium LT2
cgcgucaucggcgcgcuggc

SEQ ID NO: 1819457 - RNA, 12 nt, Salmonella typhimurium LT2
cgcgucagcgcc

SEQ ID NO: 1819458 - RNA, 12 nt, Salmonella typhimurium LT2
cgcgucgccauc

SEQ ID NO: 1819459 - RNA, 15 nt, Salmonella typhimurium LT2
cgcgucgcauccggc

SEQ ID NO: 1819460 - RNA, 14 nt, Salmonella typhimurium LT2
cgcgucggacaggg

SEQ ID NO: 1819461 - RNA, 17 nt, Salmonella typhimurium LT2
cgcgucgaccagacgaa

SEQ ID NO: 1819462 - RNA, 13 nt, Salmonella typhimurium LT2
cgcgugaccaucg

SEQ ID NO: 1819463 - RNA, 18 nt, Salmonella typhimurium LT2
cgcgugaccaucgcguug

SEQ ID NO: 1819464 - RNA, 20 nt, Salmonella typhimurium LT2
cgcgucuuaucuggccuaca

SEQ ID NO: 1819465 - RNA, 20 nt, Salmonella typhimurium LT2
cgcgucuuaucaggccuaca

SEQ ID NO: 1819466 - RNA, 16 nt, Salmonella typhimurium LT2
cgcgucguucgacgac

SEQ ID NO: 1819467 - RNA, 16 nt, Salmonella typhimurium LT2
cgcgucgggaucguaa

SEQ ID NO: 1819468 - RNA, 16 nt, Salmonella typhimurium LT2
cgcguuuaccaccgga

SEQ ID NO: 1819469 - RNA, 21 nt, Salmonella typhimurium LT2
cgcguuuaccuucgauaacgg

SEQ ID NO: 1819470 - RNA, 17 nt, Salmonella typhimurium LT2
cgcguuguugaucauaa

SEQ ID NO: 1819471 - RNA, 15 nt, Salmonella typhimurium LT2
cgcguugaugaaucu

SEQ ID NO: 1819472 - RNA, 18 nt, Salmonella typhimurium LT2
cgcguucagcaucgggaa

SEQ ID NO: 1819473 - RNA, 21 nt, Salmonella typhimurium LT2
cgcguucacaacggcgaauaa

SEQ ID NO: 1819474 - RNA, 23 nt, Salmonella typhimurium LT2
cgcgugacgcaguaauacgccgc

SEQ ID NO: 1819475 - RNA, 14 nt, Salmonella typhimurium LT2
cgcguuaauaccgu

SEQ ID NO: 1819476 - RNA, 22 nt, Salmonella typhimurium LT2
cgcuggcaauaaagcagggcgg

SEQ ID NO: 1819477 - RNA, 13 nt, Salmonella typhimurium LT2
cgcuggaaagcgg

SEQ ID NO: 1819478 - RNA, 15 nt, Salmonella typhimurium LT2
cgcuggaaagcggca

SEQ ID NO: 1819479 - RNA, 14 nt, Salmonella typhimurium LT2
cgcuggaaucaucc

SEQ ID NO: 1819480 - RNA, 20 nt, Salmonella typhimurium LT2
cgcuggaaugcgcgcgugac

SEQ ID NO: 1819481 - RNA, 19 nt, Salmonella typhimurium LT2
cgcugcuggcagcgcugaa

SEQ ID NO: 1819482 - RNA, 16 nt, Salmonella typhimurium LT2
cgcuggccuccagcac

SEQ ID NO: 1819483 - RNA, 13 nt, Salmonella typhimurium LT2
cgcugcgucaggc

SEQ ID NO: 1819484 - RNA, 17 nt, Salmonella typhimurium LT2
cgcugcguuugccgccu

SEQ ID NO: 1819485 - RNA, 12 nt, Salmonella typhimurium LT2
cgcugcuccggc

SEQ ID NO: 1819486 - RNA, 13 nt, Salmonella typhimurium LT2
cgcugcuccggcu

SEQ ID NO: 1819487 - RNA, 20 nt, Salmonella typhimurium LT2
cgcugcugaccuuaauccag

SEQ ID NO: 1819488 - RNA, 19 nt, Salmonella typhimurium LT2
cgcugcgcuuauccggccu

SEQ ID NO: 1819489 - RNA, 20 nt, Salmonella typhimurium LT2
cgcugcgcuuaccaggccua

SEQ ID NO: 1819490 - RNA, 13 nt, Salmonella typhimurium LT2
cgcugaucgccac

SEQ ID NO: 1819491 - RNA, 14 nt, Salmonella typhimurium LT2
cgcucgccagcccg

SEQ ID NO: 1819492 - RNA, 15 nt, Salmonella typhimurium LT2
cgcucgccagcgcag

SEQ ID NO: 1819493 - RNA, 18 nt, Salmonella typhimurium LT2
cgcucggugacggaaacc

SEQ ID NO: 1819494 - RNA, 14 nt, Salmonella typhimurium LT2
cgcugacggcggca

SEQ ID NO: 1819495 - RNA, 13 nt, Salmonella typhimurium LT2
cgcugacgcgauc

SEQ ID NO: 1819496 - RNA, 23 nt, Salmonella typhimurium LT2
cgcugaguuucucccgccagaug

SEQ ID NO: 1819497 - RNA, 16 nt, Salmonella typhimurium LT2
cgcugaguuucucccg

SEQ ID NO: 1819498 - RNA, 23 nt, Salmonella typhimurium LT2
cgcugagucuaacccguugccga

SEQ ID NO: 1819499 - RNA, 13 nt, Salmonella typhimurium LT2
cgcugacguugcg

SEQ ID NO: 1819500 - RNA, 21 nt, Salmonella typhimurium LT2
cgcuccagaccaccagcgaca

SEQ ID NO: 1819501 - RNA, 17 nt, Salmonella typhimurium LT2
cgcguuuuccagcaucc

SEQ ID NO: 1819502 - RNA, 19 nt, Salmonella typhimurium LT2
cgcguuuuagcaaccagcu

SEQ ID NO: 1819503 - RNA, 17 nt, Salmonella typhimurium LT2
cgcguuuaucacccuga

SEQ ID NO: 1819504 - RNA, 14 nt, Salmonella typhimurium LT2
cgcguuuugccgcu

SEQ ID NO: 1819505 - RNA, 23 nt, Salmonella typhimurium LT2
cgcguuuuuucaugaaucaucac

SEQ ID NO: 1819506 - RNA, 22 nt, Salmonella typhimurium LT2
cgcucccgcgaggaauacggaa

SEQ ID NO: 1819507 - RNA, 21 nt, Salmonella typhimurium LT2
cgcuccgacaaacuucaucgc

SEQ ID NO: 1819508 - RNA, 23 nt, Salmonella typhimurium LT2
cgcuccgacaaacuucaucgcca

SEQ ID NO: 1819509 - RNA, 13 nt, Salmonella typhimurium LT2
cgcucccggcacc

SEQ ID NO: 1819510 - RNA, 16 nt, Salmonella typhimurium LT2
cgcccauuaugccgca

SEQ ID NO: 1819511 - RNA, 20 nt, Salmonella typhimurium LT2
cgccccccuaccggaaucgc

SEQ ID NO: 1819512 - RNA, 13 nt, Salmonella typhimurium LT2
cgcccccagcaaa

SEQ ID NO: 1819513 - RNA, 14 nt, Salmonella typhimurium LT2
cgcccaucccuaau

SEQ ID NO: 1819514 - RNA, 12 nt, Salmonella typhimurium LT2
cgcccauaucca

SEQ ID NO: 1819515 - RNA, 19 nt, Salmonella typhimurium LT2
cgcccauccagagcagucg

SEQ ID NO: 1819516 - RNA, 20 nt, Salmonella typhimurium LT2
cgcccaucgccacagcggaa

SEQ ID NO: 1819517 - RNA, 18 nt, Salmonella typhimurium LT2
cgcccaucgccgccuccg

SEQ ID NO: 1819518 - RNA, 19 nt, Salmonella typhimurium LT2
cgcccaggauacagccgaa

SEQ ID NO: 1819519 - RNA, 18 nt, Salmonella typhimurium LT2
cgcccaggccugauaagc

SEQ ID NO: 1819520 - RNA, 23 nt, Salmonella typhimurium LT2
cgcccgcuucaaggaagagaucg

SEQ ID NO: 1819521 - RNA, 22 nt, Salmonella typhimurium LT2
cgcccggccccgcgccagccaa

SEQ ID NO: 1819522 - RNA, 16 nt, Salmonella typhimurium LT2
cgcccgcgcgccagcg

SEQ ID NO: 1819523 - RNA, 15 nt, Salmonella typhimurium LT2
cgcccgccaccagca

SEQ ID NO: 1819524 - RNA, 12 nt, Salmonella typhimurium LT2
cgcccagcgccg

SEQ ID NO: 1819525 - RNA, 17 nt, Salmonella typhimurium LT2
cgccaggauugccugau

SEQ ID NO: 1819526 - RNA, 18 nt, Salmonella typhimurium LT2
cgccaggcacgccggcaa

SEQ ID NO: 1819527 - RNA, 20 nt, Salmonella typhimurium LT2
cgccaugcgggugacgcugg

SEQ ID NO: 1819528 - RNA, 21 nt, Salmonella typhimurium LT2
cgccaugcgggugacgcuggc

SEQ ID NO: 1819529 - RNA, 15 nt, Salmonella typhimurium LT2
cgccauuccgcagaa

SEQ ID NO: 1819530 - RNA, 15 nt, Salmonella typhimurium LT2
cgccauucacggcga

SEQ ID NO: 1819531 - RNA, 21 nt, Salmonella typhimurium LT2
cgccauuaucgaacucauagc

SEQ ID NO: 1819532 - RNA, 18 nt, Salmonella typhimurium LT2
cgcccaacggaugcgcca

SEQ ID NO: 1819533 - RNA, 20 nt, Salmonella typhimurium LT2
cgcccaacaccagcacugac

SEQ ID NO: 1819534 - RNA, 16 nt, Salmonella typhimurium LT2
cgccauuugccagaua

SEQ ID NO: 1819535 - RNA, 15 nt, Salmonella typhimurium LT2
cgccauuugcauccg

SEQ ID NO: 1819536 - RNA, 22 nt, Salmonella typhimurium LT2
cgcccaacggaugcgccauccc

SEQ ID NO: 1819537 - RNA, 15 nt, Salmonella typhimurium LT2
cgcccugcccgccag

SEQ ID NO: 1819538 - RNA, 14 nt, Salmonella typhimurium LT2
cgcccugcgccaga

SEQ ID NO: 1819539 - RNA, 16 nt, Salmonella typhimurium LT2
cgcccgguagcauccg

SEQ ID NO: 1819540 - RNA, 12 nt, Salmonella typhimurium LT2
cgcccgguaauu

SEQ ID NO: 1819541 - RNA, 15 nt, Salmonella typhimurium LT2
cgccgaagcaggcgg

SEQ ID NO: 1819542 - RNA, 21 nt, Salmonella typhimurium LT2
cgccgaaaauauacaccugac

SEQ ID NO: 1819543 - RNA, 14 nt, Salmonella typhimurium LT2
cgccgaugccgccg

SEQ ID NO: 1819544 - RNA, 19 nt, Salmonella typhimurium LT2
cgccgaugcacaacacgcu

SEQ ID NO: 1819545 - RNA, 21 nt, Salmonella typhimurium LT2
cgccgaugaccaguggcguaa

SEQ ID NO: 1819546 - RNA, 15 nt, Salmonella typhimurium LT2
cgccgcaccacugcu

SEQ ID NO: 1819547 - RNA, 15 nt, Salmonella typhimurium LT2
cgccgcaagcggcgu

SEQ ID NO: 1819548 - RNA, 13 nt, Salmonella typhimurium LT2
cgccgauuucuuc

SEQ ID NO: 1819549 - RNA, 23 nt, Salmonella typhimurium LT2
cgccgcaaccaaagccggcgcca

SEQ ID NO: 1819550 - RNA, 20 nt, Salmonella typhimurium LT2
cgccgcccccaugccgccug

SEQ ID NO: 1819551 - RNA, 13 nt, Salmonella typhimurium LT2
cgccgccagcuca

SEQ ID NO: 1819552 - RNA, 18 nt, Salmonella typhimurium LT2
cgccgccagguuauccag

SEQ ID NO: 1819553 - RNA, 13 nt, Salmonella typhimurium LT2
cgccgccgacagg

SEQ ID NO: 1819554 - RNA, 20 nt, Salmonella typhimurium LT2
cgcgaccaggaaaccgguaa

SEQ ID NO: 1819555 - RNA, 22 nt, Salmonella typhimurium LT2
cgcgaauuuuauuaagcaggcc

SEQ ID NO: 1819556 - RNA, 15 nt, Salmonella typhimurium LT2
cgcgacaacgccgga

SEQ ID NO: 1819557 - RNA, 24 nt, Salmonella typhimurium LT2
cgcgacaauaugauccucguugac

SEQ ID NO: 1819558 - RNA, 18 nt, Salmonella typhimurium LT2
cgcgaaaugucccgauau

SEQ ID NO: 1819559 - RNA, 23 nt, Salmonella typhimurium LT2
cgccuugccccagcggucagcga

SEQ ID NO: 1819560 - RNA, 18 nt, Salmonella typhimurium LT2
cgccuugcgauaacccgc

SEQ ID NO: 1819561 - RNA, 16 nt, Salmonella typhimurium LT2
cgccuucuucaucuuc

SEQ ID NO: 1819562 - RNA, 22 nt, Salmonella typhimurium LT2
cgccuggucuuccgcaucguuc

SEQ ID NO: 1819563 - RNA, 22 nt, Salmonella typhimurium LT2
cgccugcgguaaucgccgcgac

SEQ ID NO: 1819564 - RNA, 14 nt, Salmonella typhimurium LT2
cgccugcggcguaa

SEQ ID NO: 1819565 - RNA, 18 nt, Salmonella typhimurium LT2
cgccugcggacacggcgu

SEQ ID NO: 1819566 - RNA, 14 nt, Salmonella typhimurium LT2
cgccuggcggcaga

SEQ ID NO: 1819567 - RNA, 16 nt, Salmonella typhimurium LT2
cgccuguugcaugacg

SEQ ID NO: 1819568 - RNA, 14 nt, Salmonella typhimurium LT2
cgccuuauccggcc

SEQ ID NO: 1819569 - RNA, 19 nt, Salmonella typhimurium LT2
cgccuuauccggccuacaa

SEQ ID NO: 1819570 - RNA, 19 nt, Salmonella typhimurium LT2
cgccuuauccgaccuacaa

SEQ ID NO: 1819571 - RNA, 14 nt, Salmonella typhimurium LT2
cgccuuaucaagcc

SEQ ID NO: 1819572 - RNA, 21 nt, Salmonella typhimurium LT2
cgccugugcuuucgccaccag

SEQ ID NO: 1819573 - RNA, 19 nt, Salmonella typhimurium LT2
cgccuucgccuuccagugc

SEQ ID NO: 1819574 - RNA, 14 nt, Salmonella typhimurium LT2
cgccuuccugccag

SEQ ID NO: 1819575 - RNA, 15 nt, Salmonella typhimurium LT2
cgccuuacccggccu

SEQ ID NO: 1819576 - RNA, 20 nt, Salmonella typhimurium LT2
cgccuuauccugccuacagg

SEQ ID NO: 1819577 - RNA, 18 nt, Salmonella typhimurium LT2
cgccuuccgcaccgccag

SEQ ID NO: 1819578 - RNA, 14 nt, Salmonella typhimurium LT2
cgccugauggcgac

SEQ ID NO: 1819579 - RNA, 17 nt, Salmonella typhimurium LT2
cgccugauggcgacguu

SEQ ID NO: 1819580 - RNA, 16 nt, Salmonella typhimurium LT2
cgccugcgccuugacg

SEQ ID NO: 1819581 - RNA, 23 nt, Salmonella typhimurium LT2
cgccugcgccuugacgauaugcu

SEQ ID NO: 1819582 - RNA, 17 nt, Salmonella typhimurium LT2
cgccugcgcugcaauac

SEQ ID NO: 1819583 - RNA, 16 nt, Salmonella typhimurium LT2
cgccuccagcgauagu

SEQ ID NO: 1819584 - RNA, 15 nt, Salmonella typhimurium LT2
cgccuaacagcgccg

SEQ ID NO: 1819585 - RNA, 18 nt, Salmonella typhimurium LT2
cgccgucgcggcuacgga

SEQ ID NO: 1819586 - RNA, 16 nt, Salmonella typhimurium LT2
cgccgucggcagccag

SEQ ID NO: 1819587 - RNA, 17 nt, Salmonella typhimurium LT2
cgccgucggcagccaga

SEQ ID NO: 1819588 - RNA, 17 nt, Salmonella typhimurium LT2
cgccgucguucagccag

SEQ ID NO: 1819589 - RNA, 18 nt, Salmonella typhimurium LT2
cgccguguaagagcuggu

SEQ ID NO: 1819590 - RNA, 15 nt, Salmonella typhimurium LT2
cgccggauuccagaa

SEQ ID NO: 1819591 - RNA, 15 nt, Salmonella typhimurium LT2
cgccggaugaccaga

SEQ ID NO: 1819592 - RNA, 15 nt, Salmonella typhimurium LT2
cgccgcuuccggcag

SEQ ID NO: 1819593 - RNA, 14 nt, Salmonella typhimurium LT2
cgccgcuuccaggc

SEQ ID NO: 1819594 - RNA, 12 nt, Salmonella typhimurium LT2
cgccgcugaucc

SEQ ID NO: 1819595 - RNA, 18 nt, Salmonella typhimurium LT2
cgccggagaucagcaguu

SEQ ID NO: 1819596 - RNA, 20 nt, Salmonella typhimurium LT2
cgccggaaagaaacgccgcg

SEQ ID NO: 1819597 - RNA, 17 nt, Salmonella typhimurium LT2
cgccgguagccagccaa

SEQ ID NO: 1819598 - RNA, 17 nt, Salmonella typhimurium LT2
cgccgggcuucacggua

SEQ ID NO: 1819599 - RNA, 15 nt, Salmonella typhimurium LT2
cggcgaugccggccu

SEQ ID NO: 1819600 - RNA, 15 nt, Salmonella typhimurium LT2
cggcgagcaguacgc

SEQ ID NO: 1819601 - RNA, 16 nt, Salmonella typhimurium LT2
cggcgagguacugcau

SEQ ID NO: 1819602 - RNA, 21 nt, Salmonella typhimurium LT2
cggcgaccuucacgccgccaa

SEQ ID NO: 1819603 - RNA, 18 nt, Salmonella typhimurium LT2
cggccuuugccuucgccg

SEQ ID NO: 1819604 - RNA, 19 nt, Salmonella typhimurium LT2
cggcgaaaagcuggcugac

SEQ ID NO: 1819605 - RNA, 22 nt, Salmonella typhimurium LT2
cggcgaaacgccuuauccggcc

SEQ ID NO: 1819606 - RNA, 20 nt, Salmonella typhimurium LT2
cggcgaaaaaccaggcaaca

SEQ ID NO: 1819607 - RNA, 14 nt, Salmonella typhimurium LT2
cggcgaacgcgcgc

SEQ ID NO: 1819608 - RNA, 19 nt, Salmonella typhimurium LT2
cggccuacaacucagcgua

SEQ ID NO: 1819609 - RNA, 15 nt, Salmonella typhimurium LT2
cggccuacacaagcu

SEQ ID NO: 1819610 - RNA, 22 nt, Salmonella typhimurium LT2
cggccuaagaccagcaccaucu

SEQ ID NO: 1819611 - RNA, 21 nt, Salmonella typhimurium LT2
cggccuccaaaugaugcuuuc

SEQ ID NO: 1819612 - RNA, 23 nt, Salmonella typhimurium LT2
cggccauaauacgcuugcgccag

SEQ ID NO: 1819613 - RNA, 17 nt, Salmonella typhimurium LT2
cggccccaauuugcugu

SEQ ID NO: 1819614 - RNA, 20 nt, Salmonella typhimurium LT2
cggcccgggagaacgccggg

SEQ ID NO: 1819615 - RNA, 17 nt, Salmonella typhimurium LT2
cggccgaggcagcggga

SEQ ID NO: 1819616 - RNA, 17 nt, Salmonella typhimurium LT2
cggcaucccaggcgucc

SEQ ID NO: 1819617 - RNA, 15 nt, Salmonella typhimurium LT2
cggcauccaaccgaa

SEQ ID NO: 1819618 - RNA, 22 nt, Salmonella typhimurium LT2
cggcauuggcguuaccggcagg

SEQ ID NO: 1819619 - RNA, 18 nt, Salmonella typhimurium LT2
cggcauugcagcgcgugg

SEQ ID NO: 1819620 - RNA, 19 nt, Salmonella typhimurium LT2
cggccaaaacccaccagca

SEQ ID NO: 1819621 - RNA, 20 nt, Salmonella typhimurium LT2
cggcagcgggugagcgcuau

SEQ ID NO: 1819622 - RNA, 18 nt, Salmonella typhimurium LT2
cggcagguagucauauuc

SEQ ID NO: 1819623 - RNA, 12 nt, Salmonella typhimurium LT2
cggcauacagcg

SEQ ID NO: 1819624 - RNA, 17 nt, Salmonella typhimurium LT2
cggcauacaccgccagc

SEQ ID NO: 1819625 - RNA, 13 nt, Salmonella typhimurium LT2
cggcauaaucagg

SEQ ID NO: 1819626 - RNA, 21 nt, Salmonella typhimurium LT2
cggcauaaucugucgguaaug

SEQ ID NO: 1819627 - RNA, 22 nt, Salmonella typhimurium LT2
cggcaucacaaaccagacgcgu

SEQ ID NO: 1819628 - RNA, 16 nt, Salmonella typhimurium LT2
cggcagccggaacggg

SEQ ID NO: 1819629 - RNA, 12 nt, Salmonella typhimurium LT2
cggcagcgcugc

SEQ ID NO: 1819630 - RNA, 21 nt, Salmonella typhimurium LT2
cggcacucaccucuuccgcca

SEQ ID NO: 1819631 - RNA, 23 nt, Salmonella typhimurium LT2
cggcacucaccucuuccgccagg

SEQ ID NO: 1819632 - RNA, 23 nt, Salmonella typhimurium LT2
cggcacguacugcaccaaauccu

SEQ ID NO: 1819633 - RNA, 20 nt, Salmonella typhimurium LT2
cggcaauaauguuuacgcca

SEQ ID NO: 1819634 - RNA, 16 nt, Salmonella typhimurium LT2
cggcaauaucccgcca

SEQ ID NO: 1819635 - RNA, 23 nt, Salmonella typhimurium LT2
cggcaauauccugugucggcaga

SEQ ID NO: 1819636 - RNA, 21 nt, Salmonella typhimurium LT2
cggaugcgcaaucacccacgu

SEQ ID NO: 1819637 - RNA, 21 nt, Salmonella typhimurium LT2
cggcaaggucugcgcccaccg

SEQ ID NO: 1819638 - RNA, 21 nt, Salmonella typhimurium LT2
cggagaucagcaguugcgacu

SEQ ID NO: 1819639 - RNA, 17 nt, Salmonella typhimurium LT2
cggagcggcguccgcca

SEQ ID NO: 1819640 - RNA, 15 nt, Salmonella typhimurium LT2
cggagcggcguccgc

SEQ ID NO: 1819641 - RNA, 22 nt, Salmonella typhimurium LT2
cggagccugggaucgcaucauc

SEQ ID NO: 1819642 - RNA, 23 nt, Salmonella typhimurium LT2
cggacugauaccgcguuugcgca

SEQ ID NO: 1819643 - RNA, 21 nt, Salmonella typhimurium LT2
cggagagagcaacuggcaaua

SEQ ID NO: 1819644 - RNA, 21 nt, Salmonella typhimurium LT2
cggagagaguauaagcgccgc

SEQ ID NO: 1819645 - RNA, 18 nt, Salmonella typhimurium LT2
cggagagaugccgccagu

SEQ ID NO: 1819646 - RNA, 19 nt, Salmonella typhimurium LT2
cggaucagccugagcgcca

SEQ ID NO: 1819647 - RNA, 20 nt, Salmonella typhimurium LT2
cggaucagccugagcgccag

SEQ ID NO: 1819648 - RNA, 20 nt, Salmonella typhimurium LT2
cggaucaaucaccaccaggu

SEQ ID NO: 1819649 - RNA, 17 nt, Salmonella typhimurium LT2
cggauaagcgcagcgcc

SEQ ID NO: 1819650 - RNA, 19 nt, Salmonella typhimurium LT2
cggauaagcguaagcgcca

SEQ ID NO: 1819651 - RNA, 19 nt, Salmonella typhimurium LT2
cggauaagcguagcgcauc

SEQ ID NO: 1819652 - RNA, 18 nt, Salmonella typhimurium LT2
cggauaagcaaagcgcca

SEQ ID NO: 1819653 - RNA, 19 nt, Salmonella typhimurium LT2
cggauaagcaaagcgccau

SEQ ID NO: 1819654 - RNA, 14 nt, Salmonella typhimurium LT2
cggauaagacgcua

SEQ ID NO: 1819655 - RNA, 15 nt, Salmonella typhimurium LT2
cggauagucaucgcc

SEQ ID NO: 1819656 - RNA, 15 nt, Salmonella typhimurium LT2
cggaucaaaaaggug

SEQ ID NO: 1819657 - RNA, 24 nt, Salmonella typhimurium LT2
cggauaaggcguucacgccgccau

SEQ ID NO: 1819658 - RNA, 18 nt, Salmonella typhimurium LT2
cggauaagcguagcgcca

SEQ ID NO: 1819659 - RNA, 19 nt, Salmonella typhimurium LT2
cggauaagcguuagcgcca

SEQ ID NO: 1819660 - RNA, 20 nt, Salmonella typhimurium LT2
cggauaaggcgcagccgcca

SEQ ID NO: 1819661 - RNA, 20 nt, Salmonella typhimurium LT2
cggauaagcauuagcgccau

SEQ ID NO: 1819662 - RNA, 19 nt, Salmonella typhimurium LT2
cggaggaauccaugaccgu

SEQ ID NO: 1819663 - RNA, 23 nt, Salmonella typhimurium LT2
cggaggaccugauuaaucagcuc

SEQ ID NO: 1819664 - RNA, 18 nt, Salmonella typhimurium LT2
cgcuggugacaucgccgg

SEQ ID NO: 1819665 - RNA, 15 nt, Salmonella typhimurium LT2
cgcuguaccggcagg

SEQ ID NO: 1819666 - RNA, 17 nt, Salmonella typhimurium LT2
cgcuguaccgccauccg

SEQ ID NO: 1819667 - RNA, 19 nt, Salmonella typhimurium LT2
cgcuguaccgccauccggc

SEQ ID NO: 1819668 - RNA, 18 nt, Salmonella typhimurium LT2
cgcuguaacuucacgcca

SEQ ID NO: 1819669 - RNA, 19 nt, Salmonella typhimurium LT2
cgcuguaacuucacgccau

SEQ ID NO: 1819670 - RNA, 15 nt, Salmonella typhimurium LT2
cgcuguaaaccggcc

SEQ ID NO: 1819671 - RNA, 13 nt, Salmonella typhimurium LT2
cgcuguaggccgg

SEQ ID NO: 1819672 - RNA, 16 nt, Salmonella typhimurium LT2
cgcuguaguaaacggc

SEQ ID NO: 1819673 - RNA, 24 nt, Salmonella typhimurium LT2
cggaaugacaaacgccaccgcuac

SEQ ID NO: 1819674 - RNA, 23 nt, Salmonella typhimurium LT2
cggaaugccguauaccagcguca

SEQ ID NO: 1819675 - RNA, 16 nt, Salmonella typhimurium LT2
cggacacccgcagccg

SEQ ID NO: 1819676 - RNA, 16 nt, Salmonella typhimurium LT2
cggaccagacgaccgu

SEQ ID NO: 1819677 - RNA, 13 nt, Salmonella typhimurium LT2
cggaccagcgugc

SEQ ID NO: 1819678 - RNA, 19 nt, Salmonella typhimurium LT2
cggacgaacgcuaugcgcc

SEQ ID NO: 1819679 - RNA, 15 nt, Salmonella typhimurium LT2
cggacgagcgcguca

SEQ ID NO: 1819680 - RNA, 19 nt, Salmonella typhimurium LT2
cggacggcaaccguccgcu

SEQ ID NO: 1819681 - RNA, 22 nt, Salmonella typhimurium LT2
cggaccggcagcgucggcuuca

SEQ ID NO: 1819682 - RNA, 13 nt, Salmonella typhimurium LT2
cggcugccgauag

SEQ ID NO: 1819683 - RNA, 21 nt, Salmonella typhimurium LT2
cggcugcgucgcuuccuguuc

SEQ ID NO: 1819684 - RNA, 17 nt, Salmonella typhimurium LT2
cggcugcaccagcguua

SEQ ID NO: 1819685 - RNA, 16 nt, Salmonella typhimurium LT2
cggcucugcaucauuc

SEQ ID NO: 1819686 - RNA, 21 nt, Salmonella typhimurium LT2
cggcuguauguaggguacagc

SEQ ID NO: 1819687 - RNA, 13 nt, Salmonella typhimurium LT2
cggcuuacccuga

SEQ ID NO: 1819688 - RNA, 18 nt, Salmonella typhimurium LT2
cggcuuauccggcuuacg

SEQ ID NO: 1819689 - RNA, 21 nt, Salmonella typhimurium LT2
cggcugguaagagagccuuau

SEQ ID NO: 1819690 - RNA, 22 nt, Salmonella typhimurium LT2
cggcuuucacaccguuauccgg

SEQ ID NO: 1819691 - RNA, 13 nt, Salmonella typhimurium LT2
cggcuuuccagcu

SEQ ID NO: 1819692 - RNA, 16 nt, Salmonella typhimurium LT2
cggcuugugagcgucg

SEQ ID NO: 1819693 - RNA, 14 nt, Salmonella typhimurium LT2
cggcuucagcgaca

SEQ ID NO: 1819694 - RNA, 22 nt, Salmonella typhimurium LT2
cgggaaaaggaccacaagcugu

SEQ ID NO: 1819695 - RNA, 19 nt, Salmonella typhimurium LT2
cggcguuuuuuuaucaggc

SEQ ID NO: 1819696 - RNA, 15 nt, Salmonella typhimurium LT2
cggcguuugcuguuu

SEQ ID NO: 1819697 - RNA, 17 nt, Salmonella typhimurium LT2
cggcuauguagcgcuga

SEQ ID NO: 1819698 - RNA, 14 nt, Salmonella typhimurium LT2
cggcuccagcgcca

SEQ ID NO: 1819699 - RNA, 17 nt, Salmonella typhimurium LT2
cggcuccagcgccagcu

SEQ ID NO: 1819700 - RNA, 16 nt, Salmonella typhimurium LT2
cggcgugucagggcgg

SEQ ID NO: 1819701 - RNA, 18 nt, Salmonella typhimurium LT2
cggcguguaaaccgccag

SEQ ID NO: 1819702 - RNA, 19 nt, Salmonella typhimurium LT2
cggcguguaaaccgccaga

SEQ ID NO: 1819703 - RNA, 16 nt, Salmonella typhimurium LT2
cggcguuaacgucgcc

SEQ ID NO: 1819704 - RNA, 20 nt, Salmonella typhimurium LT2
cggcggccaaccccggcaaa

SEQ ID NO: 1819705 - RNA, 14 nt, Salmonella typhimurium LT2
cggcggcuagcgca

SEQ ID NO: 1819706 - RNA, 15 nt, Salmonella typhimurium LT2
cggcggcuagcgcag

SEQ ID NO: 1819707 - RNA, 16 nt, Salmonella typhimurium LT2
cggcgcuucggcgcca

SEQ ID NO: 1819708 - RNA, 15 nt, Salmonella typhimurium LT2
cggcggacagcggca

SEQ ID NO: 1819709 - RNA, 17 nt, Salmonella typhimurium LT2
cggcgcugaugacgcgc

SEQ ID NO: 1819710 - RNA, 22 nt, Salmonella typhimurium LT2
cggcgcugucacuccggcugca

SEQ ID NO: 1819711 - RNA, 17 nt, Salmonella typhimurium LT2
cggcgcguugccgccga

SEQ ID NO: 1819712 - RNA, 17 nt, Salmonella typhimurium LT2
cggcgcgguuuccggua

SEQ ID NO: 1819713 - RNA, 17 nt, Salmonella typhimurium LT2
cggcgccauccggcaga

SEQ ID NO: 1819714 - RNA, 16 nt, Salmonella typhimurium LT2
cggcgccauccggcau

SEQ ID NO: 1819715 - RNA, 22 nt, Salmonella typhimurium LT2
cggcgcaucgccgcaagcggca

SEQ ID NO: 1819716 - RNA, 22 nt, Salmonella typhimurium LT2
cggcgcauuuucggcagcgcga

SEQ ID NO: 1819717 - RNA, 18 nt, Salmonella typhimurium LT2
cggcgccaaucaccgcca

SEQ ID NO: 1819718 - RNA, 23 nt, Salmonella typhimurium LT2
cggguaagcgcaagcgccacccg

SEQ ID NO: 1819719 - RNA, 22 nt, Salmonella typhimurium LT2
cggguaggugauggugccgccg

SEQ ID NO: 1819720 - RNA, 15 nt, Salmonella typhimurium LT2
cgggucaaaagcgug

SEQ ID NO: 1819721 - RNA, 16 nt, Salmonella typhimurium LT2
cgguacuggagaccgg

SEQ ID NO: 1819722 - RNA, 17 nt, Salmonella typhimurium LT2
cgguacgacugacuuca

SEQ ID NO: 1819723 - RNA, 20 nt, Salmonella typhimurium LT2
cgguaggccggauaaggcau

SEQ ID NO: 1819724 - RNA, 16 nt, Salmonella typhimurium LT2
cgguauagaucaggcg

SEQ ID NO: 1819725 - RNA, 17 nt, Salmonella typhimurium LT2
cgguaugaaagccaucg

SEQ ID NO: 1819726 - RNA, 16 nt, Salmonella typhimurium LT2
cggucaauacaucacg

SEQ ID NO: 1819727 - RNA, 16 nt, Salmonella typhimurium LT2
cggucaaucaucagaa

SEQ ID NO: 1819728 - RNA, 18 nt, Salmonella typhimurium LT2
cgguauugauacaggcgc

SEQ ID NO: 1819729 - RNA, 19 nt, Salmonella typhimurium LT2
cggucaaaagcugcauccg

SEQ ID NO: 1819730 - RNA, 19 nt, Salmonella typhimurium LT2
cggucagcacagcgaugau

SEQ ID NO: 1819731 - RNA, 12 nt, Salmonella typhimurium LT2
cggucacgcgau

SEQ ID NO: 1819732 - RNA, 15 nt, Salmonella typhimurium LT2
cgggcaaugccacca

SEQ ID NO: 1819733 - RNA, 21 nt, Salmonella typhimurium LT2
cgggcaaugccaccagcgcca

SEQ ID NO: 1819734 - RNA, 15 nt, Salmonella typhimurium LT2
cgggaaguaaggcau

SEQ ID NO: 1819735 - RNA, 18 nt, Salmonella typhimurium LT2
cgggcauucaguuugcaa

SEQ ID NO: 1819736 - RNA, 14 nt, Salmonella typhimurium LT2
cgggcgaggccucg

SEQ ID NO: 1819737 - RNA, 20 nt, Salmonella typhimurium LT2
cgggcgguaaguuccggcuc

SEQ ID NO: 1819738 - RNA, 18 nt, Salmonella typhimurium LT2
gagcuuugacgacccgcu

SEQ ID NO: 1819739 - RNA, 18 nt, Salmonella typhimurium LT2
gagcuucuuggcgauuuc

SEQ ID NO: 1819740 - RNA, 17 nt, Salmonella typhimurium LT2
gaggaacuguucagcca

SEQ ID NO: 1819741 - RNA, 21 nt, Salmonella typhimurium LT2
gaggauagugauauagcgcca

SEQ ID NO: 1819742 - RNA, 22 nt, Salmonella typhimurium LT2
gaggauagugauauagcgccau

SEQ ID NO: 1819743 - RNA, 14 nt, Salmonella typhimurium LT2
gaguaacaccgcgg

SEQ ID NO: 1819744 - RNA, 21 nt, Salmonella typhimurium LT2
gaguaccgccuuguccggccu

SEQ ID NO: 1819745 - RNA, 16 nt, Salmonella typhimurium LT2
gaguacgccgauagcg

SEQ ID NO: 1819746 - RNA, 15 nt, Salmonella typhimurium LT2
gaggguugauaaccc

SEQ ID NO: 1819747 - RNA, 16 nt, Salmonella typhimurium LT2
gaggguggcaccgcgc

SEQ ID NO: 1819748 - RNA, 15 nt, Salmonella typhimurium LT2
gaggcuacccagaca

SEQ ID NO: 1819749 - RNA, 16 nt, Salmonella typhimurium LT2
gaggcaaaaugccagc

SEQ ID NO: 1819750 - RNA, 19 nt, Salmonella typhimurium LT2
gaggcaacagauacggcgc

SEQ ID NO: 1819751 - RNA, 23 nt, Salmonella typhimurium LT2
gaggccuuaacccccauuuccgu

SEQ ID NO: 1819752 - RNA, 14 nt, Salmonella typhimurium LT2
gauaacccggcgca

SEQ ID NO: 1819753 - RNA, 15 nt, Salmonella typhimurium LT2
gauaacgcagcgcgg

SEQ ID NO: 1819754 - RNA, 13 nt, Salmonella typhimurium LT2
gauaacuaauggc

SEQ ID NO: 1819755 - RNA, 14 nt, Salmonella typhimurium LT2
gauaacgcggguua

SEQ ID NO: 1819756 - RNA, 16 nt, Salmonella typhimurium LT2
gauaacgcucuuaccg

SEQ ID NO: 1819757 - RNA, 14 nt, Salmonella typhimurium LT2
gaguugaauaacgu

SEQ ID NO: 1819758 - RNA, 14 nt, Salmonella typhimurium LT2
gaguugaaaccgcg

SEQ ID NO: 1819759 - RNA, 16 nt, Salmonella typhimurium LT2
gauaaucagcagcgac

SEQ ID NO: 1819760 - RNA, 19 nt, Salmonella typhimurium LT2
gauaaugacgaucaacaga

SEQ ID NO: 1819761 - RNA, 16 nt, Salmonella typhimurium LT2
gauaaugcuuucgcca

SEQ ID NO: 1819762 - RNA, 11 nt, Salmonella typhimurium LT2
gauaaucagca

SEQ ID NO: 1819763 - RNA, 17 nt, Salmonella typhimurium LT2
gauaaucagcacgccac

SEQ ID NO: 1819764 - RNA, 14 nt, Salmonella typhimurium LT2
gauaagucgcguga

SEQ ID NO: 1819765 - RNA, 15 nt, Salmonella typhimurium LT2
gauaagguugccaaa

SEQ ID NO: 1819766 - RNA, 19 nt, Salmonella typhimurium LT2
gauaagguaaagccgccau

SEQ ID NO: 1819767 - RNA, 22 nt, Salmonella typhimurium LT2
gauaagguaaagccgccauccg

SEQ ID NO: 1819768 - RNA, 20 nt, Salmonella typhimurium LT2
gauaagcgaagcgucauccg

SEQ ID NO: 1819769 - RNA, 12 nt, Salmonella typhimurium LT2
gauaagccuccg

SEQ ID NO: 1819770 - RNA, 17 nt, Salmonella typhimurium LT2
gauaagccuccggauga

SEQ ID NO: 1819771 - RNA, 20 nt, Salmonella typhimurium LT2
gauaagccggauaagcguag

SEQ ID NO: 1819772 - RNA, 18 nt, Salmonella typhimurium LT2
gauaagcaagcgccaucg

SEQ ID NO: 1819773 - RNA, 19 nt, Salmonella typhimurium LT2
gauaagcaaagcgccaucg

SEQ ID NO: 1819774 - RNA, 22 nt, Salmonella typhimurium LT2
gauaagcugggcgucaacguga

SEQ ID NO: 1819775 - RNA, 18 nt, Salmonella typhimurium LT2
gauaagcuuacgccaucg

SEQ ID NO: 1819776 - RNA, 15 nt, Salmonella typhimurium LT2
gauaagcgucagcgu

SEQ ID NO: 1819777 - RNA, 15 nt, Salmonella typhimurium LT2
gauaagcgucgccag

SEQ ID NO: 1819778 - RNA, 21 nt, Salmonella typhimurium LT2
gauaagcgucagcgccauccg

SEQ ID NO: 1819779 - RNA, 20 nt, Salmonella typhimurium LT2
gauaagcguagcgccaucag

SEQ ID NO: 1819780 - RNA, 21 nt, Salmonella typhimurium LT2
gauaagcguaagcgccauccg

SEQ ID NO: 1819781 - RNA, 17 nt, Salmonella typhimurium LT2
gauaagcgcagcgccau

SEQ ID NO: 1819782 - RNA, 20 nt, Salmonella typhimurium LT2
gauaagcgcagcgccauccg

SEQ ID NO: 1819783 - RNA, 18 nt, Salmonella typhimurium LT2
gauaagcgccacgucggc

SEQ ID NO: 1819784 - RNA, 23 nt, Salmonella typhimurium LT2
gauauccacaauguugauggcgc

SEQ ID NO: 1819785 - RNA, 16 nt, Salmonella typhimurium LT2
gauaguaucuuauccg

SEQ ID NO: 1819786 - RNA, 17 nt, Salmonella typhimurium LT2
gauagucauugacagca

SEQ ID NO: 1819787 - RNA, 13 nt, Salmonella typhimurium LT2
gauaggccgcuau

SEQ ID NO: 1819788 - RNA, 14 nt, Salmonella typhimurium LT2
gauaggccgcuaua

SEQ ID NO: 1819789 - RNA, 21 nt, Salmonella typhimurium LT2
gauagcugaagugcggauaga

SEQ ID NO: 1819790 - RNA, 19 nt, Salmonella typhimurium LT2
gauagcguagcgccauccg

SEQ ID NO: 1819791 - RNA, 18 nt, Salmonella typhimurium LT2
gauacgucauaucaucca

SEQ ID NO: 1819792 - RNA, 14 nt, Salmonella typhimurium LT2
gauacguuccagca

SEQ ID NO: 1819793 - RNA, 15 nt, Salmonella typhimurium LT2
gauacguuccagcag

SEQ ID NO: 1819794 - RNA, 15 nt, Salmonella typhimurium LT2
gauacggcuccagca

SEQ ID NO: 1819795 - RNA, 20 nt, Salmonella typhimurium LT2
gauacgcuguaguuccugua

SEQ ID NO: 1819796 - RNA, 13 nt, Salmonella typhimurium LT2
gauaauuuaucca

SEQ ID NO: 1819797 - RNA, 16 nt, Salmonella typhimurium LT2
gauacgcggcugaugc

SEQ ID NO: 1819798 - RNA, 22 nt, Salmonella typhimurium LT2
gaucaacuucguucaguuccag

SEQ ID NO: 1819799 - RNA, 22 nt, Salmonella typhimurium LT2
gaucacccacaucagcggcaca

SEQ ID NO: 1819800 - RNA, 16 nt, Salmonella typhimurium LT2
gauaucgcuuacagca

SEQ ID NO: 1819801 - RNA, 16 nt, Salmonella typhimurium LT2
gaucaaacuccgcgcu

SEQ ID NO: 1819802 - RNA, 18 nt, Salmonella typhimurium LT2
gagcauacacauucaggc

SEQ ID NO: 1819803 - RNA, 12 nt, Salmonella typhimurium LT2
gagccaauaucc

SEQ ID NO: 1819804 - RNA, 19 nt, Salmonella typhimurium LT2
gagcagguaucguauccgg

SEQ ID NO: 1819805 - RNA, 14 nt, Salmonella typhimurium LT2
gagccgccauccgg

SEQ ID NO: 1819806 - RNA, 17 nt, Salmonella typhimurium LT2
gagcccucuauccacac

SEQ ID NO: 1819807 - RNA, 15 nt, Salmonella typhimurium LT2
gagcgugacgaccgg

SEQ ID NO: 1819808 - RNA, 16 nt, Salmonella typhimurium LT2
gagcgucaggccaucg

SEQ ID NO: 1819809 - RNA, 15 nt, Salmonella typhimurium LT2
gagcguauccagcac

SEQ ID NO: 1819810 - RNA, 17 nt, Salmonella typhimurium LT2
gagcgucuacgccauca

SEQ ID NO: 1819811 - RNA, 19 nt, Salmonella typhimurium LT2
gagcuauccggcaacauga

SEQ ID NO: 1819812 - RNA, 14 nt, Salmonella typhimurium LT2
gagcggcacgccga

SEQ ID NO: 1819813 - RNA, 23 nt, Salmonella typhimurium LT2
gagcggcaaugagcggccagcgg

SEQ ID NO: 1819814 - RNA, 16 nt, Salmonella typhimurium LT2
gagcggcucauccagc

SEQ ID NO: 1819815 - RNA, 18 nt, Salmonella typhimurium LT2
gagcggcucauccagcaa

SEQ ID NO: 1819816 - RNA, 16 nt, Salmonella typhimurium LT2
gagcgccguaccgcgu

SEQ ID NO: 1819817 - RNA, 16 nt, Salmonella typhimurium LT2
gagcgcgucagcgccu

SEQ ID NO: 1819818 - RNA, 20 nt, Salmonella typhimurium LT2
gagcgauaaacucagcgcca

SEQ ID NO: 1819819 - RNA, 19 nt, Salmonella typhimurium LT2
gagcgcauccggccagcga

SEQ ID NO: 1819820 - RNA, 16 nt, Salmonella typhimurium LT2
gaugacuaaaucagca

SEQ ID NO: 1819821 - RNA, 20 nt, Salmonella typhimurium LT2
gaugacuaaaucagcauccg

SEQ ID NO: 1819822 - RNA, 20 nt, Salmonella typhimurium LT2
gaugagaaauagcgcgccau

SEQ ID NO: 1819823 - RNA, 21 nt, Salmonella typhimurium LT2
gaugagaaauagcgcgccaua

SEQ ID NO: 1819824 - RNA, 22 nt, Salmonella typhimurium LT2
gaugaucagcauagcgccuuca

SEQ ID NO: 1819825 - RNA, 20 nt, Salmonella typhimurium LT2
gaugacgcuucgcuuauccg

SEQ ID NO: 1819826 - RNA, 20 nt, Salmonella typhimurium LT2
gaugacgcugcgcuuauccg

SEQ ID NO: 1819827 - RNA, 20 nt, Salmonella typhimurium LT2
gaugcaggccaagcagcgcc

SEQ ID NO: 1819828 - RNA, 23 nt, Salmonella typhimurium LT2
gaugaugucauaaucgccgucgg

SEQ ID NO: 1819829 - RNA, 23 nt, Salmonella typhimurium LT2
gaugauguuugugaccccggccu

SEQ ID NO: 1819830 - RNA, 15 nt, Salmonella typhimurium LT2
gaugaucuucagccc

SEQ ID NO: 1819831 - RNA, 19 nt, Salmonella typhimurium LT2
gaugaugagaugcaggcca

SEQ ID NO: 1819832 - RNA, 19 nt, Salmonella typhimurium LT2
gaucuucuuuaaccgcgcc

SEQ ID NO: 1819833 - RNA, 20 nt, Salmonella typhimurium LT2
gaugaaacaguccggcgaaa

SEQ ID NO: 1819834 - RNA, 21 nt, Salmonella typhimurium LT2
gaugaaacgacacaggccuga

SEQ ID NO: 1819835 - RNA, 22 nt, Salmonella typhimurium LT2
gaucucaagcgccgccgcauuu

SEQ ID NO: 1819836 - RNA, 14 nt, Salmonella typhimurium LT2
gaucguuuccagca

SEQ ID NO: 1819837 - RNA, 11 nt, Salmonella typhimurium LT2
gaucguucggg

SEQ ID NO: 1819838 - RNA, 19 nt, Salmonella typhimurium LT2
gaucguuauccagcagcca

SEQ ID NO: 1819839 - RNA, 12 nt, Salmonella typhimurium LT2
gaucgcuuucca

SEQ ID NO: 1819840 - RNA, 22 nt, Salmonella typhimurium LT2
gaucgcuuaacaacuccagcaa

SEQ ID NO: 1819841 - RNA, 20 nt, Salmonella typhimurium LT2
gaucgcugagcgccaucagg

SEQ ID NO: 1819842 - RNA, 14 nt, Salmonella typhimurium LT2
gaucggccauaucc

SEQ ID NO: 1819843 - RNA, 14 nt, Salmonella typhimurium LT2
gaucgcgccagccu

SEQ ID NO: 1819844 - RNA, 14 nt, Salmonella typhimurium LT2
gaucgaggucagca

SEQ ID NO: 1819845 - RNA, 21 nt, Salmonella typhimurium LT2
gaucgccuucgccuuccagug

SEQ ID NO: 1819846 - RNA, 17 nt, Salmonella typhimurium LT2
gaucgcgauagcgcuga

SEQ ID NO: 1819847 - RNA, 21 nt, Salmonella typhimurium LT2
gauccccucuuccaucagcca

SEQ ID NO: 1819848 - RNA, 17 nt, Salmonella typhimurium LT2
gaucacggcuucaacuu

SEQ ID NO: 1819849 - RNA, 15 nt, Salmonella typhimurium LT2
gaucccgccgaccag

SEQ ID NO: 1819850 - RNA, 18 nt, Salmonella typhimurium LT2
gaucccgggcgauaaacc

SEQ ID NO: 1819851 - RNA, 14 nt, Salmonella typhimurium LT2
gaucgacggcaaca

SEQ ID NO: 1819852 - RNA, 11 nt, Salmonella typhimurium LT2
gaugccagaug

SEQ ID NO: 1819853 - RNA, 22 nt, Salmonella typhimurium LT2
gaugcauuuuguccagucgaac

SEQ ID NO: 1819854 - RNA, 16 nt, Salmonella typhimurium LT2
gaugccagaucugcau

SEQ ID NO: 1819855 - RNA, 18 nt, Salmonella typhimurium LT2
gaugcgcaaucacccacg

SEQ ID NO: 1819856 - RNA, 19 nt, Salmonella typhimurium LT2
gaugccgccgacaaccagc

SEQ ID NO: 1819857 - RNA, 19 nt, Salmonella typhimurium LT2
gauggcgcuacgcuuauca

SEQ ID NO: 1819858 - RNA, 23 nt, Salmonella typhimurium LT2
gauggacguuuccugcgccagca

SEQ ID NO: 1819859 - RNA, 22 nt, Salmonella typhimurium LT2
gauggcggcuaccucuuauccg

SEQ ID NO: 1819860 - RNA, 21 nt, Salmonella typhimurium LT2
gauggcggcugcgccuuauca

SEQ ID NO: 1819861 - RNA, 17 nt, Salmonella typhimurium LT2
gauggcguaagcuuauc

SEQ ID NO: 1819862 - RNA, 18 nt, Salmonella typhimurium LT2
gauggcguaagcuuaucg

SEQ ID NO: 1819863 - RNA, 19 nt, Salmonella typhimurium LT2
gauggcgcuacgcuuaucg

SEQ ID NO: 1819864 - RNA, 20 nt, Salmonella typhimurium LT2
gauggcgcuuugcuuauccg

SEQ ID NO: 1819865 - RNA, 19 nt, Salmonella typhimurium LT2
gauggcgcugcgcuuauca

SEQ ID NO: 1819866 - RNA, 19 nt, Salmonella typhimurium LT2
gauggcgcuucgcuuauca

SEQ ID NO: 1819867 - RNA, 18 nt, Salmonella typhimurium LT2
gauggcgcuugcuuaucg

SEQ ID NO: 1819868 - RNA, 20 nt, Salmonella typhimurium LT2
gauggcgcuacgcuuaucag

SEQ ID NO: 1819869 - RNA, 20 nt, Salmonella typhimurium LT2
gauggcgcuacgcuuauccg

SEQ ID NO: 1819870 - RNA, 19 nt, Salmonella typhimurium LT2
gauggcgcucgcuuaucug

SEQ ID NO: 1819871 - RNA, 20 nt, Salmonella typhimurium LT2
gaugcgcucacgcuuauccg

SEQ ID NO: 1819872 - RNA, 20 nt, Salmonella typhimurium LT2
gaugcgcucauaaccgcgau

SEQ ID NO: 1819873 - RNA, 21 nt, Salmonella typhimurium LT2
gaugcgcguuuagcgccagca

SEQ ID NO: 1819874 - RNA, 22 nt, Salmonella typhimurium LT2
gaugcgcguuuagcgccagcag

SEQ ID NO: 1819875 - RNA, 19 nt, Salmonella typhimurium LT2
gaugcgcguuuuccaccag

SEQ ID NO: 1819876 - RNA, 13 nt, Salmonella typhimurium LT2
gaugcgcucacgc

SEQ ID NO: 1819877 - RNA, 14 nt, Salmonella typhimurium LT2
gaugcggacgcuga

SEQ ID NO: 1819878 - RNA, 14 nt, Salmonella typhimurium LT2
gaugcgcuuuucca

SEQ ID NO: 1819879 - RNA, 17 nt, Salmonella typhimurium LT2
gaugcguaauccggccu

SEQ ID NO: 1819880 - RNA, 17 nt, Salmonella typhimurium LT2
gauuuuuaagcugcgca

SEQ ID NO: 1819881 - RNA, 17 nt, Salmonella typhimurium LT2
gcaaaaagaaucgccag

SEQ ID NO: 1819882 - RNA, 18 nt, Salmonella typhimurium LT2
gcaaaaagaaucgccagg

SEQ ID NO: 1819883 - RNA, 17 nt, Salmonella typhimurium LT2
gauuugucgcgcauugc

SEQ ID NO: 1819884 - RNA, 15 nt, Salmonella typhimurium LT2
gauuggcaccgacgu

SEQ ID NO: 1819885 - RNA, 22 nt, Salmonella typhimurium LT2
gauuuugccuucaauuccugga

SEQ ID NO: 1819886 - RNA, 17 nt, Salmonella typhimurium LT2
gauugauucgcgccagc

SEQ ID NO: 1819887 - RNA, 20 nt, Salmonella typhimurium LT2
gauugccgcccguacagaca

SEQ ID NO: 1819888 - RNA, 23 nt, Salmonella typhimurium LT2
gauugcagagaaguguacaaaca

SEQ ID NO: 1819889 - RNA, 16 nt, Salmonella typhimurium LT2
gauugccugauggcgc

SEQ ID NO: 1819890 - RNA, 17 nt, Salmonella typhimurium LT2
gauuaagggacgguaaa

SEQ ID NO: 1819891 - RNA, 23 nt, Salmonella typhimurium LT2
gauguuuugcggcuucagcgaca

SEQ ID NO: 1819892 - RNA, 20 nt, Salmonella typhimurium LT2
gauuaauaauugagcgcaaa

SEQ ID NO: 1819893 - RNA, 21 nt, Salmonella typhimurium LT2
gaugguguuggcgaucagcgg

SEQ ID NO: 1819894 - RNA, 17 nt, Salmonella typhimurium LT2
gcagccucguccugcaa

SEQ ID NO: 1819895 - RNA, 20 nt, Salmonella typhimurium LT2
gcagccuaguucugcgccag

SEQ ID NO: 1819896 - RNA, 17 nt, Salmonella typhimurium LT2
gcagccgguauccagcg

SEQ ID NO: 1819897 - RNA, 20 nt, Salmonella typhimurium LT2
gcagcgacguaaugaucagc

SEQ ID NO: 1819898 - RNA, 12 nt, Salmonella typhimurium LT2
gcagcgccaucc

SEQ ID NO: 1819899 - RNA, 12 nt, Salmonella typhimurium LT2
gcagcgccaucu

SEQ ID NO: 1819900 - RNA, 19 nt, Salmonella typhimurium LT2
gcagcguaauggccaccag

SEQ ID NO: 1819901 - RNA, 21 nt, Salmonella typhimurium LT2
gcagcgugguuuccggcagcu

SEQ ID NO: 1819902 - RNA, 14 nt, Salmonella typhimurium LT2
gcagcggcauuggc

SEQ ID NO: 1819903 - RNA, 16 nt, Salmonella typhimurium LT2
gcagcgggugcuccag

SEQ ID NO: 1819904 - RNA, 15 nt, Salmonella typhimurium LT2
gcagcaucgccauca

SEQ ID NO: 1819905 - RNA, 20 nt, Salmonella typhimurium LT2
gcagcauacgacaucgccaa

SEQ ID NO: 1819906 - RNA, 13 nt, Salmonella typhimurium LT2
gcagcauccagcu

SEQ ID NO: 1819907 - RNA, 22 nt, Salmonella typhimurium LT2
gcagccagaaaaagggaaaagc

SEQ ID NO: 1819908 - RNA, 14 nt, Salmonella typhimurium LT2
gcagccacggcgca

SEQ ID NO: 1819909 - RNA, 21 nt, Salmonella typhimurium LT2
gcagccagcccagcgcaaccu

SEQ ID NO: 1819910 - RNA, 19 nt, Salmonella typhimurium LT2
gcagauaccgaccgugaga

SEQ ID NO: 1819911 - RNA, 21 nt, Salmonella typhimurium LT2
gcagauaucuuccagcgcguc

SEQ ID NO: 1819912 - RNA, 19 nt, Salmonella typhimurium LT2
gcagaguccagcggcagcu

SEQ ID NO: 1819913 - RNA, 22 nt, Salmonella typhimurium LT2
gcagauaucuuccagcgcgucc

SEQ ID NO: 1819914 - RNA, 18 nt, Salmonella typhimurium LT2
gcagauacugcgcguggc

SEQ ID NO: 1819915 - RNA, 23 nt, Salmonella typhimurium LT2
gcagauagagcgccugcaggcga

SEQ ID NO: 1819916 - RNA, 16 nt, Salmonella typhimurium LT2
gcagauccaucgccug

SEQ ID NO: 1819917 - RNA, 20 nt, Salmonella typhimurium LT2
gcagaucugucgccaugacc

SEQ ID NO: 1819918 - RNA, 22 nt, Salmonella typhimurium LT2
gcaggaucccgaauaucgcgag

SEQ ID NO: 1819919 - RNA, 21 nt, Salmonella typhimurium LT2
gcaggauucgaaccugcgacc

SEQ ID NO: 1819920 - RNA, 15 nt, Salmonella typhimurium LT2
gcaggacagcgacau

SEQ ID NO: 1819921 - RNA, 13 nt, Salmonella typhimurium LT2
gcagcuuauccgg

SEQ ID NO: 1819922 - RNA, 17 nt, Salmonella typhimurium LT2
gcaggcuuccacgcacg

SEQ ID NO: 1819923 - RNA, 20 nt, Salmonella typhimurium LT2
gcaggcuuccacgcacgccg

SEQ ID NO: 1819924 - RNA, 12 nt, Salmonella typhimurium LT2
gcaggcuuccag

SEQ ID NO: 1819925 - RNA, 20 nt, Salmonella typhimurium LT2
gcaggcuucacgcucacggu

SEQ ID NO: 1819926 - RNA, 17 nt, Salmonella typhimurium LT2
gcagggccgcguuaacg

SEQ ID NO: 1819927 - RNA, 20 nt, Salmonella typhimurium LT2
gcagggccgcguuaacgccg

SEQ ID NO: 1819928 - RNA, 21 nt, Salmonella typhimurium LT2
gcaggcgaccucgcagguacg

SEQ ID NO: 1819929 - RNA, 18 nt, Salmonella typhimurium LT2
gcaggccuuucggcagcg

SEQ ID NO: 1819930 - RNA, 15 nt, Salmonella typhimurium LT2
gcaggcaacaugacc

SEQ ID NO: 1819931 - RNA, 21 nt, Salmonella typhimurium LT2
gcaucaucucccaggccgcca

SEQ ID NO: 1819932 - RNA, 23 nt, Salmonella typhimurium LT2
gcaucauacauauauuccggguc

SEQ ID NO: 1819933 - RNA, 21 nt, Salmonella typhimurium LT2
gcaucaugauguucaucgaca

SEQ ID NO: 1819934 - RNA, 16 nt, Salmonella typhimurium LT2
gcaucagacuguuacg

SEQ ID NO: 1819935 - RNA, 12 nt, Salmonella typhimurium LT2
gcaucagcgacu

SEQ ID NO: 1819936 - RNA, 22 nt, Salmonella typhimurium LT2
gcaucaggauugcugugaagca

SEQ ID NO: 1819937 - RNA, 17 nt, Salmonella typhimurium LT2
gcauaugcacagcgcua

SEQ ID NO: 1819938 - RNA, 22 nt, Salmonella typhimurium LT2
gcauaguccugccgacaggcag

SEQ ID NO: 1819939 - RNA, 21 nt, Salmonella typhimurium LT2
gcauaucgauagcaucgguca

SEQ ID NO: 1819940 - RNA, 16 nt, Salmonella typhimurium LT2
gcauacgacaucgcca

SEQ ID NO: 1819941 - RNA, 14 nt, Salmonella typhimurium LT2
gcauacguuucacc

SEQ ID NO: 1819942 - RNA, 21 nt, Salmonella typhimurium LT2
gcauacacgccgggcacgcug

SEQ ID NO: 1819943 - RNA, 24 nt, Salmonella typhimurium LT2
gcauacauaaauccggaucggauu

SEQ ID NO: 1819944 - RNA, 18 nt, Salmonella typhimurium LT2
gcaguguaucguugucgc

SEQ ID NO: 1819945 - RNA, 18 nt, Salmonella typhimurium LT2
gcagucguucacgcgcuu

SEQ ID NO: 1819946 - RNA, 23 nt, Salmonella typhimurium LT2
gcaguaauuucuugcgccagcgc

SEQ ID NO: 1819947 - RNA, 20 nt, Salmonella typhimurium LT2
gcagucagugaaaaaccgau

SEQ ID NO: 1819948 - RNA, 12 nt, Salmonella typhimurium LT2
gcaccagaccga

SEQ ID NO: 1819949 - RNA, 20 nt, Salmonella typhimurium LT2
gcaccaccggacucggcuga

SEQ ID NO: 1819950 - RNA, 23 nt, Salmonella typhimurium LT2
gcacauugcugccuuauccggcc

SEQ ID NO: 1819951 - RNA, 18 nt, Salmonella typhimurium LT2
gcacauguuucagcaccu

SEQ ID NO: 1819952 - RNA, 14 nt, Salmonella typhimurium LT2
gcaccaaucaucac

SEQ ID NO: 1819953 - RNA, 13 nt, Salmonella typhimurium LT2
gcaccaacgccgc

SEQ ID NO: 1819954 - RNA, 17 nt, Salmonella typhimurium LT2
gcaccaaaguuaaucag

SEQ ID NO: 1819955 - RNA, 18 nt, Salmonella typhimurium LT2
gcaccaggagcaaaccga

SEQ ID NO: 1819956 - RNA, 22 nt, Salmonella typhimurium LT2
gcaccaggauaaccuuccggca

SEQ ID NO: 1819957 - RNA, 18 nt, Salmonella typhimurium LT2
gcaccaucuuuuccggca

SEQ ID NO: 1819958 - RNA, 22 nt, Salmonella typhimurium LT2
gcaccaucuuuuccggcagggu

SEQ ID NO: 1819959 - RNA, 15 nt, Salmonella typhimurium LT2
gcaccauagcagcca

SEQ ID NO: 1819960 - RNA, 23 nt, Salmonella typhimurium LT2
gcacaggcggguauggcgccaau

SEQ ID NO: 1819961 - RNA, 11 nt, Salmonella typhimurium LT2
gcacaggccug

SEQ ID NO: 1819962 - RNA, 20 nt, Salmonella typhimurium LT2
gcacaucaauaaauccgcgc

SEQ ID NO: 1819963 - RNA, 16 nt, Salmonella typhimurium LT2
gcacaucaugccagcc

SEQ ID NO: 1819964 - RNA, 19 nt, Salmonella typhimurium LT2
gcacacguauaaacgccgc

SEQ ID NO: 1819965 - RNA, 18 nt, Salmonella typhimurium LT2
gcaauacccagaacuucc

SEQ ID NO: 1819966 - RNA, 20 nt, Salmonella typhimurium LT2
gcaauaugcgucagcgcggc

SEQ ID NO: 1819967 - RNA, 13 nt, Salmonella typhimurium LT2
gcaauaauccgcu

SEQ ID NO: 1819968 - RNA, 16 nt, Salmonella typhimurium LT2
gcaaacgucagcgaua

SEQ ID NO: 1819969 - RNA, 17 nt, Salmonella typhimurium LT2
gcaauacagccagcaca

SEQ ID NO: 1819970 - RNA, 17 nt, Salmonella typhimurium LT2
gcaaaccuaccggcaua

SEQ ID NO: 1819971 - RNA, 22 nt, Salmonella typhimurium LT2
gcaaaccuauuucaguacagcc

SEQ ID NO: 1819972 - RNA, 15 nt, Salmonella typhimurium LT2
gcaaacgacgcugac

SEQ ID NO: 1819973 - RNA, 17 nt, Salmonella typhimurium LT2
gcaaacgguaaacgugc

SEQ ID NO: 1819974 - RNA, 16 nt, Salmonella typhimurium LT2
gcaaacgccugcuccg

SEQ ID NO: 1819975 - RNA, 19 nt, Salmonella typhimurium LT2
gcaauggguaggccggaua

SEQ ID NO: 1819976 - RNA, 15 nt, Salmonella typhimurium LT2
gcaauuucucgcucg

SEQ ID NO: 1819977 - RNA, 23 nt, Salmonella typhimurium LT2
gcacaacacgcuuuucagcgcca

SEQ ID NO: 1819978 - RNA, 14 nt, Salmonella typhimurium LT2
gcaaucgcuggcgu

SEQ ID NO: 1819979 - RNA, 16 nt, Salmonella typhimurium LT2
gcaaugccgccgccag

SEQ ID NO: 1819980 - RNA, 15 nt, Salmonella typhimurium LT2
gcaaucggcuuugac

SEQ ID NO: 1819981 - RNA, 22 nt, Salmonella typhimurium LT2
gcaaucacguuuugcagcgcca

SEQ ID NO: 1819982 - RNA, 15 nt, Salmonella typhimurium LT2
gcaaucgccugaaua

SEQ ID NO: 1819983 - RNA, 16 nt, Salmonella typhimurium LT2
gcaaucgccagcgccu

SEQ ID NO: 1819984 - RNA, 23 nt, Salmonella typhimurium LT2
gcaaucgacguugaucgccaucg

SEQ ID NO: 1819985 - RNA, 16 nt, Salmonella typhimurium LT2
gcaccuuauccggccu

SEQ ID NO: 1819986 - RNA, 12 nt, Salmonella typhimurium LT2
gcacgccagcgc

SEQ ID NO: 1819987 - RNA, 18 nt, Salmonella typhimurium LT2
gcacgcuuuggcaggccu

SEQ ID NO: 1819988 - RNA, 17 nt, Salmonella typhimurium LT2
gcacgcuuacccagcau

SEQ ID NO: 1819989 - RNA, 18 nt, Salmonella typhimurium LT2
gcacgcuauauuccagcc

SEQ ID NO: 1819990 - RNA, 15 nt, Salmonella typhimurium LT2
gcacggcuucacgua

SEQ ID NO: 1819991 - RNA, 21 nt, Salmonella typhimurium LT2
gccgcgcgacagagccaacag

SEQ ID NO: 1819992 - RNA, 12 nt, Salmonella typhimurium LT2
gccgcgccuuac

SEQ ID NO: 1819993 - RNA, 16 nt, Salmonella typhimurium LT2
gccgcgcccagcgccg

SEQ ID NO: 1819994 - RNA, 13 nt, Salmonella typhimurium LT2
gccgcgcccagcg

SEQ ID NO: 1819995 - RNA, 13 nt, Salmonella typhimurium LT2
gccgcgccagacg

SEQ ID NO: 1819996 - RNA, 13 nt, Salmonella typhimurium LT2
gccgcgcagcgca

SEQ ID NO: 1819997 - RNA, 17 nt, Salmonella typhimurium LT2
gccgccugccagaucca

SEQ ID NO: 1819998 - RNA, 13 nt, Salmonella typhimurium LT2
gccgccgccaucg

SEQ ID NO: 1819999 - RNA, 11 nt, Salmonella typhimurium LT2
gccgccagcgu

SEQ ID NO: 1820000 - RNA, 19 nt, Salmonella typhimurium LT2
gccgccauaggucagcgcu

SEQ ID NO: 1820001 - RNA, 16 nt, Salmonella typhimurium LT2
gccgccauccggcaca

SEQ ID NO: 1820002 - RNA, 16 nt, Salmonella typhimurium LT2
gccgccauccggccug

SEQ ID NO: 1820003 - RNA, 17 nt, Salmonella typhimurium LT2
gccgcccaccugcagca

SEQ ID NO: 1820004 - RNA, 16 nt, Salmonella typhimurium LT2
gccgcuggucaacacg

SEQ ID NO: 1820005 - RNA, 14 nt, Salmonella typhimurium LT2
gccgcuggcgucuu

SEQ ID NO: 1820006 - RNA, 20 nt, Salmonella typhimurium LT2
gccgcuugccaguacgccag

SEQ ID NO: 1820007 - RNA, 16 nt, Salmonella typhimurium LT2
gccggagcugauacgg

SEQ ID NO: 1820008 - RNA, 18 nt, Salmonella typhimurium LT2
gccgcuuuaccgccuucc

SEQ ID NO: 1820009 - RNA, 23 nt, Salmonella typhimurium LT2
gccgcuuuccgccgccgccaucg

SEQ ID NO: 1820010 - RNA, 22 nt, Salmonella typhimurium LT2
gccggauaagcgaagcgucauc

SEQ ID NO: 1820011 - RNA, 16 nt, Salmonella typhimurium LT2
gccggaugaccagaac

SEQ ID NO: 1820012 - RNA, 15 nt, Salmonella typhimurium LT2
gccgcuauccggcaa

SEQ ID NO: 1820013 - RNA, 22 nt, Salmonella typhimurium LT2
gccgcucgccugcgcucauaua

SEQ ID NO: 1820014 - RNA, 14 nt, Salmonella typhimurium LT2
gccgaccaauugca

SEQ ID NO: 1820015 - RNA, 22 nt, Salmonella typhimurium LT2
gccgacgcauuucuccugauua

SEQ ID NO: 1820016 - RNA, 15 nt, Salmonella typhimurium LT2
gccgacuauuccgca

SEQ ID NO: 1820017 - RNA, 23 nt, Salmonella typhimurium LT2
gccgacuauuccgcaaacgccgu

SEQ ID NO: 1820018 - RNA, 21 nt, Salmonella typhimurium LT2
gccgaugaacgaugcugauuu

SEQ ID NO: 1820019 - RNA, 15 nt, Salmonella typhimurium LT2
gccgaugaucccggc

SEQ ID NO: 1820020 - RNA, 17 nt, Salmonella typhimurium LT2
gccgauggucgcgccaa

SEQ ID NO: 1820021 - RNA, 17 nt, Salmonella typhimurium LT2
gccgcacagaaucgccg

SEQ ID NO: 1820022 - RNA, 12 nt, Salmonella typhimurium LT2
gccgaucaggcc

SEQ ID NO: 1820023 - RNA, 16 nt, Salmonella typhimurium LT2
gccgaucaccagcgca

SEQ ID NO: 1820024 - RNA, 20 nt, Salmonella typhimurium LT2
gccgaucaccagcgcaucgc

SEQ ID NO: 1820025 - RNA, 15 nt, Salmonella typhimurium LT2
gccgauagaccuucg

SEQ ID NO: 1820026 - RNA, 18 nt, Salmonella typhimurium LT2
gccgaucacaacgucagc

SEQ ID NO: 1820027 - RNA, 16 nt, Salmonella typhimurium LT2
gcccucuuccggcgcu

SEQ ID NO: 1820028 - RNA, 16 nt, Salmonella typhimurium LT2
gcccucgguacugcgg

SEQ ID NO: 1820029 - RNA, 21 nt, Salmonella typhimurium LT2
gcccugcuugucgaucaucag

SEQ ID NO: 1820030 - RNA, 23 nt, Salmonella typhimurium LT2
gcccugcaaaaguuugaccagca

SEQ ID NO: 1820031 - RNA, 22 nt, Salmonella typhimurium LT2
gcccugaggaguauuauccauu

SEQ ID NO: 1820032 - RNA, 14 nt, Salmonella typhimurium LT2
gcccgugacgccag

SEQ ID NO: 1820033 - RNA, 18 nt, Salmonella typhimurium LT2
gcccguaucacugauaua

SEQ ID NO: 1820034 - RNA, 13 nt, Salmonella typhimurium LT2
gcccguuccaggc

SEQ ID NO: 1820035 - RNA, 23 nt, Salmonella typhimurium LT2
gcccgucaccauuaacaucagaa

SEQ ID NO: 1820036 - RNA, 14 nt, Salmonella typhimurium LT2
gcccguuuuaccgg

SEQ ID NO: 1820037 - RNA, 17 nt, Salmonella typhimurium LT2
gcccuguccuccauggc

SEQ ID NO: 1820038 - RNA, 23 nt, Salmonella typhimurium LT2
gcccuggaggaacagcgccguca

SEQ ID NO: 1820039 - RNA, 17 nt, Salmonella typhimurium LT2
gcccuucuccggucauc

SEQ ID NO: 1820040 - RNA, 12 nt, Salmonella typhimurium LT2
gcccuuccagcu

SEQ ID NO: 1820041 - RNA, 13 nt, Salmonella typhimurium LT2
gccgaacaggcca

SEQ ID NO: 1820042 - RNA, 14 nt, Salmonella typhimurium LT2
gccgaacgcggcuu

SEQ ID NO: 1820043 - RNA, 22 nt, Salmonella typhimurium LT2
gccgaagccauuggucaucauc

SEQ ID NO: 1820044 - RNA, 18 nt, Salmonella typhimurium LT2
gccgaagacuccccugca

SEQ ID NO: 1820045 - RNA, 17 nt, Salmonella typhimurium LT2
gcccccgaucacggcga

SEQ ID NO: 1820046 - RNA, 15 nt, Salmonella typhimurium LT2
gccccgaugucgcca

SEQ ID NO: 1820047 - RNA, 18 nt, Salmonella typhimurium LT2
gcccaugauggugaacag

SEQ ID NO: 1820048 - RNA, 22 nt, Salmonella typhimurium LT2
gcccagcucuuuaggcaggaaa

SEQ ID NO: 1820049 - RNA, 14 nt, Salmonella typhimurium LT2
gcccagcucaucga

SEQ ID NO: 1820050 - RNA, 14 nt, Salmonella typhimurium LT2
gcccaucagcgcca

SEQ ID NO: 1820051 - RNA, 15 nt, Salmonella typhimurium LT2
gcccaucagcgccag

SEQ ID NO: 1820052 - RNA, 16 nt, Salmonella typhimurium LT2
gcccaucaccgccagu

SEQ ID NO: 1820053 - RNA, 21 nt, Salmonella typhimurium LT2
gcccgauggcgcugcgcgcau

SEQ ID NO: 1820054 - RNA, 23 nt, Salmonella typhimurium LT2
gcccgcaaucucuggccaggcau

SEQ ID NO: 1820055 - RNA, 12 nt, Salmonella typhimurium LT2
gcccgccgccag

SEQ ID NO: 1820056 - RNA, 13 nt, Salmonella typhimurium LT2
gcccgccgccagc

SEQ ID NO: 1820057 - RNA, 19 nt, Salmonella typhimurium LT2
gcccgauaagcaagcgcca

SEQ ID NO: 1820058 - RNA, 19 nt, Salmonella typhimurium LT2
gcccgauaagcaaagcgcc

SEQ ID NO: 1820059 - RNA, 20 nt, Salmonella typhimurium LT2
gcccgauaagcaaagcgcca

SEQ ID NO: 1820060 - RNA, 14 nt, Salmonella typhimurium LT2
gccccugcaggcga

SEQ ID NO: 1820061 - RNA, 15 nt, Salmonella typhimurium LT2
gccauaaucgcguuu

SEQ ID NO: 1820062 - RNA, 22 nt, Salmonella typhimurium LT2
gccauaagcgaacaggccgaaa

SEQ ID NO: 1820063 - RNA, 17 nt, Salmonella typhimurium LT2
gccauaaaugcugauga

SEQ ID NO: 1820064 - RNA, 13 nt, Salmonella typhimurium LT2
gccauccggcaca

SEQ ID NO: 1820065 - RNA, 12 nt, Salmonella typhimurium LT2
gccauccggcaa

SEQ ID NO: 1820066 - RNA, 15 nt, Salmonella typhimurium LT2
gccauccggcaaucc

SEQ ID NO: 1820067 - RNA, 20 nt, Salmonella typhimurium LT2
gccauaccggcgcgcgccag

SEQ ID NO: 1820068 - RNA, 18 nt, Salmonella typhimurium LT2
gccauccggcaucucuuc

SEQ ID NO: 1820069 - RNA, 15 nt, Salmonella typhimurium LT2
gccaucgacagcgcc

SEQ ID NO: 1820070 - RNA, 20 nt, Salmonella typhimurium LT2
gccaucgacagcagcgcuuu

SEQ ID NO: 1820071 - RNA, 13 nt, Salmonella typhimurium LT2
gccaucgacagcg

SEQ ID NO: 1820072 - RNA, 17 nt, Salmonella typhimurium LT2
gccaucuccaucauuuc

SEQ ID NO: 1820073 - RNA, 17 nt, Salmonella typhimurium LT2
gccaucucauucgccag

SEQ ID NO: 1820074 - RNA, 14 nt, Salmonella typhimurium LT2
gccaucguccagcc

SEQ ID NO: 1820075 - RNA, 16 nt, Salmonella typhimurium LT2
gccaucgacagcgcca

SEQ ID NO: 1820076 - RNA, 16 nt, Salmonella typhimurium LT2
gccaugaugagcgcca

SEQ ID NO: 1820077 - RNA, 13 nt, Salmonella typhimurium LT2
gccaugccgaaga

SEQ ID NO: 1820078 - RNA, 18 nt, Salmonella typhimurium LT2
gccaguagauggcgcuaa

SEQ ID NO: 1820079 - RNA, 17 nt, Salmonella typhimurium LT2
gccaguacagcacgccg

SEQ ID NO: 1820080 - RNA, 17 nt, Salmonella typhimurium LT2
gccaguuuuugcgccau

SEQ ID NO: 1820081 - RNA, 19 nt, Salmonella typhimurium LT2
gccaguuuacgcguacucg

SEQ ID NO: 1820082 - RNA, 14 nt, Salmonella typhimurium LT2
gccaugcggcgcca

SEQ ID NO: 1820083 - RNA, 18 nt, Salmonella typhimurium LT2
gcccagcacuaacagcag

SEQ ID NO: 1820084 - RNA, 22 nt, Salmonella typhimurium LT2
gccacggauggccucugccagu

SEQ ID NO: 1820085 - RNA, 19 nt, Salmonella typhimurium LT2
gccacuucacuggcggcaa

SEQ ID NO: 1820086 - RNA, 18 nt, Salmonella typhimurium LT2
gccagcagaagacggaaa

SEQ ID NO: 1820087 - RNA, 22 nt, Salmonella typhimurium LT2
gccagauggaaaccggcgucuu

SEQ ID NO: 1820088 - RNA, 13 nt, Salmonella typhimurium LT2
gccagauggcugc

SEQ ID NO: 1820089 - RNA, 14 nt, Salmonella typhimurium LT2
gccagauguaggcc

SEQ ID NO: 1820090 - RNA, 20 nt, Salmonella typhimurium LT2
gccagauguaggccugauaa

SEQ ID NO: 1820091 - RNA, 15 nt, Salmonella typhimurium LT2
gccagaugucgccag

SEQ ID NO: 1820092 - RNA, 23 nt, Salmonella typhimurium LT2
gccagauuuuccaggccgccagc

SEQ ID NO: 1820093 - RNA, 19 nt, Salmonella typhimurium LT2
gccagauaaagcagcgaca

SEQ ID NO: 1820094 - RNA, 14 nt, Salmonella typhimurium LT2
gccagauaaaucag

SEQ ID NO: 1820095 - RNA, 14 nt, Salmonella typhimurium LT2
gccacuuccagcgc

SEQ ID NO: 1820096 - RNA, 22 nt, Salmonella typhimurium LT2
gccaggaaccgccgaugcacaa

SEQ ID NO: 1820097 - RNA, 19 nt, Salmonella typhimurium LT2
gccagcguugaccagccua

SEQ ID NO: 1820098 - RNA, 21 nt, Salmonella typhimurium LT2
gccagcgaugagcgccagcaa

SEQ ID NO: 1820099 - RNA, 17 nt, Salmonella typhimurium LT2
gccagcgcaucgauaua

SEQ ID NO: 1820100 - RNA, 22 nt, Salmonella typhimurium LT2
gccagcgcagcguggccuuauc

SEQ ID NO: 1820101 - RNA, 18 nt, Salmonella typhimurium LT2
gccagcgcagucagugaa

SEQ ID NO: 1820102 - RNA, 14 nt, Salmonella typhimurium LT2
gccagcgccagcgu

SEQ ID NO: 1820103 - RNA, 22 nt, Salmonella typhimurium LT2
gccagcagcguuuugcgcguaa

SEQ ID NO: 1820104 - RNA, 16 nt, Salmonella typhimurium LT2
gccacaauggcaggca

SEQ ID NO: 1820105 - RNA, 18 nt, Salmonella typhimurium LT2
gccaaugccgaucaccag

SEQ ID NO: 1820106 - RNA, 13 nt, Salmonella typhimurium LT2
gccacaucguuac

SEQ ID NO: 1820107 - RNA, 18 nt, Salmonella typhimurium LT2
gccacaugcggcaggcuu

SEQ ID NO: 1820108 - RNA, 15 nt, Salmonella typhimurium LT2
gccaccacauaccgu

SEQ ID NO: 1820109 - RNA, 12 nt, Salmonella typhimurium LT2
gccacaggaacc

SEQ ID NO: 1820110 - RNA, 18 nt, Salmonella typhimurium LT2
gccacaggcggcaugggu

SEQ ID NO: 1820111 - RNA, 18 nt, Salmonella typhimurium LT2
gccaacuuuuugcgcaau

SEQ ID NO: 1820112 - RNA, 14 nt, Salmonella typhimurium LT2
gccaacuuauccga

SEQ ID NO: 1820113 - RNA, 16 nt, Salmonella typhimurium LT2
gccaagcgcggcagca

SEQ ID NO: 1820114 - RNA, 14 nt, Salmonella typhimurium LT2
gccaagcugcaaua

SEQ ID NO: 1820115 - RNA, 17 nt, Salmonella typhimurium LT2
gccaagcgcggacagca

SEQ ID NO: 1820116 - RNA, 23 nt, Salmonella typhimurium LT2
gccaagcgccucgcugacgccag

SEQ ID NO: 1820117 - RNA, 19 nt, Salmonella typhimurium LT2
gccaaucgccgccgccagg

SEQ ID NO: 1820118 - RNA, 19 nt, Salmonella typhimurium LT2
gccaaucaacgccgccagg

SEQ ID NO: 1820119 - RNA, 13 nt, Salmonella typhimurium LT2
gccaccggcagcg

SEQ ID NO: 1820120 - RNA, 11 nt, Salmonella typhimurium LT2
gccaccggcag

SEQ ID NO: 1820121 - RNA, 13 nt, Salmonella typhimurium LT2
gccaccagcgcca

SEQ ID NO: 1820122 - RNA, 15 nt, Salmonella typhimurium LT2
gccaccagcgauuuu

SEQ ID NO: 1820123 - RNA, 14 nt, Salmonella typhimurium LT2
gccaccaucacuac

SEQ ID NO: 1820124 - RNA, 13 nt, Salmonella typhimurium LT2
gccaccaggaacg

SEQ ID NO: 1820125 - RNA, 14 nt, Salmonella typhimurium LT2
gccaccaucgucgc

SEQ ID NO: 1820126 - RNA, 20 nt, Salmonella typhimurium LT2
gaccgcgccggucgccagca

SEQ ID NO: 1820127 - RNA, 22 nt, Salmonella typhimurium LT2
gaccgccgaugcugaauagcca

SEQ ID NO: 1820128 - RNA, 17 nt, Salmonella typhimurium LT2
gaccauuacccaccgga

SEQ ID NO: 1820129 - RNA, 18 nt, Salmonella typhimurium LT2
gaccacccgcggccaggu

SEQ ID NO: 1820130 - RNA, 23 nt, Salmonella typhimurium LT2
gacccagacaaccgggcaucacc

SEQ ID NO: 1820131 - RNA, 14 nt, Salmonella typhimurium LT2
gacccagcggcaga

SEQ ID NO: 1820132 - RNA, 20 nt, Salmonella typhimurium LT2
gacccauacucuuucccggc

SEQ ID NO: 1820133 - RNA, 16 nt, Salmonella typhimurium LT2
gaccccaguaauccgg

SEQ ID NO: 1820134 - RNA, 12 nt, Salmonella typhimurium LT2
gaccccgccagg

SEQ ID NO: 1820135 - RNA, 23 nt, Salmonella typhimurium LT2
gaccuacaaauuacacaauauca

SEQ ID NO: 1820136 - RNA, 17 nt, Salmonella typhimurium LT2
gaccugccggauggcgg

SEQ ID NO: 1820137 - RNA, 23 nt, Salmonella typhimurium LT2
gaccgucguuucguguuguccgg

SEQ ID NO: 1820138 - RNA, 17 nt, Salmonella typhimurium LT2
gaccgcuccacucgaua

SEQ ID NO: 1820139 - RNA, 20 nt, Salmonella typhimurium LT2
gaccggaacggggaaccagc

SEQ ID NO: 1820140 - RNA, 14 nt, Salmonella typhimurium LT2
gacgacacggcgca

SEQ ID NO: 1820141 - RNA, 18 nt, Salmonella typhimurium LT2
gaccuggugcucaaucag

SEQ ID NO: 1820142 - RNA, 16 nt, Salmonella typhimurium LT2
gaccuguuccaugacg

SEQ ID NO: 1820143 - RNA, 17 nt, Salmonella typhimurium LT2
gaccuguaccgcgacaa

SEQ ID NO: 1820144 - RNA, 23 nt, Salmonella typhimurium LT2
gacgacguucgauacuauaacgc

SEQ ID NO: 1820145 - RNA, 19 nt, Salmonella typhimurium LT2
gacgacggcaggggcguga

SEQ ID NO: 1820146 - RNA, 14 nt, Salmonella typhimurium LT2
gacgggaucucgca

SEQ ID NO: 1820147 - RNA, 21 nt, Salmonella typhimurium LT2
gacgucacgaagauaugcccc

SEQ ID NO: 1820148 - RNA, 19 nt, Salmonella typhimurium LT2
gacgucacugucagcauca

SEQ ID NO: 1820149 - RNA, 14 nt, Salmonella typhimurium LT2
gacguccaggccgu

SEQ ID NO: 1820150 - RNA, 12 nt, Salmonella typhimurium LT2
gacguccugcaa

SEQ ID NO: 1820151 - RNA, 18 nt, Salmonella typhimurium LT2
gacguccgccaacagccg

SEQ ID NO: 1820152 - RNA, 22 nt, Salmonella typhimurium LT2
gacggccuuuuucgcucuuauc

SEQ ID NO: 1820153 - RNA, 15 nt, Salmonella typhimurium LT2
gacgcuccagaaucu

SEQ ID NO: 1820154 - RNA, 21 nt, Salmonella typhimurium LT2
gacgcguggcaucuuaucagg

SEQ ID NO: 1820155 - RNA, 24 nt, Salmonella typhimurium LT2
gacgcguuaauauccuucagcguu

SEQ ID NO: 1820156 - RNA, 18 nt, Salmonella typhimurium LT2
gacggcagcgccauccgg

SEQ ID NO: 1820157 - RNA, 12 nt, Salmonella typhimurium LT2
gacggccagcgc

SEQ ID NO: 1820158 - RNA, 17 nt, Salmonella typhimurium LT2
gacggccaguugcgcag

SEQ ID NO: 1820159 - RNA, 16 nt, Salmonella typhimurium LT2
gacgcgcucggcagca

SEQ ID NO: 1820160 - RNA, 15 nt, Salmonella typhimurium LT2
gacgcggacgccacc

SEQ ID NO: 1820161 - RNA, 17 nt, Salmonella typhimurium LT2
gacgccguccaggcucg

SEQ ID NO: 1820162 - RNA, 18 nt, Salmonella typhimurium LT2
gacgccuuucuucacgau

SEQ ID NO: 1820163 - RNA, 12 nt, Salmonella typhimurium LT2
gacgccaauucc

SEQ ID NO: 1820164 - RNA, 18 nt, Salmonella typhimurium LT2
gacgccagauaaucacgc

SEQ ID NO: 1820165 - RNA, 16 nt, Salmonella typhimurium LT2
gacgccagccagccgu

SEQ ID NO: 1820166 - RNA, 13 nt, Salmonella typhimurium LT2
gacgccgccaucc

SEQ ID NO: 1820167 - RNA, 17 nt, Salmonella typhimurium LT2
gacgccaagcugcagaa

SEQ ID NO: 1820168 - RNA, 13 nt, Salmonella typhimurium LT2
gacgaucagcgca

SEQ ID NO: 1820169 - RNA, 15 nt, Salmonella typhimurium LT2
gacgauaaggcugca

SEQ ID NO: 1820170 - RNA, 16 nt, Salmonella typhimurium LT2
gaagaaagcuaucgcc

SEQ ID NO: 1820171 - RNA, 15 nt, Salmonella typhimurium LT2
gaagaggaugcuccg

SEQ ID NO: 1820172 - RNA, 13 nt, Salmonella typhimurium LT2
gaaacgacgucca

SEQ ID NO: 1820173 - RNA, 13 nt, Salmonella typhimurium LT2
gaaacgaucgaua

SEQ ID NO: 1820174 - RNA, 15 nt, Salmonella typhimurium LT2
gaaacgcgccggaag

SEQ ID NO: 1820175 - RNA, 14 nt, Salmonella typhimurium LT2
gaaacgguccuggu

SEQ ID NO: 1820176 - RNA, 20 nt, Salmonella typhimurium LT2
gaacgacugaguauuggcaa

SEQ ID NO: 1820177 - RNA, 15 nt, Salmonella typhimurium LT2
gaacgacucggcgau

SEQ ID NO: 1820178 - RNA, 16 nt, Salmonella typhimurium LT2
gaacgauguaucgcgc

SEQ ID NO: 1820179 - RNA, 17 nt, Salmonella typhimurium LT2
gaacgauaauaucguca

SEQ ID NO: 1820180 - RNA, 23 nt, Salmonella typhimurium LT2
gaacgcguccaugaccaccagcg

SEQ ID NO: 1820181 - RNA, 19 nt, Salmonella typhimurium LT2
gaacgcguccaugaccacc

SEQ ID NO: 1820182 - RNA, 21 nt, Salmonella typhimurium LT2
gaacgggaaccaugauaucgc

SEQ ID NO: 1820183 - RNA, 19 nt, Salmonella typhimurium LT2
gaacgggcuuuugaauaau

SEQ ID NO: 1820184 - RNA, 15 nt, Salmonella typhimurium LT2
gaagcgucauccggc

SEQ ID NO: 1820185 - RNA, 21 nt, Salmonella typhimurium LT2
gaagcguauuucugucagcgu

SEQ ID NO: 1820186 - RNA, 22 nt, Salmonella typhimurium LT2
gaagcgguaguuaagcgucagc

SEQ ID NO: 1820187 - RNA, 18 nt, Salmonella typhimurium LT2
gaagcggcgccauccggc

SEQ ID NO: 1820188 - RNA, 23 nt, Salmonella typhimurium LT2
gaagcggcgcaauuuuccccgau

SEQ ID NO: 1820189 - RNA, 17 nt, Salmonella typhimurium LT2
gaagcgggaaagcguaa

SEQ ID NO: 1820190 - RNA, 16 nt, Salmonella typhimurium LT2
gaaggcaacugauccu

SEQ ID NO: 1820191 - RNA, 14 nt, Salmonella typhimurium LT2
gaaggaaauaacgu

SEQ ID NO: 1820192 - RNA, 19 nt, Salmonella typhimurium LT2
gaaggcgaguuucgcauca

SEQ ID NO: 1820193 - RNA, 15 nt, Salmonella typhimurium LT2
gaagcgccaucaggc

SEQ ID NO: 1820194 - RNA, 13 nt, Salmonella typhimurium LT2
gaagcgccauccg

SEQ ID NO: 1820195 - RNA, 16 nt, Salmonella typhimurium LT2
gaagcgcauaucuuac

SEQ ID NO: 1820196 - RNA, 21 nt, Salmonella typhimurium LT2
gaagcgauuuauccaccgcca

SEQ ID NO: 1820197 - RNA, 22 nt, Salmonella typhimurium LT2
gaagcgauguauuuauccacgc

SEQ ID NO: 1820198 - RNA, 16 nt, Salmonella typhimurium LT2
gaagccgccgccaucg

SEQ ID NO: 1820199 - RNA, 15 nt, Salmonella typhimurium LT2
gaagcaucuuuccgg

SEQ ID NO: 1820200 - RNA, 16 nt, Salmonella typhimurium LT2
gacagacguugcgcca

SEQ ID NO: 1820201 - RNA, 17 nt, Salmonella typhimurium LT2
gacagauaacaccagcg

SEQ ID NO: 1820202 - RNA, 23 nt, Salmonella typhimurium LT2
gacaaaggcaagauccggacuga

SEQ ID NO: 1820203 - RNA, 13 nt, Salmonella typhimurium LT2
gacagugcgccau

SEQ ID NO: 1820204 - RNA, 15 nt, Salmonella typhimurium LT2
gacauacuuuaccgg

SEQ ID NO: 1820205 - RNA, 16 nt, Salmonella typhimurium LT2
gacaucgucacaauau

SEQ ID NO: 1820206 - RNA, 19 nt, Salmonella typhimurium LT2
gacagcuuauacugauauc

SEQ ID NO: 1820207 - RNA, 21 nt, Salmonella typhimurium LT2
gacagcccuauaacagcgcca

SEQ ID NO: 1820208 - RNA, 14 nt, Salmonella typhimurium LT2
gacauucgggacaa

SEQ ID NO: 1820209 - RNA, 17 nt, Salmonella typhimurium LT2
gacaugcaaugccguua

SEQ ID NO: 1820210 - RNA, 21 nt, Salmonella typhimurium LT2
gaccaauacugagacgcgaaa

SEQ ID NO: 1820211 - RNA, 22 nt, Salmonella typhimurium LT2
gaaggucgcgccgccgccaacg

SEQ ID NO: 1820212 - RNA, 17 nt, Salmonella typhimurium LT2
gaaggucggcugaauca

SEQ ID NO: 1820213 - RNA, 15 nt, Salmonella typhimurium LT2
gaaguaagcgccagc

SEQ ID NO: 1820214 - RNA, 16 nt, Salmonella typhimurium LT2
gaaggcuuuuccauac

SEQ ID NO: 1820215 - RNA, 17 nt, Salmonella typhimurium LT2
gaaggcuucacgccaca

SEQ ID NO: 1820216 - RNA, 21 nt, Salmonella typhimurium LT2
gaaggucgcauccgcguuagc

SEQ ID NO: 1820217 - RNA, 14 nt, Salmonella typhimurium LT2
gaaucgcgucguuc

SEQ ID NO: 1820218 - RNA, 14 nt, Salmonella typhimurium LT2
gaaugagggcgcga

SEQ ID NO: 1820219 - RNA, 19 nt, Salmonella typhimurium LT2
gaaugaguaaccagaccgu

SEQ ID NO: 1820220 - RNA, 18 nt, Salmonella typhimurium LT2
gaaucgaauacagcgccu

SEQ ID NO: 1820221 - RNA, 15 nt, Salmonella typhimurium LT2
gaauagcgccagggu

SEQ ID NO: 1820222 - RNA, 16 nt, Salmonella typhimurium LT2
gaauaacaucuuccau

SEQ ID NO: 1820223 - RNA, 21 nt, Salmonella typhimurium LT2
gaaugcgcgucaggccagggu

SEQ ID NO: 1820224 - RNA, 19 nt, Salmonella typhimurium LT2
gaaugccguauaccagcgu

SEQ ID NO: 1820225 - RNA, 16 nt, Salmonella typhimurium LT2
gaaugccauccagcac

SEQ ID NO: 1820226 - RNA, 20 nt, Salmonella typhimurium LT2
gaaugccaucccuuccugac

SEQ ID NO: 1820227 - RNA, 17 nt, Salmonella typhimurium LT2
gaauugccauuguucgc

SEQ ID NO: 1820228 - RNA, 18 nt, Salmonella typhimurium LT2
gaauugauauuccgcgcu

SEQ ID NO: 1820229 - RNA, 18 nt, Salmonella typhimurium LT2
gaauuccuuuuuccgcca

SEQ ID NO: 1820230 - RNA, 14 nt, Salmonella typhimurium LT2
cuggcaagcgccag

SEQ ID NO: 1820231 - RNA, 22 nt, Salmonella typhimurium LT2
cuggcaaaacgcauccagcgca

SEQ ID NO: 1820232 - RNA, 21 nt, Salmonella typhimurium LT2
cuggcauuaucguccgucaga

SEQ ID NO: 1820233 - RNA, 23 nt, Salmonella typhimurium LT2
cuggccaggcauugauaaagcgc

SEQ ID NO: 1820234 - RNA, 18 nt, Salmonella typhimurium LT2
cuggccaguuucaaugcc

SEQ ID NO: 1820235 - RNA, 15 nt, Salmonella typhimurium LT2
cuggcauuacgcugg

SEQ ID NO: 1820236 - RNA, 19 nt, Salmonella typhimurium LT2
cugcuugucgaucaucaga

SEQ ID NO: 1820237 - RNA, 14 nt, Salmonella typhimurium LT2
cugcuucgucuucg

SEQ ID NO: 1820238 - RNA, 21 nt, Salmonella typhimurium LT2
cuggaaccagugaauacugcg

SEQ ID NO: 1820239 - RNA, 22 nt, Salmonella typhimurium LT2
cugcugucaucgauacgaccgc

SEQ ID NO: 1820240 - RNA, 19 nt, Salmonella typhimurium LT2
cugcuggguacgugcaaac

SEQ ID NO: 1820241 - RNA, 22 nt, Salmonella typhimurium LT2
cugcugucuguauacucagacg

SEQ ID NO: 1820242 - RNA, 15 nt, Salmonella typhimurium LT2
cugcuguuaccggac

SEQ ID NO: 1820243 - RNA, 20 nt, Salmonella typhimurium LT2
cugcuuaaggcaaacaaggc

SEQ ID NO: 1820244 - RNA, 20 nt, Salmonella typhimurium LT2
cugcuucaguaaaucccgca

SEQ ID NO: 1820245 - RNA, 16 nt, Salmonella typhimurium LT2
cugcuggcagcgcuga

SEQ ID NO: 1820246 - RNA, 18 nt, Salmonella typhimurium LT2
cuggccguuuucccggca

SEQ ID NO: 1820247 - RNA, 23 nt, Salmonella typhimurium LT2
cuggcgcuuuaagugcaucgcca

SEQ ID NO: 1820248 - RNA, 14 nt, Salmonella typhimurium LT2
cuggucagcgcaau

SEQ ID NO: 1820249 - RNA, 18 nt, Salmonella typhimurium LT2
cuggcuggucagcguacc

SEQ ID NO: 1820250 - RNA, 17 nt, Salmonella typhimurium LT2
cuggcuggucagcguac

SEQ ID NO: 1820251 - RNA, 17 nt, Salmonella typhimurium LT2
cugcgcugcggucaggg

SEQ ID NO: 1820252 - RNA, 17 nt, Salmonella typhimurium LT2
cugcgcugucaccagca

SEQ ID NO: 1820253 - RNA, 15 nt, Salmonella typhimurium LT2
cugcgcuuauccggc

SEQ ID NO: 1820254 - RNA, 16 nt, Salmonella typhimurium LT2
cugcgcuucgaugcgu

SEQ ID NO: 1820255 - RNA, 19 nt, Salmonella typhimurium LT2
cugcgcucauauacccugc

SEQ ID NO: 1820256 - RNA, 21 nt, Salmonella typhimurium LT2
cugcgcggcaauuuccgcuga

SEQ ID NO: 1820257 - RNA, 20 nt, Salmonella typhimurium LT2
cugcgcggccagaaccugcu

SEQ ID NO: 1820258 - RNA, 22 nt, Salmonella typhimurium LT2
cugcgcggccagaaccugcucg

SEQ ID NO: 1820259 - RNA, 22 nt, Salmonella typhimurium LT2
cugcgcgauaucugccgcgcca

SEQ ID NO: 1820260 - RNA, 18 nt, Salmonella typhimurium LT2
cugcgcgacgcccaccag

SEQ ID NO: 1820261 - RNA, 16 nt, Salmonella typhimurium LT2
cugcgccuuauccgac

SEQ ID NO: 1820262 - RNA, 14 nt, Salmonella typhimurium LT2
cugcgccucaagcg

SEQ ID NO: 1820263 - RNA, 14 nt, Salmonella typhimurium LT2
cugcgccucagcca

SEQ ID NO: 1820264 - RNA, 15 nt, Salmonella typhimurium LT2
cugcgccgguuccgg

SEQ ID NO: 1820265 - RNA, 15 nt, Salmonella typhimurium LT2
cugcgccagccagac

SEQ ID NO: 1820266 - RNA, 14 nt, Salmonella typhimurium LT2
cugcgccagcgccg

SEQ ID NO: 1820267 - RNA, 18 nt, Salmonella typhimurium LT2
cugcgccauuaacgcggu

SEQ ID NO: 1820268 - RNA, 12 nt, Salmonella typhimurium LT2
cugcgccaccag

SEQ ID NO: 1820269 - RNA, 14 nt, Salmonella typhimurium LT2
cugcgccaccagcg

SEQ ID NO: 1820270 - RNA, 19 nt, Salmonella typhimurium LT2
cugcgcauacgucaugccu

SEQ ID NO: 1820271 - RNA, 19 nt, Salmonella typhimurium LT2
cugcacgagagaccaugcu

SEQ ID NO: 1820272 - RNA, 14 nt, Salmonella typhimurium LT2
cugcugacauuccu

SEQ ID NO: 1820273 - RNA, 20 nt, Salmonella typhimurium LT2
cugcugaccaaacugcggaa

SEQ ID NO: 1820274 - RNA, 20 nt, Salmonella typhimurium LT2
cugcugaacacaaugaaucc

SEQ ID NO: 1820275 - RNA, 20 nt, Salmonella typhimurium LT2
cugcugcgcuuuccaggcca

SEQ ID NO: 1820276 - RNA, 22 nt, Salmonella typhimurium LT2
cugcugcgcggccagaaccugc

SEQ ID NO: 1820277 - RNA, 15 nt, Salmonella typhimurium LT2
cugcuccagcguggc

SEQ ID NO: 1820278 - RNA, 20 nt, Salmonella typhimurium LT2
cugcguuccgcucagcguca

SEQ ID NO: 1820279 - RNA, 17 nt, Salmonella typhimurium LT2
cugcucaaucgcaugac

SEQ ID NO: 1820280 - RNA, 17 nt, Salmonella typhimurium LT2
cugcuaguagcggaaua

SEQ ID NO: 1820281 - RNA, 12 nt, Salmonella typhimurium LT2
cugcguuucauu

SEQ ID NO: 1820282 - RNA, 19 nt, Salmonella typhimurium LT2
cugcuaaacgaaccgucau

SEQ ID NO: 1820283 - RNA, 13 nt, Salmonella typhimurium LT2
cugcguaacgcuu

SEQ ID NO: 1820284 - RNA, 23 nt, Salmonella typhimurium LT2
cugcguaaccgccagaacgcugu

SEQ ID NO: 1820285 - RNA, 15 nt, Salmonella typhimurium LT2
cugcguaaaagcguu

SEQ ID NO: 1820286 - RNA, 23 nt, Salmonella typhimurium LT2
cugcggcgcuuugcgcucaggcg

SEQ ID NO: 1820287 - RNA, 16 nt, Salmonella typhimurium LT2
cuugcgguugcagcaa

SEQ ID NO: 1820288 - RNA, 21 nt, Salmonella typhimurium LT2
cuugcggugagaaacgcgcca

SEQ ID NO: 1820289 - RNA, 17 nt, Salmonella typhimurium LT2
cuugccgggccuggcau

SEQ ID NO: 1820290 - RNA, 19 nt, Salmonella typhimurium LT2
cuuguaagggaggugcucu

SEQ ID NO: 1820291 - RNA, 13 nt, Salmonella typhimurium LT2
cuuguaagccgga

SEQ ID NO: 1820292 - RNA, 22 nt, Salmonella typhimurium LT2
cuuggguauagagcaaucuggc

SEQ ID NO: 1820293 - RNA, 17 nt, Salmonella typhimurium LT2
cuugaguuuuccgccau

SEQ ID NO: 1820294 - RNA, 15 nt, Salmonella typhimurium LT2
cuugauccggcugau

SEQ ID NO: 1820295 - RNA, 14 nt, Salmonella typhimurium LT2
cuugcaugaccauc

SEQ ID NO: 1820296 - RNA, 20 nt, Salmonella typhimurium LT2
cuugccacuacgcagcucca

SEQ ID NO: 1820297 - RNA, 20 nt, Salmonella typhimurium LT2
cuugcaacccauacagccca

SEQ ID NO: 1820298 - RNA, 21 nt, Salmonella typhimurium LT2
cuuucuccugggauaccggaa

SEQ ID NO: 1820299 - RNA, 19 nt, Salmonella typhimurium LT2
cuuugaaaaucacaucgcc

SEQ ID NO: 1820300 - RNA, 15 nt, Salmonella typhimurium LT2
cuuucgccagaaccg

SEQ ID NO: 1820301 - RNA, 20 nt, Salmonella typhimurium LT2
cuuucgccaguucauucgcc

SEQ ID NO: 1820302 - RNA, 12 nt, Salmonella typhimurium LT2
cuuugcgccauc

SEQ ID NO: 1820303 - RNA, 23 nt, Salmonella typhimurium LT2
cuuugccggaugguggucggcua

SEQ ID NO: 1820304 - RNA, 16 nt, Salmonella typhimurium LT2
cuuugacgccgggaaa

SEQ ID NO: 1820305 - RNA, 13 nt, Salmonella typhimurium LT2
cuuugagaaagcu

SEQ ID NO: 1820306 - RNA, 17 nt, Salmonella typhimurium LT2
cuuucgacgucaccauc

SEQ ID NO: 1820307 - RNA, 13 nt, Salmonella typhimurium LT2
cuuuccagcgaca

SEQ ID NO: 1820308 - RNA, 13 nt, Salmonella typhimurium LT2
cuuguccggccua

SEQ ID NO: 1820309 - RNA, 16 nt, Salmonella typhimurium LT2
cuuucaauuuccgcac

SEQ ID NO: 1820310 - RNA, 23 nt, Salmonella typhimurium LT2
cuuucaacauauuuuucacacau

SEQ ID NO: 1820311 - RNA, 13 nt, Salmonella typhimurium LT2
cuuucagaucggc

SEQ ID NO: 1820312 - RNA, 18 nt, Salmonella typhimurium LT2
gaaaaguuacaggcucca

SEQ ID NO: 1820313 - RNA, 20 nt, Salmonella typhimurium LT2
gaaaaucagugaacacccug

SEQ ID NO: 1820314 - RNA, 21 nt, Salmonella typhimurium LT2
cuuuuuuguauuaacggcgcu

SEQ ID NO: 1820315 - RNA, 16 nt, Salmonella typhimurium LT2
cuuuguggcaggucgg

SEQ ID NO: 1820316 - RNA, 19 nt, Salmonella typhimurium LT2
cuuugguugccugcagaau

SEQ ID NO: 1820317 - RNA, 14 nt, Salmonella typhimurium LT2
cuuugggcgccauu

SEQ ID NO: 1820318 - RNA, 18 nt, Salmonella typhimurium LT2
gaaaaauguucagcgacc

SEQ ID NO: 1820319 - RNA, 18 nt, Salmonella typhimurium LT2
gaaaacaaggcgcuacca

SEQ ID NO: 1820320 - RNA, 15 nt, Salmonella typhimurium LT2
gaaaacccgccacca

SEQ ID NO: 1820321 - RNA, 15 nt, Salmonella typhimurium LT2
cuucgguccggcgcu

SEQ ID NO: 1820322 - RNA, 14 nt, Salmonella typhimurium LT2
cuucucgcaggcca

SEQ ID NO: 1820323 - RNA, 21 nt, Salmonella typhimurium LT2
cuucuugguaccaaacagcag

SEQ ID NO: 1820324 - RNA, 16 nt, Salmonella typhimurium LT2
cuucuuagaauagcau

SEQ ID NO: 1820325 - RNA, 14 nt, Salmonella typhimurium LT2
cuucccgcgauaaa

SEQ ID NO: 1820326 - RNA, 22 nt, Salmonella typhimurium LT2
cuucccauauuuuuucugccag

SEQ ID NO: 1820327 - RNA, 14 nt, Salmonella typhimurium LT2
cuuccacgcacgcc

SEQ ID NO: 1820328 - RNA, 17 nt, Salmonella typhimurium LT2
cuuccacgcacgccggc

SEQ ID NO: 1820329 - RNA, 21 nt, Salmonella typhimurium LT2
cuuccacugcggcauuacgcg

SEQ ID NO: 1820330 - RNA, 24 nt, Salmonella typhimurium LT2
cuucacccacugcacgcgaucguc

SEQ ID NO: 1820331 - RNA, 14 nt, Salmonella typhimurium LT2
cuucacaaucagcg

SEQ ID NO: 1820332 - RNA, 14 nt, Salmonella typhimurium LT2
cuuccgccugauaa

SEQ ID NO: 1820333 - RNA, 12 nt, Salmonella typhimurium LT2
cuuccgcaucgu

SEQ ID NO: 1820334 - RNA, 19 nt, Salmonella typhimurium LT2
cuuccggaguaaugaaacc

SEQ ID NO: 1820335 - RNA, 18 nt, Salmonella typhimurium LT2
cuucgaaugucucaauau

SEQ ID NO: 1820336 - RNA, 15 nt, Salmonella typhimurium LT2
cuuaaugcucuccag

SEQ ID NO: 1820337 - RNA, 16 nt, Salmonella typhimurium LT2
cuuaauuuuguugaaa

SEQ ID NO: 1820338 - RNA, 22 nt, Salmonella typhimurium LT2
cuuacccgcuuuuaaacggcua

SEQ ID NO: 1820339 - RNA, 20 nt, Salmonella typhimurium LT2
cuuacgaguggcgaucaggc

SEQ ID NO: 1820340 - RNA, 16 nt, Salmonella typhimurium LT2
cuuacgcacuguuggc

SEQ ID NO: 1820341 - RNA, 16 nt, Salmonella typhimurium LT2
cuuaacgcccgcgucu

SEQ ID NO: 1820342 - RNA, 22 nt, Salmonella typhimurium LT2
cuguuucaacacauccagcguc

SEQ ID NO: 1820343 - RNA, 13 nt, Salmonella typhimurium LT2
cuuauccggccua

SEQ ID NO: 1820344 - RNA, 17 nt, Salmonella typhimurium LT2
cuuaucgaccagcguua

SEQ ID NO: 1820345 - RNA, 23 nt, Salmonella typhimurium LT2
cuuaugcugccagcgaaccgcag

SEQ ID NO: 1820346 - RNA, 19 nt, Salmonella typhimurium LT2
cuucaaaaccgcacugcau

SEQ ID NO: 1820347 - RNA, 18 nt, Salmonella typhimurium LT2
cuuauuucuccugcgcca

SEQ ID NO: 1820348 - RNA, 18 nt, Salmonella typhimurium LT2
cuucaacagcucgccaug

SEQ ID NO: 1820349 - RNA, 19 nt, Salmonella typhimurium LT2
cuucaacagcggcggcagu

SEQ ID NO: 1820350 - RNA, 18 nt, Salmonella typhimurium LT2
cuucaacaccgacauccg

SEQ ID NO: 1820351 - RNA, 11 nt, Salmonella typhimurium LT2
cuucaauguua

SEQ ID NO: 1820352 - RNA, 14 nt, Salmonella typhimurium LT2
cuguuaauaccgug

SEQ ID NO: 1820353 - RNA, 17 nt, Salmonella typhimurium LT2
cuguggguucaucgcca

SEQ ID NO: 1820354 - RNA, 16 nt, Salmonella typhimurium LT2
cugucaccagcagcau

SEQ ID NO: 1820355 - RNA, 21 nt, Salmonella typhimurium LT2
cugucaucaucaaguaccgug

SEQ ID NO: 1820356 - RNA, 15 nt, Salmonella typhimurium LT2
cugucagaacccugu

SEQ ID NO: 1820357 - RNA, 16 nt, Salmonella typhimurium LT2
cugucgaaaccagcau

SEQ ID NO: 1820358 - RNA, 21 nt, Salmonella typhimurium LT2
cgguggcgcugcgcuuaccgg

SEQ ID NO: 1820359 - RNA, 23 nt, Salmonella typhimurium LT2
cggugaugaucaauaacgccggu

SEQ ID NO: 1820360 - RNA, 19 nt, Salmonella typhimurium LT2
cggugaucccaccaggagu

SEQ ID NO: 1820361 - RNA, 15 nt, Salmonella typhimurium LT2
cggugaguuuuaccg

SEQ ID NO: 1820362 - RNA, 20 nt, Salmonella typhimurium LT2
cggugauccuccugcagacu

SEQ ID NO: 1820363 - RNA, 22 nt, Salmonella typhimurium LT2
cggugacuucgcagcccaucgc

SEQ ID NO: 1820364 - RNA, 13 nt, Salmonella typhimurium LT2
cggugagaaacgc

SEQ ID NO: 1820365 - RNA, 13 nt, Salmonella typhimurium LT2
cggugagcgccgc

SEQ ID NO: 1820366 - RNA, 21 nt, Salmonella typhimurium LT2
cgguuuuacuauugccgauaa

SEQ ID NO: 1820367 - RNA, 13 nt, Salmonella typhimurium LT2
cgguuuuuccgcu

SEQ ID NO: 1820368 - RNA, 15 nt, Salmonella typhimurium LT2
cguaaaacaacagcg

SEQ ID NO: 1820369 - RNA, 14 nt, Salmonella typhimurium LT2
cguaaaaccgcgcu

SEQ ID NO: 1820370 - RNA, 21 nt, Salmonella typhimurium LT2
cguaaucaucgcgaucgccaa

SEQ ID NO: 1820371 - RNA, 13 nt, Salmonella typhimurium LT2
cgguuucaggcca

SEQ ID NO: 1820372 - RNA, 16 nt, Salmonella typhimurium LT2
cgguucugggcaguuu

SEQ ID NO: 1820373 - RNA, 22 nt, Salmonella typhimurium LT2
cgguuaacaccaguuuauccgc

SEQ ID NO: 1820374 - RNA, 20 nt, Salmonella typhimurium LT2
cgguuaucuggcgcaaccgg

SEQ ID NO: 1820375 - RNA, 17 nt, Salmonella typhimurium LT2
cgguuacguucggcaaa

SEQ ID NO: 1820376 - RNA, 13 nt, Salmonella typhimurium LT2
cgguuacaugcug

SEQ ID NO: 1820377 - RNA, 19 nt, Salmonella typhimurium LT2
cgguguacaucgcgcugac

SEQ ID NO: 1820378 - RNA, 12 nt, Salmonella typhimurium LT2
cguagcagacgu

SEQ ID NO: 1820379 - RNA, 24 nt, Salmonella typhimurium LT2
cguagccaaaagcgccacgcguca

SEQ ID NO: 1820380 - RNA, 20 nt, Salmonella typhimurium LT2
cguaggccccgccauccggc

SEQ ID NO: 1820381 - RNA, 13 nt, Salmonella typhimurium LT2
cguaggccaggca

SEQ ID NO: 1820382 - RNA, 20 nt, Salmonella typhimurium LT2
cguaggccugauaagcgcag

SEQ ID NO: 1820383 - RNA, 22 nt, Salmonella typhimurium LT2
cguagccgaccaccauccggca

SEQ ID NO: 1820384 - RNA, 22 nt, Salmonella typhimurium LT2
cguagugccacaacgccugaug

SEQ ID NO: 1820385 - RNA, 17 nt, Salmonella typhimurium LT2
cguagucguuguaggcc

SEQ ID NO: 1820386 - RNA, 14 nt, Salmonella typhimurium LT2
cgucaaugaucagc

SEQ ID NO: 1820387 - RNA, 14 nt, Salmonella typhimurium LT2
cguaucacuguaaa

SEQ ID NO: 1820388 - RNA, 22 nt, Salmonella typhimurium LT2
cguaucacuaauuugcgauucc

SEQ ID NO: 1820389 - RNA, 12 nt, Salmonella typhimurium LT2
cguauccagcgc

SEQ ID NO: 1820390 - RNA, 23 nt, Salmonella typhimurium LT2
cguauccauucucaucagaccgu

SEQ ID NO: 1820391 - RNA, 14 nt, Salmonella typhimurium LT2
cguauagccaggca

SEQ ID NO: 1820392 - RNA, 23 nt, Salmonella typhimurium LT2
cguauaccagcgucagcgggcca

SEQ ID NO: 1820393 - RNA, 18 nt, Salmonella typhimurium LT2
cgucacugucagcaucag

SEQ ID NO: 1820394 - RNA, 17 nt, Salmonella typhimurium LT2
cgucacucccugcguca

SEQ ID NO: 1820395 - RNA, 16 nt, Salmonella typhimurium LT2
cgucacgucagcgucg

SEQ ID NO: 1820396 - RNA, 23 nt, Salmonella typhimurium LT2
cgucggcaauuaacauuucacga

SEQ ID NO: 1820397 - RNA, 13 nt, Salmonella typhimurium LT2
cgucggcaucgug

SEQ ID NO: 1820398 - RNA, 20 nt, Salmonella typhimurium LT2
cgucggcauggucagcauaa

SEQ ID NO: 1820399 - RNA, 14 nt, Salmonella typhimurium LT2
cgucgccagggcgg

SEQ ID NO: 1820400 - RNA, 19 nt, Salmonella typhimurium LT2
cgucgccugaaugcacugc

SEQ ID NO: 1820401 - RNA, 18 nt, Salmonella typhimurium LT2
cgucgagaaaccgcucgc

SEQ ID NO: 1820402 - RNA, 15 nt, Salmonella typhimurium LT2
cgucgagcgccguca

SEQ ID NO: 1820403 - RNA, 19 nt, Salmonella typhimurium LT2
cgucgacaaagccaacgcc

SEQ ID NO: 1820404 - RNA, 22 nt, Salmonella typhimurium LT2
cguccugcgcgacgcccaccag

SEQ ID NO: 1820405 - RNA, 14 nt, Salmonella typhimurium LT2
cguccggcagucgg

SEQ ID NO: 1820406 - RNA, 15 nt, Salmonella typhimurium LT2
cgucccuuccgccac

SEQ ID NO: 1820407 - RNA, 15 nt, Salmonella typhimurium LT2
cgucccugcaacgcc

SEQ ID NO: 1820408 - RNA, 12 nt, Salmonella typhimurium LT2
cguccgcucacg

SEQ ID NO: 1820409 - RNA, 14 nt, Salmonella typhimurium LT2
cguccuccagcgug

SEQ ID NO: 1820410 - RNA, 19 nt, Salmonella typhimurium LT2
cguccugcaacccauauuc

SEQ ID NO: 1820411 - RNA, 22 nt, Salmonella typhimurium LT2
cgucccggucggcgcauggcgu

SEQ ID NO: 1820412 - RNA, 17 nt, Salmonella typhimurium LT2
cgucaucagauaggcgg

SEQ ID NO: 1820413 - RNA, 21 nt, Salmonella typhimurium LT2
cgucauagcaggagauauagc

SEQ ID NO: 1820414 - RNA, 16 nt, Salmonella typhimurium LT2
cgucauauugccgccu

SEQ ID NO: 1820415 - RNA, 21 nt, Salmonella typhimurium LT2
cgugauaauucccccauccgc

SEQ ID NO: 1820416 - RNA, 21 nt, Salmonella typhimurium LT2
cgugaaacuccccgccgcuga

SEQ ID NO: 1820417 - RNA, 22 nt, Salmonella typhimurium LT2
cgucuuuggcucuuagcagcau

SEQ ID NO: 1820418 - RNA, 19 nt, Salmonella typhimurium LT2
cgugaaaaaugacgccggg

SEQ ID NO: 1820419 - RNA, 15 nt, Salmonella typhimurium LT2
cgugaaccagcaucc

SEQ ID NO: 1820420 - RNA, 20 nt, Salmonella typhimurium LT2
cgugaaccuguuaucaggau

SEQ ID NO: 1820421 - RNA, 20 nt, Salmonella typhimurium LT2
cgugaugcgacgcgcucacc

SEQ ID NO: 1820422 - RNA, 21 nt, Salmonella typhimurium LT2
cgugaugcgacgcgcucaccu

SEQ ID NO: 1820423 - RNA, 23 nt, Salmonella typhimurium LT2
cgugcgaauuucggcaaugacgg

SEQ ID NO: 1820424 - RNA, 15 nt, Salmonella typhimurium LT2
cgugccugccgcaga

SEQ ID NO: 1820425 - RNA, 23 nt, Salmonella typhimurium LT2
cgugcaggccggauaagccggau

SEQ ID NO: 1820426 - RNA, 13 nt, Salmonella typhimurium LT2
cgugcaggccgga

SEQ ID NO: 1820427 - RNA, 16 nt, Salmonella typhimurium LT2
cgucugaccgccgcga

SEQ ID NO: 1820428 - RNA, 21 nt, Salmonella typhimurium LT2
cgucguccagcccggcggaua

SEQ ID NO: 1820429 - RNA, 19 nt, Salmonella typhimurium LT2
cgucuccagacaauccgcg

SEQ ID NO: 1820430 - RNA, 16 nt, Salmonella typhimurium LT2
cgucguuaaucagcgc

SEQ ID NO: 1820431 - RNA, 22 nt, Salmonella typhimurium LT2
cguuguccaguaaggcaaguuc

SEQ ID NO: 1820432 - RNA, 22 nt, Salmonella typhimurium LT2
cguuucauccugacaggccgga

SEQ ID NO: 1820433 - RNA, 21 nt, Salmonella typhimurium LT2
cguuguuucucuuccgccagc

SEQ ID NO: 1820434 - RNA, 12 nt, Salmonella typhimurium LT2
cguuuaaagcgc

SEQ ID NO: 1820435 - RNA, 16 nt, Salmonella typhimurium LT2
cguugucauggcgcca

SEQ ID NO: 1820436 - RNA, 20 nt, Salmonella typhimurium LT2
cguuguaguuaucgccgaaa

SEQ ID NO: 1820437 - RNA, 17 nt, Salmonella typhimurium LT2
cguugggugaggcguag

SEQ ID NO: 1820438 - RNA, 20 nt, Salmonella typhimurium LT2
cguuggcguaaaucaggcca

SEQ ID NO: 1820439 - RNA, 20 nt, Salmonella typhimurium LT2
cuaaaugcauagccccagcg

SEQ ID NO: 1820440 - RNA, 23 nt, Salmonella typhimurium LT2
cguuuccugcgccagcaccaugg

SEQ ID NO: 1820441 - RNA, 15 nt, Salmonella typhimurium LT2
cguuugcgccggauc

SEQ ID NO: 1820442 - RNA, 22 nt, Salmonella typhimurium LT2
cguuuuucugcccauuucagca

SEQ ID NO: 1820443 - RNA, 22 nt, Salmonella typhimurium LT2
cguuuucauaucugcgccgcca

SEQ ID NO: 1820444 - RNA, 21 nt, Salmonella typhimurium LT2
cguuuuauacaccugaucggc

SEQ ID NO: 1820445 - RNA, 15 nt, Salmonella typhimurium LT2
cguuuuagccguuca

SEQ ID NO: 1820446 - RNA, 21 nt, Salmonella typhimurium LT2
cguuuucaauaucggcggaaa

SEQ ID NO: 1820447 - RNA, 16 nt, Salmonella typhimurium LT2
cguuuggcuuauccgc

SEQ ID NO: 1820448 - RNA, 18 nt, Salmonella typhimurium LT2
cguucguugauagcgacg

SEQ ID NO: 1820449 - RNA, 18 nt, Salmonella typhimurium LT2
cguucgacaacggaucgc

SEQ ID NO: 1820450 - RNA, 16 nt, Salmonella typhimurium LT2
cguucgggucaagaaa

SEQ ID NO: 1820451 - RNA, 21 nt, Salmonella typhimurium LT2
cguugaucuccgcgcaaucgc

SEQ ID NO: 1820452 - RNA, 15 nt, Salmonella typhimurium LT2
cguugauagcgacgc

SEQ ID NO: 1820453 - RNA, 22 nt, Salmonella typhimurium LT2
cguucucacggucuccugaacu

SEQ ID NO: 1820454 - RNA, 19 nt, Salmonella typhimurium LT2
cguugaauuccaucggcau

SEQ ID NO: 1820455 - RNA, 22 nt, Salmonella typhimurium LT2
cguugcccaucgcaacgccggu

SEQ ID NO: 1820456 - RNA, 15 nt, Salmonella typhimurium LT2
cguugccagcggcca

SEQ ID NO: 1820457 - RNA, 19 nt, Salmonella typhimurium LT2
cguugccaauagcaaugaa

SEQ ID NO: 1820458 - RNA, 16 nt, Salmonella typhimurium LT2
cguugcgacuaucggc

SEQ ID NO: 1820459 - RNA, 19 nt, Salmonella typhimurium LT2
cguugcgcccaucaucauc

SEQ ID NO: 1820460 - RNA, 18 nt, Salmonella typhimurium LT2
cguugcgccaugcucauu

SEQ ID NO: 1820461 - RNA, 21 nt, Salmonella typhimurium LT2
cguugcgcugaaguaauguuc

SEQ ID NO: 1820462 - RNA, 13 nt, Salmonella typhimurium LT2
cuaauauccagcc

SEQ ID NO: 1820463 - RNA, 23 nt, Salmonella typhimurium LT2
cuaauccccauuuuuuucagccu

SEQ ID NO: 1820464 - RNA, 20 nt, Salmonella typhimurium LT2
cuaacgucuuauccggccua

SEQ ID NO: 1820465 - RNA, 18 nt, Salmonella typhimurium LT2
cuaacgucgccaucaggc

SEQ ID NO: 1820466 - RNA, 19 nt, Salmonella typhimurium LT2
cuaacuuaccaguuauagc

SEQ ID NO: 1820467 - RNA, 23 nt, Salmonella typhimurium LT2
cuaccggcgguucuuuugcuaac

SEQ ID NO: 1820468 - RNA, 17 nt, Salmonella typhimurium LT2
cuaccugcacuuuaagc

SEQ ID NO: 1820469 - RNA, 16 nt, Salmonella typhimurium LT2
cuaccugcagggugaa

SEQ ID NO: 1820470 - RNA, 18 nt, Salmonella typhimurium LT2
cuaccacagaaaucgccg

SEQ ID NO: 1820471 - RNA, 20 nt, Salmonella typhimurium LT2
cuaccacgccgcuacugccg

SEQ ID NO: 1820472 - RNA, 22 nt, Salmonella typhimurium LT2
cuaccagcgcgccagcgccaau

SEQ ID NO: 1820473 - RNA, 15 nt, Salmonella typhimurium LT2
cuaaugagccagaug

SEQ ID NO: 1820474 - RNA, 23 nt, Salmonella typhimurium LT2
cuaauugccuggcagcuugccuu

SEQ ID NO: 1820475 - RNA, 23 nt, Salmonella typhimurium LT2
cuauccucuuuuaucacccggau

SEQ ID NO: 1820476 - RNA, 22 nt, Salmonella typhimurium LT2
cuauaaaaauaccggcaucacg

SEQ ID NO: 1820477 - RNA, 12 nt, Salmonella typhimurium LT2
cuaguucugcgc

SEQ ID NO: 1820478 - RNA, 22 nt, Salmonella typhimurium LT2
cuaucgggucugcgcgccggaa

SEQ ID NO: 1820479 - RNA, 23 nt, Salmonella typhimurium LT2
cuauguagcgcugaagcccgcga

SEQ ID NO: 1820480 - RNA, 15 nt, Salmonella typhimurium LT2
cuauguuuuuaucag

SEQ ID NO: 1820481 - RNA, 20 nt, Salmonella typhimurium LT2
cuacgguuagcgaacgucca

SEQ ID NO: 1820482 - RNA, 22 nt, Salmonella typhimurium LT2
cuacgucaggaaacgcgccgga

SEQ ID NO: 1820483 - RNA, 15 nt, Salmonella typhimurium LT2
cuacgcuuaucaggc

SEQ ID NO: 1820484 - RNA, 17 nt, Salmonella typhimurium LT2
cucaccgagacugcccg

SEQ ID NO: 1820485 - RNA, 17 nt, Salmonella typhimurium LT2
cucaccuccgccaccag

SEQ ID NO: 1820486 - RNA, 21 nt, Salmonella typhimurium LT2
cucaccgggcaggauacggcg

SEQ ID NO: 1820487 - RNA, 21 nt, Salmonella typhimurium LT2
cucaccgugguuaccgccaga

SEQ ID NO: 1820488 - RNA, 18 nt, Salmonella typhimurium LT2
cucauaaauugcagcgac

SEQ ID NO: 1820489 - RNA, 13 nt, Salmonella typhimurium LT2
cucaggaucgccg

SEQ ID NO: 1820490 - RNA, 18 nt, Salmonella typhimurium LT2
cucagcgucugcacgcca

SEQ ID NO: 1820491 - RNA, 16 nt, Salmonella typhimurium LT2
cucagauugaacgcug

SEQ ID NO: 1820492 - RNA, 18 nt, Salmonella typhimurium LT2
cucagaucggcagacagu

SEQ ID NO: 1820493 - RNA, 16 nt, Salmonella typhimurium LT2
cucacgcaacaacagg

SEQ ID NO: 1820494 - RNA, 21 nt, Salmonella typhimurium LT2
cuccaccauaucgcagaccau

SEQ ID NO: 1820495 - RNA, 20 nt, Salmonella typhimurium LT2
cuccaccgccuggcgcgacu

SEQ ID NO: 1820496 - RNA, 12 nt, Salmonella typhimurium LT2
cuccaccucgcg

SEQ ID NO: 1820497 - RNA, 15 nt, Salmonella typhimurium LT2
cucaucaauacguua

SEQ ID NO: 1820498 - RNA, 17 nt, Salmonella typhimurium LT2
cucccaggccgccaccg

SEQ ID NO: 1820499 - RNA, 20 nt, Salmonella typhimurium LT2
cuccaguuguuccagcagcu

SEQ ID NO: 1820500 - RNA, 18 nt, Salmonella typhimurium LT2
cuccacgcccagcgccgg

SEQ ID NO: 1820501 - RNA, 16 nt, Salmonella typhimurium LT2
cucgcucgcccgcguu

SEQ ID NO: 1820502 - RNA, 12 nt, Salmonella typhimurium LT2
cucgcuaaugcc

SEQ ID NO: 1820503 - RNA, 22 nt, Salmonella typhimurium LT2
cucgccguuaugcagcggaauu

SEQ ID NO: 1820504 - RNA, 22 nt, Salmonella typhimurium LT2
cucgauaauauccgacgccugu

SEQ ID NO: 1820505 - RNA, 16 nt, Salmonella typhimurium LT2
cucgauaacuuucggg

SEQ ID NO: 1820506 - RNA, 23 nt, Salmonella typhimurium LT2
cucgauagcugaagugcggauag

SEQ ID NO: 1820507 - RNA, 23 nt, Salmonella typhimurium LT2
cucgacaggaguauagcggcguu

SEQ ID NO: 1820508 - RNA, 18 nt, Salmonella typhimurium LT2
cucgacauagguucugcg

SEQ ID NO: 1820509 - RNA, 19 nt, Salmonella typhimurium LT2
cuccccuguuugcaucacg

SEQ ID NO: 1820510 - RNA, 17 nt, Salmonella typhimurium LT2
cugacgcggacgccacc

SEQ ID NO: 1820511 - RNA, 16 nt, Salmonella typhimurium LT2
cugacguuacgcggug

SEQ ID NO: 1820512 - RNA, 22 nt, Salmonella typhimurium LT2
cugacguuacgcggugcgccgu

SEQ ID NO: 1820513 - RNA, 22 nt, Salmonella typhimurium LT2
cugacugccguauaauccagcu

SEQ ID NO: 1820514 - RNA, 19 nt, Salmonella typhimurium LT2
cugagaaaaagcgaagcgg

SEQ ID NO: 1820515 - RNA, 16 nt, Salmonella typhimurium LT2
cugacugguuuguugc

SEQ ID NO: 1820516 - RNA, 20 nt, Salmonella typhimurium LT2
cugaagcguaacagcgcuau

SEQ ID NO: 1820517 - RNA, 11 nt, Salmonella typhimurium LT2
cugaagcguau

SEQ ID NO: 1820518 - RNA, 13 nt, Salmonella typhimurium LT2
cugaagccauccu

SEQ ID NO: 1820519 - RNA, 21 nt, Salmonella typhimurium LT2
cugaagauaaacagcagcgcg

SEQ ID NO: 1820520 - RNA, 20 nt, Salmonella typhimurium LT2
cugacgcgcagcgauauagc

SEQ ID NO: 1820521 - RNA, 14 nt, Salmonella typhimurium LT2
cugacgcgaucgcc

SEQ ID NO: 1820522 - RNA, 13 nt, Salmonella typhimurium LT2
cugacgccaccac

SEQ ID NO: 1820523 - RNA, 22 nt, Salmonella typhimurium LT2
cugacgacacuuuuugccgagc

SEQ ID NO: 1820524 - RNA, 17 nt, Salmonella typhimurium LT2
cugaccuuaauccagcc

SEQ ID NO: 1820525 - RNA, 23 nt, Salmonella typhimurium LT2
cugauggcgcugcgcuuaucagg

SEQ ID NO: 1820526 - RNA, 18 nt, Salmonella typhimurium LT2
cugauuaccuaccagcgc

SEQ ID NO: 1820527 - RNA, 23 nt, Salmonella typhimurium LT2
cugaugucccaucguaacgccgu

SEQ ID NO: 1820528 - RNA, 23 nt, Salmonella typhimurium LT2
cugaugucguuguaguuaucgcc

SEQ ID NO: 1820529 - RNA, 19 nt, Salmonella typhimurium LT2
cugauuggcuccccgcucg

SEQ ID NO: 1820530 - RNA, 21 nt, Salmonella typhimurium LT2
cugaguauacagacagcagau

SEQ ID NO: 1820531 - RNA, 14 nt, Salmonella typhimurium LT2
cugaguucgccaug

SEQ ID NO: 1820532 - RNA, 18 nt, Salmonella typhimurium LT2
cugaguuucaccgccaga

SEQ ID NO: 1820533 - RNA, 17 nt, Salmonella typhimurium LT2
cugaugcguauccagcg

SEQ ID NO: 1820534 - RNA, 14 nt, Salmonella typhimurium LT2
cugauggcgcgcca

SEQ ID NO: 1820535 - RNA, 23 nt, Salmonella typhimurium LT2
cugauacuuauuacgguaucagc

SEQ ID NO: 1820536 - RNA, 16 nt, Salmonella typhimurium LT2
cugauacucguagcca

SEQ ID NO: 1820537 - RNA, 20 nt, Salmonella typhimurium LT2
cugauaagcgaagcgccauc

SEQ ID NO: 1820538 - RNA, 18 nt, Salmonella typhimurium LT2
cugauaagcgcagcgcca

SEQ ID NO: 1820539 - RNA, 20 nt, Salmonella typhimurium LT2
cugauaagcgcagcgccauc

SEQ ID NO: 1820540 - RNA, 14 nt, Salmonella typhimurium LT2
cugauaagcguagc

SEQ ID NO: 1820541 - RNA, 18 nt, Salmonella typhimurium LT2
cugauaagcguagcgcca

SEQ ID NO: 1820542 - RNA, 17 nt, Salmonella typhimurium LT2
cugauaccccagcgauc

SEQ ID NO: 1820543 - RNA, 16 nt, Salmonella typhimurium LT2
cucgguauguccugcc

SEQ ID NO: 1820544 - RNA, 16 nt, Salmonella typhimurium LT2
cucguaggccagcgcu

SEQ ID NO: 1820545 - RNA, 17 nt, Salmonella typhimurium LT2
cugaacaaucgccugac

SEQ ID NO: 1820546 - RNA, 14 nt, Salmonella typhimurium LT2
cucuucaguaacca

SEQ ID NO: 1820547 - RNA, 16 nt, Salmonella typhimurium LT2
cucuuccagauacgga

SEQ ID NO: 1820548 - RNA, 14 nt, Salmonella typhimurium LT2
cucuuccagcgcca

SEQ ID NO: 1820549 - RNA, 23 nt, Salmonella typhimurium LT2
cucuccgccgcgggcagcagcag

SEQ ID NO: 1820550 - RNA, 14 nt, Salmonella typhimurium LT2
cucuccggcucguc

SEQ ID NO: 1820551 - RNA, 14 nt, Salmonella typhimurium LT2
cucuccagggcaac

SEQ ID NO: 1820552 - RNA, 14 nt, Salmonella typhimurium LT2
cucuggcggcguga

SEQ ID NO: 1820553 - RNA, 17 nt, Salmonella typhimurium LT2
cucgugcaaaucacugg

SEQ ID NO: 1820554 - RNA, 22 nt, Salmonella typhimurium LT2
cucucuuuuggcgacagacgcu

SEQ ID NO: 1820555 - RNA, 14 nt, Salmonella typhimurium LT2
cucuaaagcgcuga

SEQ ID NO: 1820556 - RNA, 21 nt, Salmonella typhimurium LT2
cucguugguagacccggcauu

SEQ ID NO: 1820557 - RNA, 20 nt, Salmonella typhimurium LT2
cucguaggccggauaagacg

SEQ ID NO: 1820558 - RNA, 14 nt, Salmonella typhimurium LT2
cucguaccaggccc

SEQ ID NO: 1820559 - RNA, 14 nt, Salmonella typhimurium LT2
cucggugccgcugc

SEQ ID NO: 1820560 - RNA, 19 nt, Salmonella typhimurium LT2
cucgccauugcguaaacgc

SEQ ID NO: 1820561 - RNA, 16 nt, Salmonella typhimurium LT2
cucgcccagaauuucc

SEQ ID NO: 1820562 - RNA, 15 nt, Salmonella typhimurium LT2
cucgcgccuucgccg

SEQ ID NO: 1820563 - RNA, 14 nt, Salmonella typhimurium LT2
cucgcccagcgccu

SEQ ID NO: 1820564 - RNA, 22 nt, Salmonella typhimurium LT2
cucgcuaaugcccggcgcggca

SEQ ID NO: 1820565 - RNA, 22 nt, Salmonella typhimurium LT2
cucgcuaauauccaccagccca

SEQ ID NO: 1820566 - RNA, 17 nt, Salmonella typhimurium LT2
cuccggcgcgccgcugg

SEQ ID NO: 1820567 - RNA, 20 nt, Salmonella typhimurium LT2
cuccgccagagcuucaggcg

SEQ ID NO: 1820568 - RNA, 16 nt, Salmonella typhimurium LT2
cuccgccgcuaucgcc

SEQ ID NO: 1820569 - RNA, 23 nt, Salmonella typhimurium LT2
cuccgccgucguaauaauaugcc

SEQ ID NO: 1820570 - RNA, 16 nt, Salmonella typhimurium LT2
cuccgcgcaaucgccg

SEQ ID NO: 1820571 - RNA, 19 nt, Salmonella typhimurium LT2
cuccugccuuuuugacgcu

SEQ ID NO: 1820572 - RNA, 22 nt, Salmonella typhimurium LT2
cucgaugcgccgaggcauccag

SEQ ID NO: 1820573 - RNA, 22 nt, Salmonella typhimurium LT2
cuccacauauugagcugauaac

SEQ ID NO: 1820574 - RNA, 14 nt, Salmonella typhimurium LT2
cuccagagcgccgu

SEQ ID NO: 1820575 - RNA, 16 nt, Salmonella typhimurium LT2
cucaugcaacuggcaa

SEQ ID NO: 1820576 - RNA, 18 nt, Salmonella typhimurium LT2
cucaugcguaaaucgcga

SEQ ID NO: 1820577 - RNA, 13 nt, Salmonella typhimurium LT2
cucauccggcagc

SEQ ID NO: 1820578 - RNA, 20 nt, Salmonella typhimurium LT2
cucauaacggcuuaacgcca

SEQ ID NO: 1820579 - RNA, 14 nt, Salmonella typhimurium LT2
cucaucaaacaggg

SEQ ID NO: 1820580 - RNA, 17 nt, Salmonella typhimurium LT2
cucaucaaggaacacgg

SEQ ID NO: 1820581 - RNA, 23 nt, Salmonella typhimurium LT2
cucagggucaucguuauucgcug

SEQ ID NO: 1820582 - RNA, 16 nt, Salmonella typhimurium LT2
cuagugccgccaggca

SEQ ID NO: 1820583 - RNA, 17 nt, Salmonella typhimurium LT2
cucccggcgcccauccg

SEQ ID NO: 1820584 - RNA, 13 nt, Salmonella typhimurium LT2
cuccgcaauuucc

SEQ ID NO: 1820585 - RNA, 16 nt, Salmonella typhimurium LT2
cuccgccaccagcgcu

SEQ ID NO: 1820586 - RNA, 13 nt, Salmonella typhimurium LT2
cuccagcaucaca

SEQ ID NO: 1820587 - RNA, 15 nt, Salmonella typhimurium LT2
cucccgcacgcuggc

SEQ ID NO: 1820588 - RNA, 20 nt, Salmonella typhimurium LT2
cuccccagaaugauaaugcc

SEQ ID NO: 1820589 - RNA, 19 nt, Salmonella typhimurium LT2
cguugaguuugacugccag

SEQ ID NO: 1820590 - RNA, 22 nt, Salmonella typhimurium LT2
cguucggcaaaacgccgcagaa

SEQ ID NO: 1820591 - RNA, 14 nt, Salmonella typhimurium LT2
cguugccagaguuc

SEQ ID NO: 1820592 - RNA, 14 nt, Salmonella typhimurium LT2
cguucgaaucagcu

SEQ ID NO: 1820593 - RNA, 14 nt, Salmonella typhimurium LT2
cguuccuuaucagc

SEQ ID NO: 1820594 - RNA, 18 nt, Salmonella typhimurium LT2
cguuacccgugcgcgucg

SEQ ID NO: 1820595 - RNA, 17 nt, Salmonella typhimurium LT2
cguguuaccagcaacug

SEQ ID NO: 1820596 - RNA, 16 nt, Salmonella typhimurium LT2
cguuacgcggugcgcc

SEQ ID NO: 1820597 - RNA, 18 nt, Salmonella typhimurium LT2
cguuacccggccagccgu

SEQ ID NO: 1820598 - RNA, 22 nt, Salmonella typhimurium LT2
cguggccagcaugcccgccagc

SEQ ID NO: 1820599 - RNA, 19 nt, Salmonella typhimurium LT2
cgugcggacguagggcugc

SEQ ID NO: 1820600 - RNA, 19 nt, Salmonella typhimurium LT2
cgugcgguauaucacgcca

SEQ ID NO: 1820601 - RNA, 15 nt, Salmonella typhimurium LT2
cgugcgucauccggc

SEQ ID NO: 1820602 - RNA, 19 nt, Salmonella typhimurium LT2
cgugguuuguugcgcgacc

SEQ ID NO: 1820603 - RNA, 13 nt, Salmonella typhimurium LT2
cuacaacucagcg

SEQ ID NO: 1820604 - RNA, 21 nt, Salmonella typhimurium LT2
cuaauuugagucgcagcacau

SEQ ID NO: 1820605 - RNA, 12 nt, Salmonella typhimurium LT2
cuaauuugcgau

SEQ ID NO: 1820606 - RNA, 14 nt, Salmonella typhimurium LT2
cuacaccaccagcc

SEQ ID NO: 1820607 - RNA, 15 nt, Salmonella typhimurium LT2
cuacauuaaugucau

SEQ ID NO: 1820608 - RNA, 18 nt, Salmonella typhimurium LT2
cuaccauugauaccaaua

SEQ ID NO: 1820609 - RNA, 15 nt, Salmonella typhimurium LT2
cuaccccuucugcca

SEQ ID NO: 1820610 - RNA, 16 nt, Salmonella typhimurium LT2
cuaagcagaacggcga

SEQ ID NO: 1820611 - RNA, 14 nt, Salmonella typhimurium LT2
cuaagaccagcauc

SEQ ID NO: 1820612 - RNA, 17 nt, Salmonella typhimurium LT2
cuaauaaccagccccag

SEQ ID NO: 1820613 - RNA, 22 nt, Salmonella typhimurium LT2
cuaauccccccuuuuuugcugg

SEQ ID NO: 1820614 - RNA, 19 nt, Salmonella typhimurium LT2
cuaauauccaccagcccau

SEQ ID NO: 1820615 - RNA, 20 nt, Salmonella typhimurium LT2
cuaaucaggacaucaaaggc

SEQ ID NO: 1820616 - RNA, 13 nt, Salmonella typhimurium LT2
cuaaugccuggca

SEQ ID NO: 1820617 - RNA, 14 nt, Salmonella typhimurium LT2
cuacgccaucauug

SEQ ID NO: 1820618 - RNA, 12 nt, Salmonella typhimurium LT2
cuacgaacgcga

SEQ ID NO: 1820619 - RNA, 15 nt, Salmonella typhimurium LT2
cuaccuucacacagu

SEQ ID NO: 1820620 - RNA, 18 nt, Salmonella typhimurium LT2
cuacgcuuaucaggccua

SEQ ID NO: 1820621 - RNA, 15 nt, Salmonella typhimurium LT2
cuaccggcaccagca

SEQ ID NO: 1820622 - RNA, 15 nt, Salmonella typhimurium LT2
cuaccuacguucccg

SEQ ID NO: 1820623 - RNA, 12 nt, Salmonella typhimurium LT2
cuacugccgcca

SEQ ID NO: 1820624 - RNA, 21 nt, Salmonella typhimurium LT2
cguuuaacugaacaucgccgu

SEQ ID NO: 1820625 - RNA, 14 nt, Salmonella typhimurium LT2
cguuuaaagcgcuc

SEQ ID NO: 1820626 - RNA, 12 nt, Salmonella typhimurium LT2
cguuuaaacggg

SEQ ID NO: 1820627 - RNA, 19 nt, Salmonella typhimurium LT2
cguugucggcucauccagc

SEQ ID NO: 1820628 - RNA, 15 nt, Salmonella typhimurium LT2
cguugugcugcggca

SEQ ID NO: 1820629 - RNA, 19 nt, Salmonella typhimurium LT2
cguuguccaacugucgcca

SEQ ID NO: 1820630 - RNA, 13 nt, Salmonella typhimurium LT2
cguuguaggccug

SEQ ID NO: 1820631 - RNA, 15 nt, Salmonella typhimurium LT2
cguuggccgccucgc

SEQ ID NO: 1820632 - RNA, 21 nt, Salmonella typhimurium LT2
cuaaacaauuugcccagcgcu

SEQ ID NO: 1820633 - RNA, 23 nt, Salmonella typhimurium LT2
cuaaacaauuugcccagcgcugg

SEQ ID NO: 1820634 - RNA, 11 nt, Salmonella typhimurium LT2
cuaaaccggcg

SEQ ID NO: 1820635 - RNA, 18 nt, Salmonella typhimurium LT2
cuaaaccggcggaauagc

SEQ ID NO: 1820636 - RNA, 16 nt, Salmonella typhimurium LT2
cuaaagagcgccugac

SEQ ID NO: 1820637 - RNA, 22 nt, Salmonella typhimurium LT2
cuaacagcagcaacaaaccgau

SEQ ID NO: 1820638 - RNA, 16 nt, Salmonella typhimurium LT2
cuaacgucagcgccac

SEQ ID NO: 1820639 - RNA, 19 nt, Salmonella typhimurium LT2
cuaacgucgccaucaggcg

SEQ ID NO: 1820640 - RNA, 18 nt, Salmonella typhimurium LT2
cguuuuuaucgcucgucg

SEQ ID NO: 1820641 - RNA, 17 nt, Salmonella typhimurium LT2
cguuuuucagccgcgca

SEQ ID NO: 1820642 - RNA, 20 nt, Salmonella typhimurium LT2
cguuuuggggagcugcgaaa

SEQ ID NO: 1820643 - RNA, 16 nt, Salmonella typhimurium LT2
cguuuugcagcgccau

SEQ ID NO: 1820644 - RNA, 17 nt, Salmonella typhimurium LT2
cguuuucauccauugcu

SEQ ID NO: 1820645 - RNA, 18 nt, Salmonella typhimurium LT2
cguuuucauuagccgcca

SEQ ID NO: 1820646 - RNA, 16 nt, Salmonella typhimurium LT2
cguuuuccaucaccau

SEQ ID NO: 1820647 - RNA, 13 nt, Salmonella typhimurium LT2
cguuuuauaagcc

SEQ ID NO: 1820648 - RNA, 15 nt, Salmonella typhimurium LT2
cguuuuacaccagcu

SEQ ID NO: 1820649 - RNA, 16 nt, Salmonella typhimurium LT2
cguuuuacaccagcuu

SEQ ID NO: 1820650 - RNA, 20 nt, Salmonella typhimurium LT2
cguuucguguuguccggcca

SEQ ID NO: 1820651 - RNA, 20 nt, Salmonella typhimurium LT2
cguuucgggaacguucccau

SEQ ID NO: 1820652 - RNA, 12 nt, Salmonella typhimurium LT2
cggucgcgccag

SEQ ID NO: 1820653 - RNA, 17 nt, Salmonella typhimurium LT2
cggucgccuaauccgcc

SEQ ID NO: 1820654 - RNA, 17 nt, Salmonella typhimurium LT2
cggucgcgccagcgacc

SEQ ID NO: 1820655 - RNA, 21 nt, Salmonella typhimurium LT2
cggucgcguuauaaccgccaa

SEQ ID NO: 1820656 - RNA, 16 nt, Salmonella typhimurium LT2
cggucgcuucaaucgu

SEQ ID NO: 1820657 - RNA, 14 nt, Salmonella typhimurium LT2
cggucgcuucgccu

SEQ ID NO: 1820658 - RNA, 23 nt, Salmonella typhimurium LT2
cggucugauaagcgcagcgccau

SEQ ID NO: 1820659 - RNA, 23 nt, Salmonella typhimurium LT2
cggucuccagcaacagcgcgucc

SEQ ID NO: 1820660 - RNA, 21 nt, Salmonella typhimurium LT2
cggugaccugcauuucccauc

SEQ ID NO: 1820661 - RNA, 24 nt, Salmonella typhimurium LT2
cggugauauuuuagccaucccggc

SEQ ID NO: 1820662 - RNA, 23 nt, Salmonella typhimurium LT2
cggugaugacuaaaucagcaucc

SEQ ID NO: 1820663 - RNA, 16 nt, Salmonella typhimurium LT2
cggugccgcugcugac

SEQ ID NO: 1820664 - RNA, 19 nt, Salmonella typhimurium LT2
cggugccgaaaucaucaau

SEQ ID NO: 1820665 - RNA, 21 nt, Salmonella typhimurium LT2
cggugcgguuacguccggcau

SEQ ID NO: 1820666 - RNA, 16 nt, Salmonella typhimurium LT2
cggugcgucacgccuu

SEQ ID NO: 1820667 - RNA, 23 nt, Salmonella typhimurium LT2
cgguggauacguucgaacgacuc

SEQ ID NO: 1820668 - RNA, 16 nt, Salmonella typhimurium LT2
cgguggucaucgcggc

SEQ ID NO: 1820669 - RNA, 17 nt, Salmonella typhimurium LT2
cgguggcgccgcgccac

SEQ ID NO: 1820670 - RNA, 14 nt, Salmonella typhimurium LT2
cgguggcgaaaacg

SEQ ID NO: 1820671 - RNA, 18 nt, Salmonella typhimurium LT2
cgguguaccccgccugac

SEQ ID NO: 1820672 - RNA, 15 nt, Salmonella typhimurium LT2
cgguguccaucaggc

SEQ ID NO: 1820673 - RNA, 18 nt, Salmonella typhimurium LT2
cgguuggaucucaccacu

SEQ ID NO: 1820674 - RNA, 22 nt, Salmonella typhimurium LT2
cgguuggccagcauggcgguca

SEQ ID NO: 1820675 - RNA, 20 nt, Salmonella typhimurium LT2
cgguuguucuuccagcguca

SEQ ID NO: 1820676 - RNA, 13 nt, Salmonella typhimurium LT2
cguaaacaaugga

SEQ ID NO: 1820677 - RNA, 22 nt, Salmonella typhimurium LT2
cguaaagggaaggucauuauca

SEQ ID NO: 1820678 - RNA, 18 nt, Salmonella typhimurium LT2
cguaaaaaaacaucauaa

SEQ ID NO: 1820679 - RNA, 15 nt, Salmonella typhimurium LT2
cgguuuaagcggaua

SEQ ID NO: 1820680 - RNA, 15 nt, Salmonella typhimurium LT2
cgguuccaacagcga

SEQ ID NO: 1820681 - RNA, 15 nt, Salmonella typhimurium LT2
cguaggucgcgaaca

SEQ ID NO: 1820682 - RNA, 22 nt, Salmonella typhimurium LT2
cguaauccgccucugccguagc

SEQ ID NO: 1820683 - RNA, 13 nt, Salmonella typhimurium LT2
cguaaucaucgcg

SEQ ID NO: 1820684 - RNA, 19 nt, Salmonella typhimurium LT2
cguaaucaucgcgaucgcc

SEQ ID NO: 1820685 - RNA, 18 nt, Salmonella typhimurium LT2
cguaauucaugcaacuuc

SEQ ID NO: 1820686 - RNA, 17 nt, Salmonella typhimurium LT2
cguaauuaagcaacaua

SEQ ID NO: 1820687 - RNA, 15 nt, Salmonella typhimurium LT2
cguaauuaagccggg

SEQ ID NO: 1820688 - RNA, 19 nt, Salmonella typhimurium LT2
cguaauacguaaaccgcuc

SEQ ID NO: 1820689 - RNA, 23 nt, Salmonella typhimurium LT2
cguaaauccuccaucaugggcgc

SEQ ID NO: 1820690 - RNA, 22 nt, Salmonella typhimurium LT2
cgucaacgcacuguaacgcacu

SEQ ID NO: 1820691 - RNA, 12 nt, Salmonella typhimurium LT2
cgucaagacgcu

SEQ ID NO: 1820692 - RNA, 23 nt, Salmonella typhimurium LT2
aacccggcugccauuaucaccau

SEQ ID NO: 1820693 - RNA, 14 nt, Salmonella typhimurium LT2
cguauuaugccgac

SEQ ID NO: 1820694 - RNA, 19 nt, Salmonella typhimurium LT2
cguauaaggcgaagcccau

SEQ ID NO: 1820695 - RNA, 18 nt, Salmonella typhimurium LT2
cguaguuggccuucuccg

SEQ ID NO: 1820696 - RNA, 20 nt, Salmonella typhimurium LT2
cgucagguuuaaucggcgug

SEQ ID NO: 1820697 - RNA, 17 nt, Salmonella typhimurium LT2
cgucagcgccauccggc

SEQ ID NO: 1820698 - RNA, 14 nt, Salmonella typhimurium LT2
cgucagccgugagc

SEQ ID NO: 1820699 - RNA, 16 nt, Salmonella typhimurium LT2
cgucagcguuuccggc

SEQ ID NO: 1820700 - RNA, 15 nt, Salmonella typhimurium LT2
cgucagcggcugcua

SEQ ID NO: 1820701 - RNA, 13 nt, Salmonella typhimurium LT2
cgucacaaucgcg

SEQ ID NO: 1820702 - RNA, 15 nt, Salmonella typhimurium LT2
cgucaaugcccggca

SEQ ID NO: 1820703 - RNA, 17 nt, Salmonella typhimurium LT2
cgucaaugcccggcagu

SEQ ID NO: 1820704 - RNA, 22 nt, Salmonella typhimurium LT2
cgucagacggcuccagcgccag

SEQ ID NO: 1820705 - RNA, 15 nt, Salmonella typhimurium LT2
cgucagaaauccgcg

SEQ ID NO: 1820706 - RNA, 15 nt, Salmonella typhimurium LT2
cgucagcaccagcga

SEQ ID NO: 1820707 - RNA, 16 nt, Salmonella typhimurium LT2
cgucagcaccagcgag

SEQ ID NO: 1820708 - RNA, 14 nt, Salmonella typhimurium LT2
cgucacucacauuc

SEQ ID NO: 1820709 - RNA, 14 nt, Salmonella typhimurium LT2
cguccuuuaucaga

SEQ ID NO: 1820710 - RNA, 22 nt, Salmonella typhimurium LT2
cguccguucugauacucguagc

SEQ ID NO: 1820711 - RNA, 20 nt, Salmonella typhimurium LT2
cguccgccuuugacgccggg

SEQ ID NO: 1820712 - RNA, 14 nt, Salmonella typhimurium LT2
cgucccuuccgcca

SEQ ID NO: 1820713 - RNA, 20 nt, Salmonella typhimurium LT2
cgucccuuccgccaccaggu

SEQ ID NO: 1820714 - RNA, 13 nt, Salmonella typhimurium LT2
cgucauaaucgcg

SEQ ID NO: 1820715 - RNA, 13 nt, Salmonella typhimurium LT2
cgucauccggcaa

SEQ ID NO: 1820716 - RNA, 18 nt, Salmonella typhimurium LT2
cguccacggacaucggcu

SEQ ID NO: 1820717 - RNA, 13 nt, Salmonella typhimurium LT2
cguccccagccag

SEQ ID NO: 1820718 - RNA, 15 nt, Salmonella typhimurium LT2
cguccccagcgaucc

SEQ ID NO: 1820719 - RNA, 21 nt, Salmonella typhimurium LT2
cgucccgacgaacgaagagcc

SEQ ID NO: 1820720 - RNA, 19 nt, Salmonella typhimurium LT2
cgucuaccguuucgaccgu

SEQ ID NO: 1820721 - RNA, 14 nt, Salmonella typhimurium LT2
cgucucccgacacc

SEQ ID NO: 1820722 - RNA, 19 nt, Salmonella typhimurium LT2
cgucgguagaugcugaugu

SEQ ID NO: 1820723 - RNA, 16 nt, Salmonella typhimurium LT2
cgucggcgaugugccu

SEQ ID NO: 1820724 - RNA, 11 nt, Salmonella typhimurium LT2
cgucgccuucc

SEQ ID NO: 1820725 - RNA, 11 nt, Salmonella typhimurium LT2
cuggugcgccu

SEQ ID NO: 1820726 - RNA, 19 nt, Salmonella typhimurium LT2
cugguggcaagauaagccg

SEQ ID NO: 1820727 - RNA, 16 nt, Salmonella typhimurium LT2
cuggugggguucccga

SEQ ID NO: 1820728 - RNA, 16 nt, Salmonella typhimurium LT2
cuggucgccagcgccg

SEQ ID NO: 1820729 - RNA, 18 nt, Salmonella typhimurium LT2
cuggucgccagcgccgga

SEQ ID NO: 1820730 - RNA, 15 nt, Salmonella typhimurium LT2
cuggugacaucgcca

SEQ ID NO: 1820731 - RNA, 14 nt, Salmonella typhimurium LT2
cuggucuuccgcau

SEQ ID NO: 1820732 - RNA, 22 nt, Salmonella typhimurium LT2
cugggcaaucaucagaccgaua

SEQ ID NO: 1820733 - RNA, 16 nt, Salmonella typhimurium LT2
cuggguugauaccgga

SEQ ID NO: 1820734 - RNA, 16 nt, Salmonella typhimurium LT2
cuggguagaguaaccc

SEQ ID NO: 1820735 - RNA, 22 nt, Salmonella typhimurium LT2
cugucugaaucaaugcaucuuc

SEQ ID NO: 1820736 - RNA, 19 nt, Salmonella typhimurium LT2
cugucgauaaacucaugcg

SEQ ID NO: 1820737 - RNA, 14 nt, Salmonella typhimurium LT2
cugucgccaggcca

SEQ ID NO: 1820738 - RNA, 12 nt, Salmonella typhimurium LT2
cugucguagccg

SEQ ID NO: 1820739 - RNA, 19 nt, Salmonella typhimurium LT2
cuguuccagugggcggaua

SEQ ID NO: 1820740 - RNA, 18 nt, Salmonella typhimurium LT2
cuguuccaugacguucaa

SEQ ID NO: 1820741 - RNA, 13 nt, Salmonella typhimurium LT2
cuguucgccuucg

SEQ ID NO: 1820742 - RNA, 15 nt, Salmonella typhimurium LT2
cuguaacaguauccg

SEQ ID NO: 1820743 - RNA, 14 nt, Salmonella typhimurium LT2
cuguaacaguaucc

SEQ ID NO: 1820744 - RNA, 13 nt, Salmonella typhimurium LT2
cugguuuuccgcu

SEQ ID NO: 1820745 - RNA, 17 nt, Salmonella typhimurium LT2
cuguccagaucuuccca

SEQ ID NO: 1820746 - RNA, 13 nt, Salmonella typhimurium LT2
cugucccagcguc

SEQ ID NO: 1820747 - RNA, 17 nt, Salmonella typhimurium LT2
cuucacgcuggugcgcg

SEQ ID NO: 1820748 - RNA, 16 nt, Salmonella typhimurium LT2
cuucacgucggcgacc

SEQ ID NO: 1820749 - RNA, 20 nt, Salmonella typhimurium LT2
cuucaccucagucgcuugua

SEQ ID NO: 1820750 - RNA, 15 nt, Salmonella typhimurium LT2
cuucaccuuucgccg

SEQ ID NO: 1820751 - RNA, 13 nt, Salmonella typhimurium LT2
cuucacgccaucg

SEQ ID NO: 1820752 - RNA, 23 nt, Salmonella typhimurium LT2
cuucacgauauaguccugaugaa

SEQ ID NO: 1820753 - RNA, 14 nt, Salmonella typhimurium LT2
cuucacgcagcgcc

SEQ ID NO: 1820754 - RNA, 20 nt, Salmonella typhimurium LT2
cuuauaggcgcaucugaaaa

SEQ ID NO: 1820755 - RNA, 18 nt, Salmonella typhimurium LT2
cuuagggggcuaccggag

SEQ ID NO: 1820756 - RNA, 21 nt, Salmonella typhimurium LT2
cuuauccgacgcguuucacau

SEQ ID NO: 1820757 - RNA, 14 nt, Salmonella typhimurium LT2
cuuauccgcgugga

SEQ ID NO: 1820758 - RNA, 11 nt, Salmonella typhimurium LT2
cuuaucgccaa

SEQ ID NO: 1820759 - RNA, 22 nt, Salmonella typhimurium LT2
cuuauccggccuauagcuaaug

SEQ ID NO: 1820760 - RNA, 20 nt, Salmonella typhimurium LT2
cuuaucccacaacuguucuu

SEQ ID NO: 1820761 - RNA, 17 nt, Salmonella typhimurium LT2
cuuacugcuguccgcca

SEQ ID NO: 1820762 - RNA, 20 nt, Salmonella typhimurium LT2
cuuacccagagucaccagca

SEQ ID NO: 1820763 - RNA, 21 nt, Salmonella typhimurium LT2
cuuaccaccuuaaacuugccg

SEQ ID NO: 1820764 - RNA, 21 nt, Salmonella typhimurium LT2
cuugauagcgaucagcgccac

SEQ ID NO: 1820765 - RNA, 12 nt, Salmonella typhimurium LT2
cuugccagcgca

SEQ ID NO: 1820766 - RNA, 22 nt, Salmonella typhimurium LT2
cuuguaaaaaugccugugccag

SEQ ID NO: 1820767 - RNA, 19 nt, Salmonella typhimurium LT2
cuuguagcgcugcccaauc

SEQ ID NO: 1820768 - RNA, 16 nt, Salmonella typhimurium LT2
cuuggcgaucaccagc

SEQ ID NO: 1820769 - RNA, 21 nt, Salmonella typhimurium LT2
cuugcgccagcgcgcguaccc

SEQ ID NO: 1820770 - RNA, 23 nt, Salmonella typhimurium LT2
cuugcgcaucgcaucagggcgac

SEQ ID NO: 1820771 - RNA, 20 nt, Salmonella typhimurium LT2
cuugccucacccugaaaucc

SEQ ID NO: 1820772 - RNA, 16 nt, Salmonella typhimurium LT2
cuuccaguugaaaacc

SEQ ID NO: 1820773 - RNA, 15 nt, Salmonella typhimurium LT2
cuuccugaaucacca

SEQ ID NO: 1820774 - RNA, 19 nt, Salmonella typhimurium LT2
cuuccugaaucaccagccg

SEQ ID NO: 1820775 - RNA, 20 nt, Salmonella typhimurium LT2
cuuccguuuuguugccgccc

SEQ ID NO: 1820776 - RNA, 21 nt, Salmonella typhimurium LT2
cuuccugaaagaguacgccga

SEQ ID NO: 1820777 - RNA, 17 nt, Salmonella typhimurium LT2
cuucuugcugacgaucg

SEQ ID NO: 1820778 - RNA, 21 nt, Salmonella typhimurium LT2
cuucuucauauuugcuauaaa

SEQ ID NO: 1820779 - RNA, 15 nt, Salmonella typhimurium LT2
cuucuuccagcggca

SEQ ID NO: 1820780 - RNA, 17 nt, Salmonella typhimurium LT2
cuucugacagugacggc

SEQ ID NO: 1820781 - RNA, 20 nt, Salmonella typhimurium LT2
cuucugauaagcgcagcguc

SEQ ID NO: 1820782 - RNA, 13 nt, Salmonella typhimurium LT2
cuucggcgccauu

SEQ ID NO: 1820783 - RNA, 16 nt, Salmonella typhimurium LT2
cugcgcuuauccggcc

SEQ ID NO: 1820784 - RNA, 17 nt, Salmonella typhimurium LT2
cugcgcuuauccggccu

SEQ ID NO: 1820785 - RNA, 15 nt, Salmonella typhimurium LT2
cugcgcuuaacgcuu

SEQ ID NO: 1820786 - RNA, 23 nt, Salmonella typhimurium LT2
cugcgcuuuccaggccagcgaca

SEQ ID NO: 1820787 - RNA, 18 nt, Salmonella typhimurium LT2
cugcggcagaaucacggc

SEQ ID NO: 1820788 - RNA, 23 nt, Salmonella typhimurium LT2
cugcgccauguucauaaagugcc

SEQ ID NO: 1820789 - RNA, 19 nt, Salmonella typhimurium LT2
cugcgcccgcucugcgcca

SEQ ID NO: 1820790 - RNA, 17 nt, Salmonella typhimurium LT2
cugcgccagcauggcgu

SEQ ID NO: 1820791 - RNA, 17 nt, Salmonella typhimurium LT2
cugcgcauuaacgccgu

SEQ ID NO: 1820792 - RNA, 19 nt, Salmonella typhimurium LT2
cugcgcauauuccggcgac

SEQ ID NO: 1820793 - RNA, 14 nt, Salmonella typhimurium LT2
cugcgcacggcaau

SEQ ID NO: 1820794 - RNA, 17 nt, Salmonella typhimurium LT2
cugcgcacggcaauccg

SEQ ID NO: 1820795 - RNA, 17 nt, Salmonella typhimurium LT2
cugcgccuuauccggcc

SEQ ID NO: 1820796 - RNA, 12 nt, Salmonella typhimurium LT2
cugccguaccgu

SEQ ID NO: 1820797 - RNA, 20 nt, Salmonella typhimurium LT2
cugccguagcguacuuucaa

SEQ ID NO: 1820798 - RNA, 18 nt, Salmonella typhimurium LT2
cugccuuuuuuagcgugu

SEQ ID NO: 1820799 - RNA, 21 nt, Salmonella typhimurium LT2
cugccuuuguacagcuugccg

SEQ ID NO: 1820800 - RNA, 15 nt, Salmonella typhimurium LT2
cugcgaaaagcgugc

SEQ ID NO: 1820801 - RNA, 14 nt, Salmonella typhimurium LT2
cugcgaagccaccg

SEQ ID NO: 1820802 - RNA, 19 nt, Salmonella typhimurium LT2
cugcgacgcaugaaacgcc

SEQ ID NO: 1820803 - RNA, 15 nt, Salmonella typhimurium LT2
cugaaauagccccgu

SEQ ID NO: 1820804 - RNA, 12 nt, Salmonella typhimurium LT2
cugaaagcgccu

SEQ ID NO: 1820805 - RNA, 14 nt, Salmonella typhimurium LT2
cugccgcaaacgcc

SEQ ID NO: 1820806 - RNA, 19 nt, Salmonella typhimurium LT2
cugccgcagccgcucaggg

SEQ ID NO: 1820807 - RNA, 16 nt, Salmonella typhimurium LT2
cugccgcccaucgcca

SEQ ID NO: 1820808 - RNA, 22 nt, Salmonella typhimurium LT2
cugccgccggcuucuuccggcc

SEQ ID NO: 1820809 - RNA, 19 nt, Salmonella typhimurium LT2
cugcguugggugcagcguc

SEQ ID NO: 1820810 - RNA, 20 nt, Salmonella typhimurium LT2
cugcguugggugcagcguca

SEQ ID NO: 1820811 - RNA, 11 nt, Salmonella typhimurium LT2
cugcguugccg

SEQ ID NO: 1820812 - RNA, 16 nt, Salmonella typhimurium LT2
cugcgugaacgaccgc

SEQ ID NO: 1820813 - RNA, 16 nt, Salmonella typhimurium LT2
cugcgucgcuuccugu

SEQ ID NO: 1820814 - RNA, 21 nt, Salmonella typhimurium LT2
cugcugcucccucacgcguca

SEQ ID NO: 1820815 - RNA, 19 nt, Salmonella typhimurium LT2
cugcugcaaauauucgcca

SEQ ID NO: 1820816 - RNA, 19 nt, Salmonella typhimurium LT2
cugcucguaaguuuccugc

SEQ ID NO: 1820817 - RNA, 15 nt, Salmonella typhimurium LT2
aaccgcucuccgcaa

SEQ ID NO: 1820818 - RNA, 15 nt, Salmonella typhimurium LT2
aaccgcuuuuccugc

SEQ ID NO: 1820819 - RNA, 13 nt, Salmonella typhimurium LT2
cugcucgccagua

SEQ ID NO: 1820820 - RNA, 21 nt, Salmonella typhimurium LT2
cuggcaugcgccccguuuccg

SEQ ID NO: 1820821 - RNA, 15 nt, Salmonella typhimurium LT2
cugcuuuuccggcag

SEQ ID NO: 1820822 - RNA, 16 nt, Salmonella typhimurium LT2
cugcuuuuccggcagc

SEQ ID NO: 1820823 - RNA, 19 nt, Salmonella typhimurium LT2
cugcuuucuuacaccucgc

SEQ ID NO: 1820824 - RNA, 14 nt, Salmonella typhimurium LT2
cuggaaaggccgcg

SEQ ID NO: 1820825 - RNA, 20 nt, Salmonella typhimurium LT2
cuggaaacagccaaucauaa

SEQ ID NO: 1820826 - RNA, 22 nt, Salmonella typhimurium LT2
cugcuguagcugucccagcguc

SEQ ID NO: 1820827 - RNA, 17 nt, Salmonella typhimurium LT2
cugcuuagcucaucagc

SEQ ID NO: 1820828 - RNA, 21 nt, Salmonella typhimurium LT2
cugcuuaucgauaucugccug

SEQ ID NO: 1820829 - RNA, 16 nt, Salmonella typhimurium LT2
cugcuucaguaaaucc

SEQ ID NO: 1820830 - RNA, 19 nt, Salmonella typhimurium LT2
gaccggcguuuuuauaaga

SEQ ID NO: 1820831 - RNA, 14 nt, Salmonella typhimurium LT2
gaccgccggaaauu

SEQ ID NO: 1820832 - RNA, 17 nt, Salmonella typhimurium LT2
gaccgcuuaacuccggc

SEQ ID NO: 1820833 - RNA, 21 nt, Salmonella typhimurium LT2
gaccgcuuaacuccggcgacc

SEQ ID NO: 1820834 - RNA, 20 nt, Salmonella typhimurium LT2
aacgcuuccggaucgcggcu

SEQ ID NO: 1820835 - RNA, 21 nt, Salmonella typhimurium LT2
aacgcuuaaccccucgcagac

SEQ ID NO: 1820836 - RNA, 15 nt, Salmonella typhimurium LT2
gacccgcaauaacgc

SEQ ID NO: 1820837 - RNA, 18 nt, Salmonella typhimurium LT2
gacccgcaauaacgccga

SEQ ID NO: 1820838 - RNA, 19 nt, Salmonella typhimurium LT2
aacgcuggcggcaggccua

SEQ ID NO: 1820839 - RNA, 21 nt, Salmonella typhimurium LT2
gaccgccaugcggcgccauca

SEQ ID NO: 1820840 - RNA, 14 nt, Salmonella typhimurium LT2
gaccgacgccaacc

SEQ ID NO: 1820841 - RNA, 15 nt, Salmonella typhimurium LT2
aacgggcccggcuuu

SEQ ID NO: 1820842 - RNA, 18 nt, Salmonella typhimurium LT2
aacgguaaacacgacgcu

SEQ ID NO: 1820843 - RNA, 16 nt, Salmonella typhimurium LT2
aacgguccugguccgg

SEQ ID NO: 1820844 - RNA, 17 nt, Salmonella typhimurium LT2
aacggcuuuccagcagc

SEQ ID NO: 1820845 - RNA, 17 nt, Salmonella typhimurium LT2
aacggcugacgcccauc

SEQ ID NO: 1820846 - RNA, 14 nt, Salmonella typhimurium LT2
aacggcguaccaga

SEQ ID NO: 1820847 - RNA, 18 nt, Salmonella typhimurium LT2
gaccgugagaaucgauca

SEQ ID NO: 1820848 - RNA, 18 nt, Salmonella typhimurium LT2
gaccuuuuacuucacgua

SEQ ID NO: 1820849 - RNA, 19 nt, Salmonella typhimurium LT2
gacgaacgcuaugcgccag

SEQ ID NO: 1820850 - RNA, 15 nt, Salmonella typhimurium LT2
aacgcgaccagcgca

SEQ ID NO: 1820851 - RNA, 13 nt, Salmonella typhimurium LT2
aacgcgacaacgc

SEQ ID NO: 1820852 - RNA, 14 nt, Salmonella typhimurium LT2
aacgccuucguccg

SEQ ID NO: 1820853 - RNA, 17 nt, Salmonella typhimurium LT2
aacgcgcauaccgcuuu

SEQ ID NO: 1820854 - RNA, 14 nt, Salmonella typhimurium LT2
aacgcgccaucuuu

SEQ ID NO: 1820855 - RNA, 16 nt, Salmonella typhimurium LT2
aacgcgccacgcgcca

SEQ ID NO: 1820856 - RNA, 12 nt, Salmonella typhimurium LT2
aacgcgccaggu

SEQ ID NO: 1820857 - RNA, 20 nt, Salmonella typhimurium LT2
gaccaucgcgccgcuggcgu

SEQ ID NO: 1820858 - RNA, 22 nt, Salmonella typhimurium LT2
gaccauauugaagggaccgcga

SEQ ID NO: 1820859 - RNA, 13 nt, Salmonella typhimurium LT2
gaccauccagaca

SEQ ID NO: 1820860 - RNA, 16 nt, Salmonella typhimurium LT2
gaccauccaccagaac

SEQ ID NO: 1820861 - RNA, 13 nt, Salmonella typhimurium LT2
gaccacuagcgcc

SEQ ID NO: 1820862 - RNA, 19 nt, Salmonella typhimurium LT2
aacgccguacuccagccca

SEQ ID NO: 1820863 - RNA, 17 nt, Salmonella typhimurium LT2
aacgccgguacgcagca

SEQ ID NO: 1820864 - RNA, 22 nt, Salmonella typhimurium LT2
gaccagcaaaaagaaucgccag

SEQ ID NO: 1820865 - RNA, 20 nt, Salmonella typhimurium LT2
aacgccuuauccggccuaca

SEQ ID NO: 1820866 - RNA, 20 nt, Salmonella typhimurium LT2
aacgccuuauccugccuaca

SEQ ID NO: 1820867 - RNA, 20 nt, Salmonella typhimurium LT2
aacgccuuauccggccuacu

SEQ ID NO: 1820868 - RNA, 17 nt, Salmonella typhimurium LT2
aacgccuuauccggccu

SEQ ID NO: 1820869 - RNA, 16 nt, Salmonella typhimurium LT2
aacgcagcaucgccau

SEQ ID NO: 1820870 - RNA, 13 nt, Salmonella typhimurium LT2
aacgcauccagcc

SEQ ID NO: 1820871 - RNA, 14 nt, Salmonella typhimurium LT2
aacgcaucgcggau

SEQ ID NO: 1820872 - RNA, 15 nt, Salmonella typhimurium LT2
gaccaccauauucgc

SEQ ID NO: 1820873 - RNA, 18 nt, Salmonella typhimurium LT2
gaccaaaaucaaacugau

SEQ ID NO: 1820874 - RNA, 14 nt, Salmonella typhimurium LT2
aacgacucacgcgc

SEQ ID NO: 1820875 - RNA, 21 nt, Salmonella typhimurium LT2
aacgagugaggaccguacuca

SEQ ID NO: 1820876 - RNA, 12 nt, Salmonella typhimurium LT2
aacgagccgaua

SEQ ID NO: 1820877 - RNA, 16 nt, Salmonella typhimurium LT2
aacgagccgucgcuau

SEQ ID NO: 1820878 - RNA, 20 nt, Salmonella typhimurium LT2
gaccaauauccgcaggcgac

SEQ ID NO: 1820879 - RNA, 15 nt, Salmonella typhimurium LT2
aacgauaacgucagc

SEQ ID NO: 1820880 - RNA, 20 nt, Salmonella typhimurium LT2
aacgauaagugaagcguuuc

SEQ ID NO: 1820881 - RNA, 23 nt, Salmonella typhimurium LT2
gacagucgcagagcccagcgcga

SEQ ID NO: 1820882 - RNA, 23 nt, Salmonella typhimurium LT2
gacaggguuugccagcaccagca

SEQ ID NO: 1820883 - RNA, 19 nt, Salmonella typhimurium LT2
gacauuuggggcuggcgac

SEQ ID NO: 1820884 - RNA, 17 nt, Salmonella typhimurium LT2
gacauugguuucaugca

SEQ ID NO: 1820885 - RNA, 23 nt, Salmonella typhimurium LT2
gacauugguuucaugcaucauug

SEQ ID NO: 1820886 - RNA, 22 nt, Salmonella typhimurium LT2
gacaugcuccgccccgccuucc

SEQ ID NO: 1820887 - RNA, 15 nt, Salmonella typhimurium LT2
gacagccaccagcgu

SEQ ID NO: 1820888 - RNA, 16 nt, Salmonella typhimurium LT2
gacagcccgccagcau

SEQ ID NO: 1820889 - RNA, 21 nt, Salmonella typhimurium LT2
gaauuccuuuuuccgccaccu

SEQ ID NO: 1820890 - RNA, 17 nt, Salmonella typhimurium LT2
gaauggcgaaccacggc

SEQ ID NO: 1820891 - RNA, 15 nt, Salmonella typhimurium LT2
gaauuaugacggaug

SEQ ID NO: 1820892 - RNA, 13 nt, Salmonella typhimurium LT2
gacagcgccauca

SEQ ID NO: 1820893 - RNA, 23 nt, Salmonella typhimurium LT2
gacagcgccaucagcaucaucac

SEQ ID NO: 1820894 - RNA, 16 nt, Salmonella typhimurium LT2
gacaggcagcgucagc

SEQ ID NO: 1820895 - RNA, 14 nt, Salmonella typhimurium LT2
gacagcgcgcguca

SEQ ID NO: 1820896 - RNA, 17 nt, Salmonella typhimurium LT2
aacgacacaggccugau

SEQ ID NO: 1820897 - RNA, 13 nt, Salmonella typhimurium LT2
aacgacagcgcca

SEQ ID NO: 1820898 - RNA, 15 nt, Salmonella typhimurium LT2
gaagcccggccacag

SEQ ID NO: 1820899 - RNA, 20 nt, Salmonella typhimurium LT2
gaagcccggccacagcgcca

SEQ ID NO: 1820900 - RNA, 19 nt, Salmonella typhimurium LT2
gaagauaaacagcagcgcg

SEQ ID NO: 1820901 - RNA, 22 nt, Salmonella typhimurium LT2
gaagaucguuauccagcagcca

SEQ ID NO: 1820902 - RNA, 19 nt, Salmonella typhimurium LT2
gaagagucgauacgcugaa

SEQ ID NO: 1820903 - RNA, 23 nt, Salmonella typhimurium LT2
gaagagauugaguuugauagcgc

SEQ ID NO: 1820904 - RNA, 16 nt, Salmonella typhimurium LT2
gaagcagcuuauccgg

SEQ ID NO: 1820905 - RNA, 17 nt, Salmonella typhimurium LT2
gaagcucaugugcagca

SEQ ID NO: 1820906 - RNA, 17 nt, Salmonella typhimurium LT2
gaagcguaacagcgcua

SEQ ID NO: 1820907 - RNA, 20 nt, Salmonella typhimurium LT2
gaagcguaacagcgcuauca

SEQ ID NO: 1820908 - RNA, 22 nt, Salmonella typhimurium LT2
gaaggcauggggauuaagcgag

SEQ ID NO: 1820909 - RNA, 16 nt, Salmonella typhimurium LT2
gaaggcaucuucagac

SEQ ID NO: 1820910 - RNA, 19 nt, Salmonella typhimurium LT2
gaagcgauguauuuaucca

SEQ ID NO: 1820911 - RNA, 18 nt, Salmonella typhimurium LT2
gaagcgccaucaggcacu

SEQ ID NO: 1820912 - RNA, 14 nt, Salmonella typhimurium LT2
gaagcgccauccga

SEQ ID NO: 1820913 - RNA, 14 nt, Salmonella typhimurium LT2
gaaggcuccggcac

SEQ ID NO: 1820914 - RNA, 22 nt, Salmonella typhimurium LT2
gaagguauccagccaggucagc

SEQ ID NO: 1820915 - RNA, 21 nt, Salmonella typhimurium LT2
gaaggcgacgcgauagcgcag

SEQ ID NO: 1820916 - RNA, 13 nt, Salmonella typhimurium LT2
gaaguaagcgcca

SEQ ID NO: 1820917 - RNA, 16 nt, Salmonella typhimurium LT2
gaagguuagcgucugc

SEQ ID NO: 1820918 - RNA, 15 nt, Salmonella typhimurium LT2
gaaggucgcauccgc

SEQ ID NO: 1820919 - RNA, 15 nt, Salmonella typhimurium LT2
gaaucgcgcgcgcca

SEQ ID NO: 1820920 - RNA, 15 nt, Salmonella typhimurium LT2
gaaucgcuuccuggg

SEQ ID NO: 1820921 - RNA, 14 nt, Salmonella typhimurium LT2
gaaucgcugcgcca

SEQ ID NO: 1820922 - RNA, 22 nt, Salmonella typhimurium LT2
gaaugcccacgcuucccagcgu

SEQ ID NO: 1820923 - RNA, 21 nt, Salmonella typhimurium LT2
gaaugacgggccuacgcgcau

SEQ ID NO: 1820924 - RNA, 17 nt, Salmonella typhimurium LT2
gaaucucccgauaaccu

SEQ ID NO: 1820925 - RNA, 18 nt, Salmonella typhimurium LT2
gaaucucgcugccggaaa

SEQ ID NO: 1820926 - RNA, 19 nt, Salmonella typhimurium LT2
gaauacgguccguuuucgc

SEQ ID NO: 1820927 - RNA, 19 nt, Salmonella typhimurium LT2
gaauacgugugcugacggc

SEQ ID NO: 1820928 - RNA, 11 nt, Salmonella typhimurium LT2
gaauacgauag

SEQ ID NO: 1820929 - RNA, 12 nt, Salmonella typhimurium LT2
gaaucaccgaca

SEQ ID NO: 1820930 - RNA, 17 nt, Salmonella typhimurium LT2
gaaucaccgacagcacc

SEQ ID NO: 1820931 - RNA, 19 nt, Salmonella typhimurium LT2
gaaucaccgacagcaccgc

SEQ ID NO: 1820932 - RNA, 18 nt, Salmonella typhimurium LT2
gaaucacuucauccggau

SEQ ID NO: 1820933 - RNA, 18 nt, Salmonella typhimurium LT2
gaaucagcgauugcgcca

SEQ ID NO: 1820934 - RNA, 20 nt, Salmonella typhimurium LT2
gaauaccaaaucucaagagu

SEQ ID NO: 1820935 - RNA, 20 nt, Salmonella typhimurium LT2
gaauaccagaaucaccgaca

SEQ ID NO: 1820936 - RNA, 23 nt, Salmonella typhimurium LT2
gaagugccaguaacucaucgcca

SEQ ID NO: 1820937 - RNA, 13 nt, Salmonella typhimurium LT2
gaauacagcgccu

SEQ ID NO: 1820938 - RNA, 17 nt, Salmonella typhimurium LT2
gaacucgucuuauccgg

SEQ ID NO: 1820939 - RNA, 17 nt, Salmonella typhimurium LT2
gaagacgcugcaacucu

SEQ ID NO: 1820940 - RNA, 20 nt, Salmonella typhimurium LT2
gaagaaacggaaaucacgca

SEQ ID NO: 1820941 - RNA, 14 nt, Salmonella typhimurium LT2
gaagaaagacgcgc

SEQ ID NO: 1820942 - RNA, 12 nt, Salmonella typhimurium LT2
gaagaaaccgca

SEQ ID NO: 1820943 - RNA, 19 nt, Salmonella typhimurium LT2
gaacuucgcgguugcgccc

SEQ ID NO: 1820944 - RNA, 14 nt, Salmonella typhimurium LT2
gaacuugucaucgc

SEQ ID NO: 1820945 - RNA, 22 nt, Salmonella typhimurium LT2
gaacgaauuuacucgccaauau

SEQ ID NO: 1820946 - RNA, 18 nt, Salmonella typhimurium LT2
gaacgccaaauacgucgc

SEQ ID NO: 1820947 - RNA, 16 nt, Salmonella typhimurium LT2
gaacgcggcuuauccg

SEQ ID NO: 1820948 - RNA, 18 nt, Salmonella typhimurium LT2
gaaaucgguacgcgucug

SEQ ID NO: 1820949 - RNA, 18 nt, Salmonella typhimurium LT2
gaaaucccggaggcgaua

SEQ ID NO: 1820950 - RNA, 16 nt, Salmonella typhimurium LT2
gaaaucccggcguagc

SEQ ID NO: 1820951 - RNA, 11 nt, Salmonella typhimurium LT2
gaaauccggcu

SEQ ID NO: 1820952 - RNA, 20 nt, Salmonella typhimurium LT2
gaacagucccaccagcgcgg

SEQ ID NO: 1820953 - RNA, 23 nt, Salmonella typhimurium LT2
gaacagugaguuaagacgcuuca

SEQ ID NO: 1820954 - RNA, 21 nt, Salmonella typhimurium LT2
gaacagguaguuaccguauuc

SEQ ID NO: 1820955 - RNA, 17 nt, Salmonella typhimurium LT2
cuuguaagggaggugcu

SEQ ID NO: 1820956 - RNA, 13 nt, Salmonella typhimurium LT2
cuuguaggccgga

SEQ ID NO: 1820957 - RNA, 14 nt, Salmonella typhimurium LT2
cuuguguaggccgg

SEQ ID NO: 1820958 - RNA, 23 nt, Salmonella typhimurium LT2
gaaacgaucgauaaagcgauuac

SEQ ID NO: 1820959 - RNA, 17 nt, Salmonella typhimurium LT2
gaaacgaaagcucaggc

SEQ ID NO: 1820960 - RNA, 15 nt, Salmonella typhimurium LT2
gaaagggacgaugau

SEQ ID NO: 1820961 - RNA, 16 nt, Salmonella typhimurium LT2
gaaaggcgugcagcgu

SEQ ID NO: 1820962 - RNA, 19 nt, Salmonella typhimurium LT2
gaaaggcgucagccgccau

SEQ ID NO: 1820963 - RNA, 12 nt, Salmonella typhimurium LT2
gaaagcugcacc

SEQ ID NO: 1820964 - RNA, 19 nt, Salmonella typhimurium LT2
gaaagccaguacagcacgc

SEQ ID NO: 1820965 - RNA, 18 nt, Salmonella typhimurium LT2
gaaagcgaccggcacuca

SEQ ID NO: 1820966 - RNA, 17 nt, Salmonella typhimurium LT2
gaaagccuucaucauca

SEQ ID NO: 1820967 - RNA, 16 nt, Salmonella typhimurium LT2
gaaagacgcgcucggc

SEQ ID NO: 1820968 - RNA, 17 nt, Salmonella typhimurium LT2
gccaaacccugcgccac

SEQ ID NO: 1820969 - RNA, 23 nt, Salmonella typhimurium LT2
gccaaaagaaguggcaaucgaga

SEQ ID NO: 1820970 - RNA, 17 nt, Salmonella typhimurium LT2
gccaaaaauaucgccgu

SEQ ID NO: 1820971 - RNA, 21 nt, Salmonella typhimurium LT2
gccaaagucauugcugccagu

SEQ ID NO: 1820972 - RNA, 22 nt, Salmonella typhimurium LT2
gccaaauacgucgcacggauca

SEQ ID NO: 1820973 - RNA, 17 nt, Salmonella typhimurium LT2
gccaaacgggcaagcca

SEQ ID NO: 1820974 - RNA, 16 nt, Salmonella typhimurium LT2
gccaaaucaugcccaa

SEQ ID NO: 1820975 - RNA, 21 nt, Salmonella typhimurium LT2
gccaaaucgucagccgccagu

SEQ ID NO: 1820976 - RNA, 18 nt, Salmonella typhimurium LT2
gccaacaggucgaugauu

SEQ ID NO: 1820977 - RNA, 22 nt, Salmonella typhimurium LT2
gccaacagccgcccacaaccga

SEQ ID NO: 1820978 - RNA, 22 nt, Salmonella typhimurium LT2
gcauuuguagcggcaacagcac

SEQ ID NO: 1820979 - RNA, 23 nt, Salmonella typhimurium LT2
gccaaaaaaggcagccaggaacg

SEQ ID NO: 1820980 - RNA, 20 nt, Salmonella typhimurium LT2
gcauuugcgcuuucagcgca

SEQ ID NO: 1820981 - RNA, 23 nt, Salmonella typhimurium LT2
gcauugggccgauaaagcgaccg

SEQ ID NO: 1820982 - RNA, 16 nt, Salmonella typhimurium LT2
gcauuucccauccgcc

SEQ ID NO: 1820983 - RNA, 21 nt, Salmonella typhimurium LT2
gcauucgcggcaagcggugua

SEQ ID NO: 1820984 - RNA, 13 nt, Salmonella typhimurium LT2
gcauugcagcgca

SEQ ID NO: 1820985 - RNA, 13 nt, Salmonella typhimurium LT2
gcauugccggaaa

SEQ ID NO: 1820986 - RNA, 22 nt, Salmonella typhimurium LT2
gccaacggcccaaucaacgcau

SEQ ID NO: 1820987 - RNA, 12 nt, Salmonella typhimurium LT2
gccaacgcguuu

SEQ ID NO: 1820988 - RNA, 17 nt, Salmonella typhimurium LT2
gccaauauagccgaugg

SEQ ID NO: 1820989 - RNA, 15 nt, Salmonella typhimurium LT2
gccacaaucugauaa

SEQ ID NO: 1820990 - RNA, 17 nt, Salmonella typhimurium LT2
gcauggcgucggcgacu

SEQ ID NO: 1820991 - RNA, 13 nt, Salmonella typhimurium LT2
gcauuaauaucca

SEQ ID NO: 1820992 - RNA, 23 nt, Salmonella typhimurium LT2
gcauguuucuccugccagcgacg

SEQ ID NO: 1820993 - RNA, 14 nt, Salmonella typhimurium LT2
gcaugcaaacgucc

SEQ ID NO: 1820994 - RNA, 13 nt, Salmonella typhimurium LT2
gcaugauggcgaa

SEQ ID NO: 1820995 - RNA, 21 nt, Salmonella typhimurium LT2
gcaugauggcgaacagcccca

SEQ ID NO: 1820996 - RNA, 22 nt, Salmonella typhimurium LT2
gcaugaugggcgcacagcgcca

SEQ ID NO: 1820997 - RNA, 16 nt, Salmonella typhimurium LT2
gcaugauggucgccag

SEQ ID NO: 1820998 - RNA, 22 nt, Salmonella typhimurium LT2
gcaugauggucgccagcgucuu

SEQ ID NO: 1820999 - RNA, 13 nt, Salmonella typhimurium LT2
gcaugauaccgau

SEQ ID NO: 1821000 - RNA, 22 nt, Salmonella typhimurium LT2
gcaugauaucgagugaaccgga

SEQ ID NO: 1821001 - RNA, 16 nt, Salmonella typhimurium LT2
gcaugacgcaggcgca

SEQ ID NO: 1821002 - RNA, 18 nt, Salmonella typhimurium LT2
gcaugacaucagaagugc

SEQ ID NO: 1821003 - RNA, 15 nt, Salmonella typhimurium LT2
gcaucugcgcguagc

SEQ ID NO: 1821004 - RNA, 21 nt, Salmonella typhimurium LT2
gcaucugauauaucuucaucg

SEQ ID NO: 1821005 - RNA, 21 nt, Salmonella typhimurium LT2
gcaugaaaauaugaugcuauc

SEQ ID NO: 1821006 - RNA, 19 nt, Salmonella typhimurium LT2
gcaucuuuccggaacgcgu

SEQ ID NO: 1821007 - RNA, 21 nt, Salmonella typhimurium LT2
gcaucuuuccggaacgcguuu

SEQ ID NO: 1821008 - RNA, 12 nt, Salmonella typhimurium LT2
gcaguucaucca

SEQ ID NO: 1821009 - RNA, 22 nt, Salmonella typhimurium LT2
gcaguugaucguaaagcgcauc

SEQ ID NO: 1821010 - RNA, 14 nt, Salmonella typhimurium LT2
gcaguugaucguaa

SEQ ID NO: 1821011 - RNA, 14 nt, Salmonella typhimurium LT2
gcaguugcgcgucu

SEQ ID NO: 1821012 - RNA, 16 nt, Salmonella typhimurium LT2
gcauaaacgcggccau

SEQ ID NO: 1821013 - RNA, 18 nt, Salmonella typhimurium LT2
gcaguuuacgcagcgccu

SEQ ID NO: 1821014 - RNA, 15 nt, Salmonella typhimurium LT2
gcauaaaugcgauga

SEQ ID NO: 1821015 - RNA, 13 nt, Salmonella typhimurium LT2
gcaguucagcagc

SEQ ID NO: 1821016 - RNA, 15 nt, Salmonella typhimurium LT2
gcaguggcucaguca

SEQ ID NO: 1821017 - RNA, 22 nt, Salmonella typhimurium LT2
gcauacucuccuccauaccuuu

SEQ ID NO: 1821018 - RNA, 14 nt, Salmonella typhimurium LT2
gcauagcgccauca

SEQ ID NO: 1821019 - RNA, 15 nt, Salmonella typhimurium LT2
gcauauccagcgccu

SEQ ID NO: 1821020 - RNA, 20 nt, Salmonella typhimurium LT2
gcauaucccacugcacgcca

SEQ ID NO: 1821021 - RNA, 14 nt, Salmonella typhimurium LT2
gcauaucuggcgag

SEQ ID NO: 1821022 - RNA, 22 nt, Salmonella typhimurium LT2
gcaucaaacucgcccagcgccu

SEQ ID NO: 1821023 - RNA, 13 nt, Salmonella typhimurium LT2
gcaucaacgccag

SEQ ID NO: 1821024 - RNA, 16 nt, Salmonella typhimurium LT2
gcauaugcacagcgcu

SEQ ID NO: 1821025 - RNA, 13 nt, Salmonella typhimurium LT2
gcaucacaggcuu

SEQ ID NO: 1821026 - RNA, 15 nt, Salmonella typhimurium LT2
gcaucaggaaauccu

SEQ ID NO: 1821027 - RNA, 17 nt, Salmonella typhimurium LT2
gcauccggccagcgaca

SEQ ID NO: 1821028 - RNA, 10 nt, Salmonella typhimurium LT2
gcauccggcu

SEQ ID NO: 1821029 - RNA, 14 nt, Salmonella typhimurium LT2
gcauccuccaucca

SEQ ID NO: 1821030 - RNA, 17 nt, Salmonella typhimurium LT2
gcaucaggaucuucauc

SEQ ID NO: 1821031 - RNA, 20 nt, Salmonella typhimurium LT2
gcaucaucgguguucacaau

SEQ ID NO: 1821032 - RNA, 17 nt, Salmonella typhimurium LT2
gcaucauucugucagca

SEQ ID NO: 1821033 - RNA, 15 nt, Salmonella typhimurium LT2
gcaucauugaagcga

SEQ ID NO: 1821034 - RNA, 16 nt, Salmonella typhimurium LT2
gcaucgguucugcgac

SEQ ID NO: 1821035 - RNA, 19 nt, Salmonella typhimurium LT2
gcaucggucuccagcaaca

SEQ ID NO: 1821036 - RNA, 18 nt, Salmonella typhimurium LT2
gcaucgggccguccggca

SEQ ID NO: 1821037 - RNA, 14 nt, Salmonella typhimurium LT2
gcaucuccagcgca

SEQ ID NO: 1821038 - RNA, 21 nt, Salmonella typhimurium LT2
gcaucucuucguucaggcgua

SEQ ID NO: 1821039 - RNA, 14 nt, Salmonella typhimurium LT2
gcaucguuugcucg

SEQ ID NO: 1821040 - RNA, 14 nt, Salmonella typhimurium LT2
gcaucgugccggaa

SEQ ID NO: 1821041 - RNA, 16 nt, Salmonella typhimurium LT2
gcaucgcccugccagu

SEQ ID NO: 1821042 - RNA, 13 nt, Salmonella typhimurium LT2
gcaucgccgggaa

SEQ ID NO: 1821043 - RNA, 15 nt, Salmonella typhimurium LT2
gccagcggcagcgcg

SEQ ID NO: 1821044 - RNA, 17 nt, Salmonella typhimurium LT2
gccagcgcaacgcgcau

SEQ ID NO: 1821045 - RNA, 17 nt, Salmonella typhimurium LT2
gccagcgaucaggcguc

SEQ ID NO: 1821046 - RNA, 12 nt, Salmonella typhimurium LT2
gccagcgcaucc

SEQ ID NO: 1821047 - RNA, 15 nt, Salmonella typhimurium LT2
gccagcgcauccacc

SEQ ID NO: 1821048 - RNA, 22 nt, Salmonella typhimurium LT2
gccagcccgacuaccggcacca

SEQ ID NO: 1821049 - RNA, 19 nt, Salmonella typhimurium LT2
gccagccaaauagcgccag

SEQ ID NO: 1821050 - RNA, 15 nt, Salmonella typhimurium LT2
gccagccccagcccu

SEQ ID NO: 1821051 - RNA, 22 nt, Salmonella typhimurium LT2
gccagccauugcccggccuccg

SEQ ID NO: 1821052 - RNA, 15 nt, Salmonella typhimurium LT2
gccagauaaucgccg

SEQ ID NO: 1821053 - RNA, 13 nt, Salmonella typhimurium LT2
gccagauccggcg

SEQ ID NO: 1821054 - RNA, 17 nt, Salmonella typhimurium LT2
gccagaucgugccagau

SEQ ID NO: 1821055 - RNA, 18 nt, Salmonella typhimurium LT2
gccacaucguuacccauc

SEQ ID NO: 1821056 - RNA, 17 nt, Salmonella typhimurium LT2
gccacggccagcagcca

SEQ ID NO: 1821057 - RNA, 12 nt, Salmonella typhimurium LT2
gccacgccaucg

SEQ ID NO: 1821058 - RNA, 19 nt, Salmonella typhimurium LT2
gccacgagccuucuggcca

SEQ ID NO: 1821059 - RNA, 19 nt, Salmonella typhimurium LT2
gccacgaguggcgcggaaa

SEQ ID NO: 1821060 - RNA, 16 nt, Salmonella typhimurium LT2
gccagacccagcgcua

SEQ ID NO: 1821061 - RNA, 14 nt, Salmonella typhimurium LT2
gccagaauuuccgc

SEQ ID NO: 1821062 - RNA, 16 nt, Salmonella typhimurium LT2
gccagaggcggcgcca

SEQ ID NO: 1821063 - RNA, 14 nt, Salmonella typhimurium LT2
gccagauaaagcag

SEQ ID NO: 1821064 - RNA, 20 nt, Salmonella typhimurium LT2
gccagauaaagcagcgacaa

SEQ ID NO: 1821065 - RNA, 22 nt, Salmonella typhimurium LT2
gccacucuuccacuucaaucaa

SEQ ID NO: 1821066 - RNA, 13 nt, Salmonella typhimurium LT2
gccacugcgccau

SEQ ID NO: 1821067 - RNA, 16 nt, Salmonella typhimurium LT2
gccacugcgccauuaa

SEQ ID NO: 1821068 - RNA, 18 nt, Salmonella typhimurium LT2
gccauaacgccggcgcuu

SEQ ID NO: 1821069 - RNA, 16 nt, Salmonella typhimurium LT2
gccauaauggcccagc

SEQ ID NO: 1821070 - RNA, 15 nt, Salmonella typhimurium LT2
gccaguuuccugacc

SEQ ID NO: 1821071 - RNA, 12 nt, Salmonella typhimurium LT2
gccauaucgccg

SEQ ID NO: 1821072 - RNA, 14 nt, Salmonella typhimurium LT2
gccauagccggcga

SEQ ID NO: 1821073 - RNA, 18 nt, Salmonella typhimurium LT2
gccauaggucagcgcuuc

SEQ ID NO: 1821074 - RNA, 19 nt, Salmonella typhimurium LT2
gccauaccggcgcgcgcca

SEQ ID NO: 1821075 - RNA, 20 nt, Salmonella typhimurium LT2
gccauacuuuuccagcgccu

SEQ ID NO: 1821076 - RNA, 18 nt, Salmonella typhimurium LT2
gccauacccgauaucgcu

SEQ ID NO: 1821077 - RNA, 17 nt, Salmonella typhimurium LT2
gccaucaacagcaggca

SEQ ID NO: 1821078 - RNA, 17 nt, Salmonella typhimurium LT2
gccaucaggcacaaugc

SEQ ID NO: 1821079 - RNA, 16 nt, Salmonella typhimurium LT2
gccaucaggcaugacc

SEQ ID NO: 1821080 - RNA, 13 nt, Salmonella typhimurium LT2
gccaucagcgcga

SEQ ID NO: 1821081 - RNA, 13 nt, Salmonella typhimurium LT2
gccaucaggccua

SEQ ID NO: 1821082 - RNA, 18 nt, Salmonella typhimurium LT2
gccaucaauuuugcgccu

SEQ ID NO: 1821083 - RNA, 15 nt, Salmonella typhimurium LT2
gccauccauugcgcc

SEQ ID NO: 1821084 - RNA, 22 nt, Salmonella typhimurium LT2
gccaucccaugcaccagcccca

SEQ ID NO: 1821085 - RNA, 22 nt, Salmonella typhimurium LT2
gccaucccggcgacagcgacca

SEQ ID NO: 1821086 - RNA, 15 nt, Salmonella typhimurium LT2
gccaucauuaccaac

SEQ ID NO: 1821087 - RNA, 19 nt, Salmonella typhimurium LT2
gccaucaugcagccggcga

SEQ ID NO: 1821088 - RNA, 16 nt, Salmonella typhimurium LT2
gccaucaugcaggccg

SEQ ID NO: 1821089 - RNA, 16 nt, Salmonella typhimurium LT2
gccaucuuccagcauc

SEQ ID NO: 1821090 - RNA, 15 nt, Salmonella typhimurium LT2
gccaucucauucgcc

SEQ ID NO: 1821091 - RNA, 14 nt, Salmonella typhimurium LT2
gccaucgccgccau

SEQ ID NO: 1821092 - RNA, 16 nt, Salmonella typhimurium LT2
gccaucgcgcacuucg

SEQ ID NO: 1821093 - RNA, 12 nt, Salmonella typhimurium LT2
gccauccggcac

SEQ ID NO: 1821094 - RNA, 23 nt, Salmonella typhimurium LT2
gccauccggcacgccaucgccug

SEQ ID NO: 1821095 - RNA, 13 nt, Salmonella typhimurium LT2
gccauccggcaga

SEQ ID NO: 1821096 - RNA, 11 nt, Salmonella typhimurium LT2
gccauccggca

SEQ ID NO: 1821097 - RNA, 14 nt, Salmonella typhimurium LT2
gccaguggggcugc

SEQ ID NO: 1821098 - RNA, 20 nt, Salmonella typhimurium LT2
gccagugcauagcagcgccc

SEQ ID NO: 1821099 - RNA, 21 nt, Salmonella typhimurium LT2
gccaggguucaaccugauauu

SEQ ID NO: 1821100 - RNA, 18 nt, Salmonella typhimurium LT2
gccaggcggcaauauccu

SEQ ID NO: 1821101 - RNA, 21 nt, Salmonella typhimurium LT2
gccgcaacacggugcggcauu

SEQ ID NO: 1821102 - RNA, 22 nt, Salmonella typhimurium LT2
gccgcaaacgccugcuccgucc

SEQ ID NO: 1821103 - RNA, 19 nt, Salmonella typhimurium LT2
gccgauuuaccucucacca

SEQ ID NO: 1821104 - RNA, 21 nt, Salmonella typhimurium LT2
gccgauuuucuaugugcgcca

SEQ ID NO: 1821105 - RNA, 22 nt, Salmonella typhimurium LT2
gccgauuuucuaugugcgccag

SEQ ID NO: 1821106 - RNA, 19 nt, Salmonella typhimurium LT2
gccgccaacgccggcaaca

SEQ ID NO: 1821107 - RNA, 21 nt, Salmonella typhimurium LT2
gccgccagcgugacccagaca

SEQ ID NO: 1821108 - RNA, 13 nt, Salmonella typhimurium LT2
gccgccaacgcca

SEQ ID NO: 1821109 - RNA, 19 nt, Salmonella typhimurium LT2
gccgccaaaaauaucgccg

SEQ ID NO: 1821110 - RNA, 22 nt, Salmonella typhimurium LT2
gccgcagccuaguucugcgcca

SEQ ID NO: 1821111 - RNA, 15 nt, Salmonella typhimurium LT2
gccgcccaucaauac

SEQ ID NO: 1821112 - RNA, 15 nt, Salmonella typhimurium LT2
gccgcccagcgaacu

SEQ ID NO: 1821113 - RNA, 17 nt, Salmonella typhimurium LT2
gccgcccccaugccgcc

SEQ ID NO: 1821114 - RNA, 22 nt, Salmonella typhimurium LT2
gccgccaucuccggcagcgaau

SEQ ID NO: 1821115 - RNA, 14 nt, Salmonella typhimurium LT2
gccgccaucgccag

SEQ ID NO: 1821116 - RNA, 16 nt, Salmonella typhimurium LT2
gccgccaucgccagua

SEQ ID NO: 1821117 - RNA, 19 nt, Salmonella typhimurium LT2
gccgccaucuccggcagcg

SEQ ID NO: 1821118 - RNA, 18 nt, Salmonella typhimurium LT2
gccgccaguucaauaucc

SEQ ID NO: 1821119 - RNA, 17 nt, Salmonella typhimurium LT2
gccgccagguuauccag

SEQ ID NO: 1821120 - RNA, 12 nt, Salmonella typhimurium LT2
gccgccgccagg

SEQ ID NO: 1821121 - RNA, 23 nt, Salmonella typhimurium LT2
gccgccgcauuuugcuucacgug

SEQ ID NO: 1821122 - RNA, 17 nt, Salmonella typhimurium LT2
gccgccgacaggauguc

SEQ ID NO: 1821123 - RNA, 18 nt, Salmonella typhimurium LT2
gccgcccggcuuccaucg

SEQ ID NO: 1821124 - RNA, 14 nt, Salmonella typhimurium LT2
gccgagcaucgcuu

SEQ ID NO: 1821125 - RNA, 19 nt, Salmonella typhimurium LT2
gccgauauggccguuuuca

SEQ ID NO: 1821126 - RNA, 13 nt, Salmonella typhimurium LT2
gccgaucaggccg

SEQ ID NO: 1821127 - RNA, 14 nt, Salmonella typhimurium LT2
gccgaucagcgcca

SEQ ID NO: 1821128 - RNA, 16 nt, Salmonella typhimurium LT2
gccgauaaucgcgucu

SEQ ID NO: 1821129 - RNA, 15 nt, Salmonella typhimurium LT2
gccgauaaucgcguc

SEQ ID NO: 1821130 - RNA, 21 nt, Salmonella typhimurium LT2
aagaucccagggcggcgucgc

SEQ ID NO: 1821131 - RNA, 23 nt, Salmonella typhimurium LT2
gccgacgauuugcgcucgcgcca

SEQ ID NO: 1821132 - RNA, 21 nt, Salmonella typhimurium LT2
gccgacaaaugacgucagcaa

SEQ ID NO: 1821133 - RNA, 16 nt, Salmonella typhimurium LT2
gccgacaaauccuccg

SEQ ID NO: 1821134 - RNA, 18 nt, Salmonella typhimurium LT2
gcccuccagcuccgcgua

SEQ ID NO: 1821135 - RNA, 12 nt, Salmonella typhimurium LT2
gccgaaagcgau

SEQ ID NO: 1821136 - RNA, 15 nt, Salmonella typhimurium LT2
gcccguccgucagga

SEQ ID NO: 1821137 - RNA, 21 nt, Salmonella typhimurium LT2
gcccgucaccauuaacaucag

SEQ ID NO: 1821138 - RNA, 17 nt, Salmonella typhimurium LT2
gcccgucgcgaucacag

SEQ ID NO: 1821139 - RNA, 24 nt, Salmonella typhimurium LT2
gcccgugaucggagaaauagacga

SEQ ID NO: 1821140 - RNA, 16 nt, Salmonella typhimurium LT2
gcccguuaugccaucu

SEQ ID NO: 1821141 - RNA, 17 nt, Salmonella typhimurium LT2
gcccguugccuggcgac

SEQ ID NO: 1821142 - RNA, 14 nt, Salmonella typhimurium LT2
gcccguucucgccg

SEQ ID NO: 1821143 - RNA, 20 nt, Salmonella typhimurium LT2
gcccucaacauugccggcau

SEQ ID NO: 1821144 - RNA, 19 nt, Salmonella typhimurium LT2
gcccgguggcgccgcgcca

SEQ ID NO: 1821145 - RNA, 16 nt, Salmonella typhimurium LT2
gcccgguaagcacaac

SEQ ID NO: 1821146 - RNA, 19 nt, Salmonella typhimurium LT2
gcccgguaauuuugauaua

SEQ ID NO: 1821147 - RNA, 21 nt, Salmonella typhimurium LT2
gcccggauaacggcgcgaaag

SEQ ID NO: 1821148 - RNA, 14 nt, Salmonella typhimurium LT2
gcccggaucgccau

SEQ ID NO: 1821149 - RNA, 20 nt, Salmonella typhimurium LT2
gcccggaaauaaacgccagu

SEQ ID NO: 1821150 - RNA, 13 nt, Salmonella typhimurium LT2
gcccgcugcgcac

SEQ ID NO: 1821151 - RNA, 22 nt, Salmonella typhimurium LT2
gcccaggcuuuaguuuccggua

SEQ ID NO: 1821152 - RNA, 21 nt, Salmonella typhimurium LT2
gcccagggaaagaucaaacag

SEQ ID NO: 1821153 - RNA, 14 nt, Salmonella typhimurium LT2
gccccaaaauucac

SEQ ID NO: 1821154 - RNA, 14 nt, Salmonella typhimurium LT2
gccccaaucgccag

SEQ ID NO: 1821155 - RNA, 22 nt, Salmonella typhimurium LT2
aagacggcagcgccauccggca

SEQ ID NO: 1821156 - RNA, 13 nt, Salmonella typhimurium LT2
aagacguuucaga

SEQ ID NO: 1821157 - RNA, 21 nt, Salmonella typhimurium LT2
aagagccgcgcagcgcaacgc

SEQ ID NO: 1821158 - RNA, 19 nt, Salmonella typhimurium LT2
aagagcgagucuuuguccg

SEQ ID NO: 1821159 - RNA, 13 nt, Salmonella typhimurium LT2
gcccgccgccaau

SEQ ID NO: 1821160 - RNA, 15 nt, Salmonella typhimurium LT2
gcccgccgccaccau

SEQ ID NO: 1821161 - RNA, 16 nt, Salmonella typhimurium LT2
gcccgccagcacagca

SEQ ID NO: 1821162 - RNA, 14 nt, Salmonella typhimurium LT2
gcccgccagcacag

SEQ ID NO: 1821163 - RNA, 20 nt, Salmonella typhimurium LT2
gccccuucaucagccagcau

SEQ ID NO: 1821164 - RNA, 22 nt, Salmonella typhimurium LT2
aagagguauccugaaccagcgg

SEQ ID NO: 1821165 - RNA, 13 nt, Salmonella typhimurium LT2
gcccgacgcgcca

SEQ ID NO: 1821166 - RNA, 23 nt, Salmonella typhimurium LT2
gcccgacuaccggcaccagcaau

SEQ ID NO: 1821167 - RNA, 21 nt, Salmonella typhimurium LT2
gcccgaccacgcccagcuauu

SEQ ID NO: 1821168 - RNA, 11 nt, Salmonella typhimurium LT2
gcccgaaucgc

SEQ ID NO: 1821169 - RNA, 13 nt, Salmonella typhimurium LT2
gcccgaaucgccg

SEQ ID NO: 1821170 - RNA, 13 nt, Salmonella typhimurium LT2
gagcaacuggcaa

SEQ ID NO: 1821171 - RNA, 12 nt, Salmonella typhimurium LT2
gagcaauuuccu

SEQ ID NO: 1821172 - RNA, 17 nt, Salmonella typhimurium LT2
gagaucuuccgccacca

SEQ ID NO: 1821173 - RNA, 13 nt, Salmonella typhimurium LT2
gagaugcaggcca

SEQ ID NO: 1821174 - RNA, 21 nt, Salmonella typhimurium LT2
gagaucuuuccauuucagccc

SEQ ID NO: 1821175 - RNA, 19 nt, Salmonella typhimurium LT2
gagauuaacagcgcgacca

SEQ ID NO: 1821176 - RNA, 23 nt, Salmonella typhimurium LT2
gagauuaacagcgcgaccagcgu

SEQ ID NO: 1821177 - RNA, 16 nt, Salmonella typhimurium LT2
gagauugauaaucagc

SEQ ID NO: 1821178 - RNA, 13 nt, Salmonella typhimurium LT2
gagacugccgccg

SEQ ID NO: 1821179 - RNA, 21 nt, Salmonella typhimurium LT2
gagaaucgaucagcuuaaagg

SEQ ID NO: 1821180 - RNA, 20 nt, Salmonella typhimurium LT2
gagacuguuugacacuauau

SEQ ID NO: 1821181 - RNA, 23 nt, Salmonella typhimurium LT2
gagagcgauaaacucagcgccag

SEQ ID NO: 1821182 - RNA, 16 nt, Salmonella typhimurium LT2
gagaguaugcccgcga

SEQ ID NO: 1821183 - RNA, 18 nt, Salmonella typhimurium LT2
gagauaucccaucgacuu

SEQ ID NO: 1821184 - RNA, 13 nt, Salmonella typhimurium LT2
aacuccuccggcg

SEQ ID NO: 1821185 - RNA, 14 nt, Salmonella typhimurium LT2
aacuccaccugauc

SEQ ID NO: 1821186 - RNA, 12 nt, Salmonella typhimurium LT2
aacucagcaaua

SEQ ID NO: 1821187 - RNA, 22 nt, Salmonella typhimurium LT2
gagcgccgcgccuaccagcgcu

SEQ ID NO: 1821188 - RNA, 19 nt, Salmonella typhimurium LT2
gagcgccuuaucgacggcg

SEQ ID NO: 1821189 - RNA, 20 nt, Salmonella typhimurium LT2
gagcgcaaaacgcugcuauu

SEQ ID NO: 1821190 - RNA, 23 nt, Salmonella typhimurium LT2
gagcccuaucaccauaaucgcga

SEQ ID NO: 1821191 - RNA, 17 nt, Salmonella typhimurium LT2
gagcccuccuccagcgc

SEQ ID NO: 1821192 - RNA, 23 nt, Salmonella typhimurium LT2
gagcccggauccaguuccaggac

SEQ ID NO: 1821193 - RNA, 18 nt, Salmonella typhimurium LT2
gacuacuuaccggcgcca

SEQ ID NO: 1821194 - RNA, 18 nt, Salmonella typhimurium LT2
gacguuuggcuuauccgc

SEQ ID NO: 1821195 - RNA, 15 nt, Salmonella typhimurium LT2
gacguuuuccucguu

SEQ ID NO: 1821196 - RNA, 18 nt, Salmonella typhimurium LT2
gacuaaccuugauucccu

SEQ ID NO: 1821197 - RNA, 16 nt, Salmonella typhimurium LT2
gacuacauacgcgcau

SEQ ID NO: 1821198 - RNA, 15 nt, Salmonella typhimurium LT2
gacgugggcuacggc

SEQ ID NO: 1821199 - RNA, 21 nt, Salmonella typhimurium LT2
gacguuaacgcagcaucgcca

SEQ ID NO: 1821200 - RNA, 18 nt, Salmonella typhimurium LT2
gacguuacaucuccuggu

SEQ ID NO: 1821201 - RNA, 15 nt, Salmonella typhimurium LT2
gacguuccgcgacaa

SEQ ID NO: 1821202 - RNA, 20 nt, Salmonella typhimurium LT2
gacgaccagggaacucacgc

SEQ ID NO: 1821203 - RNA, 19 nt, Salmonella typhimurium LT2
gacguagggcugccaucag

SEQ ID NO: 1821204 - RNA, 14 nt, Salmonella typhimurium LT2
gacgucugucagaa

SEQ ID NO: 1821205 - RNA, 16 nt, Salmonella typhimurium LT2
gacugaaaaaagcgau

SEQ ID NO: 1821206 - RNA, 13 nt, Salmonella typhimurium LT2
gacucugaagcgg

SEQ ID NO: 1821207 - RNA, 14 nt, Salmonella typhimurium LT2
gacuguccacgaca

SEQ ID NO: 1821208 - RNA, 20 nt, Salmonella typhimurium LT2
gacuguccacgacgcuauau

SEQ ID NO: 1821209 - RNA, 13 nt, Salmonella typhimurium LT2
gacugcguuaucg

SEQ ID NO: 1821210 - RNA, 17 nt, Salmonella typhimurium LT2
gacuucgcuuccugcau

SEQ ID NO: 1821211 - RNA, 21 nt, Salmonella typhimurium LT2
gacuucuuagguuuguagcgc

SEQ ID NO: 1821212 - RNA, 20 nt, Salmonella typhimurium LT2
gacuuuuuucaaauccagcu

SEQ ID NO: 1821213 - RNA, 16 nt, Salmonella typhimurium LT2
gagaaaaccccguaca

SEQ ID NO: 1821214 - RNA, 17 nt, Salmonella typhimurium LT2
gagaacugcugcauccg

SEQ ID NO: 1821215 - RNA, 13 nt, Salmonella typhimurium LT2
aacuaccgggcau

SEQ ID NO: 1821216 - RNA, 16 nt, Salmonella typhimurium LT2
aacuacuggcugguuu

SEQ ID NO: 1821217 - RNA, 17 nt, Salmonella typhimurium LT2
aacguuuguaacagcag

SEQ ID NO: 1821218 - RNA, 17 nt, Salmonella typhimurium LT2
aacguguuuauccccgc

SEQ ID NO: 1821219 - RNA, 23 nt, Salmonella typhimurium LT2
gacuuacgcacuguuggcguuga

SEQ ID NO: 1821220 - RNA, 13 nt, Salmonella typhimurium LT2
gacuuaucaggcc

SEQ ID NO: 1821221 - RNA, 17 nt, Salmonella typhimurium LT2
gacuuaucaggccuacg

SEQ ID NO: 1821222 - RNA, 16 nt, Salmonella typhimurium LT2
gaggauggcgcggcaa

SEQ ID NO: 1821223 - RNA, 20 nt, Salmonella typhimurium LT2
gaggcaaaaugccagcccga

SEQ ID NO: 1821224 - RNA, 15 nt, Salmonella typhimurium LT2
gaggauuuucgcguc

SEQ ID NO: 1821225 - RNA, 15 nt, Salmonella typhimurium LT2
gaggcgcccaacgcu

SEQ ID NO: 1821226 - RNA, 12 nt, Salmonella typhimurium LT2
gaguuccggaua

SEQ ID NO: 1821227 - RNA, 13 nt, Salmonella typhimurium LT2
gaguuccggauac

SEQ ID NO: 1821228 - RNA, 22 nt, Salmonella typhimurium LT2
gaguucaacgccgaacaggcca

SEQ ID NO: 1821229 - RNA, 15 nt, Salmonella typhimurium LT2
gagugcucaauaagc

SEQ ID NO: 1821230 - RNA, 21 nt, Salmonella typhimurium LT2
gagugauccaccaccagcauc

SEQ ID NO: 1821231 - RNA, 12 nt, Salmonella typhimurium LT2
gaguccagccau

SEQ ID NO: 1821232 - RNA, 13 nt, Salmonella typhimurium LT2
gauaacguccggc

SEQ ID NO: 1821233 - RNA, 17 nt, Salmonella typhimurium LT2
gauaagaccgguacgca

SEQ ID NO: 1821234 - RNA, 15 nt, Salmonella typhimurium LT2
gauaaaaucgccaaa

SEQ ID NO: 1821235 - RNA, 15 nt, Salmonella typhimurium LT2
gauaaacagcagcgc

SEQ ID NO: 1821236 - RNA, 15 nt, Salmonella typhimurium LT2
gauaaacucaaucag

SEQ ID NO: 1821237 - RNA, 16 nt, Salmonella typhimurium LT2
gauaaagagcaggcca

SEQ ID NO: 1821238 - RNA, 17 nt, Salmonella typhimurium LT2
gaguucgccaugagcgu

SEQ ID NO: 1821239 - RNA, 14 nt, Salmonella typhimurium LT2
gaguuucaccgcca

SEQ ID NO: 1821240 - RNA, 22 nt, Salmonella typhimurium LT2
gauaccgccuuaccgcgguauu

SEQ ID NO: 1821241 - RNA, 22 nt, Salmonella typhimurium LT2
gauaauuuucccaguucaucca

SEQ ID NO: 1821242 - RNA, 21 nt, Salmonella typhimurium LT2
gauaagcauuagcgccauccg

SEQ ID NO: 1821243 - RNA, 17 nt, Salmonella typhimurium LT2
gauaagcgaagcgccau

SEQ ID NO: 1821244 - RNA, 20 nt, Salmonella typhimurium LT2
gauaagcgaagcgccaucag

SEQ ID NO: 1821245 - RNA, 15 nt, Salmonella typhimurium LT2
gauaagauaggagac

SEQ ID NO: 1821246 - RNA, 20 nt, Salmonella typhimurium LT2
gauaagcaaagcgccauccg

SEQ ID NO: 1821247 - RNA, 20 nt, Salmonella typhimurium LT2
gauaagcauagcgccaucag

SEQ ID NO: 1821248 - RNA, 12 nt, Salmonella typhimurium LT2
gauaagcaguga

SEQ ID NO: 1821249 - RNA, 16 nt, Salmonella typhimurium LT2
gauaagcaagcgccau

SEQ ID NO: 1821250 - RNA, 15 nt, Salmonella typhimurium LT2
gauaauacguacgga

SEQ ID NO: 1821251 - RNA, 18 nt, Salmonella typhimurium LT2
gauaauauccgacgccug

SEQ ID NO: 1821252 - RNA, 14 nt, Salmonella typhimurium LT2
gauaauagcugcgg

SEQ ID NO: 1821253 - RNA, 21 nt, Salmonella typhimurium LT2
gauaaucagcaagaugaccca

SEQ ID NO: 1821254 - RNA, 15 nt, Salmonella typhimurium LT2
gauaaucagcagcga

SEQ ID NO: 1821255 - RNA, 23 nt, Salmonella typhimurium LT2
gauaaucagcagcgacguaauga

SEQ ID NO: 1821256 - RNA, 23 nt, Salmonella typhimurium LT2
gauaucuuccagcgcguccagcc

SEQ ID NO: 1821257 - RNA, 23 nt, Salmonella typhimurium LT2
gauaugacccgggcgugacaggg

SEQ ID NO: 1821258 - RNA, 22 nt, Salmonella typhimurium LT2
gauaucuuccagcgcguccagc

SEQ ID NO: 1821259 - RNA, 21 nt, Salmonella typhimurium LT2
gauagagcgcggucagguuca

SEQ ID NO: 1821260 - RNA, 15 nt, Salmonella typhimurium LT2
gauagagacugccgc

SEQ ID NO: 1821261 - RNA, 18 nt, Salmonella typhimurium LT2
gauaguguaaacgcgcca

SEQ ID NO: 1821262 - RNA, 17 nt, Salmonella typhimurium LT2
gauaucgcacuggauca

SEQ ID NO: 1821263 - RNA, 18 nt, Salmonella typhimurium LT2
gauagugauauagcgcca

SEQ ID NO: 1821264 - RNA, 20 nt, Salmonella typhimurium LT2
gaucgcggcaaccguaucca

SEQ ID NO: 1821265 - RNA, 21 nt, Salmonella typhimurium LT2
gaucgcuuaacaacuccagca

SEQ ID NO: 1821266 - RNA, 23 nt, Salmonella typhimurium LT2
gaucgcgugcauuaaaauaaugc

SEQ ID NO: 1821267 - RNA, 22 nt, Salmonella typhimurium LT2
gaucggcaaaagugugauaagc

SEQ ID NO: 1821268 - RNA, 18 nt, Salmonella typhimurium LT2
gaucggaagacuggcgca

SEQ ID NO: 1821269 - RNA, 21 nt, Salmonella typhimurium LT2
gaucggcggcccacucaucca

SEQ ID NO: 1821270 - RNA, 15 nt, Salmonella typhimurium LT2
gaucgugccguccgg

SEQ ID NO: 1821271 - RNA, 24 nt, Salmonella typhimurium LT2
gaucgugccaugaccauucgcacu

SEQ ID NO: 1821272 - RNA, 18 nt, Salmonella typhimurium LT2
gaucgucggucgcguagc

SEQ ID NO: 1821273 - RNA, 15 nt, Salmonella typhimurium LT2
gaucucacaagauuc

SEQ ID NO: 1821274 - RNA, 18 nt, Salmonella typhimurium LT2
gaucuaacgaaaccggcg

SEQ ID NO: 1821275 - RNA, 13 nt, Salmonella typhimurium LT2
gaucguccaucga

SEQ ID NO: 1821276 - RNA, 19 nt, Salmonella typhimurium LT2
gaucgggcuuccagcguug

SEQ ID NO: 1821277 - RNA, 20 nt, Salmonella typhimurium LT2
gauccaccaccagcaucacg

SEQ ID NO: 1821278 - RNA, 23 nt, Salmonella typhimurium LT2
gauccacugagcgcgccaugaga

SEQ ID NO: 1821279 - RNA, 13 nt, Salmonella typhimurium LT2
gaucccaggccgg

SEQ ID NO: 1821280 - RNA, 18 nt, Salmonella typhimurium LT2
gaucacgccguccagcac

SEQ ID NO: 1821281 - RNA, 21 nt, Salmonella typhimurium LT2
gaucagaccaucggccgcuau

SEQ ID NO: 1821282 - RNA, 16 nt, Salmonella typhimurium LT2
gaucaggggucagcgu

SEQ ID NO: 1821283 - RNA, 20 nt, Salmonella typhimurium LT2
gaucgagccgucgccggccu

SEQ ID NO: 1821284 - RNA, 18 nt, Salmonella typhimurium LT2
gaucgcauaaauauccgg

SEQ ID NO: 1821285 - RNA, 14 nt, Salmonella typhimurium LT2
gaucgccuggccga

SEQ ID NO: 1821286 - RNA, 17 nt, Salmonella typhimurium LT2
gaucgccauucggauaa

SEQ ID NO: 1821287 - RNA, 22 nt, Salmonella typhimurium LT2
gaucgccaucgacagcagcgcu

SEQ ID NO: 1821288 - RNA, 20 nt, Salmonella typhimurium LT2
gcacgccgcucgaaucgcca

SEQ ID NO: 1821289 - RNA, 14 nt, Salmonella typhimurium LT2
gcacguccuggaaa

SEQ ID NO: 1821290 - RNA, 16 nt, Salmonella typhimurium LT2
gcacgagauccauuac

SEQ ID NO: 1821291 - RNA, 15 nt, Salmonella typhimurium LT2
gcaccgccagcgccg

SEQ ID NO: 1821292 - RNA, 14 nt, Salmonella typhimurium LT2
gcacagaagcgccu

SEQ ID NO: 1821293 - RNA, 17 nt, Salmonella typhimurium LT2
gcacagcagacaaccga

SEQ ID NO: 1821294 - RNA, 16 nt, Salmonella typhimurium LT2
gcaccauaaacggcac

SEQ ID NO: 1821295 - RNA, 14 nt, Salmonella typhimurium LT2
gcagacugccggca

SEQ ID NO: 1821296 - RNA, 22 nt, Salmonella typhimurium LT2
gcagacggcugggcugaacgga

SEQ ID NO: 1821297 - RNA, 18 nt, Salmonella typhimurium LT2
gcacguugucccaggcca

SEQ ID NO: 1821298 - RNA, 15 nt, Salmonella typhimurium LT2
gcacguucugcuggu

SEQ ID NO: 1821299 - RNA, 14 nt, Salmonella typhimurium LT2
gcagcagcggaauc

SEQ ID NO: 1821300 - RNA, 18 nt, Salmonella typhimurium LT2
gcagauccaaauggcgua

SEQ ID NO: 1821301 - RNA, 13 nt, Salmonella typhimurium LT2
gcagccagcgccc

SEQ ID NO: 1821302 - RNA, 21 nt, Salmonella typhimurium LT2
gcagcauugaccaccauauuc

SEQ ID NO: 1821303 - RNA, 17 nt, Salmonella typhimurium LT2
gcagcaucugauagccc

SEQ ID NO: 1821304 - RNA, 17 nt, Salmonella typhimurium LT2
gcagcauaaacaucagc

SEQ ID NO: 1821305 - RNA, 12 nt, Salmonella typhimurium LT2
gcagcaggucga

SEQ ID NO: 1821306 - RNA, 14 nt, Salmonella typhimurium LT2
gcagcauaucgccg

SEQ ID NO: 1821307 - RNA, 23 nt, Salmonella typhimurium LT2
gcagcccuuacgcuuuauucugu

SEQ ID NO: 1821308 - RNA, 11 nt, Salmonella typhimurium LT2
gcagcccugcg

SEQ ID NO: 1821309 - RNA, 17 nt, Salmonella typhimurium LT2
gcagcgccauccacggc

SEQ ID NO: 1821310 - RNA, 18 nt, Salmonella typhimurium LT2
gaugggcgcacagcgcca

SEQ ID NO: 1821311 - RNA, 19 nt, Salmonella typhimurium LT2
gaugguauaaaucacgcug

SEQ ID NO: 1821312 - RNA, 20 nt, Salmonella typhimurium LT2
gauggcgcgacgcuuaucag

SEQ ID NO: 1821313 - RNA, 22 nt, Salmonella typhimurium LT2
gauggcggcugcgccuuauccg

SEQ ID NO: 1821314 - RNA, 12 nt, Salmonella typhimurium LT2
gauggcggcuuu

SEQ ID NO: 1821315 - RNA, 15 nt, Salmonella typhimurium LT2
gaugguggcgucggc

SEQ ID NO: 1821316 - RNA, 13 nt, Salmonella typhimurium LT2
gaugguugccaga

SEQ ID NO: 1821317 - RNA, 19 nt, Salmonella typhimurium LT2
gaugguugugugcguucgg

SEQ ID NO: 1821318 - RNA, 20 nt, Salmonella typhimurium LT2
gaugucccaucguaacgccg

SEQ ID NO: 1821319 - RNA, 14 nt, Salmonella typhimurium LT2
gauguccaggcgac

SEQ ID NO: 1821320 - RNA, 12 nt, Salmonella typhimurium LT2
gauguccgguug

SEQ ID NO: 1821321 - RNA, 17 nt, Salmonella typhimurium LT2
gaugugaauccaggcca

SEQ ID NO: 1821322 - RNA, 22 nt, Salmonella typhimurium LT2
aacuuauccgacgcguuucaca

SEQ ID NO: 1821323 - RNA, 16 nt, Salmonella typhimurium LT2
gaucuggacgccaauu

SEQ ID NO: 1821324 - RNA, 18 nt, Salmonella typhimurium LT2
gauggacaauccgcgaau

SEQ ID NO: 1821325 - RNA, 17 nt, Salmonella typhimurium LT2
gauggacaauccgcgaa

SEQ ID NO: 1821326 - RNA, 21 nt, Salmonella typhimurium LT2
gauggcgacacuugcgcaucg

SEQ ID NO: 1821327 - RNA, 17 nt, Salmonella typhimurium LT2
gauggccgaugaugcgc

SEQ ID NO: 1821328 - RNA, 16 nt, Salmonella typhimurium LT2
gaugcguaccgcgcug

SEQ ID NO: 1821329 - RNA, 19 nt, Salmonella typhimurium LT2
gcaacccgacugccaccac

SEQ ID NO: 1821330 - RNA, 22 nt, Salmonella typhimurium LT2
gcaacaugaaagggaaaccgcu

SEQ ID NO: 1821331 - RNA, 15 nt, Salmonella typhimurium LT2
gcaacaugaccagcg

SEQ ID NO: 1821332 - RNA, 23 nt, Salmonella typhimurium LT2
gcaacaauaaaguuauacagcac

SEQ ID NO: 1821333 - RNA, 13 nt, Salmonella typhimurium LT2
gcaacacaggccg

SEQ ID NO: 1821334 - RNA, 21 nt, Salmonella typhimurium LT2
gcaacacagacuuugcacagu

SEQ ID NO: 1821335 - RNA, 15 nt, Salmonella typhimurium LT2
gcaaaaaauauagcc

SEQ ID NO: 1821336 - RNA, 16 nt, Salmonella typhimurium LT2
gcaaaaaucgucauca

SEQ ID NO: 1821337 - RNA, 21 nt, Salmonella typhimurium LT2
gcaaaacgcguauaacgccgc

SEQ ID NO: 1821338 - RNA, 22 nt, Salmonella typhimurium LT2
gcaaaauauauaauuuauagcc

SEQ ID NO: 1821339 - RNA, 21 nt, Salmonella typhimurium LT2
gcaaaaugcucauuauggacg

SEQ ID NO: 1821340 - RNA, 19 nt, Salmonella typhimurium LT2
gcaaacccaucucaggccg

SEQ ID NO: 1821341 - RNA, 18 nt, Salmonella typhimurium LT2
gcaaacagcacuacagcc

SEQ ID NO: 1821342 - RNA, 22 nt, Salmonella typhimurium LT2
gcaaacacaaucacacccagcg

SEQ ID NO: 1821343 - RNA, 14 nt, Salmonella typhimurium LT2
gcaaagcgccaucc

SEQ ID NO: 1821344 - RNA, 20 nt, Salmonella typhimurium LT2
gcaaagcaucugccggcacg

SEQ ID NO: 1821345 - RNA, 15 nt, Salmonella typhimurium LT2
gauuccagauagcgc

SEQ ID NO: 1821346 - RNA, 23 nt, Salmonella typhimurium LT2
gauuccauuuuugcggauggcgc

SEQ ID NO: 1821347 - RNA, 13 nt, Salmonella typhimurium LT2
gauucgaaccugc

SEQ ID NO: 1821348 - RNA, 15 nt, Salmonella typhimurium LT2
gauuaucgcggauga

SEQ ID NO: 1821349 - RNA, 17 nt, Salmonella typhimurium LT2
gauuauuugaucccguc

SEQ ID NO: 1821350 - RNA, 18 nt, Salmonella typhimurium LT2
gauuauuuuaucaucagc

SEQ ID NO: 1821351 - RNA, 21 nt, Salmonella typhimurium LT2
gauuagcgacagcgcuauccg

SEQ ID NO: 1821352 - RNA, 16 nt, Salmonella typhimurium LT2
gauuacugcgugcugg

SEQ ID NO: 1821353 - RNA, 21 nt, Salmonella typhimurium LT2
gauuagccaggugacuuugcc

SEQ ID NO: 1821354 - RNA, 20 nt, Salmonella typhimurium LT2
gauuacucccuugccagcgc

SEQ ID NO: 1821355 - RNA, 19 nt, Salmonella typhimurium LT2
gauuucuucuggcugcuga

SEQ ID NO: 1821356 - RNA, 17 nt, Salmonella typhimurium LT2
gauuugcgcucgcgcca

SEQ ID NO: 1821357 - RNA, 22 nt, Salmonella typhimurium LT2
gauugaccgugccggauggcgg

SEQ ID NO: 1821358 - RNA, 19 nt, Salmonella typhimurium LT2
gcaauggacaaguaaaccg

SEQ ID NO: 1821359 - RNA, 17 nt, Salmonella typhimurium LT2
gcaaugccugaccaacg

SEQ ID NO: 1821360 - RNA, 22 nt, Salmonella typhimurium LT2
gcaaugcgcuccagcuucauca

SEQ ID NO: 1821361 - RNA, 20 nt, Salmonella typhimurium LT2
gcaauggccgcagcgccaua

SEQ ID NO: 1821362 - RNA, 18 nt, Salmonella typhimurium LT2
gcaauggccgcagcgcca

SEQ ID NO: 1821363 - RNA, 14 nt, Salmonella typhimurium LT2
gcaaugaaaccgcc

SEQ ID NO: 1821364 - RNA, 18 nt, Salmonella typhimurium LT2
gcaaugauaacggcgcca

SEQ ID NO: 1821365 - RNA, 14 nt, Salmonella typhimurium LT2
gcaaugauauagcc

SEQ ID NO: 1821366 - RNA, 15 nt, Salmonella typhimurium LT2
gcaaugauaucggcc

SEQ ID NO: 1821367 - RNA, 14 nt, Salmonella typhimurium LT2
gcaaugagcggcca

SEQ ID NO: 1821368 - RNA, 14 nt, Salmonella typhimurium LT2
gcacaacacgcuuu

SEQ ID NO: 1821369 - RNA, 14 nt, Salmonella typhimurium LT2
gcacaauaccaaua

SEQ ID NO: 1821370 - RNA, 14 nt, Salmonella typhimurium LT2
gcacaccggccauu

SEQ ID NO: 1821371 - RNA, 21 nt, Salmonella typhimurium LT2
gcaaucaaaugcguggcguau

SEQ ID NO: 1821372 - RNA, 17 nt, Salmonella typhimurium LT2
gcaauauggcugcgaca

SEQ ID NO: 1821373 - RNA, 24 nt, Salmonella typhimurium LT2
gcaauaugucuuaaacagcgauca

SEQ ID NO: 1821374 - RNA, 21 nt, Salmonella typhimurium LT2
gcaauauuaaugucaugcgcc

SEQ ID NO: 1821375 - RNA, 12 nt, Salmonella typhimurium LT2
gcaauaucagcc

SEQ ID NO: 1821376 - RNA, 15 nt, Salmonella typhimurium LT2
gcaauaucagccauu

SEQ ID NO: 1821377 - RNA, 15 nt, Salmonella typhimurium LT2
gcaauacuguaagcc

SEQ ID NO: 1821378 - RNA, 19 nt, Salmonella typhimurium LT2
gcaauauaccgucagcacc

SEQ ID NO: 1821379 - RNA, 14 nt, Salmonella typhimurium LT2
gcaaucgccugcaa

SEQ ID NO: 1821380 - RNA, 16 nt, Salmonella typhimurium LT2
gcaaucgagaucagac

SEQ ID NO: 1821381 - RNA, 21 nt, Salmonella typhimurium LT2
gcaauacagcccgccagcacc

SEQ ID NO: 1821382 - RNA, 23 nt, Salmonella typhimurium LT2
gcaaguucgugagcgaagcgccg

SEQ ID NO: 1821383 - RNA, 15 nt, Salmonella typhimurium LT2
gcaaggccguuaucc

SEQ ID NO: 1821384 - RNA, 20 nt, Salmonella typhimurium LT2
gcaacguuucuuucaucaga

SEQ ID NO: 1821385 - RNA, 23 nt, Salmonella typhimurium LT2
gcaacguuucuuucaucagauca

SEQ ID NO: 1821386 - RNA, 18 nt, Salmonella typhimurium LT2
gcaacggguugcgaacuu

SEQ ID NO: 1821387 - RNA, 15 nt, Salmonella typhimurium LT2
gcaacggccagcgca

SEQ ID NO: 1821388 - RNA, 11 nt, Salmonella typhimurium LT2
gcaacggcgcc

SEQ ID NO: 1821389 - RNA, 23 nt, Salmonella typhimurium LT2
gcaacgggacggcggccagcauu

SEQ ID NO: 1821390 - RNA, 17 nt, Salmonella typhimurium LT2
gcaacgcgcauaccgcu

SEQ ID NO: 1821391 - RNA, 20 nt, Salmonella typhimurium LT2
gcaacgacgucuuucuucgc

SEQ ID NO: 1821392 - RNA, 22 nt, Salmonella typhimurium LT2
gcaagauuccagauagcgcugc

SEQ ID NO: 1821393 - RNA, 14 nt, Salmonella typhimurium LT2
gcaacugaccaucu

SEQ ID NO: 1821394 - RNA, 21 nt, Salmonella typhimurium LT2
gcaagacccgaaccugcgaca

SEQ ID NO: 1821395 - RNA, 13 nt, Salmonella typhimurium LT2
gcaagaaaaguuu

SEQ ID NO: 1821396 - RNA, 20 nt, Salmonella typhimurium LT2
gcaacuguugcgccagcacg

SEQ ID NO: 1821397 - RNA, 19 nt, Salmonella typhimurium LT2
ggcggcaagaucauccggg

SEQ ID NO: 1821398 - RNA, 21 nt, Salmonella typhimurium LT2
ggcggcaauuuguagcugcgc

SEQ ID NO: 1821399 - RNA, 16 nt, Salmonella typhimurium LT2
ggcggccaaucagaua

SEQ ID NO: 1821400 - RNA, 20 nt, Salmonella typhimurium LT2
ggcgcuuugcuuauccggcc

SEQ ID NO: 1821401 - RNA, 14 nt, Salmonella typhimurium LT2
ggcggaaaagcgcc

SEQ ID NO: 1821402 - RNA, 17 nt, Salmonella typhimurium LT2
ggcggaaauucgcgcca

SEQ ID NO: 1821403 - RNA, 19 nt, Salmonella typhimurium LT2
ggcggacaacgcuccagca

SEQ ID NO: 1821404 - RNA, 15 nt, Salmonella typhimurium LT2
ggcggauaaaucauc

SEQ ID NO: 1821405 - RNA, 20 nt, Salmonella typhimurium LT2
ggcggcuacgccuuacccgg

SEQ ID NO: 1821406 - RNA, 13 nt, Salmonella typhimurium LT2
ggcggcuagcgca

SEQ ID NO: 1821407 - RNA, 23 nt, Salmonella typhimurium LT2
ggcggcgugaccgccuuauccgg

SEQ ID NO: 1821408 - RNA, 20 nt, Salmonella typhimurium LT2
ggcggcgugaccgccuuauc

SEQ ID NO: 1821409 - RNA, 13 nt, Salmonella typhimurium LT2
ggcggcguuaacg

SEQ ID NO: 1821410 - RNA, 22 nt, Salmonella typhimurium LT2
ggcggcgcuaacgcgucuuauc

SEQ ID NO: 1821411 - RNA, 21 nt, Salmonella typhimurium LT2
ggcggcgcgcucuacguugac

SEQ ID NO: 1821412 - RNA, 13 nt, Salmonella typhimurium LT2
ggcgguuuauccg

SEQ ID NO: 1821413 - RNA, 15 nt, Salmonella typhimurium LT2
ggcgguucggcugcc

SEQ ID NO: 1821414 - RNA, 15 nt, Salmonella typhimurium LT2
ggcguaagaucccag

SEQ ID NO: 1821415 - RNA, 21 nt, Salmonella typhimurium LT2
ggcguaaccgccauccggcga

SEQ ID NO: 1821416 - RNA, 23 nt, Salmonella typhimurium LT2
ggcguaacggcugacgcccauca

SEQ ID NO: 1821417 - RNA, 17 nt, Salmonella typhimurium LT2
ggcguaaaugugcgcca

SEQ ID NO: 1821418 - RNA, 18 nt, Salmonella typhimurium LT2
ggcguaauuaaccgcgcc

SEQ ID NO: 1821419 - RNA, 14 nt, Salmonella typhimurium LT2
ggcguacgggcaaa

SEQ ID NO: 1821420 - RNA, 14 nt, Salmonella typhimurium LT2
ggcguagucagcga

SEQ ID NO: 1821421 - RNA, 13 nt, Salmonella typhimurium LT2
ggcguauagccag

SEQ ID NO: 1821422 - RNA, 21 nt, Salmonella typhimurium LT2
ggcguauagccaggcagaucc

SEQ ID NO: 1821423 - RNA, 13 nt, Salmonella typhimurium LT2
ggcguauagcgcu

SEQ ID NO: 1821424 - RNA, 18 nt, Salmonella typhimurium LT2
ggcgguacuccgccaucc

SEQ ID NO: 1821425 - RNA, 23 nt, Salmonella typhimurium LT2
ggcgguauaacugccuuauccgg

SEQ ID NO: 1821426 - RNA, 23 nt, Salmonella typhimurium LT2
ggcgguaaaaccuaacgccugca

SEQ ID NO: 1821427 - RNA, 22 nt, Salmonella typhimurium LT2
ggcgguacagcgagcuauccgg

SEQ ID NO: 1821428 - RNA, 16 nt, Salmonella typhimurium LT2
ggcgguaccggcauua

SEQ ID NO: 1821429 - RNA, 16 nt, Salmonella typhimurium LT2
ggcggguauggcgcca

SEQ ID NO: 1821430 - RNA, 18 nt, Salmonella typhimurium LT2
ggcggguaauuugcgcca

SEQ ID NO: 1821431 - RNA, 20 nt, Salmonella typhimurium LT2
ggcgggguucgggcagcgcu

SEQ ID NO: 1821432 - RNA, 17 nt, Salmonella typhimurium LT2
aaggucgcuauccagca

SEQ ID NO: 1821433 - RNA, 19 nt, Salmonella typhimurium LT2
aaggucgcuauccagcagu

SEQ ID NO: 1821434 - RNA, 15 nt, Salmonella typhimurium LT2
aaggucuugauagcg

SEQ ID NO: 1821435 - RNA, 16 nt, Salmonella typhimurium LT2
aagguugcacggcauu

SEQ ID NO: 1821436 - RNA, 18 nt, Salmonella typhimurium LT2
ggcgcuacgcuuaucagg

SEQ ID NO: 1821437 - RNA, 22 nt, Salmonella typhimurium LT2
ggcgcuacgcuuaucaggccua

SEQ ID NO: 1821438 - RNA, 14 nt, Salmonella typhimurium LT2
ggcgcuacggcgca

SEQ ID NO: 1821439 - RNA, 19 nt, Salmonella typhimurium LT2
ggcgcuacggcgcacagua

SEQ ID NO: 1821440 - RNA, 21 nt, Salmonella typhimurium LT2
aaggucagguuaugcgcgcca

SEQ ID NO: 1821441 - RNA, 20 nt, Salmonella typhimurium LT2
ggcgcuacgcuuaucaggcc

SEQ ID NO: 1821442 - RNA, 18 nt, Salmonella typhimurium LT2
ggcgcuacguuuaucugg

SEQ ID NO: 1821443 - RNA, 17 nt, Salmonella typhimurium LT2
ggcgcgaucgguaggcc

SEQ ID NO: 1821444 - RNA, 22 nt, Salmonella typhimurium LT2
ggcgcgaugacggcgcguuauc

SEQ ID NO: 1821445 - RNA, 14 nt, Salmonella typhimurium LT2
ggcgcacagcgcca

SEQ ID NO: 1821446 - RNA, 12 nt, Salmonella typhimurium LT2
ggcgcacaggcc

SEQ ID NO: 1821447 - RNA, 20 nt, Salmonella typhimurium LT2
ggcgcaggggcauuuuccgg

SEQ ID NO: 1821448 - RNA, 14 nt, Salmonella typhimurium LT2
aagguauccgccau

SEQ ID NO: 1821449 - RNA, 19 nt, Salmonella typhimurium LT2
aaggucacaucaucgccaa

SEQ ID NO: 1821450 - RNA, 20 nt, Salmonella typhimurium LT2
aaggguuuucgccuggcggc

SEQ ID NO: 1821451 - RNA, 21 nt, Salmonella typhimurium LT2
aagggcagccgagacuaucga

SEQ ID NO: 1821452 - RNA, 16 nt, Salmonella typhimurium LT2
ggcgagcgaugcugcu

SEQ ID NO: 1821453 - RNA, 21 nt, Salmonella typhimurium LT2
ggcgagcguuuugauguccag

SEQ ID NO: 1821454 - RNA, 19 nt, Salmonella typhimurium LT2
ggcgcaaccauuaccgcca

SEQ ID NO: 1821455 - RNA, 21 nt, Salmonella typhimurium LT2
ggcgccgcaaugccgccugcg

SEQ ID NO: 1821456 - RNA, 16 nt, Salmonella typhimurium LT2
ggcgccagcgacaacg

SEQ ID NO: 1821457 - RNA, 16 nt, Salmonella typhimurium LT2
ggcgccaccagcgauu

SEQ ID NO: 1821458 - RNA, 17 nt, Salmonella typhimurium LT2
aaggcggcaaagauaau

SEQ ID NO: 1821459 - RNA, 11 nt, Salmonella typhimurium LT2
aaggcgcugaa

SEQ ID NO: 1821460 - RNA, 20 nt, Salmonella typhimurium LT2
ggccugguaagcgcagcgcc

SEQ ID NO: 1821461 - RNA, 12 nt, Salmonella typhimurium LT2
aaggcgcagccg

SEQ ID NO: 1821462 - RNA, 22 nt, Salmonella typhimurium LT2
ggccugugacguuaacgcagca

SEQ ID NO: 1821463 - RNA, 17 nt, Salmonella typhimurium LT2
ggccugucuccgcagca

SEQ ID NO: 1821464 - RNA, 14 nt, Salmonella typhimurium LT2
ggcgaagcggugca

SEQ ID NO: 1821465 - RNA, 21 nt, Salmonella typhimurium LT2
ggcgaaccggcaucggcagcg

SEQ ID NO: 1821466 - RNA, 19 nt, Salmonella typhimurium LT2
ggcgaacaggcucagcgcc

SEQ ID NO: 1821467 - RNA, 23 nt, Salmonella typhimurium LT2
ggcgaacaauaccguuagcguca

SEQ ID NO: 1821468 - RNA, 21 nt, Salmonella typhimurium LT2
ggcgaacagccccaccgccag

SEQ ID NO: 1821469 - RNA, 17 nt, Salmonella typhimurium LT2
ggcgaaccacggcuuca

SEQ ID NO: 1821470 - RNA, 18 nt, Salmonella typhimurium LT2
ggcgaaaagcuggcugac

SEQ ID NO: 1821471 - RNA, 20 nt, Salmonella typhimurium LT2
aaggcguuucgccgccaucc

SEQ ID NO: 1821472 - RNA, 15 nt, Salmonella typhimurium LT2
aaggcguuugcgccg

SEQ ID NO: 1821473 - RNA, 16 nt, Salmonella typhimurium LT2
ggcgacgaucagcgcc

SEQ ID NO: 1821474 - RNA, 18 nt, Salmonella typhimurium LT2
ggcgacgguuuacgauac

SEQ ID NO: 1821475 - RNA, 21 nt, Salmonella typhimurium LT2
ggcgacuaacgucuuauccgg

SEQ ID NO: 1821476 - RNA, 15 nt, Salmonella typhimurium LT2
ggcgacguuagcgca

SEQ ID NO: 1821477 - RNA, 20 nt, Salmonella typhimurium LT2
ggcgacgugacgcgccagcg

SEQ ID NO: 1821478 - RNA, 19 nt, Salmonella typhimurium LT2
ggcgagaacucgucuuauc

SEQ ID NO: 1821479 - RNA, 23 nt, Salmonella typhimurium LT2
ggcgacuuucacgaaaccggcga

SEQ ID NO: 1821480 - RNA, 14 nt, Salmonella typhimurium LT2
ggcgaccggcagcc

SEQ ID NO: 1821481 - RNA, 16 nt, Salmonella typhimurium LT2
ggcgacgaaucagcga

SEQ ID NO: 1821482 - RNA, 16 nt, Salmonella typhimurium LT2
ggcgacaaucucaccg

SEQ ID NO: 1821483 - RNA, 20 nt, Salmonella typhimurium LT2
ggcgacaagaauaugggugu

SEQ ID NO: 1821484 - RNA, 16 nt, Salmonella typhimurium LT2
ggcgacaagaauaugg

SEQ ID NO: 1821485 - RNA, 16 nt, Salmonella typhimurium LT2
ggcgacaaacagcgcc

SEQ ID NO: 1821486 - RNA, 23 nt, Salmonella typhimurium LT2
ggcgaauccccaucuccagacga

SEQ ID NO: 1821487 - RNA, 13 nt, Salmonella typhimurium LT2
ggcgaaucgccug

SEQ ID NO: 1821488 - RNA, 22 nt, Salmonella typhimurium LT2
ggcgaauagucgccgcggcgca

SEQ ID NO: 1821489 - RNA, 21 nt, Salmonella typhimurium LT2
ggcgacagacgcuuaucgccg

SEQ ID NO: 1821490 - RNA, 17 nt, Salmonella typhimurium LT2
ggcgaccacuagcgccg

SEQ ID NO: 1821491 - RNA, 16 nt, Salmonella typhimurium LT2
ggccgccaccgccucg

SEQ ID NO: 1821492 - RNA, 20 nt, Salmonella typhimurium LT2
ggccgccaucuccggcagcg

SEQ ID NO: 1821493 - RNA, 19 nt, Salmonella typhimurium LT2
ggccgcguuaacgccguug

SEQ ID NO: 1821494 - RNA, 23 nt, Salmonella typhimurium LT2
ggccgcuaucugcuccgccagca

SEQ ID NO: 1821495 - RNA, 17 nt, Salmonella typhimurium LT2
ggccuacguuccaugcg

SEQ ID NO: 1821496 - RNA, 15 nt, Salmonella typhimurium LT2
ggccuacgcgcaugu

SEQ ID NO: 1821497 - RNA, 15 nt, Salmonella typhimurium LT2
ggccuacccgcgugc

SEQ ID NO: 1821498 - RNA, 12 nt, Salmonella typhimurium LT2
ggcagcagcgcg

SEQ ID NO: 1821499 - RNA, 15 nt, Salmonella typhimurium LT2
ggcagccccaggccu

SEQ ID NO: 1821500 - RNA, 16 nt, Salmonella typhimurium LT2
ggcagggugccaggua

SEQ ID NO: 1821501 - RNA, 20 nt, Salmonella typhimurium LT2
ggcagcgugaacgccuuauc

SEQ ID NO: 1821502 - RNA, 13 nt, Salmonella typhimurium LT2
ggcauaucgccau

SEQ ID NO: 1821503 - RNA, 15 nt, Salmonella typhimurium LT2
ggcauauccggcgca

SEQ ID NO: 1821504 - RNA, 14 nt, Salmonella typhimurium LT2
ggcaucacgccggu

SEQ ID NO: 1821505 - RNA, 14 nt, Salmonella typhimurium LT2
ggcaucgacgccag

SEQ ID NO: 1821506 - RNA, 16 nt, Salmonella typhimurium LT2
ggcaacagcucuucgc

SEQ ID NO: 1821507 - RNA, 18 nt, Salmonella typhimurium LT2
ggcaaggaaaaccaguaa

SEQ ID NO: 1821508 - RNA, 16 nt, Salmonella typhimurium LT2
ggcaacggccagcgca

SEQ ID NO: 1821509 - RNA, 17 nt, Salmonella typhimurium LT2
ggcaauagucuccauga

SEQ ID NO: 1821510 - RNA, 16 nt, Salmonella typhimurium LT2
ggcaauaaacaucagc

SEQ ID NO: 1821511 - RNA, 21 nt, Salmonella typhimurium LT2
ggcaauaaacaucagccauuc

SEQ ID NO: 1821512 - RNA, 15 nt, Salmonella typhimurium LT2
ggcaauuaaccgaac

SEQ ID NO: 1821513 - RNA, 22 nt, Salmonella typhimurium LT2
ggcaaucgacguugaucgccau

SEQ ID NO: 1821514 - RNA, 16 nt, Salmonella typhimurium LT2
ggcaauuucucgcucg

SEQ ID NO: 1821515 - RNA, 12 nt, Salmonella typhimurium LT2
ggcacaauagcg

SEQ ID NO: 1821516 - RNA, 14 nt, Salmonella typhimurium LT2
ggcacacaggccgc

SEQ ID NO: 1821517 - RNA, 15 nt, Salmonella typhimurium LT2
ggcacaccggccauu

SEQ ID NO: 1821518 - RNA, 12 nt, Salmonella typhimurium LT2
ggcaccagcaau

SEQ ID NO: 1821519 - RNA, 22 nt, Salmonella typhimurium LT2
ggcaccagccaggaaccgccga

SEQ ID NO: 1821520 - RNA, 12 nt, Salmonella typhimurium LT2
ggcaccagcgua

SEQ ID NO: 1821521 - RNA, 15 nt, Salmonella typhimurium LT2
ggcacgcccgcauuc

SEQ ID NO: 1821522 - RNA, 12 nt, Salmonella typhimurium LT2
ggcacgccaucg

SEQ ID NO: 1821523 - RNA, 15 nt, Salmonella typhimurium LT2
ggcacggucugcuga

SEQ ID NO: 1821524 - RNA, 18 nt, Salmonella typhimurium LT2
ggcagaaaaaucagcauu

SEQ ID NO: 1821525 - RNA, 17 nt, Salmonella typhimurium LT2
ggcccacucauccagca

SEQ ID NO: 1821526 - RNA, 18 nt, Salmonella typhimurium LT2
ggcccagcgacagccagu

SEQ ID NO: 1821527 - RNA, 17 nt, Salmonella typhimurium LT2
ggccaugcgcaagcgcc

SEQ ID NO: 1821528 - RNA, 15 nt, Salmonella typhimurium LT2
ggccaucuggcguug

SEQ ID NO: 1821529 - RNA, 19 nt, Salmonella typhimurium LT2
ggccagugccaaguaacac

SEQ ID NO: 1821530 - RNA, 15 nt, Salmonella typhimurium LT2
ggcaucggcagcguc

SEQ ID NO: 1821531 - RNA, 19 nt, Salmonella typhimurium LT2
ggcaugcagcucaagcgcc

SEQ ID NO: 1821532 - RNA, 14 nt, Salmonella typhimurium LT2
aaggccagcaccag

SEQ ID NO: 1821533 - RNA, 16 nt, Salmonella typhimurium LT2
aaggcauuuaugccgc

SEQ ID NO: 1821534 - RNA, 16 nt, Salmonella typhimurium LT2
aaggcauucacgccgc

SEQ ID NO: 1821535 - RNA, 22 nt, Salmonella typhimurium LT2
aaggcaaaguaucccuuccuca

SEQ ID NO: 1821536 - RNA, 21 nt, Salmonella typhimurium LT2
aaggcaaucgcuuccagcgcc

SEQ ID NO: 1821537 - RNA, 15 nt, Salmonella typhimurium LT2
aaggcagagaacaac

SEQ ID NO: 1821538 - RNA, 15 nt, Salmonella typhimurium LT2
aaggauacagcgccg

SEQ ID NO: 1821539 - RNA, 19 nt, Salmonella typhimurium LT2
ggagaagacgccgccgcau

SEQ ID NO: 1821540 - RNA, 23 nt, Salmonella typhimurium LT2
ggagagcauuuguagcggcaaca

SEQ ID NO: 1821541 - RNA, 14 nt, Salmonella typhimurium LT2
ggagaucggcugua

SEQ ID NO: 1821542 - RNA, 11 nt, Salmonella typhimurium LT2
ggagcccagua

SEQ ID NO: 1821543 - RNA, 18 nt, Salmonella typhimurium LT2
ggacuuaucaggccuacg

SEQ ID NO: 1821544 - RNA, 18 nt, Salmonella typhimurium LT2
ggacguuuccugcgccag

SEQ ID NO: 1821545 - RNA, 19 nt, Salmonella typhimurium LT2
ggacguuuggcuuauccgc

SEQ ID NO: 1821546 - RNA, 23 nt, Salmonella typhimurium LT2
ggacggcggcugcgaugccauca

SEQ ID NO: 1821547 - RNA, 16 nt, Salmonella typhimurium LT2
ggacgcuuuuauccgg

SEQ ID NO: 1821548 - RNA, 21 nt, Salmonella typhimurium LT2
ggacgcgacuuuccgccacca

SEQ ID NO: 1821549 - RNA, 12 nt, Salmonella typhimurium LT2
ggaggaacagcg

SEQ ID NO: 1821550 - RNA, 14 nt, Salmonella typhimurium LT2
ggagcugcgcuucg

SEQ ID NO: 1821551 - RNA, 14 nt, Salmonella typhimurium LT2
ggaggacgucuguc

SEQ ID NO: 1821552 - RNA, 14 nt, Salmonella typhimurium LT2
ggagcggcguccgc

SEQ ID NO: 1821553 - RNA, 23 nt, Salmonella typhimurium LT2
ggagcgcauuuuacugccguauc

SEQ ID NO: 1821554 - RNA, 20 nt, Salmonella typhimurium LT2
ggaggcggacgaaacguugc

SEQ ID NO: 1821555 - RNA, 13 nt, Salmonella typhimurium LT2
ggauaaagaccgg

SEQ ID NO: 1821556 - RNA, 22 nt, Salmonella typhimurium LT2
ggauaaauagugacgccgccau

SEQ ID NO: 1821557 - RNA, 18 nt, Salmonella typhimurium LT2
ggauaagcaaagcgccau

SEQ ID NO: 1821558 - RNA, 19 nt, Salmonella typhimurium LT2
ggauaagcguaagcgccau

SEQ ID NO: 1821559 - RNA, 18 nt, Salmonella typhimurium LT2
ggauaagcguagcgccau

SEQ ID NO: 1821560 - RNA, 23 nt, Salmonella typhimurium LT2
ggauaaggcauucacgccgccau

SEQ ID NO: 1821561 - RNA, 23 nt, Salmonella typhimurium LT2
ggauaaggcauuuaugccgccau

SEQ ID NO: 1821562 - RNA, 20 nt, Salmonella typhimurium LT2
ggauaaggcggagccgccau

SEQ ID NO: 1821563 - RNA, 20 nt, Salmonella typhimurium LT2
ggauaaggcguaaccgccau

SEQ ID NO: 1821564 - RNA, 22 nt, Salmonella typhimurium LT2
ggauagcucgcuguaccgccau

SEQ ID NO: 1821565 - RNA, 22 nt, Salmonella typhimurium LT2
ggauagagaucuuccgccacca

SEQ ID NO: 1821566 - RNA, 20 nt, Salmonella typhimurium LT2
ggauaccguccaccagcaca

SEQ ID NO: 1821567 - RNA, 13 nt, Salmonella typhimurium LT2
ggauagucuucaa

SEQ ID NO: 1821568 - RNA, 19 nt, Salmonella typhimurium LT2
ggauagcguagcgccaucc

SEQ ID NO: 1821569 - RNA, 16 nt, Salmonella typhimurium LT2
ggauacccagccacau

SEQ ID NO: 1821570 - RNA, 16 nt, Salmonella typhimurium LT2
ggauaccacgccaaua

SEQ ID NO: 1821571 - RNA, 14 nt, Salmonella typhimurium LT2
ggauacccagccac

SEQ ID NO: 1821572 - RNA, 15 nt, Salmonella typhimurium LT2
ggauaaucagcagcg

SEQ ID NO: 1821573 - RNA, 23 nt, Salmonella typhimurium LT2
ggauaaggugcuugcgccgccau

SEQ ID NO: 1821574 - RNA, 13 nt, Salmonella typhimurium LT2
ggauacagcgccg

SEQ ID NO: 1821575 - RNA, 19 nt, Salmonella typhimurium LT2
ggauaaucuugauccggcu

SEQ ID NO: 1821576 - RNA, 23 nt, Salmonella typhimurium LT2
ggaucaggcgcuugcgccgccau

SEQ ID NO: 1821577 - RNA, 15 nt, Salmonella typhimurium LT2
ggaauagcgccuuca

SEQ ID NO: 1821578 - RNA, 19 nt, Salmonella typhimurium LT2
ggaauaucuucaucgguaa

SEQ ID NO: 1821579 - RNA, 20 nt, Salmonella typhimurium LT2
ggaauaacaucguaaaucaa

SEQ ID NO: 1821580 - RNA, 15 nt, Salmonella typhimurium LT2
ggaacuguucagcca

SEQ ID NO: 1821581 - RNA, 14 nt, Salmonella typhimurium LT2
gcuggcgcuuaccg

SEQ ID NO: 1821582 - RNA, 16 nt, Salmonella typhimurium LT2
ggaaccaaaugcccag

SEQ ID NO: 1821583 - RNA, 18 nt, Salmonella typhimurium LT2
ggaaccaaaugcccagcu

SEQ ID NO: 1821584 - RNA, 15 nt, Salmonella typhimurium LT2
ggaacagcgccguca

SEQ ID NO: 1821585 - RNA, 17 nt, Salmonella typhimurium LT2
ggaacgcccuguucguc

SEQ ID NO: 1821586 - RNA, 15 nt, Salmonella typhimurium LT2
ggaacguugcgccau

SEQ ID NO: 1821587 - RNA, 16 nt, Salmonella typhimurium LT2
ggaacgcgcaguccgu

SEQ ID NO: 1821588 - RNA, 11 nt, Salmonella typhimurium LT2
ggacagcgaca

SEQ ID NO: 1821589 - RNA, 14 nt, Salmonella typhimurium LT2
ggacagcagcauau

SEQ ID NO: 1821590 - RNA, 12 nt, Salmonella typhimurium LT2
ggacaucgccau

SEQ ID NO: 1821591 - RNA, 21 nt, Salmonella typhimurium LT2
ggacaggcgacgccgccaucc

SEQ ID NO: 1821592 - RNA, 15 nt, Salmonella typhimurium LT2
gggcaucaccggauc

SEQ ID NO: 1821593 - RNA, 17 nt, Salmonella typhimurium LT2
gggccagcauaguaaau

SEQ ID NO: 1821594 - RNA, 13 nt, Salmonella typhimurium LT2
gggccgccgccau

SEQ ID NO: 1821595 - RNA, 13 nt, Salmonella typhimurium LT2
gggccgaaaccgc

SEQ ID NO: 1821596 - RNA, 23 nt, Salmonella typhimurium LT2
gggcaacaaacauaagcaaaucc

SEQ ID NO: 1821597 - RNA, 23 nt, Salmonella typhimurium LT2
gggcagcaucucgauuacagcau

SEQ ID NO: 1821598 - RNA, 13 nt, Salmonella typhimurium LT2
ggcguaucggcag

SEQ ID NO: 1821599 - RNA, 15 nt, Salmonella typhimurium LT2
ggcgucaaugaucag

SEQ ID NO: 1821600 - RNA, 18 nt, Salmonella typhimurium LT2
aaguaaaacaagccgaua

SEQ ID NO: 1821601 - RNA, 20 nt, Salmonella typhimurium LT2
aagguuguuugggcgcauag

SEQ ID NO: 1821602 - RNA, 16 nt, Salmonella typhimurium LT2
gggcuguuauucagca

SEQ ID NO: 1821603 - RNA, 17 nt, Salmonella typhimurium LT2
ggggaagcgacgacacg

SEQ ID NO: 1821604 - RNA, 17 nt, Salmonella typhimurium LT2
gggcguaaauauaacgc

SEQ ID NO: 1821605 - RNA, 15 nt, Salmonella typhimurium LT2
gggcugccaucaggc

SEQ ID NO: 1821606 - RNA, 15 nt, Salmonella typhimurium LT2
gggcugccagggcau

SEQ ID NO: 1821607 - RNA, 22 nt, Salmonella typhimurium LT2
gggcugcccgccguuaaaucau

SEQ ID NO: 1821608 - RNA, 15 nt, Salmonella typhimurium LT2
gggcuauuugcagau

SEQ ID NO: 1821609 - RNA, 12 nt, Salmonella typhimurium LT2
gggcuauaggcc

SEQ ID NO: 1821610 - RNA, 17 nt, Salmonella typhimurium LT2
gggcgcuugcgcauggc

SEQ ID NO: 1821611 - RNA, 22 nt, Salmonella typhimurium LT2
gggcgaaucuggauagucaggc

SEQ ID NO: 1821612 - RNA, 16 nt, Salmonella typhimurium LT2
gggcgaccgucgggcc

SEQ ID NO: 1821613 - RNA, 14 nt, Salmonella typhimurium LT2
gggccugcugcggu

SEQ ID NO: 1821614 - RNA, 18 nt, Salmonella typhimurium LT2
ggucgacagccacacgcc

SEQ ID NO: 1821615 - RNA, 16 nt, Salmonella typhimurium LT2
gguaucgguaucgcag

SEQ ID NO: 1821616 - RNA, 17 nt, Salmonella typhimurium LT2
gguaucguugcggcgca

SEQ ID NO: 1821617 - RNA, 17 nt, Salmonella typhimurium LT2
gguaugaaagccaucgc

SEQ ID NO: 1821618 - RNA, 15 nt, Salmonella typhimurium LT2
gguagccacagauua

SEQ ID NO: 1821619 - RNA, 22 nt, Salmonella typhimurium LT2
gguaucaucgcuuaacggccca

SEQ ID NO: 1821620 - RNA, 12 nt, Salmonella typhimurium LT2
gguauccagcgc

SEQ ID NO: 1821621 - RNA, 15 nt, Salmonella typhimurium LT2
ggguugagcgaguca

SEQ ID NO: 1821622 - RNA, 16 nt, Salmonella typhimurium LT2
ggguggucacgccauu

SEQ ID NO: 1821623 - RNA, 14 nt, Salmonella typhimurium LT2
gguaacaggcacca

SEQ ID NO: 1821624 - RNA, 23 nt, Salmonella typhimurium LT2
gguaacaucgaacuguuuaccca

SEQ ID NO: 1821625 - RNA, 17 nt, Salmonella typhimurium LT2
gguaaauaccaggcacu

SEQ ID NO: 1821626 - RNA, 22 nt, Salmonella typhimurium LT2
gguaagacguuuacgccgccau

SEQ ID NO: 1821627 - RNA, 22 nt, Salmonella typhimurium LT2
gguaagcccauggcaggcagca

SEQ ID NO: 1821628 - RNA, 18 nt, Salmonella typhimurium LT2
gguaacgcaacucaucgu

SEQ ID NO: 1821629 - RNA, 21 nt, Salmonella typhimurium LT2
gguaauaauuggcauccagca

SEQ ID NO: 1821630 - RNA, 19 nt, Salmonella typhimurium LT2
gguaauauuaaaaccauug

SEQ ID NO: 1821631 - RNA, 17 nt, Salmonella typhimurium LT2
gguaauaauccucgccg

SEQ ID NO: 1821632 - RNA, 14 nt, Salmonella typhimurium LT2
gguaccccagccau

SEQ ID NO: 1821633 - RNA, 13 nt, Salmonella typhimurium LT2
gguaccagaucgu

SEQ ID NO: 1821634 - RNA, 14 nt, Salmonella typhimurium LT2
ggugaauuugcugc

SEQ ID NO: 1821635 - RNA, 14 nt, Salmonella typhimurium LT2
ggugacaucgccaa

SEQ ID NO: 1821636 - RNA, 18 nt, Salmonella typhimurium LT2
ggugagcaaaggcagcca

SEQ ID NO: 1821637 - RNA, 17 nt, Salmonella typhimurium LT2
ggugauuaacagcgcca

SEQ ID NO: 1821638 - RNA, 14 nt, Salmonella typhimurium LT2
ggugauuuccagaa

SEQ ID NO: 1821639 - RNA, 21 nt, Salmonella typhimurium LT2
ggucugaugagcgcagcgacu

SEQ ID NO: 1821640 - RNA, 15 nt, Salmonella typhimurium LT2
ggucggcccgacagg

SEQ ID NO: 1821641 - RNA, 11 nt, Salmonella typhimurium LT2
ggugcagucgc

SEQ ID NO: 1821642 - RNA, 18 nt, Salmonella typhimurium LT2
ggugccaaucuccagcau

SEQ ID NO: 1821643 - RNA, 20 nt, Salmonella typhimurium LT2
ggugcgcagccccagcgcca

SEQ ID NO: 1821644 - RNA, 15 nt, Salmonella typhimurium LT2
gucgccgcccaucgg

SEQ ID NO: 1821645 - RNA, 13 nt, Salmonella typhimurium LT2
gucgccauccuga

SEQ ID NO: 1821646 - RNA, 21 nt, Salmonella typhimurium LT2
gucgccaucaggcgauggcgc

SEQ ID NO: 1821647 - RNA, 14 nt, Salmonella typhimurium LT2
gucgccauccggcg

SEQ ID NO: 1821648 - RNA, 22 nt, Salmonella typhimurium LT2
gucgccaugaccugggcgccag

SEQ ID NO: 1821649 - RNA, 23 nt, Salmonella typhimurium LT2
gucgccaugaccugggcgccaga

SEQ ID NO: 1821650 - RNA, 13 nt, Salmonella typhimurium LT2
gucgcccguccgc

SEQ ID NO: 1821651 - RNA, 15 nt, Salmonella typhimurium LT2
gucgccagcgccgga

SEQ ID NO: 1821652 - RNA, 21 nt, Salmonella typhimurium LT2
gucgccaaagcagcugcuggu

SEQ ID NO: 1821653 - RNA, 13 nt, Salmonella typhimurium LT2
gucgcagcggcgg

SEQ ID NO: 1821654 - RNA, 23 nt, Salmonella typhimurium LT2
gucgcagcggcggucugcgccug

SEQ ID NO: 1821655 - RNA, 22 nt, Salmonella typhimurium LT2
gucgcuacuggcguauuaucgg

SEQ ID NO: 1821656 - RNA, 22 nt, Salmonella typhimurium LT2
gucgcuaaagcgacuuauccgg

SEQ ID NO: 1821657 - RNA, 20 nt, Salmonella typhimurium LT2
gucgcguccggggccagcgc

SEQ ID NO: 1821658 - RNA, 21 nt, Salmonella typhimurium LT2
gucgcguaugguucagguauu

SEQ ID NO: 1821659 - RNA, 17 nt, Salmonella typhimurium LT2
gucgcguacuuucgcca

SEQ ID NO: 1821660 - RNA, 18 nt, Salmonella typhimurium LT2
gucgcguacuuucgccag

SEQ ID NO: 1821661 - RNA, 21 nt, Salmonella typhimurium LT2
gucgcgggcgcuaaaccggcg

SEQ ID NO: 1821662 - RNA, 20 nt, Salmonella typhimurium LT2
gucgcgaucgcgccagccuu

SEQ ID NO: 1821663 - RNA, 14 nt, Salmonella typhimurium LT2
gucggacagcgaca

SEQ ID NO: 1821664 - RNA, 17 nt, Salmonella typhimurium LT2
gucgcuuuuugcgccag

SEQ ID NO: 1821665 - RNA, 14 nt, Salmonella typhimurium LT2
gucggaauuuccgg

SEQ ID NO: 1821666 - RNA, 17 nt, Salmonella typhimurium LT2
gucgcuccggaacgcga

SEQ ID NO: 1821667 - RNA, 22 nt, Salmonella typhimurium LT2
gucgcuaccacagaaaucgccg

SEQ ID NO: 1821668 - RNA, 15 nt, Salmonella typhimurium LT2
gucgcuauccagcag

SEQ ID NO: 1821669 - RNA, 13 nt, Salmonella typhimurium LT2
guccggauggcgu

SEQ ID NO: 1821670 - RNA, 18 nt, Salmonella typhimurium LT2
guccgguaacggaugaaa

SEQ ID NO: 1821671 - RNA, 17 nt, Salmonella typhimurium LT2
guccggguucagcgaca

SEQ ID NO: 1821672 - RNA, 20 nt, Salmonella typhimurium LT2
guccggcaucgugauaaacg

SEQ ID NO: 1821673 - RNA, 14 nt, Salmonella typhimurium LT2
guccguggcacggu

SEQ ID NO: 1821674 - RNA, 21 nt, Salmonella typhimurium LT2
guccaucaggcuuugcgccau

SEQ ID NO: 1821675 - RNA, 15 nt, Salmonella typhimurium LT2
gucauccggcaauca

SEQ ID NO: 1821676 - RNA, 16 nt, Salmonella typhimurium LT2
gucaucaucaggaaca

SEQ ID NO: 1821677 - RNA, 15 nt, Salmonella typhimurium LT2
gucauauugccgaua

SEQ ID NO: 1821678 - RNA, 13 nt, Salmonella typhimurium LT2
gucaucaagauuu

SEQ ID NO: 1821679 - RNA, 22 nt, Salmonella typhimurium LT2
gucaucgcccaugacauuccca

SEQ ID NO: 1821680 - RNA, 14 nt, Salmonella typhimurium LT2
gucgacaugcgcau

SEQ ID NO: 1821681 - RNA, 15 nt, Salmonella typhimurium LT2
gucgaccgguccacu

SEQ ID NO: 1821682 - RNA, 18 nt, Salmonella typhimurium LT2
gucgacugguaggccuga

SEQ ID NO: 1821683 - RNA, 15 nt, Salmonella typhimurium LT2
gucgacugguaggcc

SEQ ID NO: 1821684 - RNA, 16 nt, Salmonella typhimurium LT2
guccugguacaucgcg

SEQ ID NO: 1821685 - RNA, 17 nt, Salmonella typhimurium LT2
gucgacagcccgccagc

SEQ ID NO: 1821686 - RNA, 16 nt, Salmonella typhimurium LT2
guccugccccugccag

SEQ ID NO: 1821687 - RNA, 21 nt, Salmonella typhimurium LT2
guccugcccgccacccuccgg

SEQ ID NO: 1821688 - RNA, 13 nt, Salmonella typhimurium LT2
guaguaaucgaua

SEQ ID NO: 1821689 - RNA, 15 nt, Salmonella typhimurium LT2
guaucacaaucagcc

SEQ ID NO: 1821690 - RNA, 22 nt, Salmonella typhimurium LT2
guaguggcagaguccagcggca

SEQ ID NO: 1821691 - RNA, 14 nt, Salmonella typhimurium LT2
aagucagcuuccug

SEQ ID NO: 1821692 - RNA, 18 nt, Salmonella typhimurium LT2
aagucgccacccggcuuu

SEQ ID NO: 1821693 - RNA, 16 nt, Salmonella typhimurium LT2
aagucgcgggcgcuaa

SEQ ID NO: 1821694 - RNA, 18 nt, Salmonella typhimurium LT2
guagcucgcccagcacua

SEQ ID NO: 1821695 - RNA, 21 nt, Salmonella typhimurium LT2
guagcuggcaagaccgauaga

SEQ ID NO: 1821696 - RNA, 13 nt, Salmonella typhimurium LT2
aaguauccuggaa

SEQ ID NO: 1821697 - RNA, 22 nt, Salmonella typhimurium LT2
guagacccggcauugaaacgca

SEQ ID NO: 1821698 - RNA, 14 nt, Salmonella typhimurium LT2
guagcaaaucaucg

SEQ ID NO: 1821699 - RNA, 16 nt, Salmonella typhimurium LT2
guacuugcgccgccau

SEQ ID NO: 1821700 - RNA, 15 nt, Salmonella typhimurium LT2
guacguccauccgcc

SEQ ID NO: 1821701 - RNA, 23 nt, Salmonella typhimurium LT2
guacugacuaacgcuuaccguau

SEQ ID NO: 1821702 - RNA, 22 nt, Salmonella typhimurium LT2
guacugaacccggguaggcugc

SEQ ID NO: 1821703 - RNA, 16 nt, Salmonella typhimurium LT2
guagcagaagacgcug

SEQ ID NO: 1821704 - RNA, 14 nt, Salmonella typhimurium LT2
guagcgagccaucg

SEQ ID NO: 1821705 - RNA, 16 nt, Salmonella typhimurium LT2
guagcgagccaucggc

SEQ ID NO: 1821706 - RNA, 15 nt, Salmonella typhimurium LT2
guagcgacgccaucc

SEQ ID NO: 1821707 - RNA, 16 nt, Salmonella typhimurium LT2
guagcgacgccauccg

SEQ ID NO: 1821708 - RNA, 21 nt, Salmonella typhimurium LT2
guagcgccugugcuuucgcca

SEQ ID NO: 1821709 - RNA, 12 nt, Salmonella typhimurium LT2
guagcgccauca

SEQ ID NO: 1821710 - RNA, 15 nt, Salmonella typhimurium LT2
guagcgccaucaggc

SEQ ID NO: 1821711 - RNA, 16 nt, Salmonella typhimurium LT2
guagcucauaacucgc

SEQ ID NO: 1821712 - RNA, 19 nt, Salmonella typhimurium LT2
guaccugauggacaauccg

SEQ ID NO: 1821713 - RNA, 23 nt, Salmonella typhimurium LT2
guacggcuuucuuucuccagcgu

SEQ ID NO: 1821714 - RNA, 20 nt, Salmonella typhimurium LT2
guaccgucacuucuucgcga

SEQ ID NO: 1821715 - RNA, 21 nt, Salmonella typhimurium LT2
guaaucauuucauuaaucagu

SEQ ID NO: 1821716 - RNA, 11 nt, Salmonella typhimurium LT2
guaaucgcggu

SEQ ID NO: 1821717 - RNA, 13 nt, Salmonella typhimurium LT2
guacaccagacga

SEQ ID NO: 1821718 - RNA, 18 nt, Salmonella typhimurium LT2
guacagggcgauuuccgu

SEQ ID NO: 1821719 - RNA, 23 nt, Salmonella typhimurium LT2
guacauauccaguugaccguuag

SEQ ID NO: 1821720 - RNA, 17 nt, Salmonella typhimurium LT2
guaaauacgcugcggcc

SEQ ID NO: 1821721 - RNA, 15 nt, Salmonella typhimurium LT2
guaaauaaucgacga

SEQ ID NO: 1821722 - RNA, 19 nt, Salmonella typhimurium LT2
guaaaucgcgcccgacaug

SEQ ID NO: 1821723 - RNA, 21 nt, Salmonella typhimurium LT2
guaaagcgcaaaauagcagcg

SEQ ID NO: 1821724 - RNA, 19 nt, Salmonella typhimurium LT2
guaaaggcggaaaucagca

SEQ ID NO: 1821725 - RNA, 14 nt, Salmonella typhimurium LT2
guaauaaagcguag

SEQ ID NO: 1821726 - RNA, 15 nt, Salmonella typhimurium LT2
guaagcgccagccgu

SEQ ID NO: 1821727 - RNA, 14 nt, Salmonella typhimurium LT2
guaagcgccagcgg

SEQ ID NO: 1821728 - RNA, 23 nt, Salmonella typhimurium LT2
guaagccauuccccacgccaucg

SEQ ID NO: 1821729 - RNA, 18 nt, Salmonella typhimurium LT2
guaagcgcagcgccaccg

SEQ ID NO: 1821730 - RNA, 16 nt, Salmonella typhimurium LT2
guaaauuagcgcgaaa

SEQ ID NO: 1821731 - RNA, 12 nt, Salmonella typhimurium LT2
guaacucaucgc

SEQ ID NO: 1821732 - RNA, 17 nt, Salmonella typhimurium LT2
guaagaaugcgcgucag

SEQ ID NO: 1821733 - RNA, 19 nt, Salmonella typhimurium LT2
guaagaauuauuaccaaug

SEQ ID NO: 1821734 - RNA, 17 nt, Salmonella typhimurium LT2
guaacuucacgccaucg

SEQ ID NO: 1821735 - RNA, 20 nt, Salmonella typhimurium LT2
guaacuucuugguaccaaac

SEQ ID NO: 1821736 - RNA, 15 nt, Salmonella typhimurium LT2
guaagcaaucaaggu

SEQ ID NO: 1821737 - RNA, 19 nt, Salmonella typhimurium LT2
guaagauuugcgccgccgu

SEQ ID NO: 1821738 - RNA, 19 nt, Salmonella typhimurium LT2
gucacgacggcgaccagca

SEQ ID NO: 1821739 - RNA, 16 nt, Salmonella typhimurium LT2
gucacgcgaucguagc

SEQ ID NO: 1821740 - RNA, 22 nt, Salmonella typhimurium LT2
gucagauuuucauuuagcgccu

SEQ ID NO: 1821741 - RNA, 19 nt, Salmonella typhimurium LT2
gucacuccggcugcaccag

SEQ ID NO: 1821742 - RNA, 16 nt, Salmonella typhimurium LT2
gucagcauaauauccu

SEQ ID NO: 1821743 - RNA, 19 nt, Salmonella typhimurium LT2
guauucguuaccagcaucg

SEQ ID NO: 1821744 - RNA, 16 nt, Salmonella typhimurium LT2
guauugacgccgacau

SEQ ID NO: 1821745 - RNA, 14 nt, Salmonella typhimurium LT2
guauuauccauugu

SEQ ID NO: 1821746 - RNA, 19 nt, Salmonella typhimurium LT2
gucaaacuuguguucccac

SEQ ID NO: 1821747 - RNA, 14 nt, Salmonella typhimurium LT2
guauuuauccagca

SEQ ID NO: 1821748 - RNA, 12 nt, Salmonella typhimurium LT2
guauuugcgccc

SEQ ID NO: 1821749 - RNA, 19 nt, Salmonella typhimurium LT2
guaucguagauguccacga

SEQ ID NO: 1821750 - RNA, 21 nt, Salmonella typhimurium LT2
guaucacguuuuuuacgucag

SEQ ID NO: 1821751 - RNA, 17 nt, Salmonella typhimurium LT2
guaucccgccuggcgaa

SEQ ID NO: 1821752 - RNA, 16 nt, Salmonella typhimurium LT2
guaucggcaauauccc

SEQ ID NO: 1821753 - RNA, 16 nt, Salmonella typhimurium LT2
guaugcccccuccagc

SEQ ID NO: 1821754 - RNA, 14 nt, Salmonella typhimurium LT2
gucaauaucgacgg

SEQ ID NO: 1821755 - RNA, 23 nt, Salmonella typhimurium LT2
gucaaugacuuuuuugccaauau

SEQ ID NO: 1821756 - RNA, 22 nt, Salmonella typhimurium LT2
gucaacguccaguucguucugc

SEQ ID NO: 1821757 - RNA, 22 nt, Salmonella typhimurium LT2
gucaacgaggugaauaaauccu

SEQ ID NO: 1821758 - RNA, 22 nt, Salmonella typhimurium LT2
gucaacccuauugccacaauau

SEQ ID NO: 1821759 - RNA, 18 nt, Salmonella typhimurium LT2
gucaccgaauagcgacaa

SEQ ID NO: 1821760 - RNA, 22 nt, Salmonella typhimurium LT2
gucaccggaauggucgcgccag

SEQ ID NO: 1821761 - RNA, 17 nt, Salmonella typhimurium LT2
gcguucggccugcugca

SEQ ID NO: 1821762 - RNA, 13 nt, Salmonella typhimurium LT2
gcguuccuuauca

SEQ ID NO: 1821763 - RNA, 15 nt, Salmonella typhimurium LT2
gcguuccuuaucagc

SEQ ID NO: 1821764 - RNA, 16 nt, Salmonella typhimurium LT2
gcguuccuuaucagca

SEQ ID NO: 1821765 - RNA, 17 nt, Salmonella typhimurium LT2
gcguuccgcucagcguc

SEQ ID NO: 1821766 - RNA, 18 nt, Salmonella typhimurium LT2
gcguuccgcucagcguca

SEQ ID NO: 1821767 - RNA, 19 nt, Salmonella typhimurium LT2
gcguuccccaacagcgacc

SEQ ID NO: 1821768 - RNA, 17 nt, Salmonella typhimurium LT2
gcguuccccaacagcga

SEQ ID NO: 1821769 - RNA, 13 nt, Salmonella typhimurium LT2
gcguuccagcauu

SEQ ID NO: 1821770 - RNA, 22 nt, Salmonella typhimurium LT2
gcgugugucccggacaauguaa

SEQ ID NO: 1821771 - RNA, 13 nt, Salmonella typhimurium LT2
gcguugauggcgu

SEQ ID NO: 1821772 - RNA, 21 nt, Salmonella typhimurium LT2
gcguuuuaugaucgacaauga

SEQ ID NO: 1821773 - RNA, 16 nt, Salmonella typhimurium LT2
gcguuuccagccaguc

SEQ ID NO: 1821774 - RNA, 18 nt, Salmonella typhimurium LT2
gcguuuuccaucaucagg

SEQ ID NO: 1821775 - RNA, 23 nt, Salmonella typhimurium LT2
gcguuuugacuuugaccagcauc

SEQ ID NO: 1821776 - RNA, 14 nt, Salmonella typhimurium LT2
gcuaaacagcaaau

SEQ ID NO: 1821777 - RNA, 14 nt, Salmonella typhimurium LT2
gcuaaacagcgccg

SEQ ID NO: 1821778 - RNA, 21 nt, Salmonella typhimurium LT2
gcuaaccagcgagcuacaggu

SEQ ID NO: 1821779 - RNA, 22 nt, Salmonella typhimurium LT2
gcuaacguccgccgucaggcua

SEQ ID NO: 1821780 - RNA, 20 nt, Salmonella typhimurium LT2
gcuaacgcgccuccggccug

SEQ ID NO: 1821781 - RNA, 14 nt, Salmonella typhimurium LT2
gcuaacgcgucuua

SEQ ID NO: 1821782 - RNA, 23 nt, Salmonella typhimurium LT2
gcuaacgcgucuuaucuggccua

SEQ ID NO: 1821783 - RNA, 18 nt, Salmonella typhimurium LT2
gcuaagggcaccagcaac

SEQ ID NO: 1821784 - RNA, 16 nt, Salmonella typhimurium LT2
gcuaauauccagccac

SEQ ID NO: 1821785 - RNA, 22 nt, Salmonella typhimurium LT2
gcuaaucaggaagaaagacgcg

SEQ ID NO: 1821786 - RNA, 20 nt, Salmonella typhimurium LT2
gcguuggcgucagaccggca

SEQ ID NO: 1821787 - RNA, 16 nt, Salmonella typhimurium LT2
gcguugucuaccgcgc

SEQ ID NO: 1821788 - RNA, 16 nt, Salmonella typhimurium LT2
gcguuuaccaccggaa

SEQ ID NO: 1821789 - RNA, 17 nt, Salmonella typhimurium LT2
gcguuuaccaccggaaa

SEQ ID NO: 1821790 - RNA, 22 nt, Salmonella typhimurium LT2
gcguuucguaauggccuacaca

SEQ ID NO: 1821791 - RNA, 15 nt, Salmonella typhimurium LT2
gcguuuccacgacaa

SEQ ID NO: 1821792 - RNA, 14 nt, Salmonella typhimurium LT2
gcuacucagcguca

SEQ ID NO: 1821793 - RNA, 19 nt, Salmonella typhimurium LT2
gcuacgcuuaucaggccua

SEQ ID NO: 1821794 - RNA, 20 nt, Salmonella typhimurium LT2
gcuauacaguaaaacgccaa

SEQ ID NO: 1821795 - RNA, 12 nt, Salmonella typhimurium LT2
gcuacaggcguc

SEQ ID NO: 1821796 - RNA, 16 nt, Salmonella typhimurium LT2
gcuaauugguagcuuu

SEQ ID NO: 1821797 - RNA, 22 nt, Salmonella typhimurium LT2
gcuaauucucccugccaggcca

SEQ ID NO: 1821798 - RNA, 18 nt, Salmonella typhimurium LT2
gcuaccagcgcggcgcca

SEQ ID NO: 1821799 - RNA, 22 nt, Salmonella typhimurium LT2
gcuacgaacgcgaaggccagca

SEQ ID NO: 1821800 - RNA, 22 nt, Salmonella typhimurium LT2
gcuaucggguaaaguaacaauc

SEQ ID NO: 1821801 - RNA, 22 nt, Salmonella typhimurium LT2
gcuaucgccguaaauuccuugu

SEQ ID NO: 1821802 - RNA, 17 nt, Salmonella typhimurium LT2
gcuaugacaaguccgcc

SEQ ID NO: 1821803 - RNA, 18 nt, Salmonella typhimurium LT2
gcuaucugcuccgccagc

SEQ ID NO: 1821804 - RNA, 12 nt, Salmonella typhimurium LT2
gcuauccggcaa

SEQ ID NO: 1821805 - RNA, 14 nt, Salmonella typhimurium LT2
gcuauccggcaaca

SEQ ID NO: 1821806 - RNA, 17 nt, Salmonella typhimurium LT2
gcuaucagacugaucgc

SEQ ID NO: 1821807 - RNA, 14 nt, Salmonella typhimurium LT2
gcuaucagccgcca

SEQ ID NO: 1821808 - RNA, 16 nt, Salmonella typhimurium LT2
gcuauguagcgcugaa

SEQ ID NO: 1821809 - RNA, 14 nt, Salmonella typhimurium LT2
gcuauucagcaguu

SEQ ID NO: 1821810 - RNA, 18 nt, Salmonella typhimurium LT2
gcucaauaauacgaugua

SEQ ID NO: 1821811 - RNA, 24 nt, Salmonella typhimurium LT2
gcucacaaugccgcccaggauaca

SEQ ID NO: 1821812 - RNA, 17 nt, Salmonella typhimurium LT2
gcucaaccacgauaacc

SEQ ID NO: 1821813 - RNA, 19 nt, Salmonella typhimurium LT2
gcucaacgccuuuacaauc

SEQ ID NO: 1821814 - RNA, 21 nt, Salmonella typhimurium LT2
gcucaacgccuuuacaaucga

SEQ ID NO: 1821815 - RNA, 18 nt, Salmonella typhimurium LT2
gcucaacgcguucaucca

SEQ ID NO: 1821816 - RNA, 21 nt, Salmonella typhimurium LT2
gcguaucucagcauguccgcc

SEQ ID NO: 1821817 - RNA, 14 nt, Salmonella typhimurium LT2
gcguauucagcgca

SEQ ID NO: 1821818 - RNA, 13 nt, Salmonella typhimurium LT2
gcguaugcugaua

SEQ ID NO: 1821819 - RNA, 14 nt, Salmonella typhimurium LT2
gcguauugguacaa

SEQ ID NO: 1821820 - RNA, 16 nt, Salmonella typhimurium LT2
gcguagcguacugcag

SEQ ID NO: 1821821 - RNA, 16 nt, Salmonella typhimurium LT2
gcgucaucggcucauc

SEQ ID NO: 1821822 - RNA, 14 nt, Salmonella typhimurium LT2
gcgucaucccgguu

SEQ ID NO: 1821823 - RNA, 22 nt, Salmonella typhimurium LT2
gcgucauccacauuauucacgc

SEQ ID NO: 1821824 - RNA, 17 nt, Salmonella typhimurium LT2
gcgucaaaguugcauca

SEQ ID NO: 1821825 - RNA, 20 nt, Salmonella typhimurium LT2
gcgucaaagcacaugcagau

SEQ ID NO: 1821826 - RNA, 22 nt, Salmonella typhimurium LT2
gcguccacucgcccauuugcga

SEQ ID NO: 1821827 - RNA, 19 nt, Salmonella typhimurium LT2
gcguccggggccagcgcca

SEQ ID NO: 1821828 - RNA, 21 nt, Salmonella typhimurium LT2
gcgucgauaauugcgcgcgua

SEQ ID NO: 1821829 - RNA, 19 nt, Salmonella typhimurium LT2
gcguguaacugcaaacgcg

SEQ ID NO: 1821830 - RNA, 15 nt, Salmonella typhimurium LT2
gcguguacauuauca

SEQ ID NO: 1821831 - RNA, 14 nt, Salmonella typhimurium LT2
gcgugguggcguca

SEQ ID NO: 1821832 - RNA, 13 nt, Salmonella typhimurium LT2
aaggaaacgccag

SEQ ID NO: 1821833 - RNA, 17 nt, Salmonella typhimurium LT2
aaggaaacgccaggcac

SEQ ID NO: 1821834 - RNA, 22 nt, Salmonella typhimurium LT2
aagcuuuuaguuacgcacgcca

SEQ ID NO: 1821835 - RNA, 20 nt, Salmonella typhimurium LT2
aagcuuuuaguuacgcacgc

SEQ ID NO: 1821836 - RNA, 21 nt, Salmonella typhimurium LT2
gcgucuacgucaggaaacgcg

SEQ ID NO: 1821837 - RNA, 11 nt, Salmonella typhimurium LT2
gcuggaaacgc

SEQ ID NO: 1821838 - RNA, 22 nt, Salmonella typhimurium LT2
gcuggaaucuaccgccaucggc

SEQ ID NO: 1821839 - RNA, 16 nt, Salmonella typhimurium LT2
gcuggccuccagcacu

SEQ ID NO: 1821840 - RNA, 23 nt, Salmonella typhimurium LT2
gcugauguucauucaacaucgcc

SEQ ID NO: 1821841 - RNA, 15 nt, Salmonella typhimurium LT2
gcugacucgcgcaau

SEQ ID NO: 1821842 - RNA, 16 nt, Salmonella typhimurium LT2
gcugacgcgccuggau

SEQ ID NO: 1821843 - RNA, 14 nt, Salmonella typhimurium LT2
gcugacggcgcgau

SEQ ID NO: 1821844 - RNA, 15 nt, Salmonella typhimurium LT2
gcugccagccagcgg

SEQ ID NO: 1821845 - RNA, 13 nt, Salmonella typhimurium LT2
gcugccuuauccg

SEQ ID NO: 1821846 - RNA, 17 nt, Salmonella typhimurium LT2
gcugccuuauccggccu

SEQ ID NO: 1821847 - RNA, 15 nt, Salmonella typhimurium LT2
gcugcgaagccaccg

SEQ ID NO: 1821848 - RNA, 13 nt, Salmonella typhimurium LT2
gcugcgcagcacu

SEQ ID NO: 1821849 - RNA, 19 nt, Salmonella typhimurium LT2
gcugcgcuuauccggccua

SEQ ID NO: 1821850 - RNA, 17 nt, Salmonella typhimurium LT2
gcugcgcugcggucagg

SEQ ID NO: 1821851 - RNA, 15 nt, Salmonella typhimurium LT2
gcugcgcuuuccagg

SEQ ID NO: 1821852 - RNA, 13 nt, Salmonella typhimurium LT2
gcugcggcacgcu

SEQ ID NO: 1821853 - RNA, 23 nt, Salmonella typhimurium LT2
gcucuucguggaacugcagcgcg

SEQ ID NO: 1821854 - RNA, 17 nt, Salmonella typhimurium LT2
gcucuucgccguuaucg

SEQ ID NO: 1821855 - RNA, 21 nt, Salmonella typhimurium LT2
gcucuucgccguuaucggccu

SEQ ID NO: 1821856 - RNA, 15 nt, Salmonella typhimurium LT2
gcugaacgcggugac

SEQ ID NO: 1821857 - RNA, 15 nt, Salmonella typhimurium LT2
gcugacgccaggcca

SEQ ID NO: 1821858 - RNA, 19 nt, Salmonella typhimurium LT2
gcucguaggccagcgcuuu

SEQ ID NO: 1821859 - RNA, 14 nt, Salmonella typhimurium LT2
gcucguacacgcgc

SEQ ID NO: 1821860 - RNA, 16 nt, Salmonella typhimurium LT2
gcucgucccgcagcau

SEQ ID NO: 1821861 - RNA, 22 nt, Salmonella typhimurium LT2
gcucgcgcuguucgcuuaaccg

SEQ ID NO: 1821862 - RNA, 22 nt, Salmonella typhimurium LT2
gcucgcuggugccaaucuccag

SEQ ID NO: 1821863 - RNA, 19 nt, Salmonella typhimurium LT2
gcucggccagauaacgcgc

SEQ ID NO: 1821864 - RNA, 17 nt, Salmonella typhimurium LT2
gcucgcuguucgccaga

SEQ ID NO: 1821865 - RNA, 22 nt, Salmonella typhimurium LT2
gcucgcuuaaugaggccaccag

SEQ ID NO: 1821866 - RNA, 13 nt, Salmonella typhimurium LT2
gcuccucgcgaau

SEQ ID NO: 1821867 - RNA, 15 nt, Salmonella typhimurium LT2
gcuccucagcgcuua

SEQ ID NO: 1821868 - RNA, 12 nt, Salmonella typhimurium LT2
gcuccuccaauc

SEQ ID NO: 1821869 - RNA, 20 nt, Salmonella typhimurium LT2
gcuccgccggagcaucauuu

SEQ ID NO: 1821870 - RNA, 20 nt, Salmonella typhimurium LT2
gcucacgcuuauccggccua

SEQ ID NO: 1821871 - RNA, 16 nt, Salmonella typhimurium LT2
gcucacgcagggugua

SEQ ID NO: 1821872 - RNA, 21 nt, Salmonella typhimurium LT2
gcgcuuuuucacgaccagcca

SEQ ID NO: 1821873 - RNA, 22 nt, Salmonella typhimurium LT2
gcgcuuuuucacgaccagccaa

SEQ ID NO: 1821874 - RNA, 15 nt, Salmonella typhimurium LT2
gcgcuuuuuccagcg

SEQ ID NO: 1821875 - RNA, 17 nt, Salmonella typhimurium LT2
gcgcuuuuuccagcgca

SEQ ID NO: 1821876 - RNA, 19 nt, Salmonella typhimurium LT2
gcgcuuugggaacuagcga

SEQ ID NO: 1821877 - RNA, 18 nt, Salmonella typhimurium LT2
gcgcuuuucgccagcgca

SEQ ID NO: 1821878 - RNA, 20 nt, Salmonella typhimurium LT2
gcgcuuugcuuauccggccu

SEQ ID NO: 1821879 - RNA, 23 nt, Salmonella typhimurium LT2
gcgcuuugcuuauccggccuaca

SEQ ID NO: 1821880 - RNA, 13 nt, Salmonella typhimurium LT2
gcggaaagccuuc

SEQ ID NO: 1821881 - RNA, 22 nt, Salmonella typhimurium LT2
gcggaaaggacuuaucaggccu

SEQ ID NO: 1821882 - RNA, 20 nt, Salmonella typhimurium LT2
gcggaaccuguucaugccag

SEQ ID NO: 1821883 - RNA, 15 nt, Salmonella typhimurium LT2
gcggaagaucgccau

SEQ ID NO: 1821884 - RNA, 19 nt, Salmonella typhimurium LT2
gcggaagcaaaauagcauu

SEQ ID NO: 1821885 - RNA, 19 nt, Salmonella typhimurium LT2
gcggaaguuaccgcgccag

SEQ ID NO: 1821886 - RNA, 22 nt, Salmonella typhimurium LT2
gcggaauccccgccgccaguaa

SEQ ID NO: 1821887 - RNA, 22 nt, Salmonella typhimurium LT2
gcggaauucccacaucgcgauu

SEQ ID NO: 1821888 - RNA, 18 nt, Salmonella typhimurium LT2
gcggaaugcccacgcuuc

SEQ ID NO: 1821889 - RNA, 23 nt, Salmonella typhimurium LT2
gcgcugguuggcgcgcucgcauu

SEQ ID NO: 1821890 - RNA, 18 nt, Salmonella typhimurium LT2
gcgcuggugacaucgccg

SEQ ID NO: 1821891 - RNA, 21 nt, Salmonella typhimurium LT2
gcgcuucguugagcuuaucgg

SEQ ID NO: 1821892 - RNA, 20 nt, Salmonella typhimurium LT2
gcgcuucgcuuaucgggccu

SEQ ID NO: 1821893 - RNA, 19 nt, Salmonella typhimurium LT2
gcgcuucuuugaagcguuc

SEQ ID NO: 1821894 - RNA, 23 nt, Salmonella typhimurium LT2
gcgcuucuaacaaaacagauuaa

SEQ ID NO: 1821895 - RNA, 19 nt, Salmonella typhimurium LT2
gcgcuuauccggccuacag

SEQ ID NO: 1821896 - RNA, 17 nt, Salmonella typhimurium LT2
gcgcugucgcuuaccgg

SEQ ID NO: 1821897 - RNA, 19 nt, Salmonella typhimurium LT2
gcgcugucgccaucaccag

SEQ ID NO: 1821898 - RNA, 20 nt, Salmonella typhimurium LT2
gcgcuuaccaggccuacacg

SEQ ID NO: 1821899 - RNA, 22 nt, Salmonella typhimurium LT2
gcgcuuagccugcucgaucagc

SEQ ID NO: 1821900 - RNA, 24 nt, Salmonella typhimurium LT2
gcgcuuaucaggccuaccagccga

SEQ ID NO: 1821901 - RNA, 15 nt, Salmonella typhimurium LT2
gcgcuguguccgccu

SEQ ID NO: 1821902 - RNA, 23 nt, Salmonella typhimurium LT2
gcgcuggcgcacgcgucaucggc

SEQ ID NO: 1821903 - RNA, 14 nt, Salmonella typhimurium LT2
gcgcuggcagaucg

SEQ ID NO: 1821904 - RNA, 17 nt, Salmonella typhimurium LT2
gcgcugcggucagggcu

SEQ ID NO: 1821905 - RNA, 16 nt, Salmonella typhimurium LT2
gcgcugcgcuuaccgg

SEQ ID NO: 1821906 - RNA, 17 nt, Salmonella typhimurium LT2
gcgcugcgcuuaucagg

SEQ ID NO: 1821907 - RNA, 16 nt, Salmonella typhimurium LT2
gcgcugcgcuuauccg

SEQ ID NO: 1821908 - RNA, 20 nt, Salmonella typhimurium LT2
gcgcugcgcuuauccggccu

SEQ ID NO: 1821909 - RNA, 14 nt, Salmonella typhimurium LT2
gcgcuggaaagcgg

SEQ ID NO: 1821910 - RNA, 21 nt, Salmonella typhimurium LT2
gcgcugcugcucaaaggcgcu

SEQ ID NO: 1821911 - RNA, 20 nt, Salmonella typhimurium LT2
gcgcuggaaugcgcgcguga

SEQ ID NO: 1821912 - RNA, 19 nt, Salmonella typhimurium LT2
gcgcugcgccaucaggcau

SEQ ID NO: 1821913 - RNA, 18 nt, Salmonella typhimurium LT2
gcgcugcacaaucgccag

SEQ ID NO: 1821914 - RNA, 22 nt, Salmonella typhimurium LT2
gcgcugcacgugugcugcguca

SEQ ID NO: 1821915 - RNA, 18 nt, Salmonella typhimurium LT2
gcgcucguaggccagcgc

SEQ ID NO: 1821916 - RNA, 20 nt, Salmonella typhimurium LT2
gcgcugacaucauccacggc

SEQ ID NO: 1821917 - RNA, 15 nt, Salmonella typhimurium LT2
gcgcucuucgcucca

SEQ ID NO: 1821918 - RNA, 15 nt, Salmonella typhimurium LT2
gcgcucgcucaucac

SEQ ID NO: 1821919 - RNA, 19 nt, Salmonella typhimurium LT2
gcgcucgcuuaucuggccu

SEQ ID NO: 1821920 - RNA, 23 nt, Salmonella typhimurium LT2
gcggcagccaugcuauucagcag

SEQ ID NO: 1821921 - RNA, 11 nt, Salmonella typhimurium LT2
gcggcagcgcg

SEQ ID NO: 1821922 - RNA, 22 nt, Salmonella typhimurium LT2
aagccgggucagcccccaguuu

SEQ ID NO: 1821923 - RNA, 19 nt, Salmonella typhimurium LT2
aagccgauggcccccguuu

SEQ ID NO: 1821924 - RNA, 22 nt, Salmonella typhimurium LT2
gcggcaauuucacugucgccag

SEQ ID NO: 1821925 - RNA, 16 nt, Salmonella typhimurium LT2
gcggcaauggccgcag

SEQ ID NO: 1821926 - RNA, 15 nt, Salmonella typhimurium LT2
aagccgucggcgcca

SEQ ID NO: 1821927 - RNA, 17 nt, Salmonella typhimurium LT2
gcggcaaucgccucauc

SEQ ID NO: 1821928 - RNA, 15 nt, Salmonella typhimurium LT2
gcggcaagcgcgcca

SEQ ID NO: 1821929 - RNA, 19 nt, Salmonella typhimurium LT2
gcggcaaggauaaccauuc

SEQ ID NO: 1821930 - RNA, 18 nt, Salmonella typhimurium LT2
gcggcaagaucauccggg

SEQ ID NO: 1821931 - RNA, 16 nt, Salmonella typhimurium LT2
gcggcaagaucauccg

SEQ ID NO: 1821932 - RNA, 19 nt, Salmonella typhimurium LT2
gcggauugccauacacgcg

SEQ ID NO: 1821933 - RNA, 15 nt, Salmonella typhimurium LT2
gcggauuuuucgcca

SEQ ID NO: 1821934 - RNA, 18 nt, Salmonella typhimurium LT2
gcggaucaaacuccgcgc

SEQ ID NO: 1821935 - RNA, 22 nt, Salmonella typhimurium LT2
gcggaucaaacuccgcgcuggc

SEQ ID NO: 1821936 - RNA, 21 nt, Salmonella typhimurium LT2
gcggauacagcggcgcgccaa

SEQ ID NO: 1821937 - RNA, 20 nt, Salmonella typhimurium LT2
gcggauaagcgcagcgccau

SEQ ID NO: 1821938 - RNA, 24 nt, Salmonella typhimurium LT2
gcggauaaauagugacgccgccau

SEQ ID NO: 1821939 - RNA, 16 nt, Salmonella typhimurium LT2
gcggaugaaacagucc

SEQ ID NO: 1821940 - RNA, 17 nt, Salmonella typhimurium LT2
gcggaugaucgccucuu

SEQ ID NO: 1821941 - RNA, 12 nt, Salmonella typhimurium LT2
gcggaugcgcca

SEQ ID NO: 1821942 - RNA, 15 nt, Salmonella typhimurium LT2
gcggaugcugcgcca

SEQ ID NO: 1821943 - RNA, 17 nt, Salmonella typhimurium LT2
gcggaugcugcgccagc

SEQ ID NO: 1821944 - RNA, 18 nt, Salmonella typhimurium LT2
gcggacggcaaccguccg

SEQ ID NO: 1821945 - RNA, 18 nt, Salmonella typhimurium LT2
gcggagaguucgcggaag

SEQ ID NO: 1821946 - RNA, 13 nt, Salmonella typhimurium LT2
gcggacacggcgu

SEQ ID NO: 1821947 - RNA, 21 nt, Salmonella typhimurium LT2
aagcugguggcgaguccugcc

SEQ ID NO: 1821948 - RNA, 14 nt, Salmonella typhimurium LT2
aagcugggcgucaa

SEQ ID NO: 1821949 - RNA, 20 nt, Salmonella typhimurium LT2
gcggcuagcgccuuauccgg

SEQ ID NO: 1821950 - RNA, 19 nt, Salmonella typhimurium LT2
gcggcuacgccuuacccgg

SEQ ID NO: 1821951 - RNA, 14 nt, Salmonella typhimurium LT2
gcggcucaccagcu

SEQ ID NO: 1821952 - RNA, 14 nt, Salmonella typhimurium LT2
gcggcuuggcugua

SEQ ID NO: 1821953 - RNA, 19 nt, Salmonella typhimurium LT2
gcgggcagaaaaaucagca

SEQ ID NO: 1821954 - RNA, 21 nt, Salmonella typhimurium LT2
gcgggcagcauugaccaccau

SEQ ID NO: 1821955 - RNA, 17 nt, Salmonella typhimurium LT2
gcgggcagaaaaaucag

SEQ ID NO: 1821956 - RNA, 23 nt, Salmonella typhimurium LT2
gcgggcuguuuuccagcggcuuc

SEQ ID NO: 1821957 - RNA, 20 nt, Salmonella typhimurium LT2
gcggucagugauuuccgggu

SEQ ID NO: 1821958 - RNA, 23 nt, Salmonella typhimurium LT2
gcgguaucaaugcgacagcggca

SEQ ID NO: 1821959 - RNA, 18 nt, Salmonella typhimurium LT2
gcgguacuccgccauccg

SEQ ID NO: 1821960 - RNA, 16 nt, Salmonella typhimurium LT2
gcgguacgaaucgccg

SEQ ID NO: 1821961 - RNA, 21 nt, Salmonella typhimurium LT2
gcgguaccggcauuacccagu

SEQ ID NO: 1821962 - RNA, 13 nt, Salmonella typhimurium LT2
gcgguaaaaccgg

SEQ ID NO: 1821963 - RNA, 22 nt, Salmonella typhimurium LT2
gcgguaaaaccuaacgccugca

SEQ ID NO: 1821964 - RNA, 15 nt, Salmonella typhimurium LT2
gcgggugaugcgcca

SEQ ID NO: 1821965 - RNA, 16 nt, Salmonella typhimurium LT2
gcgggugaugcgccag

SEQ ID NO: 1821966 - RNA, 16 nt, Salmonella typhimurium LT2
gcgggugagcgcuauc

SEQ ID NO: 1821967 - RNA, 23 nt, Salmonella typhimurium LT2
gcgggucaacgccaagcgcggca

SEQ ID NO: 1821968 - RNA, 12 nt, Salmonella typhimurium LT2
gcgggucaggaa

SEQ ID NO: 1821969 - RNA, 15 nt, Salmonella typhimurium LT2
gcgggguuugcagau

SEQ ID NO: 1821970 - RNA, 22 nt, Salmonella typhimurium LT2
aagcguugaauuccaucggcau

SEQ ID NO: 1821971 - RNA, 13 nt, Salmonella typhimurium LT2
aagcguuuccaga

SEQ ID NO: 1821972 - RNA, 22 nt, Salmonella typhimurium LT2
aagcuaucuggccugacgacgg

SEQ ID NO: 1821973 - RNA, 21 nt, Salmonella typhimurium LT2
aagcuaucgccaucaacgcca

SEQ ID NO: 1821974 - RNA, 21 nt, Salmonella typhimurium LT2
aagcugcaucccggucaacgu

SEQ ID NO: 1821975 - RNA, 15 nt, Salmonella typhimurium LT2
aagcugacgcgccug

SEQ ID NO: 1821976 - RNA, 22 nt, Salmonella typhimurium LT2
aagcugcgcccgcucugcgcca

SEQ ID NO: 1821977 - RNA, 13 nt, Salmonella typhimurium LT2
gcggcgucgccag

SEQ ID NO: 1821978 - RNA, 12 nt, Salmonella typhimurium LT2
aagcucgcggau

SEQ ID NO: 1821979 - RNA, 20 nt, Salmonella typhimurium LT2
gcggcgaagcaucuuuccgg

SEQ ID NO: 1821980 - RNA, 18 nt, Salmonella typhimurium LT2
gcggcgaauuaaucgucg

SEQ ID NO: 1821981 - RNA, 14 nt, Salmonella typhimurium LT2
gcggccugcgccag

SEQ ID NO: 1821982 - RNA, 19 nt, Salmonella typhimurium LT2
gcggcauuggcguuaccgg

SEQ ID NO: 1821983 - RNA, 21 nt, Salmonella typhimurium LT2
gcggcauuaaaaaaaagagcg

SEQ ID NO: 1821984 - RNA, 23 nt, Salmonella typhimurium LT2
gcggccaaaucgucagccgccag

SEQ ID NO: 1821985 - RNA, 20 nt, Salmonella typhimurium LT2
gccggaaaccuguucccggc

SEQ ID NO: 1821986 - RNA, 20 nt, Salmonella typhimurium LT2
gccgcuugugccgacgucgc

SEQ ID NO: 1821987 - RNA, 21 nt, Salmonella typhimurium LT2
gccggagaguucauagcgcac

SEQ ID NO: 1821988 - RNA, 23 nt, Salmonella typhimurium LT2
gccggagagcauuuguagcggca

SEQ ID NO: 1821989 - RNA, 20 nt, Salmonella typhimurium LT2
gccggagagaugccgccagu

SEQ ID NO: 1821990 - RNA, 21 nt, Salmonella typhimurium LT2
gccggagaaaaagaccgacau

SEQ ID NO: 1821991 - RNA, 17 nt, Salmonella typhimurium LT2
gccggacggcggcugcg

SEQ ID NO: 1821992 - RNA, 18 nt, Salmonella typhimurium LT2
gccggacggcgcagcgcg

SEQ ID NO: 1821993 - RNA, 12 nt, Salmonella typhimurium LT2
gccggaccugcg

SEQ ID NO: 1821994 - RNA, 13 nt, Salmonella typhimurium LT2
gccggcaucauuc

SEQ ID NO: 1821995 - RNA, 23 nt, Salmonella typhimurium LT2
gccggauacgucacgucagcguc

SEQ ID NO: 1821996 - RNA, 17 nt, Salmonella typhimurium LT2
gccggauaaggcgcagc

SEQ ID NO: 1821997 - RNA, 19 nt, Salmonella typhimurium LT2
gccggauaagcguagcgca

SEQ ID NO: 1821998 - RNA, 21 nt, Salmonella typhimurium LT2
gccggauaagcauuagcgcca

SEQ ID NO: 1821999 - RNA, 20 nt, Salmonella typhimurium LT2
gccggauaagcaaagcgcca

SEQ ID NO: 1822000 - RNA, 20 nt, Salmonella typhimurium LT2
gccggauaagcguagcgcca

SEQ ID NO: 1822001 - RNA, 21 nt, Salmonella typhimurium LT2
gccggauaagcgucagcgcca

SEQ ID NO: 1822002 - RNA, 22 nt, Salmonella typhimurium LT2
gccggaugaggcgcagccgcca

SEQ ID NO: 1822003 - RNA, 22 nt, Salmonella typhimurium LT2
gccggaugcaagacuuagccca

SEQ ID NO: 1822004 - RNA, 16 nt, Salmonella typhimurium LT2
gccggauaagcguagc

SEQ ID NO: 1822005 - RNA, 14 nt, Salmonella typhimurium LT2
gccggauuagcgac

SEQ ID NO: 1822006 - RNA, 15 nt, Salmonella typhimurium LT2
gccggauuagcgaca

SEQ ID NO: 1822007 - RNA, 16 nt, Salmonella typhimurium LT2
gccggauggcggcuga

SEQ ID NO: 1822008 - RNA, 17 nt, Salmonella typhimurium LT2
gccggaugugagcgcau

SEQ ID NO: 1822009 - RNA, 15 nt, Salmonella typhimurium LT2
gccggauggcgucgc

SEQ ID NO: 1822010 - RNA, 16 nt, Salmonella typhimurium LT2
gccggaugugagcgca

SEQ ID NO: 1822011 - RNA, 19 nt, Salmonella typhimurium LT2
aagcagcggcgguuauccg

SEQ ID NO: 1822012 - RNA, 22 nt, Salmonella typhimurium LT2
aagcagcggcgguuauccgcca

SEQ ID NO: 1822013 - RNA, 14 nt, Salmonella typhimurium LT2
gccuguuuacggca

SEQ ID NO: 1822014 - RNA, 13 nt, Salmonella typhimurium LT2
gccugucgcgcca

SEQ ID NO: 1822015 - RNA, 22 nt, Salmonella typhimurium LT2
gccuuaaaaagaacaagcugau

SEQ ID NO: 1822016 - RNA, 15 nt, Salmonella typhimurium LT2
gccuuacccggccua

SEQ ID NO: 1822017 - RNA, 14 nt, Salmonella typhimurium LT2
gccuguaaaccgcc

SEQ ID NO: 1822018 - RNA, 20 nt, Salmonella typhimurium LT2
gccuguacuugcgccgccau

SEQ ID NO: 1822019 - RNA, 20 nt, Salmonella typhimurium LT2
gccugguaagcgcagcgcca

SEQ ID NO: 1822020 - RNA, 15 nt, Salmonella typhimurium LT2
gccugggaucgcauc

SEQ ID NO: 1822021 - RNA, 20 nt, Salmonella typhimurium LT2
gccuggcggcagaccgcaac

SEQ ID NO: 1822022 - RNA, 16 nt, Salmonella typhimurium LT2
aagcccaucagcgcca

SEQ ID NO: 1822023 - RNA, 21 nt, Salmonella typhimurium LT2
gccuacaagaucgcaacgugc

SEQ ID NO: 1822024 - RNA, 12 nt, Salmonella typhimurium LT2
gccuaaugacgg

SEQ ID NO: 1822025 - RNA, 22 nt, Salmonella typhimurium LT2
gccuaaugacggacgcagacca

SEQ ID NO: 1822026 - RNA, 14 nt, Salmonella typhimurium LT2
gccuaccagcgcua

SEQ ID NO: 1822027 - RNA, 16 nt, Salmonella typhimurium LT2
gccuaccugccgccau

SEQ ID NO: 1822028 - RNA, 15 nt, Salmonella typhimurium LT2
aagccaugugacggc

SEQ ID NO: 1822029 - RNA, 23 nt, Salmonella typhimurium LT2
aagccauuccccacgccaucgcg

SEQ ID NO: 1822030 - RNA, 22 nt, Salmonella typhimurium LT2
gccugaugcgcguuuagcgcca

SEQ ID NO: 1822031 - RNA, 22 nt, Salmonella typhimurium LT2
gccugacaggagcgccguggaa

SEQ ID NO: 1822032 - RNA, 21 nt, Salmonella typhimurium LT2
gccugcccacuuugccaugaa

SEQ ID NO: 1822033 - RNA, 23 nt, Salmonella typhimurium LT2
gccugauggcgacguuagcgcau

SEQ ID NO: 1822034 - RNA, 19 nt, Salmonella typhimurium LT2
gccugauggcgcagcgcca

SEQ ID NO: 1822035 - RNA, 15 nt, Salmonella typhimurium LT2
gccugaugcugcgca

SEQ ID NO: 1822036 - RNA, 19 nt, Salmonella typhimurium LT2
gccugauggcgcugcgcca

SEQ ID NO: 1822037 - RNA, 15 nt, Salmonella typhimurium LT2
gccugccguccugau

SEQ ID NO: 1822038 - RNA, 23 nt, Salmonella typhimurium LT2
gccugccgccagcaguugcagcg

SEQ ID NO: 1822039 - RNA, 19 nt, Salmonella typhimurium LT2
gccgugaauaaaaccggca

SEQ ID NO: 1822040 - RNA, 21 nt, Salmonella typhimurium LT2
gccgucugguacggccaccag

SEQ ID NO: 1822041 - RNA, 16 nt, Salmonella typhimurium LT2
gccguacuccagccca

SEQ ID NO: 1822042 - RNA, 12 nt, Salmonella typhimurium LT2
gccguagcagaa

SEQ ID NO: 1822043 - RNA, 19 nt, Salmonella typhimurium LT2
gccguaguuauccuucacg

SEQ ID NO: 1822044 - RNA, 17 nt, Salmonella typhimurium LT2
gccguauaccagcguca

SEQ ID NO: 1822045 - RNA, 13 nt, Salmonella typhimurium LT2
gccguccagcacc

SEQ ID NO: 1822046 - RNA, 20 nt, Salmonella typhimurium LT2
gccgguaaagugacggcgcu

SEQ ID NO: 1822047 - RNA, 15 nt, Salmonella typhimurium LT2
gccggugaucccacc

SEQ ID NO: 1822048 - RNA, 20 nt, Salmonella typhimurium LT2
gcgcaaucgggccugcuccg

SEQ ID NO: 1822049 - RNA, 12 nt, Salmonella typhimurium LT2
gcgcaaccggcg

SEQ ID NO: 1822050 - RNA, 13 nt, Salmonella typhimurium LT2
gcgcaacugggaa

SEQ ID NO: 1822051 - RNA, 14 nt, Salmonella typhimurium LT2
gcgauuuuuaggcc

SEQ ID NO: 1822052 - RNA, 14 nt, Salmonella typhimurium LT2
gcgcaaaucgccau

SEQ ID NO: 1822053 - RNA, 18 nt, Salmonella typhimurium LT2
gcgauucauaugcgccaa

SEQ ID NO: 1822054 - RNA, 14 nt, Salmonella typhimurium LT2
gcgauucgcccacg

SEQ ID NO: 1822055 - RNA, 23 nt, Salmonella typhimurium LT2
gcgauugaucggaugaucgucaa

SEQ ID NO: 1822056 - RNA, 17 nt, Salmonella typhimurium LT2
gcgauuugccgcgccuu

SEQ ID NO: 1822057 - RNA, 12 nt, Salmonella typhimurium LT2
gcgaucgcgcca

SEQ ID NO: 1822058 - RNA, 13 nt, Salmonella typhimurium LT2
gcgaucgcgccag

SEQ ID NO: 1822059 - RNA, 16 nt, Salmonella typhimurium LT2
gcgaucgcgauucgcc

SEQ ID NO: 1822060 - RNA, 19 nt, Salmonella typhimurium LT2
gcgaucgccccgaccagga

SEQ ID NO: 1822061 - RNA, 11 nt, Salmonella typhimurium LT2
gcgaucgcggc

SEQ ID NO: 1822062 - RNA, 13 nt, Salmonella typhimurium LT2
gcgaucgcggcaa

SEQ ID NO: 1822063 - RNA, 22 nt, Salmonella typhimurium LT2
gcgaucccaauugaucggccag

SEQ ID NO: 1822064 - RNA, 13 nt, Salmonella typhimurium LT2
gcgaucagcgcca

SEQ ID NO: 1822065 - RNA, 19 nt, Salmonella typhimurium LT2
gcgaucagcucuucgcuuu

SEQ ID NO: 1822066 - RNA, 13 nt, Salmonella typhimurium LT2
gcgaucaccagca

SEQ ID NO: 1822067 - RNA, 21 nt, Salmonella typhimurium LT2
gcgaucaccagcaccgccagc

SEQ ID NO: 1822068 - RNA, 20 nt, Salmonella typhimurium LT2
gcgaucaauuuuuaguucgc

SEQ ID NO: 1822069 - RNA, 23 nt, Salmonella typhimurium LT2
gcgaucgggauuccagugacaau

SEQ ID NO: 1822070 - RNA, 20 nt, Salmonella typhimurium LT2
gcgaccgcaucaaugcccag

SEQ ID NO: 1822071 - RNA, 17 nt, Salmonella typhimurium LT2
gcgaccucuugcgcgac

SEQ ID NO: 1822072 - RNA, 21 nt, Salmonella typhimurium LT2
gcgaccaauauccgcaggcga

SEQ ID NO: 1822073 - RNA, 11 nt, Salmonella typhimurium LT2
gcgaccagcgc

SEQ ID NO: 1822074 - RNA, 18 nt, Salmonella typhimurium LT2
gcgacaccacgcaggcga

SEQ ID NO: 1822075 - RNA, 15 nt, Salmonella typhimurium LT2
gccuuauccggccua

SEQ ID NO: 1822076 - RNA, 13 nt, Salmonella typhimurium LT2
gccuucgccggca

SEQ ID NO: 1822077 - RNA, 13 nt, Salmonella typhimurium LT2
gccuucgccuuca

SEQ ID NO: 1822078 - RNA, 17 nt, Salmonella typhimurium LT2
gcgagaccauauugaag

SEQ ID NO: 1822079 - RNA, 14 nt, Salmonella typhimurium LT2
gcgacguuccgcga

SEQ ID NO: 1822080 - RNA, 22 nt, Salmonella typhimurium LT2
gcgacuacgguaaaccaggcca

SEQ ID NO: 1822081 - RNA, 15 nt, Salmonella typhimurium LT2
gcgacugcugauauu

SEQ ID NO: 1822082 - RNA, 21 nt, Salmonella typhimurium LT2
gcgacggcuaucgucguauua

SEQ ID NO: 1822083 - RNA, 20 nt, Salmonella typhimurium LT2
gcgaggucuggucagcgaug

SEQ ID NO: 1822084 - RNA, 17 nt, Salmonella typhimurium LT2
gcgauaaaccagcccca

SEQ ID NO: 1822085 - RNA, 14 nt, Salmonella typhimurium LT2
gcgauaaacgccag

SEQ ID NO: 1822086 - RNA, 20 nt, Salmonella typhimurium LT2
gcgauaaacgccagcccuuc

SEQ ID NO: 1822087 - RNA, 18 nt, Salmonella typhimurium LT2
gcgauaaacucagcgcca

SEQ ID NO: 1822088 - RNA, 18 nt, Salmonella typhimurium LT2
gcgagguuuuagcguguc

SEQ ID NO: 1822089 - RNA, 18 nt, Salmonella typhimurium LT2
gcgauaaugacgaucaac

SEQ ID NO: 1822090 - RNA, 21 nt, Salmonella typhimurium LT2
gcgauacaaggcaaucugauc

SEQ ID NO: 1822091 - RNA, 21 nt, Salmonella typhimurium LT2
gcgauauuguccgucagcgca

SEQ ID NO: 1822092 - RNA, 20 nt, Salmonella typhimurium LT2
gcgauauguuugcgcgucgg

SEQ ID NO: 1822093 - RNA, 19 nt, Salmonella typhimurium LT2
gcgauaccaguaauacgcc

SEQ ID NO: 1822094 - RNA, 20 nt, Salmonella typhimurium LT2
gcgauacgcacaucaauaaa

SEQ ID NO: 1822095 - RNA, 15 nt, Salmonella typhimurium LT2
gcgauacucucgcag

SEQ ID NO: 1822096 - RNA, 15 nt, Salmonella typhimurium LT2
gcgauacguaggccu

SEQ ID NO: 1822097 - RNA, 19 nt, Salmonella typhimurium LT2
gcgccucgguggccuugua

SEQ ID NO: 1822098 - RNA, 16 nt, Salmonella typhimurium LT2
gcgccucgcugacgcc

SEQ ID NO: 1822099 - RNA, 16 nt, Salmonella typhimurium LT2
gcgccugcuccaccag

SEQ ID NO: 1822100 - RNA, 16 nt, Salmonella typhimurium LT2
gcgccuuauccggccu

SEQ ID NO: 1822101 - RNA, 17 nt, Salmonella typhimurium LT2
gcgccuuauucaggcga

SEQ ID NO: 1822102 - RNA, 14 nt, Salmonella typhimurium LT2
gcgccuucaggcau

SEQ ID NO: 1822103 - RNA, 13 nt, Salmonella typhimurium LT2
gcgccuuccagca

SEQ ID NO: 1822104 - RNA, 21 nt, Salmonella typhimurium LT2
gcgccuucuucgcaaucuccg

SEQ ID NO: 1822105 - RNA, 18 nt, Salmonella typhimurium LT2
gcgccuugcaaaccgggu

SEQ ID NO: 1822106 - RNA, 17 nt, Salmonella typhimurium LT2
gcgccugggauaagcag

SEQ ID NO: 1822107 - RNA, 15 nt, Salmonella typhimurium LT2
gcgcgauacgcagaa

SEQ ID NO: 1822108 - RNA, 15 nt, Salmonella typhimurium LT2
gcgcgaccacgccag

SEQ ID NO: 1822109 - RNA, 23 nt, Salmonella typhimurium LT2
gcgccuuuaauuccgccgggcaa

SEQ ID NO: 1822110 - RNA, 18 nt, Salmonella typhimurium LT2
gcgccgcuuccggcaggu

SEQ ID NO: 1822111 - RNA, 18 nt, Salmonella typhimurium LT2
gcgccgcuuccaggcggu

SEQ ID NO: 1822112 - RNA, 22 nt, Salmonella typhimurium LT2
gcgccgcucaucaccagcagca

SEQ ID NO: 1822113 - RNA, 13 nt, Salmonella typhimurium LT2
gcgccgccagcga

SEQ ID NO: 1822114 - RNA, 15 nt, Salmonella typhimurium LT2
gcgccgccagcgaca

SEQ ID NO: 1822115 - RNA, 15 nt, Salmonella typhimurium LT2
gcgccgccagcgacu

SEQ ID NO: 1822116 - RNA, 18 nt, Salmonella typhimurium LT2
gcgccgcgggcugguagu

SEQ ID NO: 1822117 - RNA, 20 nt, Salmonella typhimurium LT2
gcgccgugaguuucagcauc

SEQ ID NO: 1822118 - RNA, 14 nt, Salmonella typhimurium LT2
gcgccguccugcaa

SEQ ID NO: 1822119 - RNA, 15 nt, Salmonella typhimurium LT2
gcgccuaccgccaua

SEQ ID NO: 1822120 - RNA, 16 nt, Salmonella typhimurium LT2
gcgccguuuacagccg

SEQ ID NO: 1822121 - RNA, 15 nt, Salmonella typhimurium LT2
gcgcauaucuuacgg

SEQ ID NO: 1822122 - RNA, 15 nt, Salmonella typhimurium LT2
gcgcaucaacgccag

SEQ ID NO: 1822123 - RNA, 19 nt, Salmonella typhimurium LT2
gcgcauacugcgaugcgcu

SEQ ID NO: 1822124 - RNA, 22 nt, Salmonella typhimurium LT2
gcgcagucacagauccagacau

SEQ ID NO: 1822125 - RNA, 17 nt, Salmonella typhimurium LT2
gcgcauccggccagcga

SEQ ID NO: 1822126 - RNA, 18 nt, Salmonella typhimurium LT2
gcgcauccgguaaacgcu

SEQ ID NO: 1822127 - RNA, 13 nt, Salmonella typhimurium LT2
gcgcauccggcau

SEQ ID NO: 1822128 - RNA, 19 nt, Salmonella typhimurium LT2
gcgcaucccacaccacacg

SEQ ID NO: 1822129 - RNA, 20 nt, Salmonella typhimurium LT2
gcgccaagcgccucgcugac

SEQ ID NO: 1822130 - RNA, 13 nt, Salmonella typhimurium LT2
gcgcaugcugcca

SEQ ID NO: 1822131 - RNA, 22 nt, Salmonella typhimurium LT2
gcgccacggauggccucugcca

SEQ ID NO: 1822132 - RNA, 20 nt, Salmonella typhimurium LT2
gcgccaauugaugaaccgcu

SEQ ID NO: 1822133 - RNA, 22 nt, Salmonella typhimurium LT2
gcgccagccaaaccacgcgcga

SEQ ID NO: 1822134 - RNA, 15 nt, Salmonella typhimurium LT2
gcgccagccauaacg

SEQ ID NO: 1822135 - RNA, 14 nt, Salmonella typhimurium LT2
gcgccagcccugcg

SEQ ID NO: 1822136 - RNA, 15 nt, Salmonella typhimurium LT2
gcgccagccggauac

SEQ ID NO: 1822137 - RNA, 22 nt, Salmonella typhimurium LT2
gcgccagcuccauagaaaucag

SEQ ID NO: 1822138 - RNA, 21 nt, Salmonella typhimurium LT2
gcgccagcguugaccagccua

SEQ ID NO: 1822139 - RNA, 24 nt, Salmonella typhimurium LT2
gcgccagcgcugacaucauccacg

SEQ ID NO: 1822140 - RNA, 20 nt, Salmonella typhimurium LT2
gcgcccagaggcacgguauu

SEQ ID NO: 1822141 - RNA, 13 nt, Salmonella typhimurium LT2
gcgcccagcgccg

SEQ ID NO: 1822142 - RNA, 22 nt, Salmonella typhimurium LT2
gcgccccaguaacgcgccccag

SEQ ID NO: 1822143 - RNA, 15 nt, Salmonella typhimurium LT2
gcgcccgcgcgccag

SEQ ID NO: 1822144 - RNA, 16 nt, Salmonella typhimurium LT2
gcgccaugcuuuccgg

SEQ ID NO: 1822145 - RNA, 16 nt, Salmonella typhimurium LT2
gcgccaguaacaccga

SEQ ID NO: 1822146 - RNA, 13 nt, Salmonella typhimurium LT2
gcgccaggcagca

SEQ ID NO: 1822147 - RNA, 20 nt, Salmonella typhimurium LT2
gcgcccuauuuggccugcag

SEQ ID NO: 1822148 - RNA, 16 nt, Salmonella typhimurium LT2
gcgcccuccuccagcg

SEQ ID NO: 1822149 - RNA, 19 nt, Salmonella typhimurium LT2
cgcccguuguccgccagcg

SEQ ID NO: 1822150 - RNA, 21 nt, Salmonella typhimurium LT2
cgcccuauuuggccugcagaa

SEQ ID NO: 1822151 - RNA, 17 nt, Salmonella typhimurium LT2
cgcccguacaccugcaa

SEQ ID NO: 1822152 - RNA, 13 nt, Salmonella typhimurium LT2
cgcccguccgcua

SEQ ID NO: 1822153 - RNA, 19 nt, Salmonella typhimurium LT2
cgcccgugacgccaggcag

SEQ ID NO: 1822154 - RNA, 16 nt, Salmonella typhimurium LT2
cgcccugcccgccagg

SEQ ID NO: 1822155 - RNA, 21 nt, Salmonella typhimurium LT2
cgcccugcgccagcauggcgu

SEQ ID NO: 1822156 - RNA, 18 nt, Salmonella typhimurium LT2
cgccgaagccaacgcagu

SEQ ID NO: 1822157 - RNA, 21 nt, Salmonella typhimurium LT2
cgccgaagcugaccagacagu

SEQ ID NO: 1822158 - RNA, 13 nt, Salmonella typhimurium LT2
cgccgaagcggca

SEQ ID NO: 1822159 - RNA, 14 nt, Salmonella typhimurium LT2
cgccgaccauccag

SEQ ID NO: 1822160 - RNA, 13 nt, Salmonella typhimurium LT2
cgccgaccaccag

SEQ ID NO: 1822161 - RNA, 17 nt, Salmonella typhimurium LT2
cgccgacaucgccaccg

SEQ ID NO: 1822162 - RNA, 15 nt, Salmonella typhimurium LT2
cgccgacaucacgca

SEQ ID NO: 1822163 - RNA, 19 nt, Salmonella typhimurium LT2
cgccgaguaauuugaacau

SEQ ID NO: 1822164 - RNA, 13 nt, Salmonella typhimurium LT2
cgcccgccgccag

SEQ ID NO: 1822165 - RNA, 14 nt, Salmonella typhimurium LT2
cgcccgccgccuga

SEQ ID NO: 1822166 - RNA, 17 nt, Salmonella typhimurium LT2
cgcccgccgccugaugc

SEQ ID NO: 1822167 - RNA, 13 nt, Salmonella typhimurium LT2
cgcccgccaucug

SEQ ID NO: 1822168 - RNA, 13 nt, Salmonella typhimurium LT2
cgcccgcagcaaa

SEQ ID NO: 1822169 - RNA, 14 nt, Salmonella typhimurium LT2
cgcccgguaaacgc

SEQ ID NO: 1822170 - RNA, 15 nt, Salmonella typhimurium LT2
cgcccgcucgauagc

SEQ ID NO: 1822171 - RNA, 20 nt, Salmonella typhimurium LT2
cgcccgcguuggcggcuuua

SEQ ID NO: 1822172 - RNA, 20 nt, Salmonella typhimurium LT2
cgcccggcaugacaucagaa

SEQ ID NO: 1822173 - RNA, 12 nt, Salmonella typhimurium LT2
cgcccaggccug

SEQ ID NO: 1822174 - RNA, 18 nt, Salmonella typhimurium LT2
cgcccauacacaccagca

SEQ ID NO: 1822175 - RNA, 19 nt, Salmonella typhimurium LT2
cgcccauacacaccagcag

SEQ ID NO: 1822176 - RNA, 14 nt, Salmonella typhimurium LT2
cgcccccaacugag

SEQ ID NO: 1822177 - RNA, 13 nt, Salmonella typhimurium LT2
cgccccugcgggu

SEQ ID NO: 1822178 - RNA, 16 nt, Salmonella typhimurium LT2
cgccccuugcagcaaa

SEQ ID NO: 1822179 - RNA, 17 nt, Salmonella typhimurium LT2
cgccguguaagagcugg

SEQ ID NO: 1822180 - RNA, 21 nt, Salmonella typhimurium LT2
cgccguguaagagcuggucgg

SEQ ID NO: 1822181 - RNA, 19 nt, Salmonella typhimurium LT2
cgccgugcacuucugcggu

SEQ ID NO: 1822182 - RNA, 16 nt, Salmonella typhimurium LT2
cgccgugacggcguaa

SEQ ID NO: 1822183 - RNA, 23 nt, Salmonella typhimurium LT2
cgccgugacuguucacauccagc

SEQ ID NO: 1822184 - RNA, 20 nt, Salmonella typhimurium LT2
cgccgucggcagccagaccu

SEQ ID NO: 1822185 - RNA, 17 nt, Salmonella typhimurium LT2
cgccugacggcgcuguc

SEQ ID NO: 1822186 - RNA, 13 nt, Salmonella typhimurium LT2
cgccugacugaag

SEQ ID NO: 1822187 - RNA, 18 nt, Salmonella typhimurium LT2
cgccugccaggauccguu

SEQ ID NO: 1822188 - RNA, 17 nt, Salmonella typhimurium LT2
cgccugaauaaucggcg

SEQ ID NO: 1822189 - RNA, 23 nt, Salmonella typhimurium LT2
cgccugaacgcgugguugcguaa

SEQ ID NO: 1822190 - RNA, 21 nt, Salmonella typhimurium LT2
cgccucauugauaccuaaacg

SEQ ID NO: 1822191 - RNA, 17 nt, Salmonella typhimurium LT2
cgccucgcaaaacaugg

SEQ ID NO: 1822192 - RNA, 18 nt, Salmonella typhimurium LT2
cgccucgcgauccgccag

SEQ ID NO: 1822193 - RNA, 17 nt, Salmonella typhimurium LT2
cgccuauguuaugcaca

SEQ ID NO: 1822194 - RNA, 11 nt, Salmonella typhimurium LT2
cgccucaggcg

SEQ ID NO: 1822195 - RNA, 18 nt, Salmonella typhimurium LT2
cgccguuccauuccagaa

SEQ ID NO: 1822196 - RNA, 19 nt, Salmonella typhimurium LT2
cgccguucaaacgguagua

SEQ ID NO: 1822197 - RNA, 20 nt, Salmonella typhimurium LT2
cgccguuaacgcgggcguaa

SEQ ID NO: 1822198 - RNA, 23 nt, Salmonella typhimurium LT2
cgccguucgcauugguaucggca

SEQ ID NO: 1822199 - RNA, 22 nt, Salmonella typhimurium LT2
cgccuaaaaucggguggccuaa

SEQ ID NO: 1822200 - RNA, 13 nt, Salmonella typhimurium LT2
cgccguuuccggu

SEQ ID NO: 1822201 - RNA, 14 nt, Salmonella typhimurium LT2
cgccguuuuaacca

SEQ ID NO: 1822202 - RNA, 19 nt, Salmonella typhimurium LT2
aacacggcggcuagcgcag

SEQ ID NO: 1822203 - RNA, 15 nt, Salmonella typhimurium LT2
aacacggcaugaagc

SEQ ID NO: 1822204 - RNA, 19 nt, Salmonella typhimurium LT2
cgccuacacaaaaucauuc

SEQ ID NO: 1822205 - RNA, 14 nt, Salmonella typhimurium LT2
cgccuaccgccaua

SEQ ID NO: 1822206 - RNA, 23 nt, Salmonella typhimurium LT2
aacagaccgccaugcggcgccau

SEQ ID NO: 1822207 - RNA, 21 nt, Salmonella typhimurium LT2
cgccgcuggucaacacgcggu

SEQ ID NO: 1822208 - RNA, 17 nt, Salmonella typhimurium LT2
cgccgcuuauagcggcc

SEQ ID NO: 1822209 - RNA, 17 nt, Salmonella typhimurium LT2
cgccgcuuuucaggggu

SEQ ID NO: 1822210 - RNA, 18 nt, Salmonella typhimurium LT2
cgccggacugacguugcg

SEQ ID NO: 1822211 - RNA, 23 nt, Salmonella typhimurium LT2
cgccgccucccccucaaucggcg

SEQ ID NO: 1822212 - RNA, 13 nt, Salmonella typhimurium LT2
cgccgcgcaggcg

SEQ ID NO: 1822213 - RNA, 13 nt, Salmonella typhimurium LT2
cgccgcgccaccg

SEQ ID NO: 1822214 - RNA, 17 nt, Salmonella typhimurium LT2
cgccgcgcccagcagca

SEQ ID NO: 1822215 - RNA, 14 nt, Salmonella typhimurium LT2
cgccgcggucgcac

SEQ ID NO: 1822216 - RNA, 18 nt, Salmonella typhimurium LT2
cgccgcggucgcacagaa

SEQ ID NO: 1822217 - RNA, 17 nt, Salmonella typhimurium LT2
cgccgcgggcagcagca

SEQ ID NO: 1822218 - RNA, 17 nt, Salmonella typhimurium LT2
cgcggcguucugcgcca

SEQ ID NO: 1822219 - RNA, 17 nt, Salmonella typhimurium LT2
aacagcagacagccgau

SEQ ID NO: 1822220 - RNA, 17 nt, Salmonella typhimurium LT2
cgcggcgcuacggcgca

SEQ ID NO: 1822221 - RNA, 19 nt, Salmonella typhimurium LT2
cgcggcgcuacggcgcaca

SEQ ID NO: 1822222 - RNA, 19 nt, Salmonella typhimurium LT2
aacagcaccagcagguggu

SEQ ID NO: 1822223 - RNA, 21 nt, Salmonella typhimurium LT2
aacagauguuuacgcugcucc

SEQ ID NO: 1822224 - RNA, 16 nt, Salmonella typhimurium LT2
cgcgggcuucacguug

SEQ ID NO: 1822225 - RNA, 16 nt, Salmonella typhimurium LT2
aacagccugucgccgu

SEQ ID NO: 1822226 - RNA, 17 nt, Salmonella typhimurium LT2
aacaggaggaucgccgc

SEQ ID NO: 1822227 - RNA, 16 nt, Salmonella typhimurium LT2
aacagcuuuauggcga

SEQ ID NO: 1822228 - RNA, 17 nt, Salmonella typhimurium LT2
cgcguaaucgcgaauaa

SEQ ID NO: 1822229 - RNA, 12 nt, Salmonella typhimurium LT2
cgcguaccagcg

SEQ ID NO: 1822230 - RNA, 23 nt, Salmonella typhimurium LT2
cgcguaauuugcgacauggcgac

SEQ ID NO: 1822231 - RNA, 23 nt, Salmonella typhimurium LT2
cgcguaauacgauccucgccauu

SEQ ID NO: 1822232 - RNA, 22 nt, Salmonella typhimurium LT2
cgcgguugacggcuacuccggc

SEQ ID NO: 1822233 - RNA, 14 nt, Salmonella typhimurium LT2
cgcgguggcgcaca

SEQ ID NO: 1822234 - RNA, 16 nt, Salmonella typhimurium LT2
cgcucguaggccagcg

SEQ ID NO: 1822235 - RNA, 13 nt, Salmonella typhimurium LT2
cgcugacaucauc

SEQ ID NO: 1822236 - RNA, 23 nt, Salmonella typhimurium LT2
cgcugacaucauccacggcauca

SEQ ID NO: 1822237 - RNA, 21 nt, Salmonella typhimurium LT2
cgcugaaaaccgcaucaagcc

SEQ ID NO: 1822238 - RNA, 19 nt, Salmonella typhimurium LT2
cgcucuccuacaccaccag

SEQ ID NO: 1822239 - RNA, 13 nt, Salmonella typhimurium LT2
cgcucggcauaca

SEQ ID NO: 1822240 - RNA, 18 nt, Salmonella typhimurium LT2
cgcucgcggaagcgaccg

SEQ ID NO: 1822241 - RNA, 16 nt, Salmonella typhimurium LT2
cgcuccagaccaccag

SEQ ID NO: 1822242 - RNA, 18 nt, Salmonella typhimurium LT2
cgcuccagaccaccagcg

SEQ ID NO: 1822243 - RNA, 13 nt, Salmonella typhimurium LT2
cgcuccagcaguu

SEQ ID NO: 1822244 - RNA, 14 nt, Salmonella typhimurium LT2
cgcuccagcaguuc

SEQ ID NO: 1822245 - RNA, 13 nt, Salmonella typhimurium LT2
cgcucgcccauca

SEQ ID NO: 1822246 - RNA, 13 nt, Salmonella typhimurium LT2
cgcguaucgucag

SEQ ID NO: 1822247 - RNA, 22 nt, Salmonella typhimurium LT2
cgcgucgcagguuaucggccag

SEQ ID NO: 1822248 - RNA, 14 nt, Salmonella typhimurium LT2
cgcgucucccagau

SEQ ID NO: 1822249 - RNA, 16 nt, Salmonella typhimurium LT2
cgcguuaagccccucg

SEQ ID NO: 1822250 - RNA, 18 nt, Salmonella typhimurium LT2
cgcgugguaucgcggcag

SEQ ID NO: 1822251 - RNA, 13 nt, Salmonella typhimurium LT2
cgcguugccgccg

SEQ ID NO: 1822252 - RNA, 12 nt, Salmonella typhimurium LT2
cgcguugccgcc

SEQ ID NO: 1822253 - RNA, 12 nt, Salmonella typhimurium LT2
cgcguugccgca

SEQ ID NO: 1822254 - RNA, 14 nt, Salmonella typhimurium LT2
cgcguucuggcgau

SEQ ID NO: 1822255 - RNA, 14 nt, Salmonella typhimurium LT2
cgcguucagcgccg

SEQ ID NO: 1822256 - RNA, 15 nt, Salmonella typhimurium LT2
cgcuauccaucgccg

SEQ ID NO: 1822257 - RNA, 12 nt, Salmonella typhimurium LT2
cgcuaucaggca

SEQ ID NO: 1822258 - RNA, 18 nt, Salmonella typhimurium LT2
cgcuagcuucagguguua

SEQ ID NO: 1822259 - RNA, 24 nt, Salmonella typhimurium LT2
cgcuacggcgcacaguagcucaua

SEQ ID NO: 1822260 - RNA, 16 nt, Salmonella typhimurium LT2
cgcuacgcuuaucagg

SEQ ID NO: 1822261 - RNA, 20 nt, Salmonella typhimurium LT2
cgcuacgcuuaucaggccug

SEQ ID NO: 1822262 - RNA, 15 nt, Salmonella typhimurium LT2
cgcuacucagcguca

SEQ ID NO: 1822263 - RNA, 18 nt, Salmonella typhimurium LT2
cgcucaagcugggcguua

SEQ ID NO: 1822264 - RNA, 16 nt, Salmonella typhimurium LT2
cgcucaacgauuucgc

SEQ ID NO: 1822265 - RNA, 21 nt, Salmonella typhimurium LT2
cgcuauuguugaugcgcucac

SEQ ID NO: 1822266 - RNA, 13 nt, Salmonella typhimurium LT2
cgcuauuugcgca

SEQ ID NO: 1822267 - RNA, 23 nt, Salmonella typhimurium LT2
cgcuauccgcgcucgccagcaua

SEQ ID NO: 1822268 - RNA, 12 nt, Salmonella typhimurium LT2
cgcuaucgccaa

SEQ ID NO: 1822269 - RNA, 12 nt, Salmonella typhimurium LT2
cgcuaucgccga

SEQ ID NO: 1822270 - RNA, 20 nt, Salmonella typhimurium LT2
cgcuaucucuuccagcgucu

SEQ ID NO: 1822271 - RNA, 22 nt, Salmonella typhimurium LT2
cgcuauggugcgggguuuccgg

SEQ ID NO: 1822272 - RNA, 24 nt, Salmonella typhimurium LT2
cgcucauuaaaccgcgcggcauaa

SEQ ID NO: 1822273 - RNA, 17 nt, Salmonella typhimurium LT2
cgcucaauggcgcgcca

SEQ ID NO: 1822274 - RNA, 19 nt, Salmonella typhimurium LT2
cgcucauacgaucgcgcac

SEQ ID NO: 1822275 - RNA, 15 nt, Salmonella typhimurium LT2
cgcgcgacagagcca

SEQ ID NO: 1822276 - RNA, 21 nt, Salmonella typhimurium LT2
cgcgcgacagagccaacagaa

SEQ ID NO: 1822277 - RNA, 17 nt, Salmonella typhimurium LT2
cgcgccuaccagcgcua

SEQ ID NO: 1822278 - RNA, 23 nt, Salmonella typhimurium LT2
cgcgccgguucucccaccgcgca

SEQ ID NO: 1822279 - RNA, 13 nt, Salmonella typhimurium LT2
cgcgcgcgcguca

SEQ ID NO: 1822280 - RNA, 19 nt, Salmonella typhimurium LT2
cgcgcgccgcuuccggcag

SEQ ID NO: 1822281 - RNA, 18 nt, Salmonella typhimurium LT2
cgcgcuuuuuuggcguag

SEQ ID NO: 1822282 - RNA, 14 nt, Salmonella typhimurium LT2
cgcggaaagccuuc

SEQ ID NO: 1822283 - RNA, 18 nt, Salmonella typhimurium LT2
cgcgcucugggucggcac

SEQ ID NO: 1822284 - RNA, 22 nt, Salmonella typhimurium LT2
cgcgcuccugcucuuccgguac

SEQ ID NO: 1822285 - RNA, 14 nt, Salmonella typhimurium LT2
cgcgcucggcagca

SEQ ID NO: 1822286 - RNA, 16 nt, Salmonella typhimurium LT2
cgcgcuaucgguauca

SEQ ID NO: 1822287 - RNA, 23 nt, Salmonella typhimurium LT2
cgcgcuauucugcuguuccuggu

SEQ ID NO: 1822288 - RNA, 16 nt, Salmonella typhimurium LT2
cgcgcuagugccgcca

SEQ ID NO: 1822289 - RNA, 18 nt, Salmonella typhimurium LT2
cgcgcucaccuccgccac

SEQ ID NO: 1822290 - RNA, 23 nt, Salmonella typhimurium LT2
cgcgcucaccuccgccaccagcg

SEQ ID NO: 1822291 - RNA, 13 nt, Salmonella typhimurium LT2
cgcgcucagcguc

SEQ ID NO: 1822292 - RNA, 14 nt, Salmonella typhimurium LT2
cgcgcucagcgucu

SEQ ID NO: 1822293 - RNA, 22 nt, Salmonella typhimurium LT2
cgcgcucauacgaucgcgcaca

SEQ ID NO: 1822294 - RNA, 13 nt, Salmonella typhimurium LT2
cgcgcgucagcgu

SEQ ID NO: 1822295 - RNA, 15 nt, Salmonella typhimurium LT2
cgcgcgucaacgcca

SEQ ID NO: 1822296 - RNA, 22 nt, Salmonella typhimurium LT2
cgcgccaguuuggugaugcgau

SEQ ID NO: 1822297 - RNA, 21 nt, Salmonella typhimurium LT2
cgcgccacgcagauaucuucc

SEQ ID NO: 1822298 - RNA, 17 nt, Salmonella typhimurium LT2
cgcgcauggcagggcga

SEQ ID NO: 1822299 - RNA, 21 nt, Salmonella typhimurium LT2
cgcgccaaaagaggcagcaaa

SEQ ID NO: 1822300 - RNA, 21 nt, Salmonella typhimurium LT2
cgcgccaccaucgucgccaga

SEQ ID NO: 1822301 - RNA, 23 nt, Salmonella typhimurium LT2
cgcgcaucgggccguccggcaaa

SEQ ID NO: 1822302 - RNA, 16 nt, Salmonella typhimurium LT2
cgcgccgcuuccggca

SEQ ID NO: 1822303 - RNA, 17 nt, Salmonella typhimurium LT2
cgcgccggucgccagca

SEQ ID NO: 1822304 - RNA, 18 nt, Salmonella typhimurium LT2
cgcgccggucgccagcau

SEQ ID NO: 1822305 - RNA, 14 nt, Salmonella typhimurium LT2
cgcgccgccgccug

SEQ ID NO: 1822306 - RNA, 13 nt, Salmonella typhimurium LT2
cgcgccgccgcca

SEQ ID NO: 1822307 - RNA, 18 nt, Salmonella typhimurium LT2
cgcgcccgcuuccgucac

SEQ ID NO: 1822308 - RNA, 22 nt, Salmonella typhimurium LT2
cgcgcccaguuucuucaggcca

SEQ ID NO: 1822309 - RNA, 20 nt, Salmonella typhimurium LT2
cgcgacgcuuaucagcccua

SEQ ID NO: 1822310 - RNA, 16 nt, Salmonella typhimurium LT2
cgccugcgcgccugac

SEQ ID NO: 1822311 - RNA, 22 nt, Salmonella typhimurium LT2
cgccugcuccguccacgcgagc

SEQ ID NO: 1822312 - RNA, 19 nt, Salmonella typhimurium LT2
cgccugcuccaccagcgca

SEQ ID NO: 1822313 - RNA, 17 nt, Salmonella typhimurium LT2
cgcgacggaccggcagc

SEQ ID NO: 1822314 - RNA, 21 nt, Salmonella typhimurium LT2
cgcgacuuaucuuccacgccg

SEQ ID NO: 1822315 - RNA, 16 nt, Salmonella typhimurium LT2
cgcgacuucaaucgcc

SEQ ID NO: 1822316 - RNA, 13 nt, Salmonella typhimurium LT2
cgcgauaucugcc

SEQ ID NO: 1822317 - RNA, 14 nt, Salmonella typhimurium LT2
cgcgauagcgcuga

SEQ ID NO: 1822318 - RNA, 15 nt, Salmonella typhimurium LT2
cgcgauagcgcugag

SEQ ID NO: 1822319 - RNA, 21 nt, Salmonella typhimurium LT2
cgcgauaaaaaacgcccagau

SEQ ID NO: 1822320 - RNA, 12 nt, Salmonella typhimurium LT2
cgcgaugcccca

SEQ ID NO: 1822321 - RNA, 14 nt, Salmonella typhimurium LT2
cgcgaugacggcgc

SEQ ID NO: 1822322 - RNA, 11 nt, Salmonella typhimurium LT2
cgcgcacgccc

SEQ ID NO: 1822323 - RNA, 19 nt, Salmonella typhimurium LT2
cggccucgcccgcgaugau

SEQ ID NO: 1822324 - RNA, 14 nt, Salmonella typhimurium LT2
cggccuaccgcugg

SEQ ID NO: 1822325 - RNA, 18 nt, Salmonella typhimurium LT2
cggcaugucgccagccag

SEQ ID NO: 1822326 - RNA, 15 nt, Salmonella typhimurium LT2
cggcauguccggcga

SEQ ID NO: 1822327 - RNA, 15 nt, Salmonella typhimurium LT2
cggcauggucagcau

SEQ ID NO: 1822328 - RNA, 19 nt, Salmonella typhimurium LT2
cggcauggcguuauggcaa

SEQ ID NO: 1822329 - RNA, 14 nt, Salmonella typhimurium LT2
cggccaccaggccu

SEQ ID NO: 1822330 - RNA, 15 nt, Salmonella typhimurium LT2
cggcagcucgugcag

SEQ ID NO: 1822331 - RNA, 17 nt, Salmonella typhimurium LT2
cggcaggaugaaugacu

SEQ ID NO: 1822332 - RNA, 15 nt, Salmonella typhimurium LT2
cggcaggcagcgcca

SEQ ID NO: 1822333 - RNA, 18 nt, Salmonella typhimurium LT2
cggcaggcccgauaaacg

SEQ ID NO: 1822334 - RNA, 18 nt, Salmonella typhimurium LT2
cggcaucaauaacggcaa

SEQ ID NO: 1822335 - RNA, 23 nt, Salmonella typhimurium LT2
cggcaucaauaacggcaacguca

SEQ ID NO: 1822336 - RNA, 14 nt, Salmonella typhimurium LT2
cggcaucgaacggg

SEQ ID NO: 1822337 - RNA, 16 nt, Salmonella typhimurium LT2
aacaucuuugccgcgu

SEQ ID NO: 1822338 - RNA, 12 nt, Salmonella typhimurium LT2
cggccauaucca

SEQ ID NO: 1822339 - RNA, 16 nt, Salmonella typhimurium LT2
cggaucaccggcauuu

SEQ ID NO: 1822340 - RNA, 20 nt, Salmonella typhimurium LT2
cggauaaggcggagccgcca

SEQ ID NO: 1822341 - RNA, 17 nt, Salmonella typhimurium LT2
cggauaagguguuuacg

SEQ ID NO: 1822342 - RNA, 19 nt, Salmonella typhimurium LT2
cggauaagcgucagcgcca

SEQ ID NO: 1822343 - RNA, 20 nt, Salmonella typhimurium LT2
cggauaagcgucagcgccau

SEQ ID NO: 1822344 - RNA, 21 nt, Salmonella typhimurium LT2
cggauaaggcgcagccgccau

SEQ ID NO: 1822345 - RNA, 16 nt, Salmonella typhimurium LT2
cggauagcguagcgcc

SEQ ID NO: 1822346 - RNA, 18 nt, Salmonella typhimurium LT2
cggauagcguagcgccau

SEQ ID NO: 1822347 - RNA, 23 nt, Salmonella typhimurium LT2
cggauagcucgcuguaccgccau

SEQ ID NO: 1822348 - RNA, 15 nt, Salmonella typhimurium LT2
cggaggggcgauggu

SEQ ID NO: 1822349 - RNA, 19 nt, Salmonella typhimurium LT2
cggauaagcauuagcgcca

SEQ ID NO: 1822350 - RNA, 18 nt, Salmonella typhimurium LT2
cggauaagcgcagcgcca

SEQ ID NO: 1822351 - RNA, 19 nt, Salmonella typhimurium LT2
cggauaaaaacccugccga

SEQ ID NO: 1822352 - RNA, 20 nt, Salmonella typhimurium LT2
cggauaaaaacccugccgaa

SEQ ID NO: 1822353 - RNA, 18 nt, Salmonella typhimurium LT2
cggagccgccauccggca

SEQ ID NO: 1822354 - RNA, 15 nt, Salmonella typhimurium LT2
cggaggagugcgcca

SEQ ID NO: 1822355 - RNA, 23 nt, Salmonella typhimurium LT2
cggaggauauuuauuaguguuau

SEQ ID NO: 1822356 - RNA, 14 nt, Salmonella typhimurium LT2
cggagaacggcaca

SEQ ID NO: 1822357 - RNA, 18 nt, Salmonella typhimurium LT2
cggagauuaacagcgcga

SEQ ID NO: 1822358 - RNA, 20 nt, Salmonella typhimurium LT2
cggagauuaacagcgcgacc

SEQ ID NO: 1822359 - RNA, 21 nt, Salmonella typhimurium LT2
cggagagcauuuguagcggca

SEQ ID NO: 1822360 - RNA, 16 nt, Salmonella typhimurium LT2
cggagagaugccgcca

SEQ ID NO: 1822361 - RNA, 21 nt, Salmonella typhimurium LT2
cggagauauagaccagcgccg

SEQ ID NO: 1822362 - RNA, 16 nt, Salmonella typhimurium LT2
cggacgguaccugaag

SEQ ID NO: 1822363 - RNA, 21 nt, Salmonella typhimurium LT2
cggacugauagcgaggcagca

SEQ ID NO: 1822364 - RNA, 21 nt, Salmonella typhimurium LT2
cggacugggcugauacgccug

SEQ ID NO: 1822365 - RNA, 20 nt, Salmonella typhimurium LT2
cggacgagcgcgucagcgcc

SEQ ID NO: 1822366 - RNA, 12 nt, Salmonella typhimurium LT2
cggacgcaucgc

SEQ ID NO: 1822367 - RNA, 20 nt, Salmonella typhimurium LT2
cgcugagcggcucauccagc

SEQ ID NO: 1822368 - RNA, 16 nt, Salmonella typhimurium LT2
cgcugacgccagccag

SEQ ID NO: 1822369 - RNA, 14 nt, Salmonella typhimurium LT2
cgcugacucaucac

SEQ ID NO: 1822370 - RNA, 14 nt, Salmonella typhimurium LT2
cggcaacaugacau

SEQ ID NO: 1822371 - RNA, 12 nt, Salmonella typhimurium LT2
cggcaacccgcu

SEQ ID NO: 1822372 - RNA, 13 nt, Salmonella typhimurium LT2
cggcaacccgacu

SEQ ID NO: 1822373 - RNA, 21 nt, Salmonella typhimurium LT2
cggcaacgcguuuuuaucgcu

SEQ ID NO: 1822374 - RNA, 21 nt, Salmonella typhimurium LT2
cggcaaccugagcgcgaacgc

SEQ ID NO: 1822375 - RNA, 17 nt, Salmonella typhimurium LT2
cggcaagcaucugauau

SEQ ID NO: 1822376 - RNA, 22 nt, Salmonella typhimurium LT2
cggcaagcguaagguauuuagc

SEQ ID NO: 1822377 - RNA, 20 nt, Salmonella typhimurium LT2
cggcaaugcucugcagguca

SEQ ID NO: 1822378 - RNA, 20 nt, Salmonella typhimurium LT2
cggcaaugccucuuccggua

SEQ ID NO: 1822379 - RNA, 22 nt, Salmonella typhimurium LT2
cggcaaucgccugcaacgcuuu

SEQ ID NO: 1822380 - RNA, 15 nt, Salmonella typhimurium LT2
cggcaauaagcgcca

SEQ ID NO: 1822381 - RNA, 16 nt, Salmonella typhimurium LT2
cggcaauuuccggcga

SEQ ID NO: 1822382 - RNA, 23 nt, Salmonella typhimurium LT2
cggcaauggcuuaguaggcuggc

SEQ ID NO: 1822383 - RNA, 15 nt, Salmonella typhimurium LT2
cggcaauuaccgcca

SEQ ID NO: 1822384 - RNA, 17 nt, Salmonella typhimurium LT2
aacagguugcguaacgc

SEQ ID NO: 1822385 - RNA, 17 nt, Salmonella typhimurium LT2
aacagguuuccggcaga

SEQ ID NO: 1822386 - RNA, 19 nt, Salmonella typhimurium LT2
cggcaccauuggcgcguca

SEQ ID NO: 1822387 - RNA, 18 nt, Salmonella typhimurium LT2
cggcaaagucuucauggu

SEQ ID NO: 1822388 - RNA, 16 nt, Salmonella typhimurium LT2
cggauuucguaccgaa

SEQ ID NO: 1822389 - RNA, 22 nt, Salmonella typhimurium LT2
cggauucucuaacgucagcgcc

SEQ ID NO: 1822390 - RNA, 22 nt, Salmonella typhimurium LT2
cggauugagcgaauccagcgcc

SEQ ID NO: 1822391 - RNA, 15 nt, Salmonella typhimurium LT2
cggaugugagcgcau

SEQ ID NO: 1822392 - RNA, 16 nt, Salmonella typhimurium LT2
cggaugugagcgcauc

SEQ ID NO: 1822393 - RNA, 17 nt, Salmonella typhimurium LT2
cggaugggguaucgcca

SEQ ID NO: 1822394 - RNA, 20 nt, Salmonella typhimurium LT2
cggauggcaguacagggcga

SEQ ID NO: 1822395 - RNA, 23 nt, Salmonella typhimurium LT2
cggauggcgguauaacugccuua

SEQ ID NO: 1822396 - RNA, 17 nt, Salmonella typhimurium LT2
cggauggcgacgcguag

SEQ ID NO: 1822397 - RNA, 15 nt, Salmonella typhimurium LT2
cggaucggaacgcga

SEQ ID NO: 1822398 - RNA, 18 nt, Salmonella typhimurium LT2
cggaucgacggcaacaua

SEQ ID NO: 1822399 - RNA, 13 nt, Salmonella typhimurium LT2
cggaugacgcuuc

SEQ ID NO: 1822400 - RNA, 20 nt, Salmonella typhimurium LT2
cggaugaggcgcagccgcca

SEQ ID NO: 1822401 - RNA, 21 nt, Salmonella typhimurium LT2
cggcgcacacccugcagaccu

SEQ ID NO: 1822402 - RNA, 13 nt, Salmonella typhimurium LT2
cggcgcagggcga

SEQ ID NO: 1822403 - RNA, 16 nt, Salmonella typhimurium LT2
cggcggcacggcguca

SEQ ID NO: 1822404 - RNA, 20 nt, Salmonella typhimurium LT2
cggcgcguaaccguggcacc

SEQ ID NO: 1822405 - RNA, 20 nt, Salmonella typhimurium LT2
cggcgcgggugaugacgcgc

SEQ ID NO: 1822406 - RNA, 23 nt, Salmonella typhimurium LT2
cggcgccgugaguuucagcauca

SEQ ID NO: 1822407 - RNA, 15 nt, Salmonella typhimurium LT2
cggcguagccgccga

SEQ ID NO: 1822408 - RNA, 21 nt, Salmonella typhimurium LT2
cggcgguuauccgccagcgca

SEQ ID NO: 1822409 - RNA, 20 nt, Salmonella typhimurium LT2
cggcguaaaagcgauaaaga

SEQ ID NO: 1822410 - RNA, 22 nt, Salmonella typhimurium LT2
cggcguaaaccccuucaccacu

SEQ ID NO: 1822411 - RNA, 14 nt, Salmonella typhimurium LT2
cggcggcguacagc

SEQ ID NO: 1822412 - RNA, 21 nt, Salmonella typhimurium LT2
cgggcugauauuuucaggcac

SEQ ID NO: 1822413 - RNA, 15 nt, Salmonella typhimurium LT2
cgggcuggcgcguca

SEQ ID NO: 1822414 - RNA, 18 nt, Salmonella typhimurium LT2
cgggcuuacgaguggcga

SEQ ID NO: 1822415 - RNA, 19 nt, Salmonella typhimurium LT2
cgggcuuacgaguggcgau

SEQ ID NO: 1822416 - RNA, 22 nt, Salmonella typhimurium LT2
cgggcuccauagggcagggugc

SEQ ID NO: 1822417 - RNA, 14 nt, Salmonella typhimurium LT2
cgggccugcggcga

SEQ ID NO: 1822418 - RNA, 15 nt, Salmonella typhimurium LT2
cgggcgauaaccucu

SEQ ID NO: 1822419 - RNA, 22 nt, Salmonella typhimurium LT2
cgggcgauagagaccgcuuuag

SEQ ID NO: 1822420 - RNA, 21 nt, Salmonella typhimurium LT2
cgggggcgacaaacagcgccc

SEQ ID NO: 1822421 - RNA, 16 nt, Salmonella typhimurium LT2
cggguaacagcauuga

SEQ ID NO: 1822422 - RNA, 21 nt, Salmonella typhimurium LT2
cggguaaugagaccagcgucg

SEQ ID NO: 1822423 - RNA, 20 nt, Salmonella typhimurium LT2
cggguaaggcgaagccgcca

SEQ ID NO: 1822424 - RNA, 17 nt, Salmonella typhimurium LT2
cgggaacugacagcagu

SEQ ID NO: 1822425 - RNA, 23 nt, Salmonella typhimurium LT2
cggcuuuuugcuuuuuauagcuc

SEQ ID NO: 1822426 - RNA, 13 nt, Salmonella typhimurium LT2
cgggaacaugcau

SEQ ID NO: 1822427 - RNA, 19 nt, Salmonella typhimurium LT2
cgggaaagugguuaacagc

SEQ ID NO: 1822428 - RNA, 15 nt, Salmonella typhimurium LT2
cggcuuucaucauuc

SEQ ID NO: 1822429 - RNA, 20 nt, Salmonella typhimurium LT2
cggcuuuaucgcccguaccg

SEQ ID NO: 1822430 - RNA, 18 nt, Salmonella typhimurium LT2
cggcuugugagcgucgcg

SEQ ID NO: 1822431 - RNA, 16 nt, Salmonella typhimurium LT2
cggcuguucaccacgu

SEQ ID NO: 1822432 - RNA, 12 nt, Salmonella typhimurium LT2
cggcugcggauu

SEQ ID NO: 1822433 - RNA, 23 nt, Salmonella typhimurium LT2
cggcugaccugaacgccuaccgc

SEQ ID NO: 1822434 - RNA, 21 nt, Salmonella typhimurium LT2
cggcugaggcuuugagcguca

SEQ ID NO: 1822435 - RNA, 15 nt, Salmonella typhimurium LT2
cggcugaugcagaua

SEQ ID NO: 1822436 - RNA, 14 nt, Salmonella typhimurium LT2
cgggcaagcgaagc

SEQ ID NO: 1822437 - RNA, 22 nt, Salmonella typhimurium LT2
cgggcagacaugaccgcacagc

SEQ ID NO: 1822438 - RNA, 13 nt, Salmonella typhimurium LT2
cgggcaaugcccg

SEQ ID NO: 1822439 - RNA, 14 nt, Salmonella typhimurium LT2
cgggcaauuucucg

SEQ ID NO: 1822440 - RNA, 18 nt, Salmonella typhimurium LT2
cgacguaacuaucuguuc

SEQ ID NO: 1822441 - RNA, 17 nt, Salmonella typhimurium LT2
cgacgcaacucacgcca

SEQ ID NO: 1822442 - RNA, 15 nt, Salmonella typhimurium LT2
cgacggcaggcggca

SEQ ID NO: 1822443 - RNA, 17 nt, Salmonella typhimurium LT2
cgacggcaggcggcaau

SEQ ID NO: 1822444 - RNA, 16 nt, Salmonella typhimurium LT2
aacacaaucaggcgca

SEQ ID NO: 1822445 - RNA, 18 nt, Salmonella typhimurium LT2
cgacuaccggcaccagca

SEQ ID NO: 1822446 - RNA, 21 nt, Salmonella typhimurium LT2
cgacuacgguaaaccaggcca

SEQ ID NO: 1822447 - RNA, 16 nt, Salmonella typhimurium LT2
cgacguuuucaauauc

SEQ ID NO: 1822448 - RNA, 16 nt, Salmonella typhimurium LT2
cgacugguaacggcga

SEQ ID NO: 1822449 - RNA, 21 nt, Salmonella typhimurium LT2
cgacugucgaaaccagcauaa

SEQ ID NO: 1822450 - RNA, 14 nt, Salmonella typhimurium LT2
cgacuuauccggcc

SEQ ID NO: 1822451 - RNA, 21 nt, Salmonella typhimurium LT2
cgagaacguaaaagacgaagc

SEQ ID NO: 1822452 - RNA, 14 nt, Salmonella typhimurium LT2
cgagaaugucgcca

SEQ ID NO: 1822453 - RNA, 13 nt, Salmonella typhimurium LT2
cgagaaucgccag

SEQ ID NO: 1822454 - RNA, 22 nt, Salmonella typhimurium LT2
cgagaagcccagcucauaggau

SEQ ID NO: 1822455 - RNA, 20 nt, Salmonella typhimurium LT2
cgagaagcccggccacagcg

SEQ ID NO: 1822456 - RNA, 21 nt, Salmonella typhimurium LT2
cgagagaauuaacagcgcgac

SEQ ID NO: 1822457 - RNA, 15 nt, Salmonella typhimurium LT2
cgacgauagucagcg

SEQ ID NO: 1822458 - RNA, 16 nt, Salmonella typhimurium LT2
cgaccugguggcgaac

SEQ ID NO: 1822459 - RNA, 22 nt, Salmonella typhimurium LT2
cgaccguauccgccaccaugau

SEQ ID NO: 1822460 - RNA, 14 nt, Salmonella typhimurium LT2
cgacauaaccggca

SEQ ID NO: 1822461 - RNA, 12 nt, Salmonella typhimurium LT2
cgacauacgcgc

SEQ ID NO: 1822462 - RNA, 17 nt, Salmonella typhimurium LT2
cgaccaacagcaucaca

SEQ ID NO: 1822463 - RNA, 15 nt, Salmonella typhimurium LT2
cgaccacgcccagcu

SEQ ID NO: 1822464 - RNA, 19 nt, Salmonella typhimurium LT2
ccugucgucaccagcaggu

SEQ ID NO: 1822465 - RNA, 13 nt, Salmonella typhimurium LT2
ccugucgcgccau

SEQ ID NO: 1822466 - RNA, 23 nt, Salmonella typhimurium LT2
ccugugauuuauguaccgucauc

SEQ ID NO: 1822467 - RNA, 21 nt, Salmonella typhimurium LT2
ccuguggaaacuccagcggca

SEQ ID NO: 1822468 - RNA, 18 nt, Salmonella typhimurium LT2
ccuguggguucaucgcca

SEQ ID NO: 1822469 - RNA, 15 nt, Salmonella typhimurium LT2
ccugucaucaucaag

SEQ ID NO: 1822470 - RNA, 18 nt, Salmonella typhimurium LT2
ccuguuaugaaacccgcc

SEQ ID NO: 1822471 - RNA, 15 nt, Salmonella typhimurium LT2
ccuguuuacggcagg

SEQ ID NO: 1822472 - RNA, 12 nt, Salmonella typhimurium LT2
ccuucaccacuu

SEQ ID NO: 1822473 - RNA, 20 nt, Salmonella typhimurium LT2
ccuuauccggccuacgagca

SEQ ID NO: 1822474 - RNA, 14 nt, Salmonella typhimurium LT2
ccuuauucagccca

SEQ ID NO: 1822475 - RNA, 16 nt, Salmonella typhimurium LT2
ccuuacgcucgcugau

SEQ ID NO: 1822476 - RNA, 15 nt, Salmonella typhimurium LT2
ccuugaccgccugau

SEQ ID NO: 1822477 - RNA, 20 nt, Salmonella typhimurium LT2
ccuucauauuucaagccgca

SEQ ID NO: 1822478 - RNA, 11 nt, Salmonella typhimurium LT2
ccuuccagcaa

SEQ ID NO: 1822479 - RNA, 19 nt, Salmonella typhimurium LT2
ccuucagguuuuuaagcug

SEQ ID NO: 1822480 - RNA, 17 nt, Salmonella typhimurium LT2
ccuuccggccacuccgc

SEQ ID NO: 1822481 - RNA, 19 nt, Salmonella typhimurium LT2
ccuucgccgccgcugaauu

SEQ ID NO: 1822482 - RNA, 18 nt, Salmonella typhimurium LT2
ccuucgcguuuaucacca

SEQ ID NO: 1822483 - RNA, 14 nt, Salmonella typhimurium LT2
cgaaacaggcggca

SEQ ID NO: 1822484 - RNA, 18 nt, Salmonella typhimurium LT2
cgaaaaugguuuugccca

SEQ ID NO: 1822485 - RNA, 21 nt, Salmonella typhimurium LT2
cgaaacgccuuauccggccua

SEQ ID NO: 1822486 - RNA, 19 nt, Salmonella typhimurium LT2
cgaaagcacuucucgcgca

SEQ ID NO: 1822487 - RNA, 17 nt, Salmonella typhimurium LT2
ccuuuuguuuuugcccc

SEQ ID NO: 1822488 - RNA, 13 nt, Salmonella typhimurium LT2
ccuuucacgccga

SEQ ID NO: 1822489 - RNA, 14 nt, Salmonella typhimurium LT2
ccuuuacgcugccu

SEQ ID NO: 1822490 - RNA, 13 nt, Salmonella typhimurium LT2
ccuuucuucaacg

SEQ ID NO: 1822491 - RNA, 18 nt, Salmonella typhimurium LT2
ccuuucuucaacggcgcc

SEQ ID NO: 1822492 - RNA, 12 nt, Salmonella typhimurium LT2
ccuuucuucacg

SEQ ID NO: 1822493 - RNA, 22 nt, Salmonella typhimurium LT2
ccuuuuagcgcguuaccgcuca

SEQ ID NO: 1822494 - RNA, 13 nt, Salmonella typhimurium LT2
ccuugucguaaua

SEQ ID NO: 1822495 - RNA, 14 nt, Salmonella typhimurium LT2
ccuuguugcggaug

SEQ ID NO: 1822496 - RNA, 16 nt, Salmonella typhimurium LT2
ccuuguaagccggaua

SEQ ID NO: 1822497 - RNA, 14 nt, Salmonella typhimurium LT2
ccuugcaaaccggg

SEQ ID NO: 1822498 - RNA, 19 nt, Salmonella typhimurium LT2
ccuugccgccgcgaugcau

SEQ ID NO: 1822499 - RNA, 18 nt, Salmonella typhimurium LT2
cgaaucacauccgccagc

SEQ ID NO: 1822500 - RNA, 14 nt, Salmonella typhimurium LT2
cgaauaaucgccgg

SEQ ID NO: 1822501 - RNA, 13 nt, Salmonella typhimurium LT2
cgaacgcgcgucg

SEQ ID NO: 1822502 - RNA, 13 nt, Salmonella typhimurium LT2
cgaacgcgaugcg

SEQ ID NO: 1822503 - RNA, 24 nt, Salmonella typhimurium LT2
cgaacggcuuuccagcagccagaa

SEQ ID NO: 1822504 - RNA, 16 nt, Salmonella typhimurium LT2
cgaacgggaucaugau

SEQ ID NO: 1822505 - RNA, 16 nt, Salmonella typhimurium LT2
cgaacggccugaucga

SEQ ID NO: 1822506 - RNA, 15 nt, Salmonella typhimurium LT2
cgaaccacggcuuca

SEQ ID NO: 1822507 - RNA, 12 nt, Salmonella typhimurium LT2
cgaaccaucgac

SEQ ID NO: 1822508 - RNA, 19 nt, Salmonella typhimurium LT2
cgaacauccuugcacgcca

SEQ ID NO: 1822509 - RNA, 13 nt, Salmonella typhimurium LT2
cgaacauuucagc

SEQ ID NO: 1822510 - RNA, 17 nt, Salmonella typhimurium LT2
cgaaccguaaacgccug

SEQ ID NO: 1822511 - RNA, 19 nt, Salmonella typhimurium LT2
cgaaccggcaucggcagcg

SEQ ID NO: 1822512 - RNA, 19 nt, Salmonella typhimurium LT2
cgaacaggcucagcgccac

SEQ ID NO: 1822513 - RNA, 21 nt, Salmonella typhimurium LT2
cgaacagacguuacaucuccu

SEQ ID NO: 1822514 - RNA, 23 nt, Salmonella typhimurium LT2
cgaaaucucgcuaaucaucagcg

SEQ ID NO: 1822515 - RNA, 13 nt, Salmonella typhimurium LT2
cgaaauaaucagg

SEQ ID NO: 1822516 - RNA, 17 nt, Salmonella typhimurium LT2
cgaaauauuaucgccau

SEQ ID NO: 1822517 - RNA, 15 nt, Salmonella typhimurium LT2
cgaaauccaccagcg

SEQ ID NO: 1822518 - RNA, 16 nt, Salmonella typhimurium LT2
cgaaaucaucaauggc

SEQ ID NO: 1822519 - RNA, 14 nt, Salmonella typhimurium LT2
cgaaaucaaagacc

SEQ ID NO: 1822520 - RNA, 14 nt, Salmonella typhimurium LT2
cgaaauugccgccc

SEQ ID NO: 1822521 - RNA, 18 nt, Salmonella typhimurium LT2
cgaaauuuauucaucgau

SEQ ID NO: 1822522 - RNA, 21 nt, Salmonella typhimurium LT2
cgaaauggaucggcuugccuu

SEQ ID NO: 1822523 - RNA, 17 nt, Salmonella typhimurium LT2
cgaacaaacuccagcac

SEQ ID NO: 1822524 - RNA, 19 nt, Salmonella typhimurium LT2
cgaugaucgucgcgaucgc

SEQ ID NO: 1822525 - RNA, 18 nt, Salmonella typhimurium LT2
cgaucguaaucacccgcu

SEQ ID NO: 1822526 - RNA, 17 nt, Salmonella typhimurium LT2
cgaugacgccugccaga

SEQ ID NO: 1822527 - RNA, 21 nt, Salmonella typhimurium LT2
cgauccuuccggcgccuccag

SEQ ID NO: 1822528 - RNA, 17 nt, Salmonella typhimurium LT2
cgauccgaagaacagau

SEQ ID NO: 1822529 - RNA, 17 nt, Salmonella typhimurium LT2
cgauccggcgcgguauu

SEQ ID NO: 1822530 - RNA, 20 nt, Salmonella typhimurium LT2
cgauagcauuuuuacucagc

SEQ ID NO: 1822531 - RNA, 20 nt, Salmonella typhimurium LT2
cgauagcugaagugcggaua

SEQ ID NO: 1822532 - RNA, 15 nt, Salmonella typhimurium LT2
cgauauaagcgccgu

SEQ ID NO: 1822533 - RNA, 15 nt, Salmonella typhimurium LT2
cgaucaccacgccuu

SEQ ID NO: 1822534 - RNA, 15 nt, Salmonella typhimurium LT2
cgaucacagacagau

SEQ ID NO: 1822535 - RNA, 12 nt, Salmonella typhimurium LT2
cgaucaccagcg

SEQ ID NO: 1822536 - RNA, 15 nt, Salmonella typhimurium LT2
cgaucaccagcgcau

SEQ ID NO: 1822537 - RNA, 22 nt, Salmonella typhimurium LT2
cgauacgucccugcuggcgaac

SEQ ID NO: 1822538 - RNA, 15 nt, Salmonella typhimurium LT2
cgauaaucaccagcc

SEQ ID NO: 1822539 - RNA, 12 nt, Salmonella typhimurium LT2
cgauaacgguca

SEQ ID NO: 1822540 - RNA, 13 nt, Salmonella typhimurium LT2
cgauaagcgccgc

SEQ ID NO: 1822541 - RNA, 21 nt, Salmonella typhimurium LT2
cgauaauagccucauccccaa

SEQ ID NO: 1822542 - RNA, 12 nt, Salmonella typhimurium LT2
cgauaaccgaug

SEQ ID NO: 1822543 - RNA, 21 nt, Salmonella typhimurium LT2
cgaucaggcgucagcggcuga

SEQ ID NO: 1822544 - RNA, 20 nt, Salmonella typhimurium LT2
cgaggaaaacgcuucuaccu

SEQ ID NO: 1822545 - RNA, 18 nt, Salmonella typhimurium LT2
cgaggauagugauauagc

SEQ ID NO: 1822546 - RNA, 17 nt, Salmonella typhimurium LT2
cgcagcauaucgccguu

SEQ ID NO: 1822547 - RNA, 14 nt, Salmonella typhimurium LT2
cgcagccagcgccc

SEQ ID NO: 1822548 - RNA, 14 nt, Salmonella typhimurium LT2
cgcagcacaugcaa

SEQ ID NO: 1822549 - RNA, 16 nt, Salmonella typhimurium LT2
cgcagaguacgucgcc

SEQ ID NO: 1822550 - RNA, 21 nt, Salmonella typhimurium LT2
cgcagacgucaacaccuccag

SEQ ID NO: 1822551 - RNA, 22 nt, Salmonella typhimurium LT2
cgcagaccgcguuccaucgcuu

SEQ ID NO: 1822552 - RNA, 18 nt, Salmonella typhimurium LT2
cgcagauaucuuccagcg

SEQ ID NO: 1822553 - RNA, 21 nt, Salmonella typhimurium LT2
cgcagauaccggcgcagcauc

SEQ ID NO: 1822554 - RNA, 21 nt, Salmonella typhimurium LT2
cgcaccuucaacagcucgcca

SEQ ID NO: 1822555 - RNA, 18 nt, Salmonella typhimurium LT2
cgcaccaaaguuaaucag

SEQ ID NO: 1822556 - RNA, 16 nt, Salmonella typhimurium LT2
cgcaagaaacaggcug

SEQ ID NO: 1822557 - RNA, 23 nt, Salmonella typhimurium LT2
cgcaagcauaaaaaacaucaugc

SEQ ID NO: 1822558 - RNA, 19 nt, Salmonella typhimurium LT2
cgaugcucagggcauccgc

SEQ ID NO: 1822559 - RNA, 18 nt, Salmonella typhimurium LT2
cgaugcucagggcauccg

SEQ ID NO: 1822560 - RNA, 17 nt, Salmonella typhimurium LT2
cgauuucaucagcgacg

SEQ ID NO: 1822561 - RNA, 21 nt, Salmonella typhimurium LT2
cgauuucacgaccgccgauaa

SEQ ID NO: 1822562 - RNA, 22 nt, Salmonella typhimurium LT2
cgauuguugacugccagcguug

SEQ ID NO: 1822563 - RNA, 19 nt, Salmonella typhimurium LT2
cgcaaucugcucgacgcgc

SEQ ID NO: 1822564 - RNA, 21 nt, Salmonella typhimurium LT2
cgcaaucucuuccgcccagau

SEQ ID NO: 1822565 - RNA, 21 nt, Salmonella typhimurium LT2
cgcaaucacauacagcacuuc

SEQ ID NO: 1822566 - RNA, 16 nt, Salmonella typhimurium LT2
cgcaaucauuaccgga

SEQ ID NO: 1822567 - RNA, 21 nt, Salmonella typhimurium LT2
cgcaaucuuugccgcaaacgc

SEQ ID NO: 1822568 - RNA, 15 nt, Salmonella typhimurium LT2
cgcaaucuggcgcaa

SEQ ID NO: 1822569 - RNA, 14 nt, Salmonella typhimurium LT2
cgcaauaccggcga

SEQ ID NO: 1822570 - RNA, 21 nt, Salmonella typhimurium LT2
cgcaccacugcuguagcgucu

SEQ ID NO: 1822571 - RNA, 12 nt, Salmonella typhimurium LT2
cgcacaggccug

SEQ ID NO: 1822572 - RNA, 18 nt, Salmonella typhimurium LT2
cgcacaguagcucauagc

SEQ ID NO: 1822573 - RNA, 15 nt, Salmonella typhimurium LT2
cgccaacgccaaccg

SEQ ID NO: 1822574 - RNA, 14 nt, Salmonella typhimurium LT2
cgcauguuccgcua

SEQ ID NO: 1822575 - RNA, 15 nt, Salmonella typhimurium LT2
cgcauuaaaaugaug

SEQ ID NO: 1822576 - RNA, 17 nt, Salmonella typhimurium LT2
cgccacaucguuggccg

SEQ ID NO: 1822577 - RNA, 16 nt, Salmonella typhimurium LT2
cgcauccgguaaacgc

SEQ ID NO: 1822578 - RNA, 17 nt, Salmonella typhimurium LT2
cgcauccuguaccacca

SEQ ID NO: 1822579 - RNA, 18 nt, Salmonella typhimurium LT2
cgcauggacgucgacgcc

SEQ ID NO: 1822580 - RNA, 22 nt, Salmonella typhimurium LT2
cgcauggaagaaaauauaaucu

SEQ ID NO: 1822581 - RNA, 21 nt, Salmonella typhimurium LT2
cgcaucgggucgcgugccgca

SEQ ID NO: 1822582 - RNA, 19 nt, Salmonella typhimurium LT2
cgcagggcgauauccagcg

SEQ ID NO: 1822583 - RNA, 14 nt, Salmonella typhimurium LT2
cgcaggcauccggu

SEQ ID NO: 1822584 - RNA, 20 nt, Salmonella typhimurium LT2
cgcagccuaguucugcgcca

SEQ ID NO: 1822585 - RNA, 18 nt, Salmonella typhimurium LT2
cgcagccggucagcguca

SEQ ID NO: 1822586 - RNA, 15 nt, Salmonella typhimurium LT2
cgcaggacagcgaca

SEQ ID NO: 1822587 - RNA, 21 nt, Salmonella typhimurium LT2
cgcaggauaaagaccggcaca

SEQ ID NO: 1822588 - RNA, 17 nt, Salmonella typhimurium LT2
cgcaggcaacgccguga

SEQ ID NO: 1822589 - RNA, 15 nt, Salmonella typhimurium LT2
cgcaucaagcccaug

SEQ ID NO: 1822590 - RNA, 16 nt, Salmonella typhimurium LT2
cgcaucacuggcguau

SEQ ID NO: 1822591 - RNA, 13 nt, Salmonella typhimurium LT2
cgcauccagccac

SEQ ID NO: 1822592 - RNA, 17 nt, Salmonella typhimurium LT2
cgcauaaugagcgcuug

SEQ ID NO: 1822593 - RNA, 14 nt, Salmonella typhimurium LT2
cgcauacaucgcag

SEQ ID NO: 1822594 - RNA, 16 nt, Salmonella typhimurium LT2
cgcauaauagcgccag

SEQ ID NO: 1822595 - RNA, 18 nt, Salmonella typhimurium LT2
cgcauaauagcgccagaa

SEQ ID NO: 1822596 - RNA, 21 nt, Salmonella typhimurium LT2
cgcauagguugauauaaaacg

SEQ ID NO: 1822597 - RNA, 20 nt, Salmonella typhimurium LT2
cgcauagagaccauagacuc

SEQ ID NO: 1822598 - RNA, 20 nt, Salmonella typhimurium LT2
cgcaguaauuucuugcgcca

SEQ ID NO: 1822599 - RNA, 22 nt, Salmonella typhimurium LT2
cgcaguccagaugcgccagauu

SEQ ID NO: 1822600 - RNA, 19 nt, Salmonella typhimurium LT2
cgcaguuuacgcagcgccu

SEQ ID NO: 1822601 - RNA, 13 nt, Salmonella typhimurium LT2
cgcaguuagcgca

SEQ ID NO: 1822602 - RNA, 19 nt, Salmonella typhimurium LT2
cgcagugaagaauggcgcc

SEQ ID NO: 1822603 - RNA, 17 nt, Salmonella typhimurium LT2
ccguuguugucaauauc

SEQ ID NO: 1822604 - RNA, 17 nt, Salmonella typhimurium LT2
ccguuuuucucaucaag

SEQ ID NO: 1822605 - RNA, 21 nt, Salmonella typhimurium LT2
ccguuucuuuuucgaucagca

SEQ ID NO: 1822606 - RNA, 17 nt, Salmonella typhimurium LT2
ccguuggcuuuaugcac

SEQ ID NO: 1822607 - RNA, 23 nt, Salmonella typhimurium LT2
ccguuggcuugaucaacgccgcg

SEQ ID NO: 1822608 - RNA, 19 nt, Salmonella typhimurium LT2
ccguuggcguaaaucaggc

SEQ ID NO: 1822609 - RNA, 15 nt, Salmonella typhimurium LT2
ccguugcgcccauca

SEQ ID NO: 1822610 - RNA, 19 nt, Salmonella typhimurium LT2
ccguuggauaccacgcaca

SEQ ID NO: 1822611 - RNA, 18 nt, Salmonella typhimurium LT2
ccuacaagaauuuaucgc

SEQ ID NO: 1822612 - RNA, 13 nt, Salmonella typhimurium LT2
ccuaccagacgcg

SEQ ID NO: 1822613 - RNA, 22 nt, Salmonella typhimurium LT2
ccuaccagcgcgccagcgccaa

SEQ ID NO: 1822614 - RNA, 15 nt, Salmonella typhimurium LT2
ccuaagccggcaggc

SEQ ID NO: 1822615 - RNA, 13 nt, Salmonella typhimurium LT2
ccuaacaucauuc

SEQ ID NO: 1822616 - RNA, 19 nt, Salmonella typhimurium LT2
ccuaaaacauuaaucgcca

SEQ ID NO: 1822617 - RNA, 15 nt, Salmonella typhimurium LT2
ccuagaugaaugacu

SEQ ID NO: 1822618 - RNA, 16 nt, Salmonella typhimurium LT2
ccguucaucgguaaua

SEQ ID NO: 1822619 - RNA, 22 nt, Salmonella typhimurium LT2
ccguuaaaugcccgauggcgcu

SEQ ID NO: 1822620 - RNA, 12 nt, Salmonella typhimurium LT2
ccguuaucggcc

SEQ ID NO: 1822621 - RNA, 18 nt, Salmonella typhimurium LT2
ccguuaucggccugcuca

SEQ ID NO: 1822622 - RNA, 18 nt, Salmonella typhimurium LT2
ccguguggucgcggcuca

SEQ ID NO: 1822623 - RNA, 17 nt, Salmonella typhimurium LT2
ccguugagaauggcggg

SEQ ID NO: 1822624 - RNA, 15 nt, Salmonella typhimurium LT2
ccguuccugccguca

SEQ ID NO: 1822625 - RNA, 22 nt, Salmonella typhimurium LT2
ccguugccuggcgacccauacc

SEQ ID NO: 1822626 - RNA, 18 nt, Salmonella typhimurium LT2
ccuccggcgagcgaugcu

SEQ ID NO: 1822627 - RNA, 18 nt, Salmonella typhimurium LT2
ccuccggcuaugccggag

SEQ ID NO: 1822628 - RNA, 22 nt, Salmonella typhimurium LT2
ccuaggguggacaugauaagcg

SEQ ID NO: 1822629 - RNA, 17 nt, Salmonella typhimurium LT2
ccucaugcuuaucgcca

SEQ ID NO: 1822630 - RNA, 12 nt, Salmonella typhimurium LT2
ccucauccgcau

SEQ ID NO: 1822631 - RNA, 21 nt, Salmonella typhimurium LT2
ccucauaaauagccagcauca

SEQ ID NO: 1822632 - RNA, 10 nt, Salmonella typhimurium LT2
ccucaauaua

SEQ ID NO: 1822633 - RNA, 17 nt, Salmonella typhimurium LT2
ccucaggcgcacgaccu

SEQ ID NO: 1822634 - RNA, 11 nt, Salmonella typhimurium LT2
ccguaauccaa

SEQ ID NO: 1822635 - RNA, 21 nt, Salmonella typhimurium LT2
ccguaacgugcuccagcgccu

SEQ ID NO: 1822636 - RNA, 16 nt, Salmonella typhimurium LT2
ccguacuccagcccau

SEQ ID NO: 1822637 - RNA, 15 nt, Salmonella typhimurium LT2
ccguacggcgucgug

SEQ ID NO: 1822638 - RNA, 19 nt, Salmonella typhimurium LT2
ccgucauauagccgcgcag

SEQ ID NO: 1822639 - RNA, 11 nt, Salmonella typhimurium LT2
ccguccagcac

SEQ ID NO: 1822640 - RNA, 20 nt, Salmonella typhimurium LT2
ccgugaauaaaaccggcaua

SEQ ID NO: 1822641 - RNA, 20 nt, Salmonella typhimurium LT2
ccgucuuuuagcaucaggac

SEQ ID NO: 1822642 - RNA, 22 nt, Salmonella typhimurium LT2
ccgugaaauuuccuccgccgau

SEQ ID NO: 1822643 - RNA, 19 nt, Salmonella typhimurium LT2
ccggguauucaucggcaca

SEQ ID NO: 1822644 - RNA, 18 nt, Salmonella typhimurium LT2
ccggugaaaaacaucggc

SEQ ID NO: 1822645 - RNA, 21 nt, Salmonella typhimurium LT2
ccgguuuuuuuaugccgcuua

SEQ ID NO: 1822646 - RNA, 19 nt, Salmonella typhimurium LT2
ccgguuugcgguaugcguu

SEQ ID NO: 1822647 - RNA, 18 nt, Salmonella typhimurium LT2
ccguaacgccgucggcag

SEQ ID NO: 1822648 - RNA, 12 nt, Salmonella typhimurium LT2
ccguaaacaggc

SEQ ID NO: 1822649 - RNA, 13 nt, Salmonella typhimurium LT2
ccguaacgaacgc

SEQ ID NO: 1822650 - RNA, 16 nt, Salmonella typhimurium LT2
ccgguuauaccgccau

SEQ ID NO: 1822651 - RNA, 19 nt, Salmonella typhimurium LT2
ccgguuagcgccgcguggc

SEQ ID NO: 1822652 - RNA, 20 nt, Salmonella typhimurium LT2
ccgguggcgguaccggcauu

SEQ ID NO: 1822653 - RNA, 12 nt, Salmonella typhimurium LT2
ccggcgccugaa

SEQ ID NO: 1822654 - RNA, 15 nt, Salmonella typhimurium LT2
ccgcuuuaagcgcug

SEQ ID NO: 1822655 - RNA, 16 nt, Salmonella typhimurium LT2
ccgcuuuaaucaccau

SEQ ID NO: 1822656 - RNA, 15 nt, Salmonella typhimurium LT2
ccgcuuucccggcau

SEQ ID NO: 1822657 - RNA, 21 nt, Salmonella typhimurium LT2
ccgcuuuuccugcugccaucg

SEQ ID NO: 1822658 - RNA, 21 nt, Salmonella typhimurium LT2
ccggcaugaagacguucuauc

SEQ ID NO: 1822659 - RNA, 14 nt, Salmonella typhimurium LT2
ccggcauucgcaca

SEQ ID NO: 1822660 - RNA, 14 nt, Salmonella typhimurium LT2
ccgggauaaucagg

SEQ ID NO: 1822661 - RNA, 15 nt, Salmonella typhimurium LT2
ccggcuuauccggcc

SEQ ID NO: 1822662 - RNA, 22 nt, Salmonella typhimurium LT2
ccgggagagaguugagccagau

SEQ ID NO: 1822663 - RNA, 21 nt, Salmonella typhimurium LT2
ccggcuuaccggcuaucagcc

SEQ ID NO: 1822664 - RNA, 12 nt, Salmonella typhimurium LT2
aaauuccggcac

SEQ ID NO: 1822665 - RNA, 22 nt, Salmonella typhimurium LT2
aaauugaccucaugcuuaucgc

SEQ ID NO: 1822666 - RNA, 23 nt, Salmonella typhimurium LT2
ccggcgggguuuuuuuaugcguu

SEQ ID NO: 1822667 - RNA, 14 nt, Salmonella typhimurium LT2
ccggcguagcgcgc

SEQ ID NO: 1822668 - RNA, 19 nt, Salmonella typhimurium LT2
ccggcguccggcgccugaa

SEQ ID NO: 1822669 - RNA, 22 nt, Salmonella typhimurium LT2
ccggcgucgcguucagcgccgg

SEQ ID NO: 1822670 - RNA, 21 nt, Salmonella typhimurium LT2
ccggcgugugucccggacaau

SEQ ID NO: 1822671 - RNA, 16 nt, Salmonella typhimurium LT2
ccggcguguaaaccgc

SEQ ID NO: 1822672 - RNA, 20 nt, Salmonella typhimurium LT2
ccgcuguuuagccccacauu

SEQ ID NO: 1822673 - RNA, 14 nt, Salmonella typhimurium LT2
ccgcuuccggcagg

SEQ ID NO: 1822674 - RNA, 16 nt, Salmonella typhimurium LT2
ccgcuucgucgccauc

SEQ ID NO: 1822675 - RNA, 14 nt, Salmonella typhimurium LT2
ccgcugucgccaga

SEQ ID NO: 1822676 - RNA, 20 nt, Salmonella typhimurium LT2
ccgcugguugccuuccugau

SEQ ID NO: 1822677 - RNA, 17 nt, Salmonella typhimurium LT2
ccgcguuucucgccggu

SEQ ID NO: 1822678 - RNA, 20 nt, Salmonella typhimurium LT2
ccgcguucgcauauucugcg

SEQ ID NO: 1822679 - RNA, 15 nt, Salmonella typhimurium LT2
ccgcggccuuaaccu

SEQ ID NO: 1822680 - RNA, 11 nt, Salmonella typhimurium LT2
ccgcgccggac

SEQ ID NO: 1822681 - RNA, 17 nt, Salmonella typhimurium LT2
ccgcgaugaucgucgcg

SEQ ID NO: 1822682 - RNA, 23 nt, Salmonella typhimurium LT2
ccgcgacaugguuuccagcgaau

SEQ ID NO: 1822683 - RNA, 18 nt, Salmonella typhimurium LT2
ccgccugaugcuggcaga

SEQ ID NO: 1822684 - RNA, 13 nt, Salmonella typhimurium LT2
ccgccugccagau

SEQ ID NO: 1822685 - RNA, 16 nt, Salmonella typhimurium LT2
ccgccguuaaccgucu

SEQ ID NO: 1822686 - RNA, 18 nt, Salmonella typhimurium LT2
aaauggucggucacgcga

SEQ ID NO: 1822687 - RNA, 22 nt, Salmonella typhimurium LT2
aaaugacgccggguaaacgcag

SEQ ID NO: 1822688 - RNA, 22 nt, Salmonella typhimurium LT2
ccgccggcgaggauaauacgaa

SEQ ID NO: 1822689 - RNA, 23 nt, Salmonella typhimurium LT2
ccgccgcuuuaucguaaccgaug

SEQ ID NO: 1822690 - RNA, 22 nt, Salmonella typhimurium LT2
ccgcagcgccuuaccguaugca

SEQ ID NO: 1822691 - RNA, 21 nt, Salmonella typhimurium LT2
ccgcagcgccgacguuaucgc

SEQ ID NO: 1822692 - RNA, 21 nt, Salmonella typhimurium LT2
ccgccaaucaacgccgccagg

SEQ ID NO: 1822693 - RNA, 18 nt, Salmonella typhimurium LT2
ccgccaauuccugccaga

SEQ ID NO: 1822694 - RNA, 19 nt, Salmonella typhimurium LT2
ccgccagcgugacccagac

SEQ ID NO: 1822695 - RNA, 15 nt, Salmonella typhimurium LT2
ccgccagcgucgcca

SEQ ID NO: 1822696 - RNA, 15 nt, Salmonella typhimurium LT2
ccgccagcguaucgc

SEQ ID NO: 1822697 - RNA, 11 nt, Salmonella typhimurium LT2
ccgccagccag

SEQ ID NO: 1822698 - RNA, 12 nt, Salmonella typhimurium LT2
ccgccauggcga

SEQ ID NO: 1822699 - RNA, 17 nt, Salmonella typhimurium LT2
ccgccaucggcgcguaa

SEQ ID NO: 1822700 - RNA, 17 nt, Salmonella typhimurium LT2
ccgccaucuccggcagc

SEQ ID NO: 1822701 - RNA, 17 nt, Salmonella typhimurium LT2
ccgcaaccaaagccggc

SEQ ID NO: 1822702 - RNA, 23 nt, Salmonella typhimurium LT2
ccgauuuugucggaauuuccggg

SEQ ID NO: 1822703 - RNA, 20 nt, Salmonella typhimurium LT2
ccgauuucacgaccgccgau

SEQ ID NO: 1822704 - RNA, 15 nt, Salmonella typhimurium LT2
ccgauuucagcgugg

SEQ ID NO: 1822705 - RNA, 16 nt, Salmonella typhimurium LT2
ccgauuucagcguggc

SEQ ID NO: 1822706 - RNA, 22 nt, Salmonella typhimurium LT2
ccgcaagcggcaaucgccucau

SEQ ID NO: 1822707 - RNA, 23 nt, Salmonella typhimurium LT2
ccgcaagcauaaaaaacaucaug

SEQ ID NO: 1822708 - RNA, 20 nt, Salmonella typhimurium LT2
ccgcaauacagcccgccagc

SEQ ID NO: 1822709 - RNA, 17 nt, Salmonella typhimurium LT2
ccgcaauacgcuucaua

SEQ ID NO: 1822710 - RNA, 12 nt, Salmonella typhimurium LT2
ccgcagcgccau

SEQ ID NO: 1822711 - RNA, 22 nt, Salmonella typhimurium LT2
ccgcagcacccguucgcugcau

SEQ ID NO: 1822712 - RNA, 19 nt, Salmonella typhimurium LT2
ccgcagauauuuccggcaa

SEQ ID NO: 1822713 - RNA, 20 nt, Salmonella typhimurium LT2
ccgcacgguuagccggaaga

SEQ ID NO: 1822714 - RNA, 17 nt, Salmonella typhimurium LT2
ccgauaauuaagccggu

SEQ ID NO: 1822715 - RNA, 18 nt, Salmonella typhimurium LT2
ccgauaagcaagcgccau

SEQ ID NO: 1822716 - RNA, 18 nt, Salmonella typhimurium LT2
ccgauaauacgcgcgauu

SEQ ID NO: 1822717 - RNA, 14 nt, Salmonella typhimurium LT2
ccgauaaucaccag

SEQ ID NO: 1822718 - RNA, 14 nt, Salmonella typhimurium LT2
ccgauaaacgccag

SEQ ID NO: 1822719 - RNA, 19 nt, Salmonella typhimurium LT2
ccgauaagcaaagcgccau

SEQ ID NO: 1822720 - RNA, 11 nt, Salmonella typhimurium LT2
ccgaucaggcc

SEQ ID NO: 1822721 - RNA, 13 nt, Salmonella typhimurium LT2
ccgaucacggcga

SEQ ID NO: 1822722 - RNA, 23 nt, Salmonella typhimurium LT2
ccgauauugccuucacccagacu

SEQ ID NO: 1822723 - RNA, 16 nt, Salmonella typhimurium LT2
ccgaucaccagcgcau

SEQ ID NO: 1822724 - RNA, 21 nt, Salmonella typhimurium LT2
ccgauauauugucggccugau

SEQ ID NO: 1822725 - RNA, 16 nt, Salmonella typhimurium LT2
ccgauaguguaaacgc

SEQ ID NO: 1822726 - RNA, 14 nt, Salmonella typhimurium LT2
ccgaugcccagcuu

SEQ ID NO: 1822727 - RNA, 11 nt, Salmonella typhimurium LT2
ccgaugcacau

SEQ ID NO: 1822728 - RNA, 20 nt, Salmonella typhimurium LT2
cacuggugacaucgccaacg

SEQ ID NO: 1822729 - RNA, 22 nt, Salmonella typhimurium LT2
cacuggucgucugaaagcgacu

SEQ ID NO: 1822730 - RNA, 13 nt, Salmonella typhimurium LT2
cagaaaaccggca

SEQ ID NO: 1822731 - RNA, 21 nt, Salmonella typhimurium LT2
cagaaucacggccgaggcagc

SEQ ID NO: 1822732 - RNA, 19 nt, Salmonella typhimurium LT2
cagaaucagauccgcguca

SEQ ID NO: 1822733 - RNA, 14 nt, Salmonella typhimurium LT2
cagaaucagugacc

SEQ ID NO: 1822734 - RNA, 13 nt, Salmonella typhimurium LT2
cagaccaccagcg

SEQ ID NO: 1822735 - RNA, 16 nt, Salmonella typhimurium LT2
cagaccaccagcgaca

SEQ ID NO: 1822736 - RNA, 14 nt, Salmonella typhimurium LT2
cagaauaaacggca

SEQ ID NO: 1822737 - RNA, 13 nt, Salmonella typhimurium LT2
cagacccgcaaua

SEQ ID NO: 1822738 - RNA, 16 nt, Salmonella typhimurium LT2
cagacccagacggcga

SEQ ID NO: 1822739 - RNA, 15 nt, Salmonella typhimurium LT2
cagacgccugccguu

SEQ ID NO: 1822740 - RNA, 21 nt, Salmonella typhimurium LT2
cagacgaauaaucucaucgcc

SEQ ID NO: 1822741 - RNA, 22 nt, Salmonella typhimurium LT2
cagaccgcuuaacuccggcgac

SEQ ID NO: 1822742 - RNA, 23 nt, Salmonella typhimurium LT2
cagaccgccaagcgcggacagca

SEQ ID NO: 1822743 - RNA, 16 nt, Salmonella typhimurium LT2
cagacgggccaggcga

SEQ ID NO: 1822744 - RNA, 17 nt, Salmonella typhimurium LT2
cagacugugauggcggu

SEQ ID NO: 1822745 - RNA, 18 nt, Salmonella typhimurium LT2
cagacuguggccgguaua

SEQ ID NO: 1822746 - RNA, 18 nt, Salmonella typhimurium LT2
cagacuucaaugccgcac

SEQ ID NO: 1822747 - RNA, 16 nt, Salmonella typhimurium LT2
cagagcccagcgcgau

SEQ ID NO: 1822748 - RNA, 16 nt, Salmonella typhimurium LT2
cagagccggauggcga

SEQ ID NO: 1822749 - RNA, 18 nt, Salmonella typhimurium LT2
cacguuaucugaccuaca

SEQ ID NO: 1822750 - RNA, 22 nt, Salmonella typhimurium LT2
cacguagccagagcgcgcuggc

SEQ ID NO: 1822751 - RNA, 15 nt, Salmonella typhimurium LT2
cacgucauaacgcgc

SEQ ID NO: 1822752 - RNA, 17 nt, Salmonella typhimurium LT2
cacgucauaacgcgcau

SEQ ID NO: 1822753 - RNA, 18 nt, Salmonella typhimurium LT2
cacuaccauuuccggcgc

SEQ ID NO: 1822754 - RNA, 19 nt, Salmonella typhimurium LT2
cacuacuucuucaguuccg

SEQ ID NO: 1822755 - RNA, 20 nt, Salmonella typhimurium LT2
cacuacacagggucgucaaa

SEQ ID NO: 1822756 - RNA, 15 nt, Salmonella typhimurium LT2
cacguucagcgcggu

SEQ ID NO: 1822757 - RNA, 12 nt, Salmonella typhimurium LT2
cacugaccugcu

SEQ ID NO: 1822758 - RNA, 22 nt, Salmonella typhimurium LT2
cacugccgacgcccucaauauc

SEQ ID NO: 1822759 - RNA, 15 nt, Salmonella typhimurium LT2
cacgcuuuucagcgc

SEQ ID NO: 1822760 - RNA, 21 nt, Salmonella typhimurium LT2
cacgcuuuuccuuccagcgca

SEQ ID NO: 1822761 - RNA, 22 nt, Salmonella typhimurium LT2
cacggaacaacgcaacacaggc

SEQ ID NO: 1822762 - RNA, 17 nt, Salmonella typhimurium LT2
cacggagagcggcugga

SEQ ID NO: 1822763 - RNA, 16 nt, Salmonella typhimurium LT2
cacgcugauacguaac

SEQ ID NO: 1822764 - RNA, 23 nt, Salmonella typhimurium LT2
cacgcugacugcauaauggugga

SEQ ID NO: 1822765 - RNA, 17 nt, Salmonella typhimurium LT2
cacggcauucacgucgc

SEQ ID NO: 1822766 - RNA, 20 nt, Salmonella typhimurium LT2
cacggauauuuaccgccgcu

SEQ ID NO: 1822767 - RNA, 13 nt, Salmonella typhimurium LT2
cacgcuaacgucc

SEQ ID NO: 1822768 - RNA, 17 nt, Salmonella typhimurium LT2
cacgcggccuccggcgc

SEQ ID NO: 1822769 - RNA, 16 nt, Salmonella typhimurium LT2
caccguuauccggcaa

SEQ ID NO: 1822770 - RNA, 16 nt, Salmonella typhimurium LT2
cacgcgcgaaggcgac

SEQ ID NO: 1822771 - RNA, 15 nt, Salmonella typhimurium LT2
aaacuggcuaucgcc

SEQ ID NO: 1822772 - RNA, 21 nt, Salmonella typhimurium LT2
cacggcgccaugauccagcgg

SEQ ID NO: 1822773 - RNA, 13 nt, Salmonella typhimurium LT2
cacggcuggcaau

SEQ ID NO: 1822774 - RNA, 12 nt, Salmonella typhimurium LT2
cacggcgucaaa

SEQ ID NO: 1822775 - RNA, 21 nt, Salmonella typhimurium LT2
cacguaacucggcagcgcgac

SEQ ID NO: 1822776 - RNA, 22 nt, Salmonella typhimurium LT2
cacguacggcgagaccaccguu

SEQ ID NO: 1822777 - RNA, 23 nt, Salmonella typhimurium LT2
cacgguucacggccaaagcgcga

SEQ ID NO: 1822778 - RNA, 14 nt, Salmonella typhimurium LT2
cacggggcggcaau

SEQ ID NO: 1822779 - RNA, 18 nt, Salmonella typhimurium LT2
cacgggcuuaaucaguuc

SEQ ID NO: 1822780 - RNA, 13 nt, Salmonella typhimurium LT2
cagcaucaccaua

SEQ ID NO: 1822781 - RNA, 14 nt, Salmonella typhimurium LT2
cagcauacgccgcu

SEQ ID NO: 1822782 - RNA, 20 nt, Salmonella typhimurium LT2
cagcaucaauagcagcuuca

SEQ ID NO: 1822783 - RNA, 13 nt, Salmonella typhimurium LT2
cagcauaaacauc

SEQ ID NO: 1822784 - RNA, 20 nt, Salmonella typhimurium LT2
cagcaguagccacgguaaca

SEQ ID NO: 1822785 - RNA, 14 nt, Salmonella typhimurium LT2
cagcagcgacguaa

SEQ ID NO: 1822786 - RNA, 18 nt, Salmonella typhimurium LT2
cagccacacugcuguguc

SEQ ID NO: 1822787 - RNA, 21 nt, Salmonella typhimurium LT2
cagccacaagagcagcaaccc

SEQ ID NO: 1822788 - RNA, 21 nt, Salmonella typhimurium LT2
cagccacuggcuggucagcgu

SEQ ID NO: 1822789 - RNA, 14 nt, Salmonella typhimurium LT2
cagccacugcgcca

SEQ ID NO: 1822790 - RNA, 20 nt, Salmonella typhimurium LT2
cagccagcagcucaacggca

SEQ ID NO: 1822791 - RNA, 21 nt, Salmonella typhimurium LT2
cagccacuucuuccagcggca

SEQ ID NO: 1822792 - RNA, 20 nt, Salmonella typhimurium LT2
cagccagaaacgguccuggu

SEQ ID NO: 1822793 - RNA, 15 nt, Salmonella typhimurium LT2
cagauaaucaaacgc

SEQ ID NO: 1822794 - RNA, 21 nt, Salmonella typhimurium LT2
cagauacacgcccucucgcca

SEQ ID NO: 1822795 - RNA, 13 nt, Salmonella typhimurium LT2
cagauagcgcugc

SEQ ID NO: 1822796 - RNA, 12 nt, Salmonella typhimurium LT2
cagauagcgcau

SEQ ID NO: 1822797 - RNA, 17 nt, Salmonella typhimurium LT2
cagcacaaucccggcac

SEQ ID NO: 1822798 - RNA, 17 nt, Salmonella typhimurium LT2
cagcacaaugacauccg

SEQ ID NO: 1822799 - RNA, 14 nt, Salmonella typhimurium LT2
cagcaacgccagcg

SEQ ID NO: 1822800 - RNA, 20 nt, Salmonella typhimurium LT2
cagcacagcgaugaugauua

SEQ ID NO: 1822801 - RNA, 17 nt, Salmonella typhimurium LT2
cagcacaauggucagcg

SEQ ID NO: 1822802 - RNA, 20 nt, Salmonella typhimurium LT2
cagcacaauggucagcgccg

SEQ ID NO: 1822803 - RNA, 21 nt, Salmonella typhimurium LT2
cagcaccaucuuuuccggcag

SEQ ID NO: 1822804 - RNA, 13 nt, Salmonella typhimurium LT2
cagcacgccaccg

SEQ ID NO: 1822805 - RNA, 17 nt, Salmonella typhimurium LT2
cagcacgcacagcggau

SEQ ID NO: 1822806 - RNA, 17 nt, Salmonella typhimurium LT2
cagcacgcaggcauccg

SEQ ID NO: 1822807 - RNA, 15 nt, Salmonella typhimurium LT2
cagcacgaucgccuu

SEQ ID NO: 1822808 - RNA, 10 nt, Salmonella typhimurium LT2
cagcagccag

SEQ ID NO: 1822809 - RNA, 17 nt, Salmonella typhimurium LT2
cagcagccacagaaugc

SEQ ID NO: 1822810 - RNA, 13 nt, Salmonella typhimurium LT2
cagcagcagcgua

SEQ ID NO: 1822811 - RNA, 21 nt, Salmonella typhimurium LT2
cagcacuaacgaggccaccau

SEQ ID NO: 1822812 - RNA, 18 nt, Salmonella typhimurium LT2
cagcagauuuucauccgu

SEQ ID NO: 1822813 - RNA, 24 nt, Salmonella typhimurium LT2
cagcagauaauuuuucagacguca

SEQ ID NO: 1822814 - RNA, 17 nt, Salmonella typhimurium LT2
cagccccagcaccagag

SEQ ID NO: 1822815 - RNA, 17 nt, Salmonella typhimurium LT2
cagcccaucuuucgcca

SEQ ID NO: 1822816 - RNA, 18 nt, Salmonella typhimurium LT2
cagccccagcgccagccg

SEQ ID NO: 1822817 - RNA, 17 nt, Salmonella typhimurium LT2
cagccccagcgccagcu

SEQ ID NO: 1822818 - RNA, 20 nt, Salmonella typhimurium LT2
cagccauguaaaauagcgcc

SEQ ID NO: 1822819 - RNA, 23 nt, Salmonella typhimurium LT2
cagccauaauggauuagguugcu

SEQ ID NO: 1822820 - RNA, 19 nt, Salmonella typhimurium LT2
cagccaguccuccggcuga

SEQ ID NO: 1822821 - RNA, 14 nt, Salmonella typhimurium LT2
cagccgcccgcgau

SEQ ID NO: 1822822 - RNA, 20 nt, Salmonella typhimurium LT2
cagccgacuauuccgcaaac

SEQ ID NO: 1822823 - RNA, 13 nt, Salmonella typhimurium LT2
cagccgcgaugau

SEQ ID NO: 1822824 - RNA, 22 nt, Salmonella typhimurium LT2
cagcgccgccuguacuuccggu

SEQ ID NO: 1822825 - RNA, 17 nt, Salmonella typhimurium LT2
cagcgccauccggcaaa

SEQ ID NO: 1822826 - RNA, 16 nt, Salmonella typhimurium LT2
cagcgccauccggcac

SEQ ID NO: 1822827 - RNA, 19 nt, Salmonella typhimurium LT2
cagcgcaaacaacccggcu

SEQ ID NO: 1822828 - RNA, 12 nt, Salmonella typhimurium LT2
cagcgcaacgcg

SEQ ID NO: 1822829 - RNA, 15 nt, Salmonella typhimurium LT2
cagcgcaacgcgcau

SEQ ID NO: 1822830 - RNA, 14 nt, Salmonella typhimurium LT2
cagcgcaaccugcg

SEQ ID NO: 1822831 - RNA, 19 nt, Salmonella typhimurium LT2
cagcgcauuaccgccgccu

SEQ ID NO: 1822832 - RNA, 15 nt, Salmonella typhimurium LT2
cagcgcauggacguc

SEQ ID NO: 1822833 - RNA, 14 nt, Salmonella typhimurium LT2
cagcgcaucauggu

SEQ ID NO: 1822834 - RNA, 17 nt, Salmonella typhimurium LT2
cagccugagcgccagcg

SEQ ID NO: 1822835 - RNA, 15 nt, Salmonella typhimurium LT2
cagcgacaggcuguc

SEQ ID NO: 1822836 - RNA, 19 nt, Salmonella typhimurium LT2
cagcgacccuucauacugc

SEQ ID NO: 1822837 - RNA, 15 nt, Salmonella typhimurium LT2
cagcgacgccagauu

SEQ ID NO: 1822838 - RNA, 12 nt, Salmonella typhimurium LT2
caggacagcgac

SEQ ID NO: 1822839 - RNA, 18 nt, Salmonella typhimurium LT2
cagcuuguuauccaucag

SEQ ID NO: 1822840 - RNA, 15 nt, Salmonella typhimurium LT2
caggaacgagccgau

SEQ ID NO: 1822841 - RNA, 16 nt, Salmonella typhimurium LT2
caggaagaaagacgcg

SEQ ID NO: 1822842 - RNA, 15 nt, Salmonella typhimurium LT2
aaagcccaucagcgc

SEQ ID NO: 1822843 - RNA, 23 nt, Salmonella typhimurium LT2
aaagccccaggcuauccagcuca

SEQ ID NO: 1822844 - RNA, 17 nt, Salmonella typhimurium LT2
aaagccgaccgccaggu

SEQ ID NO: 1822845 - RNA, 17 nt, Salmonella typhimurium LT2
aaagcacuucucgcgca

SEQ ID NO: 1822846 - RNA, 17 nt, Salmonella typhimurium LT2
aaagcagggcggcacau

SEQ ID NO: 1822847 - RNA, 15 nt, Salmonella typhimurium LT2
aaagcacuucucgcg

SEQ ID NO: 1822848 - RNA, 18 nt, Salmonella typhimurium LT2
caggccaggguugcguuc

SEQ ID NO: 1822849 - RNA, 17 nt, Salmonella typhimurium LT2
caggcaaucagcagccg

SEQ ID NO: 1822850 - RNA, 15 nt, Salmonella typhimurium LT2
caggcauggcagcag

SEQ ID NO: 1822851 - RNA, 23 nt, Salmonella typhimurium LT2
caggcaugcagcucaagcgccgc

SEQ ID NO: 1822852 - RNA, 16 nt, Salmonella typhimurium LT2
caggcauugauaaagc

SEQ ID NO: 1822853 - RNA, 19 nt, Salmonella typhimurium LT2
caggccaacguaguuauug

SEQ ID NO: 1822854 - RNA, 15 nt, Salmonella typhimurium LT2
caggcgauccuguuc

SEQ ID NO: 1822855 - RNA, 18 nt, Salmonella typhimurium LT2
caggccuguaaaccgccu

SEQ ID NO: 1822856 - RNA, 22 nt, Salmonella typhimurium LT2
caggccuucuucauauuugcua

SEQ ID NO: 1822857 - RNA, 18 nt, Salmonella typhimurium LT2
cagggaaacgagcgcggc

SEQ ID NO: 1822858 - RNA, 17 nt, Salmonella typhimurium LT2
caggcuacccgcaauac

SEQ ID NO: 1822859 - RNA, 19 nt, Salmonella typhimurium LT2
caggcgcuaaggcaucucu

SEQ ID NO: 1822860 - RNA, 18 nt, Salmonella typhimurium LT2
cagcuugaucaucagggc

SEQ ID NO: 1822861 - RNA, 12 nt, Salmonella typhimurium LT2
cagcuucugaua

SEQ ID NO: 1822862 - RNA, 18 nt, Salmonella typhimurium LT2
cagcuuaggauucgccau

SEQ ID NO: 1822863 - RNA, 16 nt, Salmonella typhimurium LT2
cagcuguuuaagcgcc

SEQ ID NO: 1822864 - RNA, 19 nt, Salmonella typhimurium LT2
cagcuguccauaccggacu

SEQ ID NO: 1822865 - RNA, 21 nt, Salmonella typhimurium LT2
cagcuuaugaaucaucgccgu

SEQ ID NO: 1822866 - RNA, 13 nt, Salmonella typhimurium LT2
cagcuggcuggca

SEQ ID NO: 1822867 - RNA, 22 nt, Salmonella typhimurium LT2
cagcuggguuuugucgguaaug

SEQ ID NO: 1822868 - RNA, 19 nt, Salmonella typhimurium LT2
cagcugagcuaaucaccca

SEQ ID NO: 1822869 - RNA, 17 nt, Salmonella typhimurium LT2
cagcugauauaacgugc

SEQ ID NO: 1822870 - RNA, 15 nt, Salmonella typhimurium LT2
cagcugcgacagcga

SEQ ID NO: 1822871 - RNA, 19 nt, Salmonella typhimurium LT2
cagcucuuugguccauaac

SEQ ID NO: 1822872 - RNA, 15 nt, Salmonella typhimurium LT2
cagcucuucgccggu

SEQ ID NO: 1822873 - RNA, 17 nt, Salmonella typhimurium LT2
cagcucaucgaaccuau

SEQ ID NO: 1822874 - RNA, 20 nt, Salmonella typhimurium LT2
cagcuccgcaauuuccugau

SEQ ID NO: 1822875 - RNA, 18 nt, Salmonella typhimurium LT2
cagcguugcagccacguu

SEQ ID NO: 1822876 - RNA, 14 nt, Salmonella typhimurium LT2
cagcucaccagcca

SEQ ID NO: 1822877 - RNA, 16 nt, Salmonella typhimurium LT2
cagcuauagacgacau

SEQ ID NO: 1822878 - RNA, 18 nt, Salmonella typhimurium LT2
cagcgugaagcugccgua

SEQ ID NO: 1822879 - RNA, 13 nt, Salmonella typhimurium LT2
cagcgccggcaac

SEQ ID NO: 1822880 - RNA, 17 nt, Salmonella typhimurium LT2
cagcgccggcaacagcu

SEQ ID NO: 1822881 - RNA, 16 nt, Salmonella typhimurium LT2
cagcggcgucccggca

SEQ ID NO: 1822882 - RNA, 17 nt, Salmonella typhimurium LT2
cagcggcgguuauccgc

SEQ ID NO: 1822883 - RNA, 17 nt, Salmonella typhimurium LT2
cagcgucacaggcuucg

SEQ ID NO: 1822884 - RNA, 18 nt, Salmonella typhimurium LT2
cagcguauuaagccaacg

SEQ ID NO: 1822885 - RNA, 21 nt, Salmonella typhimurium LT2
cagcguacugccaaagcgaug

SEQ ID NO: 1822886 - RNA, 15 nt, Salmonella typhimurium LT2
cagcgggugaugcgc

SEQ ID NO: 1822887 - RNA, 16 nt, Salmonella typhimurium LT2
caucauuuucccacug

SEQ ID NO: 1822888 - RNA, 16 nt, Salmonella typhimurium LT2
cauccagacaugcaca

SEQ ID NO: 1822889 - RNA, 19 nt, Salmonella typhimurium LT2
cauccagauguagcgcggu

SEQ ID NO: 1822890 - RNA, 15 nt, Salmonella typhimurium LT2
cauccagcaccaggc

SEQ ID NO: 1822891 - RNA, 14 nt, Salmonella typhimurium LT2
caucccaugcacca

SEQ ID NO: 1822892 - RNA, 12 nt, Salmonella typhimurium LT2
caucccggcaac

SEQ ID NO: 1822893 - RNA, 20 nt, Salmonella typhimurium LT2
cauccgccgagggcauugau

SEQ ID NO: 1822894 - RNA, 22 nt, Salmonella typhimurium LT2
caucaucgcuggugugcagcca

SEQ ID NO: 1822895 - RNA, 21 nt, Salmonella typhimurium LT2
caucauuacaggcgaauagcg

SEQ ID NO: 1822896 - RNA, 21 nt, Salmonella typhimurium LT2
caucaguucagggcuaacgcc

SEQ ID NO: 1822897 - RNA, 16 nt, Salmonella typhimurium LT2
caucaauaaagccgca

SEQ ID NO: 1822898 - RNA, 17 nt, Salmonella typhimurium LT2
cauccugugggaugcgu

SEQ ID NO: 1822899 - RNA, 20 nt, Salmonella typhimurium LT2
caucgauuuuagcgcaucgc

SEQ ID NO: 1822900 - RNA, 13 nt, Salmonella typhimurium LT2
caucgccaacgcc

SEQ ID NO: 1822901 - RNA, 21 nt, Salmonella typhimurium LT2
caucgccaacgccaaccggcu

SEQ ID NO: 1822902 - RNA, 17 nt, Salmonella typhimurium LT2
caucgcacucuccggcu

SEQ ID NO: 1822903 - RNA, 14 nt, Salmonella typhimurium LT2
caucgcccaugaca

SEQ ID NO: 1822904 - RNA, 15 nt, Salmonella typhimurium LT2
cauaaauagccagca

SEQ ID NO: 1822905 - RNA, 13 nt, Salmonella typhimurium LT2
cauaagcgcgaau

SEQ ID NO: 1822906 - RNA, 18 nt, Salmonella typhimurium LT2
cauaauacgcuugcgcca

SEQ ID NO: 1822907 - RNA, 19 nt, Salmonella typhimurium LT2
cauaauaagcgcucaggca

SEQ ID NO: 1822908 - RNA, 23 nt, Salmonella typhimurium LT2
cauaauaagcgcucaggcagcca

SEQ ID NO: 1822909 - RNA, 15 nt, Salmonella typhimurium LT2
cauaauaaagccggg

SEQ ID NO: 1822910 - RNA, 17 nt, Salmonella typhimurium LT2
cauacauauauuccggg

SEQ ID NO: 1822911 - RNA, 18 nt, Salmonella typhimurium LT2
cauacccaacagcagaca

SEQ ID NO: 1822912 - RNA, 11 nt, Salmonella typhimurium LT2
cauaccagcga

SEQ ID NO: 1822913 - RNA, 12 nt, Salmonella typhimurium LT2
caguuuauccgc

SEQ ID NO: 1822914 - RNA, 20 nt, Salmonella typhimurium LT2
cauaaaaaaagcgccggauu

SEQ ID NO: 1822915 - RNA, 24 nt, Salmonella typhimurium LT2
cauaaaaacgcgcucgccagcgca

SEQ ID NO: 1822916 - RNA, 15 nt, Salmonella typhimurium LT2
cauaaaacgggucgc

SEQ ID NO: 1822917 - RNA, 14 nt, Salmonella typhimurium LT2
caguuuucaauauu

SEQ ID NO: 1822918 - RNA, 18 nt, Salmonella typhimurium LT2
caguuuguccauuucuug

SEQ ID NO: 1822919 - RNA, 15 nt, Salmonella typhimurium LT2
caguuucuucgccca

SEQ ID NO: 1822920 - RNA, 14 nt, Salmonella typhimurium LT2
caguugccaggguu

SEQ ID NO: 1822921 - RNA, 15 nt, Salmonella typhimurium LT2
cauaguuugcauaac

SEQ ID NO: 1822922 - RNA, 11 nt, Salmonella typhimurium LT2
cauauaacaga

SEQ ID NO: 1822923 - RNA, 22 nt, Salmonella typhimurium LT2
cauaggcgacaggcgugauagc

SEQ ID NO: 1822924 - RNA, 23 nt, Salmonella typhimurium LT2
cauacccgcuuaccgcggucacc

SEQ ID NO: 1822925 - RNA, 14 nt, Salmonella typhimurium LT2
cauaggccagcguu

SEQ ID NO: 1822926 - RNA, 22 nt, Salmonella typhimurium LT2
cauaucaauauguuccggcguc

SEQ ID NO: 1822927 - RNA, 18 nt, Salmonella typhimurium LT2
cauaucgccauucacggc

SEQ ID NO: 1822928 - RNA, 14 nt, Salmonella typhimurium LT2
cauauagccgcgca

SEQ ID NO: 1822929 - RNA, 15 nt, Salmonella typhimurium LT2
caucaacagcaggca

SEQ ID NO: 1822930 - RNA, 14 nt, Salmonella typhimurium LT2
caggguugcguucg

SEQ ID NO: 1822931 - RNA, 19 nt, Salmonella typhimurium LT2
cagggagagugagcaacgu

SEQ ID NO: 1822932 - RNA, 21 nt, Salmonella typhimurium LT2
cagguauucguuaaagccgau

SEQ ID NO: 1822933 - RNA, 19 nt, Salmonella typhimurium LT2
cagguuaggcgcgauaaua

SEQ ID NO: 1822934 - RNA, 19 nt, Salmonella typhimurium LT2
cagguuucguccgccgcua

SEQ ID NO: 1822935 - RNA, 20 nt, Salmonella typhimurium LT2
caggucgccagaagccgucg

SEQ ID NO: 1822936 - RNA, 16 nt, Salmonella typhimurium LT2
caguucagccgccagu

SEQ ID NO: 1822937 - RNA, 14 nt, Salmonella typhimurium LT2
caguucauccagca

SEQ ID NO: 1822938 - RNA, 21 nt, Salmonella typhimurium LT2
caguuccaucuccggcgacca

SEQ ID NO: 1822939 - RNA, 16 nt, Salmonella typhimurium LT2
caguaaauuaaacagc

SEQ ID NO: 1822940 - RNA, 14 nt, Salmonella typhimurium LT2
caguaaaucaacuu

SEQ ID NO: 1822941 - RNA, 22 nt, Salmonella typhimurium LT2
caguaacugcaaaucuucggca

SEQ ID NO: 1822942 - RNA, 16 nt, Salmonella typhimurium LT2
caguaaugcuguugua

SEQ ID NO: 1822943 - RNA, 18 nt, Salmonella typhimurium LT2
caguaauuucagcgacca

SEQ ID NO: 1822944 - RNA, 17 nt, Salmonella typhimurium LT2
caguaauccggcaacug

SEQ ID NO: 1822945 - RNA, 16 nt, Salmonella typhimurium LT2
cagucccuguucgcca

SEQ ID NO: 1822946 - RNA, 14 nt, Salmonella typhimurium LT2
cagucggcgaacuu

SEQ ID NO: 1822947 - RNA, 18 nt, Salmonella typhimurium LT2
cagugaaucgcaucauaa

SEQ ID NO: 1822948 - RNA, 16 nt, Salmonella typhimurium LT2
cagugaauccagcgua

SEQ ID NO: 1822949 - RNA, 13 nt, Salmonella typhimurium LT2
cagugccgccaga

SEQ ID NO: 1822950 - RNA, 17 nt, Salmonella typhimurium LT2
cagugccgccagaauca

SEQ ID NO: 1822951 - RNA, 15 nt, Salmonella typhimurium LT2
cauguucgaacaugc

SEQ ID NO: 1822952 - RNA, 14 nt, Salmonella typhimurium LT2
cauguuccggcaga

SEQ ID NO: 1822953 - RNA, 18 nt, Salmonella typhimurium LT2
cauuaauacaggccagca

SEQ ID NO: 1822954 - RNA, 13 nt, Salmonella typhimurium LT2
cauuaaucgccau

SEQ ID NO: 1822955 - RNA, 14 nt, Salmonella typhimurium LT2
cauuagccgccagc

SEQ ID NO: 1822956 - RNA, 11 nt, Salmonella typhimurium LT2
cauuagcgccu

SEQ ID NO: 1822957 - RNA, 15 nt, Salmonella typhimurium LT2
cauuauaagcgccaa

SEQ ID NO: 1822958 - RNA, 22 nt, Salmonella typhimurium LT2
cauuaguaauaaagcguagccg

SEQ ID NO: 1822959 - RNA, 18 nt, Salmonella typhimurium LT2
cauguacgaaagcgcgau

SEQ ID NO: 1822960 - RNA, 12 nt, Salmonella typhimurium LT2
cauguccaucag

SEQ ID NO: 1822961 - RNA, 17 nt, Salmonella typhimurium LT2
cauguccggugauauug

SEQ ID NO: 1822962 - RNA, 15 nt, Salmonella typhimurium LT2
cauguuaaugauucc

SEQ ID NO: 1822963 - RNA, 21 nt, Salmonella typhimurium LT2
cauuauugcgaaauagcgcgg

SEQ ID NO: 1822964 - RNA, 20 nt, Salmonella typhimurium LT2
cauuccaggugucacucauc

SEQ ID NO: 1822965 - RNA, 21 nt, Salmonella typhimurium LT2
cauuccuuuaaauauccgcag

SEQ ID NO: 1822966 - RNA, 17 nt, Salmonella typhimurium LT2
cauucgccagcggaucg

SEQ ID NO: 1822967 - RNA, 17 nt, Salmonella typhimurium LT2
cauugcaaugcaguucu

SEQ ID NO: 1822968 - RNA, 23 nt, Salmonella typhimurium LT2
cauugccauguuaauaccagcgc

SEQ ID NO: 1822969 - RNA, 17 nt, Salmonella typhimurium LT2
cauugcccauucguaau

SEQ ID NO: 1822970 - RNA, 20 nt, Salmonella typhimurium LT2
cauucucgccgugacuguuc

SEQ ID NO: 1822971 - RNA, 22 nt, Salmonella typhimurium LT2
cauugaccaccauauucgccac

SEQ ID NO: 1822972 - RNA, 16 nt, Salmonella typhimurium LT2
caugccugauggcgca

SEQ ID NO: 1822973 - RNA, 16 nt, Salmonella typhimurium LT2
caugcggaaucacgca

SEQ ID NO: 1822974 - RNA, 12 nt, Salmonella typhimurium LT2
caugcgcggcau

SEQ ID NO: 1822975 - RNA, 13 nt, Salmonella typhimurium LT2
caugcuuaucgcc

SEQ ID NO: 1822976 - RNA, 20 nt, Salmonella typhimurium LT2
caugguuacgcgacgugcug

SEQ ID NO: 1822977 - RNA, 18 nt, Salmonella typhimurium LT2
cauguaaaauagcgccgu

SEQ ID NO: 1822978 - RNA, 15 nt, Salmonella typhimurium LT2
cauggugaugaucgc

SEQ ID NO: 1822979 - RNA, 19 nt, Salmonella typhimurium LT2
caugggacgggucuccauc

SEQ ID NO: 1822980 - RNA, 22 nt, Salmonella typhimurium LT2
caugguaggccugauaagcgca

SEQ ID NO: 1822981 - RNA, 21 nt, Salmonella typhimurium LT2
cauggguaaagcccaucgcca

SEQ ID NO: 1822982 - RNA, 17 nt, Salmonella typhimurium LT2
cauggcagccccggcau

SEQ ID NO: 1822983 - RNA, 14 nt, Salmonella typhimurium LT2
cauggcagcagggu

SEQ ID NO: 1822984 - RNA, 15 nt, Salmonella typhimurium LT2
cauggcgaagugcag

SEQ ID NO: 1822985 - RNA, 13 nt, Salmonella typhimurium LT2
cauuggcaaugaa

SEQ ID NO: 1822986 - RNA, 22 nt, Salmonella typhimurium LT2
cauugcguaaugagcgucgcca

SEQ ID NO: 1822987 - RNA, 16 nt, Salmonella typhimurium LT2
cauugcugucgacaau

SEQ ID NO: 1822988 - RNA, 13 nt, Salmonella typhimurium LT2
cauuuaaucgccu

SEQ ID NO: 1822989 - RNA, 18 nt, Salmonella typhimurium LT2
cauuugucgcuguuaauu

SEQ ID NO: 1822990 - RNA, 20 nt, Salmonella typhimurium LT2
cauuuguacaaaaaauguga

SEQ ID NO: 1822991 - RNA, 22 nt, Salmonella typhimurium LT2
cauuuuguauucgcagggcugc

SEQ ID NO: 1822992 - RNA, 17 nt, Salmonella typhimurium LT2
cauuugauuccagccuu

SEQ ID NO: 1822993 - RNA, 14 nt, Salmonella typhimurium LT2
cauuugaucucaug

SEQ ID NO: 1822994 - RNA, 18 nt, Salmonella typhimurium LT2
cauuugcgcuuucagcgc

SEQ ID NO: 1822995 - RNA, 17 nt, Salmonella typhimurium LT2
cauuuauugcagguauu

SEQ ID NO: 1822996 - RNA, 21 nt, Salmonella typhimurium LT2
cauuucaagcagacgaucggc

SEQ ID NO: 1822997 - RNA, 12 nt, Salmonella typhimurium LT2
cauuucagcgcc

SEQ ID NO: 1822998 - RNA, 13 nt, Salmonella typhimurium LT2
cauuuagcgccug

SEQ ID NO: 1822999 - RNA, 16 nt, Salmonella typhimurium LT2
cauuucgcccucgcca

SEQ ID NO: 1823000 - RNA, 14 nt, Salmonella typhimurium LT2
cauuuccugcauua

SEQ ID NO: 1823001 - RNA, 15 nt, Salmonella typhimurium LT2
ccaaaaaaucagcaa

SEQ ID NO: 1823002 - RNA, 19 nt, Salmonella typhimurium LT2
cauuuuuuaugcccgcguu

SEQ ID NO: 1823003 - RNA, 12 nt, Salmonella typhimurium LT2
cauuuuugcccg

SEQ ID NO: 1823004 - RNA, 13 nt, Salmonella typhimurium LT2
ccaaaagcgccac

SEQ ID NO: 1823005 - RNA, 19 nt, Salmonella typhimurium LT2
ccaaaagcgccacgcguca

SEQ ID NO: 1823006 - RNA, 13 nt, Salmonella typhimurium LT2
ccaaaaugccgcc

SEQ ID NO: 1823007 - RNA, 21 nt, Salmonella typhimurium LT2
ccaacaaggauauccgccagu

SEQ ID NO: 1823008 - RNA, 19 nt, Salmonella typhimurium LT2
ccaacaaggauauccgcca

SEQ ID NO: 1823009 - RNA, 16 nt, Salmonella typhimurium LT2
ccaacaaacgcucauu

SEQ ID NO: 1823010 - RNA, 20 nt, Salmonella typhimurium LT2
ccaacugucgccauccugac

SEQ ID NO: 1823011 - RNA, 16 nt, Salmonella typhimurium LT2
ccaacugcgccugaag

SEQ ID NO: 1823012 - RNA, 15 nt, Salmonella typhimurium LT2
ccaauaccggcguaa

SEQ ID NO: 1823013 - RNA, 16 nt, Salmonella typhimurium LT2
ccaauacccagcgcca

SEQ ID NO: 1823014 - RNA, 17 nt, Salmonella typhimurium LT2
ccaauacccagcgccaa

SEQ ID NO: 1823015 - RNA, 20 nt, Salmonella typhimurium LT2
ccaauaauuaguuuuaccgg

SEQ ID NO: 1823016 - RNA, 16 nt, Salmonella typhimurium LT2
ccaauaaugcaggcua

SEQ ID NO: 1823017 - RNA, 20 nt, Salmonella typhimurium LT2
ccaauugcugcaucgugagc

SEQ ID NO: 1823018 - RNA, 23 nt, Salmonella typhimurium LT2
ccaauauccggauauucugcacg

SEQ ID NO: 1823019 - RNA, 17 nt, Salmonella typhimurium LT2
ccaauuccugccagaga

SEQ ID NO: 1823020 - RNA, 19 nt, Salmonella typhimurium LT2
ccaauuacccucgcgcuca

SEQ ID NO: 1823021 - RNA, 16 nt, Salmonella typhimurium LT2
ccacaguuaacgccaa

SEQ ID NO: 1823022 - RNA, 18 nt, Salmonella typhimurium LT2
ccacaucguuggccgcca

SEQ ID NO: 1823023 - RNA, 17 nt, Salmonella typhimurium LT2
ccacauauaacaaacgc

SEQ ID NO: 1823024 - RNA, 15 nt, Salmonella typhimurium LT2
ccacauucaggcggu

SEQ ID NO: 1823025 - RNA, 19 nt, Salmonella typhimurium LT2
ccacgccuuucacgccgaa

SEQ ID NO: 1823026 - RNA, 22 nt, Salmonella typhimurium LT2
aaaguuaaucagcgcugucgcc

SEQ ID NO: 1823027 - RNA, 14 nt, Salmonella typhimurium LT2
ccacgaguggcgcg

SEQ ID NO: 1823028 - RNA, 17 nt, Salmonella typhimurium LT2
ccacgaguggcgcggaa

SEQ ID NO: 1823029 - RNA, 17 nt, Salmonella typhimurium LT2
ccacgaguuaucgauuc

SEQ ID NO: 1823030 - RNA, 14 nt, Salmonella typhimurium LT2
aaauaauaucgcgc

SEQ ID NO: 1823031 - RNA, 14 nt, Salmonella typhimurium LT2
aaauaaccagagua

SEQ ID NO: 1823032 - RNA, 16 nt, Salmonella typhimurium LT2
aaauacgcucaauaua

SEQ ID NO: 1823033 - RNA, 14 nt, Salmonella typhimurium LT2
aaauacgcugcggc

SEQ ID NO: 1823034 - RNA, 16 nt, Salmonella typhimurium LT2
ccacggccagcagcca

SEQ ID NO: 1823035 - RNA, 18 nt, Salmonella typhimurium LT2
aaauaccguaaugccgac

SEQ ID NO: 1823036 - RNA, 17 nt, Salmonella typhimurium LT2
ccacgacgaccgccaga

SEQ ID NO: 1823037 - RNA, 18 nt, Salmonella typhimurium LT2
ccacgacgaccgccagag

SEQ ID NO: 1823038 - RNA, 22 nt, Salmonella typhimurium LT2
ccagacaucacguucgcgcaua

SEQ ID NO: 1823039 - RNA, 21 nt, Salmonella typhimurium LT2
ccagaaugauaaugccgcuga

SEQ ID NO: 1823040 - RNA, 16 nt, Salmonella typhimurium LT2
ccagaaugcccagcaa

SEQ ID NO: 1823041 - RNA, 20 nt, Salmonella typhimurium LT2
ccagaauguggguggcgaua

SEQ ID NO: 1823042 - RNA, 12 nt, Salmonella typhimurium LT2
ccagcacauuac

SEQ ID NO: 1823043 - RNA, 22 nt, Salmonella typhimurium LT2
ccagcacauuacaggcaucuuc

SEQ ID NO: 1823044 - RNA, 19 nt, Salmonella typhimurium LT2
ccagcacauugagcguaau

SEQ ID NO: 1823045 - RNA, 23 nt, Salmonella typhimurium LT2
ccagcaaguauuggcugccgaca

SEQ ID NO: 1823046 - RNA, 16 nt, Salmonella typhimurium LT2
ccagauaaaucagccc

SEQ ID NO: 1823047 - RNA, 21 nt, Salmonella typhimurium LT2
ccagauagcgcugcgccagau

SEQ ID NO: 1823048 - RNA, 18 nt, Salmonella typhimurium LT2
ccagauaauauucagauc

SEQ ID NO: 1823049 - RNA, 23 nt, Salmonella typhimurium LT2
ccagauacaaaucucaggguguu

SEQ ID NO: 1823050 - RNA, 21 nt, Salmonella typhimurium LT2
ccagauaagccugcgcgccug

SEQ ID NO: 1823051 - RNA, 17 nt, Salmonella typhimurium LT2
ccagauauugccgacca

SEQ ID NO: 1823052 - RNA, 17 nt, Salmonella typhimurium LT2
ccagauauccgcgcuca

SEQ ID NO: 1823053 - RNA, 20 nt, Salmonella typhimurium LT2
ccacugaguuucaccgccag

SEQ ID NO: 1823054 - RNA, 15 nt, Salmonella typhimurium LT2
ccacugcaucucuuc

SEQ ID NO: 1823055 - RNA, 22 nt, Salmonella typhimurium LT2
ccacuucaucagcguguacggc

SEQ ID NO: 1823056 - RNA, 13 nt, Salmonella typhimurium LT2
ccacuucgccggu

SEQ ID NO: 1823057 - RNA, 20 nt, Salmonella typhimurium LT2
ccagaauacgccgccgccca

SEQ ID NO: 1823058 - RNA, 20 nt, Salmonella typhimurium LT2
ccagaaacaucgguaauagc

SEQ ID NO: 1823059 - RNA, 16 nt, Salmonella typhimurium LT2
ccacuuuuccggcacc

SEQ ID NO: 1823060 - RNA, 20 nt, Salmonella typhimurium LT2
ccacuuggcgaucaccagca

SEQ ID NO: 1823061 - RNA, 21 nt, Salmonella typhimurium LT2
ccacgucagcccaaaacgcgc

SEQ ID NO: 1823062 - RNA, 16 nt, Salmonella typhimurium LT2
ccagccuaucgccaua

SEQ ID NO: 1823063 - RNA, 20 nt, Salmonella typhimurium LT2
ccagccuaccugccgccaua

SEQ ID NO: 1823064 - RNA, 23 nt, Salmonella typhimurium LT2
ccagccggaaaucaauuccgguu

SEQ ID NO: 1823065 - RNA, 15 nt, Salmonella typhimurium LT2
ccagcccugccacca

SEQ ID NO: 1823066 - RNA, 22 nt, Salmonella typhimurium LT2
ccagcgccaacgccacugccau

SEQ ID NO: 1823067 - RNA, 16 nt, Salmonella typhimurium LT2
ccagcgccaaucacua

SEQ ID NO: 1823068 - RNA, 12 nt, Salmonella typhimurium LT2
ccagcgccggac

SEQ ID NO: 1823069 - RNA, 12 nt, Salmonella typhimurium LT2
aaauauuaucgc

SEQ ID NO: 1823070 - RNA, 15 nt, Salmonella typhimurium LT2
aaaucacgcacacgu

SEQ ID NO: 1823071 - RNA, 15 nt, Salmonella typhimurium LT2
aaaucacaucgccgg

SEQ ID NO: 1823072 - RNA, 13 nt, Salmonella typhimurium LT2
ccagcgcggcaca

SEQ ID NO: 1823073 - RNA, 15 nt, Salmonella typhimurium LT2
ccagcgcggcgccag

SEQ ID NO: 1823074 - RNA, 13 nt, Salmonella typhimurium LT2
aaauauagccauu

SEQ ID NO: 1823075 - RNA, 19 nt, Salmonella typhimurium LT2
ccagcagaauaacaucuuc

SEQ ID NO: 1823076 - RNA, 19 nt, Salmonella typhimurium LT2
aaauagucaguuaacgcgu

SEQ ID NO: 1823077 - RNA, 15 nt, Salmonella typhimurium LT2
aaauaguccagcagc

SEQ ID NO: 1823078 - RNA, 12 nt, Salmonella typhimurium LT2
ccagcaccagca

SEQ ID NO: 1823079 - RNA, 15 nt, Salmonella typhimurium LT2
ccagcaugcccgcca

SEQ ID NO: 1823080 - RNA, 20 nt, Salmonella typhimurium LT2
ccagcaugagccagcccuca

SEQ ID NO: 1823081 - RNA, 16 nt, Salmonella typhimurium LT2
ccagcauggcggucag

SEQ ID NO: 1823082 - RNA, 15 nt, Salmonella typhimurium LT2
ccagccacugcgcca

SEQ ID NO: 1823083 - RNA, 14 nt, Salmonella typhimurium LT2
ccagcauggcgucg

SEQ ID NO: 1823084 - RNA, 12 nt, Salmonella typhimurium LT2
ccagccagccgu

SEQ ID NO: 1823085 - RNA, 20 nt, Salmonella typhimurium LT2
cccuaucaccauaaucgcga

SEQ ID NO: 1823086 - RNA, 15 nt, Salmonella typhimurium LT2
cccuccagccagcgc

SEQ ID NO: 1823087 - RNA, 17 nt, Salmonella typhimurium LT2
cccucauuauccagugc

SEQ ID NO: 1823088 - RNA, 22 nt, Salmonella typhimurium LT2
cccucuuccaucagccaggcgg

SEQ ID NO: 1823089 - RNA, 22 nt, Salmonella typhimurium LT2
cccugaaaccccuuuagcggca

SEQ ID NO: 1823090 - RNA, 14 nt, Salmonella typhimurium LT2
cccugaacugguaa

SEQ ID NO: 1823091 - RNA, 20 nt, Salmonella typhimurium LT2
cccgucuaaccgggccugau

SEQ ID NO: 1823092 - RNA, 15 nt, Salmonella typhimurium LT2
cccuuaaauccggcc

SEQ ID NO: 1823093 - RNA, 16 nt, Salmonella typhimurium LT2
cccugucuuccgacag

SEQ ID NO: 1823094 - RNA, 20 nt, Salmonella typhimurium LT2
cccugaugcguauccagcgc

SEQ ID NO: 1823095 - RNA, 15 nt, Salmonella typhimurium LT2
cccugcagaccuggc

SEQ ID NO: 1823096 - RNA, 21 nt, Salmonella typhimurium LT2
cccugcgucgcguaccagcgc

SEQ ID NO: 1823097 - RNA, 18 nt, Salmonella typhimurium LT2
cccugcgguagcgccgau

SEQ ID NO: 1823098 - RNA, 18 nt, Salmonella typhimurium LT2
cccggcgccauccggcag

SEQ ID NO: 1823099 - RNA, 18 nt, Salmonella typhimurium LT2
cccggcggauaaaucauc

SEQ ID NO: 1823100 - RNA, 21 nt, Salmonella typhimurium LT2
cccggcggauaaaucaucauc

SEQ ID NO: 1823101 - RNA, 22 nt, Salmonella typhimurium LT2
cccggcuaaaugacgcgcgaga

SEQ ID NO: 1823102 - RNA, 19 nt, Salmonella typhimurium LT2
cccggccacaggcgucgcg

SEQ ID NO: 1823103 - RNA, 20 nt, Salmonella typhimurium LT2
cccggcaguccgucgagcgc

SEQ ID NO: 1823104 - RNA, 21 nt, Salmonella typhimurium LT2
cccggcaggcgucauagccgc

SEQ ID NO: 1823105 - RNA, 17 nt, Salmonella typhimurium LT2
cccggcccgucaucuuc

SEQ ID NO: 1823106 - RNA, 18 nt, Salmonella typhimurium LT2
cccgauucgcaugaauuc

SEQ ID NO: 1823107 - RNA, 13 nt, Salmonella typhimurium LT2
cccgcagccggaa

SEQ ID NO: 1823108 - RNA, 13 nt, Salmonella typhimurium LT2
cccgccgccugau

SEQ ID NO: 1823109 - RNA, 16 nt, Salmonella typhimurium LT2
cccgccagcugcgcgc

SEQ ID NO: 1823110 - RNA, 14 nt, Salmonella typhimurium LT2
cccgcuucgucgcc

SEQ ID NO: 1823111 - RNA, 14 nt, Salmonella typhimurium LT2
cccgccugcggaca

SEQ ID NO: 1823112 - RNA, 11 nt, Salmonella typhimurium LT2
ccccgcgacaa

SEQ ID NO: 1823113 - RNA, 20 nt, Salmonella typhimurium LT2
ccccagguaaauccgccagu

SEQ ID NO: 1823114 - RNA, 13 nt, Salmonella typhimurium LT2
ccccaccgccaga

SEQ ID NO: 1823115 - RNA, 16 nt, Salmonella typhimurium LT2
cccgacgcuggcgcaa

SEQ ID NO: 1823116 - RNA, 14 nt, Salmonella typhimurium LT2
cccgacgcgccacu

SEQ ID NO: 1823117 - RNA, 22 nt, Salmonella typhimurium LT2
cccgacggcaggcggcaaucag

SEQ ID NO: 1823118 - RNA, 20 nt, Salmonella typhimurium LT2
cccgaucacggcgaaucgcc

SEQ ID NO: 1823119 - RNA, 19 nt, Salmonella typhimurium LT2
ccccucuuccaucagccag

SEQ ID NO: 1823120 - RNA, 20 nt, Salmonella typhimurium LT2
ccagucaucgucugcgucuu

SEQ ID NO: 1823121 - RNA, 19 nt, Salmonella typhimurium LT2
ccagugaauccaccacgua

SEQ ID NO: 1823122 - RNA, 15 nt, Salmonella typhimurium LT2
ccaguucucaaucgc

SEQ ID NO: 1823123 - RNA, 17 nt, Salmonella typhimurium LT2
ccaguucgcgauaggcc

SEQ ID NO: 1823124 - RNA, 14 nt, Salmonella typhimurium LT2
ccaguuaucacggu

SEQ ID NO: 1823125 - RNA, 18 nt, Salmonella typhimurium LT2
ccaguuauuaaucaagcc

SEQ ID NO: 1823126 - RNA, 13 nt, Salmonella typhimurium LT2
ccaucagcgccag

SEQ ID NO: 1823127 - RNA, 20 nt, Salmonella typhimurium LT2
ccaucagcgcgggauaacgc

SEQ ID NO: 1823128 - RNA, 14 nt, Salmonella typhimurium LT2
ccaucaggccuacg

SEQ ID NO: 1823129 - RNA, 14 nt, Salmonella typhimurium LT2
ccaucaggaaauuc

SEQ ID NO: 1823130 - RNA, 15 nt, Salmonella typhimurium LT2
ccaucacgcccggau

SEQ ID NO: 1823131 - RNA, 16 nt, Salmonella typhimurium LT2
ccaucacgcccggaug

SEQ ID NO: 1823132 - RNA, 15 nt, Salmonella typhimurium LT2
ccaucaacgccauaa

SEQ ID NO: 1823133 - RNA, 18 nt, Salmonella typhimurium LT2
ccaucaauccauuucgcc

SEQ ID NO: 1823134 - RNA, 16 nt, Salmonella typhimurium LT2
ccaucacaugcggaug

SEQ ID NO: 1823135 - RNA, 17 nt, Salmonella typhimurium LT2
ccaucaacuucucgcag

SEQ ID NO: 1823136 - RNA, 15 nt, Salmonella typhimurium LT2
ccauauuuaugcagc

SEQ ID NO: 1823137 - RNA, 21 nt, Salmonella typhimurium LT2
ccaucaaauaauacgccggca

SEQ ID NO: 1823138 - RNA, 18 nt, Salmonella typhimurium LT2
ccauaacgggaagccgua

SEQ ID NO: 1823139 - RNA, 13 nt, Salmonella typhimurium LT2
ccauacagcccau

SEQ ID NO: 1823140 - RNA, 18 nt, Salmonella typhimurium LT2
ccaguuuaccaaacacga

SEQ ID NO: 1823141 - RNA, 14 nt, Salmonella typhimurium LT2
ccaguuuuuauaac

SEQ ID NO: 1823142 - RNA, 17 nt, Salmonella typhimurium LT2
ccauaaacgguuucagc

SEQ ID NO: 1823143 - RNA, 18 nt, Salmonella typhimurium LT2
ccaguuuccugacccgcu

SEQ ID NO: 1823144 - RNA, 13 nt, Salmonella typhimurium LT2
ccaguuuauccgc

SEQ ID NO: 1823145 - RNA, 16 nt, Salmonella typhimurium LT2
ccauacggaugccgau

SEQ ID NO: 1823146 - RNA, 21 nt, Salmonella typhimurium LT2
ccauacuggcgaauagcgccu

SEQ ID NO: 1823147 - RNA, 20 nt, Salmonella typhimurium LT2
ccaguaaaaucgggccuccg

SEQ ID NO: 1823148 - RNA, 18 nt, Salmonella typhimurium LT2
ccagguaaauccgccagu

SEQ ID NO: 1823149 - RNA, 18 nt, Salmonella typhimurium LT2
ccagcggaacucaucauc

SEQ ID NO: 1823150 - RNA, 15 nt, Salmonella typhimurium LT2
ccagggaaugccaua

SEQ ID NO: 1823151 - RNA, 17 nt, Salmonella typhimurium LT2
ccaggcgaugagcguga

SEQ ID NO: 1823152 - RNA, 15 nt, Salmonella typhimurium LT2
cccaccugcagcagc

SEQ ID NO: 1823153 - RNA, 22 nt, Salmonella typhimurium LT2
cccacacugaauuacugcguaa

SEQ ID NO: 1823154 - RNA, 19 nt, Salmonella typhimurium LT2
cccacuuguagcgagcgcc

SEQ ID NO: 1823155 - RNA, 21 nt, Salmonella typhimurium LT2
cccacuuguagcgagcgccgu

SEQ ID NO: 1823156 - RNA, 16 nt, Salmonella typhimurium LT2
cccacuuugcucacca

SEQ ID NO: 1823157 - RNA, 15 nt, Salmonella typhimurium LT2
cccacugacauuuaa

SEQ ID NO: 1823158 - RNA, 12 nt, Salmonella typhimurium LT2
cccacgccaucg

SEQ ID NO: 1823159 - RNA, 21 nt, Salmonella typhimurium LT2
aaaucggggucuuccagcaga

SEQ ID NO: 1823160 - RNA, 21 nt, Salmonella typhimurium LT2
aaaucgucagccgccaguuca

SEQ ID NO: 1823161 - RNA, 16 nt, Salmonella typhimurium LT2
aaaucggcuccggcaa

SEQ ID NO: 1823162 - RNA, 14 nt, Salmonella typhimurium LT2
ccauguacgcaggc

SEQ ID NO: 1823163 - RNA, 15 nt, Salmonella typhimurium LT2
ccauguugcgccgaa

SEQ ID NO: 1823164 - RNA, 17 nt, Salmonella typhimurium LT2
cccagcgcgauacgcag

SEQ ID NO: 1823165 - RNA, 12 nt, Salmonella typhimurium LT2
cccagcgcgaca

SEQ ID NO: 1823166 - RNA, 21 nt, Salmonella typhimurium LT2
cccagccccccuaaagcucau

SEQ ID NO: 1823167 - RNA, 22 nt, Salmonella typhimurium LT2
ccaucgcgaauuucaaucgcca

SEQ ID NO: 1823168 - RNA, 17 nt, Salmonella typhimurium LT2
ccaucgggucggccaua

SEQ ID NO: 1823169 - RNA, 19 nt, Salmonella typhimurium LT2
ccaucgguucucugccauc

SEQ ID NO: 1823170 - RNA, 18 nt, Salmonella typhimurium LT2
ccaucaggcuuugcgcca

SEQ ID NO: 1823171 - RNA, 21 nt, Salmonella typhimurium LT2
ccaucccugauuuaucacguc

SEQ ID NO: 1823172 - RNA, 18 nt, Salmonella typhimurium LT2
ccauccggcaauuaaccg

SEQ ID NO: 1823173 - RNA, 22 nt, Salmonella typhimurium LT2
ccaugcccggcggcggcgggga

SEQ ID NO: 1823174 - RNA, 14 nt, Salmonella typhimurium LT2
ccaugauggcguaa

SEQ ID NO: 1823175 - RNA, 24 nt, Salmonella typhimurium LT2
ccaucuggcgguuugacggcugca

SEQ ID NO: 1823176 - RNA, 14 nt, Salmonella typhimurium LT2
caagagcagcaacc

SEQ ID NO: 1823177 - RNA, 20 nt, Salmonella typhimurium LT2
caagagauaucccaucgacu

SEQ ID NO: 1823178 - RNA, 15 nt, Salmonella typhimurium LT2
caagacccgacagua

SEQ ID NO: 1823179 - RNA, 14 nt, Salmonella typhimurium LT2
caacugcucuacca

SEQ ID NO: 1823180 - RNA, 16 nt, Salmonella typhimurium LT2
caagacacgcuuccag

SEQ ID NO: 1823181 - RNA, 21 nt, Salmonella typhimurium LT2
caacggucuugccagcgagaa

SEQ ID NO: 1823182 - RNA, 16 nt, Salmonella typhimurium LT2
caacguuacgccagcg

SEQ ID NO: 1823183 - RNA, 12 nt, Salmonella typhimurium LT2
caacgucgcgcc

SEQ ID NO: 1823184 - RNA, 14 nt, Salmonella typhimurium LT2
caacguaaugauca

SEQ ID NO: 1823185 - RNA, 20 nt, Salmonella typhimurium LT2
caauggcgacgaucagcgcc

SEQ ID NO: 1823186 - RNA, 21 nt, Salmonella typhimurium LT2
caauggcuuaguaggcuggcg

SEQ ID NO: 1823187 - RNA, 13 nt, Salmonella typhimurium LT2
caauuccacaggc

SEQ ID NO: 1823188 - RNA, 15 nt, Salmonella typhimurium LT2
caauuccacaggcgc

SEQ ID NO: 1823189 - RNA, 17 nt, Salmonella typhimurium LT2
caauuugcccagcgcug

SEQ ID NO: 1823190 - RNA, 14 nt, Salmonella typhimurium LT2
caaucucaccggcu

SEQ ID NO: 1823191 - RNA, 21 nt, Salmonella typhimurium LT2
caaugauaucggccggaugcc

SEQ ID NO: 1823192 - RNA, 16 nt, Salmonella typhimurium LT2
caauagccuuuaucgg

SEQ ID NO: 1823193 - RNA, 17 nt, Salmonella typhimurium LT2
caauagaccagcggccc

SEQ ID NO: 1823194 - RNA, 17 nt, Salmonella typhimurium LT2
caauagagucuaccgcc

SEQ ID NO: 1823195 - RNA, 15 nt, Salmonella typhimurium LT2
caauagcaaugaagc

SEQ ID NO: 1823196 - RNA, 18 nt, Salmonella typhimurium LT2
caauagcagcuucacgcg

SEQ ID NO: 1823197 - RNA, 14 nt, Salmonella typhimurium LT2
caauauaccgucag

SEQ ID NO: 1823198 - RNA, 22 nt, Salmonella typhimurium LT2
caaguaauaaagagaacgacgc

SEQ ID NO: 1823199 - RNA, 15 nt, Salmonella typhimurium LT2
caaucagaaucagau

SEQ ID NO: 1823200 - RNA, 20 nt, Salmonella typhimurium LT2
caaucagccccagcaccaga

SEQ ID NO: 1823201 - RNA, 23 nt, Salmonella typhimurium LT2
caauccgccacgcucgcuggugc

SEQ ID NO: 1823202 - RNA, 11 nt, Salmonella typhimurium LT2
caaucaaccgc

SEQ ID NO: 1823203 - RNA, 18 nt, Salmonella typhimurium LT2
caauaugcgucagcgcgg

SEQ ID NO: 1823204 - RNA, 12 nt, Salmonella typhimurium LT2
caauaugcgcau

SEQ ID NO: 1823205 - RNA, 14 nt, Salmonella typhimurium LT2
caauaucgaugcca

SEQ ID NO: 1823206 - RNA, 22 nt, Salmonella typhimurium LT2
caauaugucuuaaacagcgauc

SEQ ID NO: 1823207 - RNA, 23 nt, Salmonella typhimurium LT2
caauauugaacauuuuuucagcc

SEQ ID NO: 1823208 - RNA, 20 nt, Salmonella typhimurium LT2
caauauuuaagcccaaccgc

SEQ ID NO: 1823209 - RNA, 18 nt, Salmonella typhimurium LT2
caaccgcucuccgcaauu

SEQ ID NO: 1823210 - RNA, 18 nt, Salmonella typhimurium LT2
caaccgguacucuuccag

SEQ ID NO: 1823211 - RNA, 21 nt, Salmonella typhimurium LT2
caaccguuucuuuuucgauca

SEQ ID NO: 1823212 - RNA, 14 nt, Salmonella typhimurium LT2
caacgcuccagcag

SEQ ID NO: 1823213 - RNA, 19 nt, Salmonella typhimurium LT2
caacgcguucauccagcgc

SEQ ID NO: 1823214 - RNA, 15 nt, Salmonella typhimurium LT2
caacgccuccagcgg

SEQ ID NO: 1823215 - RNA, 16 nt, Salmonella typhimurium LT2
caacgccggcaacacc

SEQ ID NO: 1823216 - RNA, 14 nt, Salmonella typhimurium LT2
caacgcaggcugga

SEQ ID NO: 1823217 - RNA, 20 nt, Salmonella typhimurium LT2
caaccauugucuucuaccgc

SEQ ID NO: 1823218 - RNA, 14 nt, Salmonella typhimurium LT2
caaccaaugcagcg

SEQ ID NO: 1823219 - RNA, 22 nt, Salmonella typhimurium LT2
caaccacaaguuuauccggcac

SEQ ID NO: 1823220 - RNA, 11 nt, Salmonella typhimurium LT2
caacagcgacc

SEQ ID NO: 1823221 - RNA, 14 nt, Salmonella typhimurium LT2
caaagcccaccgcg

SEQ ID NO: 1823222 - RNA, 18 nt, Salmonella typhimurium LT2
caaagcauugugcagcca

SEQ ID NO: 1823223 - RNA, 19 nt, Salmonella typhimurium LT2
caaagcauugugcagccau

SEQ ID NO: 1823224 - RNA, 11 nt, Salmonella typhimurium LT2
auuuagccguu

SEQ ID NO: 1823225 - RNA, 22 nt, Salmonella typhimurium LT2
auuuagcgcaguacgcgccaug

SEQ ID NO: 1823226 - RNA, 16 nt, Salmonella typhimurium LT2
caaaugaugcuuucga

SEQ ID NO: 1823227 - RNA, 22 nt, Salmonella typhimurium LT2
caaauagguuuuaugcaucgcg

SEQ ID NO: 1823228 - RNA, 13 nt, Salmonella typhimurium LT2
caacaacaggcca

SEQ ID NO: 1823229 - RNA, 16 nt, Salmonella typhimurium LT2
caacaaauuccggcac

SEQ ID NO: 1823230 - RNA, 12 nt, Salmonella typhimurium LT2
caccacgcaggc

SEQ ID NO: 1823231 - RNA, 23 nt, Salmonella typhimurium LT2
caccaaaaauucuuuuacgaucg

SEQ ID NO: 1823232 - RNA, 14 nt, Salmonella typhimurium LT2
cacaaaauauuacg

SEQ ID NO: 1823233 - RNA, 16 nt, Salmonella typhimurium LT2
cacaaacuccagacga

SEQ ID NO: 1823234 - RNA, 18 nt, Salmonella typhimurium LT2
cacagcccauaccagcgc

SEQ ID NO: 1823235 - RNA, 22 nt, Salmonella typhimurium LT2
cacagccccagcaccaacgccg

SEQ ID NO: 1823236 - RNA, 14 nt, Salmonella typhimurium LT2
cacauccagcguca

SEQ ID NO: 1823237 - RNA, 13 nt, Salmonella typhimurium LT2
cacauauacccgc

SEQ ID NO: 1823238 - RNA, 11 nt, Salmonella typhimurium LT2
cacauaucgca

SEQ ID NO: 1823239 - RNA, 14 nt, Salmonella typhimurium LT2
cacagugcgcgacc

SEQ ID NO: 1823240 - RNA, 17 nt, Salmonella typhimurium LT2
caccagccguucaccag

SEQ ID NO: 1823241 - RNA, 12 nt, Salmonella typhimurium LT2
caccagcgaucc

SEQ ID NO: 1823242 - RNA, 13 nt, Salmonella typhimurium LT2
caccagcgcagua

SEQ ID NO: 1823243 - RNA, 22 nt, Salmonella typhimurium LT2
caccaguuuauccgccagccag

SEQ ID NO: 1823244 - RNA, 17 nt, Salmonella typhimurium LT2
caccaguuuauccgccg

SEQ ID NO: 1823245 - RNA, 23 nt, Salmonella typhimurium LT2
caccaggucaaaauuaaucgcca

SEQ ID NO: 1823246 - RNA, 14 nt, Salmonella typhimurium LT2
caccauucgcgcau

SEQ ID NO: 1823247 - RNA, 13 nt, Salmonella typhimurium LT2
caccauuaucgcg

SEQ ID NO: 1823248 - RNA, 17 nt, Salmonella typhimurium LT2
caccauaucgcagacca

SEQ ID NO: 1823249 - RNA, 18 nt, Salmonella typhimurium LT2
caccgggcaggauacggc

SEQ ID NO: 1823250 - RNA, 17 nt, Salmonella typhimurium LT2
caccgggguucagacca

SEQ ID NO: 1823251 - RNA, 18 nt, Salmonella typhimurium LT2
caccgcuaaucccagcgc

SEQ ID NO: 1823252 - RNA, 18 nt, Salmonella typhimurium LT2
caccgcgaauauacgcac

SEQ ID NO: 1823253 - RNA, 15 nt, Salmonella typhimurium LT2
caccggauacccagc

SEQ ID NO: 1823254 - RNA, 22 nt, Salmonella typhimurium LT2
caccggccccggaauggcgaac

SEQ ID NO: 1823255 - RNA, 19 nt, Salmonella typhimurium LT2
cacccuguaaugacgcugu

SEQ ID NO: 1823256 - RNA, 15 nt, Salmonella typhimurium LT2
caccgccagagcacg

SEQ ID NO: 1823257 - RNA, 15 nt, Salmonella typhimurium LT2
caccgccaaacgcgg

SEQ ID NO: 1823258 - RNA, 13 nt, Salmonella typhimurium LT2
augaucgacaaug

SEQ ID NO: 1823259 - RNA, 23 nt, Salmonella typhimurium LT2
augaucagacgcacaaucgccgu

SEQ ID NO: 1823260 - RNA, 17 nt, Salmonella typhimurium LT2
augaucagcauagcgcc

SEQ ID NO: 1823261 - RNA, 22 nt, Salmonella typhimurium LT2
augauaucggccggaugccagu

SEQ ID NO: 1823262 - RNA, 23 nt, Salmonella typhimurium LT2
augacuaaaucagcauccgcaag

SEQ ID NO: 1823263 - RNA, 15 nt, Salmonella typhimurium LT2
augacccagcgcgac

SEQ ID NO: 1823264 - RNA, 18 nt, Salmonella typhimurium LT2
augacccccagauagccc

SEQ ID NO: 1823265 - RNA, 13 nt, Salmonella typhimurium LT2
augaccauucgca

SEQ ID NO: 1823266 - RNA, 20 nt, Salmonella typhimurium LT2
augaauuccugcggugguaa

SEQ ID NO: 1823267 - RNA, 20 nt, Salmonella typhimurium LT2
aucuuuauuaaaaagcagcc

SEQ ID NO: 1823268 - RNA, 16 nt, Salmonella typhimurium LT2
aucuuucucgcggcag

SEQ ID NO: 1823269 - RNA, 17 nt, Salmonella typhimurium LT2
augaaugacgagcaggu

SEQ ID NO: 1823270 - RNA, 18 nt, Salmonella typhimurium LT2
augaauacgcuccagcug

SEQ ID NO: 1823271 - RNA, 14 nt, Salmonella typhimurium LT2
aucuuuuccggcag

SEQ ID NO: 1823272 - RNA, 20 nt, Salmonella typhimurium LT2
aucugcucgacgcgcugcgg

SEQ ID NO: 1823273 - RNA, 16 nt, Salmonella typhimurium LT2
aucuguagauugcgcg

SEQ ID NO: 1823274 - RNA, 14 nt, Salmonella typhimurium LT2
aucuucauccgcuc

SEQ ID NO: 1823275 - RNA, 21 nt, Salmonella typhimurium LT2
aucuuccguuuuacacggcgu

SEQ ID NO: 1823276 - RNA, 16 nt, Salmonella typhimurium LT2
aucuuccacuucauca

SEQ ID NO: 1823277 - RNA, 13 nt, Salmonella typhimurium LT2
aucuuuacguaac

SEQ ID NO: 1823278 - RNA, 23 nt, Salmonella typhimurium LT2
aucgucaaaaccaaacagcgaca

SEQ ID NO: 1823279 - RNA, 18 nt, Salmonella typhimurium LT2
aucgucaccaggaugcca

SEQ ID NO: 1823280 - RNA, 22 nt, Salmonella typhimurium LT2
aucgguaaacgucgucacguua

SEQ ID NO: 1823281 - RNA, 18 nt, Salmonella typhimurium LT2
aucgguaguguuaucgcc

SEQ ID NO: 1823282 - RNA, 21 nt, Salmonella typhimurium LT2
aucgguaguguuaucgccgau

SEQ ID NO: 1823283 - RNA, 13 nt, Salmonella typhimurium LT2
aucguccggcauc

SEQ ID NO: 1823284 - RNA, 20 nt, Salmonella typhimurium LT2
aucguccguugggcgguauu

SEQ ID NO: 1823285 - RNA, 17 nt, Salmonella typhimurium LT2
aucguugccagcggcca

SEQ ID NO: 1823286 - RNA, 19 nt, Salmonella typhimurium LT2
aucuaauacgagcggguca

SEQ ID NO: 1823287 - RNA, 22 nt, Salmonella typhimurium LT2
aucuaauacgagcgggucagga

SEQ ID NO: 1823288 - RNA, 20 nt, Salmonella typhimurium LT2
aucucaagcgccgccgcauu

SEQ ID NO: 1823289 - RNA, 17 nt, Salmonella typhimurium LT2
aucggcaagcaucugau

SEQ ID NO: 1823290 - RNA, 16 nt, Salmonella typhimurium LT2
aucggcaccuggagcg

SEQ ID NO: 1823291 - RNA, 14 nt, Salmonella typhimurium LT2
aucggccagcgcca

SEQ ID NO: 1823292 - RNA, 23 nt, Salmonella typhimurium LT2
aucggcguuuugcgcgccacgcc

SEQ ID NO: 1823293 - RNA, 14 nt, Salmonella typhimurium LT2
aucggcguaccgca

SEQ ID NO: 1823294 - RNA, 23 nt, Salmonella typhimurium LT2
aucggcgcguaaguuugcguacu

SEQ ID NO: 1823295 - RNA, 15 nt, Salmonella typhimurium LT2
aucgccugauggcga

SEQ ID NO: 1823296 - RNA, 14 nt, Salmonella typhimurium LT2
aucgccucaacgcu

SEQ ID NO: 1823297 - RNA, 14 nt, Salmonella typhimurium LT2
aucgcgcagcaggc

SEQ ID NO: 1823298 - RNA, 16 nt, Salmonella typhimurium LT2
aucgcgauagcgcuga

SEQ ID NO: 1823299 - RNA, 22 nt, Salmonella typhimurium LT2
aucgcgauccagccccagcgcc

SEQ ID NO: 1823300 - RNA, 17 nt, Salmonella typhimurium LT2
aucgcgacggaccggca

SEQ ID NO: 1823301 - RNA, 22 nt, Salmonella typhimurium LT2
aucgccgccaucaacagcaggc

SEQ ID NO: 1823302 - RNA, 23 nt, Salmonella typhimurium LT2
aucgccgcccgcaugguaaacgc

SEQ ID NO: 1823303 - RNA, 21 nt, Salmonella typhimurium LT2
aucgccgccccagcgguacca

SEQ ID NO: 1823304 - RNA, 16 nt, Salmonella typhimurium LT2
aucgccggacggcgca

SEQ ID NO: 1823305 - RNA, 20 nt, Salmonella typhimurium LT2
aucgccggacggcgcagcgc

SEQ ID NO: 1823306 - RNA, 22 nt, Salmonella typhimurium LT2
aucgccgcgccggacuccagca

SEQ ID NO: 1823307 - RNA, 13 nt, Salmonella typhimurium LT2
aucgccgcgacag

SEQ ID NO: 1823308 - RNA, 13 nt, Salmonella typhimurium LT2
aucgccgcugcga

SEQ ID NO: 1823309 - RNA, 12 nt, Salmonella typhimurium LT2
aucgcgcggauu

SEQ ID NO: 1823310 - RNA, 22 nt, Salmonella typhimurium LT2
aucgcgccaugauucaucccgc

SEQ ID NO: 1823311 - RNA, 21 nt, Salmonella typhimurium LT2
aucgcuuuuugcagauccuua

SEQ ID NO: 1823312 - RNA, 20 nt, Salmonella typhimurium LT2
aucggagauauaaaccugau

SEQ ID NO: 1823313 - RNA, 15 nt, Salmonella typhimurium LT2
aucgcugcgccagca

SEQ ID NO: 1823314 - RNA, 17 nt, Salmonella typhimurium LT2
aucgcuuugagcagcgc

SEQ ID NO: 1823315 - RNA, 19 nt, Salmonella typhimurium LT2
aucgcuuugagcagcgcca

SEQ ID NO: 1823316 - RNA, 21 nt, Salmonella typhimurium LT2
aucgcuuugagcagcgccauc

SEQ ID NO: 1823317 - RNA, 19 nt, Salmonella typhimurium LT2
aucgcuuuuaucuggguca

SEQ ID NO: 1823318 - RNA, 11 nt, Salmonella typhimurium LT2
aucgcguucgc

SEQ ID NO: 1823319 - RNA, 12 nt, Salmonella typhimurium LT2
aucgcguuggcu

SEQ ID NO: 1823320 - RNA, 22 nt, Salmonella typhimurium LT2
aucgauccgcaucagcaacgcg

SEQ ID NO: 1823321 - RNA, 14 nt, Salmonella typhimurium LT2
aucgauacgcggau

SEQ ID NO: 1823322 - RNA, 23 nt, Salmonella typhimurium LT2
aucgaggcuggucgcgauagccg

SEQ ID NO: 1823323 - RNA, 18 nt, Salmonella typhimurium LT2
aucgaccuuuuucgcgcc

SEQ ID NO: 1823324 - RNA, 21 nt, Salmonella typhimurium LT2
aucaggccuaccagccgagug

SEQ ID NO: 1823325 - RNA, 22 nt, Salmonella typhimurium LT2
aucgaugcuggugaagacgcug

SEQ ID NO: 1823326 - RNA, 16 nt, Salmonella typhimurium LT2
aucgaugaccauacgg

SEQ ID NO: 1823327 - RNA, 23 nt, Salmonella typhimurium LT2
aucgcaacagauaagcaccugca

SEQ ID NO: 1823328 - RNA, 20 nt, Salmonella typhimurium LT2
aucgauuuacggaucgccgc

SEQ ID NO: 1823329 - RNA, 17 nt, Salmonella typhimurium LT2
aucgcauuuaaucgccu

SEQ ID NO: 1823330 - RNA, 22 nt, Salmonella typhimurium LT2
aucgcauuaacguccauaccgg

SEQ ID NO: 1823331 - RNA, 17 nt, Salmonella typhimurium LT2
aucgcaggcggucagca

SEQ ID NO: 1823332 - RNA, 19 nt, Salmonella typhimurium LT2
aucgcauccucgccgacug

SEQ ID NO: 1823333 - RNA, 19 nt, Salmonella typhimurium LT2
aucgccacaugcggcaggc

SEQ ID NO: 1823334 - RNA, 22 nt, Salmonella typhimurium LT2
aucgccacaugcggcaggcuuu

SEQ ID NO: 1823335 - RNA, 22 nt, Salmonella typhimurium LT2
aucgccacggugagccacugca

SEQ ID NO: 1823336 - RNA, 19 nt, Salmonella typhimurium LT2
aucgccagggcuuccgcuu

SEQ ID NO: 1823337 - RNA, 14 nt, Salmonella typhimurium LT2
aucgccagcagcgc

SEQ ID NO: 1823338 - RNA, 19 nt, Salmonella typhimurium LT2
aucgccagccccagcccug

SEQ ID NO: 1823339 - RNA, 17 nt, Salmonella typhimurium LT2
aucgccauucacggcga

SEQ ID NO: 1823340 - RNA, 20 nt, Salmonella typhimurium LT2
aucgccaucaacuccuccgg

SEQ ID NO: 1823341 - RNA, 15 nt, Salmonella typhimurium LT2
aucgccaucaacgcc

SEQ ID NO: 1823342 - RNA, 23 nt, Salmonella typhimurium LT2
aucgccaguuugucaugcgugcg

SEQ ID NO: 1823343 - RNA, 15 nt, Salmonella typhimurium LT2
aucgccaucagcgcg

SEQ ID NO: 1823344 - RNA, 14 nt, Salmonella typhimurium LT2
aucgccccaggcga

SEQ ID NO: 1823345 - RNA, 21 nt, Salmonella typhimurium LT2
auugcugcuguauuucacgcc

SEQ ID NO: 1823346 - RNA, 15 nt, Salmonella typhimurium LT2
auugcuggaaacgcg

SEQ ID NO: 1823347 - RNA, 19 nt, Salmonella typhimurium LT2
auugccgccuugguugccg

SEQ ID NO: 1823348 - RNA, 19 nt, Salmonella typhimurium LT2
auuggaauauccgcugcgg

SEQ ID NO: 1823349 - RNA, 14 nt, Salmonella typhimurium LT2
auugguacaacgcc

SEQ ID NO: 1823350 - RNA, 16 nt, Salmonella typhimurium LT2
auugguagacgcgcua

SEQ ID NO: 1823351 - RNA, 17 nt, Salmonella typhimurium LT2
auugguagacgcgcuag

SEQ ID NO: 1823352 - RNA, 23 nt, Salmonella typhimurium LT2
auuccuauuuucucaaguagaac

SEQ ID NO: 1823353 - RNA, 19 nt, Salmonella typhimurium LT2
auuccugcuuuuagcgaua

SEQ ID NO: 1823354 - RNA, 14 nt, Salmonella typhimurium LT2
auuccugucaacga

SEQ ID NO: 1823355 - RNA, 20 nt, Salmonella typhimurium LT2
auucauuauguuagaaucua

SEQ ID NO: 1823356 - RNA, 23 nt, Salmonella typhimurium LT2
auucgacagauuggucagcagcc

SEQ ID NO: 1823357 - RNA, 15 nt, Salmonella typhimurium LT2
auucgcuacgcacga

SEQ ID NO: 1823358 - RNA, 17 nt, Salmonella typhimurium LT2
auucgguuuauccccgc

SEQ ID NO: 1823359 - RNA, 17 nt, Salmonella typhimurium LT2
auucucuguugccgccc

SEQ ID NO: 1823360 - RNA, 23 nt, Salmonella typhimurium LT2
auucugaagagguguaguuggcg

SEQ ID NO: 1823361 - RNA, 14 nt, Salmonella typhimurium LT2
auugacgauaucau

SEQ ID NO: 1823362 - RNA, 15 nt, Salmonella typhimurium LT2
auugaacccgaccgu

SEQ ID NO: 1823363 - RNA, 19 nt, Salmonella typhimurium LT2
auucuuuaauuugugccag

SEQ ID NO: 1823364 - RNA, 16 nt, Salmonella typhimurium LT2
auucugcgaaagccuc

SEQ ID NO: 1823365 - RNA, 21 nt, Salmonella typhimurium LT2
auucugcaacuguugcgccag

SEQ ID NO: 1823366 - RNA, 16 nt, Salmonella typhimurium LT2
auuaucaauccugcca

SEQ ID NO: 1823367 - RNA, 16 nt, Salmonella typhimurium LT2
auucaucucgauaccg

SEQ ID NO: 1823368 - RNA, 20 nt, Salmonella typhimurium LT2
auucauaaugguugugccag

SEQ ID NO: 1823369 - RNA, 21 nt, Salmonella typhimurium LT2
auucaguuucuucggcuucac

SEQ ID NO: 1823370 - RNA, 17 nt, Salmonella typhimurium LT2
auucauaacaccaauac

SEQ ID NO: 1823371 - RNA, 23 nt, Salmonella typhimurium LT2
auucaagaacgguuuauccccgc

SEQ ID NO: 1823372 - RNA, 19 nt, Salmonella typhimurium LT2
auuagccggauagcaacgc

SEQ ID NO: 1823373 - RNA, 22 nt, Salmonella typhimurium LT2
auuagcguuuuuaucuuuuacg

SEQ ID NO: 1823374 - RNA, 12 nt, Salmonella typhimurium LT2
auuagccgccag

SEQ ID NO: 1823375 - RNA, 20 nt, Salmonella typhimurium LT2
auuaauaaccaauaauugcc

SEQ ID NO: 1823376 - RNA, 22 nt, Salmonella typhimurium LT2
auuaggcuuuucauucagcgcg

SEQ ID NO: 1823377 - RNA, 19 nt, Salmonella typhimurium LT2
auuaacgggcguugcucaa

SEQ ID NO: 1823378 - RNA, 17 nt, Salmonella typhimurium LT2
augugcucguuggccug

SEQ ID NO: 1823379 - RNA, 15 nt, Salmonella typhimurium LT2
auguuuccguuugua

SEQ ID NO: 1823380 - RNA, 14 nt, Salmonella typhimurium LT2
auguuuacgccauu

SEQ ID NO: 1823381 - RNA, 17 nt, Salmonella typhimurium LT2
auguuuuuaucaugcug

SEQ ID NO: 1823382 - RNA, 20 nt, Salmonella typhimurium LT2
augucguuguaguuaucgcc

SEQ ID NO: 1823383 - RNA, 21 nt, Salmonella typhimurium LT2
augucucaauaucgccuaccg

SEQ ID NO: 1823384 - RNA, 15 nt, Salmonella typhimurium LT2
auguccgacgccgcu

SEQ ID NO: 1823385 - RNA, 14 nt, Salmonella typhimurium LT2
augucccgauauug

SEQ ID NO: 1823386 - RNA, 19 nt, Salmonella typhimurium LT2
auguccgccuaccagcaca

SEQ ID NO: 1823387 - RNA, 19 nt, Salmonella typhimurium LT2
auguccguuugcugcacca

SEQ ID NO: 1823388 - RNA, 20 nt, Salmonella typhimurium LT2
auguccguuuuuucugucgu

SEQ ID NO: 1823389 - RNA, 20 nt, Salmonella typhimurium LT2
auguagagcggauaagcgca

SEQ ID NO: 1823390 - RNA, 17 nt, Salmonella typhimurium LT2
auguagcgcggcagcgc

SEQ ID NO: 1823391 - RNA, 17 nt, Salmonella typhimurium LT2
auguacgaaagcgcgau

SEQ ID NO: 1823392 - RNA, 21 nt, Salmonella typhimurium LT2
auggcgaauccguugaucguc

SEQ ID NO: 1823393 - RNA, 14 nt, Salmonella typhimurium LT2
auggaacuuaucca

SEQ ID NO: 1823394 - RNA, 17 nt, Salmonella typhimurium LT2
auggaacuuauccacaa

SEQ ID NO: 1823395 - RNA, 13 nt, Salmonella typhimurium LT2
auggaaguugccg

SEQ ID NO: 1823396 - RNA, 18 nt, Salmonella typhimurium LT2
auggacaaguaaaccggu

SEQ ID NO: 1823397 - RNA, 20 nt, Salmonella typhimurium LT2
auggcgcuacgcuuauccgg

SEQ ID NO: 1823398 - RNA, 12 nt, Salmonella typhimurium LT2
auggcgcugcgc

SEQ ID NO: 1823399 - RNA, 22 nt, Salmonella typhimurium LT2
auggcgcuacgcuuaucaggcc

SEQ ID NO: 1823400 - RNA, 22 nt, Salmonella typhimurium LT2
auggcgcuucgcuuaucaggcc

SEQ ID NO: 1823401 - RNA, 24 nt, Salmonella typhimurium LT2
auggcggccaaaucgucagccgcc

SEQ ID NO: 1823402 - RNA, 13 nt, Salmonella typhimurium LT2
auggcugauggcg

SEQ ID NO: 1823403 - RNA, 23 nt, Salmonella typhimurium LT2
auggcugacugaauuuucagcca

SEQ ID NO: 1823404 - RNA, 18 nt, Salmonella typhimurium LT2
auggcuacaccuuauccg

SEQ ID NO: 1823405 - RNA, 18 nt, Salmonella typhimurium LT2
auggcguuccgguugccg

SEQ ID NO: 1823406 - RNA, 13 nt, Salmonella typhimurium LT2
augcgcuuuccgc

SEQ ID NO: 1823407 - RNA, 16 nt, Salmonella typhimurium LT2
augcggacgcugacgc

SEQ ID NO: 1823408 - RNA, 21 nt, Salmonella typhimurium LT2
augcgauacguaggccugaua

SEQ ID NO: 1823409 - RNA, 21 nt, Salmonella typhimurium LT2
augcgcaaggccguuauccag

SEQ ID NO: 1823410 - RNA, 19 nt, Salmonella typhimurium LT2
augcuuauccggccuacag

SEQ ID NO: 1823411 - RNA, 14 nt, Salmonella typhimurium LT2
augcuggucagcaa

SEQ ID NO: 1823412 - RNA, 20 nt, Salmonella typhimurium LT2
augcuggugaagacgcugca

SEQ ID NO: 1823413 - RNA, 22 nt, Salmonella typhimurium LT2
augcguucuagcuuaucgccaa

SEQ ID NO: 1823414 - RNA, 18 nt, Salmonella typhimurium LT2
augcguugaaaaccugca

SEQ ID NO: 1823415 - RNA, 19 nt, Salmonella typhimurium LT2
augcguuggcucgcugcca

SEQ ID NO: 1823416 - RNA, 22 nt, Salmonella typhimurium LT2
augcguuguaccguuuuccaga

SEQ ID NO: 1823417 - RNA, 15 nt, Salmonella typhimurium LT2
augcgugcgccgcga

SEQ ID NO: 1823418 - RNA, 20 nt, Salmonella typhimurium LT2
augcgguuguucuuccagcg

SEQ ID NO: 1823419 - RNA, 21 nt, Salmonella typhimurium LT2
augcgguuguucuuccagcgu

SEQ ID NO: 1823420 - RNA, 12 nt, Salmonella typhimurium LT2
augccgccacuu

SEQ ID NO: 1823421 - RNA, 14 nt, Salmonella typhimurium LT2
augaugccacaggc

SEQ ID NO: 1823422 - RNA, 13 nt, Salmonella typhimurium LT2
augaucgucaacg

SEQ ID NO: 1823423 - RNA, 20 nt, Salmonella typhimurium LT2
augccuaacguguuaucgcu

SEQ ID NO: 1823424 - RNA, 21 nt, Salmonella typhimurium LT2
augccugaugcgacgcuuacc

SEQ ID NO: 1823425 - RNA, 19 nt, Salmonella typhimurium LT2
augccugaaaauagcgcca

SEQ ID NO: 1823426 - RNA, 17 nt, Salmonella typhimurium LT2
augccgcgucaggagcg

SEQ ID NO: 1823427 - RNA, 19 nt, Salmonella typhimurium LT2
augccgccuguugcaugac

SEQ ID NO: 1823428 - RNA, 13 nt, Salmonella typhimurium LT2
augccguagcggc

SEQ ID NO: 1823429 - RNA, 23 nt, Salmonella typhimurium LT2
augccggguggcggcugcgccuu

SEQ ID NO: 1823430 - RNA, 16 nt, Salmonella typhimurium LT2
augccgggcagacgac

SEQ ID NO: 1823431 - RNA, 16 nt, Salmonella typhimurium LT2
aggcgcaaggcgucgc

SEQ ID NO: 1823432 - RNA, 19 nt, Salmonella typhimurium LT2
aggcgauagcgaacggcga

SEQ ID NO: 1823433 - RNA, 16 nt, Salmonella typhimurium LT2
aggcgaacuccagcgc

SEQ ID NO: 1823434 - RNA, 22 nt, Salmonella typhimurium LT2
aggcgaacuucauccacgccga

SEQ ID NO: 1823435 - RNA, 22 nt, Salmonella typhimurium LT2
aggccucuaucuucucaggcga

SEQ ID NO: 1823436 - RNA, 18 nt, Salmonella typhimurium LT2
aggccuacacguugcgac

SEQ ID NO: 1823437 - RNA, 23 nt, Salmonella typhimurium LT2
aggccguggaucucgucgccggu

SEQ ID NO: 1823438 - RNA, 20 nt, Salmonella typhimurium LT2
aggcgcagccgccauccggc

SEQ ID NO: 1823439 - RNA, 18 nt, Salmonella typhimurium LT2
aggcgccaguuggcguac

SEQ ID NO: 1823440 - RNA, 21 nt, Salmonella typhimurium LT2
aggcgccgcucaucaccagca

SEQ ID NO: 1823441 - RNA, 18 nt, Salmonella typhimurium LT2
aggcgccgccauccggca

SEQ ID NO: 1823442 - RNA, 23 nt, Salmonella typhimurium LT2
aggcgcgaaucgacaauccgcca

SEQ ID NO: 1823443 - RNA, 13 nt, Salmonella typhimurium LT2
aggcggcaaucag

SEQ ID NO: 1823444 - RNA, 17 nt, Salmonella typhimurium LT2
aggcggcaaucagcgcc

SEQ ID NO: 1823445 - RNA, 16 nt, Salmonella typhimurium LT2
aggcggagccgccauc

SEQ ID NO: 1823446 - RNA, 22 nt, Salmonella typhimurium LT2
aggcgcucggccagauaacgcg

SEQ ID NO: 1823447 - RNA, 14 nt, Salmonella typhimurium LT2
aggcgcuggcgagc

SEQ ID NO: 1823448 - RNA, 18 nt, Salmonella typhimurium LT2
aggcgcggccucauggcg

SEQ ID NO: 1823449 - RNA, 17 nt, Salmonella typhimurium LT2
aggcgcuaucuucaaua

SEQ ID NO: 1823450 - RNA, 20 nt, Salmonella typhimurium LT2
aggcgcuauucccaggcaaa

SEQ ID NO: 1823451 - RNA, 13 nt, Salmonella typhimurium LT2
aggcagcgccagc

SEQ ID NO: 1823452 - RNA, 19 nt, Salmonella typhimurium LT2
aggcaggaauucggccuuc

SEQ ID NO: 1823453 - RNA, 17 nt, Salmonella typhimurium LT2
aggcaggcaacaugacc

SEQ ID NO: 1823454 - RNA, 21 nt, Salmonella typhimurium LT2
aggcagauccaaauggcguac

SEQ ID NO: 1823455 - RNA, 13 nt, Salmonella typhimurium LT2
aggcauaaugcca

SEQ ID NO: 1823456 - RNA, 17 nt, Salmonella typhimurium LT2
agcuggcauaaccgcag

SEQ ID NO: 1823457 - RNA, 22 nt, Salmonella typhimurium LT2
aggcacuuucauugccguuaac

SEQ ID NO: 1823458 - RNA, 19 nt, Salmonella typhimurium LT2
agcuggcacuuccccugua

SEQ ID NO: 1823459 - RNA, 21 nt, Salmonella typhimurium LT2
aggcauccgugaccugcugac

SEQ ID NO: 1823460 - RNA, 18 nt, Salmonella typhimurium LT2
aggcaucguacgggcaaa

SEQ ID NO: 1823461 - RNA, 16 nt, Salmonella typhimurium LT2
aggccagauucaccac

SEQ ID NO: 1823462 - RNA, 18 nt, Salmonella typhimurium LT2
aggccccgccauccggca

SEQ ID NO: 1823463 - RNA, 13 nt, Salmonella typhimurium LT2
aggccagccugau

SEQ ID NO: 1823464 - RNA, 15 nt, Salmonella typhimurium LT2
aggccggacaggcga

SEQ ID NO: 1823465 - RNA, 19 nt, Salmonella typhimurium LT2
aggccggauaagcgaaucc

SEQ ID NO: 1823466 - RNA, 20 nt, Salmonella typhimurium LT2
aggccggauaaggcgcagcc

SEQ ID NO: 1823467 - RNA, 19 nt, Salmonella typhimurium LT2
aggccggguccgcccggca

SEQ ID NO: 1823468 - RNA, 17 nt, Salmonella typhimurium LT2
aggcuuaacacccggau

SEQ ID NO: 1823469 - RNA, 13 nt, Salmonella typhimurium LT2
agggccaggcgcg

SEQ ID NO: 1823470 - RNA, 18 nt, Salmonella typhimurium LT2
agggcgauauccagcgcc

SEQ ID NO: 1823471 - RNA, 16 nt, Salmonella typhimurium LT2
agggcgugacgcgcca

SEQ ID NO: 1823472 - RNA, 23 nt, Salmonella typhimurium LT2
aggggccugcacaauaccaauaa

SEQ ID NO: 1823473 - RNA, 14 nt, Salmonella typhimurium LT2
agggcuuccgcuuu

SEQ ID NO: 1823474 - RNA, 14 nt, Salmonella typhimurium LT2
aggcuaaucaggaa

SEQ ID NO: 1823475 - RNA, 23 nt, Salmonella typhimurium LT2
aggcguucacgcugccacccggc

SEQ ID NO: 1823476 - RNA, 18 nt, Salmonella typhimurium LT2
aggcguaaaaaggcgcau

SEQ ID NO: 1823477 - RNA, 20 nt, Salmonella typhimurium LT2
aggcguagcgccaucaggca

SEQ ID NO: 1823478 - RNA, 23 nt, Salmonella typhimurium LT2
aggcgguucuguaucccguuaag

SEQ ID NO: 1823479 - RNA, 14 nt, Salmonella typhimurium LT2
aggcgguuuauccg

SEQ ID NO: 1823480 - RNA, 20 nt, Salmonella typhimurium LT2
aggcggcuuuuucaucaucg

SEQ ID NO: 1823481 - RNA, 23 nt, Salmonella typhimurium LT2
aggcggcgccgcgccgccguagc

SEQ ID NO: 1823482 - RNA, 14 nt, Salmonella typhimurium LT2
aggcggccugcggc

SEQ ID NO: 1823483 - RNA, 23 nt, Salmonella typhimurium LT2
aggugauagugcguucgaaucag

SEQ ID NO: 1823484 - RNA, 16 nt, Salmonella typhimurium LT2
agggugaauaccagcg

SEQ ID NO: 1823485 - RNA, 21 nt, Salmonella typhimurium LT2
agggugaauaccagcggcaaa

SEQ ID NO: 1823486 - RNA, 19 nt, Salmonella typhimurium LT2
agguauuaaauacagaguc

SEQ ID NO: 1823487 - RNA, 19 nt, Salmonella typhimurium LT2
aggucaugaucgauccgca

SEQ ID NO: 1823488 - RNA, 13 nt, Salmonella typhimurium LT2
aggugauggugcc

SEQ ID NO: 1823489 - RNA, 15 nt, Salmonella typhimurium LT2
aguacgccucgcgca

SEQ ID NO: 1823490 - RNA, 14 nt, Salmonella typhimurium LT2
aguaaguacuccag

SEQ ID NO: 1823491 - RNA, 20 nt, Salmonella typhimurium LT2
aguaacuggcuccacgggcg

SEQ ID NO: 1823492 - RNA, 16 nt, Salmonella typhimurium LT2
aguaucaaugccgcga

SEQ ID NO: 1823493 - RNA, 16 nt, Salmonella typhimurium LT2
aguauacagacagcag

SEQ ID NO: 1823494 - RNA, 17 nt, Salmonella typhimurium LT2
aguuccaucuccggcga

SEQ ID NO: 1823495 - RNA, 22 nt, Salmonella typhimurium LT2
aguuccaucuccggcgaccaau

SEQ ID NO: 1823496 - RNA, 15 nt, Salmonella typhimurium LT2
aguuccaccaguucu

SEQ ID NO: 1823497 - RNA, 22 nt, Salmonella typhimurium LT2
aguuccaccguaugugcgccgu

SEQ ID NO: 1823498 - RNA, 16 nt, Salmonella typhimurium LT2
aguucgaauagccggu

SEQ ID NO: 1823499 - RNA, 14 nt, Salmonella typhimurium LT2
aguguaaacgccag

SEQ ID NO: 1823500 - RNA, 14 nt, Salmonella typhimurium LT2
aguucauauggcgu

SEQ ID NO: 1823501 - RNA, 23 nt, Salmonella typhimurium LT2
aguucuuucgccagaaccgcgcu

SEQ ID NO: 1823502 - RNA, 14 nt, Salmonella typhimurium LT2
aguugccuucgauu

SEQ ID NO: 1823503 - RNA, 18 nt, Salmonella typhimurium LT2
aguugcgauccuuccggc

SEQ ID NO: 1823504 - RNA, 18 nt, Salmonella typhimurium LT2
aguugcguucccaguucc

SEQ ID NO: 1823505 - RNA, 13 nt, Salmonella typhimurium LT2
aguuuaucugcgu

SEQ ID NO: 1823506 - RNA, 14 nt, Salmonella typhimurium LT2
aguuuauccgccag

SEQ ID NO: 1823507 - RNA, 16 nt, Salmonella typhimurium LT2
agugauaacgcgccga

SEQ ID NO: 1823508 - RNA, 17 nt, Salmonella typhimurium LT2
agugauaccagccaaca

SEQ ID NO: 1823509 - RNA, 15 nt, Salmonella typhimurium LT2
agugagcauuacguc

SEQ ID NO: 1823510 - RNA, 14 nt, Salmonella typhimurium LT2
agugcucaccgaca

SEQ ID NO: 1823511 - RNA, 14 nt, Salmonella typhimurium LT2
aguggacgcgucgc

SEQ ID NO: 1823512 - RNA, 19 nt, Salmonella typhimurium LT2
agugaauuaugaccaaugu

SEQ ID NO: 1823513 - RNA, 16 nt, Salmonella typhimurium LT2
agucaagcuugccgcu

SEQ ID NO: 1823514 - RNA, 21 nt, Salmonella typhimurium LT2
auaacuugccgccugccugca

SEQ ID NO: 1823515 - RNA, 20 nt, Salmonella typhimurium LT2
auaacuuucggguugcccug

SEQ ID NO: 1823516 - RNA, 16 nt, Salmonella typhimurium LT2
auaagagggcgccaug

SEQ ID NO: 1823517 - RNA, 18 nt, Salmonella typhimurium LT2
auaagcaaagcgccaucc

SEQ ID NO: 1823518 - RNA, 20 nt, Salmonella typhimurium LT2
auaagcaccugcgacgcaug

SEQ ID NO: 1823519 - RNA, 18 nt, Salmonella typhimurium LT2
auaacgcguucuggcgau

SEQ ID NO: 1823520 - RNA, 23 nt, Salmonella typhimurium LT2
auaaccgucuucauccaugcggc

SEQ ID NO: 1823521 - RNA, 20 nt, Salmonella typhimurium LT2
auaaccucaaugauuuccgc

SEQ ID NO: 1823522 - RNA, 22 nt, Salmonella typhimurium LT2
auaacccgccuggcgacggguu

SEQ ID NO: 1823523 - RNA, 20 nt, Salmonella typhimurium LT2
auaaaaaagccgaccuggcg

SEQ ID NO: 1823524 - RNA, 17 nt, Salmonella typhimurium LT2
aguuucaucaucgccga

SEQ ID NO: 1823525 - RNA, 23 nt, Salmonella typhimurium LT2
aguuucagcccaaaagcgaccuc

SEQ ID NO: 1823526 - RNA, 18 nt, Salmonella typhimurium LT2
auacgccacgcuccagcg

SEQ ID NO: 1823527 - RNA, 21 nt, Salmonella typhimurium LT2
auacgauauucuguuagcgcc

SEQ ID NO: 1823528 - RNA, 14 nt, Salmonella typhimurium LT2
auaccuuccggcgu

SEQ ID NO: 1823529 - RNA, 18 nt, Salmonella typhimurium LT2
auaccuaacucuuccgca

SEQ ID NO: 1823530 - RNA, 23 nt, Salmonella typhimurium LT2
auaccgauucccagucauccggu

SEQ ID NO: 1823531 - RNA, 18 nt, Salmonella typhimurium LT2
auaauaucgucaccagga

SEQ ID NO: 1823532 - RNA, 21 nt, Salmonella typhimurium LT2
auaauaucuuucucgcggcag

SEQ ID NO: 1823533 - RNA, 23 nt, Salmonella typhimurium LT2
auaauuuccguggcgauaaugac

SEQ ID NO: 1823534 - RNA, 18 nt, Salmonella typhimurium LT2
auacaggcgauaucgcga

SEQ ID NO: 1823535 - RNA, 17 nt, Salmonella typhimurium LT2
auaccaaguuuggcaau

SEQ ID NO: 1823536 - RNA, 17 nt, Salmonella typhimurium LT2
auacaucgccacuacca

SEQ ID NO: 1823537 - RNA, 15 nt, Salmonella typhimurium LT2
auacauaaauccgga

SEQ ID NO: 1823538 - RNA, 19 nt, Salmonella typhimurium LT2
auacguuccagcagcgcau

SEQ ID NO: 1823539 - RNA, 14 nt, Salmonella typhimurium LT2
auacguuugguacc

SEQ ID NO: 1823540 - RNA, 22 nt, Salmonella typhimurium LT2
auacgggagagcguauccagca

SEQ ID NO: 1823541 - RNA, 19 nt, Salmonella typhimurium LT2
auacggucgacaccagcga

SEQ ID NO: 1823542 - RNA, 15 nt, Salmonella typhimurium LT2
auacgcuugcgccag

SEQ ID NO: 1823543 - RNA, 23 nt, Salmonella typhimurium LT2
auacgcuuucugaauuuccugcg

SEQ ID NO: 1823544 - RNA, 19 nt, Salmonella typhimurium LT2
auacggaacugggugccau

SEQ ID NO: 1823545 - RNA, 14 nt, Salmonella typhimurium LT2
auacugaacgccgc

SEQ ID NO: 1823546 - RNA, 17 nt, Salmonella typhimurium LT2
auacugccauagccggu

SEQ ID NO: 1823547 - RNA, 17 nt, Salmonella typhimurium LT2
auacugcaaccgacgaa

SEQ ID NO: 1823548 - RNA, 14 nt, Salmonella typhimurium LT2
auacucccgaaugg

SEQ ID NO: 1823549 - RNA, 18 nt, Salmonella typhimurium LT2
auacuggaagcuacaggu

SEQ ID NO: 1823550 - RNA, 22 nt, Salmonella typhimurium LT2
auacuguacgcccagccgugaa

SEQ ID NO: 1823551 - RNA, 14 nt, Salmonella typhimurium LT2
auagcaccaggcca

SEQ ID NO: 1823552 - RNA, 18 nt, Salmonella typhimurium LT2
auagcaaacuacuuucgg

SEQ ID NO: 1823553 - RNA, 17 nt, Salmonella typhimurium LT2
auagcaaccccucaucg

SEQ ID NO: 1823554 - RNA, 11 nt, Salmonella typhimurium LT2
auagcaacgcg

SEQ ID NO: 1823555 - RNA, 23 nt, Salmonella typhimurium LT2
auagccggauaauuuauccagua

SEQ ID NO: 1823556 - RNA, 14 nt, Salmonella typhimurium LT2
auagcccagcgugc

SEQ ID NO: 1823557 - RNA, 16 nt, Salmonella typhimurium LT2
auagagauccuggcga

SEQ ID NO: 1823558 - RNA, 20 nt, Salmonella typhimurium LT2
auagagcccucuauccacac

SEQ ID NO: 1823559 - RNA, 14 nt, Salmonella typhimurium LT2
auagaucaggcgac

SEQ ID NO: 1823560 - RNA, 13 nt, Salmonella typhimurium LT2
auagacuggcgcc

SEQ ID NO: 1823561 - RNA, 18 nt, Salmonella typhimurium LT2
auagaaccgaacaacgcc

SEQ ID NO: 1823562 - RNA, 17 nt, Salmonella typhimurium LT2
auaucgaagcccagcuc

SEQ ID NO: 1823563 - RNA, 23 nt, Salmonella typhimurium LT2
auauccugcaccgccugcggcau

SEQ ID NO: 1823564 - RNA, 15 nt, Salmonella typhimurium LT2
auaucggcggaaauu

SEQ ID NO: 1823565 - RNA, 19 nt, Salmonella typhimurium LT2
auaucuggacgggccgcca

SEQ ID NO: 1823566 - RNA, 13 nt, Salmonella typhimurium LT2
auauagccuucaa

SEQ ID NO: 1823567 - RNA, 13 nt, Salmonella typhimurium LT2
auauagcgccaug

SEQ ID NO: 1823568 - RNA, 17 nt, Salmonella typhimurium LT2
auauaacagaauaagcc

SEQ ID NO: 1823569 - RNA, 17 nt, Salmonella typhimurium LT2
auauaacgugccgacca

SEQ ID NO: 1823570 - RNA, 16 nt, Salmonella typhimurium LT2
auagggcgcuugcgca

SEQ ID NO: 1823571 - RNA, 17 nt, Salmonella typhimurium LT2
auaguuuaaauccagcg

SEQ ID NO: 1823572 - RNA, 23 nt, Salmonella typhimurium LT2
auaguucuggcuuugcgccggca

SEQ ID NO: 1823573 - RNA, 23 nt, Salmonella typhimurium LT2
auaguuacugucgacaaagccgc

SEQ ID NO: 1823574 - RNA, 20 nt, Salmonella typhimurium LT2
auaguggcgacaaaagccag

SEQ ID NO: 1823575 - RNA, 21 nt, Salmonella typhimurium LT2
auaguggcuggcguccgccug

SEQ ID NO: 1823576 - RNA, 16 nt, Salmonella typhimurium LT2
auagcgcaaacgcgcg

SEQ ID NO: 1823577 - RNA, 17 nt, Salmonella typhimurium LT2
auagcgcacaacgucag

SEQ ID NO: 1823578 - RNA, 16 nt, Salmonella typhimurium LT2
auagcgaccugcggac

SEQ ID NO: 1823579 - RNA, 21 nt, Salmonella typhimurium LT2
auagccuugauccuguaacgc

SEQ ID NO: 1823580 - RNA, 15 nt, Salmonella typhimurium LT2
auagcuuuucaugac

SEQ ID NO: 1823581 - RNA, 18 nt, Salmonella typhimurium LT2
auagcgccccaguaacgc

SEQ ID NO: 1823582 - RNA, 20 nt, Salmonella typhimurium LT2
aucaaaggcgucgccgaaua

SEQ ID NO: 1823583 - RNA, 23 nt, Salmonella typhimurium LT2
aucaaacucgcccagcgccuucu

SEQ ID NO: 1823584 - RNA, 22 nt, Salmonella typhimurium LT2
aucaaaucagacgcuucauugg

SEQ ID NO: 1823585 - RNA, 15 nt, Salmonella typhimurium LT2
auauucaaaauccgc

SEQ ID NO: 1823586 - RNA, 14 nt, Salmonella typhimurium LT2
auauuaaaagccgc

SEQ ID NO: 1823587 - RNA, 13 nt, Salmonella typhimurium LT2
aucaacugcgcca

SEQ ID NO: 1823588 - RNA, 23 nt, Salmonella typhimurium LT2
aucaagagauaucccaucgacuu

SEQ ID NO: 1823589 - RNA, 22 nt, Salmonella typhimurium LT2
aucacaggggucaucggcacgu

SEQ ID NO: 1823590 - RNA, 22 nt, Salmonella typhimurium LT2
aucacaucguaaaucagcguga

SEQ ID NO: 1823591 - RNA, 15 nt, Salmonella typhimurium LT2
aucaccagcaccgcc

SEQ ID NO: 1823592 - RNA, 14 nt, Salmonella typhimurium LT2
aucaccagcagcag

SEQ ID NO: 1823593 - RNA, 22 nt, Salmonella typhimurium LT2
aucaccacguaacucggcagcg

SEQ ID NO: 1823594 - RNA, 20 nt, Salmonella typhimurium LT2
aucagcgccauuaacgccau

SEQ ID NO: 1823595 - RNA, 16 nt, Salmonella typhimurium LT2
aucaggacauggucac

SEQ ID NO: 1823596 - RNA, 15 nt, Salmonella typhimurium LT2
aucagcgcuccgaca

SEQ ID NO: 1823597 - RNA, 16 nt, Salmonella typhimurium LT2
aucaggaucuucaucc

SEQ ID NO: 1823598 - RNA, 12 nt, Salmonella typhimurium LT2
aucagcgcgugc

SEQ ID NO: 1823599 - RNA, 17 nt, Salmonella typhimurium LT2
aucagcgcggugggaca

SEQ ID NO: 1823600 - RNA, 22 nt, Salmonella typhimurium LT2
aucagcgauugcgccagaccca

SEQ ID NO: 1823601 - RNA, 18 nt, Salmonella typhimurium LT2
aucagcaacacaaucagg

SEQ ID NO: 1823602 - RNA, 14 nt, Salmonella typhimurium LT2
aucagcagcagcgu

SEQ ID NO: 1823603 - RNA, 18 nt, Salmonella typhimurium LT2
aucacuaccgccgcggau

SEQ ID NO: 1823604 - RNA, 19 nt, Salmonella typhimurium LT2
agccuggagagcagcgcca

SEQ ID NO: 1823605 - RNA, 17 nt, Salmonella typhimurium LT2
agccuggagagcagcgc

SEQ ID NO: 1823606 - RNA, 14 nt, Salmonella typhimurium LT2
agccuggcggcuuc

SEQ ID NO: 1823607 - RNA, 20 nt, Salmonella typhimurium LT2
agccgcucaggguaaucacc

SEQ ID NO: 1823608 - RNA, 20 nt, Salmonella typhimurium LT2
agccgguaaucgaucccgcc

SEQ ID NO: 1823609 - RNA, 21 nt, Salmonella typhimurium LT2
agcgacgcgcgguugcggcgg

SEQ ID NO: 1823610 - RNA, 12 nt, Salmonella typhimurium LT2
agcgacaacgcu

SEQ ID NO: 1823611 - RNA, 14 nt, Salmonella typhimurium LT2
aaacgccucauccg

SEQ ID NO: 1823612 - RNA, 14 nt, Salmonella typhimurium LT2
aaacgccuuauccg

SEQ ID NO: 1823613 - RNA, 16 nt, Salmonella typhimurium LT2
aaacgccucauccggc

SEQ ID NO: 1823614 - RNA, 12 nt, Salmonella typhimurium LT2
aaacgccagcga

SEQ ID NO: 1823615 - RNA, 15 nt, Salmonella typhimurium LT2
aaacgcccauccugc

SEQ ID NO: 1823616 - RNA, 20 nt, Salmonella typhimurium LT2
aaacgccgaagccaacgcag

SEQ ID NO: 1823617 - RNA, 14 nt, Salmonella typhimurium LT2
agcgaauccagcgc

SEQ ID NO: 1823618 - RNA, 18 nt, Salmonella typhimurium LT2
agcgaaucacauccgcca

SEQ ID NO: 1823619 - RNA, 20 nt, Salmonella typhimurium LT2
aaacgcgcucgccagcgcag

SEQ ID NO: 1823620 - RNA, 23 nt, Salmonella typhimurium LT2
aaacgcggccaucacgcugcggu

SEQ ID NO: 1823621 - RNA, 23 nt, Salmonella typhimurium LT2
aaacgcggccuggaagcgcccag

SEQ ID NO: 1823622 - RNA, 13 nt, Salmonella typhimurium LT2
aaacgcguuaucg

SEQ ID NO: 1823623 - RNA, 16 nt, Salmonella typhimurium LT2
aaacgccuuauccggc

SEQ ID NO: 1823624 - RNA, 19 nt, Salmonella typhimurium LT2
agcgagucccuaauagcgc

SEQ ID NO: 1823625 - RNA, 11 nt, Salmonella typhimurium LT2
agcgcagcgcc

SEQ ID NO: 1823626 - RNA, 20 nt, Salmonella typhimurium LT2
agcgcagcgccaccgggcaa

SEQ ID NO: 1823627 - RNA, 13 nt, Salmonella typhimurium LT2
agcgcgcgcgcaa

SEQ ID NO: 1823628 - RNA, 18 nt, Salmonella typhimurium LT2
agcgcgccgcacaucggc

SEQ ID NO: 1823629 - RNA, 13 nt, Salmonella typhimurium LT2
agcgcgcuggcaa

SEQ ID NO: 1823630 - RNA, 21 nt, Salmonella typhimurium LT2
agcgcgcugucuuugaauaac

SEQ ID NO: 1823631 - RNA, 23 nt, Salmonella typhimurium LT2
agcgcgcugucuuugaauaacgc

SEQ ID NO: 1823632 - RNA, 21 nt, Salmonella typhimurium LT2
agcgcgccaauccaugccggc

SEQ ID NO: 1823633 - RNA, 22 nt, Salmonella typhimurium LT2
agcgcgccaauccaugccggcu

SEQ ID NO: 1823634 - RNA, 20 nt, Salmonella typhimurium LT2
agcgccuuauccggccuacg

SEQ ID NO: 1823635 - RNA, 16 nt, Salmonella typhimurium LT2
agcgccuuauccggcc

SEQ ID NO: 1823636 - RNA, 21 nt, Salmonella typhimurium LT2
agcgccuuguuuucaucugcu

SEQ ID NO: 1823637 - RNA, 23 nt, Salmonella typhimurium LT2
agcgcgaccaggaaaccgguaaa

SEQ ID NO: 1823638 - RNA, 16 nt, Salmonella typhimurium LT2
agcgcgaccagcguga

SEQ ID NO: 1823639 - RNA, 18 nt, Salmonella typhimurium LT2
agcgccaucaggccuacg

SEQ ID NO: 1823640 - RNA, 16 nt, Salmonella typhimurium LT2
agcgccauauccgcag

SEQ ID NO: 1823641 - RNA, 23 nt, Salmonella typhimurium LT2
agcgccgauaaucggcgcggcga

SEQ ID NO: 1823642 - RNA, 15 nt, Salmonella typhimurium LT2
agcgcagcggaaagu

SEQ ID NO: 1823643 - RNA, 21 nt, Salmonella typhimurium LT2
agcgcagcgccaccgggcaac

SEQ ID NO: 1823644 - RNA, 15 nt, Salmonella typhimurium LT2
agcgccuacgggcau

SEQ ID NO: 1823645 - RNA, 21 nt, Salmonella typhimurium LT2
agcgccguuaaacugcgcgau

SEQ ID NO: 1823646 - RNA, 13 nt, Salmonella typhimurium LT2
agcgccgcagggc

SEQ ID NO: 1823647 - RNA, 19 nt, Salmonella typhimurium LT2
agcgccugaccgcgaucgc

SEQ ID NO: 1823648 - RNA, 22 nt, Salmonella typhimurium LT2
agcgccugaugcacauuguccg

SEQ ID NO: 1823649 - RNA, 19 nt, Salmonella typhimurium LT2
agcgccugucgggccuaca

SEQ ID NO: 1823650 - RNA, 17 nt, Salmonella typhimurium LT2
agcgcgugcccgguaag

SEQ ID NO: 1823651 - RNA, 22 nt, Salmonella typhimurium LT2
agcgcguucgccgucacgccga

SEQ ID NO: 1823652 - RNA, 16 nt, Salmonella typhimurium LT2
agcgcggccagcgccu

SEQ ID NO: 1823653 - RNA, 14 nt, Salmonella typhimurium LT2
agcgcuugauccag

SEQ ID NO: 1823654 - RNA, 16 nt, Salmonella typhimurium LT2
agcgcugucgccauca

SEQ ID NO: 1823655 - RNA, 15 nt, Salmonella typhimurium LT2
agcgcuucaccggcg

SEQ ID NO: 1823656 - RNA, 18 nt, Salmonella typhimurium LT2
agcggcacguacugcacc

SEQ ID NO: 1823657 - RNA, 19 nt, Salmonella typhimurium LT2
agcggauaauccgccacuu

SEQ ID NO: 1823658 - RNA, 19 nt, Salmonella typhimurium LT2
agcgguaagucaaccagcc

SEQ ID NO: 1823659 - RNA, 22 nt, Salmonella typhimurium LT2
agcgggucaacgccaagcgcgg

SEQ ID NO: 1823660 - RNA, 16 nt, Salmonella typhimurium LT2
agcggcaucucgccaa

SEQ ID NO: 1823661 - RNA, 13 nt, Salmonella typhimurium LT2
agcggcaggccgu

SEQ ID NO: 1823662 - RNA, 19 nt, Salmonella typhimurium LT2
agcguuuaaaaagcugcau

SEQ ID NO: 1823663 - RNA, 24 nt, Salmonella typhimurium LT2
agcguuggcgucagaccggcaauc

SEQ ID NO: 1823664 - RNA, 22 nt, Salmonella typhimurium LT2
agcguggcgcaaccgauagcua

SEQ ID NO: 1823665 - RNA, 18 nt, Salmonella typhimurium LT2
agcgugggcaaaucaucg

SEQ ID NO: 1823666 - RNA, 23 nt, Salmonella typhimurium LT2
agcguggcgacgauagucagcgc

SEQ ID NO: 1823667 - RNA, 14 nt, Salmonella typhimurium LT2
agcgugacgaccgg

SEQ ID NO: 1823668 - RNA, 22 nt, Salmonella typhimurium LT2
agcgugaucgucuccuguaaca

SEQ ID NO: 1823669 - RNA, 23 nt, Salmonella typhimurium LT2
agcgugcguucauggcgcgacau

SEQ ID NO: 1823670 - RNA, 15 nt, Salmonella typhimurium LT2
agcgucugcacgcca

SEQ ID NO: 1823671 - RNA, 18 nt, Salmonella typhimurium LT2
agcgucuuuuauccccac

SEQ ID NO: 1823672 - RNA, 19 nt, Salmonella typhimurium LT2
agcgguccggcauccaacc

SEQ ID NO: 1823673 - RNA, 17 nt, Salmonella typhimurium LT2
agcgucccuggcguagu

SEQ ID NO: 1823674 - RNA, 13 nt, Salmonella typhimurium LT2
agcugcugguacc

SEQ ID NO: 1823675 - RNA, 19 nt, Salmonella typhimurium LT2
agcucuuucaacugaccgg

SEQ ID NO: 1823676 - RNA, 15 nt, Salmonella typhimurium LT2
agcucugcgguaaca

SEQ ID NO: 1823677 - RNA, 22 nt, Salmonella typhimurium LT2
agcuccccacgaaagucuguuc

SEQ ID NO: 1823678 - RNA, 22 nt, Salmonella typhimurium LT2
agcucaacgcaggcuggagagc

SEQ ID NO: 1823679 - RNA, 22 nt, Salmonella typhimurium LT2
agcaggaucuccagaucgccac

SEQ ID NO: 1823680 - RNA, 14 nt, Salmonella typhimurium LT2
agcaggugguacau

SEQ ID NO: 1823681 - RNA, 23 nt, Salmonella typhimurium LT2
agcaguguaucgaagaucaguga

SEQ ID NO: 1823682 - RNA, 18 nt, Salmonella typhimurium LT2
agcaucccgcuggcgcca

SEQ ID NO: 1823683 - RNA, 15 nt, Salmonella typhimurium LT2
agcaucguuaccgcu

SEQ ID NO: 1823684 - RNA, 22 nt, Salmonella typhimurium LT2
agcaucucuucgacaucuucac

SEQ ID NO: 1823685 - RNA, 16 nt, Salmonella typhimurium LT2
agcauggucuccagca

SEQ ID NO: 1823686 - RNA, 16 nt, Salmonella typhimurium LT2
agcauuaagaucgcag

SEQ ID NO: 1823687 - RNA, 13 nt, Salmonella typhimurium LT2
agcauuaccagca

SEQ ID NO: 1823688 - RNA, 14 nt, Salmonella typhimurium LT2
agccagagcgcgcu

SEQ ID NO: 1823689 - RNA, 22 nt, Salmonella typhimurium LT2
agccacuuaccaaucgcggcga

SEQ ID NO: 1823690 - RNA, 11 nt, Salmonella typhimurium LT2
agccagcaucg

SEQ ID NO: 1823691 - RNA, 18 nt, Salmonella typhimurium LT2
agcauucugaagccgaua

SEQ ID NO: 1823692 - RNA, 21 nt, Salmonella typhimurium LT2
agccacagaaugccguugacc

SEQ ID NO: 1823693 - RNA, 22 nt, Salmonella typhimurium LT2
aaaccguagcuuugcgccagau

SEQ ID NO: 1823694 - RNA, 21 nt, Salmonella typhimurium LT2
aaacgaccaggaucagaccga

SEQ ID NO: 1823695 - RNA, 17 nt, Salmonella typhimurium LT2
agccgcguugcgcugaa

SEQ ID NO: 1823696 - RNA, 17 nt, Salmonella typhimurium LT2
agccgcaaucagcguuu

SEQ ID NO: 1823697 - RNA, 18 nt, Salmonella typhimurium LT2
agcccgucccuuccgcca

SEQ ID NO: 1823698 - RNA, 13 nt, Salmonella typhimurium LT2
agccagguugcgc

SEQ ID NO: 1823699 - RNA, 14 nt, Salmonella typhimurium LT2
agccagguaauccg

SEQ ID NO: 1823700 - RNA, 14 nt, Salmonella typhimurium LT2
agcccaucagcgcc

SEQ ID NO: 1823701 - RNA, 14 nt, Salmonella typhimurium LT2
agcccgaauccacu

SEQ ID NO: 1823702 - RNA, 15 nt, Salmonella typhimurium LT2
agcaccaacgccgcu

SEQ ID NO: 1823703 - RNA, 17 nt, Salmonella typhimurium LT2
agcaccauuagcggcau

SEQ ID NO: 1823704 - RNA, 16 nt, Salmonella typhimurium LT2
agcaccgccagcgcau

SEQ ID NO: 1823705 - RNA, 18 nt, Salmonella typhimurium LT2
agcaccgccagcgcauuc

SEQ ID NO: 1823706 - RNA, 14 nt, Salmonella typhimurium LT2
agcaaauugcugau

SEQ ID NO: 1823707 - RNA, 19 nt, Salmonella typhimurium LT2
agcaaagcgccauccggca

SEQ ID NO: 1823708 - RNA, 22 nt, Salmonella typhimurium LT2
agcaacauagccauaucgucau

SEQ ID NO: 1823709 - RNA, 20 nt, Salmonella typhimurium LT2
agcaacacuuugcgcugcgc

SEQ ID NO: 1823710 - RNA, 18 nt, Salmonella typhimurium LT2
agcaacgggcaguccggc

SEQ ID NO: 1823711 - RNA, 22 nt, Salmonella typhimurium LT2
agcaaacgaccuuucgccguca

SEQ ID NO: 1823712 - RNA, 16 nt, Salmonella typhimurium LT2
agcaaaaguugcgauc

SEQ ID NO: 1823713 - RNA, 17 nt, Salmonella typhimurium LT2
acuuucucuccuucacg

SEQ ID NO: 1823714 - RNA, 17 nt, Salmonella typhimurium LT2
agcaaaaagaaucgcca

SEQ ID NO: 1823715 - RNA, 14 nt, Salmonella typhimurium LT2
acuuucgcuucacg

SEQ ID NO: 1823716 - RNA, 20 nt, Salmonella typhimurium LT2
acuuucgcccugaugauuua

SEQ ID NO: 1823717 - RNA, 14 nt, Salmonella typhimurium LT2
agcaagugcuggag

SEQ ID NO: 1823718 - RNA, 18 nt, Salmonella typhimurium LT2
agcaauacagccagcaca

SEQ ID NO: 1823719 - RNA, 20 nt, Salmonella typhimurium LT2
agcaaugcgaauaacaucau

SEQ ID NO: 1823720 - RNA, 17 nt, Salmonella typhimurium LT2
agcaaugaagcaagugc

SEQ ID NO: 1823721 - RNA, 12 nt, Salmonella typhimurium LT2
agcaaugccgcc

SEQ ID NO: 1823722 - RNA, 13 nt, Salmonella typhimurium LT2
agcaaugccgccg

SEQ ID NO: 1823723 - RNA, 23 nt, Salmonella typhimurium LT2
agcaauuucucgcccgccagauc

SEQ ID NO: 1823724 - RNA, 19 nt, Salmonella typhimurium LT2
agcaauugccugaccggca

SEQ ID NO: 1823725 - RNA, 20 nt, Salmonella typhimurium LT2
agcagauuuuucgccaggua

SEQ ID NO: 1823726 - RNA, 19 nt, Salmonella typhimurium LT2
agcagcauacgacaucgcc

SEQ ID NO: 1823727 - RNA, 20 nt, Salmonella typhimurium LT2
agcagcaggacguugccgcc

SEQ ID NO: 1823728 - RNA, 17 nt, Salmonella typhimurium LT2
agcagccagguaauccg

SEQ ID NO: 1823729 - RNA, 21 nt, Salmonella typhimurium LT2
agcagccagcccagcgcaacc

SEQ ID NO: 1823730 - RNA, 14 nt, Salmonella typhimurium LT2
aaaccggcugccag

SEQ ID NO: 1823731 - RNA, 15 nt, Salmonella typhimurium LT2
aaacccguccggcag

SEQ ID NO: 1823732 - RNA, 21 nt, Salmonella typhimurium LT2
aaaccgcaccguuccgccacc

SEQ ID NO: 1823733 - RNA, 23 nt, Salmonella typhimurium LT2
aaaccgcguuacccugcgaaucc

SEQ ID NO: 1823734 - RNA, 15 nt, Salmonella typhimurium LT2
aaaccgccgcccauc

SEQ ID NO: 1823735 - RNA, 18 nt, Salmonella typhimurium LT2
aaaccauuucuccugcau

SEQ ID NO: 1823736 - RNA, 23 nt, Salmonella typhimurium LT2
agcagacagacaaccagcagggc

SEQ ID NO: 1823737 - RNA, 19 nt, Salmonella typhimurium LT2
agcagaaacuggcggcgca

SEQ ID NO: 1823738 - RNA, 23 nt, Salmonella typhimurium LT2
agcagaacaaacagaccgccaug

SEQ ID NO: 1823739 - RNA, 15 nt, Salmonella typhimurium LT2
agcacuucagaacgg

SEQ ID NO: 1823740 - RNA, 22 nt, Salmonella typhimurium LT2
agcacuuccugaaucaccagcc

SEQ ID NO: 1823741 - RNA, 20 nt, Salmonella typhimurium LT2
acuggaauaguuacggacau

SEQ ID NO: 1823742 - RNA, 20 nt, Salmonella typhimurium LT2
acuggaaggcuucggucaga

SEQ ID NO: 1823743 - RNA, 19 nt, Salmonella typhimurium LT2
acuggcagcgccugacggc

SEQ ID NO: 1823744 - RNA, 17 nt, Salmonella typhimurium LT2
acugcuguacgcuacug

SEQ ID NO: 1823745 - RNA, 21 nt, Salmonella typhimurium LT2
acugguucaacaucagcgcua

SEQ ID NO: 1823746 - RNA, 14 nt, Salmonella typhimurium LT2
acucuuccaccauu

SEQ ID NO: 1823747 - RNA, 20 nt, Salmonella typhimurium LT2
acucuucggcuuccggcagc

SEQ ID NO: 1823748 - RNA, 23 nt, Salmonella typhimurium LT2
acuugaucgugccguccggcauc

SEQ ID NO: 1823749 - RNA, 16 nt, Salmonella typhimurium LT2
acuuuaccgcucacaa

SEQ ID NO: 1823750 - RNA, 14 nt, Salmonella typhimurium LT2
acuuuaaacgucau

SEQ ID NO: 1823751 - RNA, 13 nt, Salmonella typhimurium LT2
acugucgggcaaa

SEQ ID NO: 1823752 - RNA, 17 nt, Salmonella typhimurium LT2
acugucgacaaagccgc

SEQ ID NO: 1823753 - RNA, 17 nt, Salmonella typhimurium LT2
acuguacgccacggcuu

SEQ ID NO: 1823754 - RNA, 19 nt, Salmonella typhimurium LT2
acuguagcugagcggcaau

SEQ ID NO: 1823755 - RNA, 16 nt, Salmonella typhimurium LT2
acuguccugacggcga

SEQ ID NO: 1823756 - RNA, 22 nt, Salmonella typhimurium LT2
acuguccagaucuucccaguua

SEQ ID NO: 1823757 - RNA, 23 nt, Salmonella typhimurium LT2
acuguaaaucugccgucaucgac

SEQ ID NO: 1823758 - RNA, 23 nt, Salmonella typhimurium LT2
acucaccgcuaaucccagcgcgc

SEQ ID NO: 1823759 - RNA, 13 nt, Salmonella typhimurium LT2
acucagccagaua

SEQ ID NO: 1823760 - RNA, 23 nt, Salmonella typhimurium LT2
acguugcggcgcguucagcaucg

SEQ ID NO: 1823761 - RNA, 13 nt, Salmonella typhimurium LT2
acucaugcgccuu

SEQ ID NO: 1823762 - RNA, 21 nt, Salmonella typhimurium LT2
acucagggaacguugcgccau

SEQ ID NO: 1823763 - RNA, 19 nt, Salmonella typhimurium LT2
acuccacggaaucacggca

SEQ ID NO: 1823764 - RNA, 23 nt, Salmonella typhimurium LT2
acuccccuguuugcaucacgcgc

SEQ ID NO: 1823765 - RNA, 21 nt, Salmonella typhimurium LT2
acucccuauaaugcgccacca

SEQ ID NO: 1823766 - RNA, 15 nt, Salmonella typhimurium LT2
acuccagcagggcgu

SEQ ID NO: 1823767 - RNA, 19 nt, Salmonella typhimurium LT2
acucgcgcagaaucagcgu

SEQ ID NO: 1823768 - RNA, 18 nt, Salmonella typhimurium LT2
acucgugaagaucagcag

SEQ ID NO: 1823769 - RNA, 18 nt, Salmonella typhimurium LT2
acuccuauuaucggcacc

SEQ ID NO: 1823770 - RNA, 15 nt, Salmonella typhimurium LT2
acucgcccagcgccu

SEQ ID NO: 1823771 - RNA, 16 nt, Salmonella typhimurium LT2
acguguuaugcgccug

SEQ ID NO: 1823772 - RNA, 19 nt, Salmonella typhimurium LT2
acgugaauuaauggucaga

SEQ ID NO: 1823773 - RNA, 13 nt, Salmonella typhimurium LT2
acgucugucagaa

SEQ ID NO: 1823774 - RNA, 19 nt, Salmonella typhimurium LT2
acguaacuggauuccuggc

SEQ ID NO: 1823775 - RNA, 13 nt, Salmonella typhimurium LT2
acguaaugcgaaa

SEQ ID NO: 1823776 - RNA, 20 nt, Salmonella typhimurium LT2
acgucagccgggauaaucag

SEQ ID NO: 1823777 - RNA, 22 nt, Salmonella typhimurium LT2
acgucagccgggauaaucaggu

SEQ ID NO: 1823778 - RNA, 18 nt, Salmonella typhimurium LT2
acgucaccaucaacauca

SEQ ID NO: 1823779 - RNA, 17 nt, Salmonella typhimurium LT2
acgucaccaucagcguc

SEQ ID NO: 1823780 - RNA, 18 nt, Salmonella typhimurium LT2
acgucacugucagcauca

SEQ ID NO: 1823781 - RNA, 15 nt, Salmonella typhimurium LT2
acgucacgugacgca

SEQ ID NO: 1823782 - RNA, 14 nt, Salmonella typhimurium LT2
acguaccggcgucu

SEQ ID NO: 1823783 - RNA, 15 nt, Salmonella typhimurium LT2
acgucauaacgcgca

SEQ ID NO: 1823784 - RNA, 11 nt, Salmonella typhimurium LT2
acgucaugccg

SEQ ID NO: 1823785 - RNA, 19 nt, Salmonella typhimurium LT2
acggcuuuccagcagccag

SEQ ID NO: 1823786 - RNA, 19 nt, Salmonella typhimurium LT2
acggcuuccacugcggcau

SEQ ID NO: 1823787 - RNA, 18 nt, Salmonella typhimurium LT2
acggcugucggucaggaa

SEQ ID NO: 1823788 - RNA, 21 nt, Salmonella typhimurium LT2
acggcugacgcccaucagcau

SEQ ID NO: 1823789 - RNA, 19 nt, Salmonella typhimurium LT2
acggcgcgccaaacggcag

SEQ ID NO: 1823790 - RNA, 14 nt, Salmonella typhimurium LT2
acggcgcugaaagg

SEQ ID NO: 1823791 - RNA, 17 nt, Salmonella typhimurium LT2
acggcgcguccagccag

SEQ ID NO: 1823792 - RNA, 17 nt, Salmonella typhimurium LT2
acggccuaagaccagca

SEQ ID NO: 1823793 - RNA, 13 nt, Salmonella typhimurium LT2
acggccugacggu

SEQ ID NO: 1823794 - RNA, 19 nt, Salmonella typhimurium LT2
aaaccacgucugcgcuuuc

SEQ ID NO: 1823795 - RNA, 18 nt, Salmonella typhimurium LT2
aaaccagacccgcugcgu

SEQ ID NO: 1823796 - RNA, 15 nt, Salmonella typhimurium LT2
acggcgacaggcaca

SEQ ID NO: 1823797 - RNA, 22 nt, Salmonella typhimurium LT2
acggcgacaggcacaacaauau

SEQ ID NO: 1823798 - RNA, 14 nt, Salmonella typhimurium LT2
acggcgaaucgccu

SEQ ID NO: 1823799 - RNA, 11 nt, Salmonella typhimurium LT2
acggcgccaug

SEQ ID NO: 1823800 - RNA, 19 nt, Salmonella typhimurium LT2
acggcgccaugauccagcg

SEQ ID NO: 1823801 - RNA, 22 nt, Salmonella typhimurium LT2
acgcuaacgcguuuuggcgagc

SEQ ID NO: 1823802 - RNA, 21 nt, Salmonella typhimurium LT2
acgcuaaucccgccuaaccca

SEQ ID NO: 1823803 - RNA, 15 nt, Salmonella typhimurium LT2
acgcuaaagucagca

SEQ ID NO: 1823804 - RNA, 19 nt, Salmonella typhimurium LT2
acgcugaaaaccgcaucaa

SEQ ID NO: 1823805 - RNA, 18 nt, Salmonella typhimurium LT2
acgcucuucgccaaucgc

SEQ ID NO: 1823806 - RNA, 13 nt, Salmonella typhimurium LT2
acgcucuuccuca

SEQ ID NO: 1823807 - RNA, 13 nt, Salmonella typhimurium LT2
aaacaucagcgcg

SEQ ID NO: 1823808 - RNA, 18 nt, Salmonella typhimurium LT2
acgcguucacaacggcga

SEQ ID NO: 1823809 - RNA, 14 nt, Salmonella typhimurium LT2
acgcguucauccag

SEQ ID NO: 1823810 - RNA, 20 nt, Salmonella typhimurium LT2
acgcgucugaaugacgccgu

SEQ ID NO: 1823811 - RNA, 23 nt, Salmonella typhimurium LT2
acgcgucugucgaaacuggcauu

SEQ ID NO: 1823812 - RNA, 13 nt, Salmonella typhimurium LT2
acgcgugcgcggc

SEQ ID NO: 1823813 - RNA, 14 nt, Salmonella typhimurium LT2
acgcgugcgcggca

SEQ ID NO: 1823814 - RNA, 21 nt, Salmonella typhimurium LT2
acgcguagguguuacgcgggu

SEQ ID NO: 1823815 - RNA, 23 nt, Salmonella typhimurium LT2
acgcguaauacgauccucgccau

SEQ ID NO: 1823816 - RNA, 15 nt, Salmonella typhimurium LT2
acgcggcgcuacggc

SEQ ID NO: 1823817 - RNA, 14 nt, Salmonella typhimurium LT2
acgcgucccagaua

SEQ ID NO: 1823818 - RNA, 23 nt, Salmonella typhimurium LT2
acgcguccucguacccgguacac

SEQ ID NO: 1823819 - RNA, 21 nt, Salmonella typhimurium LT2
acgcgcccaacggaugcgcca

SEQ ID NO: 1823820 - RNA, 13 nt, Salmonella typhimurium LT2
acgcgccagcagu

SEQ ID NO: 1823821 - RNA, 13 nt, Salmonella typhimurium LT2
acgcgaucgccgu

SEQ ID NO: 1823822 - RNA, 13 nt, Salmonella typhimurium LT2
acgccuuauccgg

SEQ ID NO: 1823823 - RNA, 19 nt, Salmonella typhimurium LT2
acgccuuauccggccuaca

SEQ ID NO: 1823824 - RNA, 19 nt, Salmonella typhimurium LT2
acgccuuacccggccuaca

SEQ ID NO: 1823825 - RNA, 21 nt, Salmonella typhimurium LT2
acgccuuacccggccuacauc

SEQ ID NO: 1823826 - RNA, 21 nt, Salmonella typhimurium LT2
acgccuguaaugccgccuguu

SEQ ID NO: 1823827 - RNA, 18 nt, Salmonella typhimurium LT2
acgcgagaagcccggcca

SEQ ID NO: 1823828 - RNA, 22 nt, Salmonella typhimurium LT2
acgcggccaaaacccaccagca

SEQ ID NO: 1823829 - RNA, 12 nt, Salmonella typhimurium LT2
acgcggcccuga

SEQ ID NO: 1823830 - RNA, 16 nt, Salmonella typhimurium LT2
acgcggaucagacggc

SEQ ID NO: 1823831 - RNA, 17 nt, Salmonella typhimurium LT2
acgcgcgauaucagcga

SEQ ID NO: 1823832 - RNA, 18 nt, Salmonella typhimurium LT2
acgcgcgcgcgucaacgc

SEQ ID NO: 1823833 - RNA, 22 nt, Salmonella typhimurium LT2
acgcgccgccaacgauacagca

SEQ ID NO: 1823834 - RNA, 14 nt, Salmonella typhimurium LT2
acgcgccgcugcgu

SEQ ID NO: 1823835 - RNA, 12 nt, Salmonella typhimurium LT2
acgcgccggaag

SEQ ID NO: 1823836 - RNA, 21 nt, Salmonella typhimurium LT2
acgcgccggaugagggcauaa

SEQ ID NO: 1823837 - RNA, 18 nt, Salmonella typhimurium LT2
acgccgcagccugauggc

SEQ ID NO: 1823838 - RNA, 17 nt, Salmonella typhimurium LT2
acgccgccauccggcaa

SEQ ID NO: 1823839 - RNA, 17 nt, Salmonella typhimurium LT2
acgccgccauccggcau

SEQ ID NO: 1823840 - RNA, 19 nt, Salmonella typhimurium LT2
acgccgccauccggcauuu

SEQ ID NO: 1823841 - RNA, 16 nt, Salmonella typhimurium LT2
acgccgccauccggca

SEQ ID NO: 1823842 - RNA, 22 nt, Salmonella typhimurium LT2
acgccggggauaucaaugcgcg

SEQ ID NO: 1823843 - RNA, 22 nt, Salmonella typhimurium LT2
acgccggguaaacgcagcguca

SEQ ID NO: 1823844 - RNA, 23 nt, Salmonella typhimurium LT2
acgccggucaggauacagccgac

SEQ ID NO: 1823845 - RNA, 20 nt, Salmonella typhimurium LT2
acgccggaacccgcgacgac

SEQ ID NO: 1823846 - RNA, 16 nt, Salmonella typhimurium LT2
acgccgcucgaaucgc

SEQ ID NO: 1823847 - RNA, 11 nt, Salmonella typhimurium LT2
acgccggcauc

SEQ ID NO: 1823848 - RNA, 15 nt, Salmonella typhimurium LT2
acgccggcaucauca

SEQ ID NO: 1823849 - RNA, 18 nt, Salmonella typhimurium LT2
acgccugcgucuaaccag

SEQ ID NO: 1823850 - RNA, 19 nt, Salmonella typhimurium LT2
acgccgugaacgccaaaua

SEQ ID NO: 1823851 - RNA, 15 nt, Salmonella typhimurium LT2
acgccgucggcagcc

SEQ ID NO: 1823852 - RNA, 22 nt, Salmonella typhimurium LT2
acgccgucugguacggccacca

SEQ ID NO: 1823853 - RNA, 18 nt, Salmonella typhimurium LT2
acgccgucgaugauggcg

SEQ ID NO: 1823854 - RNA, 18 nt, Salmonella typhimurium LT2
acgccguaauaaggcgga

SEQ ID NO: 1823855 - RNA, 16 nt, Salmonella typhimurium LT2
acgccguccagcacca

SEQ ID NO: 1823856 - RNA, 22 nt, Salmonella typhimurium LT2
accugguggcgaacaauaccgu

SEQ ID NO: 1823857 - RNA, 18 nt, Salmonella typhimurium LT2
accuggcguaguacgcgc

SEQ ID NO: 1823858 - RNA, 18 nt, Salmonella typhimurium LT2
accugccguuuuccagcc

SEQ ID NO: 1823859 - RNA, 20 nt, Salmonella typhimurium LT2
accgggcaggauacggcgcu

SEQ ID NO: 1823860 - RNA, 15 nt, Salmonella typhimurium LT2
accugcgcugacggc

SEQ ID NO: 1823861 - RNA, 20 nt, Salmonella typhimurium LT2
acgaucguuguuuggguaac

SEQ ID NO: 1823862 - RNA, 15 nt, Salmonella typhimurium LT2
acgaucguuugccca

SEQ ID NO: 1823863 - RNA, 22 nt, Salmonella typhimurium LT2
acgaugauaauacauugccgca

SEQ ID NO: 1823864 - RNA, 20 nt, Salmonella typhimurium LT2
acgaugcauaugcacagcgc

SEQ ID NO: 1823865 - RNA, 18 nt, Salmonella typhimurium LT2
acgagcgcggcauaccga

SEQ ID NO: 1823866 - RNA, 15 nt, Salmonella typhimurium LT2
accuguucagccguu

SEQ ID NO: 1823867 - RNA, 11 nt, Salmonella typhimurium LT2
accuucgcguu

SEQ ID NO: 1823868 - RNA, 12 nt, Salmonella typhimurium LT2
accuucgcggau

SEQ ID NO: 1823869 - RNA, 17 nt, Salmonella typhimurium LT2
acgagauucaauaacgu

SEQ ID NO: 1823870 - RNA, 21 nt, Salmonella typhimurium LT2
accuucauccugauaauccag

SEQ ID NO: 1823871 - RNA, 22 nt, Salmonella typhimurium LT2
accuucauggcguucgccgcau

SEQ ID NO: 1823872 - RNA, 17 nt, Salmonella typhimurium LT2
acgcagcaggcagacgc

SEQ ID NO: 1823873 - RNA, 22 nt, Salmonella typhimurium LT2
acgcagccgaggcuuaauacag

SEQ ID NO: 1823874 - RNA, 11 nt, Salmonella typhimurium LT2
acgcagcgccu

SEQ ID NO: 1823875 - RNA, 17 nt, Salmonella typhimurium LT2
acgaugagcguggcgua

SEQ ID NO: 1823876 - RNA, 22 nt, Salmonella typhimurium LT2
acgcaggcuugcccauucgccg

SEQ ID NO: 1823877 - RNA, 17 nt, Salmonella typhimurium LT2
acgcaggcuuaaucccg

SEQ ID NO: 1823878 - RNA, 19 nt, Salmonella typhimurium LT2
acgcaguaacgucgcauca

SEQ ID NO: 1823879 - RNA, 13 nt, Salmonella typhimurium LT2
acgcagcggcauu

SEQ ID NO: 1823880 - RNA, 13 nt, Salmonella typhimurium LT2
acgcauccgccau

SEQ ID NO: 1823881 - RNA, 20 nt, Salmonella typhimurium LT2
acgcauaaugcgccccgcaa

SEQ ID NO: 1823882 - RNA, 18 nt, Salmonella typhimurium LT2
acgccaccgccgccacca

SEQ ID NO: 1823883 - RNA, 19 nt, Salmonella typhimurium LT2
acgccaccacagucaucgc

SEQ ID NO: 1823884 - RNA, 15 nt, Salmonella typhimurium LT2
acgccaacucaacgc

SEQ ID NO: 1823885 - RNA, 22 nt, Salmonella typhimurium LT2
acgccaaccaucggcacacuuu

SEQ ID NO: 1823886 - RNA, 23 nt, Salmonella typhimurium LT2
acgccaauuccuaucaguacgac

SEQ ID NO: 1823887 - RNA, 16 nt, Salmonella typhimurium LT2
acgccaagcgcggcag

SEQ ID NO: 1823888 - RNA, 18 nt, Salmonella typhimurium LT2
acgccaagcgcggcagca

SEQ ID NO: 1823889 - RNA, 16 nt, Salmonella typhimurium LT2
acgcccggcgcgacac

SEQ ID NO: 1823890 - RNA, 19 nt, Salmonella typhimurium LT2
acgcccgcugacguuggcc

SEQ ID NO: 1823891 - RNA, 15 nt, Salmonella typhimurium LT2
acgcccaucggcaca

SEQ ID NO: 1823892 - RNA, 18 nt, Salmonella typhimurium LT2
acgcccagcgccgggaaa

SEQ ID NO: 1823893 - RNA, 16 nt, Salmonella typhimurium LT2
acgcccgccgccugau

SEQ ID NO: 1823894 - RNA, 12 nt, Salmonella typhimurium LT2
acgcccgccauc

SEQ ID NO: 1823895 - RNA, 22 nt, Salmonella typhimurium LT2
acgccccuaaggcagcgaggua

SEQ ID NO: 1823896 - RNA, 18 nt, Salmonella typhimurium LT2
acgccagccuaucgccau

SEQ ID NO: 1823897 - RNA, 15 nt, Salmonella typhimurium LT2
acgccacggccagca

SEQ ID NO: 1823898 - RNA, 19 nt, Salmonella typhimurium LT2
acgcccaaaaugcggcauc

SEQ ID NO: 1823899 - RNA, 19 nt, Salmonella typhimurium LT2
acgccauugcugucgacaa

SEQ ID NO: 1823900 - RNA, 14 nt, Salmonella typhimurium LT2
acgccauuccgcuu

SEQ ID NO: 1823901 - RNA, 18 nt, Salmonella typhimurium LT2
acgccauggggugaggca

SEQ ID NO: 1823902 - RNA, 14 nt, Salmonella typhimurium LT2
acgccaucgacaaa

SEQ ID NO: 1823903 - RNA, 13 nt, Salmonella typhimurium LT2
acgccaucgcggc

SEQ ID NO: 1823904 - RNA, 16 nt, Salmonella typhimurium LT2
acgccaucgcggcgca

SEQ ID NO: 1823905 - RNA, 15 nt, Salmonella typhimurium LT2
acgccauaucgccgg

SEQ ID NO: 1823906 - RNA, 19 nt, Salmonella typhimurium LT2
acgccauaucgccggcaag

SEQ ID NO: 1823907 - RNA, 15 nt, Salmonella typhimurium LT2
acgccaguuccgcca

SEQ ID NO: 1823908 - RNA, 16 nt, Salmonella typhimurium LT2
acaaacgcaauauugg

SEQ ID NO: 1823909 - RNA, 23 nt, Salmonella typhimurium LT2
acaaacugcgcuagccgccgugu

SEQ ID NO: 1823910 - RNA, 23 nt, Salmonella typhimurium LT2
acagcauugaggcuacccagaca

SEQ ID NO: 1823911 - RNA, 18 nt, Salmonella typhimurium LT2
acagccaaaaauaacgcc

SEQ ID NO: 1823912 - RNA, 18 nt, Salmonella typhimurium LT2
acagcccaguaauauccc

SEQ ID NO: 1823913 - RNA, 20 nt, Salmonella typhimurium LT2
acagccagcgagcgcagucc

SEQ ID NO: 1823914 - RNA, 11 nt, Salmonella typhimurium LT2
acagcgccauc

SEQ ID NO: 1823915 - RNA, 19 nt, Salmonella typhimurium LT2
acagcgccauccggcaguu

SEQ ID NO: 1823916 - RNA, 17 nt, Salmonella typhimurium LT2
acagcgcggcaggccgg

SEQ ID NO: 1823917 - RNA, 20 nt, Salmonella typhimurium LT2
acaggcauccgugaccugcu

SEQ ID NO: 1823918 - RNA, 15 nt, Salmonella typhimurium LT2
acaggcaacggcgcc

SEQ ID NO: 1823919 - RNA, 21 nt, Salmonella typhimurium LT2
acagucgcgccgugcccagca

SEQ ID NO: 1823920 - RNA, 16 nt, Salmonella typhimurium LT2
acagguacagaugcug

SEQ ID NO: 1823921 - RNA, 15 nt, Salmonella typhimurium LT2
acagguacaggccgc

SEQ ID NO: 1823922 - RNA, 22 nt, Salmonella typhimurium LT2
acagggcggcgcgcugccgccc

SEQ ID NO: 1823923 - RNA, 16 nt, Salmonella typhimurium LT2
acaucaauaaagccgc

SEQ ID NO: 1823924 - RNA, 23 nt, Salmonella typhimurium LT2
acaucauccacggcaucaauaac

SEQ ID NO: 1823925 - RNA, 16 nt, Salmonella typhimurium LT2
acaguguaaacgccag

SEQ ID NO: 1823926 - RNA, 17 nt, Salmonella typhimurium LT2
acagugaguacgcagga

SEQ ID NO: 1823927 - RNA, 16 nt, Salmonella typhimurium LT2
acaugcugugcgcgug

SEQ ID NO: 1823928 - RNA, 14 nt, Salmonella typhimurium LT2
acauggcgguaauc

SEQ ID NO: 1823929 - RNA, 20 nt, Salmonella typhimurium LT2
acaugcggaugcugcgccag

SEQ ID NO: 1823930 - RNA, 21 nt, Salmonella typhimurium LT2
acaugcuccgccccgccuucc

SEQ ID NO: 1823931 - RNA, 20 nt, Salmonella typhimurium LT2
acaugcaagucgaacgguaa

SEQ ID NO: 1823932 - RNA, 21 nt, Salmonella typhimurium LT2
acauccagacccagacggcga

SEQ ID NO: 1823933 - RNA, 23 nt, Salmonella typhimurium LT2
acaucgccaccgcauggaaucga

SEQ ID NO: 1823934 - RNA, 20 nt, Salmonella typhimurium LT2
acaucgcccugauggcgcgc

SEQ ID NO: 1823935 - RNA, 16 nt, Salmonella typhimurium LT2
acaucgccgugaucga

SEQ ID NO: 1823936 - RNA, 17 nt, Salmonella typhimurium LT2
acaucguaaaucagcgu

SEQ ID NO: 1823937 - RNA, 14 nt, Salmonella typhimurium LT2
acaucgguuaucgg

SEQ ID NO: 1823938 - RNA, 20 nt, Salmonella typhimurium LT2
accaaaaacgcccccagaua

SEQ ID NO: 1823939 - RNA, 20 nt, Salmonella typhimurium LT2
acauuuuuagcguuucaucg

SEQ ID NO: 1823940 - RNA, 11 nt, Salmonella typhimurium LT2
acauugcgaac

SEQ ID NO: 1823941 - RNA, 21 nt, Salmonella typhimurium LT2
accaaacagcaauuccgccau

SEQ ID NO: 1823942 - RNA, 15 nt, Salmonella typhimurium LT2
acauuucagcgccaa

SEQ ID NO: 1823943 - RNA, 17 nt, Salmonella typhimurium LT2
acauuacuuccggcgau

SEQ ID NO: 1823944 - RNA, 14 nt, Salmonella typhimurium LT2
acauugccggcauc

SEQ ID NO: 1823945 - RNA, 18 nt, Salmonella typhimurium LT2
acauguucgaacaugccg

SEQ ID NO: 1823946 - RNA, 21 nt, Salmonella typhimurium LT2
acauuacgcccauuaugccgc

SEQ ID NO: 1823947 - RNA, 21 nt, Salmonella typhimurium LT2
acauguagcgcggcagcgcgc

SEQ ID NO: 1823948 - RNA, 20 nt, Salmonella typhimurium LT2
accaacggucgugcgagaua

SEQ ID NO: 1823949 - RNA, 17 nt, Salmonella typhimurium LT2
accagcggaauccccgc

SEQ ID NO: 1823950 - RNA, 22 nt, Salmonella typhimurium LT2
accagcggacggcuaauaugcc

SEQ ID NO: 1823951 - RNA, 21 nt, Salmonella typhimurium LT2
accagcgaaaugacagccacc

SEQ ID NO: 1823952 - RNA, 15 nt, Salmonella typhimurium LT2
accagccugccgucu

SEQ ID NO: 1823953 - RNA, 14 nt, Salmonella typhimurium LT2
accagcccggcgca

SEQ ID NO: 1823954 - RNA, 23 nt, Salmonella typhimurium LT2
accagcccagguagaaucccacc

SEQ ID NO: 1823955 - RNA, 11 nt, Salmonella typhimurium LT2
accagacccgc

SEQ ID NO: 1823956 - RNA, 14 nt, Salmonella typhimurium LT2
accagacccgcugc

SEQ ID NO: 1823957 - RNA, 14 nt, Salmonella typhimurium LT2
accagacgcgaacg

SEQ ID NO: 1823958 - RNA, 19 nt, Salmonella typhimurium LT2
accagacguaaucguaauc

SEQ ID NO: 1823959 - RNA, 19 nt, Salmonella typhimurium LT2
accagaucgagacgcguca

SEQ ID NO: 1823960 - RNA, 19 nt, Salmonella typhimurium LT2
accacuaacagugcgcgua

SEQ ID NO: 1823961 - RNA, 22 nt, Salmonella typhimurium LT2
accacugacacggaacaacgca

SEQ ID NO: 1823962 - RNA, 12 nt, Salmonella typhimurium LT2
accagcaggugc

SEQ ID NO: 1823963 - RNA, 16 nt, Salmonella typhimurium LT2
accagcaggugguaca

SEQ ID NO: 1823964 - RNA, 14 nt, Salmonella typhimurium LT2
accagcaucgcguu

SEQ ID NO: 1823965 - RNA, 14 nt, Salmonella typhimurium LT2
accagaugcagcaa

SEQ ID NO: 1823966 - RNA, 14 nt, Salmonella typhimurium LT2
accagauuccccaa

SEQ ID NO: 1823967 - RNA, 16 nt, Salmonella typhimurium LT2
accacaaacgccguca

SEQ ID NO: 1823968 - RNA, 21 nt, Salmonella typhimurium LT2
accacagcaaaucguuuaacg

SEQ ID NO: 1823969 - RNA, 12 nt, Salmonella typhimurium LT2
accacaccugau

SEQ ID NO: 1823970 - RNA, 14 nt, Salmonella typhimurium LT2
accaccgauaaacg

SEQ ID NO: 1823971 - RNA, 13 nt, Salmonella typhimurium LT2
accacgucauccg

SEQ ID NO: 1823972 - RNA, 17 nt, Salmonella typhimurium LT2
accacgucauccggcaa

SEQ ID NO: 1823973 - RNA, 20 nt, Salmonella typhimurium LT2
accacggcuucagcggcgca

SEQ ID NO: 1823974 - RNA, 19 nt, Salmonella typhimurium LT2
accacgccggaaucgcgau

SEQ ID NO: 1823975 - RNA, 21 nt, Salmonella typhimurium LT2
accaccuuaaacuugccguuu

SEQ ID NO: 1823976 - RNA, 19 nt, Salmonella typhimurium LT2
accggcagcgucggcuuca

SEQ ID NO: 1823977 - RNA, 16 nt, Salmonella typhimurium LT2
accggcaucggcagcg

SEQ ID NO: 1823978 - RNA, 23 nt, Salmonella typhimurium LT2
accggcaugaagacguucuauca

SEQ ID NO: 1823979 - RNA, 17 nt, Salmonella typhimurium LT2
accggcaugauggcgaa

SEQ ID NO: 1823980 - RNA, 20 nt, Salmonella typhimurium LT2
accgccauacggaugccgau

SEQ ID NO: 1823981 - RNA, 18 nt, Salmonella typhimurium LT2
accgccacaucguuggcc

SEQ ID NO: 1823982 - RNA, 15 nt, Salmonella typhimurium LT2
accgccauccggcau

SEQ ID NO: 1823983 - RNA, 17 nt, Salmonella typhimurium LT2
accgcccccagucugcu

SEQ ID NO: 1823984 - RNA, 18 nt, Salmonella typhimurium LT2
accgccaagcgcggacag

SEQ ID NO: 1823985 - RNA, 13 nt, Salmonella typhimurium LT2
accgccgggcuaa

SEQ ID NO: 1823986 - RNA, 14 nt, Salmonella typhimurium LT2
accgccuucagcgc

SEQ ID NO: 1823987 - RNA, 20 nt, Salmonella typhimurium LT2
accgccuuauccggccuaca

SEQ ID NO: 1823988 - RNA, 14 nt, Salmonella typhimurium LT2
accgcuaaucccag

SEQ ID NO: 1823989 - RNA, 18 nt, Salmonella typhimurium LT2
accgcguuugcgcaacag

SEQ ID NO: 1823990 - RNA, 20 nt, Salmonella typhimurium LT2
accgcgacaauaugauccuc

SEQ ID NO: 1823991 - RNA, 15 nt, Salmonella typhimurium LT2
accgcgaauauacgc

SEQ ID NO: 1823992 - RNA, 23 nt, Salmonella typhimurium LT2
accgcgaauauacgcaccugaua

SEQ ID NO: 1823993 - RNA, 18 nt, Salmonella typhimurium LT2
accgcgcgcccgacgcgc

SEQ ID NO: 1823994 - RNA, 20 nt, Salmonella typhimurium LT2
aaaauggucggucacgcgau

SEQ ID NO: 1823995 - RNA, 18 nt, Salmonella typhimurium LT2
aaaauggcaauugcgccg

SEQ ID NO: 1823996 - RNA, 17 nt, Salmonella typhimurium LT2
acccggccugacgcagc

SEQ ID NO: 1823997 - RNA, 19 nt, Salmonella typhimurium LT2
acccggcuaaaugacgcgc

SEQ ID NO: 1823998 - RNA, 18 nt, Salmonella typhimurium LT2
acccggcguauugguaca

SEQ ID NO: 1823999 - RNA, 14 nt, Salmonella typhimurium LT2
acccuauccgccag

SEQ ID NO: 1824000 - RNA, 13 nt, Salmonella typhimurium LT2
acccucaucccgu

SEQ ID NO: 1824001 - RNA, 14 nt, Salmonella typhimurium LT2
acccuguucagcac

SEQ ID NO: 1824002 - RNA, 17 nt, Salmonella typhimurium LT2
acccuuugcagcgcgau

SEQ ID NO: 1824003 - RNA, 15 nt, Salmonella typhimurium LT2
acccuuuggccacca

SEQ ID NO: 1824004 - RNA, 19 nt, Salmonella typhimurium LT2
acccuuuuuugguuaucca

SEQ ID NO: 1824005 - RNA, 23 nt, Salmonella typhimurium LT2
acccuuuuuugguuauccagcag

SEQ ID NO: 1824006 - RNA, 19 nt, Salmonella typhimurium LT2
acccugccgaaaugaaagc

SEQ ID NO: 1824007 - RNA, 11 nt, Salmonella typhimurium LT2
accgaaauccg

SEQ ID NO: 1824008 - RNA, 15 nt, Salmonella typhimurium LT2
accaggcaaugcccc

SEQ ID NO: 1824009 - RNA, 18 nt, Salmonella typhimurium LT2
accaggacccgugacgca

SEQ ID NO: 1824010 - RNA, 21 nt, Salmonella typhimurium LT2
accagcuuuuaugagaaaagu

SEQ ID NO: 1824011 - RNA, 14 nt, Salmonella typhimurium LT2
acccaccagcgugg

SEQ ID NO: 1824012 - RNA, 15 nt, Salmonella typhimurium LT2
acccaaugauccgga

SEQ ID NO: 1824013 - RNA, 13 nt, Salmonella typhimurium LT2
acccagacggcga

SEQ ID NO: 1824014 - RNA, 22 nt, Salmonella typhimurium LT2
acccagaugcgaaucuucaucg

SEQ ID NO: 1824015 - RNA, 15 nt, Salmonella typhimurium LT2
acccagaaucagcaa

SEQ ID NO: 1824016 - RNA, 21 nt, Salmonella typhimurium LT2
acccacuaacugccgcugacc

SEQ ID NO: 1824017 - RNA, 14 nt, Salmonella typhimurium LT2
acccacgucauccg

SEQ ID NO: 1824018 - RNA, 12 nt, Salmonella typhimurium LT2
accccagcaucu

SEQ ID NO: 1824019 - RNA, 23 nt, Salmonella typhimurium LT2
acccauaguuucauauccgacag

SEQ ID NO: 1824020 - RNA, 15 nt, Salmonella typhimurium LT2
acccaggucgccgau

SEQ ID NO: 1824021 - RNA, 17 nt, Salmonella typhimurium LT2
acccaguaccauaccgg

SEQ ID NO: 1824022 - RNA, 19 nt, Salmonella typhimurium LT2
acccgcacccgaaagucaa

SEQ ID NO: 1824023 - RNA, 21 nt, Salmonella typhimurium LT2
acccgaacaacaauacgcguc

SEQ ID NO: 1824024 - RNA, 22 nt, Salmonella typhimurium LT2
acccgacagcggcgcagacacu

SEQ ID NO: 1824025 - RNA, 18 nt, Salmonella typhimurium LT2
accccaguaauccggcaa

SEQ ID NO: 1824026 - RNA, 17 nt, Salmonella typhimurium LT2
accccagcugcggcauc

SEQ ID NO: 1824027 - RNA, 17 nt, Salmonella typhimurium LT2
accccaguaauccggca

SEQ ID NO: 1824028 - RNA, 13 nt, Salmonella typhimurium LT2
accccgccugacg

SEQ ID NO: 1824029 - RNA, 12 nt, Salmonella typhimurium LT2
aagcugcauaau

SEQ ID NO: 1824030 - RNA, 24 nt, Salmonella typhimurium LT2
aagcugcggcagaaucacggccga

SEQ ID NO: 1824031 - RNA, 16 nt, Salmonella typhimurium LT2
aagcucuucuuacucc

SEQ ID NO: 1824032 - RNA, 24 nt, Salmonella typhimurium LT2
aagcguuuuauacaccugaucggc

SEQ ID NO: 1824033 - RNA, 19 nt, Salmonella typhimurium LT2
aagcuaucgccaucaacgc

SEQ ID NO: 1824034 - RNA, 19 nt, Salmonella typhimurium LT2
aagcgcucaugccacgcca

SEQ ID NO: 1824035 - RNA, 14 nt, Salmonella typhimurium LT2
aagcgucagcgcca

SEQ ID NO: 1824036 - RNA, 17 nt, Salmonella typhimurium LT2
aagcgucagcgccaucc

SEQ ID NO: 1824037 - RNA, 15 nt, Salmonella typhimurium LT2
aagcggcaaucgccu

SEQ ID NO: 1824038 - RNA, 15 nt, Salmonella typhimurium LT2
aagcgacagcgccau

SEQ ID NO: 1824039 - RNA, 17 nt, Salmonella typhimurium LT2
aagcgacagcgccaucc

SEQ ID NO: 1824040 - RNA, 16 nt, Salmonella typhimurium LT2
aagcgccgcugacggc

SEQ ID NO: 1824041 - RNA, 15 nt, Salmonella typhimurium LT2
aagcgagcgccugau

SEQ ID NO: 1824042 - RNA, 19 nt, Salmonella typhimurium LT2
aagccauugccgcgacaaa

SEQ ID NO: 1824043 - RNA, 19 nt, Salmonella typhimurium LT2
aagcccauggcaggcagca

SEQ ID NO: 1824044 - RNA, 22 nt, Salmonella typhimurium LT2
aagaucguuauccagcagccac

SEQ ID NO: 1824045 - RNA, 23 nt, Salmonella typhimurium LT2
aagaucgccaagcugugauugcg

SEQ ID NO: 1824046 - RNA, 13 nt, Salmonella typhimurium LT2
aagaucgcgcagc

SEQ ID NO: 1824047 - RNA, 22 nt, Salmonella typhimurium LT2
aagaugccugaaaauagcgcca

SEQ ID NO: 1824048 - RNA, 11 nt, Salmonella typhimurium LT2
aagcaggccga

SEQ ID NO: 1824049 - RNA, 18 nt, Salmonella typhimurium LT2
aagcaccggcgggcugau

SEQ ID NO: 1824050 - RNA, 13 nt, Salmonella typhimurium LT2
aagauuugcgccg

SEQ ID NO: 1824051 - RNA, 21 nt, Salmonella typhimurium LT2
aacgugcgguauaucacgcca

SEQ ID NO: 1824052 - RNA, 17 nt, Salmonella typhimurium LT2
aacgugcuccagcgccu

SEQ ID NO: 1824053 - RNA, 14 nt, Salmonella typhimurium LT2
aacguuaacgccgc

SEQ ID NO: 1824054 - RNA, 16 nt, Salmonella typhimurium LT2
aagagcgccugaccgc

SEQ ID NO: 1824055 - RNA, 16 nt, Salmonella typhimurium LT2
aagaggccggauggcg

SEQ ID NO: 1824056 - RNA, 22 nt, Salmonella typhimurium LT2
aagaggaugcuccgccagagcu

SEQ ID NO: 1824057 - RNA, 19 nt, Salmonella typhimurium LT2
aagauaaacgacagcgcca

SEQ ID NO: 1824058 - RNA, 20 nt, Salmonella typhimurium LT2
aaggacuuaucaggccuacg

SEQ ID NO: 1824059 - RNA, 14 nt, Salmonella typhimurium LT2
aagcuguuccggcu

SEQ ID NO: 1824060 - RNA, 14 nt, Salmonella typhimurium LT2
aagcugguaaaugc

SEQ ID NO: 1824061 - RNA, 15 nt, Salmonella typhimurium LT2
aaggcgcuaccagga

SEQ ID NO: 1824062 - RNA, 21 nt, Salmonella typhimurium LT2
aaggcgcgcacaugcagcgca

SEQ ID NO: 1824063 - RNA, 24 nt, Salmonella typhimurium LT2
aaggcguaaccgccauccggcgau

SEQ ID NO: 1824064 - RNA, 16 nt, Salmonella typhimurium LT2
aaggcguaaccgccau

SEQ ID NO: 1824065 - RNA, 21 nt, Salmonella typhimurium LT2
aagguguuuacgccgccaucc

SEQ ID NO: 1824066 - RNA, 16 nt, Salmonella typhimurium LT2
aagguucccugcgcca

SEQ ID NO: 1824067 - RNA, 13 nt, Salmonella typhimurium LT2
aaguaagcgccag

SEQ ID NO: 1824068 - RNA, 12 nt, Salmonella typhimurium LT2
aaguaguuccag

SEQ ID NO: 1824069 - RNA, 21 nt, Salmonella typhimurium LT2
aauaauacacgcgacaaugcc

SEQ ID NO: 1824070 - RNA, 20 nt, Salmonella typhimurium LT2
aauaccaauaucgccguuaa

SEQ ID NO: 1824071 - RNA, 16 nt, Salmonella typhimurium LT2
aauaccguccagcgca

SEQ ID NO: 1824072 - RNA, 21 nt, Salmonella typhimurium LT2
aauaccggcguaauugcgccu

SEQ ID NO: 1824073 - RNA, 21 nt, Salmonella typhimurium LT2
aauacccgccgauaaacgcgu

SEQ ID NO: 1824074 - RNA, 19 nt, Salmonella typhimurium LT2
aauaccugccugucacgca

SEQ ID NO: 1824075 - RNA, 18 nt, Salmonella typhimurium LT2
aauaccuuauucagccca

SEQ ID NO: 1824076 - RNA, 15 nt, Salmonella typhimurium LT2
aaguuuauccggcac

SEQ ID NO: 1824077 - RNA, 22 nt, Salmonella typhimurium LT2
aauaaagagcacuucugacauu

SEQ ID NO: 1824078 - RNA, 12 nt, Salmonella typhimurium LT2
aauaacgcgcuu

SEQ ID NO: 1824079 - RNA, 19 nt, Salmonella typhimurium LT2
aauaaagcagcggcgguua

SEQ ID NO: 1824080 - RNA, 11 nt, Salmonella typhimurium LT2
aauaagaacuu

SEQ ID NO: 1824081 - RNA, 14 nt, Salmonella typhimurium LT2
aaugucaugcgcca

SEQ ID NO: 1824082 - RNA, 12 nt, Salmonella typhimurium LT2
aauguccgccaa

SEQ ID NO: 1824083 - RNA, 13 nt, Salmonella typhimurium LT2
aauguauuucaga

SEQ ID NO: 1824084 - RNA, 16 nt, Salmonella typhimurium LT2
aauggccgcagcgcca

SEQ ID NO: 1824085 - RNA, 17 nt, Salmonella typhimurium LT2
aauggcagggacaacgc

SEQ ID NO: 1824086 - RNA, 16 nt, Salmonella typhimurium LT2
aauggauaacggcguu

SEQ ID NO: 1824087 - RNA, 13 nt, Salmonella typhimurium LT2
aaugcgcacgcca

SEQ ID NO: 1824088 - RNA, 20 nt, Salmonella typhimurium LT2
aaugcgaaaauacucccggc

SEQ ID NO: 1824089 - RNA, 17 nt, Salmonella typhimurium LT2
aaugccuuauccggccu

SEQ ID NO: 1824090 - RNA, 20 nt, Salmonella typhimurium LT2
aaugccguauaccagcguca

SEQ ID NO: 1824091 - RNA, 23 nt, Salmonella typhimurium LT2
aaugccggauggcgucgcuaaag

SEQ ID NO: 1824092 - RNA, 23 nt, Salmonella typhimurium LT2
aaucugaugauggaacagacgcc

SEQ ID NO: 1824093 - RNA, 22 nt, Salmonella typhimurium LT2
aaucugcucgacgcgcugcggu

SEQ ID NO: 1824094 - RNA, 17 nt, Salmonella typhimurium LT2
aaugccgggcagacgac

SEQ ID NO: 1824095 - RNA, 22 nt, Salmonella typhimurium LT2
aaugccgaucaccagcgcaucg

SEQ ID NO: 1824096 - RNA, 19 nt, Salmonella typhimurium LT2
aaugauccggacgauagcc

SEQ ID NO: 1824097 - RNA, 13 nt, Salmonella typhimurium LT2
aaugauaucgcgc

SEQ ID NO: 1824098 - RNA, 18 nt, Salmonella typhimurium LT2
aauguucauguacgccgc

SEQ ID NO: 1824099 - RNA, 19 nt, Salmonella typhimurium LT2
aauuauuccuugaucagga

SEQ ID NO: 1824100 - RNA, 23 nt, Salmonella typhimurium LT2
aauucuuuaauuugugccagcgu

SEQ ID NO: 1824101 - RNA, 20 nt, Salmonella typhimurium LT2
aauucucacagaaucaucag

SEQ ID NO: 1824102 - RNA, 21 nt, Salmonella typhimurium LT2
aauuuauccaguaacgcgucc

SEQ ID NO: 1824103 - RNA, 17 nt, Salmonella typhimurium LT2
aauuuagagugauccac

SEQ ID NO: 1824104 - RNA, 14 nt, Salmonella typhimurium LT2
aauuuaagcgauuc

SEQ ID NO: 1824105 - RNA, 14 nt, Salmonella typhimurium LT2
aaucgcgcgcgcca

SEQ ID NO: 1824106 - RNA, 13 nt, Salmonella typhimurium LT2
aaucggaugccau

SEQ ID NO: 1824107 - RNA, 14 nt, Salmonella typhimurium LT2
aaucgcuuccuggg

SEQ ID NO: 1824108 - RNA, 17 nt, Salmonella typhimurium LT2
aaucggccagcgacucg

SEQ ID NO: 1824109 - RNA, 20 nt, Salmonella typhimurium LT2
aaucggcaaauacaucgcca

SEQ ID NO: 1824110 - RNA, 17 nt, Salmonella typhimurium LT2
aaucggcggaaugccgu

SEQ ID NO: 1824111 - RNA, 20 nt, Salmonella typhimurium LT2
aaucggcguuuugcgcgcca

SEQ ID NO: 1824112 - RNA, 12 nt, Salmonella typhimurium LT2
aaucgugcgccc

SEQ ID NO: 1824113 - RNA, 20 nt, Salmonella typhimurium LT2
aaucgucgugccuuccgcaa

SEQ ID NO: 1824114 - RNA, 16 nt, Salmonella typhimurium LT2
aaucgggccuccgcgu

SEQ ID NO: 1824115 - RNA, 20 nt, Salmonella typhimurium LT2
aaucucacgcucauagccgc

SEQ ID NO: 1824116 - RNA, 17 nt, Salmonella typhimurium LT2
aaucgccaucagcgcga

SEQ ID NO: 1824117 - RNA, 14 nt, Salmonella typhimurium LT2
aauccugcacuucc

SEQ ID NO: 1824118 - RNA, 15 nt, Salmonella typhimurium LT2
aauccucgucaaggc

SEQ ID NO: 1824119 - RNA, 14 nt, Salmonella typhimurium LT2
aaucgacaauccgc

SEQ ID NO: 1824120 - RNA, 16 nt, Salmonella typhimurium LT2
aauccuuccagcgcca

SEQ ID NO: 1824121 - RNA, 11 nt, Salmonella typhimurium LT2
aauccguugau

SEQ ID NO: 1824122 - RNA, 12 nt, Salmonella typhimurium LT2
aauccgcggcaa

SEQ ID NO: 1824123 - RNA, 14 nt, Salmonella typhimurium LT2
aaucagaauaccgc

SEQ ID NO: 1824124 - RNA, 23 nt, Salmonella typhimurium LT2
aaucagcacacgccaaaaucgcc

SEQ ID NO: 1824125 - RNA, 23 nt, Salmonella typhimurium LT2
aaucagaugcgcuucagcgacuu

SEQ ID NO: 1824126 - RNA, 17 nt, Salmonella typhimurium LT2
aaucaggaaagagccgc

SEQ ID NO: 1824127 - RNA, 22 nt, Salmonella typhimurium LT2
aaucagcugcugcgcuuuccag

SEQ ID NO: 1824128 - RNA, 15 nt, Salmonella typhimurium LT2
aauagcgcugaugcg

SEQ ID NO: 1824129 - RNA, 14 nt, Salmonella typhimurium LT2
aauagccucauccc

SEQ ID NO: 1824130 - RNA, 22 nt, Salmonella typhimurium LT2
aaucccggcaacugcgccaaau

SEQ ID NO: 1824131 - RNA, 20 nt, Salmonella typhimurium LT2
aaucccccauacccuguuca

SEQ ID NO: 1824132 - RNA, 19 nt, Salmonella typhimurium LT2
aaucauauaaucugaaaga

SEQ ID NO: 1824133 - RNA, 13 nt, Salmonella typhimurium LT2
aaucauaaagcgc

SEQ ID NO: 1824134 - RNA, 19 nt, Salmonella typhimurium LT2
aaucauacauagcaggcca

SEQ ID NO: 1824135 - RNA, 17 nt, Salmonella typhimurium LT2
aaucaugcccaacugcc

SEQ ID NO: 1824136 - RNA, 21 nt, Salmonella typhimurium LT2
aacggcucgguuuauccccgc

SEQ ID NO: 1824137 - RNA, 22 nt, Salmonella typhimurium LT2
aacggagauauagaccagcgcc

SEQ ID NO: 1824138 - RNA, 23 nt, Salmonella typhimurium LT2
aacgcuuugcgauagcccggcau

SEQ ID NO: 1824139 - RNA, 20 nt, Salmonella typhimurium LT2
aacgcuuucgccagcgcgac

SEQ ID NO: 1824140 - RNA, 14 nt, Salmonella typhimurium LT2
aacgcgcgcgcugu

SEQ ID NO: 1824141 - RNA, 23 nt, Salmonella typhimurium LT2
aacgcgcccaacggaugcgccau

SEQ ID NO: 1824142 - RNA, 23 nt, Salmonella typhimurium LT2
aacgcgcaguccguuuucaacgc

SEQ ID NO: 1824143 - RNA, 14 nt, Salmonella typhimurium LT2
aacgggcugaccgc

SEQ ID NO: 1824144 - RNA, 21 nt, Salmonella typhimurium LT2
aacgggguauaacucagcggc

SEQ ID NO: 1824145 - RNA, 13 nt, Salmonella typhimurium LT2
aacgguccugguc

SEQ ID NO: 1824146 - RNA, 13 nt, Salmonella typhimurium LT2
aacggucucaggc

SEQ ID NO: 1824147 - RNA, 17 nt, Salmonella typhimurium LT2
aacggucuugccagcga

SEQ ID NO: 1824148 - RNA, 20 nt, Salmonella typhimurium LT2
aacgucuuauccggccugca

SEQ ID NO: 1824149 - RNA, 16 nt, Salmonella typhimurium LT2
aacgucuuuuuccagc

SEQ ID NO: 1824150 - RNA, 19 nt, Salmonella typhimurium LT2
aacgucuuuuuccagcagc

SEQ ID NO: 1824151 - RNA, 13 nt, Salmonella typhimurium LT2
aacgucagcgcca

SEQ ID NO: 1824152 - RNA, 19 nt, Salmonella typhimurium LT2
aacgucccacgucagccca

SEQ ID NO: 1824153 - RNA, 14 nt, Salmonella typhimurium LT2
aacgucgccauccg

SEQ ID NO: 1824154 - RNA, 16 nt, Salmonella typhimurium LT2
aacgucgccauccggc

SEQ ID NO: 1824155 - RNA, 18 nt, Salmonella typhimurium LT2
aacgucgccauccggcaa

SEQ ID NO: 1824156 - RNA, 16 nt, Salmonella typhimurium LT2
aacgucgcgcccugca

SEQ ID NO: 1824157 - RNA, 22 nt, Salmonella typhimurium LT2
aacgguuuugcgcugguaccgg

SEQ ID NO: 1824158 - RNA, 17 nt, Salmonella typhimurium LT2
aaccgccuccaggccgg

SEQ ID NO: 1824159 - RNA, 21 nt, Salmonella typhimurium LT2
aaccgcgaucgaugugauaaa

SEQ ID NO: 1824160 - RNA, 19 nt, Salmonella typhimurium LT2
aaccgcgccaaagauaaga

SEQ ID NO: 1824161 - RNA, 15 nt, Salmonella typhimurium LT2
aacgauagacgugca

SEQ ID NO: 1824162 - RNA, 20 nt, Salmonella typhimurium LT2
aacgccgaccacuucaacgc

SEQ ID NO: 1824163 - RNA, 22 nt, Salmonella typhimurium LT2
aacgccgcauccuguaccacca

SEQ ID NO: 1824164 - RNA, 13 nt, Salmonella typhimurium LT2
aacgccgcgcaaa

SEQ ID NO: 1824165 - RNA, 19 nt, Salmonella typhimurium LT2
aacgcgaacugugaagcga

SEQ ID NO: 1824166 - RNA, 18 nt, Salmonella typhimurium LT2
aacgcaacucaucgucau

SEQ ID NO: 1824167 - RNA, 17 nt, Salmonella typhimurium LT2
aacgcaacacaggccgc

SEQ ID NO: 1824168 - RNA, 23 nt, Salmonella typhimurium LT2
aacgaugcuugccauauugccgc

SEQ ID NO: 1824169 - RNA, 14 nt, Salmonella typhimurium LT2
aacgcacuaccaga

SEQ ID NO: 1824170 - RNA, 16 nt, Salmonella typhimurium LT2
aacgcauaagcgcgaa

SEQ ID NO: 1824171 - RNA, 13 nt, Salmonella typhimurium LT2
aacgcauccagcg

SEQ ID NO: 1824172 - RNA, 18 nt, Salmonella typhimurium LT2
aacgcauguuccgcuacc

SEQ ID NO: 1824173 - RNA, 13 nt, Salmonella typhimurium LT2
aacgcaucgcgga

SEQ ID NO: 1824174 - RNA, 20 nt, Salmonella typhimurium LT2
aaccaccugggucagcguca

SEQ ID NO: 1824175 - RNA, 12 nt, Salmonella typhimurium LT2
aaccagccgauc

SEQ ID NO: 1824176 - RNA, 23 nt, Salmonella typhimurium LT2
aaccaacgacccccaccauguca

SEQ ID NO: 1824177 - RNA, 12 nt, Salmonella typhimurium LT2
aaccaagauaag

SEQ ID NO: 1824178 - RNA, 14 nt, Salmonella typhimurium LT2
aacauuucagcgcc

SEQ ID NO: 1824179 - RNA, 14 nt, Salmonella typhimurium LT2
aacaugcccaguuu

SEQ ID NO: 1824180 - RNA, 18 nt, Salmonella typhimurium LT2
aacaugacggcagucgcu

SEQ ID NO: 1824181 - RNA, 21 nt, Salmonella typhimurium LT2
aacaucauugccugauggcgc

SEQ ID NO: 1824182 - RNA, 14 nt, Salmonella typhimurium LT2
aacaucgguuaucg

SEQ ID NO: 1824183 - RNA, 12 nt, Salmonella typhimurium LT2
aacaucggcaaa

SEQ ID NO: 1824184 - RNA, 15 nt, Salmonella typhimurium LT2
aacauauagcagcag

SEQ ID NO: 1824185 - RNA, 12 nt, Salmonella typhimurium LT2
aacaucagcgcu

SEQ ID NO: 1824186 - RNA, 20 nt, Salmonella typhimurium LT2
aacagugaguacgcaggagg

SEQ ID NO: 1824187 - RNA, 14 nt, Salmonella typhimurium LT2
aaccgacagcaaua

SEQ ID NO: 1824188 - RNA, 22 nt, Salmonella typhimurium LT2
aaccgacagcaauaucagccau

SEQ ID NO: 1824189 - RNA, 21 nt, Salmonella typhimurium LT2
aaccgauguaucaaccgcuuu

SEQ ID NO: 1824190 - RNA, 13 nt, Salmonella typhimurium LT2
aaccgccagcagc

SEQ ID NO: 1824191 - RNA, 15 nt, Salmonella typhimurium LT2
aaccgaauucgucca

SEQ ID NO: 1824192 - RNA, 15 nt, Salmonella typhimurium LT2
aacccggccugacgc

SEQ ID NO: 1824193 - RNA, 22 nt, Salmonella typhimurium LT2
aaccccggcaaaccuaccggca

SEQ ID NO: 1824194 - RNA, 15 nt, Salmonella typhimurium LT2
aacccacaugaucgc

SEQ ID NO: 1824195 - RNA, 17 nt, Salmonella typhimurium LT2
aacccgccaccaucucc

SEQ ID NO: 1824196 - RNA, 21 nt, Salmonella typhimurium LT2
aacccgaucgccauccugcac

SEQ ID NO: 1824197 - RNA, 17 nt, Salmonella typhimurium LT2
aaccauuucuccugcau

SEQ ID NO: 1824198 - RNA, 18 nt, Salmonella typhimurium LT2
aaccaugauaucgccaau

SEQ ID NO: 1824199 - RNA, 19 nt, Salmonella typhimurium LT2
aaccaugcccgggcgcugu

SEQ ID NO: 1824200 - RNA, 18 nt, Salmonella typhimurium LT2
aaccaggacccgugacgc

SEQ ID NO: 1824201 - RNA, 15 nt, Salmonella typhimurium LT2
aaccagguuuccaga

SEQ ID NO: 1824202 - RNA, 15 nt, Salmonella typhimurium LT2
aaccaguucgcgcgu

SEQ ID NO: 1824203 - RNA, 23 nt, Salmonella typhimurium LT2
aaagauaauauccccuaaauaac

SEQ ID NO: 1824204 - RNA, 23 nt, Salmonella typhimurium LT2
aaagauuauuuuaucaucagcac

SEQ ID NO: 1824205 - RNA, 17 nt, Salmonella typhimurium LT2
aaacugaaucaauagcu

SEQ ID NO: 1824206 - RNA, 18 nt, Salmonella typhimurium LT2
aaacugugaugccguuag

SEQ ID NO: 1824207 - RNA, 23 nt, Salmonella typhimurium LT2
aaacuaccgcgccagccguagcu

SEQ ID NO: 1824208 - RNA, 17 nt, Salmonella typhimurium LT2
aaacuccauuaaauuac

SEQ ID NO: 1824209 - RNA, 23 nt, Salmonella typhimurium LT2
aaacgcacgcugucgccgguuag

SEQ ID NO: 1824210 - RNA, 19 nt, Salmonella typhimurium LT2
aaacgcaaugccaucaggc

SEQ ID NO: 1824211 - RNA, 22 nt, Salmonella typhimurium LT2
aaacgccagcccuuccagcgga

SEQ ID NO: 1824212 - RNA, 20 nt, Salmonella typhimurium LT2
aaacgccaggcacgccggca

SEQ ID NO: 1824213 - RNA, 16 nt, Salmonella typhimurium LT2
aaacggugcgauuauc

SEQ ID NO: 1824214 - RNA, 12 nt, Salmonella typhimurium LT2
aaaaacagccau

SEQ ID NO: 1824215 - RNA, 21 nt, Salmonella typhimurium LT2
aaacgacagcgccaucagcau

SEQ ID NO: 1824216 - RNA, 12 nt, Salmonella typhimurium LT2
aaaaaaccguau

SEQ ID NO: 1824217 - RNA, 17 nt, Salmonella typhimurium LT2
aaagcaaucgccagcgc

SEQ ID NO: 1824218 - RNA, 17 nt, Salmonella typhimurium LT2
aaagucaucugccaguu

SEQ ID NO: 1824219 - RNA, 18 nt, Salmonella typhimurium LT2
aaagucaucugccaguua

SEQ ID NO: 1824220 - RNA, 15 nt, Salmonella typhimurium LT2
aaagucgauaaaugc

SEQ ID NO: 1824221 - RNA, 21 nt, Salmonella typhimurium LT2
aaaggcauuucuaccggcaga

SEQ ID NO: 1824222 - RNA, 13 nt, Salmonella typhimurium LT2
aaagcugguggcg

SEQ ID NO: 1824223 - RNA, 17 nt, Salmonella typhimurium LT2
aaauaggcgccgccgac

SEQ ID NO: 1824224 - RNA, 15 nt, Salmonella typhimurium LT2
aaauagugacgccgc

SEQ ID NO: 1824225 - RNA, 14 nt, Salmonella typhimurium LT2
aaaguuaccggcau

SEQ ID NO: 1824226 - RNA, 15 nt, Salmonella typhimurium LT2
aaagugcgccgccag

SEQ ID NO: 1824227 - RNA, 22 nt, Salmonella typhimurium LT2
aaaguuaaacauaccgccggua

SEQ ID NO: 1824228 - RNA, 12 nt, Salmonella typhimurium LT2
aaauagcacgug

SEQ ID NO: 1824229 - RNA, 22 nt, Salmonella typhimurium LT2
aaauacugcgcgaaauacggac

SEQ ID NO: 1824230 - RNA, 20 nt, Salmonella typhimurium LT2
aaauacugcuuuuccggcag

SEQ ID NO: 1824231 - RNA, 12 nt, Salmonella typhimurium LT2
aaauacggaacu

SEQ ID NO: 1824232 - RNA, 16 nt, Salmonella typhimurium LT2
aacaaugauaucgcgc

SEQ ID NO: 1824233 - RNA, 15 nt, Salmonella typhimurium LT2
aacacucuccaccaa

SEQ ID NO: 1824234 - RNA, 20 nt, Salmonella typhimurium LT2
aacagaugacagugcgccau

SEQ ID NO: 1824235 - RNA, 15 nt, Salmonella typhimurium LT2
aacagcaccagcagg

SEQ ID NO: 1824236 - RNA, 14 nt, Salmonella typhimurium LT2
aaaagcgacgcugu

SEQ ID NO: 1824237 - RNA, 16 nt, Salmonella typhimurium LT2
aaaagcccuuaucgcc

SEQ ID NO: 1824238 - RNA, 15 nt, Salmonella typhimurium LT2
aaaagcugucgccac

SEQ ID NO: 1824239 - RNA, 15 nt, Salmonella typhimurium LT2
aaaaggcucgcauuc

SEQ ID NO: 1824240 - RNA, 16 nt, Salmonella typhimurium LT2
aacaacguuacgccag

SEQ ID NO: 1824241 - RNA, 18 nt, Salmonella typhimurium LT2
aacaaggauauccgccag

SEQ ID NO: 1824242 - RNA, 18 nt, Salmonella typhimurium LT2
aacagcuggcgauauccg

SEQ ID NO: 1824243 - RNA, 17 nt, Salmonella typhimurium LT2
aacagcgcuaucaggaa

SEQ ID NO: 1824244 - RNA, 19 nt, Salmonella typhimurium LT2
aacagcgcuccacgcgucc

SEQ ID NO: 1824245 - RNA, 21 nt, Salmonella typhimurium LT2
aacagcggcacuucgauaaac

SEQ ID NO: 1824246 - RNA, 13 nt, Salmonella typhimurium LT2
aacagcgccauca

SEQ ID NO: 1824247 - RNA, 19 nt, Salmonella typhimurium LT2
aacagcgaucacgccgucc

SEQ ID NO: 1824248 - RNA, 12 nt, Salmonella typhimurium LT2
aacagccaggcu

SEQ ID NO: 1824249 - RNA, 14 nt, Salmonella typhimurium LT2
aacagccagaacgu

SEQ ID NO: 1824250 - RNA, 15 nt, Salmonella typhimurium LT2
aacagcgaccacgcc

SEQ ID NO: 1824251 - RNA, 19 nt, Salmonella typhimurium LT2
aacagucccaccagcgcgg

SEQ ID NO: 1824252 - RNA, 13 nt, Salmonella typhimurium LT2
aacaggucaacuc

SEQ ID NO: 1824253 - RNA, 16 nt, Salmonella typhimurium LT2
aacagggggcgcauca

SEQ ID NO: 1824254 - RNA, 19 nt, Salmonella typhimurium LT2
aacagggccgcauccccau

SEQ ID NO: 1824255 - RNA, 23 nt, Salmonella typhimurium LT2
aaaagcccccaucaccugaccga

SEQ ID NO: 1824256 - RNA, 23 nt, Salmonella typhimurium LT2
aaauugccugauggcgcugcgcu

SEQ ID NO: 1824257 - RNA, 17 nt, Salmonella typhimurium LT2
aaauucgcagcguucga

SEQ ID NO: 1824258 - RNA, 13 nt, Salmonella typhimurium LT2
aaauucagcgcag

SEQ ID NO: 1824259 - RNA, 12 nt, Salmonella typhimurium LT2
aaauucaacgua

SEQ ID NO: 1824260 - RNA, 20 nt, Salmonella typhimurium LT2
aaaugucagaucguaugcgc

SEQ ID NO: 1824261 - RNA, 15 nt, Salmonella typhimurium LT2
aaauuagcgcgaaau

SEQ ID NO: 1824262 - RNA, 21 nt, Salmonella typhimurium LT2
aaauggcggaacugcguuuga

SEQ ID NO: 1824263 - RNA, 16 nt, Salmonella typhimurium LT2
aaaugcggcauccggc

SEQ ID NO: 1824264 - RNA, 21 nt, Salmonella typhimurium LT2
aaaugcggguccugaucggcg

SEQ ID NO: 1824265 - RNA, 21 nt, Salmonella typhimurium LT2
aaaugccuguuuauauucugg

SEQ ID NO: 1824266 - RNA, 17 nt, Salmonella typhimurium LT2
uuuuuagcgugccgacg

SEQ ID NO: 1824267 - RNA, 13 nt, Salmonella typhimurium LT2
uuuuccagcgcga

SEQ ID NO: 1824268 - RNA, 21 nt, Salmonella typhimurium LT2
uuuggcgacagacgcuuaucg

SEQ ID NO: 1824269 - RNA, 17 nt, Salmonella typhimurium LT2
uuuuaagguuaauucug

SEQ ID NO: 1824270 - RNA, 24 nt, Salmonella typhimurium LT2
uuugcgcggauugagcgaauccag

SEQ ID NO: 1824271 - RNA, 17 nt, Salmonella typhimurium LT2
uuugcguacucagcaga

SEQ ID NO: 1824272 - RNA, 21 nt, Salmonella typhimurium LT2
uuugcugggcuuuuaaccacg

SEQ ID NO: 1824273 - RNA, 20 nt, Salmonella typhimurium LT2
uuugcucccuggugcgaucg

SEQ ID NO: 1824274 - RNA, 23 nt, Salmonella typhimurium LT2
uuugaccagauaaucaaacgcgc

SEQ ID NO: 1824275 - RNA, 18 nt, Salmonella typhimurium LT2
uuugaccagcaucgccgg

SEQ ID NO: 1824276 - RNA, 15 nt, Salmonella typhimurium LT2
uuucuucgcgguaac

SEQ ID NO: 1824277 - RNA, 20 nt, Salmonella typhimurium LT2
uuugaaaaucacaucgccgg

SEQ ID NO: 1824278 - RNA, 15 nt, Salmonella typhimurium LT2
uuugaauaaucccgc

SEQ ID NO: 1824279 - RNA, 19 nt, Salmonella typhimurium LT2
uuuccccguuuuacaccag

SEQ ID NO: 1824280 - RNA, 16 nt, Salmonella typhimurium LT2
uuuccccugcgaacag

SEQ ID NO: 1824281 - RNA, 10 nt, Salmonella typhimurium LT2
uuuccgccau

SEQ ID NO: 1824282 - RNA, 16 nt, Salmonella typhimurium LT2
uuuccagcaucgacca

SEQ ID NO: 1824283 - RNA, 13 nt, Salmonella typhimurium LT2
uuuccagugccag

SEQ ID NO: 1824284 - RNA, 15 nt, Salmonella typhimurium LT2
uuuccagugccgcca

SEQ ID NO: 1824285 - RNA, 17 nt, Salmonella typhimurium LT2
uuuccagcucaaccgcg

SEQ ID NO: 1824286 - RNA, 21 nt, Salmonella typhimurium LT2
uuucuccugcgccagccggau

SEQ ID NO: 1824287 - RNA, 16 nt, Salmonella typhimurium LT2
uuucuaugugcgccag

SEQ ID NO: 1824288 - RNA, 15 nt, Salmonella typhimurium LT2
uuuaauuuaugcgcc

SEQ ID NO: 1824289 - RNA, 18 nt, Salmonella typhimurium LT2
uuuaccugcaaaaacgcc

SEQ ID NO: 1824290 - RNA, 13 nt, Salmonella typhimurium LT2
uuuacauucucaa

SEQ ID NO: 1824291 - RNA, 15 nt, Salmonella typhimurium LT2
uuuacgucagcaaua

SEQ ID NO: 1824292 - RNA, 21 nt, Salmonella typhimurium LT2
uuguucaaucggauaauccgc

SEQ ID NO: 1824293 - RNA, 17 nt, Salmonella typhimurium LT2
uuguugacaucgcacgc

SEQ ID NO: 1824294 - RNA, 20 nt, Salmonella typhimurium LT2
uuguugaccaacaaucgccc

SEQ ID NO: 1824295 - RNA, 20 nt, Salmonella typhimurium LT2
uuucacccccagcugacugg

SEQ ID NO: 1824296 - RNA, 13 nt, Salmonella typhimurium LT2
uuuaugugccgau

SEQ ID NO: 1824297 - RNA, 16 nt, Salmonella typhimurium LT2
uuuaugcagccgauag

SEQ ID NO: 1824298 - RNA, 20 nt, Salmonella typhimurium LT2
uuuaugcguuuaauugaauu

SEQ ID NO: 1824299 - RNA, 22 nt, Salmonella typhimurium LT2
uuuaucaaacaaaccaaacuga

SEQ ID NO: 1824300 - RNA, 16 nt, Salmonella typhimurium LT2
uuuauccaguaacgcg

SEQ ID NO: 1824301 - RNA, 23 nt, Salmonella typhimurium LT2
uuuauccacgccgcuaucgacca

SEQ ID NO: 1824302 - RNA, 18 nt, Salmonella typhimurium LT2
uuuauccggcgcuggucg

SEQ ID NO: 1824303 - RNA, 11 nt, Salmonella typhimurium LT2
uuuauauugug

SEQ ID NO: 1824304 - RNA, 16 nt, Salmonella typhimurium LT2
uuuagcaccuuacgaa

SEQ ID NO: 1824305 - RNA, 11 nt, Salmonella typhimurium LT2
uuuagcacguu

SEQ ID NO: 1824306 - RNA, 16 nt, Salmonella typhimurium LT2
uuuagcgauaaacggc

SEQ ID NO: 1824307 - RNA, 22 nt, Salmonella typhimurium LT2
uuggcuuuaugaauaucaacgc

SEQ ID NO: 1824308 - RNA, 18 nt, Salmonella typhimurium LT2
uugggccggauacgucac

SEQ ID NO: 1824309 - RNA, 21 nt, Salmonella typhimurium LT2
uuguacgcuuaguuugcgcga

SEQ ID NO: 1824310 - RNA, 13 nt, Salmonella typhimurium LT2
uuguccugguaca

SEQ ID NO: 1824311 - RNA, 14 nt, Salmonella typhimurium LT2
uucuuuaugcgccu

SEQ ID NO: 1824312 - RNA, 14 nt, Salmonella typhimurium LT2
uucuuuaccaguga

SEQ ID NO: 1824313 - RNA, 15 nt, Salmonella typhimurium LT2
uucuuuccugcaaau

SEQ ID NO: 1824314 - RNA, 19 nt, Salmonella typhimurium LT2
uucuuugcgccuuauucag

SEQ ID NO: 1824315 - RNA, 16 nt, Salmonella typhimurium LT2
uugaaaucacgccaca

SEQ ID NO: 1824316 - RNA, 14 nt, Salmonella typhimurium LT2
uggcuaucgccgua

SEQ ID NO: 1824317 - RNA, 21 nt, Salmonella typhimurium LT2
uggcucaagauucaguuccac

SEQ ID NO: 1824318 - RNA, 20 nt, Salmonella typhimurium LT2
uggcuaccgggcgcaaucau

SEQ ID NO: 1824319 - RNA, 21 nt, Salmonella typhimurium LT2
uggcuaccgggcgcaaucauc

SEQ ID NO: 1824320 - RNA, 20 nt, Salmonella typhimurium LT2
uggcggcugcgccuuauccg

SEQ ID NO: 1824321 - RNA, 13 nt, Salmonella typhimurium LT2
uggcuuuaaacgc

SEQ ID NO: 1824322 - RNA, 15 nt, Salmonella typhimurium LT2
ugggaucgacucauc

SEQ ID NO: 1824323 - RNA, 13 nt, Salmonella typhimurium LT2
uggcugucuuccg

SEQ ID NO: 1824324 - RNA, 20 nt, Salmonella typhimurium LT2
uggcuggguaaaaucagcgc

SEQ ID NO: 1824325 - RNA, 22 nt, Salmonella typhimurium LT2
ugggcggcaacccgcuccagaa

SEQ ID NO: 1824326 - RNA, 20 nt, Salmonella typhimurium LT2
ugggcgcgacuuuacugcgu

SEQ ID NO: 1824327 - RNA, 14 nt, Salmonella typhimurium LT2
ugggcuuaaugcgc

SEQ ID NO: 1824328 - RNA, 18 nt, Salmonella typhimurium LT2
ugguaggccugauaagcg

SEQ ID NO: 1824329 - RNA, 16 nt, Salmonella typhimurium LT2
ugguagacgcgcuagc

SEQ ID NO: 1824330 - RNA, 21 nt, Salmonella typhimurium LT2
uggguauauuugccgaacgcg

SEQ ID NO: 1824331 - RNA, 19 nt, Salmonella typhimurium LT2
ugggucacauccagacagc

SEQ ID NO: 1824332 - RNA, 13 nt, Salmonella typhimurium LT2
ugggucgcggcau

SEQ ID NO: 1824333 - RNA, 20 nt, Salmonella typhimurium LT2
uggggccuaaugagccagau

SEQ ID NO: 1824334 - RNA, 14 nt, Salmonella typhimurium LT2
uggcgaccgcugca

SEQ ID NO: 1824335 - RNA, 14 nt, Salmonella typhimurium LT2
uggcgaauagcgcc

SEQ ID NO: 1824336 - RNA, 17 nt, Salmonella typhimurium LT2
uggcgaauaaaauucag

SEQ ID NO: 1824337 - RNA, 14 nt, Salmonella typhimurium LT2
uggccucugccagu

SEQ ID NO: 1824338 - RNA, 20 nt, Salmonella typhimurium LT2
uggccgucucuuucauggaa

SEQ ID NO: 1824339 - RNA, 14 nt, Salmonella typhimurium LT2
uggaaaaucagcga

SEQ ID NO: 1824340 - RNA, 17 nt, Salmonella typhimurium LT2
uggaaagcgccucgcaa

SEQ ID NO: 1824341 - RNA, 18 nt, Salmonella typhimurium LT2
uggaaaggaugcagcauc

SEQ ID NO: 1824342 - RNA, 18 nt, Salmonella typhimurium LT2
uggaaaagagcgucguua

SEQ ID NO: 1824343 - RNA, 21 nt, Salmonella typhimurium LT2
uggcgcuacgcuuaucaggcc

SEQ ID NO: 1824344 - RNA, 18 nt, Salmonella typhimurium LT2
uggcgcuacgcuuaucgg

SEQ ID NO: 1824345 - RNA, 19 nt, Salmonella typhimurium LT2
uggcgccuuucgcgcugca

SEQ ID NO: 1824346 - RNA, 17 nt, Salmonella typhimurium LT2
uggcggcgugaacgccu

SEQ ID NO: 1824347 - RNA, 23 nt, Salmonella typhimurium LT2
uggcggcgugaccgccuuauccg

SEQ ID NO: 1824348 - RNA, 23 nt, Salmonella typhimurium LT2
uggcggcguaaacaccuuauccg

SEQ ID NO: 1824349 - RNA, 22 nt, Salmonella typhimurium LT2
uggcggcgaaacgccuuauccg

SEQ ID NO: 1824350 - RNA, 19 nt, Salmonella typhimurium LT2
uggcgauaaagucaugacg

SEQ ID NO: 1824351 - RNA, 20 nt, Salmonella typhimurium LT2
uggcgauaggggauaucgcu

SEQ ID NO: 1824352 - RNA, 18 nt, Salmonella typhimurium LT2
uggcgaugauaaucgucc

SEQ ID NO: 1824353 - RNA, 20 nt, Salmonella typhimurium LT2
uggcgauuuccagcgaauaa

SEQ ID NO: 1824354 - RNA, 16 nt, Salmonella typhimurium LT2
uggcgauuuccagcga

SEQ ID NO: 1824355 - RNA, 14 nt, Salmonella typhimurium LT2
uggcgauuuccagc

SEQ ID NO: 1824356 - RNA, 19 nt, Salmonella typhimurium LT2
uggcgcaaaugggccuacg

SEQ ID NO: 1824357 - RNA, 15 nt, Salmonella typhimurium LT2
ugguuccgccguuaa

SEQ ID NO: 1824358 - RNA, 19 nt, Salmonella typhimurium LT2
ugguucaacaucagcgcua

SEQ ID NO: 1824359 - RNA, 16 nt, Salmonella typhimurium LT2
ugguuaacucaagcga

SEQ ID NO: 1824360 - RNA, 15 nt, Salmonella typhimurium LT2
ugguuaauuccgcau

SEQ ID NO: 1824361 - RNA, 16 nt, Salmonella typhimurium LT2
ugguuaauacaucaac

SEQ ID NO: 1824362 - RNA, 16 nt, Salmonella typhimurium LT2
uggucugacccgcgaa

SEQ ID NO: 1824363 - RNA, 20 nt, Salmonella typhimurium LT2
uggugauagcgcgccagcac

SEQ ID NO: 1824364 - RNA, 16 nt, Salmonella typhimurium LT2
uggugauauaaacggg

SEQ ID NO: 1824365 - RNA, 17 nt, Salmonella typhimurium LT2
uggugauccagcguagc

SEQ ID NO: 1824366 - RNA, 19 nt, Salmonella typhimurium LT2
uggugauuaacagcgccau

SEQ ID NO: 1824367 - RNA, 13 nt, Salmonella typhimurium LT2
uggucgcgauagc

SEQ ID NO: 1824368 - RNA, 20 nt, Salmonella typhimurium LT2
uggucaucgcggccagcaug

SEQ ID NO: 1824369 - RNA, 21 nt, Salmonella typhimurium LT2
ugguagucaaauuccagcaac

SEQ ID NO: 1824370 - RNA, 16 nt, Salmonella typhimurium LT2
uguauucgcagggcug

SEQ ID NO: 1824371 - RNA, 22 nt, Salmonella typhimurium LT2
uguaugcucauaagacgcauua

SEQ ID NO: 1824372 - RNA, 20 nt, Salmonella typhimurium LT2
uguaggccugauaagcguag

SEQ ID NO: 1824373 - RNA, 20 nt, Salmonella typhimurium LT2
uguaggccugguaagcgcag

SEQ ID NO: 1824374 - RNA, 13 nt, Salmonella typhimurium LT2
uguaguuaucgcc

SEQ ID NO: 1824375 - RNA, 21 nt, Salmonella typhimurium LT2
uguaggccugauaagcgcagc

SEQ ID NO: 1824376 - RNA, 20 nt, Salmonella typhimurium LT2
uguaggccgggcaagcgaag

SEQ ID NO: 1824377 - RNA, 22 nt, Salmonella typhimurium LT2
uguaagggaggugcucucccag

SEQ ID NO: 1824378 - RNA, 18 nt, Salmonella typhimurium LT2
uguaaccuuaaaaggcgc

SEQ ID NO: 1824379 - RNA, 19 nt, Salmonella typhimurium LT2
uguaacuucggccagcgag

SEQ ID NO: 1824380 - RNA, 12 nt, Salmonella typhimurium LT2
uguaaaccggcc

SEQ ID NO: 1824381 - RNA, 21 nt, Salmonella typhimurium LT2
uguccaugcaugacgcaggcg

SEQ ID NO: 1824382 - RNA, 21 nt, Salmonella typhimurium LT2
uguccucggcaacauaccggg

SEQ ID NO: 1824383 - RNA, 20 nt, Salmonella typhimurium LT2
uguccugacggcgacgcgcc

SEQ ID NO: 1824384 - RNA, 22 nt, Salmonella typhimurium LT2
ugucgauuuccgguuccagcgg

SEQ ID NO: 1824385 - RNA, 21 nt, Salmonella typhimurium LT2
ugucgggcaaaaugcgucggc

SEQ ID NO: 1824386 - RNA, 12 nt, Salmonella typhimurium LT2
ugucgguaaugu

SEQ ID NO: 1824387 - RNA, 11 nt, Salmonella typhimurium LT2
ugucguaccgg

SEQ ID NO: 1824388 - RNA, 22 nt, Salmonella typhimurium LT2
ugucgccugcugcuggacagga

SEQ ID NO: 1824389 - RNA, 17 nt, Salmonella typhimurium LT2
ugucgccggggcgcugg

SEQ ID NO: 1824390 - RNA, 13 nt, Salmonella typhimurium LT2
ugucguuaucgcc

SEQ ID NO: 1824391 - RNA, 22 nt, Salmonella typhimurium LT2
ugucguuccacacguccauccg

SEQ ID NO: 1824392 - RNA, 17 nt, Salmonella typhimurium LT2
ugugaacagcguuuguu

SEQ ID NO: 1824393 - RNA, 14 nt, Salmonella typhimurium LT2
ugucuugucugggc

SEQ ID NO: 1824394 - RNA, 13 nt, Salmonella typhimurium LT2
ugugccgcgcugg

SEQ ID NO: 1824395 - RNA, 22 nt, Salmonella typhimurium LT2
ugugcggcgugcagaucaagcg

SEQ ID NO: 1824396 - RNA, 16 nt, Salmonella typhimurium LT2
uucaggccagccugau

SEQ ID NO: 1824397 - RNA, 19 nt, Salmonella typhimurium LT2
uucagcguuucaccuucac

SEQ ID NO: 1824398 - RNA, 19 nt, Salmonella typhimurium LT2
uucauggcguucgccgcau

SEQ ID NO: 1824399 - RNA, 21 nt, Salmonella typhimurium LT2
uucaugaaacucgcguagcgu

SEQ ID NO: 1824400 - RNA, 16 nt, Salmonella typhimurium LT2
uucaugauauucuguc

SEQ ID NO: 1824401 - RNA, 13 nt, Salmonella typhimurium LT2
uucauccggauaa

SEQ ID NO: 1824402 - RNA, 17 nt, Salmonella typhimurium LT2
uuccagugccgccagaa

SEQ ID NO: 1824403 - RNA, 12 nt, Salmonella typhimurium LT2
uuccaucggcau

SEQ ID NO: 1824404 - RNA, 18 nt, Salmonella typhimurium LT2
uucccaguauugcaccug

SEQ ID NO: 1824405 - RNA, 13 nt, Salmonella typhimurium LT2
uucccacaucgcg

SEQ ID NO: 1824406 - RNA, 21 nt, Salmonella typhimurium LT2
uuaucgguaaugauaucgccc

SEQ ID NO: 1824407 - RNA, 17 nt, Salmonella typhimurium LT2
uuaucgccguaaccgcc

SEQ ID NO: 1824408 - RNA, 20 nt, Salmonella typhimurium LT2
uuaucggauuucguaccgaa

SEQ ID NO: 1824409 - RNA, 20 nt, Salmonella typhimurium LT2
uuaucgcccggauaacggcg

SEQ ID NO: 1824410 - RNA, 17 nt, Salmonella typhimurium LT2
uuaucgcccguaccgcg

SEQ ID NO: 1824411 - RNA, 17 nt, Salmonella typhimurium LT2
uuauucggcuuacccaa

SEQ ID NO: 1824412 - RNA, 18 nt, Salmonella typhimurium LT2
uuauugaccaucgccagc

SEQ ID NO: 1824413 - RNA, 12 nt, Salmonella typhimurium LT2
uuauuucacuuc

SEQ ID NO: 1824414 - RNA, 15 nt, Salmonella typhimurium LT2
uucaaugauccacgg

SEQ ID NO: 1824415 - RNA, 14 nt, Salmonella typhimurium LT2
uucaaauccagcug

SEQ ID NO: 1824416 - RNA, 14 nt, Salmonella typhimurium LT2
uucacgcacgcgua

SEQ ID NO: 1824417 - RNA, 19 nt, Salmonella typhimurium LT2
uucagauggugauagcgcg

SEQ ID NO: 1824418 - RNA, 15 nt, Salmonella typhimurium LT2
uucacgaaaccggcg

SEQ ID NO: 1824419 - RNA, 15 nt, Salmonella typhimurium LT2
uucagccagcugcug

SEQ ID NO: 1824420 - RNA, 21 nt, Salmonella typhimurium LT2
ugugcuccaccagcccgcgaa

SEQ ID NO: 1824421 - RNA, 22 nt, Salmonella typhimurium LT2
ugugcuccuggcgcagccgcuc

SEQ ID NO: 1824422 - RNA, 15 nt, Salmonella typhimurium LT2
ugugcucaccgguaa

SEQ ID NO: 1824423 - RNA, 15 nt, Salmonella typhimurium LT2
ugugcguaucgccca

SEQ ID NO: 1824424 - RNA, 14 nt, Salmonella typhimurium LT2
uguugucaauaucg

SEQ ID NO: 1824425 - RNA, 23 nt, Salmonella typhimurium LT2
uuaaaaaaggcagaagaaucugc

SEQ ID NO: 1824426 - RNA, 20 nt, Salmonella typhimurium LT2
uuagcgacauacauaacgcg

SEQ ID NO: 1824427 - RNA, 19 nt, Salmonella typhimurium LT2
uuagcgccuguagcguaau

SEQ ID NO: 1824428 - RNA, 16 nt, Salmonella typhimurium LT2
uuagcguuucaaccgc

SEQ ID NO: 1824429 - RNA, 18 nt, Salmonella typhimurium LT2
uuagcguuucaaccgcgc

SEQ ID NO: 1824430 - RNA, 12 nt, Salmonella typhimurium LT2
uuagugccgcca

SEQ ID NO: 1824431 - RNA, 22 nt, Salmonella typhimurium LT2
uuagccacuuaccaaucgcggc

SEQ ID NO: 1824432 - RNA, 14 nt, Salmonella typhimurium LT2
uuagccaucccggc

SEQ ID NO: 1824433 - RNA, 15 nt, Salmonella typhimurium LT2
uuagcgcaaaagcgc

SEQ ID NO: 1824434 - RNA, 21 nt, Salmonella typhimurium LT2
uuacucccuggugacgcgcau

SEQ ID NO: 1824435 - RNA, 22 nt, Salmonella typhimurium LT2
uuagcagaauggcgaucaccgc

SEQ ID NO: 1824436 - RNA, 21 nt, Salmonella typhimurium LT2
uuagauguaauucaugcugua

SEQ ID NO: 1824437 - RNA, 14 nt, Salmonella typhimurium LT2
uuauaaauccccgc

SEQ ID NO: 1824438 - RNA, 13 nt, Salmonella typhimurium LT2
uuauccacgccgc

SEQ ID NO: 1824439 - RNA, 20 nt, Salmonella typhimurium LT2
uuauacggcggcaaugccgc

SEQ ID NO: 1824440 - RNA, 11 nt, Salmonella typhimurium LT2
uuacgcgcugc

SEQ ID NO: 1824441 - RNA, 21 nt, Salmonella typhimurium LT2
uuacgccaggaucgucgguca

SEQ ID NO: 1824442 - RNA, 23 nt, Salmonella typhimurium LT2
uuacgcccuucgcccaucgccgc

SEQ ID NO: 1824443 - RNA, 19 nt, Salmonella typhimurium LT2
uuacggugcguggcgcugg

SEQ ID NO: 1824444 - RNA, 16 nt, Salmonella typhimurium LT2
uuacguucaacgggaa

SEQ ID NO: 1824445 - RNA, 23 nt, Salmonella typhimurium LT2
uuacggcgcgccaccaucgucgc

SEQ ID NO: 1824446 - RNA, 23 nt, Salmonella typhimurium LT2
uuaccuucauuguccucggcaac

SEQ ID NO: 1824447 - RNA, 18 nt, Salmonella typhimurium LT2
uuaauuucccgcugguug

SEQ ID NO: 1824448 - RNA, 20 nt, Salmonella typhimurium LT2
uuaaugucaccaucaucgau

SEQ ID NO: 1824449 - RNA, 16 nt, Salmonella typhimurium LT2
uucucguucaacggca

SEQ ID NO: 1824450 - RNA, 19 nt, Salmonella typhimurium LT2
uucuccugauuaauccgcg

SEQ ID NO: 1824451 - RNA, 21 nt, Salmonella typhimurium LT2
uucucaggcaucgcugauaaa

SEQ ID NO: 1824452 - RNA, 13 nt, Salmonella typhimurium LT2
uucuucaacggcg

SEQ ID NO: 1824453 - RNA, 13 nt, Salmonella typhimurium LT2
uucugcugauaau

SEQ ID NO: 1824454 - RNA, 23 nt, Salmonella typhimurium LT2
uucugcgcuaagcguuacggaaa

SEQ ID NO: 1824455 - RNA, 22 nt, Salmonella typhimurium LT2
uucugcgcuaagcguuacggaa

SEQ ID NO: 1824456 - RNA, 13 nt, Salmonella typhimurium LT2
uucuuaauggcca

SEQ ID NO: 1824457 - RNA, 12 nt, Salmonella typhimurium LT2
uucgucggcaaa

SEQ ID NO: 1824458 - RNA, 16 nt, Salmonella typhimurium LT2
uucgucgguaccgcuu

SEQ ID NO: 1824459 - RNA, 12 nt, Salmonella typhimurium LT2
uucuacaaaugg

SEQ ID NO: 1824460 - RNA, 15 nt, Salmonella typhimurium LT2
uucguuaacccggca

SEQ ID NO: 1824461 - RNA, 18 nt, Salmonella typhimurium LT2
uucggguaauucaaucuc

SEQ ID NO: 1824462 - RNA, 23 nt, Salmonella typhimurium LT2
uucgcagagucgcagcggcgguc

SEQ ID NO: 1824463 - RNA, 15 nt, Salmonella typhimurium LT2
uucgccacgcucacu

SEQ ID NO: 1824464 - RNA, 13 nt, Salmonella typhimurium LT2
uucgcccauaucc

SEQ ID NO: 1824465 - RNA, 20 nt, Salmonella typhimurium LT2
uucgcgcaguucauccacgc

SEQ ID NO: 1824466 - RNA, 23 nt, Salmonella typhimurium LT2
uucgcgcauugcgauaugcuguu

SEQ ID NO: 1824467 - RNA, 13 nt, Salmonella typhimurium LT2
uucgcguucagaa

SEQ ID NO: 1824468 - RNA, 14 nt, Salmonella typhimurium LT2
uucggcaaucugcu

SEQ ID NO: 1824469 - RNA, 19 nt, Salmonella typhimurium LT2
uuccccacgccaucgcggc

SEQ ID NO: 1824470 - RNA, 13 nt, Salmonella typhimurium LT2
uuccccacgccau

SEQ ID NO: 1824471 - RNA, 22 nt, Salmonella typhimurium LT2
uucccugcaauauuuaagccca

SEQ ID NO: 1824472 - RNA, 18 nt, Salmonella typhimurium LT2
uuccgcacgcgcgcccau

SEQ ID NO: 1824473 - RNA, 12 nt, Salmonella typhimurium LT2
uuccgcacgcgc

SEQ ID NO: 1824474 - RNA, 15 nt, Salmonella typhimurium LT2
uuccucgucggcaag

SEQ ID NO: 1824475 - RNA, 22 nt, Salmonella typhimurium LT2
uuccugaaagaguacgccgaua

SEQ ID NO: 1824476 - RNA, 23 nt, Salmonella typhimurium LT2
uuccugaaagaguacgccgauag

SEQ ID NO: 1824477 - RNA, 21 nt, Salmonella typhimurium LT2
uuccugcggugguaacgccuu

SEQ ID NO: 1824478 - RNA, 18 nt, Salmonella typhimurium LT2
uuccuguucgcuuauucc

SEQ ID NO: 1824479 - RNA, 17 nt, Salmonella typhimurium LT2
uucgauggccucaucau

SEQ ID NO: 1824480 - RNA, 23 nt, Salmonella typhimurium LT2
uucgauaacggucauaucgucau

SEQ ID NO: 1824481 - RNA, 12 nt, Salmonella typhimurium LT2
uucgaaccugcg

SEQ ID NO: 1824482 - RNA, 11 nt, Salmonella typhimurium LT2
uucgaauccuc

SEQ ID NO: 1824483 - RNA, 19 nt, Salmonella typhimurium LT2
ucgccguaacgaacgcgga

SEQ ID NO: 1824484 - RNA, 13 nt, Salmonella typhimurium LT2
ucgcgauaacguu

SEQ ID NO: 1824485 - RNA, 15 nt, Salmonella typhimurium LT2
ucgcgauaggccucg

SEQ ID NO: 1824486 - RNA, 19 nt, Salmonella typhimurium LT2
ucgcgauacugccgcccau

SEQ ID NO: 1824487 - RNA, 22 nt, Salmonella typhimurium LT2
ucgcgcgccgcuuccggcaggu

SEQ ID NO: 1824488 - RNA, 15 nt, Salmonella typhimurium LT2
ucgcgccacgcagau

SEQ ID NO: 1824489 - RNA, 12 nt, Salmonella typhimurium LT2
ucgcgcagcagg

SEQ ID NO: 1824490 - RNA, 18 nt, Salmonella typhimurium LT2
ucgcgcagccagcgcccc

SEQ ID NO: 1824491 - RNA, 13 nt, Salmonella typhimurium LT2
ucgcggcagcgcu

SEQ ID NO: 1824492 - RNA, 17 nt, Salmonella typhimurium LT2
ucgcggccgcuuuucgg

SEQ ID NO: 1824493 - RNA, 17 nt, Salmonella typhimurium LT2
ucgcggggguuguucag

SEQ ID NO: 1824494 - RNA, 14 nt, Salmonella typhimurium LT2
ucgcgggcauacuc

SEQ ID NO: 1824495 - RNA, 19 nt, Salmonella typhimurium LT2
ucgcccuguauacaggccu

SEQ ID NO: 1824496 - RNA, 14 nt, Salmonella typhimurium LT2
ucgcccugccagcu

SEQ ID NO: 1824497 - RNA, 13 nt, Salmonella typhimurium LT2
ucgcccugccagu

SEQ ID NO: 1824498 - RNA, 14 nt, Salmonella typhimurium LT2
ucgcccugcgccag

SEQ ID NO: 1824499 - RNA, 16 nt, Salmonella typhimurium LT2
ucgcccggaucgcggc

SEQ ID NO: 1824500 - RNA, 21 nt, Salmonella typhimurium LT2
ucgcccggaucgcggccuucg

SEQ ID NO: 1824501 - RNA, 13 nt, Salmonella typhimurium LT2
ucgcccaggcgau

SEQ ID NO: 1824502 - RNA, 13 nt, Salmonella typhimurium LT2
ucgccauccagau

SEQ ID NO: 1824503 - RNA, 17 nt, Salmonella typhimurium LT2
ucgccauccaccaggac

SEQ ID NO: 1824504 - RNA, 20 nt, Salmonella typhimurium LT2
ucgccaugccgcgccuuacg

SEQ ID NO: 1824505 - RNA, 22 nt, Salmonella typhimurium LT2
ucgccaugaguucaauaugugc

SEQ ID NO: 1824506 - RNA, 15 nt, Salmonella typhimurium LT2
ucgccauucccgcga

SEQ ID NO: 1824507 - RNA, 16 nt, Salmonella typhimurium LT2
ucgccauucccgcgac

SEQ ID NO: 1824508 - RNA, 12 nt, Salmonella typhimurium LT2
ucgccgcgacag

SEQ ID NO: 1824509 - RNA, 22 nt, Salmonella typhimurium LT2
ucggcaggccggagcugauacg

SEQ ID NO: 1824510 - RNA, 15 nt, Salmonella typhimurium LT2
ucggcaaacaucugc

SEQ ID NO: 1824511 - RNA, 22 nt, Salmonella typhimurium LT2
ucggcaaacaucugcuccagcg

SEQ ID NO: 1824512 - RNA, 22 nt, Salmonella typhimurium LT2
ucggauuauuggucagcaggcg

SEQ ID NO: 1824513 - RNA, 16 nt, Salmonella typhimurium LT2
ucggauaauccagacg

SEQ ID NO: 1824514 - RNA, 13 nt, Salmonella typhimurium LT2
ucgcuuccagcgc

SEQ ID NO: 1824515 - RNA, 19 nt, Salmonella typhimurium LT2
ucgcuuauucggccuacag

SEQ ID NO: 1824516 - RNA, 15 nt, Salmonella typhimurium LT2
ucgcuguaggccgga

SEQ ID NO: 1824517 - RNA, 16 nt, Salmonella typhimurium LT2
ucgcuuuucauacugg

SEQ ID NO: 1824518 - RNA, 23 nt, Salmonella typhimurium LT2
ucgcuugcccggccuacguucgc

SEQ ID NO: 1824519 - RNA, 13 nt, Salmonella typhimurium LT2
ucgcuaaccggcg

SEQ ID NO: 1824520 - RNA, 13 nt, Salmonella typhimurium LT2
ucgcuaaugcccg

SEQ ID NO: 1824521 - RNA, 13 nt, Salmonella typhimurium LT2
ucgcuaauaucca

SEQ ID NO: 1824522 - RNA, 12 nt, Salmonella typhimurium LT2
ucgcguuacggc

SEQ ID NO: 1824523 - RNA, 15 nt, Salmonella typhimurium LT2
ucgcguugcaaucgc

SEQ ID NO: 1824524 - RNA, 14 nt, Salmonella typhimurium LT2
ucgcuggucagcgc

SEQ ID NO: 1824525 - RNA, 20 nt, Salmonella typhimurium LT2
ucgcuccucagcgcuuacca

SEQ ID NO: 1824526 - RNA, 19 nt, Salmonella typhimurium LT2
ucgcgguuuuucgggucca

SEQ ID NO: 1824527 - RNA, 13 nt, Salmonella typhimurium LT2
ucgcgugcaacag

SEQ ID NO: 1824528 - RNA, 23 nt, Salmonella typhimurium LT2
ucggcggcaggugagggcgucgc

SEQ ID NO: 1824529 - RNA, 23 nt, Salmonella typhimurium LT2
ucggcgcccggacgaaccuggcg

SEQ ID NO: 1824530 - RNA, 17 nt, Salmonella typhimurium LT2
ucggcgagguacugcau

SEQ ID NO: 1824531 - RNA, 14 nt, Salmonella typhimurium LT2
ucggcgaggacccg

SEQ ID NO: 1824532 - RNA, 23 nt, Salmonella typhimurium LT2
ucggccgcuaucugcuccgccag

SEQ ID NO: 1824533 - RNA, 16 nt, Salmonella typhimurium LT2
ucguaauuuaaaccgc

SEQ ID NO: 1824534 - RNA, 21 nt, Salmonella typhimurium LT2
ucguccaguaaaaucgggccu

SEQ ID NO: 1824535 - RNA, 15 nt, Salmonella typhimurium LT2
ucgucgccgaucggc

SEQ ID NO: 1824536 - RNA, 21 nt, Salmonella typhimurium LT2
ucgucgccgccaaagcgcccg

SEQ ID NO: 1824537 - RNA, 19 nt, Salmonella typhimurium LT2
ucgucgcuucgucagcucc

SEQ ID NO: 1824538 - RNA, 18 nt, Salmonella typhimurium LT2
ucgucggcauggucagca

SEQ ID NO: 1824539 - RNA, 19 nt, Salmonella typhimurium LT2
ucgucgcccgucaggcgcc

SEQ ID NO: 1824540 - RNA, 17 nt, Salmonella typhimurium LT2
ucgguggcgguaucaau

SEQ ID NO: 1824541 - RNA, 16 nt, Salmonella typhimurium LT2
ucggcgucgcggcaau

SEQ ID NO: 1824542 - RNA, 18 nt, Salmonella typhimurium LT2
ucgggucauuuugccgau

SEQ ID NO: 1824543 - RNA, 13 nt, Salmonella typhimurium LT2
ucggucaccugac

SEQ ID NO: 1824544 - RNA, 20 nt, Salmonella typhimurium LT2
ucggucagauuaaucaggcg

SEQ ID NO: 1824545 - RNA, 15 nt, Salmonella typhimurium LT2
ucguucaggcguagc

SEQ ID NO: 1824546 - RNA, 16 nt, Salmonella typhimurium LT2
ucguucaggcguagcg

SEQ ID NO: 1824547 - RNA, 23 nt, Salmonella typhimurium LT2
ucguuaaaaucggggucuuccag

SEQ ID NO: 1824548 - RNA, 12 nt, Salmonella typhimurium LT2
ucguuaaagcgg

SEQ ID NO: 1824549 - RNA, 14 nt, Salmonella typhimurium LT2
ucguuaccagcauc

SEQ ID NO: 1824550 - RNA, 14 nt, Salmonella typhimurium LT2
ucguuaaucagcgc

SEQ ID NO: 1824551 - RNA, 20 nt, Salmonella typhimurium LT2
ucguguaaaugacgccagac

SEQ ID NO: 1824552 - RNA, 14 nt, Salmonella typhimurium LT2
ucguugccagcggc

SEQ ID NO: 1824553 - RNA, 14 nt, Salmonella typhimurium LT2
ucuaucgccagcgc

SEQ ID NO: 1824554 - RNA, 16 nt, Salmonella typhimurium LT2
ucuacucugcucgcca

SEQ ID NO: 1824555 - RNA, 22 nt, Salmonella typhimurium LT2
ucuaccagccuggcugaaccag

SEQ ID NO: 1824556 - RNA, 12 nt, Salmonella typhimurium LT2
ucucaccacugu

SEQ ID NO: 1824557 - RNA, 24 nt, Salmonella typhimurium LT2
ucuauuuuucccggaucgcuaauu

SEQ ID NO: 1824558 - RNA, 23 nt, Salmonella typhimurium LT2
ucucaaugaacaguuucgccagc

SEQ ID NO: 1824559 - RNA, 17 nt, Salmonella typhimurium LT2
ucucacaaauaucacaa

SEQ ID NO: 1824560 - RNA, 13 nt, Salmonella typhimurium LT2
ucuccugcgauag

SEQ ID NO: 1824561 - RNA, 23 nt, Salmonella typhimurium LT2
ucuccugauuaauccgcggauag

SEQ ID NO: 1824562 - RNA, 16 nt, Salmonella typhimurium LT2
ucucgcuaaucaucag

SEQ ID NO: 1824563 - RNA, 13 nt, Salmonella typhimurium LT2
ucucugucacugg

SEQ ID NO: 1824564 - RNA, 12 nt, Salmonella typhimurium LT2
ucugauccagcg

SEQ ID NO: 1824565 - RNA, 14 nt, Salmonella typhimurium LT2
ucugagucgccaga

SEQ ID NO: 1824566 - RNA, 20 nt, Salmonella typhimurium LT2
ucugauagcuaaccagcgag

SEQ ID NO: 1824567 - RNA, 20 nt, Salmonella typhimurium LT2
ucugaauucgccaccagcaa

SEQ ID NO: 1824568 - RNA, 10 nt, Salmonella typhimurium LT2
ucugaccagu

SEQ ID NO: 1824569 - RNA, 23 nt, Salmonella typhimurium LT2
ucugacgaggcuacucuucgcug

SEQ ID NO: 1824570 - RNA, 15 nt, Salmonella typhimurium LT2
ucugaaaggcgucag

SEQ ID NO: 1824571 - RNA, 21 nt, Salmonella typhimurium LT2
ucucuuucaccagcgccagaa

SEQ ID NO: 1824572 - RNA, 15 nt, Salmonella typhimurium LT2
ucucuuuccagcgac

SEQ ID NO: 1824573 - RNA, 20 nt, Salmonella typhimurium LT2
ucucuucugcugacauuccu

SEQ ID NO: 1824574 - RNA, 13 nt, Salmonella typhimurium LT2
ucucuuccgccag

SEQ ID NO: 1824575 - RNA, 16 nt, Salmonella typhimurium LT2
ucucuuccgccagcgc

SEQ ID NO: 1824576 - RNA, 20 nt, Salmonella typhimurium LT2
ucugcauggcgcuaaacauc

SEQ ID NO: 1824577 - RNA, 16 nt, Salmonella typhimurium LT2
ucugcauaagcguuaa

SEQ ID NO: 1824578 - RNA, 17 nt, Salmonella typhimurium LT2
ucugccgguucggcauc

SEQ ID NO: 1824579 - RNA, 14 nt, Salmonella typhimurium LT2
ucugccgacgcgau

SEQ ID NO: 1824580 - RNA, 19 nt, Salmonella typhimurium LT2
ucugcgcuguugauagcgg

SEQ ID NO: 1824581 - RNA, 19 nt, Salmonella typhimurium LT2
ucugcgccaccagcgcagu

SEQ ID NO: 1824582 - RNA, 14 nt, Salmonella typhimurium LT2
ucugcgcauuaacg

SEQ ID NO: 1824583 - RNA, 17 nt, Salmonella typhimurium LT2
ucuguuuuagcaugaca

SEQ ID NO: 1824584 - RNA, 14 nt, Salmonella typhimurium LT2
ucuuaauggccagu

SEQ ID NO: 1824585 - RNA, 22 nt, Salmonella typhimurium LT2
ucuuaucaaauuugcccagcac

SEQ ID NO: 1824586 - RNA, 21 nt, Salmonella typhimurium LT2
ucuguauaucuuucuuauccc

SEQ ID NO: 1824587 - RNA, 12 nt, Salmonella typhimurium LT2
ucugggucagga

SEQ ID NO: 1824588 - RNA, 20 nt, Salmonella typhimurium LT2
ucugcugcucccucacgcgu

SEQ ID NO: 1824589 - RNA, 23 nt, Salmonella typhimurium LT2
ucuggcgcagauacgcgucaaag

SEQ ID NO: 1824590 - RNA, 13 nt, Salmonella typhimurium LT2
ucuggcgccgcaa

SEQ ID NO: 1824591 - RNA, 17 nt, Salmonella typhimurium LT2
ucuggcgaaaguaacca

SEQ ID NO: 1824592 - RNA, 16 nt, Salmonella typhimurium LT2
ucuggccguuugcugc

SEQ ID NO: 1824593 - RNA, 19 nt, Salmonella typhimurium LT2
ucuggccaaagcggguuaa

SEQ ID NO: 1824594 - RNA, 17 nt, Salmonella typhimurium LT2
ucuucgaccgucgcgcc

SEQ ID NO: 1824595 - RNA, 21 nt, Salmonella typhimurium LT2
ucuucgauaaacucaaucagg

SEQ ID NO: 1824596 - RNA, 18 nt, Salmonella typhimurium LT2
ucuuccacuucaucagcg

SEQ ID NO: 1824597 - RNA, 18 nt, Salmonella typhimurium LT2
ucuuccaucagccaggcg

SEQ ID NO: 1824598 - RNA, 13 nt, Salmonella typhimurium LT2
ucuucaaacggca

SEQ ID NO: 1824599 - RNA, 22 nt, Salmonella typhimurium LT2
ucuucaacaccgacauccgcca

SEQ ID NO: 1824600 - RNA, 17 nt, Salmonella typhimurium LT2
ucuucaacggcgccgug

SEQ ID NO: 1824601 - RNA, 16 nt, Salmonella typhimurium LT2
ucuucacuaaacuaau

SEQ ID NO: 1824602 - RNA, 22 nt, Salmonella typhimurium LT2
ucuucagcccguucucgccgcg

SEQ ID NO: 1824603 - RNA, 23 nt, Salmonella typhimurium LT2
ucuucggcaaaauacucagcgaa

SEQ ID NO: 1824604 - RNA, 12 nt, Salmonella typhimurium LT2
ucuugaguuggc

SEQ ID NO: 1824605 - RNA, 15 nt, Salmonella typhimurium LT2
ucuucuuucagguuc

SEQ ID NO: 1824606 - RNA, 14 nt, Salmonella typhimurium LT2
ucuuuacacucgcg

SEQ ID NO: 1824607 - RNA, 22 nt, Salmonella typhimurium LT2
ucuuuaauuuacguccaccguu

SEQ ID NO: 1824608 - RNA, 21 nt, Salmonella typhimurium LT2
ugaaacaagcggcggccaacc

SEQ ID NO: 1824609 - RNA, 16 nt, Salmonella typhimurium LT2
ugaacacgccgacuca

SEQ ID NO: 1824610 - RNA, 18 nt, Salmonella typhimurium LT2
ugaacauauccgcgcaaa

SEQ ID NO: 1824611 - RNA, 22 nt, Salmonella typhimurium LT2
ugauguuugugaccccggccuc

SEQ ID NO: 1824612 - RNA, 19 nt, Salmonella typhimurium LT2
ugauguccgcagccgcauu

SEQ ID NO: 1824613 - RNA, 14 nt, Salmonella typhimurium LT2
ugaugucaauaacc

SEQ ID NO: 1824614 - RNA, 17 nt, Salmonella typhimurium LT2
ugauggcguaauccgga

SEQ ID NO: 1824615 - RNA, 13 nt, Salmonella typhimurium LT2
ugauggucuccag

SEQ ID NO: 1824616 - RNA, 19 nt, Salmonella typhimurium LT2
ugaucagaccaucggccgc

SEQ ID NO: 1824617 - RNA, 18 nt, Salmonella typhimurium LT2
ugaucaacgccgcgccau

SEQ ID NO: 1824618 - RNA, 22 nt, Salmonella typhimurium LT2
ugaucacuuuugggccgcgcag

SEQ ID NO: 1824619 - RNA, 19 nt, Salmonella typhimurium LT2
ugaucaggaaaucuuccag

SEQ ID NO: 1824620 - RNA, 21 nt, Salmonella typhimurium LT2
ugaugacgggaucgaaccgcc

SEQ ID NO: 1824621 - RNA, 17 nt, Salmonella typhimurium LT2
ugaugaucaauaacgcc

SEQ ID NO: 1824622 - RNA, 13 nt, Salmonella typhimurium LT2
ugaugaucuucag

SEQ ID NO: 1824623 - RNA, 14 nt, Salmonella typhimurium LT2
ugaugauaaccgcc

SEQ ID NO: 1824624 - RNA, 14 nt, Salmonella typhimurium LT2
ugaugagcaauacc

SEQ ID NO: 1824625 - RNA, 23 nt, Salmonella typhimurium LT2
ugaugcaacaggccgcgaaagcg

SEQ ID NO: 1824626 - RNA, 22 nt, Salmonella typhimurium LT2
ugcaccacccgguuauaacgcg

SEQ ID NO: 1824627 - RNA, 18 nt, Salmonella typhimurium LT2
ugcaccaaucaucacgua

SEQ ID NO: 1824628 - RNA, 12 nt, Salmonella typhimurium LT2
ugauuugccaga

SEQ ID NO: 1824629 - RNA, 11 nt, Salmonella typhimurium LT2
ugauuuccaga

SEQ ID NO: 1824630 - RNA, 16 nt, Salmonella typhimurium LT2
ugcaacaugcccaguu

SEQ ID NO: 1824631 - RNA, 18 nt, Salmonella typhimurium LT2
ugcaacccgccgccauca

SEQ ID NO: 1824632 - RNA, 17 nt, Salmonella typhimurium LT2
ugcagaaaggcgugcag

SEQ ID NO: 1824633 - RNA, 21 nt, Salmonella typhimurium LT2
ugcagaaaauccuucagcguu

SEQ ID NO: 1824634 - RNA, 13 nt, Salmonella typhimurium LT2
ugagcaaaggcag

SEQ ID NO: 1824635 - RNA, 15 nt, Salmonella typhimurium LT2
ugacuuugaccagca

SEQ ID NO: 1824636 - RNA, 23 nt, Salmonella typhimurium LT2
ugagaaaaagcguugacgggcga

SEQ ID NO: 1824637 - RNA, 20 nt, Salmonella typhimurium LT2
ugagauacugcgaucgccgg

SEQ ID NO: 1824638 - RNA, 20 nt, Salmonella typhimurium LT2
ugagagcacguaggccugau

SEQ ID NO: 1824639 - RNA, 18 nt, Salmonella typhimurium LT2
ugacguuugcuucaggcg

SEQ ID NO: 1824640 - RNA, 15 nt, Salmonella typhimurium LT2
ugacuaguccugaua

SEQ ID NO: 1824641 - RNA, 19 nt, Salmonella typhimurium LT2
ugaagauuauucucgcacu

SEQ ID NO: 1824642 - RNA, 19 nt, Salmonella typhimurium LT2
ugaacggcgucauccggcg

SEQ ID NO: 1824643 - RNA, 20 nt, Salmonella typhimurium LT2
ugaguaaauaaaaaccauuu

SEQ ID NO: 1824644 - RNA, 21 nt, Salmonella typhimurium LT2
ugagccuaaaacauuaaucgc

SEQ ID NO: 1824645 - RNA, 21 nt, Salmonella typhimurium LT2
ugagcgaacggcuuuccagca

SEQ ID NO: 1824646 - RNA, 23 nt, Salmonella typhimurium LT2
ugauaauuggcggugaggcugac

SEQ ID NO: 1824647 - RNA, 18 nt, Salmonella typhimurium LT2
ugauacagaaaaccggca

SEQ ID NO: 1824648 - RNA, 15 nt, Salmonella typhimurium LT2
ugauacgccuggaua

SEQ ID NO: 1824649 - RNA, 23 nt, Salmonella typhimurium LT2
ugauacuuauuacgguaucagcg

SEQ ID NO: 1824650 - RNA, 14 nt, Salmonella typhimurium LT2
ugauauagcgccau

SEQ ID NO: 1824651 - RNA, 18 nt, Salmonella typhimurium LT2
ugauauuuucaggcaccg

SEQ ID NO: 1824652 - RNA, 19 nt, Salmonella typhimurium LT2
ugauauucuuugguauuga

SEQ ID NO: 1824653 - RNA, 16 nt, Salmonella typhimurium LT2
ugauaucgcaacagau

SEQ ID NO: 1824654 - RNA, 17 nt, Salmonella typhimurium LT2
ugcauuaaccugaucca

SEQ ID NO: 1824655 - RNA, 16 nt, Salmonella typhimurium LT2
ugcauucugcaacugu

SEQ ID NO: 1824656 - RNA, 23 nt, Salmonella typhimurium LT2
ugccaauauauugcuccaucauc

SEQ ID NO: 1824657 - RNA, 18 nt, Salmonella typhimurium LT2
ugccagcucaaaucgcgg

SEQ ID NO: 1824658 - RNA, 19 nt, Salmonella typhimurium LT2
ugccaggcgcuaucuucaa

SEQ ID NO: 1824659 - RNA, 21 nt, Salmonella typhimurium LT2
ugccagaaacaucgguaauag

SEQ ID NO: 1824660 - RNA, 19 nt, Salmonella typhimurium LT2
ugccagucgguaaugccgu

SEQ ID NO: 1824661 - RNA, 18 nt, Salmonella typhimurium LT2
ugccaguagcugcuccag

SEQ ID NO: 1824662 - RNA, 20 nt, Salmonella typhimurium LT2
ugccagucgagaucgacguu

SEQ ID NO: 1824663 - RNA, 21 nt, Salmonella typhimurium LT2
ugcagggaacacggcaugaag

SEQ ID NO: 1824664 - RNA, 21 nt, Salmonella typhimurium LT2
ugcagcggaauuaacugcacu

SEQ ID NO: 1824665 - RNA, 22 nt, Salmonella typhimurium LT2
ugcagcucuucgccguuaucgg

SEQ ID NO: 1824666 - RNA, 11 nt, Salmonella typhimurium LT2
ugcagcagcgu

SEQ ID NO: 1824667 - RNA, 17 nt, Salmonella typhimurium LT2
ugcagcgccauccacgg

SEQ ID NO: 1824668 - RNA, 18 nt, Salmonella typhimurium LT2
ugcagccuggagagcagc

SEQ ID NO: 1824669 - RNA, 22 nt, Salmonella typhimurium LT2
ugcagccuggagagcagcgcca

SEQ ID NO: 1824670 - RNA, 19 nt, Salmonella typhimurium LT2
ugcagcgcguccaauagcc

SEQ ID NO: 1824671 - RNA, 13 nt, Salmonella typhimurium LT2
ugcagccaggcca

SEQ ID NO: 1824672 - RNA, 22 nt, Salmonella typhimurium LT2
ugcccugcuugucgaucaucag

SEQ ID NO: 1824673 - RNA, 16 nt, Salmonella typhimurium LT2
ugccauucgcccaguc

SEQ ID NO: 1824674 - RNA, 18 nt, Salmonella typhimurium LT2
ugccaugaugagcgccau

SEQ ID NO: 1824675 - RNA, 22 nt, Salmonella typhimurium LT2
ugccauguuaauaccagcgcca

SEQ ID NO: 1824676 - RNA, 19 nt, Salmonella typhimurium LT2
ugccauccagcaccaggcg

SEQ ID NO: 1824677 - RNA, 17 nt, Salmonella typhimurium LT2
ugccgaugacucccagu

SEQ ID NO: 1824678 - RNA, 12 nt, Salmonella typhimurium LT2
ugccgccauccg

SEQ ID NO: 1824679 - RNA, 20 nt, Salmonella typhimurium LT2
ugcgcuuauccggccuacgg

SEQ ID NO: 1824680 - RNA, 20 nt, Salmonella typhimurium LT2
ugcgcuuaucaggccuacgc

SEQ ID NO: 1824681 - RNA, 19 nt, Salmonella typhimurium LT2
ugcgcuuauccggccuaca

SEQ ID NO: 1824682 - RNA, 19 nt, Salmonella typhimurium LT2
ugcgcuuaccaggccuaca

SEQ ID NO: 1824683 - RNA, 20 nt, Salmonella typhimurium LT2
ugcgcuuaccgggccgacag

SEQ ID NO: 1824684 - RNA, 22 nt, Salmonella typhimurium LT2
ugcgcgaccgcaucaaugccca

SEQ ID NO: 1824685 - RNA, 21 nt, Salmonella typhimurium LT2
ugcgcgaucucuuuggccagu

SEQ ID NO: 1824686 - RNA, 22 nt, Salmonella typhimurium LT2
ugcgccccgcaacgccgauaag

SEQ ID NO: 1824687 - RNA, 18 nt, Salmonella typhimurium LT2
ugcgccccugcaggcgau

SEQ ID NO: 1824688 - RNA, 15 nt, Salmonella typhimurium LT2
ugcgcgaccacgcca

SEQ ID NO: 1824689 - RNA, 16 nt, Salmonella typhimurium LT2
ugcgccgacaucgcca

SEQ ID NO: 1824690 - RNA, 17 nt, Salmonella typhimurium LT2
ugcggaagaucuggcga

SEQ ID NO: 1824691 - RNA, 18 nt, Salmonella typhimurium LT2
ugcggaccgucgcggcau

SEQ ID NO: 1824692 - RNA, 17 nt, Salmonella typhimurium LT2
ugcggaaucuccggcga

SEQ ID NO: 1824693 - RNA, 19 nt, Salmonella typhimurium LT2
ugcggccuuuauccagcgg

SEQ ID NO: 1824694 - RNA, 14 nt, Salmonella typhimurium LT2
ugcggguucauccg

SEQ ID NO: 1824695 - RNA, 18 nt, Salmonella typhimurium LT2
ugcgguaauaugccagcu

SEQ ID NO: 1824696 - RNA, 15 nt, Salmonella typhimurium LT2
ugcgguaaucgccgc

SEQ ID NO: 1824697 - RNA, 16 nt, Salmonella typhimurium LT2
ugcggguccugaucgg

SEQ ID NO: 1824698 - RNA, 22 nt, Salmonella typhimurium LT2
ugcggcggacgccgggugaucg

SEQ ID NO: 1824699 - RNA, 17 nt, Salmonella typhimurium LT2
ugcggcuucagcgacau

SEQ ID NO: 1824700 - RNA, 21 nt, Salmonella typhimurium LT2
ugccguuuuaacgucaucacc

SEQ ID NO: 1824701 - RNA, 19 nt, Salmonella typhimurium LT2
ugccguuuuucucaucaag

SEQ ID NO: 1824702 - RNA, 18 nt, Salmonella typhimurium LT2
ugccuguuuacggcaggc

SEQ ID NO: 1824703 - RNA, 16 nt, Salmonella typhimurium LT2
ugccuuauccggccua

SEQ ID NO: 1824704 - RNA, 18 nt, Salmonella typhimurium LT2
ugccguuguuuucgcguu

SEQ ID NO: 1824705 - RNA, 14 nt, Salmonella typhimurium LT2
ugccuuucgccagc

SEQ ID NO: 1824706 - RNA, 21 nt, Salmonella typhimurium LT2
ugcgaaauuuaauauaugaac

SEQ ID NO: 1824707 - RNA, 16 nt, Salmonella typhimurium LT2
ugccuuuggcaaucau

SEQ ID NO: 1824708 - RNA, 15 nt, Salmonella typhimurium LT2
ugccgucauccagca

SEQ ID NO: 1824709 - RNA, 22 nt, Salmonella typhimurium LT2
ugccgucaaaggcuauaaccgu

SEQ ID NO: 1824710 - RNA, 18 nt, Salmonella typhimurium LT2
ugccguguaaggcaaucg

SEQ ID NO: 1824711 - RNA, 12 nt, Salmonella typhimurium LT2
ugcgccagcaug

SEQ ID NO: 1824712 - RNA, 20 nt, Salmonella typhimurium LT2
ugcgccacguucggcgugua

SEQ ID NO: 1824713 - RNA, 17 nt, Salmonella typhimurium LT2
ugcgcccaucaucaucg

SEQ ID NO: 1824714 - RNA, 14 nt, Salmonella typhimurium LT2
ugcgccccagcaug

SEQ ID NO: 1824715 - RNA, 19 nt, Salmonella typhimurium LT2
ugcgcccaugcucaccgau

SEQ ID NO: 1824716 - RNA, 18 nt, Salmonella typhimurium LT2
ugcgccauccaccaggca

SEQ ID NO: 1824717 - RNA, 13 nt, Salmonella typhimurium LT2
ugcgccauuaacg

SEQ ID NO: 1824718 - RNA, 15 nt, Salmonella typhimurium LT2
ugcgcagauaccggc

SEQ ID NO: 1824719 - RNA, 23 nt, Salmonella typhimurium LT2
ugcgcagauaccggcgcagcauc

SEQ ID NO: 1824720 - RNA, 14 nt, Salmonella typhimurium LT2
ugcgcauuaacgcc

SEQ ID NO: 1824721 - RNA, 14 nt, Salmonella typhimurium LT2
ugcgccacaucauu

SEQ ID NO: 1824722 - RNA, 13 nt, Salmonella typhimurium LT2
ugcgccacggaug

SEQ ID NO: 1824723 - RNA, 12 nt, Salmonella typhimurium LT2
ugcgccacggau

SEQ ID NO: 1824724 - RNA, 16 nt, Salmonella typhimurium LT2
ugcgaauaacaucauc

SEQ ID NO: 1824725 - RNA, 12 nt, Salmonella typhimurium LT2
ugcgauaaccgu

SEQ ID NO: 1824726 - RNA, 18 nt, Salmonella typhimurium LT2
ugcgcaagcacugaaugc

SEQ ID NO: 1824727 - RNA, 15 nt, Salmonella typhimurium LT2
ugcgcaauuccagca

SEQ ID NO: 1824728 - RNA, 13 nt, Salmonella typhimurium LT2
ugcuguuaccgga

SEQ ID NO: 1824729 - RNA, 20 nt, Salmonella typhimurium LT2
ugcuuaccuuguucuuccau

SEQ ID NO: 1824730 - RNA, 17 nt, Salmonella typhimurium LT2
ugcuuaucaaguaacgu

SEQ ID NO: 1824731 - RNA, 13 nt, Salmonella typhimurium LT2
ugcuuaucacgua

SEQ ID NO: 1824732 - RNA, 16 nt, Salmonella typhimurium LT2
ugcuuaccuuguucuu

SEQ ID NO: 1824733 - RNA, 16 nt, Salmonella typhimurium LT2
ugcuucauaucgccau

SEQ ID NO: 1824734 - RNA, 17 nt, Salmonella typhimurium LT2
ugcuucauaucgccauu

SEQ ID NO: 1824735 - RNA, 23 nt, Salmonella typhimurium LT2
ugcuugugagggcaaaguuccag

SEQ ID NO: 1824736 - RNA, 16 nt, Salmonella typhimurium LT2
ugcuuccggcagguuc

SEQ ID NO: 1824737 - RNA, 16 nt, Salmonella typhimurium LT2
ugcuguccgccagcaa

SEQ ID NO: 1824738 - RNA, 16 nt, Salmonella typhimurium LT2
ugcuggcgugaaccgg

SEQ ID NO: 1824739 - RNA, 13 nt, Salmonella typhimurium LT2
ugcuggcaggcca

SEQ ID NO: 1824740 - RNA, 14 nt, Salmonella typhimurium LT2
ugcugcguuucauu

SEQ ID NO: 1824741 - RNA, 12 nt, Salmonella typhimurium LT2
ugcucucaggca

SEQ ID NO: 1824742 - RNA, 23 nt, Salmonella typhimurium LT2
ugcucgucggcggaaaagcgccc

SEQ ID NO: 1824743 - RNA, 22 nt, Salmonella typhimurium LT2
ugcucgguaucguagaugucca

SEQ ID NO: 1824744 - RNA, 17 nt, Salmonella typhimurium LT2
ugcucugcugugccagu

SEQ ID NO: 1824745 - RNA, 19 nt, Salmonella typhimurium LT2
ugcucuggacguugagcgu

SEQ ID NO: 1824746 - RNA, 23 nt, Salmonella typhimurium LT2
ugcugauaguccaguacccgcac

SEQ ID NO: 1824747 - RNA, 19 nt, Salmonella typhimurium LT2
ugcguucauggcgcgacau

SEQ ID NO: 1824748 - RNA, 14 nt, Salmonella typhimurium LT2
ugcguggucauccg

SEQ ID NO: 1824749 - RNA, 17 nt, Salmonella typhimurium LT2
ugcguuggaaauacguu

SEQ ID NO: 1824750 - RNA, 13 nt, Salmonella typhimurium LT2
ugcguuugccgcc

SEQ ID NO: 1824751 - RNA, 19 nt, Salmonella typhimurium LT2
ugcguugucuaccgcgccu

SEQ ID NO: 1824752 - RNA, 23 nt, Salmonella typhimurium LT2
ugcguugucuaccgcgccuuccg

SEQ ID NO: 1824753 - RNA, 17 nt, Salmonella typhimurium LT2
ugcgucgccccaaucgc

SEQ ID NO: 1824754 - RNA, 19 nt, Salmonella typhimurium LT2
ugcgucaucauccgguaau

SEQ ID NO: 1824755 - RNA, 20 nt, Salmonella typhimurium LT2
ugcgucgcguaccagcgccc

SEQ ID NO: 1824756 - RNA, 18 nt, Salmonella typhimurium LT2
ugcgugaugcaucagaac

SEQ ID NO: 1824757 - RNA, 13 nt, Salmonella typhimurium LT2
ugcgugcgcgcca

SEQ ID NO: 1824758 - RNA, 23 nt, Salmonella typhimurium LT2
ugcgguuuacgccaugcaucaau

SEQ ID NO: 1824759 - RNA, 17 nt, Salmonella typhimurium LT2
ugcguaaaaucagcauc

SEQ ID NO: 1824760 - RNA, 18 nt, Salmonella typhimurium LT2
ugcguaauguugauauca

SEQ ID NO: 1824761 - RNA, 20 nt, Salmonella typhimurium LT2
ugcggugagaaacgcgccac

SEQ ID NO: 1824762 - RNA, 16 nt, Salmonella typhimurium LT2
ugcuccaucaucgcca

SEQ ID NO: 1824763 - RNA, 13 nt, Salmonella typhimurium LT2
ugcuccggcuuaa

SEQ ID NO: 1824764 - RNA, 13 nt, Salmonella typhimurium LT2
ugcuccagcgccu

SEQ ID NO: 1824765 - RNA, 17 nt, Salmonella typhimurium LT2
ugcuaucgucgcgcaau

SEQ ID NO: 1824766 - RNA, 19 nt, Salmonella typhimurium LT2
ugcuauucagcaguucauu

SEQ ID NO: 1824767 - RNA, 19 nt, Salmonella typhimurium LT2
ugcuauugaaaaaaccgcc

SEQ ID NO: 1824768 - RNA, 21 nt, Salmonella typhimurium LT2
ugcucaaaaagcucaagcgca

SEQ ID NO: 1824769 - RNA, 15 nt, Salmonella typhimurium LT2
ugcuacgcucaccuc

SEQ ID NO: 1824770 - RNA, 16 nt, Salmonella typhimurium LT2
ucaggaucaauucgga

SEQ ID NO: 1824771 - RNA, 19 nt, Salmonella typhimurium LT2
ucaggacaucaaaggcaga

SEQ ID NO: 1824772 - RNA, 20 nt, Salmonella typhimurium LT2
ucaggaagaacacgccgccu

SEQ ID NO: 1824773 - RNA, 21 nt, Salmonella typhimurium LT2
ucaggccgccgcacaggcgac

SEQ ID NO: 1824774 - RNA, 14 nt, Salmonella typhimurium LT2
ucaggcaacccgga

SEQ ID NO: 1824775 - RNA, 20 nt, Salmonella typhimurium LT2
ucaggcacuggcuuacucgc

SEQ ID NO: 1824776 - RNA, 19 nt, Salmonella typhimurium LT2
ucaggcaucagauaaacag

SEQ ID NO: 1824777 - RNA, 18 nt, Salmonella typhimurium LT2
ucaggcaugccaaaccag

SEQ ID NO: 1824778 - RNA, 15 nt, Salmonella typhimurium LT2
ucaggccagccugau

SEQ ID NO: 1824779 - RNA, 19 nt, Salmonella typhimurium LT2
ucagcguaauuaagccggg

SEQ ID NO: 1824780 - RNA, 18 nt, Salmonella typhimurium LT2
ucagcgucaucacagguu

SEQ ID NO: 1824781 - RNA, 17 nt, Salmonella typhimurium LT2
ucagcguggcgacgaua

SEQ ID NO: 1824782 - RNA, 17 nt, Salmonella typhimurium LT2
ucagcguguaaucgccg

SEQ ID NO: 1824783 - RNA, 18 nt, Salmonella typhimurium LT2
ucagcgaucugucgccgc

SEQ ID NO: 1824784 - RNA, 21 nt, Salmonella typhimurium LT2
ucagcgcauggacgucgacgc

SEQ ID NO: 1824785 - RNA, 19 nt, Salmonella typhimurium LT2
ucagccacuucuuccagcg

SEQ ID NO: 1824786 - RNA, 18 nt, Salmonella typhimurium LT2
ucagccagcguaccagcg

SEQ ID NO: 1824787 - RNA, 20 nt, Salmonella typhimurium LT2
ucagccaggcggcaauaucc

SEQ ID NO: 1824788 - RNA, 12 nt, Salmonella typhimurium LT2
ucagccagcgau

SEQ ID NO: 1824789 - RNA, 18 nt, Salmonella typhimurium LT2
ucagcaccacgcccggau

SEQ ID NO: 1824790 - RNA, 19 nt, Salmonella typhimurium LT2
ucagcgcgccgcgcagcau

SEQ ID NO: 1824791 - RNA, 20 nt, Salmonella typhimurium LT2
ucagcaaacgaccuuucgcc

SEQ ID NO: 1824792 - RNA, 16 nt, Salmonella typhimurium LT2
ucagcaacgccuccag

SEQ ID NO: 1824793 - RNA, 11 nt, Salmonella typhimurium LT2
ucagcacaauc

SEQ ID NO: 1824794 - RNA, 18 nt, Salmonella typhimurium LT2
ucagcaaucgcuggcgua

SEQ ID NO: 1824795 - RNA, 14 nt, Salmonella typhimurium LT2
ucagcaagcgccag

SEQ ID NO: 1824796 - RNA, 19 nt, Salmonella typhimurium LT2
ucagacgaugugaacgccc

SEQ ID NO: 1824797 - RNA, 13 nt, Salmonella typhimurium LT2
ucacgccacaguu

SEQ ID NO: 1824798 - RNA, 15 nt, Salmonella typhimurium LT2
ucacgcccgcggcau

SEQ ID NO: 1824799 - RNA, 14 nt, Salmonella typhimurium LT2
ucacgccgacgaca

SEQ ID NO: 1824800 - RNA, 15 nt, Salmonella typhimurium LT2
ucacgcccgccgaag

SEQ ID NO: 1824801 - RNA, 15 nt, Salmonella typhimurium LT2
ucacggcaacgccuu

SEQ ID NO: 1824802 - RNA, 14 nt, Salmonella typhimurium LT2
ucacguaagcauuc

SEQ ID NO: 1824803 - RNA, 21 nt, Salmonella typhimurium LT2
ucaccgcauagauauaaacgc

SEQ ID NO: 1824804 - RNA, 16 nt, Salmonella typhimurium LT2
ucacgcaaaugcagcg

SEQ ID NO: 1824805 - RNA, 21 nt, Salmonella typhimurium LT2
ucaccuuuuuauuuacugccg

SEQ ID NO: 1824806 - RNA, 23 nt, Salmonella typhimurium LT2
ucaccuuuuuauuuacugccguu

SEQ ID NO: 1824807 - RNA, 15 nt, Salmonella typhimurium LT2
ucacgaaaccggcga

SEQ ID NO: 1824808 - RNA, 15 nt, Salmonella typhimurium LT2
ucacgaagucuggcu

SEQ ID NO: 1824809 - RNA, 22 nt, Salmonella typhimurium LT2
ucaccuucggucccaucgcgcc

SEQ ID NO: 1824810 - RNA, 16 nt, Salmonella typhimurium LT2
ucaccggcacccaguu

SEQ ID NO: 1824811 - RNA, 15 nt, Salmonella typhimurium LT2
ucaccggaucgccga

SEQ ID NO: 1824812 - RNA, 21 nt, Salmonella typhimurium LT2
uccaacaaggauauccgccag

SEQ ID NO: 1824813 - RNA, 23 nt, Salmonella typhimurium LT2
uccaaagauaaacgacagcgcca

SEQ ID NO: 1824814 - RNA, 19 nt, Salmonella typhimurium LT2
ucauuauucaggccuccug

SEQ ID NO: 1824815 - RNA, 20 nt, Salmonella typhimurium LT2
ucauggcucagauugaacgc

SEQ ID NO: 1824816 - RNA, 15 nt, Salmonella typhimurium LT2
ucauggcuaaucgcg

SEQ ID NO: 1824817 - RNA, 22 nt, Salmonella typhimurium LT2
ucaugguugaaaaaagccgaug

SEQ ID NO: 1824818 - RNA, 14 nt, Salmonella typhimurium LT2
ucauguacgccgcu

SEQ ID NO: 1824819 - RNA, 13 nt, Salmonella typhimurium LT2
ucaucggcggcaa

SEQ ID NO: 1824820 - RNA, 19 nt, Salmonella typhimurium LT2
ucauccacgucauaacgcg

SEQ ID NO: 1824821 - RNA, 11 nt, Salmonella typhimurium LT2
ucauccagcgg

SEQ ID NO: 1824822 - RNA, 21 nt, Salmonella typhimurium LT2
ucaucauggcugauggcgaaa

SEQ ID NO: 1824823 - RNA, 17 nt, Salmonella typhimurium LT2
ucaucauuaccuacgcg

SEQ ID NO: 1824824 - RNA, 17 nt, Salmonella typhimurium LT2
ucaugauacccagcguc

SEQ ID NO: 1824825 - RNA, 23 nt, Salmonella typhimurium LT2
ucaucguaccaauacccagcgcc

SEQ ID NO: 1824826 - RNA, 16 nt, Salmonella typhimurium LT2
ucaguucagccgccag

SEQ ID NO: 1824827 - RNA, 16 nt, Salmonella typhimurium LT2
ucaguggucaggcgac

SEQ ID NO: 1824828 - RNA, 22 nt, Salmonella typhimurium LT2
ucaguggucauuuuacugcgua

SEQ ID NO: 1824829 - RNA, 22 nt, Salmonella typhimurium LT2
ucaguucgccacggucggcaau

SEQ ID NO: 1824830 - RNA, 14 nt, Salmonella typhimurium LT2
ucauaaauucgcag

SEQ ID NO: 1824831 - RNA, 20 nt, Salmonella typhimurium LT2
ucaucaccuacccucaacgc

SEQ ID NO: 1824832 - RNA, 16 nt, Salmonella typhimurium LT2
ucaucaccaucgccgg

SEQ ID NO: 1824833 - RNA, 21 nt, Salmonella typhimurium LT2
ucaucaagauuuugugaccgc

SEQ ID NO: 1824834 - RNA, 19 nt, Salmonella typhimurium LT2
ucaucaauacguuaugcag

SEQ ID NO: 1824835 - RNA, 19 nt, Salmonella typhimurium LT2
ucaucagcagcagcguaau

SEQ ID NO: 1824836 - RNA, 23 nt, Salmonella typhimurium LT2
ucaucagucucaaacgccugcau

SEQ ID NO: 1824837 - RNA, 12 nt, Salmonella typhimurium LT2
ucaucauacuga

SEQ ID NO: 1824838 - RNA, 22 nt, Salmonella typhimurium LT2
ucaggccuacgacagcgcuggc

SEQ ID NO: 1824839 - RNA, 19 nt, Salmonella typhimurium LT2
ucaguggcguagcguacug

SEQ ID NO: 1824840 - RNA, 21 nt, Salmonella typhimurium LT2
uccacugaguuucaccgccag

SEQ ID NO: 1824841 - RNA, 21 nt, Salmonella typhimurium LT2
uccacuggcccccuguuccag

SEQ ID NO: 1824842 - RNA, 23 nt, Salmonella typhimurium LT2
uccacuugggggcgggucgacgu

SEQ ID NO: 1824843 - RNA, 17 nt, Salmonella typhimurium LT2
uccagcacauccucaau

SEQ ID NO: 1824844 - RNA, 14 nt, Salmonella typhimurium LT2
uccacggcaucaau

SEQ ID NO: 1824845 - RNA, 16 nt, Salmonella typhimurium LT2
uccacacguccauccg

SEQ ID NO: 1824846 - RNA, 21 nt, Salmonella typhimurium LT2
uccacacgccuggccaggcuu

SEQ ID NO: 1824847 - RNA, 15 nt, Salmonella typhimurium LT2
uccaacugucgccau

SEQ ID NO: 1824848 - RNA, 16 nt, Salmonella typhimurium LT2
uccacauccccgcguu

SEQ ID NO: 1824849 - RNA, 15 nt, Salmonella typhimurium LT2
uccacauacugcaau

SEQ ID NO: 1824850 - RNA, 19 nt, Salmonella typhimurium LT2
uccaccgccagcauaucca

SEQ ID NO: 1824851 - RNA, 21 nt, Salmonella typhimurium LT2
uccagcccguucugugcgccg

SEQ ID NO: 1824852 - RNA, 17 nt, Salmonella typhimurium LT2
uccagcauuucgacguc

SEQ ID NO: 1824853 - RNA, 22 nt, Salmonella typhimurium LT2
uccagcaggguauuugcgcccg

SEQ ID NO: 1824854 - RNA, 20 nt, Salmonella typhimurium LT2
uccagcgguugcgcuucggc

SEQ ID NO: 1824855 - RNA, 14 nt, Salmonella typhimurium LT2
uccagcgugcagau

SEQ ID NO: 1824856 - RNA, 20 nt, Salmonella typhimurium LT2
uccaggcccggugucagaca

SEQ ID NO: 1824857 - RNA, 17 nt, Salmonella typhimurium LT2
uccagcuauagacgaca

SEQ ID NO: 1824858 - RNA, 21 nt, Salmonella typhimurium LT2
uccaucgguucucugccauca

SEQ ID NO: 1824859 - RNA, 15 nt, Salmonella typhimurium LT2
uccaucuccggcgac

SEQ ID NO: 1824860 - RNA, 19 nt, Salmonella typhimurium LT2
ucccuuccagcgacgccca

SEQ ID NO: 1824861 - RNA, 22 nt, Salmonella typhimurium LT2
ucccugacaauacugaacgccg

SEQ ID NO: 1824862 - RNA, 23 nt, Salmonella typhimurium LT2
ucccugacaauacugaacgccgc

SEQ ID NO: 1824863 - RNA, 23 nt, Salmonella typhimurium LT2
uccgacgcguuucacaucgccca

SEQ ID NO: 1824864 - RNA, 13 nt, Salmonella typhimurium LT2
uccgcagccgcau

SEQ ID NO: 1824865 - RNA, 19 nt, Salmonella typhimurium LT2
uccgcauaauuacgcccau

SEQ ID NO: 1824866 - RNA, 23 nt, Salmonella typhimurium LT2
uccgcagugcggagguuucgccu

SEQ ID NO: 1824867 - RNA, 20 nt, Salmonella typhimurium LT2
uccgccuuaucaggccugug

SEQ ID NO: 1824868 - RNA, 16 nt, Salmonella typhimurium LT2
uccgccgcaauagcca

SEQ ID NO: 1824869 - RNA, 21 nt, Salmonella typhimurium LT2
uccgccugauaaaacgcaggc

SEQ ID NO: 1824870 - RNA, 15 nt, Salmonella typhimurium LT2
uccgccgcaaacugg

SEQ ID NO: 1824871 - RNA, 15 nt, Salmonella typhimurium LT2
ucccguagcgucaac

SEQ ID NO: 1824872 - RNA, 17 nt, Salmonella typhimurium LT2
ucccggcugacauaauc

SEQ ID NO: 1824873 - RNA, 16 nt, Salmonella typhimurium LT2
ucccgucauuacgcgc

SEQ ID NO: 1824874 - RNA, 21 nt, Salmonella typhimurium LT2
ucccgccuggcgaaacgccug

SEQ ID NO: 1824875 - RNA, 15 nt, Salmonella typhimurium LT2
ucccgccaucgucca

SEQ ID NO: 1824876 - RNA, 14 nt, Salmonella typhimurium LT2
ucccgcacgcuggc

SEQ ID NO: 1824877 - RNA, 22 nt, Salmonella typhimurium LT2
ucccgcagcauuuccgccgccu

SEQ ID NO: 1824878 - RNA, 17 nt, Salmonella typhimurium LT2
ucccgcaucacccgcau

SEQ ID NO: 1824879 - RNA, 15 nt, Salmonella typhimurium LT2
uccauuuuugcggau

SEQ ID NO: 1824880 - RNA, 20 nt, Salmonella typhimurium LT2
uccauggcaaaauucguauu

SEQ ID NO: 1824881 - RNA, 14 nt, Salmonella typhimurium LT2
uccggcacagcguu

SEQ ID NO: 1824882 - RNA, 13 nt, Salmonella typhimurium LT2
uccggccacggau

SEQ ID NO: 1824883 - RNA, 22 nt, Salmonella typhimurium LT2
uccgcuuacucguuuugccgau

SEQ ID NO: 1824884 - RNA, 18 nt, Salmonella typhimurium LT2
uccgcuucaccuuucgcc

SEQ ID NO: 1824885 - RNA, 15 nt, Salmonella typhimurium LT2
uccggaagacagcuu

SEQ ID NO: 1824886 - RNA, 18 nt, Salmonella typhimurium LT2
uccgcgcaaauacugaaa

SEQ ID NO: 1824887 - RNA, 15 nt, Salmonella typhimurium LT2
uccgcgacguacugg

SEQ ID NO: 1824888 - RNA, 17 nt, Salmonella typhimurium LT2
uccgcgagcagccagau

SEQ ID NO: 1824889 - RNA, 10 nt, Salmonella typhimurium LT2
uccgcugcaa

SEQ ID NO: 1824890 - RNA, 18 nt, Salmonella typhimurium LT2
uccggcgccuccagccau

SEQ ID NO: 1824891 - RNA, 17 nt, Salmonella typhimurium LT2
uccggcccgugccagcu

SEQ ID NO: 1824892 - RNA, 21 nt, Salmonella typhimurium LT2
uccggcccgugccagcuaucg

SEQ ID NO: 1824893 - RNA, 22 nt, Salmonella typhimurium LT2
uccggcuuaaugcauggcagau

SEQ ID NO: 1824894 - RNA, 20 nt, Salmonella typhimurium LT2
uccgggccacucuccagcau

SEQ ID NO: 1824895 - RNA, 14 nt, Salmonella typhimurium LT2
uccuccgccgauaa

SEQ ID NO: 1824896 - RNA, 15 nt, Salmonella typhimurium LT2
uccucauucagcggc

SEQ ID NO: 1824897 - RNA, 15 nt, Salmonella typhimurium LT2
uccguugaucgucca

SEQ ID NO: 1824898 - RNA, 15 nt, Salmonella typhimurium LT2
uccguuuucaacgcc

SEQ ID NO: 1824899 - RNA, 16 nt, Salmonella typhimurium LT2
uccucacugccgacgc

SEQ ID NO: 1824900 - RNA, 18 nt, Salmonella typhimurium LT2
uccucaccguagcuccag

SEQ ID NO: 1824901 - RNA, 18 nt, Salmonella typhimurium LT2
uccgucaacaccugcauc

SEQ ID NO: 1824902 - RNA, 17 nt, Salmonella typhimurium LT2
uccggugaagguaauuu

SEQ ID NO: 1824903 - RNA, 16 nt, Salmonella typhimurium LT2
uccgguauuccaucaa

SEQ ID NO: 1824904 - RNA, 14 nt, Salmonella typhimurium LT2
uccggucgcgcaau

SEQ ID NO: 1824905 - RNA, 20 nt, Salmonella typhimurium LT2
ucgaacgccgccugcgccag

SEQ ID NO: 1824906 - RNA, 17 nt, Salmonella typhimurium LT2
ucgaacgccgacaucac

SEQ ID NO: 1824907 - RNA, 22 nt, Salmonella typhimurium LT2
ucgacaagcuaauccccagcgc

SEQ ID NO: 1824908 - RNA, 17 nt, Salmonella typhimurium LT2
ucgacaauguccgccag

SEQ ID NO: 1824909 - RNA, 12 nt, Salmonella typhimurium LT2
ucgacaccagcg

SEQ ID NO: 1824910 - RNA, 14 nt, Salmonella typhimurium LT2
ucgacaccagcgau

SEQ ID NO: 1824911 - RNA, 19 nt, Salmonella typhimurium LT2
ucgacagcccgccagcaua

SEQ ID NO: 1824912 - RNA, 17 nt, Salmonella typhimurium LT2
uccugaucaaggcgcag

SEQ ID NO: 1824913 - RNA, 15 nt, Salmonella typhimurium LT2
uccugcggaacgcgg

SEQ ID NO: 1824914 - RNA, 11 nt, Salmonella typhimurium LT2
uccugcgccag

SEQ ID NO: 1824915 - RNA, 11 nt, Salmonella typhimurium LT2
uccugccagac

SEQ ID NO: 1824916 - RNA, 14 nt, Salmonella typhimurium LT2
uccugccgccgcac

SEQ ID NO: 1824917 - RNA, 21 nt, Salmonella typhimurium LT2
uccugcggcauuagcaugggc

SEQ ID NO: 1824918 - RNA, 19 nt, Salmonella typhimurium LT2
uccugcgguaaacgcucgc

SEQ ID NO: 1824919 - RNA, 18 nt, Salmonella typhimurium LT2
uccucuuuucgaacgccg

SEQ ID NO: 1824920 - RNA, 19 nt, Salmonella typhimurium LT2
uccucuuuucgaacgccga

SEQ ID NO: 1824921 - RNA, 16 nt, Salmonella typhimurium LT2
uccugaauagcaggca

SEQ ID NO: 1824922 - RNA, 17 nt, Salmonella typhimurium LT2
uccugaaucgccgucag

SEQ ID NO: 1824923 - RNA, 18 nt, Salmonella typhimurium LT2
uccugaaacgcggcguag

SEQ ID NO: 1824924 - RNA, 17 nt, Salmonella typhimurium LT2
uccugaagcggcgcaau

SEQ ID NO: 1824925 - RNA, 14 nt, Salmonella typhimurium LT2
uccucgucggcaag

SEQ ID NO: 1824926 - RNA, 14 nt, Salmonella typhimurium LT2
uccucgacuucauu

SEQ ID NO: 1824927 - RNA, 20 nt, Salmonella typhimurium LT2
uccuuuaaugaagcaacugu

SEQ ID NO: 1824928 - RNA, 22 nt, Salmonella typhimurium LT2
ucgaaacccaacaucgcgcugc

SEQ ID NO: 1824929 - RNA, 16 nt, Salmonella typhimurium LT2
uccuuagauuaaucac

SEQ ID NO: 1824930 - RNA, 22 nt, Salmonella typhimurium LT2
uccuuauuuacgguuggccagc

SEQ ID NO: 1824931 - RNA, 23 nt, Salmonella typhimurium LT2
uccuuauuuacgguuggccagca

SEQ ID NO: 1824932 - RNA, 18 nt, Salmonella typhimurium LT2
uccuucuccuucgccaaa

SEQ ID NO: 1824933 - RNA, 12 nt, Salmonella typhimurium LT2
uccuucgggcga

SEQ ID NO: 1824934 - RNA, 16 nt, Salmonella typhimurium LT2
uccugggauaccggaa

SEQ ID NO: 1824935 - RNA, 17 nt, Salmonella typhimurium LT2
uccuggaagacuucacg

SEQ ID NO: 1824936 - RNA, 22 nt, Salmonella typhimurium LT2
uccugggccgccacgaccugca

SEQ ID NO: 1824937 - RNA, 20 nt, Salmonella typhimurium LT2
uaccuauuuguuccggcaag

SEQ ID NO: 1824938 - RNA, 14 nt, Salmonella typhimurium LT2
uaccguguuuaccu

SEQ ID NO: 1824939 - RNA, 20 nt, Salmonella typhimurium LT2
uaccguuuaccccgccagca

SEQ ID NO: 1824940 - RNA, 20 nt, Salmonella typhimurium LT2
uaccugccgccauaacgccg

SEQ ID NO: 1824941 - RNA, 15 nt, Salmonella typhimurium LT2
uaccugccgaccuca

SEQ ID NO: 1824942 - RNA, 22 nt, Salmonella typhimurium LT2
uaccugagagaacggaccggca

SEQ ID NO: 1824943 - RNA, 11 nt, Salmonella typhimurium LT2
uaccugaucca

SEQ ID NO: 1824944 - RNA, 17 nt, Salmonella typhimurium LT2
uacgcuugcgccagcau

SEQ ID NO: 1824945 - RNA, 18 nt, Salmonella typhimurium LT2
uacggacguggggguuca

SEQ ID NO: 1824946 - RNA, 14 nt, Salmonella typhimurium LT2
uacgcugacgcgau

SEQ ID NO: 1824947 - RNA, 19 nt, Salmonella typhimurium LT2
uacgcuccugcgguacggc

SEQ ID NO: 1824948 - RNA, 19 nt, Salmonella typhimurium LT2
uacgcuuaucaggccuacc

SEQ ID NO: 1824949 - RNA, 21 nt, Salmonella typhimurium LT2
uacgcuucggcuccagcgccu

SEQ ID NO: 1824950 - RNA, 16 nt, Salmonella typhimurium LT2
uacgcuucucacggau

SEQ ID NO: 1824951 - RNA, 15 nt, Salmonella typhimurium LT2
uacgccuuacccggc

SEQ ID NO: 1824952 - RNA, 17 nt, Salmonella typhimurium LT2
uacgacuuacgcagcau

SEQ ID NO: 1824953 - RNA, 13 nt, Salmonella typhimurium LT2
uacgcgacgugcu

SEQ ID NO: 1824954 - RNA, 18 nt, Salmonella typhimurium LT2
uacgcgacgcauugccau

SEQ ID NO: 1824955 - RNA, 23 nt, Salmonella typhimurium LT2
uacgcgcucucauaagccgcguu

SEQ ID NO: 1824956 - RNA, 16 nt, Salmonella typhimurium LT2
uacgcggcguaccgcg

SEQ ID NO: 1824957 - RNA, 22 nt, Salmonella typhimurium LT2
uacggugaauauuugcgcuagu

SEQ ID NO: 1824958 - RNA, 14 nt, Salmonella typhimurium LT2
uacgguuagcgaac

SEQ ID NO: 1824959 - RNA, 21 nt, Salmonella typhimurium LT2
uacguacccgcucggcauaca

SEQ ID NO: 1824960 - RNA, 22 nt, Salmonella typhimurium LT2
uacggcugaaucucgccuggcu

SEQ ID NO: 1824961 - RNA, 18 nt, Salmonella typhimurium LT2
uacguaguccggcaauga

SEQ ID NO: 1824962 - RNA, 18 nt, Salmonella typhimurium LT2
uacguccaccguuacgcc

SEQ ID NO: 1824963 - RNA, 15 nt, Salmonella typhimurium LT2
uacguucaucaggcc

SEQ ID NO: 1824964 - RNA, 19 nt, Salmonella typhimurium LT2
uacguucaucaggccugca

SEQ ID NO: 1824965 - RNA, 16 nt, Salmonella typhimurium LT2
uacuccgacggcgagc

SEQ ID NO: 1824966 - RNA, 20 nt, Salmonella typhimurium LT2
uagaaaguacaucauuggcc

SEQ ID NO: 1824967 - RNA, 16 nt, Salmonella typhimurium LT2
uacuguucuaccggcg

SEQ ID NO: 1824968 - RNA, 22 nt, Salmonella typhimurium LT2
uaggagauauccugaaacgcgg

SEQ ID NO: 1824969 - RNA, 22 nt, Salmonella typhimurium LT2
uaggaauacccagcucagcuuu

SEQ ID NO: 1824970 - RNA, 14 nt, Salmonella typhimurium LT2
uagcugcccggaua

SEQ ID NO: 1824971 - RNA, 19 nt, Salmonella typhimurium LT2
uagcuggcaagaccgauag

SEQ ID NO: 1824972 - RNA, 13 nt, Salmonella typhimurium LT2
uagcuggcagggg

SEQ ID NO: 1824973 - RNA, 20 nt, Salmonella typhimurium LT2
uagcucaguugguuagagca

SEQ ID NO: 1824974 - RNA, 20 nt, Salmonella typhimurium LT2
uaggccggaugaggcgcagc

SEQ ID NO: 1824975 - RNA, 17 nt, Salmonella typhimurium LT2
uaggcgccgccgacaau

SEQ ID NO: 1824976 - RNA, 14 nt, Salmonella typhimurium LT2
uaggcgccaagcac

SEQ ID NO: 1824977 - RNA, 20 nt, Salmonella typhimurium LT2
uaggcaggauaaggcguuca

SEQ ID NO: 1824978 - RNA, 21 nt, Salmonella typhimurium LT2
uaggccggauaaggcgcuagc

SEQ ID NO: 1824979 - RNA, 20 nt, Salmonella typhimurium LT2
uaggccggauaaggcguaac

SEQ ID NO: 1824980 - RNA, 20 nt, Salmonella typhimurium LT2
uaggccggauaaggcguuca

SEQ ID NO: 1824981 - RNA, 21 nt, Salmonella typhimurium LT2
uaggccggauaaggcguuugc

SEQ ID NO: 1824982 - RNA, 17 nt, Salmonella typhimurium LT2
uaggccggauaagcguu

SEQ ID NO: 1824983 - RNA, 20 nt, Salmonella typhimurium LT2
uaggccggauaagcguuagc

SEQ ID NO: 1824984 - RNA, 19 nt, Salmonella typhimurium LT2
uaggccggauaagcgcagc

SEQ ID NO: 1824985 - RNA, 19 nt, Salmonella typhimurium LT2
uaggcucaauaugccaggc

SEQ ID NO: 1824986 - RNA, 16 nt, Salmonella typhimurium LT2
uagggggcuaccggag

SEQ ID NO: 1824987 - RNA, 20 nt, Salmonella typhimurium LT2
uagccugcuggguacgugca

SEQ ID NO: 1824988 - RNA, 21 nt, Salmonella typhimurium LT2
uagcgccuuguuuucaucugc

SEQ ID NO: 1824989 - RNA, 19 nt, Salmonella typhimurium LT2
uagcgcugaagcccgcgau

SEQ ID NO: 1824990 - RNA, 14 nt, Salmonella typhimurium LT2
uagcgccuacgggc

SEQ ID NO: 1824991 - RNA, 13 nt, Salmonella typhimurium LT2
uagcgugacggca

SEQ ID NO: 1824992 - RNA, 20 nt, Salmonella typhimurium LT2
uagcguauccggcaagucag

SEQ ID NO: 1824993 - RNA, 14 nt, Salmonella typhimurium LT2
uagcguuggcguca

SEQ ID NO: 1824994 - RNA, 22 nt, Salmonella typhimurium LT2
uagcuaaauuaaaaauaaucag

SEQ ID NO: 1824995 - RNA, 14 nt, Salmonella typhimurium LT2
uagccugaacgccg

SEQ ID NO: 1824996 - RNA, 13 nt, Salmonella typhimurium LT2
uagauuaaucacu

SEQ ID NO: 1824997 - RNA, 20 nt, Salmonella typhimurium LT2
uauugcuuucaauuuccgca

SEQ ID NO: 1824998 - RNA, 17 nt, Salmonella typhimurium LT2
uauuggcccccaucgcc

SEQ ID NO: 1824999 - RNA, 17 nt, Salmonella typhimurium LT2
uauugcuuucaauuucc

SEQ ID NO: 1825000 - RNA, 21 nt, Salmonella typhimurium LT2
uauucaugguuccgccguuaa

SEQ ID NO: 1825001 - RNA, 23 nt, Salmonella typhimurium LT2
uauucacgcagcuuauuggcaau

SEQ ID NO: 1825002 - RNA, 19 nt, Salmonella typhimurium LT2
uauuauuuugauaaucauc

SEQ ID NO: 1825003 - RNA, 23 nt, Salmonella typhimurium LT2
uauggcgaaggaugaccggcuau

SEQ ID NO: 1825004 - RNA, 16 nt, Salmonella typhimurium LT2
uauggccguuugcugu

SEQ ID NO: 1825005 - RNA, 13 nt, Salmonella typhimurium LT2
uauuaacggucuu

SEQ ID NO: 1825006 - RNA, 21 nt, Salmonella typhimurium LT2
uauguuugccgucaucgcuca

SEQ ID NO: 1825007 - RNA, 19 nt, Salmonella typhimurium LT2
uauguuaacgccgauuaau

SEQ ID NO: 1825008 - RNA, 15 nt, Salmonella typhimurium LT2
uauuaaaaagccagc

SEQ ID NO: 1825009 - RNA, 16 nt, Salmonella typhimurium LT2
uauccagcaccucauc

SEQ ID NO: 1825010 - RNA, 18 nt, Salmonella typhimurium LT2
uaucccaaacgucguaaa

SEQ ID NO: 1825011 - RNA, 18 nt, Salmonella typhimurium LT2
uaucaggccuaccagucg

SEQ ID NO: 1825012 - RNA, 20 nt, Salmonella typhimurium LT2
uaucaggaucaaaaucgcgc

SEQ ID NO: 1825013 - RNA, 21 nt, Salmonella typhimurium LT2
uaucaggcaauacgcugccgg

SEQ ID NO: 1825014 - RNA, 24 nt, Salmonella typhimurium LT2
uaucacccugaauuucaauaaucc

SEQ ID NO: 1825015 - RNA, 15 nt, Salmonella typhimurium LT2
uaucaauaaccgcca

SEQ ID NO: 1825016 - RNA, 21 nt, Salmonella typhimurium LT2
uaucaaaaugcaccggcguua

SEQ ID NO: 1825017 - RNA, 18 nt, Salmonella typhimurium LT2
uaucccguggugcguugc

SEQ ID NO: 1825018 - RNA, 17 nt, Salmonella typhimurium LT2
uauccggcgcaucgguc

SEQ ID NO: 1825019 - RNA, 13 nt, Salmonella typhimurium LT2
uauccggccuaca

SEQ ID NO: 1825020 - RNA, 18 nt, Salmonella typhimurium LT2
uauccucuuuucgaacgc

SEQ ID NO: 1825021 - RNA, 15 nt, Salmonella typhimurium LT2
uaucguagugccaca

SEQ ID NO: 1825022 - RNA, 14 nt, Salmonella typhimurium LT2
uaucguauccgguc

SEQ ID NO: 1825023 - RNA, 14 nt, Salmonella typhimurium LT2
uaucuaucaccgcc

SEQ ID NO: 1825024 - RNA, 20 nt, Salmonella typhimurium LT2
uaugaaauucuugcccgcug

SEQ ID NO: 1825025 - RNA, 19 nt, Salmonella typhimurium LT2
uaugaacgccagcggcgga

SEQ ID NO: 1825026 - RNA, 17 nt, Salmonella typhimurium LT2
uauacaguaaaacgcca

SEQ ID NO: 1825027 - RNA, 18 nt, Salmonella typhimurium LT2
uauaagcgccgucauccg

SEQ ID NO: 1825028 - RNA, 14 nt, Salmonella typhimurium LT2
uauaacgcguucug

SEQ ID NO: 1825029 - RNA, 16 nt, Salmonella typhimurium LT2
uauaacgcguucuggc

SEQ ID NO: 1825030 - RNA, 22 nt, Salmonella typhimurium LT2
uauaaaacgggccacugcuggc

SEQ ID NO: 1825031 - RNA, 21 nt, Salmonella typhimurium LT2
uaguuucuggccucuuaucag

SEQ ID NO: 1825032 - RNA, 17 nt, Salmonella typhimurium LT2
uauaaauuuuuuaacag

SEQ ID NO: 1825033 - RNA, 15 nt, Salmonella typhimurium LT2
uauaaacucagcaau

SEQ ID NO: 1825034 - RNA, 15 nt, Salmonella typhimurium LT2
uauagcgcaaacgcg

SEQ ID NO: 1825035 - RNA, 16 nt, Salmonella typhimurium LT2
uauagcgcaaacgcgc

SEQ ID NO: 1825036 - RNA, 20 nt, Salmonella typhimurium LT2
uauaggccaucacuggcauu

SEQ ID NO: 1825037 - RNA, 14 nt, Salmonella typhimurium LT2
uauacgaagcgcca

SEQ ID NO: 1825038 - RNA, 21 nt, Salmonella typhimurium LT2
uauacgcccgccugguccucu

SEQ ID NO: 1825039 - RNA, 16 nt, Salmonella typhimurium LT2
uauacgcggcguaccg

SEQ ID NO: 1825040 - RNA, 20 nt, Salmonella typhimurium LT2
uauagucaaacccuuccgca

SEQ ID NO: 1825041 - RNA, 22 nt, Salmonella typhimurium LT2
uauaggacgccuguaaugccgc

SEQ ID NO: 1825042 - RNA, 16 nt, Salmonella typhimurium LT2
uauaucgacaggcgua

SEQ ID NO: 1825043 - RNA, 18 nt, Salmonella typhimurium LT2
uauauucagcaaaugcgc

SEQ ID NO: 1825044 - RNA, 20 nt, Salmonella typhimurium LT2
uaguuaccguaaucaucgcg

SEQ ID NO: 1825045 - RNA, 18 nt, Salmonella typhimurium LT2
uaguguaguuagcgccca

SEQ ID NO: 1825046 - RNA, 18 nt, Salmonella typhimurium LT2
uaguccggcaaugauauc

SEQ ID NO: 1825047 - RNA, 18 nt, Salmonella typhimurium LT2
uaguccgguaucggcaau

SEQ ID NO: 1825048 - RNA, 15 nt, Salmonella typhimurium LT2
uagugaucgggcuga

SEQ ID NO: 1825049 - RNA, 12 nt, Salmonella typhimurium LT2
uagucgucauug

SEQ ID NO: 1825050 - RNA, 20 nt, Salmonella typhimurium LT2
uaggucagguaagcgcuagc

SEQ ID NO: 1825051 - RNA, 16 nt, Salmonella typhimurium LT2
uagguugcgccaacgu

SEQ ID NO: 1825052 - RNA, 16 nt, Salmonella typhimurium LT2
uaguaaacggcgcuga

SEQ ID NO: 1825053 - RNA, 22 nt, Salmonella typhimurium LT2
uagucauaauacucaauauccu

SEQ ID NO: 1825054 - RNA, 15 nt, Salmonella typhimurium LT2
uagucauauuaucgc

SEQ ID NO: 1825055 - RNA, 17 nt, Salmonella typhimurium LT2
uagucauauucacggcc

SEQ ID NO: 1825056 - RNA, 20 nt, Salmonella typhimurium LT2
uagucaucgccuucauccgc

SEQ ID NO: 1825057 - RNA, 11 nt, Salmonella typhimurium LT2
uagucagcgca

SEQ ID NO: 1825058 - RNA, 19 nt, Salmonella typhimurium LT2
uaguaccgaacagccaggc

SEQ ID NO: 1825059 - RNA, 15 nt, Salmonella typhimurium LT2
uaguaaugcgcgaau

SEQ ID NO: 1825060 - RNA, 12 nt, Salmonella typhimurium LT2
uaguaccaggca

SEQ ID NO: 1825061 - RNA, 23 nt, Salmonella typhimurium LT2
guugaccaaacagcaauuccgcc

SEQ ID NO: 1825062 - RNA, 16 nt, Salmonella typhimurium LT2
guugaauagcugccgc

SEQ ID NO: 1825063 - RNA, 13 nt, Salmonella typhimurium LT2
guugagcagcgcg

SEQ ID NO: 1825064 - RNA, 19 nt, Salmonella typhimurium LT2
guugacuuaaaaagcggau

SEQ ID NO: 1825065 - RNA, 13 nt, Salmonella typhimurium LT2
guucugacgcgac

SEQ ID NO: 1825066 - RNA, 23 nt, Salmonella typhimurium LT2
guucgucgguucgucgagcagca

SEQ ID NO: 1825067 - RNA, 20 nt, Salmonella typhimurium LT2
guucguaaagcauagcguca

SEQ ID NO: 1825068 - RNA, 15 nt, Salmonella typhimurium LT2
guggugaauaucgag

SEQ ID NO: 1825069 - RNA, 20 nt, Salmonella typhimurium LT2
guugcggcaucagauggcga

SEQ ID NO: 1825070 - RNA, 14 nt, Salmonella typhimurium LT2
guugauucagcguc

SEQ ID NO: 1825071 - RNA, 22 nt, Salmonella typhimurium LT2
guugauacagaaaaccggcaaa

SEQ ID NO: 1825072 - RNA, 20 nt, Salmonella typhimurium LT2
guugcaucuuaucaggccga

SEQ ID NO: 1825073 - RNA, 15 nt, Salmonella typhimurium LT2
guugcauacggucaa

SEQ ID NO: 1825074 - RNA, 17 nt, Salmonella typhimurium LT2
guugccacugccacgag

SEQ ID NO: 1825075 - RNA, 19 nt, Salmonella typhimurium LT2
guugccagaaacgcguagc

SEQ ID NO: 1825076 - RNA, 22 nt, Salmonella typhimurium LT2
guugucauuguaaaaccgacua

SEQ ID NO: 1825077 - RNA, 16 nt, Salmonella typhimurium LT2
guugucgaacugcacg

SEQ ID NO: 1825078 - RNA, 18 nt, Salmonella typhimurium LT2
guuguccaguaaggcaag

SEQ ID NO: 1825079 - RNA, 13 nt, Salmonella typhimurium LT2
guuuccggcgcuu

SEQ ID NO: 1825080 - RNA, 16 nt, Salmonella typhimurium LT2
guuuccugcgccagca

SEQ ID NO: 1825081 - RNA, 21 nt, Salmonella typhimurium LT2
guuucgcugcacuucaauguc

SEQ ID NO: 1825082 - RNA, 18 nt, Salmonella typhimurium LT2
guuucaucaucgccgauu

SEQ ID NO: 1825083 - RNA, 10 nt, Salmonella typhimurium LT2
guuuauccgg

SEQ ID NO: 1825084 - RNA, 21 nt, Salmonella typhimurium LT2
guuuccacgacaaucucuacg

SEQ ID NO: 1825085 - RNA, 16 nt, Salmonella typhimurium LT2
guuuaccccaggcgau

SEQ ID NO: 1825086 - RNA, 20 nt, Salmonella typhimurium LT2
guuucuauccuguagugaag

SEQ ID NO: 1825087 - RNA, 14 nt, Salmonella typhimurium LT2
guuucguugccaga

SEQ ID NO: 1825088 - RNA, 18 nt, Salmonella typhimurium LT2
guuugcgcgaggucgagc

SEQ ID NO: 1825089 - RNA, 14 nt, Salmonella typhimurium LT2
guuuuggcagcgcc

SEQ ID NO: 1825090 - RNA, 15 nt, Salmonella typhimurium LT2
guuuugauguccaga

SEQ ID NO: 1825091 - RNA, 14 nt, Salmonella typhimurium LT2
guuuugcagcgcca

SEQ ID NO: 1825092 - RNA, 13 nt, Salmonella typhimurium LT2
guuuugccgauac

SEQ ID NO: 1825093 - RNA, 15 nt, Salmonella typhimurium LT2
guuuuggcagcgccc

SEQ ID NO: 1825094 - RNA, 19 nt, Salmonella typhimurium LT2
guuuuguacagccgggcau

SEQ ID NO: 1825095 - RNA, 16 nt, Salmonella typhimurium LT2
guuuuccgcaacguca

SEQ ID NO: 1825096 - RNA, 18 nt, Salmonella typhimurium LT2
guuuuaccgcccgacgga

SEQ ID NO: 1825097 - RNA, 19 nt, Salmonella typhimurium LT2
guuuuaccaguacaauuuc

SEQ ID NO: 1825098 - RNA, 18 nt, Salmonella typhimurium LT2
guuugucuucugccagca

SEQ ID NO: 1825099 - RNA, 17 nt, Salmonella typhimurium LT2
uacacucucggguacac

SEQ ID NO: 1825100 - RNA, 16 nt, Salmonella typhimurium LT2
uacacgcgaauagcca

SEQ ID NO: 1825101 - RNA, 16 nt, Salmonella typhimurium LT2
uacacgauuaaccuca

SEQ ID NO: 1825102 - RNA, 18 nt, Salmonella typhimurium LT2
uacagcucgucgucgcgg

SEQ ID NO: 1825103 - RNA, 17 nt, Salmonella typhimurium LT2
uacagacgcuuacgggc

SEQ ID NO: 1825104 - RNA, 17 nt, Salmonella typhimurium LT2
uacagacgccaacgcgc

SEQ ID NO: 1825105 - RNA, 14 nt, Salmonella typhimurium LT2
uacaucgcgcuuaa

SEQ ID NO: 1825106 - RNA, 15 nt, Salmonella typhimurium LT2
uacagggcggcagga

SEQ ID NO: 1825107 - RNA, 17 nt, Salmonella typhimurium LT2
uacaggccggacaggcg

SEQ ID NO: 1825108 - RNA, 13 nt, Salmonella typhimurium LT2
uacaggauacggc

SEQ ID NO: 1825109 - RNA, 17 nt, Salmonella typhimurium LT2
uaaugccuguguaucgc

SEQ ID NO: 1825110 - RNA, 22 nt, Salmonella typhimurium LT2
uaaugccuggagccagccugag

SEQ ID NO: 1825111 - RNA, 16 nt, Salmonella typhimurium LT2
uaaugcccggcguaug

SEQ ID NO: 1825112 - RNA, 19 nt, Salmonella typhimurium LT2
uaaugguaccaauagccuu

SEQ ID NO: 1825113 - RNA, 19 nt, Salmonella typhimurium LT2
uaauggucagaucugcgcc

SEQ ID NO: 1825114 - RNA, 18 nt, Salmonella typhimurium LT2
uaauggucucgccgauag

SEQ ID NO: 1825115 - RNA, 13 nt, Salmonella typhimurium LT2
uaauggcgucaau

SEQ ID NO: 1825116 - RNA, 14 nt, Salmonella typhimurium LT2
uaauuggccuggcg

SEQ ID NO: 1825117 - RNA, 14 nt, Salmonella typhimurium LT2
uaagagagccuuau

SEQ ID NO: 1825118 - RNA, 19 nt, Salmonella typhimurium LT2
uaagauuugcgccgccgua

SEQ ID NO: 1825119 - RNA, 16 nt, Salmonella typhimurium LT2
uaaguaaggaggaauc

SEQ ID NO: 1825120 - RNA, 18 nt, Salmonella typhimurium LT2
uaagcugcgaagccaccg

SEQ ID NO: 1825121 - RNA, 21 nt, Salmonella typhimurium LT2
uaagcagugagauugacagaa

SEQ ID NO: 1825122 - RNA, 18 nt, Salmonella typhimurium LT2
uaauacaucuuccuccug

SEQ ID NO: 1825123 - RNA, 16 nt, Salmonella typhimurium LT2
uaauaagcagaacgua

SEQ ID NO: 1825124 - RNA, 22 nt, Salmonella typhimurium LT2
uaauaugccaggcuuccugcgc

SEQ ID NO: 1825125 - RNA, 15 nt, Salmonella typhimurium LT2
uaauauugccauucg

SEQ ID NO: 1825126 - RNA, 19 nt, Salmonella typhimurium LT2
uaauauucauaucguaaau

SEQ ID NO: 1825127 - RNA, 16 nt, Salmonella typhimurium LT2
uaauaccgaaauccgc

SEQ ID NO: 1825128 - RNA, 18 nt, Salmonella typhimurium LT2
uaauaccgagaaugccga

SEQ ID NO: 1825129 - RNA, 21 nt, Salmonella typhimurium LT2
uaaauuuccucuugucaggca

SEQ ID NO: 1825130 - RNA, 21 nt, Salmonella typhimurium LT2
uaacaccgcggcgcucgccag

SEQ ID NO: 1825131 - RNA, 12 nt, Salmonella typhimurium LT2
uaaauccagcgc

SEQ ID NO: 1825132 - RNA, 17 nt, Salmonella typhimurium LT2
uaaaucaacaaccggcu

SEQ ID NO: 1825133 - RNA, 15 nt, Salmonella typhimurium LT2
uaaauuagcgcgaaa

SEQ ID NO: 1825134 - RNA, 20 nt, Salmonella typhimurium LT2
uaacgcgaauccgccauagc

SEQ ID NO: 1825135 - RNA, 17 nt, Salmonella typhimurium LT2
uaacgcgccaugcgcgg

SEQ ID NO: 1825136 - RNA, 13 nt, Salmonella typhimurium LT2
uaacgcgccccag

SEQ ID NO: 1825137 - RNA, 20 nt, Salmonella typhimurium LT2
uaacccguugccgaacgcgg

SEQ ID NO: 1825138 - RNA, 14 nt, Salmonella typhimurium LT2
uaacaggaacgccg

SEQ ID NO: 1825139 - RNA, 18 nt, Salmonella typhimurium LT2
uaacguagcaaucucuau

SEQ ID NO: 1825140 - RNA, 21 nt, Salmonella typhimurium LT2
uaacgugcgguauaucacgcc

SEQ ID NO: 1825141 - RNA, 17 nt, Salmonella typhimurium LT2
uaacguuaacgccgcau

SEQ ID NO: 1825142 - RNA, 23 nt, Salmonella typhimurium LT2
uaacggcugacgcccaucagcau

SEQ ID NO: 1825143 - RNA, 20 nt, Salmonella typhimurium LT2
uaaaccucuuuggcgcgaac

SEQ ID NO: 1825144 - RNA, 17 nt, Salmonella typhimurium LT2
uaaacgccggauuccag

SEQ ID NO: 1825145 - RNA, 23 nt, Salmonella typhimurium LT2
uaaacgcuccggcaggcaaaucu

SEQ ID NO: 1825146 - RNA, 17 nt, Salmonella typhimurium LT2
uaaacgcugugaccagu

SEQ ID NO: 1825147 - RNA, 18 nt, Salmonella typhimurium LT2
uaaacggcgcaaugccgc

SEQ ID NO: 1825148 - RNA, 21 nt, Salmonella typhimurium LT2
uaaacgccagauaaucgccgc

SEQ ID NO: 1825149 - RNA, 23 nt, Salmonella typhimurium LT2
uaaagccguuuguuugcaucgug

SEQ ID NO: 1825150 - RNA, 14 nt, Salmonella typhimurium LT2
uaaagcuucugcgc

SEQ ID NO: 1825151 - RNA, 22 nt, Salmonella typhimurium LT2
uaaaggugagcucuuucugcgc

SEQ ID NO: 1825152 - RNA, 21 nt, Salmonella typhimurium LT2
uaaagcccgucccuuccgcca

SEQ ID NO: 1825153 - RNA, 22 nt, Salmonella typhimurium LT2
uaaacgggcagcgggugcucca

SEQ ID NO: 1825154 - RNA, 15 nt, Salmonella typhimurium LT2
uaaacgguaagaguu

SEQ ID NO: 1825155 - RNA, 13 nt, Salmonella typhimurium LT2
uaaaauggacauu

SEQ ID NO: 1825156 - RNA, 11 nt, Salmonella typhimurium LT2
uaaaaccauug

SEQ ID NO: 1825157 - RNA, 18 nt, Salmonella typhimurium LT2
uaaaacucccggcggaaa

SEQ ID NO: 1825158 - RNA, 13 nt, Salmonella typhimurium LT2
uaaaaacagcgca

SEQ ID NO: 1825159 - RNA, 13 nt, Salmonella typhimurium LT2
uaaaaacaucauu

SEQ ID NO: 1825160 - RNA, 23 nt, Salmonella typhimurium LT2
uaaaacauauccguacaagcguu

SEQ ID NO: 1825161 - RNA, 16 nt, Salmonella typhimurium LT2
uaaaaaacaggcgcag

SEQ ID NO: 1825162 - RNA, 18 nt, Salmonella typhimurium LT2
guccgauagcauuauugc

SEQ ID NO: 1825163 - RNA, 19 nt, Salmonella typhimurium LT2
gucgccauauguuccaccg

SEQ ID NO: 1825164 - RNA, 19 nt, Salmonella typhimurium LT2
gucgcagagcccagcgcga

SEQ ID NO: 1825165 - RNA, 15 nt, Salmonella typhimurium LT2
gucgcagcggcugcg

SEQ ID NO: 1825166 - RNA, 19 nt, Salmonella typhimurium LT2
gucgaucucaggcuuacca

SEQ ID NO: 1825167 - RNA, 12 nt, Salmonella typhimurium LT2
gucgauuuccgg

SEQ ID NO: 1825168 - RNA, 17 nt, Salmonella typhimurium LT2
gucgauuuccggcggca

SEQ ID NO: 1825169 - RNA, 17 nt, Salmonella typhimurium LT2
gucgauuucgcaggccc

SEQ ID NO: 1825170 - RNA, 21 nt, Salmonella typhimurium LT2
gucgagcuuuugcugcgccag

SEQ ID NO: 1825171 - RNA, 16 nt, Salmonella typhimurium LT2
gucgaugaaacgcuga

SEQ ID NO: 1825172 - RNA, 14 nt, Salmonella typhimurium LT2
gucgcguagcgaug

SEQ ID NO: 1825173 - RNA, 12 nt, Salmonella typhimurium LT2
gucgcgcuuacg

SEQ ID NO: 1825174 - RNA, 20 nt, Salmonella typhimurium LT2
gucgcgcuuucaaucgucag

SEQ ID NO: 1825175 - RNA, 19 nt, Salmonella typhimurium LT2
gucgccgcgcccagcagca

SEQ ID NO: 1825176 - RNA, 15 nt, Salmonella typhimurium LT2
gucggccugauaagc

SEQ ID NO: 1825177 - RNA, 18 nt, Salmonella typhimurium LT2
gucggccuuuuugcgccg

SEQ ID NO: 1825178 - RNA, 20 nt, Salmonella typhimurium LT2
gucggucugauaagcgcagc

SEQ ID NO: 1825179 - RNA, 19 nt, Salmonella typhimurium LT2
gucggcucauccagcagca

SEQ ID NO: 1825180 - RNA, 19 nt, Salmonella typhimurium LT2
gucguuguaguuaucgccg

SEQ ID NO: 1825181 - RNA, 20 nt, Salmonella typhimurium LT2
gucguuguaguuaucgccga

SEQ ID NO: 1825182 - RNA, 20 nt, Salmonella typhimurium LT2
gucguugucuuugcguaccg

SEQ ID NO: 1825183 - RNA, 17 nt, Salmonella typhimurium LT2
gucguuucccccgcgac

SEQ ID NO: 1825184 - RNA, 22 nt, Salmonella typhimurium LT2
gucuccagacaauccgcggcaa

SEQ ID NO: 1825185 - RNA, 14 nt, Salmonella typhimurium LT2
gucuccgccuggaa

SEQ ID NO: 1825186 - RNA, 18 nt, Salmonella typhimurium LT2
gucucucgugcaggccgg

SEQ ID NO: 1825187 - RNA, 19 nt, Salmonella typhimurium LT2
gucugauaagcgcagcgcc

SEQ ID NO: 1825188 - RNA, 17 nt, Salmonella typhimurium LT2
gucuucacgacccggcg

SEQ ID NO: 1825189 - RNA, 16 nt, Salmonella typhimurium LT2
guggacuaugcuccag

SEQ ID NO: 1825190 - RNA, 23 nt, Salmonella typhimurium LT2
gugcuugcgccgccauccggcaa

SEQ ID NO: 1825191 - RNA, 21 nt, Salmonella typhimurium LT2
guggcgagccggaagucauua

SEQ ID NO: 1825192 - RNA, 22 nt, Salmonella typhimurium LT2
guggcgacgccuauucucgccg

SEQ ID NO: 1825193 - RNA, 13 nt, Salmonella typhimurium LT2
guggccuuaucca

SEQ ID NO: 1825194 - RNA, 15 nt, Salmonella typhimurium LT2
guggcaucuuaucag

SEQ ID NO: 1825195 - RNA, 21 nt, Salmonella typhimurium LT2
guggcgguaucaaugcgacag

SEQ ID NO: 1825196 - RNA, 15 nt, Salmonella typhimurium LT2
guggcguaaacgcca

SEQ ID NO: 1825197 - RNA, 23 nt, Salmonella typhimurium LT2
guggcgcugcgcuuaccgggccu

SEQ ID NO: 1825198 - RNA, 19 nt, Salmonella typhimurium LT2
guggcgcuggcgcuuaccg

SEQ ID NO: 1825199 - RNA, 18 nt, Salmonella typhimurium LT2
guggcgcuucgcuuaccg

SEQ ID NO: 1825200 - RNA, 18 nt, Salmonella typhimurium LT2
guggcgcugcgcuuacca

SEQ ID NO: 1825201 - RNA, 18 nt, Salmonella typhimurium LT2
guggcgcaaccgauagcu

SEQ ID NO: 1825202 - RNA, 16 nt, Salmonella typhimurium LT2
guggcgccugcggcag

SEQ ID NO: 1825203 - RNA, 21 nt, Salmonella typhimurium LT2
gugggacguuuggcuuauccg

SEQ ID NO: 1825204 - RNA, 18 nt, Salmonella typhimurium LT2
guggggauaucuucgaug

SEQ ID NO: 1825205 - RNA, 14 nt, Salmonella typhimurium LT2
gugguauucagccc

SEQ ID NO: 1825206 - RNA, 13 nt, Salmonella typhimurium LT2
guggguuccagcg

SEQ ID NO: 1825207 - RNA, 18 nt, Salmonella typhimurium LT2
guggucaucgcggccagc

SEQ ID NO: 1825208 - RNA, 14 nt, Salmonella typhimurium LT2
gugccggauggcgu

SEQ ID NO: 1825209 - RNA, 23 nt, Salmonella typhimurium LT2
gugcccggcaugucgccagccag

SEQ ID NO: 1825210 - RNA, 18 nt, Salmonella typhimurium LT2
gugcgccagccuuauccc

SEQ ID NO: 1825211 - RNA, 12 nt, Salmonella typhimurium LT2
gugcgccagcgc

SEQ ID NO: 1825212 - RNA, 21 nt, Salmonella typhimurium LT2
gugcgccccagcaugagccag

SEQ ID NO: 1825213 - RNA, 22 nt, Salmonella typhimurium LT2
gugccugccgcagaagcgacau

SEQ ID NO: 1825214 - RNA, 15 nt, Salmonella typhimurium LT2
gugccugcgcuuacg

SEQ ID NO: 1825215 - RNA, 18 nt, Salmonella typhimurium LT2
gugcgguauaucacgcca

SEQ ID NO: 1825216 - RNA, 15 nt, Salmonella typhimurium LT2
gugcgccgcagcgcc

SEQ ID NO: 1825217 - RNA, 21 nt, Salmonella typhimurium LT2
gugcuacgggcgcugucgcca

SEQ ID NO: 1825218 - RNA, 12 nt, Salmonella typhimurium LT2
gugaugcgccag

SEQ ID NO: 1825219 - RNA, 12 nt, Salmonella typhimurium LT2
gugaacugcgcc

SEQ ID NO: 1825220 - RNA, 13 nt, Salmonella typhimurium LT2
gugaaccgguaaa

SEQ ID NO: 1825221 - RNA, 22 nt, Salmonella typhimurium LT2
gugccauauucucuggcgcgaa

SEQ ID NO: 1825222 - RNA, 17 nt, Salmonella typhimurium LT2
gugccagggcggaagca

SEQ ID NO: 1825223 - RNA, 16 nt, Salmonella typhimurium LT2
gucaucaccuccagca

SEQ ID NO: 1825224 - RNA, 14 nt, Salmonella typhimurium LT2
gucauaacgcgcau

SEQ ID NO: 1825225 - RNA, 16 nt, Salmonella typhimurium LT2
gucaucauugcgccaa

SEQ ID NO: 1825226 - RNA, 13 nt, Salmonella typhimurium LT2
gucauccagacua

SEQ ID NO: 1825227 - RNA, 19 nt, Salmonella typhimurium LT2
gucauccgguucauaaucc

SEQ ID NO: 1825228 - RNA, 23 nt, Salmonella typhimurium LT2
gucauccccccgccgcuggcgag

SEQ ID NO: 1825229 - RNA, 15 nt, Salmonella typhimurium LT2
gucaucgcucaucuc

SEQ ID NO: 1825230 - RNA, 20 nt, Salmonella typhimurium LT2
gucauuccuuccacgcguac

SEQ ID NO: 1825231 - RNA, 19 nt, Salmonella typhimurium LT2
gucauugcuaugccugaaa

SEQ ID NO: 1825232 - RNA, 12 nt, Salmonella typhimurium LT2
gucauuaaaaug

SEQ ID NO: 1825233 - RNA, 12 nt, Salmonella typhimurium LT2
gucaugcggaug

SEQ ID NO: 1825234 - RNA, 19 nt, Salmonella typhimurium LT2
gucagcguuacuggcguaa

SEQ ID NO: 1825235 - RNA, 14 nt, Salmonella typhimurium LT2
gucagcgcgagcgu

SEQ ID NO: 1825236 - RNA, 19 nt, Salmonella typhimurium LT2
gucagcguaccagcgguca

SEQ ID NO: 1825237 - RNA, 19 nt, Salmonella typhimurium LT2
gucaggcgaccaauauccg

SEQ ID NO: 1825238 - RNA, 22 nt, Salmonella typhimurium LT2
gucaguacgcccgugacgccag

SEQ ID NO: 1825239 - RNA, 13 nt, Salmonella typhimurium LT2
gucaguacgcgcg

SEQ ID NO: 1825240 - RNA, 19 nt, Salmonella typhimurium LT2
gucaguaagauuugcgccg

SEQ ID NO: 1825241 - RNA, 22 nt, Salmonella typhimurium LT2
gucagucccgggcuaaucgcaa

SEQ ID NO: 1825242 - RNA, 20 nt, Salmonella typhimurium LT2
guccaacuggcuuucaucca

SEQ ID NO: 1825243 - RNA, 18 nt, Salmonella typhimurium LT2
guccaacuggcugcgccg

SEQ ID NO: 1825244 - RNA, 21 nt, Salmonella typhimurium LT2
guccaacaaggauauccgcca

SEQ ID NO: 1825245 - RNA, 14 nt, Salmonella typhimurium LT2
guccagcagccaug

SEQ ID NO: 1825246 - RNA, 18 nt, Salmonella typhimurium LT2
guccagccuguccagaua

SEQ ID NO: 1825247 - RNA, 17 nt, Salmonella typhimurium LT2
guccagaccaaucaugu

SEQ ID NO: 1825248 - RNA, 14 nt, Salmonella typhimurium LT2
gucccaucgcgcca

SEQ ID NO: 1825249 - RNA, 18 nt, Salmonella typhimurium LT2
gucccaucguaacgccgu

SEQ ID NO: 1825250 - RNA, 16 nt, Salmonella typhimurium LT2
guccaggguguucacc

SEQ ID NO: 1825251 - RNA, 18 nt, Salmonella typhimurium LT2
gucccaccagcgcggcac

SEQ ID NO: 1825252 - RNA, 17 nt, Salmonella typhimurium LT2
guauuaagcauuacccc

SEQ ID NO: 1825253 - RNA, 15 nt, Salmonella typhimurium LT2
guaucgcgccgccaa

SEQ ID NO: 1825254 - RNA, 20 nt, Salmonella typhimurium LT2
guaggucagguaagcgcuag

SEQ ID NO: 1825255 - RNA, 17 nt, Salmonella typhimurium LT2
gucaaacacgaccagcg

SEQ ID NO: 1825256 - RNA, 20 nt, Salmonella typhimurium LT2
gucaaaaccaaacagcgaca

SEQ ID NO: 1825257 - RNA, 16 nt, Salmonella typhimurium LT2
guauuuucuaucgcau

SEQ ID NO: 1825258 - RNA, 14 nt, Salmonella typhimurium LT2
guauugagcagcgg

SEQ ID NO: 1825259 - RNA, 21 nt, Salmonella typhimurium LT2
guauucccccugauagcgagc

SEQ ID NO: 1825260 - RNA, 14 nt, Salmonella typhimurium LT2
gucaauuuccucga

SEQ ID NO: 1825261 - RNA, 16 nt, Salmonella typhimurium LT2
gucaccaggaugccaa

SEQ ID NO: 1825262 - RNA, 17 nt, Salmonella typhimurium LT2
gucacuaacuccagcau

SEQ ID NO: 1825263 - RNA, 21 nt, Salmonella typhimurium LT2
gucacuggccauuugcggaau

SEQ ID NO: 1825264 - RNA, 13 nt, Salmonella typhimurium LT2
gucagcaguuuua

SEQ ID NO: 1825265 - RNA, 17 nt, Salmonella typhimurium LT2
guagaucuuuugcgccu

SEQ ID NO: 1825266 - RNA, 17 nt, Salmonella typhimurium LT2
guagcgucuuauccggc

SEQ ID NO: 1825267 - RNA, 20 nt, Salmonella typhimurium LT2
guaggccggauaagcguuag

SEQ ID NO: 1825268 - RNA, 19 nt, Salmonella typhimurium LT2
guaggcccgguaagcgcag

SEQ ID NO: 1825269 - RNA, 19 nt, Salmonella typhimurium LT2
guaggccugguaagcgcag

SEQ ID NO: 1825270 - RNA, 19 nt, Salmonella typhimurium LT2
guaggccugguaagcguag

SEQ ID NO: 1825271 - RNA, 14 nt, Salmonella typhimurium LT2
guacggccaccagg

SEQ ID NO: 1825272 - RNA, 20 nt, Salmonella typhimurium LT2
guacggaugggguaucgcca

SEQ ID NO: 1825273 - RNA, 13 nt, Salmonella typhimurium LT2
guacggcgcgaau

SEQ ID NO: 1825274 - RNA, 18 nt, Salmonella typhimurium LT2
guaaucccggucgcgcca

SEQ ID NO: 1825275 - RNA, 19 nt, Salmonella typhimurium LT2
guaagcggcggaccagcgu

SEQ ID NO: 1825276 - RNA, 21 nt, Salmonella typhimurium LT2
guaauaaaaaauuccgugaga

SEQ ID NO: 1825277 - RNA, 22 nt, Salmonella typhimurium LT2
guaauaacgaacugauggcgcu

SEQ ID NO: 1825278 - RNA, 15 nt, Salmonella typhimurium LT2
guaauaaagcguagc

SEQ ID NO: 1825279 - RNA, 14 nt, Salmonella typhimurium LT2
guagaccgcaucga

SEQ ID NO: 1825280 - RNA, 23 nt, Salmonella typhimurium LT2
guagacccggcauugaaacgcau

SEQ ID NO: 1825281 - RNA, 18 nt, Salmonella typhimurium LT2
guacucuuuuuccgcgag

SEQ ID NO: 1825282 - RNA, 17 nt, Salmonella typhimurium LT2
guacugaaugccauccc

SEQ ID NO: 1825283 - RNA, 16 nt, Salmonella typhimurium LT2
guacugcaacgcgcau

SEQ ID NO: 1825284 - RNA, 16 nt, Salmonella typhimurium LT2
ggugcuugcgccgcca

SEQ ID NO: 1825285 - RNA, 15 nt, Salmonella typhimurium LT2
ggugcgacaccacgc

SEQ ID NO: 1825286 - RNA, 20 nt, Salmonella typhimurium LT2
ggugcgccgcagcgccugcg

SEQ ID NO: 1825287 - RNA, 11 nt, Salmonella typhimurium LT2
ggugcccaucg

SEQ ID NO: 1825288 - RNA, 23 nt, Salmonella typhimurium LT2
guaaaacaaaaaaacggccucaa

SEQ ID NO: 1825289 - RNA, 16 nt, Salmonella typhimurium LT2
gguuucuaucccuucg

SEQ ID NO: 1825290 - RNA, 14 nt, Salmonella typhimurium LT2
gguuucgaccagca

SEQ ID NO: 1825291 - RNA, 20 nt, Salmonella typhimurium LT2
gguugcgcccuuccgucagc

SEQ ID NO: 1825292 - RNA, 17 nt, Salmonella typhimurium LT2
gguuguuugggcgcaua

SEQ ID NO: 1825293 - RNA, 14 nt, Salmonella typhimurium LT2
guaaacggcgcuga

SEQ ID NO: 1825294 - RNA, 12 nt, Salmonella typhimurium LT2
guaaaaucagcg

SEQ ID NO: 1825295 - RNA, 16 nt, Salmonella typhimurium LT2
guaaaaucagcagcga

SEQ ID NO: 1825296 - RNA, 19 nt, Salmonella typhimurium LT2
guaaagaagccgccgccau

SEQ ID NO: 1825297 - RNA, 21 nt, Salmonella typhimurium LT2
guaaaccucuuuggcgcgaac

SEQ ID NO: 1825298 - RNA, 14 nt, Salmonella typhimurium LT2
guaaacgcugcgca

SEQ ID NO: 1825299 - RNA, 13 nt, Salmonella typhimurium LT2
gguguacagcgcg

SEQ ID NO: 1825300 - RNA, 13 nt, Salmonella typhimurium LT2
gguguucaccauu

SEQ ID NO: 1825301 - RNA, 15 nt, Salmonella typhimurium LT2
gguucgggcagcgcu

SEQ ID NO: 1825302 - RNA, 19 nt, Salmonella typhimurium LT2
ggucugcaugccgcaggcc

SEQ ID NO: 1825303 - RNA, 20 nt, Salmonella typhimurium LT2
ggucugauaagcgcagcgcc

SEQ ID NO: 1825304 - RNA, 23 nt, Salmonella typhimurium LT2
ggucucucgugcaggccggauaa

SEQ ID NO: 1825305 - RNA, 21 nt, Salmonella typhimurium LT2
ggucucuucaugcauaaccgc

SEQ ID NO: 1825306 - RNA, 16 nt, Salmonella typhimurium LT2
ggucggcuacgacagg

SEQ ID NO: 1825307 - RNA, 19 nt, Salmonella typhimurium LT2
ggugaugaaggucggcuga

SEQ ID NO: 1825308 - RNA, 23 nt, Salmonella typhimurium LT2
ggugcaagcaccuuauccggccu

SEQ ID NO: 1825309 - RNA, 20 nt, Salmonella typhimurium LT2
ggugcaagcaccuuauccgg

SEQ ID NO: 1825310 - RNA, 13 nt, Salmonella typhimurium LT2
gggucuuccagca

SEQ ID NO: 1825311 - RNA, 17 nt, Salmonella typhimurium LT2
ggucauuauucaggccu

SEQ ID NO: 1825312 - RNA, 15 nt, Salmonella typhimurium LT2
ggucauuuuacugcg

SEQ ID NO: 1825313 - RNA, 12 nt, Salmonella typhimurium LT2
ggucaugcggau

SEQ ID NO: 1825314 - RNA, 22 nt, Salmonella typhimurium LT2
ggucgcgccaaaagaggcagca

SEQ ID NO: 1825315 - RNA, 24 nt, Salmonella typhimurium LT2
ggucgcgccaaaagaggcagcaaa

SEQ ID NO: 1825316 - RNA, 22 nt, Salmonella typhimurium LT2
ggcgagaacucgucuuauccgg

SEQ ID NO: 1825317 - RNA, 14 nt, Salmonella typhimurium LT2
ggcgacuaucgccg

SEQ ID NO: 1825318 - RNA, 17 nt, Salmonella typhimurium LT2
ggcgacucauuacgcca

SEQ ID NO: 1825319 - RNA, 23 nt, Salmonella typhimurium LT2
ggcgacuaacgucuuauccggcc

SEQ ID NO: 1825320 - RNA, 19 nt, Salmonella typhimurium LT2
ggcgacgauagucagcgca

SEQ ID NO: 1825321 - RNA, 20 nt, Salmonella typhimurium LT2
ggcgacgcaggcgccuuauc

SEQ ID NO: 1825322 - RNA, 21 nt, Salmonella typhimurium LT2
ggcgacgccucguuugcugag

SEQ ID NO: 1825323 - RNA, 23 nt, Salmonella typhimurium LT2
ggcgacgcguggcaucuuaucag

SEQ ID NO: 1825324 - RNA, 17 nt, Salmonella typhimurium LT2
ggcgaccaguuauucgg

SEQ ID NO: 1825325 - RNA, 15 nt, Salmonella typhimurium LT2
ggcgacccgcccacg

SEQ ID NO: 1825326 - RNA, 20 nt, Salmonella typhimurium LT2
ggcgaccuucacgccgccaa

SEQ ID NO: 1825327 - RNA, 14 nt, Salmonella typhimurium LT2
ggcgacaucgccaa

SEQ ID NO: 1825328 - RNA, 20 nt, Salmonella typhimurium LT2
ggcgaacaggcucagcgcca

SEQ ID NO: 1825329 - RNA, 20 nt, Salmonella typhimurium LT2
ggcgacaaugcucucuucgc

SEQ ID NO: 1825330 - RNA, 19 nt, Salmonella typhimurium LT2
ggcgaggaacaucagccag

SEQ ID NO: 1825331 - RNA, 16 nt, Salmonella typhimurium LT2
ggcgagcuucucgccg

SEQ ID NO: 1825332 - RNA, 19 nt, Salmonella typhimurium LT2
ggcgagggaaaacaucgcc

SEQ ID NO: 1825333 - RNA, 18 nt, Salmonella typhimurium LT2
ggcgauaaccucucaccg

SEQ ID NO: 1825334 - RNA, 21 nt, Salmonella typhimurium LT2
ggcgauaccgguacggaacgu

SEQ ID NO: 1825335 - RNA, 18 nt, Salmonella typhimurium LT2
ggcgauacuccgacggcg

SEQ ID NO: 1825336 - RNA, 13 nt, Salmonella typhimurium LT2
ggcgauagcccca

SEQ ID NO: 1825337 - RNA, 18 nt, Salmonella typhimurium LT2
ggcgagguuuaccguccg

SEQ ID NO: 1825338 - RNA, 15 nt, Salmonella typhimurium LT2
ggcgaguuaagcgcc

SEQ ID NO: 1825339 - RNA, 22 nt, Salmonella typhimurium LT2
ggcgauaguguggucgucagcc

SEQ ID NO: 1825340 - RNA, 22 nt, Salmonella typhimurium LT2
ggcgaucaauaaaauuauccag

SEQ ID NO: 1825341 - RNA, 20 nt, Salmonella typhimurium LT2
ggcgaucaccagcaccgcca

SEQ ID NO: 1825342 - RNA, 17 nt, Salmonella typhimurium LT2
ggcgaucagacgcuggu

SEQ ID NO: 1825343 - RNA, 12 nt, Salmonella typhimurium LT2
ggcgaucaggca

SEQ ID NO: 1825344 - RNA, 13 nt, Salmonella typhimurium LT2
ggcgcacaggccu

SEQ ID NO: 1825345 - RNA, 13 nt, Salmonella typhimurium LT2
ggcgaugccguua

SEQ ID NO: 1825346 - RNA, 14 nt, Salmonella typhimurium LT2
ggccgcguuaucgg

SEQ ID NO: 1825347 - RNA, 23 nt, Salmonella typhimurium LT2
ggccggauaagacgcuacgcguc

SEQ ID NO: 1825348 - RNA, 19 nt, Salmonella typhimurium LT2
ggccggauaaggcguaacc

SEQ ID NO: 1825349 - RNA, 22 nt, Salmonella typhimurium LT2
ggccggauaaggcauucacgcc

SEQ ID NO: 1825350 - RNA, 20 nt, Salmonella typhimurium LT2
ggccggauaaggcguaacac

SEQ ID NO: 1825351 - RNA, 20 nt, Salmonella typhimurium LT2
ggccugauaagcgaagcgcc

SEQ ID NO: 1825352 - RNA, 20 nt, Salmonella typhimurium LT2
ggccugauaagcgcagcgcc

SEQ ID NO: 1825353 - RNA, 14 nt, Salmonella typhimurium LT2
ggccugagcgcgca

SEQ ID NO: 1825354 - RNA, 13 nt, Salmonella typhimurium LT2
ggccugauaggcc

SEQ ID NO: 1825355 - RNA, 22 nt, Salmonella typhimurium LT2
ggccugauaagcguagcgccau

SEQ ID NO: 1825356 - RNA, 23 nt, Salmonella typhimurium LT2
ggccuacaagaucgcaacgugca

SEQ ID NO: 1825357 - RNA, 12 nt, Salmonella typhimurium LT2
ggccuaucaggc

SEQ ID NO: 1825358 - RNA, 24 nt, Salmonella typhimurium LT2
ggccuacaaaaucgcccaggucug

SEQ ID NO: 1825359 - RNA, 13 nt, Salmonella typhimurium LT2
ggcaggcaaaucu

SEQ ID NO: 1825360 - RNA, 13 nt, Salmonella typhimurium LT2
ggcagugcauaaa

SEQ ID NO: 1825361 - RNA, 19 nt, Salmonella typhimurium LT2
ggcauaaaaaagaggaaug

SEQ ID NO: 1825362 - RNA, 21 nt, Salmonella typhimurium LT2
ggcauaaugccacgagaaauc

SEQ ID NO: 1825363 - RNA, 15 nt, Salmonella typhimurium LT2
ggcauacaccgccag

SEQ ID NO: 1825364 - RNA, 17 nt, Salmonella typhimurium LT2
ggcauaaccgcagcgcg

SEQ ID NO: 1825365 - RNA, 18 nt, Salmonella typhimurium LT2
ggcauaaacgccucaucc

SEQ ID NO: 1825366 - RNA, 16 nt, Salmonella typhimurium LT2
ggcagccguuuuccgg

SEQ ID NO: 1825367 - RNA, 22 nt, Salmonella typhimurium LT2
ggauguaccgcuacgcaggcca

SEQ ID NO: 1825368 - RNA, 21 nt, Salmonella typhimurium LT2
ggcagauaaaccacgccgucg

SEQ ID NO: 1825369 - RNA, 17 nt, Salmonella typhimurium LT2
ggcauugauaaagcgcu

SEQ ID NO: 1825370 - RNA, 14 nt, Salmonella typhimurium LT2
ggcauugcagcgcg

SEQ ID NO: 1825371 - RNA, 15 nt, Salmonella typhimurium LT2
ggccaacuuauccga

SEQ ID NO: 1825372 - RNA, 17 nt, Salmonella typhimurium LT2
ggccacaauugccagca

SEQ ID NO: 1825373 - RNA, 15 nt, Salmonella typhimurium LT2
ggcaucagauuuagg

SEQ ID NO: 1825374 - RNA, 23 nt, Salmonella typhimurium LT2
ggcauucaguuucuucggcuuca

SEQ ID NO: 1825375 - RNA, 14 nt, Salmonella typhimurium LT2
ggccaccagcacaa

SEQ ID NO: 1825376 - RNA, 16 nt, Salmonella typhimurium LT2
ggccacucuccagcau

SEQ ID NO: 1825377 - RNA, 19 nt, Salmonella typhimurium LT2
ggccagauggcaaacggua

SEQ ID NO: 1825378 - RNA, 12 nt, Salmonella typhimurium LT2
ggccagcagcca

SEQ ID NO: 1825379 - RNA, 14 nt, Salmonella typhimurium LT2
ggccagauggcaaa

SEQ ID NO: 1825380 - RNA, 14 nt, Salmonella typhimurium LT2
ggccagcagcgcau

SEQ ID NO: 1825381 - RNA, 17 nt, Salmonella typhimurium LT2
ggccacugcuggcccag

SEQ ID NO: 1825382 - RNA, 18 nt, Salmonella typhimurium LT2
ggccaugaucgccgccau

SEQ ID NO: 1825383 - RNA, 17 nt, Salmonella typhimurium LT2
ggccaucgccgccauca

SEQ ID NO: 1825384 - RNA, 22 nt, Salmonella typhimurium LT2
ggccaguugcuucauaucgcca

SEQ ID NO: 1825385 - RNA, 21 nt, Salmonella typhimurium LT2
ggccauaauacgcuugcgcca

SEQ ID NO: 1825386 - RNA, 12 nt, Salmonella typhimurium LT2
ggccagcgacac

SEQ ID NO: 1825387 - RNA, 15 nt, Salmonella typhimurium LT2
ggccagcgacacgcc

SEQ ID NO: 1825388 - RNA, 11 nt, Salmonella typhimurium LT2
ggccagcgacu

SEQ ID NO: 1825389 - RNA, 14 nt, Salmonella typhimurium LT2
ggccgacagacgcc

SEQ ID NO: 1825390 - RNA, 15 nt, Salmonella typhimurium LT2
ggcggcguuuuccgg

SEQ ID NO: 1825391 - RNA, 19 nt, Salmonella typhimurium LT2
ggcggcuaccucuuauccg

SEQ ID NO: 1825392 - RNA, 20 nt, Salmonella typhimurium LT2
ggcggcuaccucuuauccgg

SEQ ID NO: 1825393 - RNA, 23 nt, Salmonella typhimurium LT2
ggcggcgugaacgucuuauccgg

SEQ ID NO: 1825394 - RNA, 20 nt, Salmonella typhimurium LT2
ggcggcgugaacgucuuauc

SEQ ID NO: 1825395 - RNA, 23 nt, Salmonella typhimurium LT2
ggcggcguaaacacguuaucuga

SEQ ID NO: 1825396 - RNA, 23 nt, Salmonella typhimurium LT2
ggcggcgcgaacgccuuauccgg

SEQ ID NO: 1825397 - RNA, 20 nt, Salmonella typhimurium LT2
ggcggcgcgaacgccuuauc

SEQ ID NO: 1825398 - RNA, 19 nt, Salmonella typhimurium LT2
ggcggcgaaacgccuuauc

SEQ ID NO: 1825399 - RNA, 22 nt, Salmonella typhimurium LT2
ggcggaaaggacuuaucaggcc

SEQ ID NO: 1825400 - RNA, 18 nt, Salmonella typhimurium LT2
ggcggcagcuuacugugc

SEQ ID NO: 1825401 - RNA, 18 nt, Salmonella typhimurium LT2
ggcgcuggcgcuuaccgg

SEQ ID NO: 1825402 - RNA, 19 nt, Salmonella typhimurium LT2
ggcgcuacgcuuaucaggc

SEQ ID NO: 1825403 - RNA, 19 nt, Salmonella typhimurium LT2
ggcgcuagccgcauccggc

SEQ ID NO: 1825404 - RNA, 17 nt, Salmonella typhimurium LT2
ggcgcuacgcuuauccg

SEQ ID NO: 1825405 - RNA, 20 nt, Salmonella typhimurium LT2
ggcgcuacgcuuauccggcu

SEQ ID NO: 1825406 - RNA, 17 nt, Salmonella typhimurium LT2
ggcgcuaagccagccaa

SEQ ID NO: 1825407 - RNA, 17 nt, Salmonella typhimurium LT2
ggcgcucaacagccaga

SEQ ID NO: 1825408 - RNA, 19 nt, Salmonella typhimurium LT2
ggcgcuaucgccuccagac

SEQ ID NO: 1825409 - RNA, 13 nt, Salmonella typhimurium LT2
ggcgcggcguagc

SEQ ID NO: 1825410 - RNA, 17 nt, Salmonella typhimurium LT2
ggcgcggcgacgccucg

SEQ ID NO: 1825411 - RNA, 19 nt, Salmonella typhimurium LT2
ggcgcggaaagccuucauc

SEQ ID NO: 1825412 - RNA, 14 nt, Salmonella typhimurium LT2
ggcguugcccaucg

SEQ ID NO: 1825413 - RNA, 13 nt, Salmonella typhimurium LT2
ggcuaacgccggu

SEQ ID NO: 1825414 - RNA, 20 nt, Salmonella typhimurium LT2
ggcguguuguaaaacgcgcc

SEQ ID NO: 1825415 - RNA, 19 nt, Salmonella typhimurium LT2
ggcucaucaaacagcggca

SEQ ID NO: 1825416 - RNA, 11 nt, Salmonella typhimurium LT2
ggcuccagcac

SEQ ID NO: 1825417 - RNA, 11 nt, Salmonella typhimurium LT2
ggcuccagcgc

SEQ ID NO: 1825418 - RNA, 16 nt, Salmonella typhimurium LT2
ggcucagauugaacgc

SEQ ID NO: 1825419 - RNA, 14 nt, Salmonella typhimurium LT2
ggcucgcccgcgcu

SEQ ID NO: 1825420 - RNA, 14 nt, Salmonella typhimurium LT2
ggcguaaaucaggc

SEQ ID NO: 1825421 - RNA, 15 nt, Salmonella typhimurium LT2
ggcguaaaucaggcc

SEQ ID NO: 1825422 - RNA, 16 nt, Salmonella typhimurium LT2
ggcguaagaucgcgag

SEQ ID NO: 1825423 - RNA, 22 nt, Salmonella typhimurium LT2
ggcguaaacaccuuauccggcc

SEQ ID NO: 1825424 - RNA, 21 nt, Salmonella typhimurium LT2
ggcguaaagauuagaauagcc

SEQ ID NO: 1825425 - RNA, 14 nt, Salmonella typhimurium LT2
ggcgguuuauccgg

SEQ ID NO: 1825426 - RNA, 18 nt, Salmonella typhimurium LT2
ggcgguuugacggcugca

SEQ ID NO: 1825427 - RNA, 12 nt, Salmonella typhimurium LT2
ggcgguucgcca

SEQ ID NO: 1825428 - RNA, 13 nt, Salmonella typhimurium LT2
ggcguaccaucag

SEQ ID NO: 1825429 - RNA, 17 nt, Salmonella typhimurium LT2
ggcguacuaaauaggcg

SEQ ID NO: 1825430 - RNA, 14 nt, Salmonella typhimurium LT2
ggcguaagcgacau

SEQ ID NO: 1825431 - RNA, 20 nt, Salmonella typhimurium LT2
ggcggugcgcagccacggcg

SEQ ID NO: 1825432 - RNA, 18 nt, Salmonella typhimurium LT2
ggcgucaucauugcgcca

SEQ ID NO: 1825433 - RNA, 14 nt, Salmonella typhimurium LT2
ggcgucauccggcg

SEQ ID NO: 1825434 - RNA, 20 nt, Salmonella typhimurium LT2
ggcgucagccgccaucaggc

SEQ ID NO: 1825435 - RNA, 13 nt, Salmonella typhimurium LT2
ggcgucacggcga

SEQ ID NO: 1825436 - RNA, 13 nt, Salmonella typhimurium LT2
ggcguauuaucgg

SEQ ID NO: 1825437 - RNA, 23 nt, Salmonella typhimurium LT2
ggcgucccuuucccuuccagcga

SEQ ID NO: 1825438 - RNA, 18 nt, Salmonella typhimurium LT2
ggcgucccggucggcgca

SEQ ID NO: 1825439 - RNA, 15 nt, Salmonella typhimurium LT2
ggcguccugcccgcc

SEQ ID NO: 1825440 - RNA, 16 nt, Salmonella typhimurium LT2
ggcguccugcccgcca

SEQ ID NO: 1825441 - RNA, 14 nt, Salmonella typhimurium LT2
ggggcauuuuccgg

SEQ ID NO: 1825442 - RNA, 16 nt, Salmonella typhimurium LT2
ggggaaacccacgacc

SEQ ID NO: 1825443 - RNA, 15 nt, Salmonella typhimurium LT2
gggcuuaaugcgcac

SEQ ID NO: 1825444 - RNA, 21 nt, Salmonella typhimurium LT2
gggguuuguccugcagcgcca

SEQ ID NO: 1825445 - RNA, 14 nt, Salmonella typhimurium LT2
ggguaauggucagc

SEQ ID NO: 1825446 - RNA, 13 nt, Salmonella typhimurium LT2
ggguaauuucuuc

SEQ ID NO: 1825447 - RNA, 17 nt, Salmonella typhimurium LT2
gggucaguacgcgcgua

SEQ ID NO: 1825448 - RNA, 18 nt, Salmonella typhimurium LT2
ggguauuuuuuagcgcca

SEQ ID NO: 1825449 - RNA, 17 nt, Salmonella typhimurium LT2
gggaugaugccacaggc

SEQ ID NO: 1825450 - RNA, 22 nt, Salmonella typhimurium LT2
gggauaucgcuggccuccagca

SEQ ID NO: 1825451 - RNA, 19 nt, Salmonella typhimurium LT2
gggcaacgggccggguucg

SEQ ID NO: 1825452 - RNA, 14 nt, Salmonella typhimurium LT2
gggauaacaguauu

SEQ ID NO: 1825453 - RNA, 17 nt, Salmonella typhimurium LT2
gggauaaucagcagcga

SEQ ID NO: 1825454 - RNA, 17 nt, Salmonella typhimurium LT2
gggagaaaacgcggccu

SEQ ID NO: 1825455 - RNA, 13 nt, Salmonella typhimurium LT2
ggcuucccaucgc

SEQ ID NO: 1825456 - RNA, 23 nt, Salmonella typhimurium LT2
ggcuuacgaguggcgaucaggca

SEQ ID NO: 1825457 - RNA, 15 nt, Salmonella typhimurium LT2
ggcuucgcgcagcca

SEQ ID NO: 1825458 - RNA, 19 nt, Salmonella typhimurium LT2
ggcuucgcuggucagcgca

SEQ ID NO: 1825459 - RNA, 17 nt, Salmonella typhimurium LT2
ggcuguacuuuaaccgg

SEQ ID NO: 1825460 - RNA, 12 nt, Salmonella typhimurium LT2
gggcgaaaacgc

SEQ ID NO: 1825461 - RNA, 14 nt, Salmonella typhimurium LT2
gggcaagcgaagcg

SEQ ID NO: 1825462 - RNA, 15 nt, Salmonella typhimurium LT2
gggccacucuccagc

SEQ ID NO: 1825463 - RNA, 17 nt, Salmonella typhimurium LT2
gggccacucuccagcau

SEQ ID NO: 1825464 - RNA, 13 nt, Salmonella typhimurium LT2
gccguuaccagca

SEQ ID NO: 1825465 - RNA, 17 nt, Salmonella typhimurium LT2
gccguggcgagccggaa

SEQ ID NO: 1825466 - RNA, 12 nt, Salmonella typhimurium LT2
gccuaacuggaa

SEQ ID NO: 1825467 - RNA, 11 nt, Salmonella typhimurium LT2
gccuacagcau

SEQ ID NO: 1825468 - RNA, 14 nt, Salmonella typhimurium LT2
gccuaacagcgccg

SEQ ID NO: 1825469 - RNA, 13 nt, Salmonella typhimurium LT2
gccuaacagcgcc

SEQ ID NO: 1825470 - RNA, 18 nt, Salmonella typhimurium LT2
gccguuuuggcagcgccc

SEQ ID NO: 1825471 - RNA, 13 nt, Salmonella typhimurium LT2
gccguuuuccggu

SEQ ID NO: 1825472 - RNA, 16 nt, Salmonella typhimurium LT2
gccguuuuaucgcccg

SEQ ID NO: 1825473 - RNA, 16 nt, Salmonella typhimurium LT2
gccguucaccagccac

SEQ ID NO: 1825474 - RNA, 16 nt, Salmonella typhimurium LT2
gccguuaacgggucuu

SEQ ID NO: 1825475 - RNA, 19 nt, Salmonella typhimurium LT2
gccguuauccagucgccag

SEQ ID NO: 1825476 - RNA, 19 nt, Salmonella typhimurium LT2
gccguucaugcacucgcga

SEQ ID NO: 1825477 - RNA, 17 nt, Salmonella typhimurium LT2
gccuacgacagcgcugg

SEQ ID NO: 1825478 - RNA, 17 nt, Salmonella typhimurium LT2
gccucagugaaucgcau

SEQ ID NO: 1825479 - RNA, 14 nt, Salmonella typhimurium LT2
gccuaccagcacau

SEQ ID NO: 1825480 - RNA, 17 nt, Salmonella typhimurium LT2
gccguaaauuccuuguu

SEQ ID NO: 1825481 - RNA, 19 nt, Salmonella typhimurium LT2
gccguacuccagcccauca

SEQ ID NO: 1825482 - RNA, 19 nt, Salmonella typhimurium LT2
gccguaaacaggcaggccc

SEQ ID NO: 1825483 - RNA, 18 nt, Salmonella typhimurium LT2
gccgguugggcgcuuaac

SEQ ID NO: 1825484 - RNA, 19 nt, Salmonella typhimurium LT2
gccgguucggcaucgcccg

SEQ ID NO: 1825485 - RNA, 15 nt, Salmonella typhimurium LT2
gccgucgccggccug

SEQ ID NO: 1825486 - RNA, 20 nt, Salmonella typhimurium LT2
gccguccgaucucguuaacg

SEQ ID NO: 1825487 - RNA, 16 nt, Salmonella typhimurium LT2
gccguauaauccagcu

SEQ ID NO: 1825488 - RNA, 15 nt, Salmonella typhimurium LT2
gccgucauccgcgua

SEQ ID NO: 1825489 - RNA, 23 nt, Salmonella typhimurium LT2
gccgucaggucaugaucgauccg

SEQ ID NO: 1825490 - RNA, 21 nt, Salmonella typhimurium LT2
gccgucaggcuugccgcgcca

SEQ ID NO: 1825491 - RNA, 18 nt, Salmonella typhimurium LT2
gccugauuucugaccgca

SEQ ID NO: 1825492 - RNA, 13 nt, Salmonella typhimurium LT2
gccugauggcgac

SEQ ID NO: 1825493 - RNA, 15 nt, Salmonella typhimurium LT2
gccugauggcgcuuc

SEQ ID NO: 1825494 - RNA, 23 nt, Salmonella typhimurium LT2
gccugauggcgcuacgcuuauca

SEQ ID NO: 1825495 - RNA, 16 nt, Salmonella typhimurium LT2
gccugcauacguuuca

SEQ ID NO: 1825496 - RNA, 20 nt, Salmonella typhimurium LT2
gccugauaagcguagcgcca

SEQ ID NO: 1825497 - RNA, 19 nt, Salmonella typhimurium LT2
gccugauaagcgcagcgca

SEQ ID NO: 1825498 - RNA, 20 nt, Salmonella typhimurium LT2
gccugauaagcauagcgcca

SEQ ID NO: 1825499 - RNA, 20 nt, Salmonella typhimurium LT2
gccugauaagcgaagcgcca

SEQ ID NO: 1825500 - RNA, 23 nt, Salmonella typhimurium LT2
gccugaugagguuacguucauca

SEQ ID NO: 1825501 - RNA, 20 nt, Salmonella typhimurium LT2
gccugaauuagguuacguug

SEQ ID NO: 1825502 - RNA, 11 nt, Salmonella typhimurium LT2
gccugaaugca

SEQ ID NO: 1825503 - RNA, 15 nt, Salmonella typhimurium LT2
gccugagguuucgcc

SEQ ID NO: 1825504 - RNA, 18 nt, Salmonella typhimurium LT2
gccucuuucagccggcua

SEQ ID NO: 1825505 - RNA, 21 nt, Salmonella typhimurium LT2
gccucguuugcugagcagcca

SEQ ID NO: 1825506 - RNA, 17 nt, Salmonella typhimurium LT2
gccucccccucaaucgg

SEQ ID NO: 1825507 - RNA, 20 nt, Salmonella typhimurium LT2
gccugguaagcguagcgcca

SEQ ID NO: 1825508 - RNA, 16 nt, Salmonella typhimurium LT2
gccugguaagcgcagc

SEQ ID NO: 1825509 - RNA, 22 nt, Salmonella typhimurium LT2
gccuguuugacgaaaucgcaua

SEQ ID NO: 1825510 - RNA, 19 nt, Salmonella typhimurium LT2
gccuguucgugcguuguca

SEQ ID NO: 1825511 - RNA, 16 nt, Salmonella typhimurium LT2
gccuguuuacccuucg

SEQ ID NO: 1825512 - RNA, 18 nt, Salmonella typhimurium LT2
gccuuccgcaccgccagu

SEQ ID NO: 1825513 - RNA, 13 nt, Salmonella typhimurium LT2
gccuuauccggcc

SEQ ID NO: 1825514 - RNA, 19 nt, Salmonella typhimurium LT2
gccuuauccggccuacaag

SEQ ID NO: 1825515 - RNA, 15 nt, Salmonella typhimurium LT2
gccuuccaucgcauc

SEQ ID NO: 1825516 - RNA, 13 nt, Salmonella typhimurium LT2
gccuuacguaccg

SEQ ID NO: 1825517 - RNA, 19 nt, Salmonella typhimurium LT2
gccuuacccggccuacaca

SEQ ID NO: 1825518 - RNA, 19 nt, Salmonella typhimurium LT2
gccuucuccgcucaugccu

SEQ ID NO: 1825519 - RNA, 20 nt, Salmonella typhimurium LT2
gccugcaugauuaauacgua

SEQ ID NO: 1825520 - RNA, 14 nt, Salmonella typhimurium LT2
gccugccagcacca

SEQ ID NO: 1825521 - RNA, 22 nt, Salmonella typhimurium LT2
gccugccagcaccagcagcgca

SEQ ID NO: 1825522 - RNA, 22 nt, Salmonella typhimurium LT2
gccugcguuugcggaucgaucu

SEQ ID NO: 1825523 - RNA, 21 nt, Salmonella typhimurium LT2
gccuggcauuuuacuucugac

SEQ ID NO: 1825524 - RNA, 22 nt, Salmonella typhimurium LT2
gccuggcagaaguccccagccg

SEQ ID NO: 1825525 - RNA, 20 nt, Salmonella typhimurium LT2
gccugggauagcgcugcgca

SEQ ID NO: 1825526 - RNA, 17 nt, Salmonella typhimurium LT2
gccuggagagcagcgcc

SEQ ID NO: 1825527 - RNA, 18 nt, Salmonella typhimurium LT2
gccuggagagcagcgcca

SEQ ID NO: 1825528 - RNA, 14 nt, Salmonella typhimurium LT2
gccuggaucugcgc

SEQ ID NO: 1825529 - RNA, 16 nt, Salmonella typhimurium LT2
gcgaugcuaucgguag

SEQ ID NO: 1825530 - RNA, 19 nt, Salmonella typhimurium LT2
gcgaugcgcgagccguaaa

SEQ ID NO: 1825531 - RNA, 13 nt, Salmonella typhimurium LT2
gcgaugauagccg

SEQ ID NO: 1825532 - RNA, 19 nt, Salmonella typhimurium LT2
gcgaugagcgugacgaccg

SEQ ID NO: 1825533 - RNA, 17 nt, Salmonella typhimurium LT2
gcgaugcaaccccugac

SEQ ID NO: 1825534 - RNA, 17 nt, Salmonella typhimurium LT2
gcgaugccaccagccua

SEQ ID NO: 1825535 - RNA, 20 nt, Salmonella typhimurium LT2
gcgaucuucauagucgcuuu

SEQ ID NO: 1825536 - RNA, 22 nt, Salmonella typhimurium LT2
gcgaucugugucguccgggccu

SEQ ID NO: 1825537 - RNA, 16 nt, Salmonella typhimurium LT2
gcgaugaacaucgaca

SEQ ID NO: 1825538 - RNA, 20 nt, Salmonella typhimurium LT2
gcgaugacggcgcguuaucg

SEQ ID NO: 1825539 - RNA, 19 nt, Salmonella typhimurium LT2
gcgaugagcgccagcaaca

SEQ ID NO: 1825540 - RNA, 13 nt, Salmonella typhimurium LT2
gcgaugagcgcca

SEQ ID NO: 1825541 - RNA, 14 nt, Salmonella typhimurium LT2
gcgaucugucgccg

SEQ ID NO: 1825542 - RNA, 21 nt, Salmonella typhimurium LT2
gcgaucgggauuccagugaca

SEQ ID NO: 1825543 - RNA, 17 nt, Salmonella typhimurium LT2
gcgaucagcgccaccac

SEQ ID NO: 1825544 - RNA, 15 nt, Salmonella typhimurium LT2
gcgaucaggcgucag

SEQ ID NO: 1825545 - RNA, 20 nt, Salmonella typhimurium LT2
gcgauccagccccagcgcca

SEQ ID NO: 1825546 - RNA, 20 nt, Salmonella typhimurium LT2
gcgauccagcgggccgacga

SEQ ID NO: 1825547 - RNA, 14 nt, Salmonella typhimurium LT2
gcgauccagaccgg

SEQ ID NO: 1825548 - RNA, 22 nt, Salmonella typhimurium LT2
gcgauccaacaauuauauacga

SEQ ID NO: 1825549 - RNA, 13 nt, Salmonella typhimurium LT2
gcgaucacgccgu

SEQ ID NO: 1825550 - RNA, 16 nt, Salmonella typhimurium LT2
gcgcaaucauuaccgg

SEQ ID NO: 1825551 - RNA, 12 nt, Salmonella typhimurium LT2
gcgcaaucgccg

SEQ ID NO: 1825552 - RNA, 14 nt, Salmonella typhimurium LT2
gcgcaaucgggccu

SEQ ID NO: 1825553 - RNA, 13 nt, Salmonella typhimurium LT2
gcgcaaugccgcc

SEQ ID NO: 1825554 - RNA, 23 nt, Salmonella typhimurium LT2
gcgcaauaugaaaccgcccugca

SEQ ID NO: 1825555 - RNA, 19 nt, Salmonella typhimurium LT2
gcgcacacaauagcaaucu

SEQ ID NO: 1825556 - RNA, 13 nt, Salmonella typhimurium LT2
gcgcacagcgcca

SEQ ID NO: 1825557 - RNA, 15 nt, Salmonella typhimurium LT2
gcgcaaacaacccgg

SEQ ID NO: 1825558 - RNA, 21 nt, Salmonella typhimurium LT2
gcgcaaaaucgcaaacgccag

SEQ ID NO: 1825559 - RNA, 23 nt, Salmonella typhimurium LT2
gcgauguauuuauccacgccgcu

SEQ ID NO: 1825560 - RNA, 18 nt, Salmonella typhimurium LT2
gcgauguaagaggccgua

SEQ ID NO: 1825561 - RNA, 21 nt, Salmonella typhimurium LT2
gcgauggucgauauugcuguc

SEQ ID NO: 1825562 - RNA, 13 nt, Salmonella typhimurium LT2
gcgcaaaagcgcg

SEQ ID NO: 1825563 - RNA, 18 nt, Salmonella typhimurium LT2
gcgauuuauccaccgcca

SEQ ID NO: 1825564 - RNA, 16 nt, Salmonella typhimurium LT2
gcgauucaacaggaca

SEQ ID NO: 1825565 - RNA, 14 nt, Salmonella typhimurium LT2
gcgauucaucgaca

SEQ ID NO: 1825566 - RNA, 22 nt, Salmonella typhimurium LT2
gcgauguuuacugcggcgcaac

SEQ ID NO: 1825567 - RNA, 22 nt, Salmonella typhimurium LT2
gcgauguuuuuaucaugcugac

SEQ ID NO: 1825568 - RNA, 20 nt, Salmonella typhimurium LT2
gcgauguucggguaaacgcu

SEQ ID NO: 1825569 - RNA, 16 nt, Salmonella typhimurium LT2
gcgaggcgauaaucuu

SEQ ID NO: 1825570 - RNA, 15 nt, Salmonella typhimurium LT2
gcgacuccaggaaca

SEQ ID NO: 1825571 - RNA, 17 nt, Salmonella typhimurium LT2
gcgacgugacgcgccag

SEQ ID NO: 1825572 - RNA, 17 nt, Salmonella typhimurium LT2
gcgacggagcgugcugu

SEQ ID NO: 1825573 - RNA, 16 nt, Salmonella typhimurium LT2
gcgacgcuuaucagcc

SEQ ID NO: 1825574 - RNA, 23 nt, Salmonella typhimurium LT2
gcgaccggcucgcuguucgccag

SEQ ID NO: 1825575 - RNA, 16 nt, Salmonella typhimurium LT2
gccuuguugcggauga

SEQ ID NO: 1825576 - RNA, 12 nt, Salmonella typhimurium LT2
gcgaaggccagc

SEQ ID NO: 1825577 - RNA, 20 nt, Salmonella typhimurium LT2
gcgaauaaucccggcgccaa

SEQ ID NO: 1825578 - RNA, 20 nt, Salmonella typhimurium LT2
gcgaauaauguuguccacaa

SEQ ID NO: 1825579 - RNA, 23 nt, Salmonella typhimurium LT2
gcgaagugcagcguuuccagcca

SEQ ID NO: 1825580 - RNA, 15 nt, Salmonella typhimurium LT2
gcgaauccagcgccg

SEQ ID NO: 1825581 - RNA, 13 nt, Salmonella typhimurium LT2
gcgaauccagauc

SEQ ID NO: 1825582 - RNA, 18 nt, Salmonella typhimurium LT2
gcgaaucgacaauccgcc

SEQ ID NO: 1825583 - RNA, 15 nt, Salmonella typhimurium LT2
gcgaauagugcagaa

SEQ ID NO: 1825584 - RNA, 23 nt, Salmonella typhimurium LT2
gcgaaucacauccgccagcgccu

SEQ ID NO: 1825585 - RNA, 18 nt, Salmonella typhimurium LT2
gcgaauaccuucccgcga

SEQ ID NO: 1825586 - RNA, 20 nt, Salmonella typhimurium LT2
gcgaauacuguuccaggcga

SEQ ID NO: 1825587 - RNA, 20 nt, Salmonella typhimurium LT2
gcgaaucucgugaucgccaa

SEQ ID NO: 1825588 - RNA, 16 nt, Salmonella typhimurium LT2
gcgacaaacagcgccc

SEQ ID NO: 1825589 - RNA, 17 nt, Salmonella typhimurium LT2
gcgaauuacuaaucugu

SEQ ID NO: 1825590 - RNA, 15 nt, Salmonella typhimurium LT2
gcgaaugcgcgccau

SEQ ID NO: 1825591 - RNA, 17 nt, Salmonella typhimurium LT2
gcgaaugccguuaacgg

SEQ ID NO: 1825592 - RNA, 17 nt, Salmonella typhimurium LT2
gcgaccacgccagccag

SEQ ID NO: 1825593 - RNA, 12 nt, Salmonella typhimurium LT2
gcgaccagcgca

SEQ ID NO: 1825594 - RNA, 15 nt, Salmonella typhimurium LT2
gcgaccagcgcacca

SEQ ID NO: 1825595 - RNA, 13 nt, Salmonella typhimurium LT2
gcgaccggcagcc

SEQ ID NO: 1825596 - RNA, 11 nt, Salmonella typhimurium LT2
gcgaccggcac

SEQ ID NO: 1825597 - RNA, 20 nt, Salmonella typhimurium LT2
gcgaccgcgccggucgccag

SEQ ID NO: 1825598 - RNA, 18 nt, Salmonella typhimurium LT2
gcgccguggaaaagagcg

SEQ ID NO: 1825599 - RNA, 23 nt, Salmonella typhimurium LT2
gcgccugcgccaguucauccagc

SEQ ID NO: 1825600 - RNA, 21 nt, Salmonella typhimurium LT2
gcgccuggaucugcgcauuaa

SEQ ID NO: 1825601 - RNA, 21 nt, Salmonella typhimurium LT2
gcgcgaauaaugcauccgcca

SEQ ID NO: 1825602 - RNA, 23 nt, Salmonella typhimurium LT2
gcgcgaugcgacucggugccgcu

SEQ ID NO: 1825603 - RNA, 16 nt, Salmonella typhimurium LT2
gcgcgccagcgccaau

SEQ ID NO: 1825604 - RNA, 15 nt, Salmonella typhimurium LT2
gcgcgccagcgcauc

SEQ ID NO: 1825605 - RNA, 15 nt, Salmonella typhimurium LT2
gcgcgccagcucuuc

SEQ ID NO: 1825606 - RNA, 20 nt, Salmonella typhimurium LT2
gcgccguccauaaugacgcu

SEQ ID NO: 1825607 - RNA, 19 nt, Salmonella typhimurium LT2
gcgccgucacccgcguauc

SEQ ID NO: 1825608 - RNA, 16 nt, Salmonella typhimurium LT2
gcgccggucgccagca

SEQ ID NO: 1825609 - RNA, 19 nt, Salmonella typhimurium LT2
gcgccaaucaccgccagca

SEQ ID NO: 1825610 - RNA, 12 nt, Salmonella typhimurium LT2
gcgccaagcgcc

SEQ ID NO: 1825611 - RNA, 21 nt, Salmonella typhimurium LT2
gcgcauugcccuucgcgcgau

SEQ ID NO: 1825612 - RNA, 13 nt, Salmonella typhimurium LT2
gcgcauugcuguc

SEQ ID NO: 1825613 - RNA, 21 nt, Salmonella typhimurium LT2
gcgcauucucuguugccgccc

SEQ ID NO: 1825614 - RNA, 22 nt, Salmonella typhimurium LT2
gcgcauucuugcgccgcaaacu

SEQ ID NO: 1825615 - RNA, 19 nt, Salmonella typhimurium LT2
gcgccaaagcaaucgccag

SEQ ID NO: 1825616 - RNA, 18 nt, Salmonella typhimurium LT2
gcgccaaaagaggcagca

SEQ ID NO: 1825617 - RNA, 13 nt, Salmonella typhimurium LT2
gcgccaaacccga

SEQ ID NO: 1825618 - RNA, 16 nt, Salmonella typhimurium LT2
gcgccaauccaugccg

SEQ ID NO: 1825619 - RNA, 19 nt, Salmonella typhimurium LT2
gcgccaccacaaacgccgu

SEQ ID NO: 1825620 - RNA, 17 nt, Salmonella typhimurium LT2
gcgcauuaacacgcucu

SEQ ID NO: 1825621 - RNA, 14 nt, Salmonella typhimurium LT2
gcgccagccacaag

SEQ ID NO: 1825622 - RNA, 22 nt, Salmonella typhimurium LT2
gcgccagccagucgccaggcaa

SEQ ID NO: 1825623 - RNA, 18 nt, Salmonella typhimurium LT2
gcgccauauugcuguauu

SEQ ID NO: 1825624 - RNA, 13 nt, Salmonella typhimurium LT2
gcgccaucaggca

SEQ ID NO: 1825625 - RNA, 15 nt, Salmonella typhimurium LT2
gcgccaucaggcacu

SEQ ID NO: 1825626 - RNA, 14 nt, Salmonella typhimurium LT2
gcgccauccggcau

SEQ ID NO: 1825627 - RNA, 15 nt, Salmonella typhimurium LT2
gcgccauccggcaga

SEQ ID NO: 1825628 - RNA, 14 nt, Salmonella typhimurium LT2
gcgccagcucaucg

SEQ ID NO: 1825629 - RNA, 15 nt, Salmonella typhimurium LT2
gcgccagcucauuaa

SEQ ID NO: 1825630 - RNA, 14 nt, Salmonella typhimurium LT2
gcgcccugcaaaag

SEQ ID NO: 1825631 - RNA, 13 nt, Salmonella typhimurium LT2
gcgccaucgggca

SEQ ID NO: 1825632 - RNA, 16 nt, Salmonella typhimurium LT2
gcgccaugauccagcg

SEQ ID NO: 1825633 - RNA, 18 nt, Salmonella typhimurium LT2
gcgccaucuuucacccau

SEQ ID NO: 1825634 - RNA, 18 nt, Salmonella typhimurium LT2
gcgccaugcgcggcauca

SEQ ID NO: 1825635 - RNA, 16 nt, Salmonella typhimurium LT2
gcgccccguuuccgcg

SEQ ID NO: 1825636 - RNA, 14 nt, Salmonella typhimurium LT2
gcgccccugcgggu

SEQ ID NO: 1825637 - RNA, 17 nt, Salmonella typhimurium LT2
gcgccgccauccggcac

SEQ ID NO: 1825638 - RNA, 14 nt, Salmonella typhimurium LT2
gcgccgcagcgccg

SEQ ID NO: 1825639 - RNA, 14 nt, Salmonella typhimurium LT2
gcgccgcagcgccu

SEQ ID NO: 1825640 - RNA, 21 nt, Salmonella typhimurium LT2
gcggaacgucuuuuuccagca

SEQ ID NO: 1825641 - RNA, 14 nt, Salmonella typhimurium LT2
gcggaagcgaccgg

SEQ ID NO: 1825642 - RNA, 23 nt, Salmonella typhimurium LT2
gcggaaccauuuuccccagaauc

SEQ ID NO: 1825643 - RNA, 15 nt, Salmonella typhimurium LT2
gcggaacaucgcuuu

SEQ ID NO: 1825644 - RNA, 13 nt, Salmonella typhimurium LT2
gcggaaugcccac

SEQ ID NO: 1825645 - RNA, 13 nt, Salmonella typhimurium LT2
gcggagaucgcuu

SEQ ID NO: 1825646 - RNA, 20 nt, Salmonella typhimurium LT2
gcggacucgcuggacauuaa

SEQ ID NO: 1825647 - RNA, 20 nt, Salmonella typhimurium LT2
gcggacggcuaauaugccag

SEQ ID NO: 1825648 - RNA, 15 nt, Salmonella typhimurium LT2
gcggauaugcagcag

SEQ ID NO: 1825649 - RNA, 16 nt, Salmonella typhimurium LT2
gcggauagacgauaua

SEQ ID NO: 1825650 - RNA, 19 nt, Salmonella typhimurium LT2
gcggauaagcgcagcgcca

SEQ ID NO: 1825651 - RNA, 15 nt, Salmonella typhimurium LT2
gcggauaauccgcca

SEQ ID NO: 1825652 - RNA, 14 nt, Salmonella typhimurium LT2
gcggauccggcgca

SEQ ID NO: 1825653 - RNA, 19 nt, Salmonella typhimurium LT2
gcggaugucggucaucagg

SEQ ID NO: 1825654 - RNA, 23 nt, Salmonella typhimurium LT2
gcggauuccaguagcgcgcccau

SEQ ID NO: 1825655 - RNA, 16 nt, Salmonella typhimurium LT2
gcggcaaaaacgccgg

SEQ ID NO: 1825656 - RNA, 14 nt, Salmonella typhimurium LT2
gcggauuguugaca

SEQ ID NO: 1825657 - RNA, 20 nt, Salmonella typhimurium LT2
gcggauuuccgggcguacuu

SEQ ID NO: 1825658 - RNA, 20 nt, Salmonella typhimurium LT2
gcggcaaagauaaucugaau

SEQ ID NO: 1825659 - RNA, 18 nt, Salmonella typhimurium LT2
gcggcaacagcaccagaa

SEQ ID NO: 1825660 - RNA, 20 nt, Salmonella typhimurium LT2
gcggcaacccgacugccacc

SEQ ID NO: 1825661 - RNA, 16 nt, Salmonella typhimurium LT2
gcggcaaccagcccau

SEQ ID NO: 1825662 - RNA, 21 nt, Salmonella typhimurium LT2
gcggcaauagcgagaggcaau

SEQ ID NO: 1825663 - RNA, 16 nt, Salmonella typhimurium LT2
gcggcaccuuguccgg

SEQ ID NO: 1825664 - RNA, 12 nt, Salmonella typhimurium LT2
gcggcagauccu

SEQ ID NO: 1825665 - RNA, 19 nt, Salmonella typhimurium LT2
gcggcagaaucacggccga

SEQ ID NO: 1825666 - RNA, 22 nt, Salmonella typhimurium LT2
gcggcagaauuaacucaucaca

SEQ ID NO: 1825667 - RNA, 19 nt, Salmonella typhimurium LT2
gcgcucuacguugaccuca

SEQ ID NO: 1825668 - RNA, 15 nt, Salmonella typhimurium LT2
gcgcucggcagcagc

SEQ ID NO: 1825669 - RNA, 18 nt, Salmonella typhimurium LT2
gcgcucggcagcagcgcg

SEQ ID NO: 1825670 - RNA, 20 nt, Salmonella typhimurium LT2
gcgcugcgcuuaucaggccu

SEQ ID NO: 1825671 - RNA, 16 nt, Salmonella typhimurium LT2
gcgcugcggcuacacg

SEQ ID NO: 1825672 - RNA, 20 nt, Salmonella typhimurium LT2
gcgcuggcgcggauuuccgg

SEQ ID NO: 1825673 - RNA, 17 nt, Salmonella typhimurium LT2
gcgcuggcgcuuaccgg

SEQ ID NO: 1825674 - RNA, 20 nt, Salmonella typhimurium LT2
gcgcugcgcuuaccaggccu

SEQ ID NO: 1825675 - RNA, 15 nt, Salmonella typhimurium LT2
gcgcugcgcuuaccg

SEQ ID NO: 1825676 - RNA, 15 nt, Salmonella typhimurium LT2
gcgcugaaucgcaau

SEQ ID NO: 1825677 - RNA, 14 nt, Salmonella typhimurium LT2
gcgcugacaucauc

SEQ ID NO: 1825678 - RNA, 19 nt, Salmonella typhimurium LT2
gcgcugacaucauccacgg

SEQ ID NO: 1825679 - RNA, 20 nt, Salmonella typhimurium LT2
gcgcuccagaccaccagcga

SEQ ID NO: 1825680 - RNA, 16 nt, Salmonella typhimurium LT2
gcgcucaggaucgccg

SEQ ID NO: 1825681 - RNA, 11 nt, Salmonella typhimurium LT2
gcgcucaggca

SEQ ID NO: 1825682 - RNA, 14 nt, Salmonella typhimurium LT2
gcgcucaugccacg

SEQ ID NO: 1825683 - RNA, 17 nt, Salmonella typhimurium LT2
gcgcuacgcuuauccgg

SEQ ID NO: 1825684 - RNA, 17 nt, Salmonella typhimurium LT2
gcgcuacgcuuaucagg

SEQ ID NO: 1825685 - RNA, 19 nt, Salmonella typhimurium LT2
gcgcuacggcuuccggcgu

SEQ ID NO: 1825686 - RNA, 12 nt, Salmonella typhimurium LT2
gcgcuaucaggc

SEQ ID NO: 1825687 - RNA, 14 nt, Salmonella typhimurium LT2
gcgcuauccggccc

SEQ ID NO: 1825688 - RNA, 20 nt, Salmonella typhimurium LT2
gcgcuaucuauucacuggca

SEQ ID NO: 1825689 - RNA, 13 nt, Salmonella typhimurium LT2
gcgcguccacggc

SEQ ID NO: 1825690 - RNA, 13 nt, Salmonella typhimurium LT2
gcgcuaccagcgc

SEQ ID NO: 1825691 - RNA, 22 nt, Salmonella typhimurium LT2
gcgcuaccaggauagcgccuug

SEQ ID NO: 1825692 - RNA, 21 nt, Salmonella typhimurium LT2
gcgcuaaugcuuauccggccu

SEQ ID NO: 1825693 - RNA, 21 nt, Salmonella typhimurium LT2
gcgcguucauccaugauggcg

SEQ ID NO: 1825694 - RNA, 15 nt, Salmonella typhimurium LT2
gcgcggcaucagccu

SEQ ID NO: 1825695 - RNA, 21 nt, Salmonella typhimurium LT2
gcgcggcgaucagacgcuggu

SEQ ID NO: 1825696 - RNA, 19 nt, Salmonella typhimurium LT2
gcgcgucauaaccgcaguc

SEQ ID NO: 1825697 - RNA, 18 nt, Salmonella typhimurium LT2
gcgcgguuaacagccgcu

SEQ ID NO: 1825698 - RNA, 22 nt, Salmonella typhimurium LT2
gcgcgggccugccuguuuacgg

SEQ ID NO: 1825699 - RNA, 18 nt, Salmonella typhimurium LT2
gcgcggcguucugcgcca

SEQ ID NO: 1825700 - RNA, 13 nt, Salmonella typhimurium LT2
gcgguacggacau

SEQ ID NO: 1825701 - RNA, 22 nt, Salmonella typhimurium LT2
gcgguaccauaccugcggccau

SEQ ID NO: 1825702 - RNA, 12 nt, Salmonella typhimurium LT2
gcgguagcgccg

SEQ ID NO: 1825703 - RNA, 12 nt, Salmonella typhimurium LT2
gcgguagcgaug

SEQ ID NO: 1825704 - RNA, 20 nt, Salmonella typhimurium LT2
gcgguacucuuuuuccgcga

SEQ ID NO: 1825705 - RNA, 19 nt, Salmonella typhimurium LT2
gcgguagcaucucacgcuc

SEQ ID NO: 1825706 - RNA, 14 nt, Salmonella typhimurium LT2
gcgguauacaccag

SEQ ID NO: 1825707 - RNA, 17 nt, Salmonella typhimurium LT2
gcgguauagaucaggcg

SEQ ID NO: 1825708 - RNA, 23 nt, Salmonella typhimurium LT2
gcgguauaacugccuuauccggc

SEQ ID NO: 1825709 - RNA, 14 nt, Salmonella typhimurium LT2
gcgguauuauccgc

SEQ ID NO: 1825710 - RNA, 16 nt, Salmonella typhimurium LT2
gcgguauaucacgcca

SEQ ID NO: 1825711 - RNA, 18 nt, Salmonella typhimurium LT2
gcgguaugaaagccaucg

SEQ ID NO: 1825712 - RNA, 13 nt, Salmonella typhimurium LT2
gcgguccgcccau

SEQ ID NO: 1825713 - RNA, 17 nt, Salmonella typhimurium LT2
gcgguggguagcggcaa

SEQ ID NO: 1825714 - RNA, 21 nt, Salmonella typhimurium LT2
gcgguuauccgccagcgcaac

SEQ ID NO: 1825715 - RNA, 16 nt, Salmonella typhimurium LT2
gcgguucaggccggau

SEQ ID NO: 1825716 - RNA, 19 nt, Salmonella typhimurium LT2
gcggucgcuuuuugcgcca

SEQ ID NO: 1825717 - RNA, 19 nt, Salmonella typhimurium LT2
gcggucuucaacaccgaca

SEQ ID NO: 1825718 - RNA, 22 nt, Salmonella typhimurium LT2
gcgguaagucaaccagcccuuc

SEQ ID NO: 1825719 - RNA, 15 nt, Salmonella typhimurium LT2
gcgguaauaugccag

SEQ ID NO: 1825720 - RNA, 14 nt, Salmonella typhimurium LT2
gcggguuagcgccg

SEQ ID NO: 1825721 - RNA, 23 nt, Salmonella typhimurium LT2
gcgggugcgcagccccagcgcca

SEQ ID NO: 1825722 - RNA, 21 nt, Salmonella typhimurium LT2
gcgggguucgggcagcgcuuc

SEQ ID NO: 1825723 - RNA, 19 nt, Salmonella typhimurium LT2
gcggguaauccgacgcuuc

SEQ ID NO: 1825724 - RNA, 18 nt, Salmonella typhimurium LT2
gcggguaauuugcgccau

SEQ ID NO: 1825725 - RNA, 22 nt, Salmonella typhimurium LT2
gcggggauaaucagcagcgacg

SEQ ID NO: 1825726 - RNA, 17 nt, Salmonella typhimurium LT2
gcgggcaaugccaccag

SEQ ID NO: 1825727 - RNA, 19 nt, Salmonella typhimurium LT2
gcgggauauaacgcaacgu

SEQ ID NO: 1825728 - RNA, 17 nt, Salmonella typhimurium LT2
gcggcuguguccgccau

SEQ ID NO: 1825729 - RNA, 13 nt, Salmonella typhimurium LT2
gcggcugcgccug

SEQ ID NO: 1825730 - RNA, 16 nt, Salmonella typhimurium LT2
gcggcugcgccuuauc

SEQ ID NO: 1825731 - RNA, 18 nt, Salmonella typhimurium LT2
gcggcuggaacucaucgg

SEQ ID NO: 1825732 - RNA, 15 nt, Salmonella typhimurium LT2
gcggcggacaacgcu

SEQ ID NO: 1825733 - RNA, 22 nt, Salmonella typhimurium LT2
gcggcggacaacgcuccagcag

SEQ ID NO: 1825734 - RNA, 22 nt, Salmonella typhimurium LT2
gcggcgcuuauucggcuuaccc

SEQ ID NO: 1825735 - RNA, 19 nt, Salmonella typhimurium LT2
gcggcuagcgccuuauccg

SEQ ID NO: 1825736 - RNA, 15 nt, Salmonella typhimurium LT2
gcggcucauccagca

SEQ ID NO: 1825737 - RNA, 19 nt, Salmonella typhimurium LT2
gcggcgaagcaucuuuccg

SEQ ID NO: 1825738 - RNA, 15 nt, Salmonella typhimurium LT2
gcggcgaucaccacg

SEQ ID NO: 1825739 - RNA, 19 nt, Salmonella typhimurium LT2
gcggcgcuaucgccuccag

SEQ ID NO: 1825740 - RNA, 18 nt, Salmonella typhimurium LT2
gcguggaaaacagcgccg

SEQ ID NO: 1825741 - RNA, 16 nt, Salmonella typhimurium LT2
gcgucugaaugacgcc

SEQ ID NO: 1825742 - RNA, 15 nt, Salmonella typhimurium LT2
gcgugacgacuaccg

SEQ ID NO: 1825743 - RNA, 13 nt, Salmonella typhimurium LT2
gcgugacgcgcca

SEQ ID NO: 1825744 - RNA, 20 nt, Salmonella typhimurium LT2
gcguuacuggcgaccggcag

SEQ ID NO: 1825745 - RNA, 14 nt, Salmonella typhimurium LT2
gcguuacgcgcugc

SEQ ID NO: 1825746 - RNA, 22 nt, Salmonella typhimurium LT2
gcguuacggccaaauuuagagu

SEQ ID NO: 1825747 - RNA, 20 nt, Salmonella typhimurium LT2
gcguuaauauccuucagcgu

SEQ ID NO: 1825748 - RNA, 13 nt, Salmonella typhimurium LT2
gcguuacaggaca

SEQ ID NO: 1825749 - RNA, 17 nt, Salmonella typhimurium LT2
gcguguuucguugcgac

SEQ ID NO: 1825750 - RNA, 17 nt, Salmonella typhimurium LT2
gcguguaaaccgccaga

SEQ ID NO: 1825751 - RNA, 22 nt, Salmonella typhimurium LT2
gcguguaaccaccugggucagc

SEQ ID NO: 1825752 - RNA, 15 nt, Salmonella typhimurium LT2
gcguaaaucaggcca

SEQ ID NO: 1825753 - RNA, 21 nt, Salmonella typhimurium LT2
gcguaaauaccaccugccaaa

SEQ ID NO: 1825754 - RNA, 17 nt, Salmonella typhimurium LT2
gcguaaauaccuuccgg

SEQ ID NO: 1825755 - RNA, 20 nt, Salmonella typhimurium LT2
gcguaaauaccuuccggcgu

SEQ ID NO: 1825756 - RNA, 13 nt, Salmonella typhimurium LT2
gcguaacagcgcu

SEQ ID NO: 1825757 - RNA, 18 nt, Salmonella typhimurium LT2
gcguaacgccacauauaa

SEQ ID NO: 1825758 - RNA, 17 nt, Salmonella typhimurium LT2
gcguccgguagagaacg

SEQ ID NO: 1825759 - RNA, 13 nt, Salmonella typhimurium LT2
gcgguuuacgcca

SEQ ID NO: 1825760 - RNA, 20 nt, Salmonella typhimurium LT2
gcgguuuaaugcuaucccag

SEQ ID NO: 1825761 - RNA, 20 nt, Salmonella typhimurium LT2
gcguaaacacguuaucugac

SEQ ID NO: 1825762 - RNA, 17 nt, Salmonella typhimurium LT2
gcguccucguacccggu

SEQ ID NO: 1825763 - RNA, 21 nt, Salmonella typhimurium LT2
gcucaguugguuagagcacau

SEQ ID NO: 1825764 - RNA, 19 nt, Salmonella typhimurium LT2
gcucauaaauugcagcgac

SEQ ID NO: 1825765 - RNA, 22 nt, Salmonella typhimurium LT2
gcucauaacggcuuaacgccag

SEQ ID NO: 1825766 - RNA, 22 nt, Salmonella typhimurium LT2
gcucaucgggcgaagccugacg

SEQ ID NO: 1825767 - RNA, 15 nt, Salmonella typhimurium LT2
gcucauuaaaccgcg

SEQ ID NO: 1825768 - RNA, 21 nt, Salmonella typhimurium LT2
gcucauuaaaccgcgcggcau

SEQ ID NO: 1825769 - RNA, 22 nt, Salmonella typhimurium LT2
gcucauuuuauccaacagcgca

SEQ ID NO: 1825770 - RNA, 23 nt, Salmonella typhimurium LT2
gcucauucuccgggauagcaauc

SEQ ID NO: 1825771 - RNA, 20 nt, Salmonella typhimurium LT2
gcuccagaccaccagcgaca

SEQ ID NO: 1825772 - RNA, 12 nt, Salmonella typhimurium LT2
gcuccagcauca

SEQ ID NO: 1825773 - RNA, 15 nt, Salmonella typhimurium LT2
gcuccagcaucacau

SEQ ID NO: 1825774 - RNA, 21 nt, Salmonella typhimurium LT2
gcuccagcgccugcugcaacg

SEQ ID NO: 1825775 - RNA, 22 nt, Salmonella typhimurium LT2
gcucagcgucugcacgccaaua

SEQ ID NO: 1825776 - RNA, 16 nt, Salmonella typhimurium LT2
gcucagcgcggcagcc

SEQ ID NO: 1825777 - RNA, 21 nt, Salmonella typhimurium LT2
gcucaggguuuucuaccgcag

SEQ ID NO: 1825778 - RNA, 18 nt, Salmonella typhimurium LT2
gcucaccuccgccaccag

SEQ ID NO: 1825779 - RNA, 20 nt, Salmonella typhimurium LT2
gcucagaaccucaucccggc

SEQ ID NO: 1825780 - RNA, 22 nt, Salmonella typhimurium LT2
gcuacgcgggcgggaugcugua

SEQ ID NO: 1825781 - RNA, 20 nt, Salmonella typhimurium LT2
gcuacgccuuacccggccua

SEQ ID NO: 1825782 - RNA, 13 nt, Salmonella typhimurium LT2
gcuacgcaggcca

SEQ ID NO: 1825783 - RNA, 18 nt, Salmonella typhimurium LT2
gcuaccgucuccauguca

SEQ ID NO: 1825784 - RNA, 17 nt, Salmonella typhimurium LT2
gcuacugccgccaucgc

SEQ ID NO: 1825785 - RNA, 13 nt, Salmonella typhimurium LT2
gcuacugccgcca

SEQ ID NO: 1825786 - RNA, 13 nt, Salmonella typhimurium LT2
gcuacccaugacg

SEQ ID NO: 1825787 - RNA, 14 nt, Salmonella typhimurium LT2
gcuaccgcgcgaac

SEQ ID NO: 1825788 - RNA, 19 nt, Salmonella typhimurium LT2
gcuaccgauucgcgcguca

SEQ ID NO: 1825789 - RNA, 18 nt, Salmonella typhimurium LT2
gcuauuaccccgcggcau

SEQ ID NO: 1825790 - RNA, 17 nt, Salmonella typhimurium LT2
gcucaacacauaacgcc

SEQ ID NO: 1825791 - RNA, 22 nt, Salmonella typhimurium LT2
gcucaacauugcucauaccgcc

SEQ ID NO: 1825792 - RNA, 22 nt, Salmonella typhimurium LT2
gcucaaccgcgcggcguucugc

SEQ ID NO: 1825793 - RNA, 20 nt, Salmonella typhimurium LT2
gcucaccagcugacgcagca

SEQ ID NO: 1825794 - RNA, 14 nt, Salmonella typhimurium LT2
gcucaauaugccag

SEQ ID NO: 1825795 - RNA, 19 nt, Salmonella typhimurium LT2
gcucaaucagaauuucgcc

SEQ ID NO: 1825796 - RNA, 21 nt, Salmonella typhimurium LT2
gcuaugcugaucaucuggccu

SEQ ID NO: 1825797 - RNA, 18 nt, Salmonella typhimurium LT2
gcuaucucuuccagcguc

SEQ ID NO: 1825798 - RNA, 23 nt, Salmonella typhimurium LT2
gcuaucgcccaaauaguccagca

SEQ ID NO: 1825799 - RNA, 23 nt, Salmonella typhimurium LT2
gcuaucgccuccagacuggcgac

SEQ ID NO: 1825800 - RNA, 16 nt, Salmonella typhimurium LT2
gcuauaugcaggcaua

SEQ ID NO: 1825801 - RNA, 22 nt, Salmonella typhimurium LT2
gcuaucacagcggcaucgauuu

SEQ ID NO: 1825802 - RNA, 14 nt, Salmonella typhimurium LT2
gcuaucgaccagca

SEQ ID NO: 1825803 - RNA, 14 nt, Salmonella typhimurium LT2
gcuaucccgaugcu

SEQ ID NO: 1825804 - RNA, 16 nt, Salmonella typhimurium LT2
gcuauccgccgccagc

SEQ ID NO: 1825805 - RNA, 21 nt, Salmonella typhimurium LT2
gcuagcgccuuauccggccua

SEQ ID NO: 1825806 - RNA, 14 nt, Salmonella typhimurium LT2
gcugaaaaccgcau

SEQ ID NO: 1825807 - RNA, 22 nt, Salmonella typhimurium LT2
gcugaaaaugacuucaucgcca

SEQ ID NO: 1825808 - RNA, 13 nt, Salmonella typhimurium LT2
gcugaaagcgccu

SEQ ID NO: 1825809 - RNA, 21 nt, Salmonella typhimurium LT2
gcugacggauacgcugcguca

SEQ ID NO: 1825810 - RNA, 13 nt, Salmonella typhimurium LT2
gcugacggcgcga

SEQ ID NO: 1825811 - RNA, 16 nt, Salmonella typhimurium LT2
gcugaaugaagccuua

SEQ ID NO: 1825812 - RNA, 21 nt, Salmonella typhimurium LT2
gcugauuggcgguagcggaau

SEQ ID NO: 1825813 - RNA, 17 nt, Salmonella typhimurium LT2
gcugcaaaucaccacau

SEQ ID NO: 1825814 - RNA, 16 nt, Salmonella typhimurium LT2
gcugcaaauacugcuu

SEQ ID NO: 1825815 - RNA, 22 nt, Salmonella typhimurium LT2
gcugauuugcgucaaaacagau

SEQ ID NO: 1825816 - RNA, 17 nt, Salmonella typhimurium LT2
gcugcaacccgccgcca

SEQ ID NO: 1825817 - RNA, 18 nt, Salmonella typhimurium LT2
gcugaggauggcgcggca

SEQ ID NO: 1825818 - RNA, 17 nt, Salmonella typhimurium LT2
gcugaucagccgcgaca

SEQ ID NO: 1825819 - RNA, 15 nt, Salmonella typhimurium LT2
gcugagcgccaucag

SEQ ID NO: 1825820 - RNA, 15 nt, Salmonella typhimurium LT2
gcugcccgccgccag

SEQ ID NO: 1825821 - RNA, 13 nt, Salmonella typhimurium LT2
gcugccgauugcc

SEQ ID NO: 1825822 - RNA, 22 nt, Salmonella typhimurium LT2
gcugcaucuuacugaccggccc

SEQ ID NO: 1825823 - RNA, 19 nt, Salmonella typhimurium LT2
gcugcaucuuacugaccgg

SEQ ID NO: 1825824 - RNA, 15 nt, Salmonella typhimurium LT2
gcucuugcggcugca

SEQ ID NO: 1825825 - RNA, 20 nt, Salmonella typhimurium LT2
gcucucuuucaccagcgcca

SEQ ID NO: 1825826 - RNA, 21 nt, Salmonella typhimurium LT2
gcucgucgccuuccagcgacu

SEQ ID NO: 1825827 - RNA, 20 nt, Salmonella typhimurium LT2
gcucggcauacaccgccagc

SEQ ID NO: 1825828 - RNA, 18 nt, Salmonella typhimurium LT2
gcucggguauggcggcau

SEQ ID NO: 1825829 - RNA, 20 nt, Salmonella typhimurium LT2
gcucggcuaucgccacuacg

SEQ ID NO: 1825830 - RNA, 22 nt, Salmonella typhimurium LT2
gcucggcuaucgccacuacgcc

SEQ ID NO: 1825831 - RNA, 24 nt, Salmonella typhimurium LT2
gcuggaggugauggagccuucaac

SEQ ID NO: 1825832 - RNA, 16 nt, Salmonella typhimurium LT2
gcugcucauuucagcg

SEQ ID NO: 1825833 - RNA, 15 nt, Salmonella typhimurium LT2
gcugcucccggcgua

SEQ ID NO: 1825834 - RNA, 16 nt, Salmonella typhimurium LT2
gcuggcgugaaccggu

SEQ ID NO: 1825835 - RNA, 21 nt, Salmonella typhimurium LT2
gcuggcgcgucacaacagccg

SEQ ID NO: 1825836 - RNA, 19 nt, Salmonella typhimurium LT2
gcuggcgcaaagaaggcau

SEQ ID NO: 1825837 - RNA, 16 nt, Salmonella typhimurium LT2
gcuggcgaaccaccag

SEQ ID NO: 1825838 - RNA, 20 nt, Salmonella typhimurium LT2
gcuggucggaucggcgguuu

SEQ ID NO: 1825839 - RNA, 17 nt, Salmonella typhimurium LT2
gcuguagcugcccggau

SEQ ID NO: 1825840 - RNA, 17 nt, Salmonella typhimurium LT2
gcuguagcgucucauca

SEQ ID NO: 1825841 - RNA, 20 nt, Salmonella typhimurium LT2
gcugucgcgaaagcacucgg

SEQ ID NO: 1825842 - RNA, 16 nt, Salmonella typhimurium LT2
gcugucgcuuauucgg

SEQ ID NO: 1825843 - RNA, 18 nt, Salmonella typhimurium LT2
gcugucgcuuauucggcc

SEQ ID NO: 1825844 - RNA, 20 nt, Salmonella typhimurium LT2
ggaugaggcgcagccgccau

SEQ ID NO: 1825845 - RNA, 22 nt, Salmonella typhimurium LT2
ggaugaggcgcagccgccaucc

SEQ ID NO: 1825846 - RNA, 21 nt, Salmonella typhimurium LT2
ggaugacgccguucaaagccg

SEQ ID NO: 1825847 - RNA, 16 nt, Salmonella typhimurium LT2
ggaugcggcuagcgcc

SEQ ID NO: 1825848 - RNA, 22 nt, Salmonella typhimurium LT2
ggaugcugccugccugaagcgc

SEQ ID NO: 1825849 - RNA, 18 nt, Salmonella typhimurium LT2
ggauggcaaaaacagccg

SEQ ID NO: 1825850 - RNA, 16 nt, Salmonella typhimurium LT2
ggauggccucugccag

SEQ ID NO: 1825851 - RNA, 14 nt, Salmonella typhimurium LT2
ggauggcggcgcuu

SEQ ID NO: 1825852 - RNA, 13 nt, Salmonella typhimurium LT2
ggaugcgccaucc

SEQ ID NO: 1825853 - RNA, 14 nt, Salmonella typhimurium LT2
ggaugcgcuaucga

SEQ ID NO: 1825854 - RNA, 20 nt, Salmonella typhimurium LT2
ggauagugauauagcgccau

SEQ ID NO: 1825855 - RNA, 15 nt, Salmonella typhimurium LT2
ggauagcuacgauaa

SEQ ID NO: 1825856 - RNA, 21 nt, Salmonella typhimurium LT2
ggauccagaauauucacgaca

SEQ ID NO: 1825857 - RNA, 21 nt, Salmonella typhimurium LT2
ggaucgccagaucgaacagcg

SEQ ID NO: 1825858 - RNA, 12 nt, Salmonella typhimurium LT2
ggaucgccauca

SEQ ID NO: 1825859 - RNA, 15 nt, Salmonella typhimurium LT2
ggaucgccaucgaca

SEQ ID NO: 1825860 - RNA, 22 nt, Salmonella typhimurium LT2
ggagguucaccaccacccagug

SEQ ID NO: 1825861 - RNA, 22 nt, Salmonella typhimurium LT2
ggagucuaaaacgaacaggccg

SEQ ID NO: 1825862 - RNA, 17 nt, Salmonella typhimurium LT2
ggagcguuaaucaccuc

SEQ ID NO: 1825863 - RNA, 23 nt, Salmonella typhimurium LT2
ggauaaagccaauggugcucagc

SEQ ID NO: 1825864 - RNA, 23 nt, Salmonella typhimurium LT2
ggauaaccguacggcugccuuug

SEQ ID NO: 1825865 - RNA, 17 nt, Salmonella typhimurium LT2
ggauaagcgcagcgcca

SEQ ID NO: 1825866 - RNA, 19 nt, Salmonella typhimurium LT2
ggauaagcauuagcgccau

SEQ ID NO: 1825867 - RNA, 18 nt, Salmonella typhimurium LT2
ggauaagcgcagcgccau

SEQ ID NO: 1825868 - RNA, 18 nt, Salmonella typhimurium LT2
ggauaagcgucagcgcca

SEQ ID NO: 1825869 - RNA, 19 nt, Salmonella typhimurium LT2
ggauaagcgucagcgccau

SEQ ID NO: 1825870 - RNA, 20 nt, Salmonella typhimurium LT2
ggauaaggcgcagccgccau

SEQ ID NO: 1825871 - RNA, 20 nt, Salmonella typhimurium LT2
ggauaccgaagacggcgaaa

SEQ ID NO: 1825872 - RNA, 17 nt, Salmonella typhimurium LT2
ggauagcguagcgccau

SEQ ID NO: 1825873 - RNA, 16 nt, Salmonella typhimurium LT2
ggauagagaucuuccg

SEQ ID NO: 1825874 - RNA, 17 nt, Salmonella typhimurium LT2
ggauacggucgacacca

SEQ ID NO: 1825875 - RNA, 20 nt, Salmonella typhimurium LT2
ggauacguuccagcagcgca

SEQ ID NO: 1825876 - RNA, 20 nt, Salmonella typhimurium LT2
ggauaaggcgcuagccgcau

SEQ ID NO: 1825877 - RNA, 12 nt, Salmonella typhimurium LT2
ggauacagcgcc

SEQ ID NO: 1825878 - RNA, 15 nt, Salmonella typhimurium LT2
ggauaccacgcacau

SEQ ID NO: 1825879 - RNA, 23 nt, Salmonella typhimurium LT2
ggauaagguguuuacgccgccau

SEQ ID NO: 1825880 - RNA, 22 nt, Salmonella typhimurium LT2
ggauaaggcguuucgccgccau

SEQ ID NO: 1825881 - RNA, 23 nt, Salmonella typhimurium LT2
ggauaaggcguuugcgccgcuau

SEQ ID NO: 1825882 - RNA, 14 nt, Salmonella typhimurium LT2
ggauaaggcgugag

SEQ ID NO: 1825883 - RNA, 23 nt, Salmonella typhimurium LT2
ggauaaggcguucacgccgccau

SEQ ID NO: 1825884 - RNA, 18 nt, Salmonella typhimurium LT2
ggagcgaagaauucgcaa

SEQ ID NO: 1825885 - RNA, 20 nt, Salmonella typhimurium LT2
ggagagcggauaauccgcca

SEQ ID NO: 1825886 - RNA, 12 nt, Salmonella typhimurium LT2
ggaccguacuca

SEQ ID NO: 1825887 - RNA, 20 nt, Salmonella typhimurium LT2
ggaaaacgcaucugggcuga

SEQ ID NO: 1825888 - RNA, 23 nt, Salmonella typhimurium LT2
ggaacugccuggcucauucuccg

SEQ ID NO: 1825889 - RNA, 18 nt, Salmonella typhimurium LT2
ggaagcugcgcagcacuu

SEQ ID NO: 1825890 - RNA, 19 nt, Salmonella typhimurium LT2
ggaacugacagcagugaca

SEQ ID NO: 1825891 - RNA, 15 nt, Salmonella typhimurium LT2
ggaagcugcgcagca

SEQ ID NO: 1825892 - RNA, 21 nt, Salmonella typhimurium LT2
ggaaguagcaaaucaucgcca

SEQ ID NO: 1825893 - RNA, 13 nt, Salmonella typhimurium LT2
ggaauccaugacc

SEQ ID NO: 1825894 - RNA, 13 nt, Salmonella typhimurium LT2
ggacaauuacccu

SEQ ID NO: 1825895 - RNA, 22 nt, Salmonella typhimurium LT2
ggacaaggcgguacuccgccau

SEQ ID NO: 1825896 - RNA, 16 nt, Salmonella typhimurium LT2
ggacaacguaccggca

SEQ ID NO: 1825897 - RNA, 16 nt, Salmonella typhimurium LT2
gcuuuccauuacgcuu

SEQ ID NO: 1825898 - RNA, 18 nt, Salmonella typhimurium LT2
gcuuucacaccguuaucc

SEQ ID NO: 1825899 - RNA, 18 nt, Salmonella typhimurium LT2
gcuuuaucuggucugcau

SEQ ID NO: 1825900 - RNA, 23 nt, Salmonella typhimurium LT2
gcuuuagugauaauuuuccgggu

SEQ ID NO: 1825901 - RNA, 21 nt, Salmonella typhimurium LT2
gcuuuugaauuugaaggacug

SEQ ID NO: 1825902 - RNA, 22 nt, Salmonella typhimurium LT2
gcuuuugccgcgcccagcgccg

SEQ ID NO: 1825903 - RNA, 14 nt, Salmonella typhimurium LT2
gcuuuucagcgcca

SEQ ID NO: 1825904 - RNA, 13 nt, Salmonella typhimurium LT2
gcuuuuugcgcca

SEQ ID NO: 1825905 - RNA, 19 nt, Salmonella typhimurium LT2
gcuuuuugcgccagcgcca

SEQ ID NO: 1825906 - RNA, 17 nt, Salmonella typhimurium LT2
ugacaauaacggccuca

SEQ ID NO: 1825907 - RNA, 21 nt, Salmonella typhimurium LT2
ugacaauaaucaguuagcgaa

SEQ ID NO: 1825908 - RNA, 18 nt, Salmonella typhimurium LT2
ugacaaagguugcgccaa

SEQ ID NO: 1825909 - RNA, 16 nt, Salmonella typhimurium LT2
ugacaaucugcuggaa

SEQ ID NO: 1825910 - RNA, 19 nt, Salmonella typhimurium LT2
ugacacaucaccuccagcg

SEQ ID NO: 1825911 - RNA, 20 nt, Salmonella typhimurium LT2
ugaaucgcgcgcgccaguca

SEQ ID NO: 1825912 - RNA, 21 nt, Salmonella typhimurium LT2
ugaaucccccugccacaaccg

SEQ ID NO: 1825913 - RNA, 13 nt, Salmonella typhimurium LT2
ugacauucagcgc

SEQ ID NO: 1825914 - RNA, 22 nt, Salmonella typhimurium LT2
ugacauuuaaggcgcggccuca

SEQ ID NO: 1825915 - RNA, 19 nt, Salmonella typhimurium LT2
ugaccaacgucgugccagu

SEQ ID NO: 1825916 - RNA, 17 nt, Salmonella typhimurium LT2
ugacaucgccggagccg

SEQ ID NO: 1825917 - RNA, 17 nt, Salmonella typhimurium LT2
ugacauccggauccaga

SEQ ID NO: 1825918 - RNA, 16 nt, Salmonella typhimurium LT2
ugacauaaucaugaac

SEQ ID NO: 1825919 - RNA, 13 nt, Salmonella typhimurium LT2
ugaccagcgacgg

SEQ ID NO: 1825920 - RNA, 21 nt, Salmonella typhimurium LT2
ugaccacuaacucaaugacga

SEQ ID NO: 1825921 - RNA, 18 nt, Salmonella typhimurium LT2
ugaccacgguuaucuggc

SEQ ID NO: 1825922 - RNA, 15 nt, Salmonella typhimurium LT2
ugaaaccgccggaug

SEQ ID NO: 1825923 - RNA, 18 nt, Salmonella typhimurium LT2
ugaagauguagucgccuu

SEQ ID NO: 1825924 - RNA, 18 nt, Salmonella typhimurium LT2
ugaaguaucgacgcagac

SEQ ID NO: 1825925 - RNA, 19 nt, Salmonella typhimurium LT2
ugaaggucggcugaaucag

SEQ ID NO: 1825926 - RNA, 12 nt, Salmonella typhimurium LT2
ugaagcggcgca

SEQ ID NO: 1825927 - RNA, 17 nt, Salmonella typhimurium LT2
ugaaucagaagcgucau

SEQ ID NO: 1825928 - RNA, 17 nt, Salmonella typhimurium LT2
ugaauccagcguacuga

SEQ ID NO: 1825929 - RNA, 15 nt, Salmonella typhimurium LT2
ugaauaaaaccggca

SEQ ID NO: 1825930 - RNA, 19 nt, Salmonella typhimurium LT2
ugaauaccaaagcccgcaa

SEQ ID NO: 1825931 - RNA, 14 nt, Salmonella typhimurium LT2
ugaaaacgaaucuc

SEQ ID NO: 1825932 - RNA, 23 nt, Salmonella typhimurium LT2
ucuuccggcaucacaucgccguu

SEQ ID NO: 1825933 - RNA, 22 nt, Salmonella typhimurium LT2
ucuguuugagaaaaacaucaug

SEQ ID NO: 1825934 - RNA, 19 nt, Salmonella typhimurium LT2
ucuguugccgcccgucgcg

SEQ ID NO: 1825935 - RNA, 13 nt, Salmonella typhimurium LT2
ucuucuuuaaccg

SEQ ID NO: 1825936 - RNA, 12 nt, Salmonella typhimurium LT2
ucuugcacaaua

SEQ ID NO: 1825937 - RNA, 16 nt, Salmonella typhimurium LT2
ucugugcgguuugcgc

SEQ ID NO: 1825938 - RNA, 23 nt, Salmonella typhimurium LT2
ucugucgccgcguaaauccacau

SEQ ID NO: 1825939 - RNA, 12 nt, Salmonella typhimurium LT2
ucugcgcguaaa

SEQ ID NO: 1825940 - RNA, 13 nt, Salmonella typhimurium LT2
ucucgacauacuc

SEQ ID NO: 1825941 - RNA, 16 nt, Salmonella typhimurium LT2
ucuggcggcggguuaa

SEQ ID NO: 1825942 - RNA, 15 nt, Salmonella typhimurium LT2
ucuggccucuuauca

SEQ ID NO: 1825943 - RNA, 15 nt, Salmonella typhimurium LT2
ucuggcgcaaccggc

SEQ ID NO: 1825944 - RNA, 18 nt, Salmonella typhimurium LT2
ucuggcgcaaugcugacg

SEQ ID NO: 1825945 - RNA, 14 nt, Salmonella typhimurium LT2
ucuggcugcugaug

SEQ ID NO: 1825946 - RNA, 19 nt, Salmonella typhimurium LT2
ucuggcugccaucggcauu

SEQ ID NO: 1825947 - RNA, 22 nt, Salmonella typhimurium LT2
ucuggcucgccguuaugcagcg

SEQ ID NO: 1825948 - RNA, 14 nt, Salmonella typhimurium LT2
ucgucauagugagc

SEQ ID NO: 1825949 - RNA, 17 nt, Salmonella typhimurium LT2
ucgucagcacuucccac

SEQ ID NO: 1825950 - RNA, 22 nt, Salmonella typhimurium LT2
ucguacugcuuuaauaccggau

SEQ ID NO: 1825951 - RNA, 19 nt, Salmonella typhimurium LT2
ucguacuguggaaccgggu

SEQ ID NO: 1825952 - RNA, 17 nt, Salmonella typhimurium LT2
ucguaacaccuuacgca

SEQ ID NO: 1825953 - RNA, 17 nt, Salmonella typhimurium LT2
ucguaacaggucacgac

SEQ ID NO: 1825954 - RNA, 17 nt, Salmonella typhimurium LT2
ucguacauguccagauc

SEQ ID NO: 1825955 - RNA, 12 nt, Salmonella typhimurium LT2
ucguccugcaau

SEQ ID NO: 1825956 - RNA, 15 nt, Salmonella typhimurium LT2
ucguccugauagccg

SEQ ID NO: 1825957 - RNA, 23 nt, Salmonella typhimurium LT2
ucguccugauccggcuguuccag

SEQ ID NO: 1825958 - RNA, 14 nt, Salmonella typhimurium LT2
ucgucgagcugcgc

SEQ ID NO: 1825959 - RNA, 15 nt, Salmonella typhimurium LT2
ucgguacggcgcugc

SEQ ID NO: 1825960 - RNA, 16 nt, Salmonella typhimurium LT2
ucggcugacgcgcuau

SEQ ID NO: 1825961 - RNA, 18 nt, Salmonella typhimurium LT2
ucggugaucuccucgccg

SEQ ID NO: 1825962 - RNA, 19 nt, Salmonella typhimurium LT2
ucgugauugauucgcgcca

SEQ ID NO: 1825963 - RNA, 14 nt, Salmonella typhimurium LT2
ucgucggccagcgc

SEQ ID NO: 1825964 - RNA, 21 nt, Salmonella typhimurium LT2
ucguuaacccaaauccgcauu

SEQ ID NO: 1825965 - RNA, 20 nt, Salmonella typhimurium LT2
ucguucacguaaucgccgug

SEQ ID NO: 1825966 - RNA, 17 nt, Salmonella typhimurium LT2
ucguucacguaaucgcc

SEQ ID NO: 1825967 - RNA, 15 nt, Salmonella typhimurium LT2
ucguuauccagcagc

SEQ ID NO: 1825968 - RNA, 21 nt, Salmonella typhimurium LT2
ucguuaucgccccaggcgaua

SEQ ID NO: 1825969 - RNA, 16 nt, Salmonella typhimurium LT2
ucguuaccagcaucgc

SEQ ID NO: 1825970 - RNA, 14 nt, Salmonella typhimurium LT2
ucguucgacgacua

SEQ ID NO: 1825971 - RNA, 17 nt, Salmonella typhimurium LT2
ucuaaaucauaccagcg

SEQ ID NO: 1825972 - RNA, 13 nt, Salmonella typhimurium LT2
ucuacaaguucag

SEQ ID NO: 1825973 - RNA, 17 nt, Salmonella typhimurium LT2
ucuaucuguaacuucgg

SEQ ID NO: 1825974 - RNA, 11 nt, Salmonella typhimurium LT2
ucuauaucgcu

SEQ ID NO: 1825975 - RNA, 18 nt, Salmonella typhimurium LT2
ucuccuccucauucagcg

SEQ ID NO: 1825976 - RNA, 23 nt, Salmonella typhimurium LT2
ucuccagcgcauugcccuucgcg

SEQ ID NO: 1825977 - RNA, 18 nt, Salmonella typhimurium LT2
ugccgccagcaguugcag

SEQ ID NO: 1825978 - RNA, 13 nt, Salmonella typhimurium LT2
ugccgccaucgcu

SEQ ID NO: 1825979 - RNA, 16 nt, Salmonella typhimurium LT2
ugccgcccaggccuga

SEQ ID NO: 1825980 - RNA, 15 nt, Salmonella typhimurium LT2
ugccgcgaucgcggc

SEQ ID NO: 1825981 - RNA, 14 nt, Salmonella typhimurium LT2
ugccgcgaucgcgg

SEQ ID NO: 1825982 - RNA, 14 nt, Salmonella typhimurium LT2
ugccgaucaugacg

SEQ ID NO: 1825983 - RNA, 18 nt, Salmonella typhimurium LT2
ugccgauaccgggguuca

SEQ ID NO: 1825984 - RNA, 22 nt, Salmonella typhimurium LT2
ugccgaauggcggcuucgccau

SEQ ID NO: 1825985 - RNA, 18 nt, Salmonella typhimurium LT2
ugccgagcagaucgcggc

SEQ ID NO: 1825986 - RNA, 21 nt, Salmonella typhimurium LT2
ugccgaagaaagcuaucgcca

SEQ ID NO: 1825987 - RNA, 13 nt, Salmonella typhimurium LT2
ugccgaacgcggc

SEQ ID NO: 1825988 - RNA, 12 nt, Salmonella typhimurium LT2
ugccgaacgcgu

SEQ ID NO: 1825989 - RNA, 16 nt, Salmonella typhimurium LT2
ugcccucuuccagcgc

SEQ ID NO: 1825990 - RNA, 15 nt, Salmonella typhimurium LT2
ugcaugaagcgucau

SEQ ID NO: 1825991 - RNA, 13 nt, Salmonella typhimurium LT2
ugccaaagucguc

SEQ ID NO: 1825992 - RNA, 18 nt, Salmonella typhimurium LT2
ugcaggccggauaagccg

SEQ ID NO: 1825993 - RNA, 18 nt, Salmonella typhimurium LT2
ugcagggaacacggcaug

SEQ ID NO: 1825994 - RNA, 20 nt, Salmonella typhimurium LT2
ugcagggugaagauggcgcc

SEQ ID NO: 1825995 - RNA, 19 nt, Salmonella typhimurium LT2
ugccccccgacuucacgcu

SEQ ID NO: 1825996 - RNA, 19 nt, Salmonella typhimurium LT2
ugccauacuuuuccagcgc

SEQ ID NO: 1825997 - RNA, 21 nt, Salmonella typhimurium LT2
ugccauuuuugcaucaucacu

SEQ ID NO: 1825998 - RNA, 18 nt, Salmonella typhimurium LT2
ugccaggaagucagcuuc

SEQ ID NO: 1825999 - RNA, 14 nt, Salmonella typhimurium LT2
ugccaccagcgcca

SEQ ID NO: 1826000 - RNA, 13 nt, Salmonella typhimurium LT2
ugccacccggcaa

SEQ ID NO: 1826001 - RNA, 21 nt, Salmonella typhimurium LT2
ugccaguaacguucuucgaua

SEQ ID NO: 1826002 - RNA, 14 nt, Salmonella typhimurium LT2
ugccaguaccgccg

SEQ ID NO: 1826003 - RNA, 21 nt, Salmonella typhimurium LT2
ugccagguuauuucgcgcagu

SEQ ID NO: 1826004 - RNA, 11 nt, Salmonella typhimurium LT2
ugccagggcca

SEQ ID NO: 1826005 - RNA, 21 nt, Salmonella typhimurium LT2
ugagacguuauuagccggaua

SEQ ID NO: 1826006 - RNA, 21 nt, Salmonella typhimurium LT2
ugagaucgguaauuuccacgc

SEQ ID NO: 1826007 - RNA, 13 nt, Salmonella typhimurium LT2
ugagauacugcga

SEQ ID NO: 1826008 - RNA, 16 nt, Salmonella typhimurium LT2
ugagauacugcgaucg

SEQ ID NO: 1826009 - RNA, 12 nt, Salmonella typhimurium LT2
ugagaucguuau

SEQ ID NO: 1826010 - RNA, 21 nt, Salmonella typhimurium LT2
ugagcaguugaucguaaagcg

SEQ ID NO: 1826011 - RNA, 19 nt, Salmonella typhimurium LT2
ugacccagacaaaauucag

SEQ ID NO: 1826012 - RNA, 15 nt, Salmonella typhimurium LT2
ugacguaauaccgaa

SEQ ID NO: 1826013 - RNA, 16 nt, Salmonella typhimurium LT2
ugacguccaggccgua

SEQ ID NO: 1826014 - RNA, 24 nt, Salmonella typhimurium LT2
ugacguaggaggagaugaccgagu

SEQ ID NO: 1826015 - RNA, 17 nt, Salmonella typhimurium LT2
ugauagccguucuccag

SEQ ID NO: 1826016 - RNA, 18 nt, Salmonella typhimurium LT2
ugauagcgaucagcgcca

SEQ ID NO: 1826017 - RNA, 21 nt, Salmonella typhimurium LT2
ugauagcgaucagcgccacca

SEQ ID NO: 1826018 - RNA, 17 nt, Salmonella typhimurium LT2
ugauaguccaucaccuc

SEQ ID NO: 1826019 - RNA, 21 nt, Salmonella typhimurium LT2
ugauauacgaagcgccauccg

SEQ ID NO: 1826020 - RNA, 20 nt, Salmonella typhimurium LT2
ugauaguuuaaauccagcgc

SEQ ID NO: 1826021 - RNA, 21 nt, Salmonella typhimurium LT2
ugagcguuacgggaacagaau

SEQ ID NO: 1826022 - RNA, 15 nt, Salmonella typhimurium LT2
ugagcgucgccagac

SEQ ID NO: 1826023 - RNA, 16 nt, Salmonella typhimurium LT2
ugagcuuaacgcguag

SEQ ID NO: 1826024 - RNA, 18 nt, Salmonella typhimurium LT2
ugagccagaugucgccag

SEQ ID NO: 1826025 - RNA, 17 nt, Salmonella typhimurium LT2
ugagccaauuuaugccg

SEQ ID NO: 1826026 - RNA, 18 nt, Salmonella typhimurium LT2
ugauuuucuccagcagac

SEQ ID NO: 1826027 - RNA, 23 nt, Salmonella typhimurium LT2
ugcaacccauauucgucuucauc

SEQ ID NO: 1826028 - RNA, 21 nt, Salmonella typhimurium LT2
ugcaacgacgcgggaucguca

SEQ ID NO: 1826029 - RNA, 19 nt, Salmonella typhimurium LT2
ugcaaggcaucgucggcga

SEQ ID NO: 1826030 - RNA, 22 nt, Salmonella typhimurium LT2
ugcaagggaaucucuucacgau

SEQ ID NO: 1826031 - RNA, 18 nt, Salmonella typhimurium LT2
ugcaacuggcaagcgcua

SEQ ID NO: 1826032 - RNA, 14 nt, Salmonella typhimurium LT2
ugcaacuucaccuu

SEQ ID NO: 1826033 - RNA, 19 nt, Salmonella typhimurium LT2
ugcaaugcgcuccagcuuc

SEQ ID NO: 1826034 - RNA, 16 nt, Salmonella typhimurium LT2
ugcacaauuuuagccg

SEQ ID NO: 1826035 - RNA, 17 nt, Salmonella typhimurium LT2
ugaugcaggcaauauac

SEQ ID NO: 1826036 - RNA, 14 nt, Salmonella typhimurium LT2
ugauccugcaacag

SEQ ID NO: 1826037 - RNA, 21 nt, Salmonella typhimurium LT2
ugaugaucgcgauagcgcuga

SEQ ID NO: 1826038 - RNA, 14 nt, Salmonella typhimurium LT2
ugaugaucgcggua

SEQ ID NO: 1826039 - RNA, 11 nt, Salmonella typhimurium LT2
ugauccagcga

SEQ ID NO: 1826040 - RNA, 17 nt, Salmonella typhimurium LT2
ugauccaccaucggcgc

SEQ ID NO: 1826041 - RNA, 16 nt, Salmonella typhimurium LT2
ugaucccaggccggca

SEQ ID NO: 1826042 - RNA, 19 nt, Salmonella typhimurium LT2
ugaucaugcugcaccgcau

SEQ ID NO: 1826043 - RNA, 16 nt, Salmonella typhimurium LT2
ugauuaacagcgccau

SEQ ID NO: 1826044 - RNA, 18 nt, Salmonella typhimurium LT2
ugauuaaugcugcaccac

SEQ ID NO: 1826045 - RNA, 16 nt, Salmonella typhimurium LT2
ugauuggcaaacugcc

SEQ ID NO: 1826046 - RNA, 15 nt, Salmonella typhimurium LT2
ugauuccagagcgaa

SEQ ID NO: 1826047 - RNA, 15 nt, Salmonella typhimurium LT2
ucccaccacuucgcc

SEQ ID NO: 1826048 - RNA, 20 nt, Salmonella typhimurium LT2
ucccaaugcggaaaccaguu

SEQ ID NO: 1826049 - RNA, 19 nt, Salmonella typhimurium LT2
uccccugcuccugccagau

SEQ ID NO: 1826050 - RNA, 17 nt, Salmonella typhimurium LT2
ucccgaugguggcgucg

SEQ ID NO: 1826051 - RNA, 21 nt, Salmonella typhimurium LT2
uccccuuuucacccaacauuu

SEQ ID NO: 1826052 - RNA, 15 nt, Salmonella typhimurium LT2
ucccgacggcaggcg

SEQ ID NO: 1826053 - RNA, 17 nt, Salmonella typhimurium LT2
ucccgcaagaaacaggc

SEQ ID NO: 1826054 - RNA, 23 nt, Salmonella typhimurium LT2
uccgcaucguuaucauuaucgcc

SEQ ID NO: 1826055 - RNA, 22 nt, Salmonella typhimurium LT2
uccgccaugaaaaaaacgcauu

SEQ ID NO: 1826056 - RNA, 14 nt, Salmonella typhimurium LT2
uccgccgccgccau

SEQ ID NO: 1826057 - RNA, 21 nt, Salmonella typhimurium LT2
uccgcaaagcccaucagcgcc

SEQ ID NO: 1826058 - RNA, 17 nt, Salmonella typhimurium LT2
uccgcaagaguaaucgu

SEQ ID NO: 1826059 - RNA, 17 nt, Salmonella typhimurium LT2
uccgcagccgacgcauu

SEQ ID NO: 1826060 - RNA, 16 nt, Salmonella typhimurium LT2
uccgcagccgacgcau

SEQ ID NO: 1826061 - RNA, 17 nt, Salmonella typhimurium LT2
uccgcacgcgcgcccau

SEQ ID NO: 1826062 - RNA, 22 nt, Salmonella typhimurium LT2
uccgauuucguucuuucugcca

SEQ ID NO: 1826063 - RNA, 20 nt, Salmonella typhimurium LT2
uccgacgcaacucacgccau

SEQ ID NO: 1826064 - RNA, 21 nt, Salmonella typhimurium LT2
uccggaucaucuuuuaccgcc

SEQ ID NO: 1826065 - RNA, 15 nt, Salmonella typhimurium LT2
uccgccgcuaucgcc

SEQ ID NO: 1826066 - RNA, 17 nt, Salmonella typhimurium LT2
uccgccgcuaucgccga

SEQ ID NO: 1826067 - RNA, 18 nt, Salmonella typhimurium LT2
uccggcgaauuucaucag

SEQ ID NO: 1826068 - RNA, 14 nt, Salmonella typhimurium LT2
uccggcgacgcgua

SEQ ID NO: 1826069 - RNA, 18 nt, Salmonella typhimurium LT2
uccggcgaggcguaaaac

SEQ ID NO: 1826070 - RNA, 24 nt, Salmonella typhimurium LT2
uccggcaucacaaaccagacgcgu

SEQ ID NO: 1826071 - RNA, 23 nt, Salmonella typhimurium LT2
uccggcaguuauuuuacgggcgu

SEQ ID NO: 1826072 - RNA, 20 nt, Salmonella typhimurium LT2
uccggcuuauccggccugca

SEQ ID NO: 1826073 - RNA, 14 nt, Salmonella typhimurium LT2
uccggcgcaucggu

SEQ ID NO: 1826074 - RNA, 23 nt, Salmonella typhimurium LT2
uccucauuuuguugcuccagcau

SEQ ID NO: 1826075 - RNA, 23 nt, Salmonella typhimurium LT2
uccucaauauuaucuucgucaau

SEQ ID NO: 1826076 - RNA, 13 nt, Salmonella typhimurium LT2
uccgucuggcgau

SEQ ID NO: 1826077 - RNA, 22 nt, Salmonella typhimurium LT2
uccgucgcugcguuugccgccu

SEQ ID NO: 1826078 - RNA, 17 nt, Salmonella typhimurium LT2
uccgggcgguucggcug

SEQ ID NO: 1826079 - RNA, 18 nt, Salmonella typhimurium LT2
uccgucaaaaaaucgacc

SEQ ID NO: 1826080 - RNA, 17 nt, Salmonella typhimurium LT2
ucgaucagcauaucgau

SEQ ID NO: 1826081 - RNA, 16 nt, Salmonella typhimurium LT2
ucgauacuauaacgcu

SEQ ID NO: 1826082 - RNA, 17 nt, Salmonella typhimurium LT2
ucgauagcguuuuccag

SEQ ID NO: 1826083 - RNA, 13 nt, Salmonella typhimurium LT2
ucgauaguccauu

SEQ ID NO: 1826084 - RNA, 13 nt, Salmonella typhimurium LT2
ucgauauccgugc

SEQ ID NO: 1826085 - RNA, 17 nt, Salmonella typhimurium LT2
ucgauaaucauacagcg

SEQ ID NO: 1826086 - RNA, 12 nt, Salmonella typhimurium LT2
ucgauacagccu

SEQ ID NO: 1826087 - RNA, 19 nt, Salmonella typhimurium LT2
ucgaggcuggucgcgauag

SEQ ID NO: 1826088 - RNA, 21 nt, Salmonella typhimurium LT2
ucgaugauuuguucgccccag

SEQ ID NO: 1826089 - RNA, 16 nt, Salmonella typhimurium LT2
ucgaugcacgccacau

SEQ ID NO: 1826090 - RNA, 14 nt, Salmonella typhimurium LT2
ucgaugucgucgau

SEQ ID NO: 1826091 - RNA, 12 nt, Salmonella typhimurium LT2
ucgauuaaacgc

SEQ ID NO: 1826092 - RNA, 21 nt, Salmonella typhimurium LT2
ucgauuuccgguuccagcggc

SEQ ID NO: 1826093 - RNA, 12 nt, Salmonella typhimurium LT2
ucgauuuccggc

SEQ ID NO: 1826094 - RNA, 13 nt, Salmonella typhimurium LT2
ucgcaaacgccag

SEQ ID NO: 1826095 - RNA, 22 nt, Salmonella typhimurium LT2
ucgauuuugaccugaauccaga

SEQ ID NO: 1826096 - RNA, 14 nt, Salmonella typhimurium LT2
ucgcaaauucugua

SEQ ID NO: 1826097 - RNA, 19 nt, Salmonella typhimurium LT2
ucgcacagaaucaccuuau

SEQ ID NO: 1826098 - RNA, 21 nt, Salmonella typhimurium LT2
ucgcacaaagcguucggccug

SEQ ID NO: 1826099 - RNA, 16 nt, Salmonella typhimurium LT2
ucgaaauaaagaaagu

SEQ ID NO: 1826100 - RNA, 14 nt, Salmonella typhimurium LT2
ucgaaaccagcaua

SEQ ID NO: 1826101 - RNA, 14 nt, Salmonella typhimurium LT2
uccuuccgccgcaa

SEQ ID NO: 1826102 - RNA, 17 nt, Salmonella typhimurium LT2
uccuuauuuaauacauc

SEQ ID NO: 1826103 - RNA, 22 nt, Salmonella typhimurium LT2
uccuuaugaccgagucuacauc

SEQ ID NO: 1826104 - RNA, 17 nt, Salmonella typhimurium LT2
uccuuaacgucaucauc

SEQ ID NO: 1826105 - RNA, 21 nt, Salmonella typhimurium LT2
uccucgcgcguuugcaauauc

SEQ ID NO: 1826106 - RNA, 11 nt, Salmonella typhimurium LT2
ucgaacgccgc

SEQ ID NO: 1826107 - RNA, 17 nt, Salmonella typhimurium LT2
ucgaacuugaccagcac

SEQ ID NO: 1826108 - RNA, 15 nt, Salmonella typhimurium LT2
ucgaauacagcgccu

SEQ ID NO: 1826109 - RNA, 17 nt, Salmonella typhimurium LT2
ucgaccgugauucgccc

SEQ ID NO: 1826110 - RNA, 13 nt, Salmonella typhimurium LT2
ucgacacaggcgu

SEQ ID NO: 1826111 - RNA, 22 nt, Salmonella typhimurium LT2
ucgacaccagcgauaaacgcca

SEQ ID NO: 1826112 - RNA, 14 nt, Salmonella typhimurium LT2
ucgacaacaucauu

SEQ ID NO: 1826113 - RNA, 19 nt, Salmonella typhimurium LT2
ucgacaacaacaucuguga

SEQ ID NO: 1826114 - RNA, 13 nt, Salmonella typhimurium LT2
ucgcccgccagau

SEQ ID NO: 1826115 - RNA, 14 nt, Salmonella typhimurium LT2
ucgcccgcgaugau

SEQ ID NO: 1826116 - RNA, 21 nt, Salmonella typhimurium LT2
ucgcccagguuguaucauguu

SEQ ID NO: 1826117 - RNA, 21 nt, Salmonella typhimurium LT2
ucgcccgguagcauccgcgau

SEQ ID NO: 1826118 - RNA, 15 nt, Salmonella typhimurium LT2
ucgcccgcucgcgau

SEQ ID NO: 1826119 - RNA, 15 nt, Salmonella typhimurium LT2
ucgcccggaucgcgg

SEQ ID NO: 1826120 - RNA, 21 nt, Salmonella typhimurium LT2
ucgccauaaaucagauccacg

SEQ ID NO: 1826121 - RNA, 13 nt, Salmonella typhimurium LT2
ucgccaguugcag

SEQ ID NO: 1826122 - RNA, 18 nt, Salmonella typhimurium LT2
ucgccaucgacagcagcg

SEQ ID NO: 1826123 - RNA, 18 nt, Salmonella typhimurium LT2
ucgcagagucgcagcggc

SEQ ID NO: 1826124 - RNA, 14 nt, Salmonella typhimurium LT2
ucgcagaucgccug

SEQ ID NO: 1826125 - RNA, 16 nt, Salmonella typhimurium LT2
ucgcagacauggcaau

SEQ ID NO: 1826126 - RNA, 17 nt, Salmonella typhimurium LT2
ucgccgcgcgcauaggc

SEQ ID NO: 1826127 - RNA, 20 nt, Salmonella typhimurium LT2
ucgccgccguacucuuucgg

SEQ ID NO: 1826128 - RNA, 18 nt, Salmonella typhimurium LT2
ucgccgccagccgaucua

SEQ ID NO: 1826129 - RNA, 17 nt, Salmonella typhimurium LT2
ucgcgccugccaggauc

SEQ ID NO: 1826130 - RNA, 22 nt, Salmonella typhimurium LT2
ucgcgcguggugcuuagcuggc

SEQ ID NO: 1826131 - RNA, 15 nt, Salmonella typhimurium LT2
ucgccgguuggcaug

SEQ ID NO: 1826132 - RNA, 16 nt, Salmonella typhimurium LT2
ucgccguaaaauucac

SEQ ID NO: 1826133 - RNA, 16 nt, Salmonella typhimurium LT2
ucgcgacgacgcuggu

SEQ ID NO: 1826134 - RNA, 14 nt, Salmonella typhimurium LT2
ucgcgauaaucaac

SEQ ID NO: 1826135 - RNA, 20 nt, Salmonella typhimurium LT2
ucgcggcuguucaccacguu

SEQ ID NO: 1826136 - RNA, 12 nt, Salmonella typhimurium LT2
ucgcggcgcaaa

SEQ ID NO: 1826137 - RNA, 21 nt, Salmonella typhimurium LT2
ucgcgcuuucaaucgucagac

SEQ ID NO: 1826138 - RNA, 22 nt, Salmonella typhimurium LT2
ucgcggaagcgaccggcgucau

SEQ ID NO: 1826139 - RNA, 14 nt, Salmonella typhimurium LT2
ucgcggaauuucag

SEQ ID NO: 1826140 - RNA, 16 nt, Salmonella typhimurium LT2
ucgcgcugcgcaggcg

SEQ ID NO: 1826141 - RNA, 19 nt, Salmonella typhimurium LT2
ucgcuuuuugcgccagcgc

SEQ ID NO: 1826142 - RNA, 16 nt, Salmonella typhimurium LT2
ucggaagcauccguuu

SEQ ID NO: 1826143 - RNA, 15 nt, Salmonella typhimurium LT2
ucgcuguacgacugg

SEQ ID NO: 1826144 - RNA, 14 nt, Salmonella typhimurium LT2
ucgcgggcaaucaa

SEQ ID NO: 1826145 - RNA, 22 nt, Salmonella typhimurium LT2
ucggcauaggcuauugccucac

SEQ ID NO: 1826146 - RNA, 23 nt, Salmonella typhimurium LT2
ucggcaggguuugaccucaucca

SEQ ID NO: 1826147 - RNA, 14 nt, Salmonella typhimurium LT2
ucggcagcgcgaac

SEQ ID NO: 1826148 - RNA, 19 nt, Salmonella typhimurium LT2
ucggcaaauccccuuucgg

SEQ ID NO: 1826149 - RNA, 20 nt, Salmonella typhimurium LT2
ucggcaaacaucugcuccag

SEQ ID NO: 1826150 - RNA, 17 nt, Salmonella typhimurium LT2
ucggauuucguaccgaa

SEQ ID NO: 1826151 - RNA, 13 nt, Salmonella typhimurium LT2
ucggauuauuggu

SEQ ID NO: 1826152 - RNA, 16 nt, Salmonella typhimurium LT2
ucggaugaucgucaac

SEQ ID NO: 1826153 - RNA, 21 nt, Salmonella typhimurium LT2
ucggauucguuaagcaacugc

SEQ ID NO: 1826154 - RNA, 14 nt, Salmonella typhimurium LT2
ucggccagcaggcg

SEQ ID NO: 1826155 - RNA, 14 nt, Salmonella typhimurium LT2
ucggccagcgccag

SEQ ID NO: 1826156 - RNA, 17 nt, Salmonella typhimurium LT2
ucggccaugggcgcguu

SEQ ID NO: 1826157 - RNA, 14 nt, Salmonella typhimurium LT2
ucggcuaaggcgau

SEQ ID NO: 1826158 - RNA, 22 nt, Salmonella typhimurium LT2
ucggcguuguuaugcgucaaaa

SEQ ID NO: 1826159 - RNA, 16 nt, Salmonella typhimurium LT2
ucggcgugccagcguc

SEQ ID NO: 1826160 - RNA, 13 nt, Salmonella typhimurium LT2
ucggcgucgcggc

SEQ ID NO: 1826161 - RNA, 14 nt, Salmonella typhimurium LT2
ucggcgucaucccg

SEQ ID NO: 1826162 - RNA, 13 nt, Salmonella typhimurium LT2
ucggcgauaaacc

SEQ ID NO: 1826163 - RNA, 21 nt, Salmonella typhimurium LT2
ucggcgcgucgugaucgaacu

SEQ ID NO: 1826164 - RNA, 20 nt, Salmonella typhimurium LT2
ucggcggaaauucgcgccag

SEQ ID NO: 1826165 - RNA, 16 nt, Salmonella typhimurium LT2
aauaaaguuuauuuga

SEQ ID NO: 1826166 - RNA, 24 nt, Salmonella typhimurium LT2
aauaaagccgcauuuuuccagcca

SEQ ID NO: 1826167 - RNA, 20 nt, Salmonella typhimurium LT2
aauaaauucuucaucaugau

SEQ ID NO: 1826168 - RNA, 20 nt, Salmonella typhimurium LT2
uaggccggauaaggcauuca

SEQ ID NO: 1826169 - RNA, 20 nt, Salmonella typhimurium LT2
uaggccggauaagcauuagc

SEQ ID NO: 1826170 - RNA, 20 nt, Salmonella typhimurium LT2
uaggccggauaagcgugagc

SEQ ID NO: 1826171 - RNA, 22 nt, Salmonella typhimurium LT2
uaggccgcuauaagcggcguca

SEQ ID NO: 1826172 - RNA, 20 nt, Salmonella typhimurium LT2
uaggccggauaaggcgcagc

SEQ ID NO: 1826173 - RNA, 19 nt, Salmonella typhimurium LT2
uaggccggauaaggcguua

SEQ ID NO: 1826174 - RNA, 20 nt, Salmonella typhimurium LT2
uaggccggguaaggcgaagc

SEQ ID NO: 1826175 - RNA, 18 nt, Salmonella typhimurium LT2
uaggccgguaugacgcuu

SEQ ID NO: 1826176 - RNA, 19 nt, Salmonella typhimurium LT2
uaggccugauaagcgcagc

SEQ ID NO: 1826177 - RNA, 19 nt, Salmonella typhimurium LT2
uaggccugauaagcguagc

SEQ ID NO: 1826178 - RNA, 20 nt, Salmonella typhimurium LT2
uaggccugauaagcguagcg

SEQ ID NO: 1826179 - RNA, 14 nt, Salmonella typhimurium LT2
uaggcugaaagcgc

SEQ ID NO: 1826180 - RNA, 15 nt, Salmonella typhimurium LT2
uaggcgaggaagaca

SEQ ID NO: 1826181 - RNA, 16 nt, Salmonella typhimurium LT2
uagcuauauuuagccg

SEQ ID NO: 1826182 - RNA, 13 nt, Salmonella typhimurium LT2
uagcuaaccagcg

SEQ ID NO: 1826183 - RNA, 16 nt, Salmonella typhimurium LT2
uagcuaaugcgguagc

SEQ ID NO: 1826184 - RNA, 14 nt, Salmonella typhimurium LT2
uagcugagacucag

SEQ ID NO: 1826185 - RNA, 15 nt, Salmonella typhimurium LT2
uagcgcugaugcguu

SEQ ID NO: 1826186 - RNA, 17 nt, Salmonella typhimurium LT2
uagcgcugagcguagau

SEQ ID NO: 1826187 - RNA, 23 nt, Salmonella typhimurium LT2
uagcgcgguaucauugcugcugu

SEQ ID NO: 1826188 - RNA, 17 nt, Salmonella typhimurium LT2
uagcgugccgacguuca

SEQ ID NO: 1826189 - RNA, 14 nt, Salmonella typhimurium LT2
uagcguucaucaau

SEQ ID NO: 1826190 - RNA, 17 nt, Salmonella typhimurium LT2
uagcaccagaccgacaa

SEQ ID NO: 1826191 - RNA, 22 nt, Salmonella typhimurium LT2
uagcaacguccgcagccgacgc

SEQ ID NO: 1826192 - RNA, 23 nt, Salmonella typhimurium LT2
uagcagaauggcgaucaccgcau

SEQ ID NO: 1826193 - RNA, 23 nt, Salmonella typhimurium LT2
uagccgccgugguaaauacgcug

SEQ ID NO: 1826194 - RNA, 16 nt, Salmonella typhimurium LT2
uagcgcgcuuccugcc

SEQ ID NO: 1826195 - RNA, 16 nt, Salmonella typhimurium LT2
uagcgaaauguucguc

SEQ ID NO: 1826196 - RNA, 14 nt, Salmonella typhimurium LT2
uagcgacauacaua

SEQ ID NO: 1826197 - RNA, 15 nt, Salmonella typhimurium LT2
uagccugaacgccgg

SEQ ID NO: 1826198 - RNA, 16 nt, Salmonella typhimurium LT2
uagccugaacgccgga

SEQ ID NO: 1826199 - RNA, 21 nt, Salmonella typhimurium LT2
uagacaguuuuuucguuccag

SEQ ID NO: 1826200 - RNA, 20 nt, Salmonella typhimurium LT2
uagacaaugcaggccggaua

SEQ ID NO: 1826201 - RNA, 20 nt, Salmonella typhimurium LT2
uagaccuggcucucggcaac

SEQ ID NO: 1826202 - RNA, 19 nt, Salmonella typhimurium LT2
uacuuuauuuuucgccaga

SEQ ID NO: 1826203 - RNA, 17 nt, Salmonella typhimurium LT2
uacugcguccggcgaau

SEQ ID NO: 1826204 - RNA, 16 nt, Salmonella typhimurium LT2
uagaaaguacaucauu

SEQ ID NO: 1826205 - RNA, 19 nt, Salmonella typhimurium LT2
uacuuuugaacauaaaguc

SEQ ID NO: 1826206 - RNA, 22 nt, Salmonella typhimurium LT2
uacgugaaauaacguuaacgcc

SEQ ID NO: 1826207 - RNA, 17 nt, Salmonella typhimurium LT2
uacucugcucgccagua

SEQ ID NO: 1826208 - RNA, 19 nt, Salmonella typhimurium LT2
uacguuuaucuggcuuaca

SEQ ID NO: 1826209 - RNA, 16 nt, Salmonella typhimurium LT2
uacugaccggcccguu

SEQ ID NO: 1826210 - RNA, 15 nt, Salmonella typhimurium LT2
uacugcaacgcgcau

SEQ ID NO: 1826211 - RNA, 22 nt, Salmonella typhimurium LT2
uacgcgcgccgccugcuccggg

SEQ ID NO: 1826212 - RNA, 18 nt, Salmonella typhimurium LT2
uacgcaucugcgcguagc

SEQ ID NO: 1826213 - RNA, 16 nt, Salmonella typhimurium LT2
uacgcaggcuaacgcg

SEQ ID NO: 1826214 - RNA, 16 nt, Salmonella typhimurium LT2
uacgcgcgcggcguca

SEQ ID NO: 1826215 - RNA, 20 nt, Salmonella typhimurium LT2
uacgcgucugucgaaacugg

SEQ ID NO: 1826216 - RNA, 10 nt, Salmonella typhimurium LT2
uacgcgucac

SEQ ID NO: 1826217 - RNA, 16 nt, Salmonella typhimurium LT2
uacgcgucacaaucgc

SEQ ID NO: 1826218 - RNA, 18 nt, Salmonella typhimurium LT2
uacgcguuucacaaccuc

SEQ ID NO: 1826219 - RNA, 21 nt, Salmonella typhimurium LT2
uacggucaaggaaccaacggu

SEQ ID NO: 1826220 - RNA, 22 nt, Salmonella typhimurium LT2
uacgggagagcguauccagcac

SEQ ID NO: 1826221 - RNA, 20 nt, Salmonella typhimurium LT2
uacggcccguacugaacccg

SEQ ID NO: 1826222 - RNA, 13 nt, Salmonella typhimurium LT2
uacgcucgaaagc

SEQ ID NO: 1826223 - RNA, 13 nt, Salmonella typhimurium LT2
uacggcgcgccac

SEQ ID NO: 1826224 - RNA, 18 nt, Salmonella typhimurium LT2
uaccuuuuuucaguaauu

SEQ ID NO: 1826225 - RNA, 18 nt, Salmonella typhimurium LT2
uaccagcgcuauccaggc

SEQ ID NO: 1826226 - RNA, 15 nt, Salmonella typhimurium LT2
uaccagcaacgccag

SEQ ID NO: 1826227 - RNA, 18 nt, Salmonella typhimurium LT2
uaccagaacucguugcca

SEQ ID NO: 1826228 - RNA, 17 nt, Salmonella typhimurium LT2
uaccacugguuaaugcc

SEQ ID NO: 1826229 - RNA, 15 nt, Salmonella typhimurium LT2
uacgacagcgcuggc

SEQ ID NO: 1826230 - RNA, 18 nt, Salmonella typhimurium LT2
uacgcaggccauuucgcc

SEQ ID NO: 1826231 - RNA, 15 nt, Salmonella typhimurium LT2
uacgcagaaccgccg

SEQ ID NO: 1826232 - RNA, 19 nt, Salmonella typhimurium LT2
uacgcagaaccgccgcgau

SEQ ID NO: 1826233 - RNA, 21 nt, Salmonella typhimurium LT2
uacgcacuuuuaucggauagu

SEQ ID NO: 1826234 - RNA, 16 nt, Salmonella typhimurium LT2
uacgcacacuugcucc

SEQ ID NO: 1826235 - RNA, 16 nt, Salmonella typhimurium LT2
uacgcaaaaaaagcca

SEQ ID NO: 1826236 - RNA, 16 nt, Salmonella typhimurium LT2
uacgauuucucgccau

SEQ ID NO: 1826237 - RNA, 21 nt, Salmonella typhimurium LT2
ucaacguuucgcuaucgccca

SEQ ID NO: 1826238 - RNA, 21 nt, Salmonella typhimurium LT2
ucaaccagggucaauacgccg

SEQ ID NO: 1826239 - RNA, 20 nt, Salmonella typhimurium LT2
ucaaauccaccgccagcaua

SEQ ID NO: 1826240 - RNA, 12 nt, Salmonella typhimurium LT2
ucaaauccagcu

SEQ ID NO: 1826241 - RNA, 20 nt, Salmonella typhimurium LT2
ucaacccuauugccacaaua

SEQ ID NO: 1826242 - RNA, 16 nt, Salmonella typhimurium LT2
ucaaccgcgcggcguu

SEQ ID NO: 1826243 - RNA, 18 nt, Salmonella typhimurium LT2
ucaaccgcuuucagcgca

SEQ ID NO: 1826244 - RNA, 13 nt, Salmonella typhimurium LT2
ucaaacuuagcga

SEQ ID NO: 1826245 - RNA, 20 nt, Salmonella typhimurium LT2
ucaaacuccgcgcuggcaau

SEQ ID NO: 1826246 - RNA, 18 nt, Salmonella typhimurium LT2
ucaaaaugcaccggcguu

SEQ ID NO: 1826247 - RNA, 19 nt, Salmonella typhimurium LT2
uauugcauaaugccugucg

SEQ ID NO: 1826248 - RNA, 15 nt, Salmonella typhimurium LT2
uauugaugacgcuua

SEQ ID NO: 1826249 - RNA, 21 nt, Salmonella typhimurium LT2
uauugauaccuuuaaccucuu

SEQ ID NO: 1826250 - RNA, 17 nt, Salmonella typhimurium LT2
ucaauaauggcgcgaaa

SEQ ID NO: 1826251 - RNA, 12 nt, Salmonella typhimurium LT2
ucaagcuuuacc

SEQ ID NO: 1826252 - RNA, 19 nt, Salmonella typhimurium LT2
ucaagacgcucgacgucca

SEQ ID NO: 1826253 - RNA, 19 nt, Salmonella typhimurium LT2
ucaagccagguugcgcccg

SEQ ID NO: 1826254 - RNA, 12 nt, Salmonella typhimurium LT2
ucacaaagccca

SEQ ID NO: 1826255 - RNA, 17 nt, Salmonella typhimurium LT2
ucaauuugauggcuaau

SEQ ID NO: 1826256 - RNA, 15 nt, Salmonella typhimurium LT2
ucaaugcgacgccca

SEQ ID NO: 1826257 - RNA, 14 nt, Salmonella typhimurium LT2
ucaaucacuuucag

SEQ ID NO: 1826258 - RNA, 22 nt, Salmonella typhimurium LT2
ucaaucagcgugggcagccguu

SEQ ID NO: 1826259 - RNA, 20 nt, Salmonella typhimurium LT2
ucaauaucuuuuugcgucau

SEQ ID NO: 1826260 - RNA, 13 nt, Salmonella typhimurium LT2
ucaauauccagcc

SEQ ID NO: 1826261 - RNA, 18 nt, Salmonella typhimurium LT2
ucaauagcacaucagcca

SEQ ID NO: 1826262 - RNA, 13 nt, Salmonella typhimurium LT2
ucaaucgccacca

SEQ ID NO: 1826263 - RNA, 15 nt, Salmonella typhimurium LT2
ucaaugaucagcuug

SEQ ID NO: 1826264 - RNA, 15 nt, Salmonella typhimurium LT2
uaucaggccuacgac

SEQ ID NO: 1826265 - RNA, 23 nt, Salmonella typhimurium LT2
uaucaggauaauuucacccguau

SEQ ID NO: 1826266 - RNA, 23 nt, Salmonella typhimurium LT2
uaucaguccccacauuacgccca

SEQ ID NO: 1826267 - RNA, 15 nt, Salmonella typhimurium LT2
uaucagguaucccgc

SEQ ID NO: 1826268 - RNA, 19 nt, Salmonella typhimurium LT2
uaucagccauuaaccagau

SEQ ID NO: 1826269 - RNA, 24 nt, Salmonella typhimurium LT2
uaucccgccacuguccugacggcg

SEQ ID NO: 1826270 - RNA, 14 nt, Salmonella typhimurium LT2
uauccccgcuggcg

SEQ ID NO: 1826271 - RNA, 16 nt, Salmonella typhimurium LT2
uauccggcgcaucggu

SEQ ID NO: 1826272 - RNA, 14 nt, Salmonella typhimurium LT2
uauccgccgcaaac

SEQ ID NO: 1826273 - RNA, 20 nt, Salmonella typhimurium LT2
uaucggcggaaauucgcgcc

SEQ ID NO: 1826274 - RNA, 18 nt, Salmonella typhimurium LT2
uauccguucaucgguaau

SEQ ID NO: 1826275 - RNA, 18 nt, Salmonella typhimurium LT2
uagggcgcggcugguaag

SEQ ID NO: 1826276 - RNA, 14 nt, Salmonella typhimurium LT2
uagggugaucgauc

SEQ ID NO: 1826277 - RNA, 14 nt, Salmonella typhimurium LT2
uauacagacaaugc

SEQ ID NO: 1826278 - RNA, 15 nt, Salmonella typhimurium LT2
uauaccacugguuaa

SEQ ID NO: 1826279 - RNA, 14 nt, Salmonella typhimurium LT2
uauauagucaaugc

SEQ ID NO: 1826280 - RNA, 17 nt, Salmonella typhimurium LT2
uaugaucgaaaaugcgc

SEQ ID NO: 1826281 - RNA, 14 nt, Salmonella typhimurium LT2
uauuaaaaagcagc

SEQ ID NO: 1826282 - RNA, 21 nt, Salmonella typhimurium LT2
uaucgguaguguuaucgccga

SEQ ID NO: 1826283 - RNA, 22 nt, Salmonella typhimurium LT2
uaucugucaugcgggagcuugg

SEQ ID NO: 1826284 - RNA, 18 nt, Salmonella typhimurium LT2
uaugaccgagucuacauc

SEQ ID NO: 1826285 - RNA, 23 nt, Salmonella typhimurium LT2
uaucugcauugccgggcugaccg

SEQ ID NO: 1826286 - RNA, 16 nt, Salmonella typhimurium LT2
uaugagcgaacggcuu

SEQ ID NO: 1826287 - RNA, 16 nt, Salmonella typhimurium LT2
uaugaaagccaucgcu

SEQ ID NO: 1826288 - RNA, 22 nt, Salmonella typhimurium LT2
uaucuugagucaaaagauugau

SEQ ID NO: 1826289 - RNA, 13 nt, Salmonella typhimurium LT2
ucacguucagcgc

SEQ ID NO: 1826290 - RNA, 13 nt, Salmonella typhimurium LT2
ucacuucauccgg

SEQ ID NO: 1826291 - RNA, 16 nt, Salmonella typhimurium LT2
aauaaggccugagcuu

SEQ ID NO: 1826292 - RNA, 23 nt, Salmonella typhimurium LT2
ucagagguaaucagaucggcaag

SEQ ID NO: 1826293 - RNA, 20 nt, Salmonella typhimurium LT2
aauaagcaccggcgggcuga

SEQ ID NO: 1826294 - RNA, 13 nt, Salmonella typhimurium LT2
ucagaaauccgcg

SEQ ID NO: 1826295 - RNA, 14 nt, Salmonella typhimurium LT2
aauaacgucaccgc

SEQ ID NO: 1826296 - RNA, 20 nt, Salmonella typhimurium LT2
aauaacgguagagaaugguc

SEQ ID NO: 1826297 - RNA, 16 nt, Salmonella typhimurium LT2
aauaacccggauuguc

SEQ ID NO: 1826298 - RNA, 22 nt, Salmonella typhimurium LT2
aauaacaggcacaguagacaac

SEQ ID NO: 1826299 - RNA, 21 nt, Salmonella typhimurium LT2
ucacacagugcgcgaccgcau

SEQ ID NO: 1826300 - RNA, 18 nt, Salmonella typhimurium LT2
ucacgcuccuugagcgcc

SEQ ID NO: 1826301 - RNA, 17 nt, Salmonella typhimurium LT2
ucacgcucuucgccaau

SEQ ID NO: 1826302 - RNA, 20 nt, Salmonella typhimurium LT2
ucacgcagcuuauuggcaau

SEQ ID NO: 1826303 - RNA, 20 nt, Salmonella typhimurium LT2
ucaccuucggucccaucgcg

SEQ ID NO: 1826304 - RNA, 21 nt, Salmonella typhimurium LT2
ucaccuugucgagcgcggcau

SEQ ID NO: 1826305 - RNA, 18 nt, Salmonella typhimurium LT2
ucacgcaacaggccgcau

SEQ ID NO: 1826306 - RNA, 17 nt, Salmonella typhimurium LT2
ucaccugucgcuaacgc

SEQ ID NO: 1826307 - RNA, 14 nt, Salmonella typhimurium LT2
ucaccugauagcgg

SEQ ID NO: 1826308 - RNA, 12 nt, Salmonella typhimurium LT2
ucaggcacaaug

SEQ ID NO: 1826309 - RNA, 13 nt, Salmonella typhimurium LT2
ucaggauucgacg

SEQ ID NO: 1826310 - RNA, 22 nt, Salmonella typhimurium LT2
ucaggcagcaggauauccugcg

SEQ ID NO: 1826311 - RNA, 15 nt, Salmonella typhimurium LT2
ucaggcaauacgcug

SEQ ID NO: 1826312 - RNA, 13 nt, Salmonella typhimurium LT2
ucaggaucgccgg

SEQ ID NO: 1826313 - RNA, 21 nt, Salmonella typhimurium LT2
ucaggagggcugcccgccguu

SEQ ID NO: 1826314 - RNA, 22 nt, Salmonella typhimurium LT2
ucagcuccucgcgaaucucaau

SEQ ID NO: 1826315 - RNA, 20 nt, Salmonella typhimurium LT2
ucagcguuucgccguaaaac

SEQ ID NO: 1826316 - RNA, 20 nt, Salmonella typhimurium LT2
ucagcgugaugcgauccagc

SEQ ID NO: 1826317 - RNA, 15 nt, Salmonella typhimurium LT2
ucagcguuucaccuu

SEQ ID NO: 1826318 - RNA, 16 nt, Salmonella typhimurium LT2
ucagcgucauucaccg

SEQ ID NO: 1826319 - RNA, 19 nt, Salmonella typhimurium LT2
ucagauaaccuguggaucg

SEQ ID NO: 1826320 - RNA, 17 nt, Salmonella typhimurium LT2
aauaauguuuacgccau

SEQ ID NO: 1826321 - RNA, 23 nt, Salmonella typhimurium LT2
aauaaugcauccgccagaugaac

SEQ ID NO: 1826322 - RNA, 18 nt, Salmonella typhimurium LT2
ucagcauauccagcgccu

SEQ ID NO: 1826323 - RNA, 16 nt, Salmonella typhimurium LT2
ucagaucugcgcccau

SEQ ID NO: 1826324 - RNA, 21 nt, Salmonella typhimurium LT2
ucagccaggguuuaaucgccg

SEQ ID NO: 1826325 - RNA, 15 nt, Salmonella typhimurium LT2
ucagcaucuuaugcg

SEQ ID NO: 1826326 - RNA, 13 nt, Salmonella typhimurium LT2
ucagcgcgccaau

SEQ ID NO: 1826327 - RNA, 19 nt, Salmonella typhimurium LT2
ucagcgcgagcgugaucuc

SEQ ID NO: 1826328 - RNA, 12 nt, Salmonella typhimurium LT2
uccagcagcagg

SEQ ID NO: 1826329 - RNA, 23 nt, Salmonella typhimurium LT2
uccagcagcaggcaaggcaucag

SEQ ID NO: 1826330 - RNA, 21 nt, Salmonella typhimurium LT2
uccagcagccacagaaugccg

SEQ ID NO: 1826331 - RNA, 13 nt, Salmonella typhimurium LT2
uccagcccgcguu

SEQ ID NO: 1826332 - RNA, 22 nt, Salmonella typhimurium LT2
uccagcccggcggauaaaucau

SEQ ID NO: 1826333 - RNA, 16 nt, Salmonella typhimurium LT2
uccagccgccaggcaa

SEQ ID NO: 1826334 - RNA, 19 nt, Salmonella typhimurium LT2
uccagaccaccagcgacau

SEQ ID NO: 1826335 - RNA, 20 nt, Salmonella typhimurium LT2
uccagaucuucacgcgucag

SEQ ID NO: 1826336 - RNA, 17 nt, Salmonella typhimurium LT2
uccagaucuucccaguu

SEQ ID NO: 1826337 - RNA, 15 nt, Salmonella typhimurium LT2
uccagcaagccggaa

SEQ ID NO: 1826338 - RNA, 16 nt, Salmonella typhimurium LT2
uccacaaucccggcaa

SEQ ID NO: 1826339 - RNA, 16 nt, Salmonella typhimurium LT2
uccacaaacgccggau

SEQ ID NO: 1826340 - RNA, 22 nt, Salmonella typhimurium LT2
uccacagguaaaauugccgcca

SEQ ID NO: 1826341 - RNA, 22 nt, Salmonella typhimurium LT2
uccacugaguuucaccgccaga

SEQ ID NO: 1826342 - RNA, 19 nt, Salmonella typhimurium LT2
uccacugcuuaucgauauc

SEQ ID NO: 1826343 - RNA, 15 nt, Salmonella typhimurium LT2
uccagcguacugcgg

SEQ ID NO: 1826344 - RNA, 17 nt, Salmonella typhimurium LT2
uccaguuuuuuccagcg

SEQ ID NO: 1826345 - RNA, 20 nt, Salmonella typhimurium LT2
uccaguugaugaugccagga

SEQ ID NO: 1826346 - RNA, 17 nt, Salmonella typhimurium LT2
uccaguucguucugcgu

SEQ ID NO: 1826347 - RNA, 17 nt, Salmonella typhimurium LT2
uccaguacaagcaggcu

SEQ ID NO: 1826348 - RNA, 14 nt, Salmonella typhimurium LT2
uccaguagcagcga

SEQ ID NO: 1826349 - RNA, 17 nt, Salmonella typhimurium LT2
uccaguccucgcccacu

SEQ ID NO: 1826350 - RNA, 16 nt, Salmonella typhimurium LT2
uccagucaggcucaau

SEQ ID NO: 1826351 - RNA, 13 nt, Salmonella typhimurium LT2
uccagucgccagg

SEQ ID NO: 1826352 - RNA, 21 nt, Salmonella typhimurium LT2
uccauuaaaugcgccagcggc

SEQ ID NO: 1826353 - RNA, 16 nt, Salmonella typhimurium LT2
uccauucccgccgcaa

SEQ ID NO: 1826354 - RNA, 15 nt, Salmonella typhimurium LT2
uccauguucggcaug

SEQ ID NO: 1826355 - RNA, 17 nt, Salmonella typhimurium LT2
uccauuggcgggcgaau

SEQ ID NO: 1826356 - RNA, 18 nt, Salmonella typhimurium LT2
uccaugcaugacgcaggc

SEQ ID NO: 1826357 - RNA, 19 nt, Salmonella typhimurium LT2
uccaucgguucucugccau

SEQ ID NO: 1826358 - RNA, 16 nt, Salmonella typhimurium LT2
uccauccggguaauuu

SEQ ID NO: 1826359 - RNA, 22 nt, Salmonella typhimurium LT2
uccaucacgguuuacgcgcaau

SEQ ID NO: 1826360 - RNA, 18 nt, Salmonella typhimurium LT2
uccaucaauaauccggca

SEQ ID NO: 1826361 - RNA, 16 nt, Salmonella typhimurium LT2
uccaucagaucgaucu

SEQ ID NO: 1826362 - RNA, 16 nt, Salmonella typhimurium LT2
uccaucagccaggguu

SEQ ID NO: 1826363 - RNA, 14 nt, Salmonella typhimurium LT2
uccauauccagcgc

SEQ ID NO: 1826364 - RNA, 19 nt, Salmonella typhimurium LT2
ucaggcaugaccugccgga

SEQ ID NO: 1826365 - RNA, 13 nt, Salmonella typhimurium LT2
ucaggcaugccaa

SEQ ID NO: 1826366 - RNA, 20 nt, Salmonella typhimurium LT2
ucaggccaggguugcguucg

SEQ ID NO: 1826367 - RNA, 18 nt, Salmonella typhimurium LT2
ucauaaauagccagcauc

SEQ ID NO: 1826368 - RNA, 14 nt, Salmonella typhimurium LT2
ucaguuuuggcaau

SEQ ID NO: 1826369 - RNA, 14 nt, Salmonella typhimurium LT2
ucaguuguccauuu

SEQ ID NO: 1826370 - RNA, 13 nt, Salmonella typhimurium LT2
ucauaaucgccgu

SEQ ID NO: 1826371 - RNA, 15 nt, Salmonella typhimurium LT2
ucauaagucauccag

SEQ ID NO: 1826372 - RNA, 15 nt, Salmonella typhimurium LT2
ucauaucauccagcc

SEQ ID NO: 1826373 - RNA, 22 nt, Salmonella typhimurium LT2
ucaucguuugggccgguacuuu

SEQ ID NO: 1826374 - RNA, 13 nt, Salmonella typhimurium LT2
ucaucgucgcgcc

SEQ ID NO: 1826375 - RNA, 17 nt, Salmonella typhimurium LT2
ucaucgccaagcggcaa

SEQ ID NO: 1826376 - RNA, 18 nt, Salmonella typhimurium LT2
ucaucggucaguuugccc

SEQ ID NO: 1826377 - RNA, 22 nt, Salmonella typhimurium LT2
ucaucgauacgaccgccgacaa

SEQ ID NO: 1826378 - RNA, 13 nt, Salmonella typhimurium LT2
ucaucgaacgccg

SEQ ID NO: 1826379 - RNA, 18 nt, Salmonella typhimurium LT2
ucaucgacaguaccagca

SEQ ID NO: 1826380 - RNA, 18 nt, Salmonella typhimurium LT2
ucauccacauacugcaau

SEQ ID NO: 1826381 - RNA, 15 nt, Salmonella typhimurium LT2
ucaucauuuucccac

SEQ ID NO: 1826382 - RNA, 15 nt, Salmonella typhimurium LT2
ucaucauucgcgaau

SEQ ID NO: 1826383 - RNA, 15 nt, Salmonella typhimurium LT2
ucaucagccagcauc

SEQ ID NO: 1826384 - RNA, 15 nt, Salmonella typhimurium LT2
ucaucaggccugcaa

SEQ ID NO: 1826385 - RNA, 12 nt, Salmonella typhimurium LT2
ucaugucgucau

SEQ ID NO: 1826386 - RNA, 15 nt, Salmonella typhimurium LT2
ucauguacgaaagcg

SEQ ID NO: 1826387 - RNA, 13 nt, Salmonella typhimurium LT2
ucauuacgcgcau

SEQ ID NO: 1826388 - RNA, 22 nt, Salmonella typhimurium LT2
ucauuaaucaguucaggaacau

SEQ ID NO: 1826389 - RNA, 15 nt, Salmonella typhimurium LT2
ucauucccgccaaua

SEQ ID NO: 1826390 - RNA, 21 nt, Salmonella typhimurium LT2
ucauucuccgggauagcaauc

SEQ ID NO: 1826391 - RNA, 14 nt, Salmonella typhimurium LT2
ucauucugucagca

SEQ ID NO: 1826392 - RNA, 14 nt, Salmonella typhimurium LT2
ucauucuguucaau

SEQ ID NO: 1826393 - RNA, 16 nt, Salmonella typhimurium LT2
ucauucaccaccggau

SEQ ID NO: 1826394 - RNA, 11 nt, Salmonella typhimurium LT2
ucauugagcau

SEQ ID NO: 1826395 - RNA, 13 nt, Salmonella typhimurium LT2
ucauuuuccacaa

SEQ ID NO: 1826396 - RNA, 15 nt, Salmonella typhimurium LT2
ucauuuugccgauaa

SEQ ID NO: 1826397 - RNA, 15 nt, Salmonella typhimurium LT2
ucauuuuuguuaauu

SEQ ID NO: 1826398 - RNA, 17 nt, Salmonella typhimurium LT2
uaaaccacaugaccagc

SEQ ID NO: 1826399 - RNA, 18 nt, Salmonella typhimurium LT2
uaaacgacagcgccauca

SEQ ID NO: 1826400 - RNA, 19 nt, Salmonella typhimurium LT2
uaaacggcagccgccacca

SEQ ID NO: 1826401 - RNA, 21 nt, Salmonella typhimurium LT2
uaacagcgcgaccaggaaacc

SEQ ID NO: 1826402 - RNA, 16 nt, Salmonella typhimurium LT2
uaaacgccucauccgg

SEQ ID NO: 1826403 - RNA, 16 nt, Salmonella typhimurium LT2
uaaccagaucggcuau

SEQ ID NO: 1826404 - RNA, 22 nt, Salmonella typhimurium LT2
uaaccaacaggaggaucgccgc

SEQ ID NO: 1826405 - RNA, 15 nt, Salmonella typhimurium LT2
uaacgcuucaccucu

SEQ ID NO: 1826406 - RNA, 17 nt, Salmonella typhimurium LT2
uaacgcgcuggucagca

SEQ ID NO: 1826407 - RNA, 19 nt, Salmonella typhimurium LT2
uaacgugcgcuggaacgcg

SEQ ID NO: 1826408 - RNA, 17 nt, Salmonella typhimurium LT2
uaacgugcuccagcgcc

SEQ ID NO: 1826409 - RNA, 15 nt, Salmonella typhimurium LT2
uaacgucgccaucag

SEQ ID NO: 1826410 - RNA, 15 nt, Salmonella typhimurium LT2
uaacguacagguugu

SEQ ID NO: 1826411 - RNA, 16 nt, Salmonella typhimurium LT2
uaaccggaucggccau

SEQ ID NO: 1826412 - RNA, 18 nt, Salmonella typhimurium LT2
uaaccgaugcccggcaau

SEQ ID NO: 1826413 - RNA, 14 nt, Salmonella typhimurium LT2
uaacgcacuaccag

SEQ ID NO: 1826414 - RNA, 17 nt, Salmonella typhimurium LT2
uaacgcauguuccgcua

SEQ ID NO: 1826415 - RNA, 14 nt, Salmonella typhimurium LT2
uaagcgcagcgcca

SEQ ID NO: 1826416 - RNA, 14 nt, Salmonella typhimurium LT2
uaaggcgaagucgc

SEQ ID NO: 1826417 - RNA, 12 nt, Salmonella typhimurium LT2
uaacucuucauc

SEQ ID NO: 1826418 - RNA, 19 nt, Salmonella typhimurium LT2
uaacuccuucuaauuccag

SEQ ID NO: 1826419 - RNA, 23 nt, Salmonella typhimurium LT2
uaacuccuucuaauuccaggaug

SEQ ID NO: 1826420 - RNA, 24 nt, Salmonella typhimurium LT2
uaagccgucauaaaaucaaucugc

SEQ ID NO: 1826421 - RNA, 19 nt, Salmonella typhimurium LT2
uaauaugcucaacuuccag

SEQ ID NO: 1826422 - RNA, 24 nt, Salmonella typhimurium LT2
uaauaugccaggcuuccugcgcug

SEQ ID NO: 1826423 - RNA, 23 nt, Salmonella typhimurium LT2
uaaucaaugcgacgcccaaccag

SEQ ID NO: 1826424 - RNA, 13 nt, Salmonella typhimurium LT2
uaauaucauccgg

SEQ ID NO: 1826425 - RNA, 18 nt, Salmonella typhimurium LT2
uaauaucaacccucccug

SEQ ID NO: 1826426 - RNA, 16 nt, Salmonella typhimurium LT2
uaauaguuagccugau

SEQ ID NO: 1826427 - RNA, 14 nt, Salmonella typhimurium LT2
uaaucaccaccuca

SEQ ID NO: 1826428 - RNA, 17 nt, Salmonella typhimurium LT2
uaaucacccgcgccagc

SEQ ID NO: 1826429 - RNA, 16 nt, Salmonella typhimurium LT2
uaaucagcaucaccua

SEQ ID NO: 1826430 - RNA, 22 nt, Salmonella typhimurium LT2
uaaucaugaacgcuaucggcau

SEQ ID NO: 1826431 - RNA, 20 nt, Salmonella typhimurium LT2
uaauguugauaucacucaga

SEQ ID NO: 1826432 - RNA, 15 nt, Salmonella typhimurium LT2
uaauguugccguggc

SEQ ID NO: 1826433 - RNA, 19 nt, Salmonella typhimurium LT2
uacaaccucaaauaagguu

SEQ ID NO: 1826434 - RNA, 21 nt, Salmonella typhimurium LT2
uacaaucuaagagccuauccc

SEQ ID NO: 1826435 - RNA, 15 nt, Salmonella typhimurium LT2
uacacacuuaccgac

SEQ ID NO: 1826436 - RNA, 14 nt, Salmonella typhimurium LT2
uacacagacugcuu

SEQ ID NO: 1826437 - RNA, 17 nt, Salmonella typhimurium LT2
uacaccauuggcgcugg

SEQ ID NO: 1826438 - RNA, 19 nt, Salmonella typhimurium LT2
uacaggcgcaguugaaaac

SEQ ID NO: 1826439 - RNA, 20 nt, Salmonella typhimurium LT2
uacagggaauaugcugaucu

SEQ ID NO: 1826440 - RNA, 17 nt, Salmonella typhimurium LT2
uacagguugugcaucuc

SEQ ID NO: 1826441 - RNA, 13 nt, Salmonella typhimurium LT2
uacauacugcuuu

SEQ ID NO: 1826442 - RNA, 16 nt, Salmonella typhimurium LT2
uacaggcaucuuccag

SEQ ID NO: 1826443 - RNA, 13 nt, Salmonella typhimurium LT2
uacaggcaucuuc

SEQ ID NO: 1826444 - RNA, 14 nt, Salmonella typhimurium LT2
uacagcguaucggc

SEQ ID NO: 1826445 - RNA, 14 nt, Salmonella typhimurium LT2
uacagcauacgccg

SEQ ID NO: 1826446 - RNA, 22 nt, Salmonella typhimurium LT2
uacagacaucaucgaacgccgc

SEQ ID NO: 1826447 - RNA, 13 nt, Salmonella typhimurium LT2
uaccacgccgcac

SEQ ID NO: 1826448 - RNA, 12 nt, Salmonella typhimurium LT2
uaccacgccgcu

SEQ ID NO: 1826449 - RNA, 19 nt, Salmonella typhimurium LT2
uaccaauuuucucgccgau

SEQ ID NO: 1826450 - RNA, 21 nt, Salmonella typhimurium LT2
uaccaauuuucucgccgauag

SEQ ID NO: 1826451 - RNA, 18 nt, Salmonella typhimurium LT2
uaccacagaaaucgccgg

SEQ ID NO: 1826452 - RNA, 15 nt, Salmonella typhimurium LT2
uaccaauaucgccgu

SEQ ID NO: 1826453 - RNA, 12 nt, Salmonella typhimurium LT2
uacaucuuccau

SEQ ID NO: 1826454 - RNA, 18 nt, Salmonella typhimurium LT2
guugaucguaaagcgcau

SEQ ID NO: 1826455 - RNA, 23 nt, Salmonella typhimurium LT2
guugaugccgaccgucggcgcaa

SEQ ID NO: 1826456 - RNA, 20 nt, Salmonella typhimurium LT2
guugauacagaaaaccggca

SEQ ID NO: 1826457 - RNA, 14 nt, Salmonella typhimurium LT2
guucuuccagcguc

SEQ ID NO: 1826458 - RNA, 21 nt, Salmonella typhimurium LT2
guugcucccgcaccuggucua

SEQ ID NO: 1826459 - RNA, 18 nt, Salmonella typhimurium LT2
guugcguguuguacagca

SEQ ID NO: 1826460 - RNA, 19 nt, Salmonella typhimurium LT2
guugcccaguacggcgcga

SEQ ID NO: 1826461 - RNA, 20 nt, Salmonella typhimurium LT2
guugcccaucgcaacgccgg

SEQ ID NO: 1826462 - RNA, 14 nt, Salmonella typhimurium LT2
guugccagucgaga

SEQ ID NO: 1826463 - RNA, 14 nt, Salmonella typhimurium LT2
guugccccggcuua

SEQ ID NO: 1826464 - RNA, 18 nt, Salmonella typhimurium LT2
guugcccggcgccauccg

SEQ ID NO: 1826465 - RNA, 15 nt, Salmonella typhimurium LT2
uaaaaacgccaauca

SEQ ID NO: 1826466 - RNA, 20 nt, Salmonella typhimurium LT2
uaaaaaaggcagaagaaucu

SEQ ID NO: 1826467 - RNA, 16 nt, Salmonella typhimurium LT2
guuuuuuuaugcguuu

SEQ ID NO: 1826468 - RNA, 17 nt, Salmonella typhimurium LT2
uaaaaaugcgcuaacgu

SEQ ID NO: 1826469 - RNA, 11 nt, Salmonella typhimurium LT2
uaaaaucgcgu

SEQ ID NO: 1826470 - RNA, 14 nt, Salmonella typhimurium LT2
guuuugcggggcau

SEQ ID NO: 1826471 - RNA, 23 nt, Salmonella typhimurium LT2
guuuugaaaucuugcugucggac

SEQ ID NO: 1826472 - RNA, 17 nt, Salmonella typhimurium LT2
guuugacgaaaucgcau

SEQ ID NO: 1826473 - RNA, 18 nt, Salmonella typhimurium LT2
guuugauaaacugcgcca

SEQ ID NO: 1826474 - RNA, 13 nt, Salmonella typhimurium LT2
guuugaacagcag

SEQ ID NO: 1826475 - RNA, 20 nt, Salmonella typhimurium LT2
guuugccggagagaugccgc

SEQ ID NO: 1826476 - RNA, 16 nt, Salmonella typhimurium LT2
guuucuuguuaacgca

SEQ ID NO: 1826477 - RNA, 17 nt, Salmonella typhimurium LT2
guuucucuuccgccagc

SEQ ID NO: 1826478 - RNA, 13 nt, Salmonella typhimurium LT2
guuugccgggcau

SEQ ID NO: 1826479 - RNA, 15 nt, Salmonella typhimurium LT2
guuugcuccacgcca

SEQ ID NO: 1826480 - RNA, 16 nt, Salmonella typhimurium LT2
guuugcugagcagcca

SEQ ID NO: 1826481 - RNA, 16 nt, Salmonella typhimurium LT2
guugguugcuaucguc

SEQ ID NO: 1826482 - RNA, 18 nt, Salmonella typhimurium LT2
guugggugcagcgucagg

SEQ ID NO: 1826483 - RNA, 15 nt, Salmonella typhimurium LT2
guuuccgcguuauca

SEQ ID NO: 1826484 - RNA, 13 nt, Salmonella typhimurium LT2
guuuccggcagcu

SEQ ID NO: 1826485 - RNA, 22 nt, Salmonella typhimurium LT2
guuuccugcgcagauaccggcg

SEQ ID NO: 1826486 - RNA, 20 nt, Salmonella typhimurium LT2
guuucgccagcggcagcgcg

SEQ ID NO: 1826487 - RNA, 13 nt, Salmonella typhimurium LT2
guuucgccgccau

SEQ ID NO: 1826488 - RNA, 18 nt, Salmonella typhimurium LT2
guucaugaaccacgcuaa

SEQ ID NO: 1826489 - RNA, 20 nt, Salmonella typhimurium LT2
guuccaacagcgacgccaga

SEQ ID NO: 1826490 - RNA, 15 nt, Salmonella typhimurium LT2
guucauaccggauau

SEQ ID NO: 1826491 - RNA, 17 nt, Salmonella typhimurium LT2
guucaguuuuuccagca

SEQ ID NO: 1826492 - RNA, 13 nt, Salmonella typhimurium LT2
guucauaaaugau

SEQ ID NO: 1826493 - RNA, 22 nt, Salmonella typhimurium LT2
guucaucccacuccaucgccug

SEQ ID NO: 1826494 - RNA, 16 nt, Salmonella typhimurium LT2
guucauccgcgauuuu

SEQ ID NO: 1826495 - RNA, 12 nt, Salmonella typhimurium LT2
guucauccagca

SEQ ID NO: 1826496 - RNA, 22 nt, Salmonella typhimurium LT2
guucaucgcuggcguacgccau

SEQ ID NO: 1826497 - RNA, 20 nt, Salmonella typhimurium LT2
guuccguggugggcgcgacu

SEQ ID NO: 1826498 - RNA, 19 nt, Salmonella typhimurium LT2
guuccuguagcgugacggc

SEQ ID NO: 1826499 - RNA, 12 nt, Salmonella typhimurium LT2
guucccgccacu

SEQ ID NO: 1826500 - RNA, 18 nt, Salmonella typhimurium LT2
guuagcgaacguccagcg

SEQ ID NO: 1826501 - RNA, 20 nt, Salmonella typhimurium LT2
guuaaaaaauuuauaacgua

SEQ ID NO: 1826502 - RNA, 23 nt, Salmonella typhimurium LT2
guuagcgagguucccgccgccau

SEQ ID NO: 1826503 - RNA, 18 nt, Salmonella typhimurium LT2
guuagcgccaccgggcau

SEQ ID NO: 1826504 - RNA, 23 nt, Salmonella typhimurium LT2
guuagcagaauggcgaucaccgc

SEQ ID NO: 1826505 - RNA, 22 nt, Salmonella typhimurium LT2
guuaucaagagaaccguucaga

SEQ ID NO: 1826506 - RNA, 15 nt, Salmonella typhimurium LT2
guuauacaucgcuuu

SEQ ID NO: 1826507 - RNA, 14 nt, Salmonella typhimurium LT2
guucagccgccagu

SEQ ID NO: 1826508 - RNA, 13 nt, Salmonella typhimurium LT2
guucagccgccag

SEQ ID NO: 1826509 - RNA, 21 nt, Salmonella typhimurium LT2
guuaugcaaguucgaauagcc

SEQ ID NO: 1826510 - RNA, 12 nt, Salmonella typhimurium LT2
guuaucggccug

SEQ ID NO: 1826511 - RNA, 22 nt, Salmonella typhimurium LT2
guuaucgccgaucacaacguca

SEQ ID NO: 1826512 - RNA, 14 nt, Salmonella typhimurium LT2
guggcaucuuauca

SEQ ID NO: 1826513 - RNA, 15 nt, Salmonella typhimurium LT2
guggcauuucucgca

SEQ ID NO: 1826514 - RNA, 16 nt, Salmonella typhimurium LT2
guggcagaguccagcg

SEQ ID NO: 1826515 - RNA, 19 nt, Salmonella typhimurium LT2
gugguaucgcggcagcgcu

SEQ ID NO: 1826516 - RNA, 12 nt, Salmonella typhimurium LT2
guggucgacaua

SEQ ID NO: 1826517 - RNA, 16 nt, Salmonella typhimurium LT2
guguccccugcaggaa

SEQ ID NO: 1826518 - RNA, 20 nt, Salmonella typhimurium LT2
gugucccuggaugaucgagg

SEQ ID NO: 1826519 - RNA, 20 nt, Salmonella typhimurium LT2
gugucauagucggcgccaaa

SEQ ID NO: 1826520 - RNA, 13 nt, Salmonella typhimurium LT2
gugguguuaacga

SEQ ID NO: 1826521 - RNA, 16 nt, Salmonella typhimurium LT2
gugugcgacaucgaca

SEQ ID NO: 1826522 - RNA, 12 nt, Salmonella typhimurium LT2
gugucgauaacc

SEQ ID NO: 1826523 - RNA, 14 nt, Salmonella typhimurium LT2
guggcaaucgacgu

SEQ ID NO: 1826524 - RNA, 21 nt, Salmonella typhimurium LT2
guggaucugaaucuugcgcag

SEQ ID NO: 1826525 - RNA, 14 nt, Salmonella typhimurium LT2
guggacaucgccau

SEQ ID NO: 1826526 - RNA, 16 nt, Salmonella typhimurium LT2
gugcuuuagcuuuacu

SEQ ID NO: 1826527 - RNA, 14 nt, Salmonella typhimurium LT2
guggaacaaacgca

SEQ ID NO: 1826528 - RNA, 14 nt, Salmonella typhimurium LT2
gugcgccagcgcau

SEQ ID NO: 1826529 - RNA, 13 nt, Salmonella typhimurium LT2
gugcggcuuaucg

SEQ ID NO: 1826530 - RNA, 14 nt, Salmonella typhimurium LT2
gugcguccgguaga

SEQ ID NO: 1826531 - RNA, 19 nt, Salmonella typhimurium LT2
gugccgccauucgcuuccg

SEQ ID NO: 1826532 - RNA, 19 nt, Salmonella typhimurium LT2
gugauaaagcacagcccca

SEQ ID NO: 1826533 - RNA, 11 nt, Salmonella typhimurium LT2
gugauaacgcg

SEQ ID NO: 1826534 - RNA, 14 nt, Salmonella typhimurium LT2
gugauauagcgcca

SEQ ID NO: 1826535 - RNA, 17 nt, Salmonella typhimurium LT2
gugccaaucuccagcau

SEQ ID NO: 1826536 - RNA, 16 nt, Salmonella typhimurium LT2
gugccacaacgccuga

SEQ ID NO: 1826537 - RNA, 14 nt, Salmonella typhimurium LT2
gugccauuccagcc

SEQ ID NO: 1826538 - RNA, 14 nt, Salmonella typhimurium LT2
uggcgacggcgguc

SEQ ID NO: 1826539 - RNA, 18 nt, Salmonella typhimurium LT2
uggcgacgaucagcgcca

SEQ ID NO: 1826540 - RNA, 20 nt, Salmonella typhimurium LT2
uggcgcauccacguaaauag

SEQ ID NO: 1826541 - RNA, 16 nt, Salmonella typhimurium LT2
uggcgccaccagcgau

SEQ ID NO: 1826542 - RNA, 17 nt, Salmonella typhimurium LT2
uggcgccaccgcugcgc

SEQ ID NO: 1826543 - RNA, 19 nt, Salmonella typhimurium LT2
uggcgcccgguucgaacga

SEQ ID NO: 1826544 - RNA, 23 nt, Salmonella typhimurium LT2
uggcggcauaaacgccuuauccg

SEQ ID NO: 1826545 - RNA, 22 nt, Salmonella typhimurium LT2
uggcggaaaauagcgcaacggc

SEQ ID NO: 1826546 - RNA, 18 nt, Salmonella typhimurium LT2
uggcgcuuugcuuauccg

SEQ ID NO: 1826547 - RNA, 16 nt, Salmonella typhimurium LT2
uggcggcaagaucauc

SEQ ID NO: 1826548 - RNA, 17 nt, Salmonella typhimurium LT2
uggcggcaaaaacgccg

SEQ ID NO: 1826549 - RNA, 23 nt, Salmonella typhimurium LT2
uggcgcggaaagccuucaucauc

SEQ ID NO: 1826550 - RNA, 19 nt, Salmonella typhimurium LT2
uggcaugauggucgccagc

SEQ ID NO: 1826551 - RNA, 12 nt, Salmonella typhimurium LT2
uggccucauccg

SEQ ID NO: 1826552 - RNA, 15 nt, Salmonella typhimurium LT2
uggccuuauaagcug

SEQ ID NO: 1826553 - RNA, 16 nt, Salmonella typhimurium LT2
uggccugcuuaaacag

SEQ ID NO: 1826554 - RNA, 19 nt, Salmonella typhimurium LT2
uggccugcuuaaacagaau

SEQ ID NO: 1826555 - RNA, 21 nt, Salmonella typhimurium LT2
uggcguuccgguugccgagcc

SEQ ID NO: 1826556 - RNA, 23 nt, Salmonella typhimurium LT2
uggcuaugacaaguccgccgcua

SEQ ID NO: 1826557 - RNA, 16 nt, Salmonella typhimurium LT2
uggcucaauccaggug

SEQ ID NO: 1826558 - RNA, 19 nt, Salmonella typhimurium LT2
uggcucccgcagccacucc

SEQ ID NO: 1826559 - RNA, 23 nt, Salmonella typhimurium LT2
uggcugagaaaaauacgccagau

SEQ ID NO: 1826560 - RNA, 16 nt, Salmonella typhimurium LT2
uggcguaaaucaggcc

SEQ ID NO: 1826561 - RNA, 19 nt, Salmonella typhimurium LT2
uggcguaaaugugcgccag

SEQ ID NO: 1826562 - RNA, 17 nt, Salmonella typhimurium LT2
uggcguacgcagaucgu

SEQ ID NO: 1826563 - RNA, 18 nt, Salmonella typhimurium LT2
uggcguagaagcuuacca

SEQ ID NO: 1826564 - RNA, 15 nt, Salmonella typhimurium LT2
uggcguaaacgccau

SEQ ID NO: 1826565 - RNA, 17 nt, Salmonella typhimurium LT2
uggcgugaaccgguaaa

SEQ ID NO: 1826566 - RNA, 12 nt, Salmonella typhimurium LT2
uggcgucaauga

SEQ ID NO: 1826567 - RNA, 18 nt, Salmonella typhimurium LT2
uggcguguggcugucgac

SEQ ID NO: 1826568 - RNA, 16 nt, Salmonella typhimurium LT2
uggcuggcgcugacga

SEQ ID NO: 1826569 - RNA, 22 nt, Salmonella typhimurium LT2
uggcuggcgcaauguucuggga

SEQ ID NO: 1826570 - RNA, 23 nt, Salmonella typhimurium LT2
uggcuguagauacugaccaagcg

SEQ ID NO: 1826571 - RNA, 17 nt, Salmonella typhimurium LT2
uggcuguuaguaaacag

SEQ ID NO: 1826572 - RNA, 16 nt, Salmonella typhimurium LT2
uggcuucuggcggcaa

SEQ ID NO: 1826573 - RNA, 18 nt, Salmonella typhimurium LT2
uggcuugccagcagauuu

SEQ ID NO: 1826574 - RNA, 20 nt, Salmonella typhimurium LT2
uggcuuauagcuacguagcg

SEQ ID NO: 1826575 - RNA, 19 nt, Salmonella typhimurium LT2
ugggaauaaggcaccgaug

SEQ ID NO: 1826576 - RNA, 18 nt, Salmonella typhimurium LT2
uggcuuuuuccugccauu

SEQ ID NO: 1826577 - RNA, 20 nt, Salmonella typhimurium LT2
ugggaucgacucauccagca

SEQ ID NO: 1826578 - RNA, 17 nt, Salmonella typhimurium LT2
uggguaaaaucagcgcg

SEQ ID NO: 1826579 - RNA, 14 nt, Salmonella typhimurium LT2
ugguagacgcgcua

SEQ ID NO: 1826580 - RNA, 17 nt, Salmonella typhimurium LT2
ugguacucaacaucauu

SEQ ID NO: 1826581 - RNA, 13 nt, Salmonella typhimurium LT2
ugguaagcgcagc

SEQ ID NO: 1826582 - RNA, 15 nt, Salmonella typhimurium LT2
ugguguaggcguagc

SEQ ID NO: 1826583 - RNA, 16 nt, Salmonella typhimurium LT2
uggugguugcaucguc

SEQ ID NO: 1826584 - RNA, 13 nt, Salmonella typhimurium LT2
ugguguuuuccag

SEQ ID NO: 1826585 - RNA, 14 nt, Salmonella typhimurium LT2
ugguuacgcgacgu

SEQ ID NO: 1826586 - RNA, 16 nt, Salmonella typhimurium LT2
uggugaugaucgcggu

SEQ ID NO: 1826587 - RNA, 15 nt, Salmonella typhimurium LT2
uguccgggcguuuca

SEQ ID NO: 1826588 - RNA, 20 nt, Salmonella typhimurium LT2
uguccagaucuucacgcguc

SEQ ID NO: 1826589 - RNA, 16 nt, Salmonella typhimurium LT2
uguccaggucaucacc

SEQ ID NO: 1826590 - RNA, 20 nt, Salmonella typhimurium LT2
ugucgccaggccaucgccgc

SEQ ID NO: 1826591 - RNA, 15 nt, Salmonella typhimurium LT2
ugguuauccagcagc

SEQ ID NO: 1826592 - RNA, 16 nt, Salmonella typhimurium LT2
ugguuauccagcagcc

SEQ ID NO: 1826593 - RNA, 12 nt, Salmonella typhimurium LT2
uguaaagcgcca

SEQ ID NO: 1826594 - RNA, 19 nt, Salmonella typhimurium LT2
uguaggccugguaagcgca

SEQ ID NO: 1826595 - RNA, 21 nt, Salmonella typhimurium LT2
uguaggccugguaagcgcagc

SEQ ID NO: 1826596 - RNA, 22 nt, Salmonella typhimurium LT2
aaucaauuaacugacagcguuu

SEQ ID NO: 1826597 - RNA, 20 nt, Salmonella typhimurium LT2
uguaggccugauaagcgcag

SEQ ID NO: 1826598 - RNA, 19 nt, Salmonella typhimurium LT2
uguaggccugauaagcgua

SEQ ID NO: 1826599 - RNA, 17 nt, Salmonella typhimurium LT2
uguaaccaacaaacgcg

SEQ ID NO: 1826600 - RNA, 16 nt, Salmonella typhimurium LT2
uguaaccuuaaaaggc

SEQ ID NO: 1826601 - RNA, 19 nt, Salmonella typhimurium LT2
uguaaccuacgccaagcac

SEQ ID NO: 1826602 - RNA, 20 nt, Salmonella typhimurium LT2
uguaggccggguaagcgcaa

SEQ ID NO: 1826603 - RNA, 15 nt, Salmonella typhimurium LT2
ugucaucgccgcuaa

SEQ ID NO: 1826604 - RNA, 21 nt, Salmonella typhimurium LT2
ugucaucggucauaaccggcc

SEQ ID NO: 1826605 - RNA, 16 nt, Salmonella typhimurium LT2
ugucaugcgccacgac

SEQ ID NO: 1826606 - RNA, 14 nt, Salmonella typhimurium LT2
ugucaucgccgcua

SEQ ID NO: 1826607 - RNA, 21 nt, Salmonella typhimurium LT2
ugucauggcgccaccagcgau

SEQ ID NO: 1826608 - RNA, 21 nt, Salmonella typhimurium LT2
ugucauuccuuccacgcguac

SEQ ID NO: 1826609 - RNA, 20 nt, Salmonella typhimurium LT2
ugcgccuuacccggccuaca

SEQ ID NO: 1826610 - RNA, 20 nt, Salmonella typhimurium LT2
ugcgccuuaucaagccuaca

SEQ ID NO: 1826611 - RNA, 19 nt, Salmonella typhimurium LT2
ugcgccgccagugagguga

SEQ ID NO: 1826612 - RNA, 19 nt, Salmonella typhimurium LT2
ugcgcauccucuuuccguu

SEQ ID NO: 1826613 - RNA, 16 nt, Salmonella typhimurium LT2
ugcgcauugacgugcu

SEQ ID NO: 1826614 - RNA, 14 nt, Salmonella typhimurium LT2
ugcgcggcaucagc

SEQ ID NO: 1826615 - RNA, 21 nt, Salmonella typhimurium LT2
ugcgcggauugagcgaaucca

SEQ ID NO: 1826616 - RNA, 22 nt, Salmonella typhimurium LT2
ugcgcgaucucuuuggccagua

SEQ ID NO: 1826617 - RNA, 23 nt, Salmonella typhimurium LT2
ugcgcguuccccaacagcgacca

SEQ ID NO: 1826618 - RNA, 18 nt, Salmonella typhimurium LT2
ugcgcucauaaccgcgau

SEQ ID NO: 1826619 - RNA, 22 nt, Salmonella typhimurium LT2
ugcgcuccagcuucaucaucag

SEQ ID NO: 1826620 - RNA, 13 nt, Salmonella typhimurium LT2
ugcgcucgcgcca

SEQ ID NO: 1826621 - RNA, 15 nt, Salmonella typhimurium LT2
ugcgcgggcgguaag

SEQ ID NO: 1826622 - RNA, 19 nt, Salmonella typhimurium LT2
ugcgcuuaccgggccuaca

SEQ ID NO: 1826623 - RNA, 16 nt, Salmonella typhimurium LT2
ugcgcugugacaggcg

SEQ ID NO: 1826624 - RNA, 19 nt, Salmonella typhimurium LT2
ugcggcagaaucacggccg

SEQ ID NO: 1826625 - RNA, 23 nt, Salmonella typhimurium LT2
ugcggcauagccuaucgggacga

SEQ ID NO: 1826626 - RNA, 17 nt, Salmonella typhimurium LT2
ugccguauaauccagcu

SEQ ID NO: 1826627 - RNA, 17 nt, Salmonella typhimurium LT2
ugccguauaccagcguc

SEQ ID NO: 1826628 - RNA, 17 nt, Salmonella typhimurium LT2
ugccguccgaucucguu

SEQ ID NO: 1826629 - RNA, 22 nt, Salmonella typhimurium LT2
ugccgcgcggauucuccaggcg

SEQ ID NO: 1826630 - RNA, 15 nt, Salmonella typhimurium LT2
ugccguuuuccagcc

SEQ ID NO: 1826631 - RNA, 12 nt, Salmonella typhimurium LT2
ugccuacuguuc

SEQ ID NO: 1826632 - RNA, 16 nt, Salmonella typhimurium LT2
aauaguccagcagcca

SEQ ID NO: 1826633 - RNA, 23 nt, Salmonella typhimurium LT2
aauagugauaccagccaacagua

SEQ ID NO: 1826634 - RNA, 17 nt, Salmonella typhimurium LT2
aauagguauguaacgug

SEQ ID NO: 1826635 - RNA, 18 nt, Salmonella typhimurium LT2
ugcgcaaauccgacggca

SEQ ID NO: 1826636 - RNA, 18 nt, Salmonella typhimurium LT2
ugcgcagccccagcgcca

SEQ ID NO: 1826637 - RNA, 21 nt, Salmonella typhimurium LT2
ugcgaauggagaagcgcgccu

SEQ ID NO: 1826638 - RNA, 14 nt, Salmonella typhimurium LT2
ugccuggagccagc

SEQ ID NO: 1826639 - RNA, 16 nt, Salmonella typhimurium LT2
ugccugccgcagcggc

SEQ ID NO: 1826640 - RNA, 18 nt, Salmonella typhimurium LT2
ugccugcguugcuauggc

SEQ ID NO: 1826641 - RNA, 18 nt, Salmonella typhimurium LT2
ugcgaggucaccgggcga

SEQ ID NO: 1826642 - RNA, 19 nt, Salmonella typhimurium LT2
uggcaggcgcgaccucauc

SEQ ID NO: 1826643 - RNA, 11 nt, Salmonella typhimurium LT2
uggcagcgccc

SEQ ID NO: 1826644 - RNA, 22 nt, Salmonella typhimurium LT2
uggcacuggcgacggcaucggc

SEQ ID NO: 1826645 - RNA, 21 nt, Salmonella typhimurium LT2
uggcaacuugccgaucaugac

SEQ ID NO: 1826646 - RNA, 16 nt, Salmonella typhimurium LT2
uggcaacgucgacccg

SEQ ID NO: 1826647 - RNA, 17 nt, Salmonella typhimurium LT2
uggcaagcgccagcaug

SEQ ID NO: 1826648 - RNA, 12 nt, Salmonella typhimurium LT2
uggcaaucgacg

SEQ ID NO: 1826649 - RNA, 20 nt, Salmonella typhimurium LT2
uggcaacauagcaucguuac

SEQ ID NO: 1826650 - RNA, 22 nt, Salmonella typhimurium LT2
uggcaacccguaccuccagcga

SEQ ID NO: 1826651 - RNA, 20 nt, Salmonella typhimurium LT2
uggauuccuggcuugccaga

SEQ ID NO: 1826652 - RNA, 20 nt, Salmonella typhimurium LT2
uggauagcaccauaaacggc

SEQ ID NO: 1826653 - RNA, 15 nt, Salmonella typhimurium LT2
uggauagucuucaag

SEQ ID NO: 1826654 - RNA, 15 nt, Salmonella typhimurium LT2
uggauauucauugcc

SEQ ID NO: 1826655 - RNA, 16 nt, Salmonella typhimurium LT2
uggaucaggcgcuugc

SEQ ID NO: 1826656 - RNA, 13 nt, Salmonella typhimurium LT2
uggaugaacucaa

SEQ ID NO: 1826657 - RNA, 19 nt, Salmonella typhimurium LT2
uggagagcagcgccagcga

SEQ ID NO: 1826658 - RNA, 13 nt, Salmonella typhimurium LT2
uggauaaccugcc

SEQ ID NO: 1826659 - RNA, 21 nt, Salmonella typhimurium LT2
uggagccaauagguaaaccag

SEQ ID NO: 1826660 - RNA, 15 nt, Salmonella typhimurium LT2
ugcuguacauaucca

SEQ ID NO: 1826661 - RNA, 19 nt, Salmonella typhimurium LT2
uggaacuuuaucgcacggc

SEQ ID NO: 1826662 - RNA, 18 nt, Salmonella typhimurium LT2
ugcuguauuaacagcuuc

SEQ ID NO: 1826663 - RNA, 13 nt, Salmonella typhimurium LT2
ugcugucgcccau

SEQ ID NO: 1826664 - RNA, 14 nt, Salmonella typhimurium LT2
uggaaguugccgcc

SEQ ID NO: 1826665 - RNA, 14 nt, Salmonella typhimurium LT2
uggaauaccacauc

SEQ ID NO: 1826666 - RNA, 19 nt, Salmonella typhimurium LT2
ugcgucaaaauaagcaccg

SEQ ID NO: 1826667 - RNA, 11 nt, Salmonella typhimurium LT2
ugcgucaacgc

SEQ ID NO: 1826668 - RNA, 17 nt, Salmonella typhimurium LT2
ugcgucaucauccggua

SEQ ID NO: 1826669 - RNA, 13 nt, Salmonella typhimurium LT2
ugcgucccagcac

SEQ ID NO: 1826670 - RNA, 15 nt, Salmonella typhimurium LT2
ugcgugaugcaucag

SEQ ID NO: 1826671 - RNA, 14 nt, Salmonella typhimurium LT2
ugcgugcgcgccac

SEQ ID NO: 1826672 - RNA, 21 nt, Salmonella typhimurium LT2
ugcggcgaaauauuaucgcca

SEQ ID NO: 1826673 - RNA, 21 nt, Salmonella typhimurium LT2
ugcggcgccaggacaacgccg

SEQ ID NO: 1826674 - RNA, 14 nt, Salmonella typhimurium LT2
ugcguauccagcgc

SEQ ID NO: 1826675 - RNA, 18 nt, Salmonella typhimurium LT2
ugcguaccugcggcgcuu

SEQ ID NO: 1826676 - RNA, 13 nt, Salmonella typhimurium LT2
ugcuacgcgccag

SEQ ID NO: 1826677 - RNA, 19 nt, Salmonella typhimurium LT2
ugcuauaugcaggcauaaa

SEQ ID NO: 1826678 - RNA, 16 nt, Salmonella typhimurium LT2
aauauccuccaccucg

SEQ ID NO: 1826679 - RNA, 13 nt, Salmonella typhimurium LT2
ugcguucuuccac

SEQ ID NO: 1826680 - RNA, 11 nt, Salmonella typhimurium LT2
aauauccagcc

SEQ ID NO: 1826681 - RNA, 16 nt, Salmonella typhimurium LT2
ugcguggcguaucggc

SEQ ID NO: 1826682 - RNA, 21 nt, Salmonella typhimurium LT2
ugcguggcgcugggccgacgu

SEQ ID NO: 1826683 - RNA, 17 nt, Salmonella typhimurium LT2
ugcucuggcuuguucau

SEQ ID NO: 1826684 - RNA, 19 nt, Salmonella typhimurium LT2
ugcucuacucaguaagcgc

SEQ ID NO: 1826685 - RNA, 14 nt, Salmonella typhimurium LT2
ugcucaaucgccug

SEQ ID NO: 1826686 - RNA, 18 nt, Salmonella typhimurium LT2
ugcuggguuaacgcgcca

SEQ ID NO: 1826687 - RNA, 13 nt, Salmonella typhimurium LT2
ugcugccagcaug

SEQ ID NO: 1826688 - RNA, 15 nt, Salmonella typhimurium LT2
uuuuauuuuagcuuc

SEQ ID NO: 1826689 - RNA, 13 nt, Salmonella typhimurium LT2
uuuuaucagcuug

SEQ ID NO: 1826690 - RNA, 21 nt, Salmonella typhimurium LT2
uuuguugcuccagcaucacau

SEQ ID NO: 1826691 - RNA, 17 nt, Salmonella typhimurium LT2
uuuguucauaucgaaga

SEQ ID NO: 1826692 - RNA, 14 nt, Salmonella typhimurium LT2
uuuugauauaaccg

SEQ ID NO: 1826693 - RNA, 12 nt, Salmonella typhimurium LT2
uuuugccgauaa

SEQ ID NO: 1826694 - RNA, 20 nt, Salmonella typhimurium LT2
uuuucaaugucgcaaucggc

SEQ ID NO: 1826695 - RNA, 18 nt, Salmonella typhimurium LT2
uuuucgcccccagcacga

SEQ ID NO: 1826696 - RNA, 17 nt, Salmonella typhimurium LT2
uuuucgcccgguucauu

SEQ ID NO: 1826697 - RNA, 21 nt, Salmonella typhimurium LT2
uuuucgccagguacaucgcgc

SEQ ID NO: 1826698 - RNA, 19 nt, Salmonella typhimurium LT2
aaucugugugggcacucga

SEQ ID NO: 1826699 - RNA, 16 nt, Salmonella typhimurium LT2
aaucuuuccagcucca

SEQ ID NO: 1826700 - RNA, 16 nt, Salmonella typhimurium LT2
aaugccaccagcgcca

SEQ ID NO: 1826701 - RNA, 17 nt, Salmonella typhimurium LT2
aaugccauccagcacca

SEQ ID NO: 1826702 - RNA, 23 nt, Salmonella typhimurium LT2
aaugccgauagucuccgccaccu

SEQ ID NO: 1826703 - RNA, 19 nt, Salmonella typhimurium LT2
aaugccgaucaccagcgca

SEQ ID NO: 1826704 - RNA, 20 nt, Salmonella typhimurium LT2
aaugcccuuaaauccggccu

SEQ ID NO: 1826705 - RNA, 21 nt, Salmonella typhimurium LT2
aaugccccgugacuuuccagu

SEQ ID NO: 1826706 - RNA, 22 nt, Salmonella typhimurium LT2
uuuuuccaguagucgcgccauu

SEQ ID NO: 1826707 - RNA, 17 nt, Salmonella typhimurium LT2
aaucgccagcagcgcga

SEQ ID NO: 1826708 - RNA, 23 nt, Salmonella typhimurium LT2
uuuuggugauuaacagcgccauc

SEQ ID NO: 1826709 - RNA, 15 nt, Salmonella typhimurium LT2
uuuuguagacucgcg

SEQ ID NO: 1826710 - RNA, 15 nt, Salmonella typhimurium LT2
uuuugucauaaggcg

SEQ ID NO: 1826711 - RNA, 19 nt, Salmonella typhimurium LT2
aaucucgcaagauuccaga

SEQ ID NO: 1826712 - RNA, 17 nt, Salmonella typhimurium LT2
aaucucgugaucgccaa

SEQ ID NO: 1826713 - RNA, 23 nt, Salmonella typhimurium LT2
aaucgccgcgccggacuccagca

SEQ ID NO: 1826714 - RNA, 17 nt, Salmonella typhimurium LT2
aaucgccgccgccaggu

SEQ ID NO: 1826715 - RNA, 18 nt, Salmonella typhimurium LT2
aaucucacugcccauucg

SEQ ID NO: 1826716 - RNA, 15 nt, Salmonella typhimurium LT2
uuuuuucuucaguuc

SEQ ID NO: 1826717 - RNA, 14 nt, Salmonella typhimurium LT2
aauuaaaggcagcg

SEQ ID NO: 1826718 - RNA, 18 nt, Salmonella typhimurium LT2
aauuaccacgcagccgag

SEQ ID NO: 1826719 - RNA, 18 nt, Salmonella typhimurium LT2
aauucgcagagcgcauca

SEQ ID NO: 1826720 - RNA, 20 nt, Salmonella typhimurium LT2
aauucauagagcgcguccag

SEQ ID NO: 1826721 - RNA, 22 nt, Salmonella typhimurium LT2
aauuauugugagaaaagcagag

SEQ ID NO: 1826722 - RNA, 16 nt, Salmonella typhimurium LT2
aauuguugcugcguuu

SEQ ID NO: 1826723 - RNA, 18 nt, Salmonella typhimurium LT2
aauuuccagugccaguua

SEQ ID NO: 1826724 - RNA, 22 nt, Salmonella typhimurium LT2
aauuuccccugcgaacagcgcu

SEQ ID NO: 1826725 - RNA, 14 nt, Salmonella typhimurium LT2
aauucugcaggcca

SEQ ID NO: 1826726 - RNA, 15 nt, Salmonella typhimurium LT2
aauugaagaguuuga

SEQ ID NO: 1826727 - RNA, 23 nt, Salmonella typhimurium LT2
aauugccaggcguuacgcgccac

SEQ ID NO: 1826728 - RNA, 15 nt, Salmonella typhimurium LT2
aauuggcauccagca

SEQ ID NO: 1826729 - RNA, 21 nt, Salmonella typhimurium LT2
uugcucaaaaagcucaagcgc

SEQ ID NO: 1826730 - RNA, 15 nt, Salmonella typhimurium LT2
uugcugcguaaccgc

SEQ ID NO: 1826731 - RNA, 22 nt, Salmonella typhimurium LT2
uugcggugagaaacgcgccacg

SEQ ID NO: 1826732 - RNA, 22 nt, Salmonella typhimurium LT2
uugcgcgauuuauagagcgcca

SEQ ID NO: 1826733 - RNA, 16 nt, Salmonella typhimurium LT2
uugcgcgccacgccca

SEQ ID NO: 1826734 - RNA, 19 nt, Salmonella typhimurium LT2
uugcgcagcauaucgccgu

SEQ ID NO: 1826735 - RNA, 16 nt, Salmonella typhimurium LT2
uugcgcuccggcacug

SEQ ID NO: 1826736 - RNA, 12 nt, Salmonella typhimurium LT2
uugcggcaucag

SEQ ID NO: 1826737 - RNA, 18 nt, Salmonella typhimurium LT2
uugccuuguuucgucaau

SEQ ID NO: 1826738 - RNA, 18 nt, Salmonella typhimurium LT2
uugaucuccgcgcaaucg

SEQ ID NO: 1826739 - RNA, 13 nt, Salmonella typhimurium LT2
uuggccugauauc

SEQ ID NO: 1826740 - RNA, 12 nt, Salmonella typhimurium LT2
uuggacggcauc

SEQ ID NO: 1826741 - RNA, 21 nt, Salmonella typhimurium LT2
uugcuuauucagucuggcaaa

SEQ ID NO: 1826742 - RNA, 18 nt, Salmonella typhimurium LT2
uuggcuauuuuuugcugg

SEQ ID NO: 1826743 - RNA, 20 nt, Salmonella typhimurium LT2
uugggaaggugauguccaga

SEQ ID NO: 1826744 - RNA, 12 nt, Salmonella typhimurium LT2
uuguagaccuga

SEQ ID NO: 1826745 - RNA, 19 nt, Salmonella typhimurium LT2
uuguuuacgcccucaucgg

SEQ ID NO: 1826746 - RNA, 14 nt, Salmonella typhimurium LT2
uuuaacgaacgcgc

SEQ ID NO: 1826747 - RNA, 12 nt, Salmonella typhimurium LT2
uuguaucgauaa

SEQ ID NO: 1826748 - RNA, 16 nt, Salmonella typhimurium LT2
uuguaguuaucgccga

SEQ ID NO: 1826749 - RNA, 22 nt, Salmonella typhimurium LT2
uuguaguuucagcccaaaagcg

SEQ ID NO: 1826750 - RNA, 17 nt, Salmonella typhimurium LT2
aaucgaauacagcgccu

SEQ ID NO: 1826751 - RNA, 15 nt, Salmonella typhimurium LT2
aaucgaacugacggu

SEQ ID NO: 1826752 - RNA, 11 nt, Salmonella typhimurium LT2
aauccugucgu

SEQ ID NO: 1826753 - RNA, 20 nt, Salmonella typhimurium LT2
uuuagcguuucaucggugua

SEQ ID NO: 1826754 - RNA, 15 nt, Salmonella typhimurium LT2
uuuagcaugacaaua

SEQ ID NO: 1826755 - RNA, 13 nt, Salmonella typhimurium LT2
uuuagcagcaaua

SEQ ID NO: 1826756 - RNA, 18 nt, Salmonella typhimurium LT2
uuuaagacuacauacgcg

SEQ ID NO: 1826757 - RNA, 17 nt, Salmonella typhimurium LT2
uuuaagccgauugaaua

SEQ ID NO: 1826758 - RNA, 10 nt, Salmonella typhimurium LT2
uuuacgccau

SEQ ID NO: 1826759 - RNA, 21 nt, Salmonella typhimurium LT2
uuuccugucucuauuaaccgg

SEQ ID NO: 1826760 - RNA, 21 nt, Salmonella typhimurium LT2
uuucgccagcgcaucgauaua

SEQ ID NO: 1826761 - RNA, 17 nt, Salmonella typhimurium LT2
uuucgccagaaccgcgc

SEQ ID NO: 1826762 - RNA, 20 nt, Salmonella typhimurium LT2
uuucgccagaaccgcgcugg

SEQ ID NO: 1826763 - RNA, 23 nt, Salmonella typhimurium LT2
uuucagauuuuuaauguccagca

SEQ ID NO: 1826764 - RNA, 18 nt, Salmonella typhimurium LT2
uuucauuccuuuagcuuc

SEQ ID NO: 1826765 - RNA, 20 nt, Salmonella typhimurium LT2
uuucaucuuuaaaaucgcgc

SEQ ID NO: 1826766 - RNA, 22 nt, Salmonella typhimurium LT2
uuucaagcagacgaucggcgug

SEQ ID NO: 1826767 - RNA, 12 nt, Salmonella typhimurium LT2
uuucacuauaaa

SEQ ID NO: 1826768 - RNA, 16 nt, Salmonella typhimurium LT2
uuuauccacgccgcua

SEQ ID NO: 1826769 - RNA, 17 nt, Salmonella typhimurium LT2
uuuauccacgccgcuau

SEQ ID NO: 1826770 - RNA, 16 nt, Salmonella typhimurium LT2
uuuagugcucagcuug

SEQ ID NO: 1826771 - RNA, 20 nt, Salmonella typhimurium LT2
uuccuguacgccugcuucac

SEQ ID NO: 1826772 - RNA, 14 nt, Salmonella typhimurium LT2
uuccuguuccugag

SEQ ID NO: 1826773 - RNA, 16 nt, Salmonella typhimurium LT2
uucgagggcgauuuug

SEQ ID NO: 1826774 - RNA, 20 nt, Salmonella typhimurium LT2
uucgcagaucgccuggaucg

SEQ ID NO: 1826775 - RNA, 18 nt, Salmonella typhimurium LT2
uucgcagcaauucugcug

SEQ ID NO: 1826776 - RNA, 14 nt, Salmonella typhimurium LT2
uucggcauaacgca

SEQ ID NO: 1826777 - RNA, 23 nt, Salmonella typhimurium LT2
uucggggauuauuugaucccguc

SEQ ID NO: 1826778 - RNA, 18 nt, Salmonella typhimurium LT2
uucgcgaauagugcagaa

SEQ ID NO: 1826779 - RNA, 21 nt, Salmonella typhimurium LT2
uucgccugccgggguauccgu

SEQ ID NO: 1826780 - RNA, 21 nt, Salmonella typhimurium LT2
uucgcguuagccggguccgga

SEQ ID NO: 1826781 - RNA, 17 nt, Salmonella typhimurium LT2
uucgcucccucaucaau

SEQ ID NO: 1826782 - RNA, 15 nt, Salmonella typhimurium LT2
uucauagaaccacuu

SEQ ID NO: 1826783 - RNA, 12 nt, Salmonella typhimurium LT2
uucagcgucaaa

SEQ ID NO: 1826784 - RNA, 23 nt, Salmonella typhimurium LT2
uucaguuuuuccagcacggcaua

SEQ ID NO: 1826785 - RNA, 15 nt, Salmonella typhimurium LT2
uucccgaugccagca

SEQ ID NO: 1826786 - RNA, 12 nt, Salmonella typhimurium LT2
uuccccaucgcg

SEQ ID NO: 1826787 - RNA, 18 nt, Salmonella typhimurium LT2
uucccccagccacgcgug

SEQ ID NO: 1826788 - RNA, 17 nt, Salmonella typhimurium LT2
uucccaucaaucaccuu

SEQ ID NO: 1826789 - RNA, 14 nt, Salmonella typhimurium LT2
uuccggcaucacau

SEQ ID NO: 1826790 - RNA, 14 nt, Salmonella typhimurium LT2
uuccugcugguaga

SEQ ID NO: 1826791 - RNA, 17 nt, Salmonella typhimurium LT2
uuccugaaggguccgaa

SEQ ID NO: 1826792 - RNA, 17 nt, Salmonella typhimurium LT2
uuccgguacacgcaguc

SEQ ID NO: 1826793 - RNA, 17 nt, Salmonella typhimurium LT2
uuccgugaaucccggaa

SEQ ID NO: 1826794 - RNA, 20 nt, Salmonella typhimurium LT2
uuccgucauggugaugaucg

SEQ ID NO: 1826795 - RNA, 12 nt, Salmonella typhimurium LT2
uuccuacaauga

SEQ ID NO: 1826796 - RNA, 13 nt, Salmonella typhimurium LT2
uucuuucaucaaa

SEQ ID NO: 1826797 - RNA, 21 nt, Salmonella typhimurium LT2
uugaaaaccacaaucacagcg

SEQ ID NO: 1826798 - RNA, 22 nt, Salmonella typhimurium LT2
uucuugcggugagaaacgcgcc

SEQ ID NO: 1826799 - RNA, 19 nt, Salmonella typhimurium LT2
uucugaacuguaaccggcg

SEQ ID NO: 1826800 - RNA, 18 nt, Salmonella typhimurium LT2
uucgguauuaaaacgcac

SEQ ID NO: 1826801 - RNA, 17 nt, Salmonella typhimurium LT2
uucggugauuuccagaa

SEQ ID NO: 1826802 - RNA, 17 nt, Salmonella typhimurium LT2
aaucagccgacggcgau

SEQ ID NO: 1826803 - RNA, 17 nt, Salmonella typhimurium LT2
uucguacauguccagau

SEQ ID NO: 1826804 - RNA, 19 nt, Salmonella typhimurium LT2
uucguacuccugcaucguu

SEQ ID NO: 1826805 - RNA, 12 nt, Salmonella typhimurium LT2
uugagccagaua

SEQ ID NO: 1826806 - RNA, 18 nt, Salmonella typhimurium LT2
uugacguuuuugacaucc

SEQ ID NO: 1826807 - RNA, 20 nt, Salmonella typhimurium LT2
uugagcucucuuccagguua

SEQ ID NO: 1826808 - RNA, 14 nt, Salmonella typhimurium LT2
uugaguaucaaugc

SEQ ID NO: 1826809 - RNA, 16 nt, Salmonella typhimurium LT2
uugauagcgaucagcg

SEQ ID NO: 1826810 - RNA, 13 nt, Salmonella typhimurium LT2
uugacaaccugcc

SEQ ID NO: 1826811 - RNA, 17 nt, Salmonella typhimurium LT2
uugaagguauccagcca

SEQ ID NO: 1826812 - RNA, 20 nt, Salmonella typhimurium LT2
uugaacggcgucauccggcg

SEQ ID NO: 1826813 - RNA, 13 nt, Salmonella typhimurium LT2
uucaaauccagcu

SEQ ID NO: 1826814 - RNA, 17 nt, Salmonella typhimurium LT2
uucaacccgaucgccau

SEQ ID NO: 1826815 - RNA, 21 nt, Salmonella typhimurium LT2
uuauuugaauagucaaccguu

SEQ ID NO: 1826816 - RNA, 21 nt, Salmonella typhimurium LT2
uuauuggcccccaucgccagc

SEQ ID NO: 1826817 - RNA, 20 nt, Salmonella typhimurium LT2
uucaaacggcuggaaucuac

SEQ ID NO: 1826818 - RNA, 16 nt, Salmonella typhimurium LT2
uucacccccaucgccc

SEQ ID NO: 1826819 - RNA, 19 nt, Salmonella typhimurium LT2
uucaccacuuugcgguuac

SEQ ID NO: 1826820 - RNA, 21 nt, Salmonella typhimurium LT2
uucaccaccacccgaucgccc

SEQ ID NO: 1826821 - RNA, 19 nt, Salmonella typhimurium LT2
uucacaugcaauaccggga

SEQ ID NO: 1826822 - RNA, 14 nt, Salmonella typhimurium LT2
uucaaucagcacgc

SEQ ID NO: 1826823 - RNA, 13 nt, Salmonella typhimurium LT2
uucaauuuccagu

SEQ ID NO: 1826824 - RNA, 12 nt, Salmonella typhimurium LT2
uucaccggauac

SEQ ID NO: 1826825 - RNA, 15 nt, Salmonella typhimurium LT2
uucaccguaucgccc

SEQ ID NO: 1826826 - RNA, 15 nt, Salmonella typhimurium LT2
uucagcauauccagc

SEQ ID NO: 1826827 - RNA, 18 nt, Salmonella typhimurium LT2
uucagcgacaggcugucg

SEQ ID NO: 1826828 - RNA, 19 nt, Salmonella typhimurium LT2
uuauguaccgucaucgccc

SEQ ID NO: 1826829 - RNA, 18 nt, Salmonella typhimurium LT2
uuauguauuucucgccgc

SEQ ID NO: 1826830 - RNA, 19 nt, Salmonella typhimurium LT2
uuaucuggcgcaaccggcg

SEQ ID NO: 1826831 - RNA, 14 nt, Salmonella typhimurium LT2
uuaucuaucaccgc

SEQ ID NO: 1826832 - RNA, 18 nt, Salmonella typhimurium LT2
uuaucuccauauccagca

SEQ ID NO: 1826833 - RNA, 11 nt, Salmonella typhimurium LT2
uuaucuuccac

SEQ ID NO: 1826834 - RNA, 18 nt, Salmonella typhimurium LT2
uuauccugcaaauagcgc

SEQ ID NO: 1826835 - RNA, 13 nt, Salmonella typhimurium LT2
uuauccugcaaau

SEQ ID NO: 1826836 - RNA, 13 nt, Salmonella typhimurium LT2
uuaucguccggca

SEQ ID NO: 1826837 - RNA, 23 nt, Salmonella typhimurium LT2
uuaccuacaauuugaauuacccc

SEQ ID NO: 1826838 - RNA, 14 nt, Salmonella typhimurium LT2
uuacuauuuuucac

SEQ ID NO: 1826839 - RNA, 13 nt, Salmonella typhimurium LT2
uuacuugucggaa

SEQ ID NO: 1826840 - RNA, 18 nt, Salmonella typhimurium LT2
uuacugugccgccggugu

SEQ ID NO: 1826841 - RNA, 20 nt, Salmonella typhimurium LT2
uuauagcaaccccucaucgg

SEQ ID NO: 1826842 - RNA, 11 nt, Salmonella typhimurium LT2
uguuccagcug

SEQ ID NO: 1826843 - RNA, 13 nt, Salmonella typhimurium LT2
uguucaucgccgu

SEQ ID NO: 1826844 - RNA, 14 nt, Salmonella typhimurium LT2
uguucaucgccgug

SEQ ID NO: 1826845 - RNA, 19 nt, Salmonella typhimurium LT2
uguuguccggccacggauu

SEQ ID NO: 1826846 - RNA, 16 nt, Salmonella typhimurium LT2
uguuuacgccgccauc

SEQ ID NO: 1826847 - RNA, 20 nt, Salmonella typhimurium LT2
ugucgcuuauucggccuaca

SEQ ID NO: 1826848 - RNA, 23 nt, Salmonella typhimurium LT2
uguuuuuucagcgcgccgcgcag

SEQ ID NO: 1826849 - RNA, 15 nt, Salmonella typhimurium LT2
uguuuucugccagca

SEQ ID NO: 1826850 - RNA, 13 nt, Salmonella typhimurium LT2
uuaaaacgcacgc

SEQ ID NO: 1826851 - RNA, 13 nt, Salmonella typhimurium LT2
uuaacggcaacag

SEQ ID NO: 1826852 - RNA, 22 nt, Salmonella typhimurium LT2
uuaacggcccaggcaucgacgc

SEQ ID NO: 1826853 - RNA, 17 nt, Salmonella typhimurium LT2
uuaacgcuuucgccagc

SEQ ID NO: 1826854 - RNA, 13 nt, Salmonella typhimurium LT2
uguuuuaacggaa

SEQ ID NO: 1826855 - RNA, 15 nt, Salmonella typhimurium LT2
uuaagcccaaccgcg

SEQ ID NO: 1826856 - RNA, 19 nt, Salmonella typhimurium LT2
uuaaggacauucagcacgc

SEQ ID NO: 1826857 - RNA, 19 nt, Salmonella typhimurium LT2
uuaauuucuuugccccaua

SEQ ID NO: 1826858 - RNA, 16 nt, Salmonella typhimurium LT2
uuaaugucacaaugcc

SEQ ID NO: 1826859 - RNA, 14 nt, Salmonella typhimurium LT2
uuaauggcuuucac

SEQ ID NO: 1826860 - RNA, 19 nt, Salmonella typhimurium LT2
uuaauggucucgccgauag

SEQ ID NO: 1826861 - RNA, 17 nt, Salmonella typhimurium LT2
acgcgcuuguucgucug

SEQ ID NO: 1826862 - RNA, 21 nt, Salmonella typhimurium LT2
acgcgcugcgguuuacgccau

SEQ ID NO: 1826863 - RNA, 21 nt, Salmonella typhimurium LT2
acgcgcuguaacuucacgcca

SEQ ID NO: 1826864 - RNA, 23 nt, Salmonella typhimurium LT2
acgcggaaucgucacagaccccg

SEQ ID NO: 1826865 - RNA, 18 nt, Salmonella typhimurium LT2
acgcggcgcuacggcgca

SEQ ID NO: 1826866 - RNA, 17 nt, Salmonella typhimurium LT2
acgcggcguacgcugca

SEQ ID NO: 1826867 - RNA, 23 nt, Salmonella typhimurium LT2
acgcggucuuuuaaaagaccugg

SEQ ID NO: 1826868 - RNA, 15 nt, Salmonella typhimurium LT2
acgcgaauccgccau

SEQ ID NO: 1826869 - RNA, 17 nt, Salmonella typhimurium LT2
acgcgaagauuaauccg

SEQ ID NO: 1826870 - RNA, 23 nt, Salmonella typhimurium LT2
acgcgaagcggcgccauccggca

SEQ ID NO: 1826871 - RNA, 17 nt, Salmonella typhimurium LT2
acgcgaauagccagaca

SEQ ID NO: 1826872 - RNA, 18 nt, Salmonella typhimurium LT2
acgcgcgcggcgucaacg

SEQ ID NO: 1826873 - RNA, 15 nt, Salmonella typhimurium LT2
acgcgcgcgcgucaa

SEQ ID NO: 1826874 - RNA, 13 nt, Salmonella typhimurium LT2
acgccguccagca

SEQ ID NO: 1826875 - RNA, 13 nt, Salmonella typhimurium LT2
acgccgucggcag

SEQ ID NO: 1826876 - RNA, 14 nt, Salmonella typhimurium LT2
acgccgucgacaaa

SEQ ID NO: 1826877 - RNA, 16 nt, Salmonella typhimurium LT2
acgccgugaacgccaa

SEQ ID NO: 1826878 - RNA, 19 nt, Salmonella typhimurium LT2
acgccgucugguacggcca

SEQ ID NO: 1826879 - RNA, 13 nt, Salmonella typhimurium LT2
acgccuuucacgc

SEQ ID NO: 1826880 - RNA, 16 nt, Salmonella typhimurium LT2
acgccuuucacgccga

SEQ ID NO: 1826881 - RNA, 21 nt, Salmonella typhimurium LT2
acgccuuuacccuuacggcca

SEQ ID NO: 1826882 - RNA, 14 nt, Salmonella typhimurium LT2
acgccugccagaua

SEQ ID NO: 1826883 - RNA, 20 nt, Salmonella typhimurium LT2
acgccugaugcugcgaggcc

SEQ ID NO: 1826884 - RNA, 22 nt, Salmonella typhimurium LT2
acgccugcuucacggauagacu

SEQ ID NO: 1826885 - RNA, 20 nt, Salmonella typhimurium LT2
acgccugcaucaacaggcga

SEQ ID NO: 1826886 - RNA, 19 nt, Salmonella typhimurium LT2
acgccggucaggauacagc

SEQ ID NO: 1826887 - RNA, 21 nt, Salmonella typhimurium LT2
acgccggguaaacgcagcguc

SEQ ID NO: 1826888 - RNA, 16 nt, Salmonella typhimurium LT2
acgccgguacgcagca

SEQ ID NO: 1826889 - RNA, 18 nt, Salmonella typhimurium LT2
acgccgggcacgcugacc

SEQ ID NO: 1826890 - RNA, 14 nt, Salmonella typhimurium LT2
acgccgcgcuggau

SEQ ID NO: 1826891 - RNA, 20 nt, Salmonella typhimurium LT2
acgcgucccagauaauccac

SEQ ID NO: 1826892 - RNA, 18 nt, Salmonella typhimurium LT2
acgcgucagaaauccgcg

SEQ ID NO: 1826893 - RNA, 23 nt, Salmonella typhimurium LT2
acgcguuguccaacugucgccau

SEQ ID NO: 1826894 - RNA, 15 nt, Salmonella typhimurium LT2
acgcuccggcaggca

SEQ ID NO: 1826895 - RNA, 12 nt, Salmonella typhimurium LT2
acgcuccagcag

SEQ ID NO: 1826896 - RNA, 21 nt, Salmonella typhimurium LT2
acgcucgcggaagcgaccggc

SEQ ID NO: 1826897 - RNA, 13 nt, Salmonella typhimurium LT2
acgcucacgcgca

SEQ ID NO: 1826898 - RNA, 18 nt, Salmonella typhimurium LT2
acgcucacgcgcagacgc

SEQ ID NO: 1826899 - RNA, 23 nt, Salmonella typhimurium LT2
acgcucauuaaaccgcgcggcau

SEQ ID NO: 1826900 - RNA, 18 nt, Salmonella typhimurium LT2
acgcuaccgucgacgucu

SEQ ID NO: 1826901 - RNA, 18 nt, Salmonella typhimurium LT2
acgcuacaccaagacgac

SEQ ID NO: 1826902 - RNA, 17 nt, Salmonella typhimurium LT2
acgcuaaagucagcaua

SEQ ID NO: 1826903 - RNA, 13 nt, Salmonella typhimurium LT2
acgcuaacgcgca

SEQ ID NO: 1826904 - RNA, 16 nt, Salmonella typhimurium LT2
acgcuaacguccgccg

SEQ ID NO: 1826905 - RNA, 16 nt, Salmonella typhimurium LT2
acgcguucauccagcg

SEQ ID NO: 1826906 - RNA, 14 nt, Salmonella typhimurium LT2
acgcuaaucccgcu

SEQ ID NO: 1826907 - RNA, 15 nt, Salmonella typhimurium LT2
acggagauuaacagc

SEQ ID NO: 1826908 - RNA, 16 nt, Salmonella typhimurium LT2
acggacagcgcgcaaa

SEQ ID NO: 1826909 - RNA, 22 nt, Salmonella typhimurium LT2
acggaaggaaauaacgugcccu

SEQ ID NO: 1826910 - RNA, 14 nt, Salmonella typhimurium LT2
acgcuguugccgcu

SEQ ID NO: 1826911 - RNA, 23 nt, Salmonella typhimurium LT2
acgcuguaguuccuguagcguga

SEQ ID NO: 1826912 - RNA, 13 nt, Salmonella typhimurium LT2
acgcuguaccggc

SEQ ID NO: 1826913 - RNA, 17 nt, Salmonella typhimurium LT2
acgcuggugcgcggaag

SEQ ID NO: 1826914 - RNA, 22 nt, Salmonella typhimurium LT2
acgcugguuugugugcaggagc

SEQ ID NO: 1826915 - RNA, 16 nt, Salmonella typhimurium LT2
acgcugacgcgaucgc

SEQ ID NO: 1826916 - RNA, 18 nt, Salmonella typhimurium LT2
acgcugaaaaccgcauca

SEQ ID NO: 1826917 - RNA, 14 nt, Salmonella typhimurium LT2
acgcucgucgguaa

SEQ ID NO: 1826918 - RNA, 14 nt, Salmonella typhimurium LT2
acgcucuccuacac

SEQ ID NO: 1826919 - RNA, 22 nt, Salmonella typhimurium LT2
acgcugauacugacacgccagu

SEQ ID NO: 1826920 - RNA, 13 nt, Salmonella typhimurium LT2
acgcugaggcgcc

SEQ ID NO: 1826921 - RNA, 22 nt, Salmonella typhimurium LT2
acgcugcgccuggucuuccgca

SEQ ID NO: 1826922 - RNA, 17 nt, Salmonella typhimurium LT2
acgcacguacggaaggu

SEQ ID NO: 1826923 - RNA, 16 nt, Salmonella typhimurium LT2
acgcacguucagcuca

SEQ ID NO: 1826924 - RNA, 16 nt, Salmonella typhimurium LT2
acgcacuguaacgcac

SEQ ID NO: 1826925 - RNA, 19 nt, Salmonella typhimurium LT2
acgcagaagcgcguuggcg

SEQ ID NO: 1826926 - RNA, 19 nt, Salmonella typhimurium LT2
acgcaacaggccgcaucgg

SEQ ID NO: 1826927 - RNA, 17 nt, Salmonella typhimurium LT2
acgauuucaucagcgac

SEQ ID NO: 1826928 - RNA, 23 nt, Salmonella typhimurium LT2
acgaugcuugccauauugccgca

SEQ ID NO: 1826929 - RNA, 15 nt, Salmonella typhimurium LT2
acgauaucgccuggu

SEQ ID NO: 1826930 - RNA, 11 nt, Salmonella typhimurium LT2
acgauaucgcc

SEQ ID NO: 1826931 - RNA, 17 nt, Salmonella typhimurium LT2
acgaucaugaaucgcgc

SEQ ID NO: 1826932 - RNA, 12 nt, Salmonella typhimurium LT2
acgaucagcgcc

SEQ ID NO: 1826933 - RNA, 22 nt, Salmonella typhimurium LT2
acgaucccuucaauaucaagau

SEQ ID NO: 1826934 - RNA, 15 nt, Salmonella typhimurium LT2
acgcccgugacgcca

SEQ ID NO: 1826935 - RNA, 21 nt, Salmonella typhimurium LT2
acgccaguuccgccacggcgu

SEQ ID NO: 1826936 - RNA, 17 nt, Salmonella typhimurium LT2
acgccaguggaugcgcu

SEQ ID NO: 1826937 - RNA, 19 nt, Salmonella typhimurium LT2
acgccaucgcggcgcaaau

SEQ ID NO: 1826938 - RNA, 21 nt, Salmonella typhimurium LT2
acgccaucgccugauggcgcu

SEQ ID NO: 1826939 - RNA, 22 nt, Salmonella typhimurium LT2
acgcaggcgauagccccaguaa

SEQ ID NO: 1826940 - RNA, 17 nt, Salmonella typhimurium LT2
acgcaucguggccgaua

SEQ ID NO: 1826941 - RNA, 22 nt, Salmonella typhimurium LT2
acgcaugacccaggcaucagau

SEQ ID NO: 1826942 - RNA, 12 nt, Salmonella typhimurium LT2
acgccagcagac

SEQ ID NO: 1826943 - RNA, 15 nt, Salmonella typhimurium LT2
acgccacugccauaa

SEQ ID NO: 1826944 - RNA, 20 nt, Salmonella typhimurium LT2
acgccacgcuccagcggaag

SEQ ID NO: 1826945 - RNA, 16 nt, Salmonella typhimurium LT2
acgcauuucuccugau

SEQ ID NO: 1826946 - RNA, 20 nt, Salmonella typhimurium LT2
acgaaacauuauggcgugau

SEQ ID NO: 1826947 - RNA, 17 nt, Salmonella typhimurium LT2
acgaaagucuguucgua

SEQ ID NO: 1826948 - RNA, 22 nt, Salmonella typhimurium LT2
accuuuuugauccguuucagaa

SEQ ID NO: 1826949 - RNA, 14 nt, Salmonella typhimurium LT2
accuuuugccgccc

SEQ ID NO: 1826950 - RNA, 14 nt, Salmonella typhimurium LT2
acgaacugauggcg

SEQ ID NO: 1826951 - RNA, 24 nt, Salmonella typhimurium LT2
acgaagauugucgaucacgguggu

SEQ ID NO: 1826952 - RNA, 22 nt, Salmonella typhimurium LT2
acgaacgcgcgucgcuaaucag

SEQ ID NO: 1826953 - RNA, 15 nt, Salmonella typhimurium LT2
accuggugcucaauc

SEQ ID NO: 1826954 - RNA, 12 nt, Salmonella typhimurium LT2
accuuccggcac

SEQ ID NO: 1826955 - RNA, 20 nt, Salmonella typhimurium LT2
accguugcgcccaucaucau

SEQ ID NO: 1826956 - RNA, 23 nt, Salmonella typhimurium LT2
accguuggaauaaaucacaacgu

SEQ ID NO: 1826957 - RNA, 17 nt, Salmonella typhimurium LT2
accguuuaaacgggcag

SEQ ID NO: 1826958 - RNA, 14 nt, Salmonella typhimurium LT2
accguuuccgccag

SEQ ID NO: 1826959 - RNA, 15 nt, Salmonella typhimurium LT2
accguuuccgccagu

SEQ ID NO: 1826960 - RNA, 15 nt, Salmonella typhimurium LT2
acgaggcauggcgau

SEQ ID NO: 1826961 - RNA, 22 nt, Salmonella typhimurium LT2
acgagaacucagaggcggcgua

SEQ ID NO: 1826962 - RNA, 12 nt, Salmonella typhimurium LT2
acgauaccagcg

SEQ ID NO: 1826963 - RNA, 18 nt, Salmonella typhimurium LT2
acgauacccaccagcgug

SEQ ID NO: 1826964 - RNA, 18 nt, Salmonella typhimurium LT2
acgagugccagccccgua

SEQ ID NO: 1826965 - RNA, 18 nt, Salmonella typhimurium LT2
acgagugcucaccgacag

SEQ ID NO: 1826966 - RNA, 23 nt, Salmonella typhimurium LT2
acgaguucucgccggauggcgac

SEQ ID NO: 1826967 - RNA, 23 nt, Salmonella typhimurium LT2
acgaagcgggcaauuccggucau

SEQ ID NO: 1826968 - RNA, 19 nt, Salmonella typhimurium LT2
acgacagcgccaucagcau

SEQ ID NO: 1826969 - RNA, 20 nt, Salmonella typhimurium LT2
acgacaggcagcgucagccc

SEQ ID NO: 1826970 - RNA, 18 nt, Salmonella typhimurium LT2
acgacuuacgcagcauua

SEQ ID NO: 1826971 - RNA, 23 nt, Salmonella typhimurium LT2
acgguggccagacgcaguagcgc

SEQ ID NO: 1826972 - RNA, 22 nt, Salmonella typhimurium LT2
acgguggccgccagcgcgguuu

SEQ ID NO: 1826973 - RNA, 21 nt, Salmonella typhimurium LT2
acgguuggcuauacgcggcgu

SEQ ID NO: 1826974 - RNA, 18 nt, Salmonella typhimurium LT2
acgggcaagguuaugcag

SEQ ID NO: 1826975 - RNA, 20 nt, Salmonella typhimurium LT2
acgggagagcguauccagca

SEQ ID NO: 1826976 - RNA, 16 nt, Salmonella typhimurium LT2
acggcuccagcgccag

SEQ ID NO: 1826977 - RNA, 19 nt, Salmonella typhimurium LT2
acggcuauucuucgaucgc

SEQ ID NO: 1826978 - RNA, 20 nt, Salmonella typhimurium LT2
acggauuuuacuugucggaa

SEQ ID NO: 1826979 - RNA, 13 nt, Salmonella typhimurium LT2
acggcuaccugca

SEQ ID NO: 1826980 - RNA, 21 nt, Salmonella typhimurium LT2
acggcgucaaauccaccgcca

SEQ ID NO: 1826981 - RNA, 15 nt, Salmonella typhimurium LT2
acguuacgcaucugc

SEQ ID NO: 1826982 - RNA, 16 nt, Salmonella typhimurium LT2
acguguuuauccccgc

SEQ ID NO: 1826983 - RNA, 16 nt, Salmonella typhimurium LT2
acguuaaagccgacca

SEQ ID NO: 1826984 - RNA, 19 nt, Salmonella typhimurium LT2
acgugugcugcgucaacgc

SEQ ID NO: 1826985 - RNA, 24 nt, Salmonella typhimurium LT2
acguuauuggcccccaucgccagc

SEQ ID NO: 1826986 - RNA, 19 nt, Salmonella typhimurium LT2
acguggccagcaugcccgc

SEQ ID NO: 1826987 - RNA, 17 nt, Salmonella typhimurium LT2
acguggaguccgaggca

SEQ ID NO: 1826988 - RNA, 20 nt, Salmonella typhimurium LT2
acguggcgcgaauuuucgau

SEQ ID NO: 1826989 - RNA, 20 nt, Salmonella typhimurium LT2
acgugauuucaugcggugca

SEQ ID NO: 1826990 - RNA, 15 nt, Salmonella typhimurium LT2
acuaccagacacagu

SEQ ID NO: 1826991 - RNA, 18 nt, Salmonella typhimurium LT2
acuaucaugaaugcccca

SEQ ID NO: 1826992 - RNA, 22 nt, Salmonella typhimurium LT2
acuauuccgcaaacgccgugaa

SEQ ID NO: 1826993 - RNA, 16 nt, Salmonella typhimurium LT2
acuaagaccagcauca

SEQ ID NO: 1826994 - RNA, 13 nt, Salmonella typhimurium LT2
acguugcgccaug

SEQ ID NO: 1826995 - RNA, 17 nt, Salmonella typhimurium LT2
acguugaucgccaucgc

SEQ ID NO: 1826996 - RNA, 22 nt, Salmonella typhimurium LT2
acguugaugauaaauugcggca

SEQ ID NO: 1826997 - RNA, 13 nt, Salmonella typhimurium LT2
acguauuaucccg

SEQ ID NO: 1826998 - RNA, 20 nt, Salmonella typhimurium LT2
acguauuucgcagcgaucag

SEQ ID NO: 1826999 - RNA, 19 nt, Salmonella typhimurium LT2
acgucagacgaggguaaua

SEQ ID NO: 1827000 - RNA, 19 nt, Salmonella typhimurium LT2
acgucacgugacgcagacg

SEQ ID NO: 1827001 - RNA, 20 nt, Salmonella typhimurium LT2
acgucagcccaaaacgcgcc

SEQ ID NO: 1827002 - RNA, 21 nt, Salmonella typhimurium LT2
acgucaggaaacgcgccggaa

SEQ ID NO: 1827003 - RNA, 14 nt, Salmonella typhimurium LT2
acguccguuagcug

SEQ ID NO: 1827004 - RNA, 18 nt, Salmonella typhimurium LT2
acguaacgcaaucccgcg

SEQ ID NO: 1827005 - RNA, 22 nt, Salmonella typhimurium LT2
acguaacucggcagcgcgacau

SEQ ID NO: 1827006 - RNA, 17 nt, Salmonella typhimurium LT2
acgguuuucacuggcau

SEQ ID NO: 1827007 - RNA, 15 nt, Salmonella typhimurium LT2
acgguuuauccccgc

SEQ ID NO: 1827008 - RNA, 16 nt, Salmonella typhimurium LT2
acgguuucagcagcgg

SEQ ID NO: 1827009 - RNA, 15 nt, Salmonella typhimurium LT2
acgucgcucccggca

SEQ ID NO: 1827010 - RNA, 20 nt, Salmonella typhimurium LT2
acgucuggaaacccgcucgc

SEQ ID NO: 1827011 - RNA, 14 nt, Salmonella typhimurium LT2
acgugacgcgccag

SEQ ID NO: 1827012 - RNA, 16 nt, Salmonella typhimurium LT2
acugcauaauggcgac

SEQ ID NO: 1827013 - RNA, 23 nt, Salmonella typhimurium LT2
acugcgcgauaucugccgcgcca

SEQ ID NO: 1827014 - RNA, 17 nt, Salmonella typhimurium LT2
acugaguuucaccgcca

SEQ ID NO: 1827015 - RNA, 17 nt, Salmonella typhimurium LT2
acugcgcucuaucaccg

SEQ ID NO: 1827016 - RNA, 12 nt, Salmonella typhimurium LT2
acugcggcauua

SEQ ID NO: 1827017 - RNA, 16 nt, Salmonella typhimurium LT2
acuggugacaucgcca

SEQ ID NO: 1827018 - RNA, 21 nt, Salmonella typhimurium LT2
acuggcggcaaaaacgccggu

SEQ ID NO: 1827019 - RNA, 13 nt, Salmonella typhimurium LT2
acuggcggcgcac

SEQ ID NO: 1827020 - RNA, 20 nt, Salmonella typhimurium LT2
acucugauccuacccgcgua

SEQ ID NO: 1827021 - RNA, 20 nt, Salmonella typhimurium LT2
acugauaccccagcgauccc

SEQ ID NO: 1827022 - RNA, 20 nt, Salmonella typhimurium LT2
acugacuuaauaacagcggc

SEQ ID NO: 1827023 - RNA, 12 nt, Salmonella typhimurium LT2
acugagcgaauc

SEQ ID NO: 1827024 - RNA, 16 nt, Salmonella typhimurium LT2
acucaagcgaauccag

SEQ ID NO: 1827025 - RNA, 20 nt, Salmonella typhimurium LT2
acucacgggcguagucagcg

SEQ ID NO: 1827026 - RNA, 16 nt, Salmonella typhimurium LT2
acucacguucagcgcg

SEQ ID NO: 1827027 - RNA, 14 nt, Salmonella typhimurium LT2
acucagccaggucu

SEQ ID NO: 1827028 - RNA, 20 nt, Salmonella typhimurium LT2
acuucaaugucguuaucgcc

SEQ ID NO: 1827029 - RNA, 23 nt, Salmonella typhimurium LT2
acuucaaucaacaccagcagcgc

SEQ ID NO: 1827030 - RNA, 14 nt, Salmonella typhimurium LT2
acuucaaugccgca

SEQ ID NO: 1827031 - RNA, 18 nt, Salmonella typhimurium LT2
acuucaauuuuccagaua

SEQ ID NO: 1827032 - RNA, 20 nt, Salmonella typhimurium LT2
acuucacaaucagcgcaaua

SEQ ID NO: 1827033 - RNA, 21 nt, Salmonella typhimurium LT2
acugugguuaugguugccgca

SEQ ID NO: 1827034 - RNA, 15 nt, Salmonella typhimurium LT2
acugugacgacaguu

SEQ ID NO: 1827035 - RNA, 16 nt, Salmonella typhimurium LT2
acuuccgguauccguu

SEQ ID NO: 1827036 - RNA, 13 nt, Salmonella typhimurium LT2
acuucagcagcag

SEQ ID NO: 1827037 - RNA, 13 nt, Salmonella typhimurium LT2
acuucaucgccac

SEQ ID NO: 1827038 - RNA, 20 nt, Salmonella typhimurium LT2
acuucaucgccacagacgaa

SEQ ID NO: 1827039 - RNA, 18 nt, Salmonella typhimurium LT2
acuucucgaaguucucaa

SEQ ID NO: 1827040 - RNA, 20 nt, Salmonella typhimurium LT2
acuucugacagugacggcaa

SEQ ID NO: 1827041 - RNA, 19 nt, Salmonella typhimurium LT2
acuugcgccgccauccggc

SEQ ID NO: 1827042 - RNA, 17 nt, Salmonella typhimurium LT2
acuuucuccaugccaga

SEQ ID NO: 1827043 - RNA, 19 nt, Salmonella typhimurium LT2
acuuucucggcuuuccagc

SEQ ID NO: 1827044 - RNA, 20 nt, Salmonella typhimurium LT2
acuuugaccagcaucgccgg

SEQ ID NO: 1827045 - RNA, 20 nt, Salmonella typhimurium LT2
acuuuuucucuuaucgccgc

SEQ ID NO: 1827046 - RNA, 19 nt, Salmonella typhimurium LT2
accgggcagacaugaccgc

SEQ ID NO: 1827047 - RNA, 19 nt, Salmonella typhimurium LT2
accgggcaggauacggcgc

SEQ ID NO: 1827048 - RNA, 12 nt, Salmonella typhimurium LT2
accguccagcgc

SEQ ID NO: 1827049 - RNA, 15 nt, Salmonella typhimurium LT2
accgucauccacgcc

SEQ ID NO: 1827050 - RNA, 23 nt, Salmonella typhimurium LT2
accgucagcuccgguaucgccgg

SEQ ID NO: 1827051 - RNA, 19 nt, Salmonella typhimurium LT2
accgucaccacgcgcgaag

SEQ ID NO: 1827052 - RNA, 12 nt, Salmonella typhimurium LT2
accguauccgcc

SEQ ID NO: 1827053 - RNA, 16 nt, Salmonella typhimurium LT2
accguaucggcaguca

SEQ ID NO: 1827054 - RNA, 22 nt, Salmonella typhimurium LT2
accguaguagguauccagcaga

SEQ ID NO: 1827055 - RNA, 20 nt, Salmonella typhimurium LT2
accguaaucaucgcgaucgc

SEQ ID NO: 1827056 - RNA, 22 nt, Salmonella typhimurium LT2
accguaaucaucgcgaucgcca

SEQ ID NO: 1827057 - RNA, 22 nt, Salmonella typhimurium LT2
accguaccagaacucguugcca

SEQ ID NO: 1827058 - RNA, 22 nt, Salmonella typhimurium LT2
accgguucgcggcagauccugg

SEQ ID NO: 1827059 - RNA, 20 nt, Salmonella typhimurium LT2
accgucggccacgcuaaagu

SEQ ID NO: 1827060 - RNA, 23 nt, Salmonella typhimurium LT2
accgugcccggaguccauauccg

SEQ ID NO: 1827061 - RNA, 15 nt, Salmonella typhimurium LT2
accggcgccagcucu

SEQ ID NO: 1827062 - RNA, 18 nt, Salmonella typhimurium LT2
accggcgucucgcacucg

SEQ ID NO: 1827063 - RNA, 13 nt, Salmonella typhimurium LT2
accggcggcgucu

SEQ ID NO: 1827064 - RNA, 22 nt, Salmonella typhimurium LT2
accggcagcgucggcuucauca

SEQ ID NO: 1827065 - RNA, 21 nt, Salmonella typhimurium LT2
accggcacgguuaaugaaauc

SEQ ID NO: 1827066 - RNA, 14 nt, Salmonella typhimurium LT2
accggacgcaucgc

SEQ ID NO: 1827067 - RNA, 20 nt, Salmonella typhimurium LT2
accggagccugggaucgcau

SEQ ID NO: 1827068 - RNA, 15 nt, Salmonella typhimurium LT2
accggcaugauggcg

SEQ ID NO: 1827069 - RNA, 21 nt, Salmonella typhimurium LT2
accggcaggugauggcggcuu

SEQ ID NO: 1827070 - RNA, 20 nt, Salmonella typhimurium LT2
accggccacaauugccagca

SEQ ID NO: 1827071 - RNA, 14 nt, Salmonella typhimurium LT2
accggacaaacauu

SEQ ID NO: 1827072 - RNA, 16 nt, Salmonella typhimurium LT2
accgccauccggcauu

SEQ ID NO: 1827073 - RNA, 18 nt, Salmonella typhimurium LT2
accgccaccauccggcgc

SEQ ID NO: 1827074 - RNA, 21 nt, Salmonella typhimurium LT2
accgccaccauccggcgcugu

SEQ ID NO: 1827075 - RNA, 14 nt, Salmonella typhimurium LT2
accgccaauaacgg

SEQ ID NO: 1827076 - RNA, 18 nt, Salmonella typhimurium LT2
accgccaauaacgggcac

SEQ ID NO: 1827077 - RNA, 21 nt, Salmonella typhimurium LT2
accgcccgcggcgaucaccac

SEQ ID NO: 1827078 - RNA, 14 nt, Salmonella typhimurium LT2
accgccccuggcaa

SEQ ID NO: 1827079 - RNA, 22 nt, Salmonella typhimurium LT2
accgacugucgaaaccagcaua

SEQ ID NO: 1827080 - RNA, 15 nt, Salmonella typhimurium LT2
accgacaaccugaau

SEQ ID NO: 1827081 - RNA, 20 nt, Salmonella typhimurium LT2
accgauagagacugccgccg

SEQ ID NO: 1827082 - RNA, 16 nt, Salmonella typhimurium LT2
accgaugcccagcuug

SEQ ID NO: 1827083 - RNA, 19 nt, Salmonella typhimurium LT2
accgaugcccggcaaucgc

SEQ ID NO: 1827084 - RNA, 12 nt, Salmonella typhimurium LT2
acccgauagugu

SEQ ID NO: 1827085 - RNA, 15 nt, Salmonella typhimurium LT2
acccgauaccgccag

SEQ ID NO: 1827086 - RNA, 13 nt, Salmonella typhimurium LT2
acccgaucgcccu

SEQ ID NO: 1827087 - RNA, 21 nt, Salmonella typhimurium LT2
acccgacugccaccacgcggc

SEQ ID NO: 1827088 - RNA, 22 nt, Salmonella typhimurium LT2
acccacccccuuacuaagccag

SEQ ID NO: 1827089 - RNA, 14 nt, Salmonella typhimurium LT2
accauuggcgcguc

SEQ ID NO: 1827090 - RNA, 17 nt, Salmonella typhimurium LT2
acccaaaaugccauaua

SEQ ID NO: 1827091 - RNA, 13 nt, Salmonella typhimurium LT2
acccaaauccgca

SEQ ID NO: 1827092 - RNA, 15 nt, Salmonella typhimurium LT2
acccgcucggcauac

SEQ ID NO: 1827093 - RNA, 16 nt, Salmonella typhimurium LT2
acccgcgcauggccau

SEQ ID NO: 1827094 - RNA, 18 nt, Salmonella typhimurium LT2
acccgcaauaacgccgau

SEQ ID NO: 1827095 - RNA, 15 nt, Salmonella typhimurium LT2
acccuucauacugcg

SEQ ID NO: 1827096 - RNA, 14 nt, Salmonella typhimurium LT2
acccuucgcaacag

SEQ ID NO: 1827097 - RNA, 21 nt, Salmonella typhimurium LT2
acccuuccaguugcgucagcg

SEQ ID NO: 1827098 - RNA, 19 nt, Salmonella typhimurium LT2
acccuauugccacaauauc

SEQ ID NO: 1827099 - RNA, 21 nt, Salmonella typhimurium LT2
acccguugccgaacgcggcuu

SEQ ID NO: 1827100 - RNA, 16 nt, Salmonella typhimurium LT2
acaucacguucgcgca

SEQ ID NO: 1827101 - RNA, 16 nt, Salmonella typhimurium LT2
acaucagagguaauca

SEQ ID NO: 1827102 - RNA, 14 nt, Salmonella typhimurium LT2
acaucaucgcuggu

SEQ ID NO: 1827103 - RNA, 16 nt, Salmonella typhimurium LT2
acaucaauaaauccgc

SEQ ID NO: 1827104 - RNA, 22 nt, Salmonella typhimurium LT2
acaucaaacucuucgcggcuca

SEQ ID NO: 1827105 - RNA, 17 nt, Salmonella typhimurium LT2
acagguuaaccaugccc

SEQ ID NO: 1827106 - RNA, 16 nt, Salmonella typhimurium LT2
acauauuuuucacaca

SEQ ID NO: 1827107 - RNA, 21 nt, Salmonella typhimurium LT2
acaucggcuacgcucacgcgc

SEQ ID NO: 1827108 - RNA, 21 nt, Salmonella typhimurium LT2
acauccagcuguuuaagcgcc

SEQ ID NO: 1827109 - RNA, 20 nt, Salmonella typhimurium LT2
acauccagacagccgacggc

SEQ ID NO: 1827110 - RNA, 17 nt, Salmonella typhimurium LT2
acaugguguuugcggca

SEQ ID NO: 1827111 - RNA, 17 nt, Salmonella typhimurium LT2
acaggcggguauggcgc

SEQ ID NO: 1827112 - RNA, 22 nt, Salmonella typhimurium LT2
acaggcggguauggcgccaaua

SEQ ID NO: 1827113 - RNA, 15 nt, Salmonella typhimurium LT2
acaggcacaacaaua

SEQ ID NO: 1827114 - RNA, 21 nt, Salmonella typhimurium LT2
acaggauguaagacagcgcgc

SEQ ID NO: 1827115 - RNA, 12 nt, Salmonella typhimurium LT2
acagcauacgcc

SEQ ID NO: 1827116 - RNA, 18 nt, Salmonella typhimurium LT2
acagcccgccagcaccag

SEQ ID NO: 1827117 - RNA, 21 nt, Salmonella typhimurium LT2
acagcccuauaacagcgccag

SEQ ID NO: 1827118 - RNA, 17 nt, Salmonella typhimurium LT2
acagagaucaggcgcau

SEQ ID NO: 1827119 - RNA, 14 nt, Salmonella typhimurium LT2
acagacuucaccca

SEQ ID NO: 1827120 - RNA, 21 nt, Salmonella typhimurium LT2
acagacugcuuguuuaauggc

SEQ ID NO: 1827121 - RNA, 22 nt, Salmonella typhimurium LT2
acagaguccacagcccggcgca

SEQ ID NO: 1827122 - RNA, 17 nt, Salmonella typhimurium LT2
acagauccagcgccguu

SEQ ID NO: 1827123 - RNA, 12 nt, Salmonella typhimurium LT2
acagacgcaggc

SEQ ID NO: 1827124 - RNA, 19 nt, Salmonella typhimurium LT2
acagacaucaucgaacgcc

SEQ ID NO: 1827125 - RNA, 13 nt, Salmonella typhimurium LT2
acagaauaagcca

SEQ ID NO: 1827126 - RNA, 15 nt, Salmonella typhimurium LT2
acagaacccggcuua

SEQ ID NO: 1827127 - RNA, 16 nt, Salmonella typhimurium LT2
acagaaaaccggcaaa

SEQ ID NO: 1827128 - RNA, 19 nt, Salmonella typhimurium LT2
acacuaccgggcagcaucu

SEQ ID NO: 1827129 - RNA, 20 nt, Salmonella typhimurium LT2
acacggucgccuaauccgcc

SEQ ID NO: 1827130 - RNA, 16 nt, Salmonella typhimurium LT2
acaccuuauccggccu

SEQ ID NO: 1827131 - RNA, 16 nt, Salmonella typhimurium LT2
acacauaaccugaaua

SEQ ID NO: 1827132 - RNA, 15 nt, Salmonella typhimurium LT2
acacauuucagcgca

SEQ ID NO: 1827133 - RNA, 15 nt, Salmonella typhimurium LT2
acaccacgcaggcga

SEQ ID NO: 1827134 - RNA, 19 nt, Salmonella typhimurium LT2
aauuucgcauucgcuucga

SEQ ID NO: 1827135 - RNA, 20 nt, Salmonella typhimurium LT2
acaccgggagaaaacgcggc

SEQ ID NO: 1827136 - RNA, 20 nt, Salmonella typhimurium LT2
acaccagcgauaaacgccag

SEQ ID NO: 1827137 - RNA, 17 nt, Salmonella typhimurium LT2
accagcgcuauccaggc

SEQ ID NO: 1827138 - RNA, 16 nt, Salmonella typhimurium LT2
accagcgcgccagcgc

SEQ ID NO: 1827139 - RNA, 16 nt, Salmonella typhimurium LT2
accaguaagagaacaa

SEQ ID NO: 1827140 - RNA, 17 nt, Salmonella typhimurium LT2
accaucguugccagcgg

SEQ ID NO: 1827141 - RNA, 13 nt, Salmonella typhimurium LT2
accaugcguggua

SEQ ID NO: 1827142 - RNA, 19 nt, Salmonella typhimurium LT2
accaucggcgcuacggcgu

SEQ ID NO: 1827143 - RNA, 14 nt, Salmonella typhimurium LT2
accaucgucgccag

SEQ ID NO: 1827144 - RNA, 14 nt, Salmonella typhimurium LT2
accauuccgguauc

SEQ ID NO: 1827145 - RNA, 13 nt, Salmonella typhimurium LT2
accauuaucgcgc

SEQ ID NO: 1827146 - RNA, 23 nt, Salmonella typhimurium LT2
accauuggcgcgucaucaauauc

SEQ ID NO: 1827147 - RNA, 22 nt, Salmonella typhimurium LT2
accauuuuccccagaaucccgc

SEQ ID NO: 1827148 - RNA, 14 nt, Salmonella typhimurium LT2
accauuuccggauc

SEQ ID NO: 1827149 - RNA, 13 nt, Salmonella typhimurium LT2
accauguugcgca

SEQ ID NO: 1827150 - RNA, 14 nt, Salmonella typhimurium LT2
accauggcgccaag

SEQ ID NO: 1827151 - RNA, 17 nt, Salmonella typhimurium LT2
accaguuuauccgccag

SEQ ID NO: 1827152 - RNA, 15 nt, Salmonella typhimurium LT2
accauaccaggcgca

SEQ ID NO: 1827153 - RNA, 11 nt, Salmonella typhimurium LT2
accauaucgca

SEQ ID NO: 1827154 - RNA, 22 nt, Salmonella typhimurium LT2
accauccauucgguacggcgcu

SEQ ID NO: 1827155 - RNA, 14 nt, Salmonella typhimurium LT2
acauucauugccgc

SEQ ID NO: 1827156 - RNA, 18 nt, Salmonella typhimurium LT2
accacaaagcgguaaauc

SEQ ID NO: 1827157 - RNA, 22 nt, Salmonella typhimurium LT2
accacaaagcgguaaaucgcaa

SEQ ID NO: 1827158 - RNA, 14 nt, Salmonella typhimurium LT2
acauguucagcgca

SEQ ID NO: 1827159 - RNA, 17 nt, Salmonella typhimurium LT2
acauuaauucaguccuu

SEQ ID NO: 1827160 - RNA, 17 nt, Salmonella typhimurium LT2
accacaaguuuauccgg

SEQ ID NO: 1827161 - RNA, 22 nt, Salmonella typhimurium LT2
accacaccgguucgcggcagau

SEQ ID NO: 1827162 - RNA, 21 nt, Salmonella typhimurium LT2
accaccgcgcuagugccgcca

SEQ ID NO: 1827163 - RNA, 19 nt, Salmonella typhimurium LT2
accacgaaggaaacgccag

SEQ ID NO: 1827164 - RNA, 13 nt, Salmonella typhimurium LT2
accacgcagccau

SEQ ID NO: 1827165 - RNA, 13 nt, Salmonella typhimurium LT2
accacgaaucagg

SEQ ID NO: 1827166 - RNA, 14 nt, Salmonella typhimurium LT2
accacgauaaccag

SEQ ID NO: 1827167 - RNA, 21 nt, Salmonella typhimurium LT2
accagauuucgcaacagcaua

SEQ ID NO: 1827168 - RNA, 21 nt, Salmonella typhimurium LT2
accagcaaugauaacggcgcc

SEQ ID NO: 1827169 - RNA, 17 nt, Salmonella typhimurium LT2
accagcaacgccagcga

SEQ ID NO: 1827170 - RNA, 14 nt, Salmonella typhimurium LT2
accagaccggcauc

SEQ ID NO: 1827171 - RNA, 22 nt, Salmonella typhimurium LT2
accacgcgggcgguauuauccg

SEQ ID NO: 1827172 - RNA, 18 nt, Salmonella typhimurium LT2
accagcgccauaauccag

SEQ ID NO: 1827173 - RNA, 13 nt, Salmonella typhimurium LT2
accagcgccggag

SEQ ID NO: 1827174 - RNA, 20 nt, Salmonella typhimurium LT2
accagcgauuuuuacgccau

SEQ ID NO: 1827175 - RNA, 21 nt, Salmonella typhimurium LT2
accagcgcaucaaugucgcgc

SEQ ID NO: 1827176 - RNA, 18 nt, Salmonella typhimurium LT2
accagcgauaaacgccag

SEQ ID NO: 1827177 - RNA, 19 nt, Salmonella typhimurium LT2
accagcgagcuacaggugc

SEQ ID NO: 1827178 - RNA, 14 nt, Salmonella typhimurium LT2
accagcgacggcca

SEQ ID NO: 1827179 - RNA, 14 nt, Salmonella typhimurium LT2
accagcacgcacag

SEQ ID NO: 1827180 - RNA, 13 nt, Salmonella typhimurium LT2
accagcaccgcuu

SEQ ID NO: 1827181 - RNA, 17 nt, Salmonella typhimurium LT2
accagcaccgccagcgc

SEQ ID NO: 1827182 - RNA, 19 nt, Salmonella typhimurium LT2
accagccccacgguacgac

SEQ ID NO: 1827183 - RNA, 16 nt, Salmonella typhimurium LT2
cacccgcuuccagcgc

SEQ ID NO: 1827184 - RNA, 18 nt, Salmonella typhimurium LT2
cacccgcuuccagcgcgu

SEQ ID NO: 1827185 - RNA, 18 nt, Salmonella typhimurium LT2
cacccuuugcagcgcgau

SEQ ID NO: 1827186 - RNA, 15 nt, Salmonella typhimurium LT2
cacccgcgccagcag

SEQ ID NO: 1827187 - RNA, 21 nt, Salmonella typhimurium LT2
caccagguccgacuucaugcg

SEQ ID NO: 1827188 - RNA, 22 nt, Salmonella typhimurium LT2
cacacggcgccaugauccagcg

SEQ ID NO: 1827189 - RNA, 11 nt, Salmonella typhimurium LT2
caccagaccga

SEQ ID NO: 1827190 - RNA, 12 nt, Salmonella typhimurium LT2
caccagcguacc

SEQ ID NO: 1827191 - RNA, 19 nt, Salmonella typhimurium LT2
caccagcucccgcgucacg

SEQ ID NO: 1827192 - RNA, 23 nt, Salmonella typhimurium LT2
caccagcgccagaauagcgcagu

SEQ ID NO: 1827193 - RNA, 17 nt, Salmonella typhimurium LT2
caccagcgccagcgacu

SEQ ID NO: 1827194 - RNA, 18 nt, Salmonella typhimurium LT2
caccagcgcgaccgguuu

SEQ ID NO: 1827195 - RNA, 13 nt, Salmonella typhimurium LT2
caccagcacaaug

SEQ ID NO: 1827196 - RNA, 15 nt, Salmonella typhimurium LT2
caccagcacgcaggc

SEQ ID NO: 1827197 - RNA, 24 nt, Salmonella typhimurium LT2
caccagccccaaaauucacgcuuc

SEQ ID NO: 1827198 - RNA, 17 nt, Salmonella typhimurium LT2
caccagcccggcgcaca

SEQ ID NO: 1827199 - RNA, 13 nt, Salmonella typhimurium LT2
caccggauugccu

SEQ ID NO: 1827200 - RNA, 20 nt, Salmonella typhimurium LT2
caccgcuacaauccaggacg

SEQ ID NO: 1827201 - RNA, 21 nt, Salmonella typhimurium LT2
caccgcuccgcgcauccugca

SEQ ID NO: 1827202 - RNA, 21 nt, Salmonella typhimurium LT2
caccggcagcgucguccagcc

SEQ ID NO: 1827203 - RNA, 15 nt, Salmonella typhimurium LT2
caccgaucaucccac

SEQ ID NO: 1827204 - RNA, 15 nt, Salmonella typhimurium LT2
caccgucuccggcgc

SEQ ID NO: 1827205 - RNA, 19 nt, Salmonella typhimurium LT2
caccgguacgcuccagggc

SEQ ID NO: 1827206 - RNA, 17 nt, Salmonella typhimurium LT2
caccguaucggcaguca

SEQ ID NO: 1827207 - RNA, 18 nt, Salmonella typhimurium LT2
caccgggagaaaacgcgg

SEQ ID NO: 1827208 - RNA, 16 nt, Salmonella typhimurium LT2
caccggcgcgccagcg

SEQ ID NO: 1827209 - RNA, 16 nt, Salmonella typhimurium LT2
caaugucguuaucgcc

SEQ ID NO: 1827210 - RNA, 17 nt, Salmonella typhimurium LT2
caaugucuuuauccgcc

SEQ ID NO: 1827211 - RNA, 20 nt, Salmonella typhimurium LT2
caaugucuuuauccgccagc

SEQ ID NO: 1827212 - RNA, 22 nt, Salmonella typhimurium LT2
caauggcgucgugcagcgccgc

SEQ ID NO: 1827213 - RNA, 21 nt, Salmonella typhimurium LT2
caauuucacugucgccaggcc

SEQ ID NO: 1827214 - RNA, 17 nt, Salmonella typhimurium LT2
caauugaugaaccgcug

SEQ ID NO: 1827215 - RNA, 20 nt, Salmonella typhimurium LT2
caauccugucgucaccagca

SEQ ID NO: 1827216 - RNA, 13 nt, Salmonella typhimurium LT2
caauccaggugga

SEQ ID NO: 1827217 - RNA, 13 nt, Salmonella typhimurium LT2
caaucaaccgcau

SEQ ID NO: 1827218 - RNA, 18 nt, Salmonella typhimurium LT2
caaucauaaacgccugac

SEQ ID NO: 1827219 - RNA, 15 nt, Salmonella typhimurium LT2
caaugccaccagcgc

SEQ ID NO: 1827220 - RNA, 23 nt, Salmonella typhimurium LT2
caaugccacgccccuaaggcagc

SEQ ID NO: 1827221 - RNA, 22 nt, Salmonella typhimurium LT2
caaugcccuuaaauccggccuc

SEQ ID NO: 1827222 - RNA, 13 nt, Salmonella typhimurium LT2
caaucguauggua

SEQ ID NO: 1827223 - RNA, 13 nt, Salmonella typhimurium LT2
caaucucgccaau

SEQ ID NO: 1827224 - RNA, 19 nt, Salmonella typhimurium LT2
caaucgcuuccagcgccgg

SEQ ID NO: 1827225 - RNA, 14 nt, Salmonella typhimurium LT2
caauaaacgggcag

SEQ ID NO: 1827226 - RNA, 18 nt, Salmonella typhimurium LT2
caauaaccaccuguucgc

SEQ ID NO: 1827227 - RNA, 14 nt, Salmonella typhimurium LT2
caauaaccgccagc

SEQ ID NO: 1827228 - RNA, 17 nt, Salmonella typhimurium LT2
caauaagcuugcuuucc

SEQ ID NO: 1827229 - RNA, 14 nt, Salmonella typhimurium LT2
caauaccagggcga

SEQ ID NO: 1827230 - RNA, 16 nt, Salmonella typhimurium LT2
caauaauuugucgaua

SEQ ID NO: 1827231 - RNA, 16 nt, Salmonella typhimurium LT2
caauaugguuauccag

SEQ ID NO: 1827232 - RNA, 14 nt, Salmonella typhimurium LT2
caauaugccaggca

SEQ ID NO: 1827233 - RNA, 19 nt, Salmonella typhimurium LT2
caauauauugcuccaucau

SEQ ID NO: 1827234 - RNA, 18 nt, Salmonella typhimurium LT2
caauauaguugagccauu

SEQ ID NO: 1827235 - RNA, 14 nt, Salmonella typhimurium LT2
caauaucagccauu

SEQ ID NO: 1827236 - RNA, 16 nt, Salmonella typhimurium LT2
caauagcacaucagcc

SEQ ID NO: 1827237 - RNA, 15 nt, Salmonella typhimurium LT2
caauaccguccagcg

SEQ ID NO: 1827238 - RNA, 18 nt, Salmonella typhimurium LT2
caauacgccgagcaucgc

SEQ ID NO: 1827239 - RNA, 22 nt, Salmonella typhimurium LT2
caaguaguuguuauagcgcgac

SEQ ID NO: 1827240 - RNA, 23 nt, Salmonella typhimurium LT2
caaguaguuguuauagcgcgacc

SEQ ID NO: 1827241 - RNA, 16 nt, Salmonella typhimurium LT2
caaggcucaauacgca

SEQ ID NO: 1827242 - RNA, 17 nt, Salmonella typhimurium LT2
caaguaaaccggucagg

SEQ ID NO: 1827243 - RNA, 21 nt, Salmonella typhimurium LT2
caaguaaaccggucaggcagc

SEQ ID NO: 1827244 - RNA, 17 nt, Salmonella typhimurium LT2
caagguuaacgucagau

SEQ ID NO: 1827245 - RNA, 12 nt, Salmonella typhimurium LT2
caagcgccagua

SEQ ID NO: 1827246 - RNA, 11 nt, Salmonella typhimurium LT2
caagcuuuacc

SEQ ID NO: 1827247 - RNA, 18 nt, Salmonella typhimurium LT2
caagcugcaucccgguca

SEQ ID NO: 1827248 - RNA, 21 nt, Salmonella typhimurium LT2
caacguuguguccaggguguu

SEQ ID NO: 1827249 - RNA, 18 nt, Salmonella typhimurium LT2
caacguccaguucguucu

SEQ ID NO: 1827250 - RNA, 20 nt, Salmonella typhimurium LT2
caacgucauuaaaaccgcac

SEQ ID NO: 1827251 - RNA, 17 nt, Salmonella typhimurium LT2
caacguccaccagcggu

SEQ ID NO: 1827252 - RNA, 23 nt, Salmonella typhimurium LT2
caacgucaguucgccacggucgg

SEQ ID NO: 1827253 - RNA, 18 nt, Salmonella typhimurium LT2
caacgcgugauccacagc

SEQ ID NO: 1827254 - RNA, 15 nt, Salmonella typhimurium LT2
caacgcucagaccga

SEQ ID NO: 1827255 - RNA, 21 nt, Salmonella typhimurium LT2
caacgacgucuuucuucgcug

SEQ ID NO: 1827256 - RNA, 21 nt, Salmonella typhimurium LT2
caaccugccguuuuccagccg

SEQ ID NO: 1827257 - RNA, 15 nt, Salmonella typhimurium LT2
caaccugagcgcgaa

SEQ ID NO: 1827258 - RNA, 15 nt, Salmonella typhimurium LT2
caaccgcaucacgcg

SEQ ID NO: 1827259 - RNA, 23 nt, Salmonella typhimurium LT2
caacaugcugaccgaaccgcugu

SEQ ID NO: 1827260 - RNA, 15 nt, Salmonella typhimurium LT2
caacaugaccagcgc

SEQ ID NO: 1827261 - RNA, 23 nt, Salmonella typhimurium LT2
caacaugaaagggaaaccgcucg

SEQ ID NO: 1827262 - RNA, 16 nt, Salmonella typhimurium LT2
caacccgaccaggaca

SEQ ID NO: 1827263 - RNA, 21 nt, Salmonella typhimurium LT2
caacccgauaagcuuccgcca

SEQ ID NO: 1827264 - RNA, 18 nt, Salmonella typhimurium LT2
caacccgacgacguucga

SEQ ID NO: 1827265 - RNA, 13 nt, Salmonella typhimurium LT2
caaauugcugaug

SEQ ID NO: 1827266 - RNA, 14 nt, Salmonella typhimurium LT2
caacacauccagcg

SEQ ID NO: 1827267 - RNA, 17 nt, Salmonella typhimurium LT2
caacacauccagcguca

SEQ ID NO: 1827268 - RNA, 17 nt, Salmonella typhimurium LT2
caaaucgggaaaaugau

SEQ ID NO: 1827269 - RNA, 20 nt, Salmonella typhimurium LT2
caaaucgccaucagcgcgaa

SEQ ID NO: 1827270 - RNA, 15 nt, Salmonella typhimurium LT2
caaauguuguuugaa

SEQ ID NO: 1827271 - RNA, 19 nt, Salmonella typhimurium LT2
caaauggcagggacaacgc

SEQ ID NO: 1827272 - RNA, 19 nt, Salmonella typhimurium LT2
caaauagggcgcuugcgca

SEQ ID NO: 1827273 - RNA, 17 nt, Salmonella typhimurium LT2
caaaucaugagcgcaau

SEQ ID NO: 1827274 - RNA, 18 nt, Salmonella typhimurium LT2
caaacaauuuacgcagcc

SEQ ID NO: 1827275 - RNA, 20 nt, Salmonella typhimurium LT2
caaacaccaccaguaaccgc

SEQ ID NO: 1827276 - RNA, 23 nt, Salmonella typhimurium LT2
caaacccgaccucuucuuugagc

SEQ ID NO: 1827277 - RNA, 22 nt, Salmonella typhimurium LT2
caaaaugagauugauaaucagc

SEQ ID NO: 1827278 - RNA, 16 nt, Salmonella typhimurium LT2
caaaaugucaguaucg

SEQ ID NO: 1827279 - RNA, 21 nt, Salmonella typhimurium LT2
caaaauguucauguacgccgc

SEQ ID NO: 1827280 - RNA, 15 nt, Salmonella typhimurium LT2
auuguuuguggcaaa

SEQ ID NO: 1827281 - RNA, 15 nt, Salmonella typhimurium LT2
auugugccgcgccug

SEQ ID NO: 1827282 - RNA, 20 nt, Salmonella typhimurium LT2
auugugccgcggcuucauca

SEQ ID NO: 1827283 - RNA, 18 nt, Salmonella typhimurium LT2
auuguuccugcuggcaaa

SEQ ID NO: 1827284 - RNA, 22 nt, Salmonella typhimurium LT2
caaacugauacuggauaaccgc

SEQ ID NO: 1827285 - RNA, 23 nt, Salmonella typhimurium LT2
caaacugaacugcgcguauccgg

SEQ ID NO: 1827286 - RNA, 14 nt, Salmonella typhimurium LT2
caaacccugcgcca

SEQ ID NO: 1827287 - RNA, 20 nt, Salmonella typhimurium LT2
caaaccgauaaucaccagcc

SEQ ID NO: 1827288 - RNA, 19 nt, Salmonella typhimurium LT2
caaagcgccauccggcaau

SEQ ID NO: 1827289 - RNA, 21 nt, Salmonella typhimurium LT2
caaagcgccaucgggcauuca

SEQ ID NO: 1827290 - RNA, 16 nt, Salmonella typhimurium LT2
caaagaaggcauuuca

SEQ ID NO: 1827291 - RNA, 20 nt, Salmonella typhimurium LT2
caaagaaauugggcuuccac

SEQ ID NO: 1827292 - RNA, 18 nt, Salmonella typhimurium LT2
caaagggauaagaaagau

SEQ ID NO: 1827293 - RNA, 21 nt, Salmonella typhimurium LT2
augugcuuucaucgccgcgac

SEQ ID NO: 1827294 - RNA, 21 nt, Salmonella typhimurium LT2
auguugccaugauccaucucg

SEQ ID NO: 1827295 - RNA, 21 nt, Salmonella typhimurium LT2
auguugauacagaaaaccggc

SEQ ID NO: 1827296 - RNA, 17 nt, Salmonella typhimurium LT2
auguugagcaaugggaa

SEQ ID NO: 1827297 - RNA, 12 nt, Salmonella typhimurium LT2
auguuccggcag

SEQ ID NO: 1827298 - RNA, 21 nt, Salmonella typhimurium LT2
auguucggguaaacgcugcgc

SEQ ID NO: 1827299 - RNA, 15 nt, Salmonella typhimurium LT2
auguuccccguugag

SEQ ID NO: 1827300 - RNA, 14 nt, Salmonella typhimurium LT2
augugagcgcaucc

SEQ ID NO: 1827301 - RNA, 13 nt, Salmonella typhimurium LT2
augugaauccagg

SEQ ID NO: 1827302 - RNA, 18 nt, Salmonella typhimurium LT2
augggaucgauccuucaa

SEQ ID NO: 1827303 - RNA, 18 nt, Salmonella typhimurium LT2
auggcgacgaucagcgcc

SEQ ID NO: 1827304 - RNA, 19 nt, Salmonella typhimurium LT2
auggcgacgaucagcgcca

SEQ ID NO: 1827305 - RNA, 17 nt, Salmonella typhimurium LT2
auggcgacgaucagcgc

SEQ ID NO: 1827306 - RNA, 16 nt, Salmonella typhimurium LT2
auggcgaacagcccca

SEQ ID NO: 1827307 - RNA, 17 nt, Salmonella typhimurium LT2
augggcgcacagcgcca

SEQ ID NO: 1827308 - RNA, 13 nt, Salmonella typhimurium LT2
augggcgcggcga

SEQ ID NO: 1827309 - RNA, 17 nt, Salmonella typhimurium LT2
auggugguugcaucguc

SEQ ID NO: 1827310 - RNA, 14 nt, Salmonella typhimurium LT2
augguuaaauugaa

SEQ ID NO: 1827311 - RNA, 15 nt, Salmonella typhimurium LT2
augguucccgccacu

SEQ ID NO: 1827312 - RNA, 16 nt, Salmonella typhimurium LT2
augguucccgccacug

SEQ ID NO: 1827313 - RNA, 20 nt, Salmonella typhimurium LT2
auggguaaaaauauggcggg

SEQ ID NO: 1827314 - RNA, 18 nt, Salmonella typhimurium LT2
auggcaggcauagacauc

SEQ ID NO: 1827315 - RNA, 14 nt, Salmonella typhimurium LT2
auggcagaacagcg

SEQ ID NO: 1827316 - RNA, 19 nt, Salmonella typhimurium LT2
auggcaacaaagccugcug

SEQ ID NO: 1827317 - RNA, 13 nt, Salmonella typhimurium LT2
auggccuggagcg

SEQ ID NO: 1827318 - RNA, 21 nt, Salmonella typhimurium LT2
augcuuucgcgauaaucaacu

SEQ ID NO: 1827319 - RNA, 23 nt, Salmonella typhimurium LT2
auggaugagucuugcgcguccgc

SEQ ID NO: 1827320 - RNA, 19 nt, Salmonella typhimurium LT2
augcgccagccagucgcca

SEQ ID NO: 1827321 - RNA, 21 nt, Salmonella typhimurium LT2
augcggcagaggucgccgcug

SEQ ID NO: 1827322 - RNA, 14 nt, Salmonella typhimurium LT2
augcauggcagaua

SEQ ID NO: 1827323 - RNA, 24 nt, Salmonella typhimurium LT2
augcgcaaggccguuauccagucg

SEQ ID NO: 1827324 - RNA, 21 nt, Salmonella typhimurium LT2
augcugacgacauucagcaca

SEQ ID NO: 1827325 - RNA, 17 nt, Salmonella typhimurium LT2
augcugcaccacaccgg

SEQ ID NO: 1827326 - RNA, 12 nt, Salmonella typhimurium LT2
augcgucggcac

SEQ ID NO: 1827327 - RNA, 23 nt, Salmonella typhimurium LT2
augcgguuguucuuccagcguca

SEQ ID NO: 1827328 - RNA, 16 nt, Salmonella typhimurium LT2
augcugcaccgcauca

SEQ ID NO: 1827329 - RNA, 19 nt, Salmonella typhimurium LT2
augcugauacaaagccgac

SEQ ID NO: 1827330 - RNA, 18 nt, Salmonella typhimurium LT2
augcggguuucguucggc

SEQ ID NO: 1827331 - RNA, 18 nt, Salmonella typhimurium LT2
auuccuaucaguacgacc

SEQ ID NO: 1827332 - RNA, 20 nt, Salmonella typhimurium LT2
auuccuuuaaauauccgcag

SEQ ID NO: 1827333 - RNA, 17 nt, Salmonella typhimurium LT2
auucgcuccucagcgcu

SEQ ID NO: 1827334 - RNA, 22 nt, Salmonella typhimurium LT2
auucgcuccucagcgcuuacca

SEQ ID NO: 1827335 - RNA, 18 nt, Salmonella typhimurium LT2
auucggauaauccagacg

SEQ ID NO: 1827336 - RNA, 17 nt, Salmonella typhimurium LT2
auucggcauaucgccau

SEQ ID NO: 1827337 - RNA, 21 nt, Salmonella typhimurium LT2
auucguggcucaaggauauug

SEQ ID NO: 1827338 - RNA, 17 nt, Salmonella typhimurium LT2
auucguuagcguuucga

SEQ ID NO: 1827339 - RNA, 15 nt, Salmonella typhimurium LT2
auucguuaaagccga

SEQ ID NO: 1827340 - RNA, 17 nt, Salmonella typhimurium LT2
auucguuaaagccgaug

SEQ ID NO: 1827341 - RNA, 13 nt, Salmonella typhimurium LT2
auucggcguaucg

SEQ ID NO: 1827342 - RNA, 19 nt, Salmonella typhimurium LT2
auucugcauggcgcuaaac

SEQ ID NO: 1827343 - RNA, 14 nt, Salmonella typhimurium LT2
auucugccaguuca

SEQ ID NO: 1827344 - RNA, 12 nt, Salmonella typhimurium LT2
auucugcgguaa

SEQ ID NO: 1827345 - RNA, 15 nt, Salmonella typhimurium LT2
auucugcgaaagccu

SEQ ID NO: 1827346 - RNA, 16 nt, Salmonella typhimurium LT2
auucugaauagccggu

SEQ ID NO: 1827347 - RNA, 12 nt, Salmonella typhimurium LT2
auucuaugccaa

SEQ ID NO: 1827348 - RNA, 14 nt, Salmonella typhimurium LT2
auucuauucuugug

SEQ ID NO: 1827349 - RNA, 18 nt, Salmonella typhimurium LT2
auucagcggcugcgccug

SEQ ID NO: 1827350 - RNA, 17 nt, Salmonella typhimurium LT2
auucagaauaugccagg

SEQ ID NO: 1827351 - RNA, 22 nt, Salmonella typhimurium LT2
auucagaauuuuuaaccgucac

SEQ ID NO: 1827352 - RNA, 19 nt, Salmonella typhimurium LT2
auucauauugcccaucgcg

SEQ ID NO: 1827353 - RNA, 18 nt, Salmonella typhimurium LT2
auucauaugcgccaacug

SEQ ID NO: 1827354 - RNA, 13 nt, Salmonella typhimurium LT2
auucaggcgguaa

SEQ ID NO: 1827355 - RNA, 13 nt, Salmonella typhimurium LT2
auuccggcgcugg

SEQ ID NO: 1827356 - RNA, 19 nt, Salmonella typhimurium LT2
auuccgcagagcugacggg

SEQ ID NO: 1827357 - RNA, 21 nt, Salmonella typhimurium LT2
auuccgacgugacucagcggc

SEQ ID NO: 1827358 - RNA, 14 nt, Salmonella typhimurium LT2
auuccgagucgauc

SEQ ID NO: 1827359 - RNA, 14 nt, Salmonella typhimurium LT2
auucccugcauguc

SEQ ID NO: 1827360 - RNA, 18 nt, Salmonella typhimurium LT2
auucauccagaccugagc

SEQ ID NO: 1827361 - RNA, 19 nt, Salmonella typhimurium LT2
auucaugauacccagcguc

SEQ ID NO: 1827362 - RNA, 20 nt, Salmonella typhimurium LT2
auucaugguuccgccguuaa

SEQ ID NO: 1827363 - RNA, 22 nt, Salmonella typhimurium LT2
auuaaaugacgcccugcgccag

SEQ ID NO: 1827364 - RNA, 20 nt, Salmonella typhimurium LT2
auuaugaccaauaauaaucc

SEQ ID NO: 1827365 - RNA, 18 nt, Salmonella typhimurium LT2
auucacuuuccgaaucag

SEQ ID NO: 1827366 - RNA, 22 nt, Salmonella typhimurium LT2
auuauucacgcuauguuugcug

SEQ ID NO: 1827367 - RNA, 16 nt, Salmonella typhimurium LT2
auuggcccuucagacg

SEQ ID NO: 1827368 - RNA, 17 nt, Salmonella typhimurium LT2
auuggcaagaaucacgc

SEQ ID NO: 1827369 - RNA, 14 nt, Salmonella typhimurium LT2
auuggcauccagca

SEQ ID NO: 1827370 - RNA, 13 nt, Salmonella typhimurium LT2
auugucggccuga

SEQ ID NO: 1827371 - RNA, 15 nt, Salmonella typhimurium LT2
auuguacugcgccag

SEQ ID NO: 1827372 - RNA, 17 nt, Salmonella typhimurium LT2
auugcgaaacggcagcg

SEQ ID NO: 1827373 - RNA, 16 nt, Salmonella typhimurium LT2
auugcgaacaguuccg

SEQ ID NO: 1827374 - RNA, 15 nt, Salmonella typhimurium LT2
auugccugauggcgc

SEQ ID NO: 1827375 - RNA, 23 nt, Salmonella typhimurium LT2
auugccugauggcgcuacgccug

SEQ ID NO: 1827376 - RNA, 19 nt, Salmonella typhimurium LT2
auugccgcuuaaguugccg

SEQ ID NO: 1827377 - RNA, 13 nt, Salmonella typhimurium LT2
auugcugacacaa

SEQ ID NO: 1827378 - RNA, 18 nt, Salmonella typhimurium LT2
auugcuccaucaucgcca

SEQ ID NO: 1827379 - RNA, 20 nt, Salmonella typhimurium LT2
auugcggaucuucaccacgc

SEQ ID NO: 1827380 - RNA, 21 nt, Salmonella typhimurium LT2
auugcguaucguaagccacug

SEQ ID NO: 1827381 - RNA, 15 nt, Salmonella typhimurium LT2
auugaccccauauug

SEQ ID NO: 1827382 - RNA, 17 nt, Salmonella typhimurium LT2
auugacagaauaaugcc

SEQ ID NO: 1827383 - RNA, 18 nt, Salmonella typhimurium LT2
auugaguggacaucgcca

SEQ ID NO: 1827384 - RNA, 16 nt, Salmonella typhimurium LT2
auugauacaggcgcug

SEQ ID NO: 1827385 - RNA, 12 nt, Salmonella typhimurium LT2
auugagcagcgg

SEQ ID NO: 1827386 - RNA, 15 nt, Salmonella typhimurium LT2
auugagcagcggcug

SEQ ID NO: 1827387 - RNA, 15 nt, Salmonella typhimurium LT2
auugaaacgcaucac

SEQ ID NO: 1827388 - RNA, 15 nt, Salmonella typhimurium LT2
auugaagcgauauuc

SEQ ID NO: 1827389 - RNA, 15 nt, Salmonella typhimurium LT2
auucuucgaaugucu

SEQ ID NO: 1827390 - RNA, 17 nt, Salmonella typhimurium LT2
auucuuuacgcagcaag

SEQ ID NO: 1827391 - RNA, 20 nt, Salmonella typhimurium LT2
auugccaugaugagcgccau

SEQ ID NO: 1827392 - RNA, 19 nt, Salmonella typhimurium LT2
auugccaugaugagcgcca

SEQ ID NO: 1827393 - RNA, 12 nt, Salmonella typhimurium LT2
auugauccacgg

SEQ ID NO: 1827394 - RNA, 22 nt, Salmonella typhimurium LT2
auugauaccuaaacgcgucaga

SEQ ID NO: 1827395 - RNA, 22 nt, Salmonella typhimurium LT2
augaacgaugcugauuugccag

SEQ ID NO: 1827396 - RNA, 14 nt, Salmonella typhimurium LT2
aucuuuauccugca

SEQ ID NO: 1827397 - RNA, 21 nt, Salmonella typhimurium LT2
aucuuuacccggcgcaaacuu

SEQ ID NO: 1827398 - RNA, 15 nt, Salmonella typhimurium LT2
augaaaaauccggca

SEQ ID NO: 1827399 - RNA, 15 nt, Salmonella typhimurium LT2
augaagguuagcguc

SEQ ID NO: 1827400 - RNA, 16 nt, Salmonella typhimurium LT2
augaaucaucgguaaa

SEQ ID NO: 1827401 - RNA, 16 nt, Salmonella typhimurium LT2
augacagccaccagcg

SEQ ID NO: 1827402 - RNA, 18 nt, Salmonella typhimurium LT2
augaccguugauucagcg

SEQ ID NO: 1827403 - RNA, 20 nt, Salmonella typhimurium LT2
augaccguugauucagcguc

SEQ ID NO: 1827404 - RNA, 18 nt, Salmonella typhimurium LT2
augacgaacaggauauua

SEQ ID NO: 1827405 - RNA, 20 nt, Salmonella typhimurium LT2
augauaucggccggaugcca

SEQ ID NO: 1827406 - RNA, 13 nt, Salmonella typhimurium LT2
augaucaggcgac

SEQ ID NO: 1827407 - RNA, 13 nt, Salmonella typhimurium LT2
augauccaucucg

SEQ ID NO: 1827408 - RNA, 14 nt, Salmonella typhimurium LT2
augaucgucaacga

SEQ ID NO: 1827409 - RNA, 11 nt, Salmonella typhimurium LT2
augaucgccgc

SEQ ID NO: 1827410 - RNA, 12 nt, Salmonella typhimurium LT2
augacgccgucu

SEQ ID NO: 1827411 - RNA, 18 nt, Salmonella typhimurium LT2
augaguucaguaugauca

SEQ ID NO: 1827412 - RNA, 21 nt, Salmonella typhimurium LT2
augauaauaugcucaacuucc

SEQ ID NO: 1827413 - RNA, 23 nt, Salmonella typhimurium LT2
augcagcaucaugucacccacgc

SEQ ID NO: 1827414 - RNA, 13 nt, Salmonella typhimurium LT2
augcacugcugau

SEQ ID NO: 1827415 - RNA, 13 nt, Salmonella typhimurium LT2
augcauccgccag

SEQ ID NO: 1827416 - RNA, 19 nt, Salmonella typhimurium LT2
augcaucgcggucagcggc

SEQ ID NO: 1827417 - RNA, 18 nt, Salmonella typhimurium LT2
augcaugacgcaggcgca

SEQ ID NO: 1827418 - RNA, 19 nt, Salmonella typhimurium LT2
augcaggccaagcagcgcc

SEQ ID NO: 1827419 - RNA, 20 nt, Salmonella typhimurium LT2
augcagcgcgaugacgucac

SEQ ID NO: 1827420 - RNA, 12 nt, Salmonella typhimurium LT2
aucucgccgucg

SEQ ID NO: 1827421 - RNA, 19 nt, Salmonella typhimurium LT2
aucuccgccgcuuuaucgu

SEQ ID NO: 1827422 - RNA, 13 nt, Salmonella typhimurium LT2
aucuccuccggcu

SEQ ID NO: 1827423 - RNA, 19 nt, Salmonella typhimurium LT2
aucuccgcgcaaucgccga

SEQ ID NO: 1827424 - RNA, 22 nt, Salmonella typhimurium LT2
aucguuugcccauucuucgucg

SEQ ID NO: 1827425 - RNA, 21 nt, Salmonella typhimurium LT2
aucgugauaaagcugacgcgc

SEQ ID NO: 1827426 - RNA, 21 nt, Salmonella typhimurium LT2
aucgugauaacgcgauggcca

SEQ ID NO: 1827427 - RNA, 19 nt, Salmonella typhimurium LT2
aucgucuaucacaugugcg

SEQ ID NO: 1827428 - RNA, 15 nt, Salmonella typhimurium LT2
aucggcgucuggagc

SEQ ID NO: 1827429 - RNA, 12 nt, Salmonella typhimurium LT2
aucggcguaccg

SEQ ID NO: 1827430 - RNA, 17 nt, Salmonella typhimurium LT2
aucuucuguccggcauu

SEQ ID NO: 1827431 - RNA, 15 nt, Salmonella typhimurium LT2
aucuguucuguccau

SEQ ID NO: 1827432 - RNA, 17 nt, Salmonella typhimurium LT2
aucuuccuggcgcugac

SEQ ID NO: 1827433 - RNA, 12 nt, Salmonella typhimurium LT2
aucuuccgccac

SEQ ID NO: 1827434 - RNA, 12 nt, Salmonella typhimurium LT2
aucuuccggcau

SEQ ID NO: 1827435 - RNA, 18 nt, Salmonella typhimurium LT2
aucuggcgguuugacggc

SEQ ID NO: 1827436 - RNA, 13 nt, Salmonella typhimurium LT2
aucugcuccggcg

SEQ ID NO: 1827437 - RNA, 15 nt, Salmonella typhimurium LT2
aucugcguugcgcgc

SEQ ID NO: 1827438 - RNA, 21 nt, Salmonella typhimurium LT2
aucugcggucuccugaacgcc

SEQ ID NO: 1827439 - RNA, 22 nt, Salmonella typhimurium LT2
auccggaaaauggguaucgccu

SEQ ID NO: 1827440 - RNA, 17 nt, Salmonella typhimurium LT2
auccggacgauagccau

SEQ ID NO: 1827441 - RNA, 20 nt, Salmonella typhimurium LT2
auccgcguggacgcguucca

SEQ ID NO: 1827442 - RNA, 16 nt, Salmonella typhimurium LT2
auccgggcugaacgcc

SEQ ID NO: 1827443 - RNA, 17 nt, Salmonella typhimurium LT2
auccggguuaaaccagc

SEQ ID NO: 1827444 - RNA, 15 nt, Salmonella typhimurium LT2
auccuccauccaggu

SEQ ID NO: 1827445 - RNA, 16 nt, Salmonella typhimurium LT2
aucccuucucauggac

SEQ ID NO: 1827446 - RNA, 19 nt, Salmonella typhimurium LT2
auccgacgcaacucacgcc

SEQ ID NO: 1827447 - RNA, 13 nt, Salmonella typhimurium LT2
auccgacgcaggu

SEQ ID NO: 1827448 - RNA, 14 nt, Salmonella typhimurium LT2
auccgccagcgccu

SEQ ID NO: 1827449 - RNA, 21 nt, Salmonella typhimurium LT2
auccgcagcggauugccgcgc

SEQ ID NO: 1827450 - RNA, 13 nt, Salmonella typhimurium LT2
auccugaagcggc

SEQ ID NO: 1827451 - RNA, 15 nt, Salmonella typhimurium LT2
auccugaagcggcgc

SEQ ID NO: 1827452 - RNA, 16 nt, Salmonella typhimurium LT2
auccuggauacguucc

SEQ ID NO: 1827453 - RNA, 16 nt, Salmonella typhimurium LT2
auccuggaugaguaug

SEQ ID NO: 1827454 - RNA, 21 nt, Salmonella typhimurium LT2
auccugcaccgccugcggcau

SEQ ID NO: 1827455 - RNA, 16 nt, Salmonella typhimurium LT2
aucgaacaauuaccga

SEQ ID NO: 1827456 - RNA, 18 nt, Salmonella typhimurium LT2
auccuguucaaacaucag

SEQ ID NO: 1827457 - RNA, 19 nt, Salmonella typhimurium LT2
auccuguuuuuucagcgcg

SEQ ID NO: 1827458 - RNA, 20 nt, Salmonella typhimurium LT2
auccuguuuuuucagcgcgc

SEQ ID NO: 1827459 - RNA, 22 nt, Salmonella typhimurium LT2
auccuguaacgcauaagcgcga

SEQ ID NO: 1827460 - RNA, 22 nt, Salmonella typhimurium LT2
aucgaaggcaucuucagacagu

SEQ ID NO: 1827461 - RNA, 20 nt, Salmonella typhimurium LT2
aucgaacuguacgcgggaaa

SEQ ID NO: 1827462 - RNA, 17 nt, Salmonella typhimurium LT2
aucgcggauggcggcau

SEQ ID NO: 1827463 - RNA, 16 nt, Salmonella typhimurium LT2
aucgcgccaugauuca

SEQ ID NO: 1827464 - RNA, 19 nt, Salmonella typhimurium LT2
aucgcuggcguacgccauu

SEQ ID NO: 1827465 - RNA, 15 nt, Salmonella typhimurium LT2
aucggaguccagcaa

SEQ ID NO: 1827466 - RNA, 17 nt, Salmonella typhimurium LT2
aucggcggcaaagccga

SEQ ID NO: 1827467 - RNA, 17 nt, Salmonella typhimurium LT2
aucggcgcggcgacgcc

SEQ ID NO: 1827468 - RNA, 18 nt, Salmonella typhimurium LT2
aucgacugcguuaucgcu

SEQ ID NO: 1827469 - RNA, 22 nt, Salmonella typhimurium LT2
aucgcccaggucugaugagcgc

SEQ ID NO: 1827470 - RNA, 23 nt, Salmonella typhimurium LT2
aucgcccacuuguaccaacugcu

SEQ ID NO: 1827471 - RNA, 14 nt, Salmonella typhimurium LT2
aucgcccggaucgc

SEQ ID NO: 1827472 - RNA, 20 nt, Salmonella typhimurium LT2
aucgcccggaucgcggccuu

SEQ ID NO: 1827473 - RNA, 16 nt, Salmonella typhimurium LT2
aucgcgaugauaccgu

SEQ ID NO: 1827474 - RNA, 14 nt, Salmonella typhimurium LT2
aucgcgaucgccaa

SEQ ID NO: 1827475 - RNA, 19 nt, Salmonella typhimurium LT2
aucgcgaucaucagcacgc

SEQ ID NO: 1827476 - RNA, 23 nt, Salmonella typhimurium LT2
aucgccgcaagcggcaaucgccu

SEQ ID NO: 1827477 - RNA, 16 nt, Salmonella typhimurium LT2
aucgccgcaaugacca

SEQ ID NO: 1827478 - RNA, 12 nt, Salmonella typhimurium LT2
aucgccgccauc

SEQ ID NO: 1827479 - RNA, 21 nt, Salmonella typhimurium LT2
aucgccgcgaggaaaaucgcu

SEQ ID NO: 1827480 - RNA, 17 nt, Salmonella typhimurium LT2
aucgccggagccgccug

SEQ ID NO: 1827481 - RNA, 23 nt, Salmonella typhimurium LT2
agcguuuaacugaacaucgccgu

SEQ ID NO: 1827482 - RNA, 17 nt, Salmonella typhimurium LT2
agcguuggcgucagacc

SEQ ID NO: 1827483 - RNA, 16 nt, Salmonella typhimurium LT2
agcguuggcgucaucg

SEQ ID NO: 1827484 - RNA, 14 nt, Salmonella typhimurium LT2
agcguugaccagcc

SEQ ID NO: 1827485 - RNA, 19 nt, Salmonella typhimurium LT2
agcguuucuacgccauggc

SEQ ID NO: 1827486 - RNA, 13 nt, Salmonella typhimurium LT2
agcguuuccagcc

SEQ ID NO: 1827487 - RNA, 22 nt, Salmonella typhimurium LT2
agcguuucgauacauccggcag

SEQ ID NO: 1827488 - RNA, 15 nt, Salmonella typhimurium LT2
agcguuuugcgcgua

SEQ ID NO: 1827489 - RNA, 15 nt, Salmonella typhimurium LT2
agcuaaaaaccgcaa

SEQ ID NO: 1827490 - RNA, 14 nt, Salmonella typhimurium LT2
agcuaacguacagg

SEQ ID NO: 1827491 - RNA, 19 nt, Salmonella typhimurium LT2
agcucaagcccgcgucguu

SEQ ID NO: 1827492 - RNA, 13 nt, Salmonella typhimurium LT2
agcucaagcgccg

SEQ ID NO: 1827493 - RNA, 18 nt, Salmonella typhimurium LT2
agcucaaccgcgcggcgu

SEQ ID NO: 1827494 - RNA, 22 nt, Salmonella typhimurium LT2
agcuccucgcgaaucucaaugc

SEQ ID NO: 1827495 - RNA, 17 nt, Salmonella typhimurium LT2
agcugaugcgaacgucc

SEQ ID NO: 1827496 - RNA, 16 nt, Salmonella typhimurium LT2
agcucuaccagaccac

SEQ ID NO: 1827497 - RNA, 19 nt, Salmonella typhimurium LT2
agcggaugucggucaucag

SEQ ID NO: 1827498 - RNA, 19 nt, Salmonella typhimurium LT2
agcggcaagcgcgccauaa

SEQ ID NO: 1827499 - RNA, 19 nt, Salmonella typhimurium LT2
agcggcaaacagcgacucg

SEQ ID NO: 1827500 - RNA, 12 nt, Salmonella typhimurium LT2
agcggcgaggca

SEQ ID NO: 1827501 - RNA, 23 nt, Salmonella typhimurium LT2
agcggcgugguaucucgucgcca

SEQ ID NO: 1827502 - RNA, 13 nt, Salmonella typhimurium LT2
agcggcuucaaua

SEQ ID NO: 1827503 - RNA, 16 nt, Salmonella typhimurium LT2
agcggcucauccagca

SEQ ID NO: 1827504 - RNA, 18 nt, Salmonella typhimurium LT2
agcgugaugcgauccagc

SEQ ID NO: 1827505 - RNA, 17 nt, Salmonella typhimurium LT2
agcguggaaaacagcgc

SEQ ID NO: 1827506 - RNA, 19 nt, Salmonella typhimurium LT2
agcguggaaaacagcgccg

SEQ ID NO: 1827507 - RNA, 22 nt, Salmonella typhimurium LT2
agcgugccgacguucaugccga

SEQ ID NO: 1827508 - RNA, 17 nt, Salmonella typhimurium LT2
agcgugguuuccggcag

SEQ ID NO: 1827509 - RNA, 18 nt, Salmonella typhimurium LT2
agcgguggcgcuccagcc

SEQ ID NO: 1827510 - RNA, 15 nt, Salmonella typhimurium LT2
agcgcuacagggcgu

SEQ ID NO: 1827511 - RNA, 20 nt, Salmonella typhimurium LT2
agcgcguuuuccaucaucag

SEQ ID NO: 1827512 - RNA, 14 nt, Salmonella typhimurium LT2
agcgcuauccaggc

SEQ ID NO: 1827513 - RNA, 17 nt, Salmonella typhimurium LT2
agcgcgucgaaugacgc

SEQ ID NO: 1827514 - RNA, 21 nt, Salmonella typhimurium LT2
agcgcguaaauaccuuccggc

SEQ ID NO: 1827515 - RNA, 17 nt, Salmonella typhimurium LT2
agcgcgagcgugaucuc

SEQ ID NO: 1827516 - RNA, 12 nt, Salmonella typhimurium LT2
agcgcgcgcuaa

SEQ ID NO: 1827517 - RNA, 21 nt, Salmonella typhimurium LT2
agcgcgcgacccagcgcauga

SEQ ID NO: 1827518 - RNA, 21 nt, Salmonella typhimurium LT2
agcgcgcgcaggguuucgaua

SEQ ID NO: 1827519 - RNA, 16 nt, Salmonella typhimurium LT2
agcgccugcgcggcaa

SEQ ID NO: 1827520 - RNA, 13 nt, Salmonella typhimurium LT2
agcgcgaccugca

SEQ ID NO: 1827521 - RNA, 19 nt, Salmonella typhimurium LT2
agcgccugaugccgccguu

SEQ ID NO: 1827522 - RNA, 13 nt, Salmonella typhimurium LT2
agcgccugacggc

SEQ ID NO: 1827523 - RNA, 18 nt, Salmonella typhimurium LT2
agcgccugacggcgcugu

SEQ ID NO: 1827524 - RNA, 17 nt, Salmonella typhimurium LT2
agcgccggauaauccag

SEQ ID NO: 1827525 - RNA, 12 nt, Salmonella typhimurium LT2
agcgccggaaug

SEQ ID NO: 1827526 - RNA, 19 nt, Salmonella typhimurium LT2
agcgccgcguggcguucca

SEQ ID NO: 1827527 - RNA, 17 nt, Salmonella typhimurium LT2
agcgccacgcgaugcaa

SEQ ID NO: 1827528 - RNA, 16 nt, Salmonella typhimurium LT2
agcgcauuaccgccgc

SEQ ID NO: 1827529 - RNA, 22 nt, Salmonella typhimurium LT2
agccgucggcgccaucaugcag

SEQ ID NO: 1827530 - RNA, 15 nt, Salmonella typhimurium LT2
agccguucaccagcc

SEQ ID NO: 1827531 - RNA, 18 nt, Salmonella typhimurium LT2
agcgaauccagaucgccc

SEQ ID NO: 1827532 - RNA, 13 nt, Salmonella typhimurium LT2
agcgaauccagcg

SEQ ID NO: 1827533 - RNA, 15 nt, Salmonella typhimurium LT2
agcgaauccagcgcc

SEQ ID NO: 1827534 - RNA, 18 nt, Salmonella typhimurium LT2
agcgaauccccgggcaca

SEQ ID NO: 1827535 - RNA, 21 nt, Salmonella typhimurium LT2
agcgaauuaugacggaugcca

SEQ ID NO: 1827536 - RNA, 23 nt, Salmonella typhimurium LT2
agccuuuguaacgaacgcugcau

SEQ ID NO: 1827537 - RNA, 22 nt, Salmonella typhimurium LT2
agccuuuuaccgucacgcggcu

SEQ ID NO: 1827538 - RNA, 14 nt, Salmonella typhimurium LT2
agccuaaugacgga

SEQ ID NO: 1827539 - RNA, 20 nt, Salmonella typhimurium LT2
agccguugccauagcgggca

SEQ ID NO: 1827540 - RNA, 20 nt, Salmonella typhimurium LT2
agcgcagcgccaucaggcaa

SEQ ID NO: 1827541 - RNA, 14 nt, Salmonella typhimurium LT2
agcgcaucgcgcaa

SEQ ID NO: 1827542 - RNA, 13 nt, Salmonella typhimurium LT2
agcgcauccggca

SEQ ID NO: 1827543 - RNA, 19 nt, Salmonella typhimurium LT2
agcgcaccgcgcggcuggu

SEQ ID NO: 1827544 - RNA, 16 nt, Salmonella typhimurium LT2
agcgcaccagccggug

SEQ ID NO: 1827545 - RNA, 12 nt, Salmonella typhimurium LT2
agcgcagcacgu

SEQ ID NO: 1827546 - RNA, 19 nt, Salmonella typhimurium LT2
agcgcagcgcaucaggcaa

SEQ ID NO: 1827547 - RNA, 14 nt, Salmonella typhimurium LT2
agcgaucagcgcca

SEQ ID NO: 1827548 - RNA, 18 nt, Salmonella typhimurium LT2
agcgaucaggggucagcg

SEQ ID NO: 1827549 - RNA, 18 nt, Salmonella typhimurium LT2
agcgauaaacucagcgcc

SEQ ID NO: 1827550 - RNA, 18 nt, Salmonella typhimurium LT2
agcgauaaagaacgccgc

SEQ ID NO: 1827551 - RNA, 15 nt, Salmonella typhimurium LT2
agcgauaaccgccgc

SEQ ID NO: 1827552 - RNA, 17 nt, Salmonella typhimurium LT2
agcgagccaucggcaaa

SEQ ID NO: 1827553 - RNA, 14 nt, Salmonella typhimurium LT2
agcgagaggcaauu

SEQ ID NO: 1827554 - RNA, 20 nt, Salmonella typhimurium LT2
agcgagauaaucgggaauac

SEQ ID NO: 1827555 - RNA, 14 nt, Salmonella typhimurium LT2
agcccucuuccggc

SEQ ID NO: 1827556 - RNA, 22 nt, Salmonella typhimurium LT2
agcccucaacauugccggcauc

SEQ ID NO: 1827557 - RNA, 19 nt, Salmonella typhimurium LT2
agcccuauaacagcgccag

SEQ ID NO: 1827558 - RNA, 13 nt, Salmonella typhimurium LT2
agcccugccacca

SEQ ID NO: 1827559 - RNA, 19 nt, Salmonella typhimurium LT2
agccgaccaauugcaggca

SEQ ID NO: 1827560 - RNA, 16 nt, Salmonella typhimurium LT2
agccgccauccggcaa

SEQ ID NO: 1827561 - RNA, 13 nt, Salmonella typhimurium LT2
agccgaucagcgc

SEQ ID NO: 1827562 - RNA, 13 nt, Salmonella typhimurium LT2
agccgaucaggcc

SEQ ID NO: 1827563 - RNA, 23 nt, Salmonella typhimurium LT2
agccgaucaucacgaaauaacgc

SEQ ID NO: 1827564 - RNA, 15 nt, Salmonella typhimurium LT2
agccgacggccauaa

SEQ ID NO: 1827565 - RNA, 13 nt, Salmonella typhimurium LT2
agcccaaccgcgu

SEQ ID NO: 1827566 - RNA, 14 nt, Salmonella typhimurium LT2
agccccagcgcaaa

SEQ ID NO: 1827567 - RNA, 20 nt, Salmonella typhimurium LT2
agccccagcccugugccgcu

SEQ ID NO: 1827568 - RNA, 23 nt, Salmonella typhimurium LT2
agccccacggcaaauuuaagcca

SEQ ID NO: 1827569 - RNA, 17 nt, Salmonella typhimurium LT2
agcccaucaguccccag

SEQ ID NO: 1827570 - RNA, 15 nt, Salmonella typhimurium LT2
agcccccagccgauc

SEQ ID NO: 1827571 - RNA, 21 nt, Salmonella typhimurium LT2
agccccuaccgaggcaggggc

SEQ ID NO: 1827572 - RNA, 12 nt, Salmonella typhimurium LT2
agccacggcgca

SEQ ID NO: 1827573 - RNA, 12 nt, Salmonella typhimurium LT2
agccacggcaac

SEQ ID NO: 1827574 - RNA, 18 nt, Salmonella typhimurium LT2
agccacgccgauccgaca

SEQ ID NO: 1827575 - RNA, 14 nt, Salmonella typhimurium LT2
agccaauauccgga

SEQ ID NO: 1827576 - RNA, 16 nt, Salmonella typhimurium LT2
agccaauauccggaua

SEQ ID NO: 1827577 - RNA, 21 nt, Salmonella typhimurium LT2
agccaacuuuuucuuaagcug

SEQ ID NO: 1827578 - RNA, 22 nt, Salmonella typhimurium LT2
agccagccgccaaaaauaucgc

SEQ ID NO: 1827579 - RNA, 14 nt, Salmonella typhimurium LT2
agccagacgcgcag

SEQ ID NO: 1827580 - RNA, 23 nt, Salmonella typhimurium LT2
agccagacgccgcgccgcggcgu

SEQ ID NO: 1827581 - RNA, 16 nt, Salmonella typhimurium LT2
agccagaacucaucuu

SEQ ID NO: 1827582 - RNA, 20 nt, Salmonella typhimurium LT2
agccacuauccagucagcgu

SEQ ID NO: 1827583 - RNA, 14 nt, Salmonella typhimurium LT2
agccaucccggcga

SEQ ID NO: 1827584 - RNA, 13 nt, Salmonella typhimurium LT2
agccaucaccguu

SEQ ID NO: 1827585 - RNA, 15 nt, Salmonella typhimurium LT2
agccaugccagcagu

SEQ ID NO: 1827586 - RNA, 22 nt, Salmonella typhimurium LT2
agccaugugacggcauguccgg

SEQ ID NO: 1827587 - RNA, 20 nt, Salmonella typhimurium LT2
agccaguuauuaaucaagcc

SEQ ID NO: 1827588 - RNA, 13 nt, Salmonella typhimurium LT2
agccagugggcgu

SEQ ID NO: 1827589 - RNA, 22 nt, Salmonella typhimurium LT2
agccaguuuucuucuuugcgcg

SEQ ID NO: 1827590 - RNA, 18 nt, Salmonella typhimurium LT2
agccagcgaugagcgcca

SEQ ID NO: 1827591 - RNA, 21 nt, Salmonella typhimurium LT2
agcagcauacgacaucgccaa

SEQ ID NO: 1827592 - RNA, 21 nt, Salmonella typhimurium LT2
agcagccaguuauuaaucaag

SEQ ID NO: 1827593 - RNA, 22 nt, Salmonella typhimurium LT2
agcagccgaccaguaagagaac

SEQ ID NO: 1827594 - RNA, 21 nt, Salmonella typhimurium LT2
agcaguaugcccccuccagcc

SEQ ID NO: 1827595 - RNA, 13 nt, Salmonella typhimurium LT2
agcaucagcgccg

SEQ ID NO: 1827596 - RNA, 19 nt, Salmonella typhimurium LT2
agagcgucucauccggcag

SEQ ID NO: 1827597 - RNA, 21 nt, Salmonella typhimurium LT2
agaggaaauccuuccagcgcc

SEQ ID NO: 1827598 - RNA, 22 nt, Salmonella typhimurium LT2
agagaucgaacaauuaccgaug

SEQ ID NO: 1827599 - RNA, 18 nt, Salmonella typhimurium LT2
agaggccaccagcgccag

SEQ ID NO: 1827600 - RNA, 16 nt, Salmonella typhimurium LT2
agaggaucuggacgcc

SEQ ID NO: 1827601 - RNA, 16 nt, Salmonella typhimurium LT2
agaggaauguccagcu

SEQ ID NO: 1827602 - RNA, 18 nt, Salmonella typhimurium LT2
agaggcguugccgggcau

SEQ ID NO: 1827603 - RNA, 16 nt, Salmonella typhimurium LT2
agaguaaagaucgcac

SEQ ID NO: 1827604 - RNA, 14 nt, Salmonella typhimurium LT2
agacucaucgccgc

SEQ ID NO: 1827605 - RNA, 15 nt, Salmonella typhimurium LT2
agacuaucuucgaua

SEQ ID NO: 1827606 - RNA, 13 nt, Salmonella typhimurium LT2
agaaagcggcuua

SEQ ID NO: 1827607 - RNA, 20 nt, Salmonella typhimurium LT2
agauggcgucacauggcgaa

SEQ ID NO: 1827608 - RNA, 18 nt, Salmonella typhimurium LT2
agauggcgcuaaaaccgu

SEQ ID NO: 1827609 - RNA, 14 nt, Salmonella typhimurium LT2
agaugccgccaguu

SEQ ID NO: 1827610 - RNA, 14 nt, Salmonella typhimurium LT2
agauggcaaacggu

SEQ ID NO: 1827611 - RNA, 22 nt, Salmonella typhimurium LT2
agaugaccguuaguaaucggau

SEQ ID NO: 1827612 - RNA, 17 nt, Salmonella typhimurium LT2
agaugagcaaaccgcaa

SEQ ID NO: 1827613 - RNA, 12 nt, Salmonella typhimurium LT2
agaucuuugggc

SEQ ID NO: 1827614 - RNA, 14 nt, Salmonella typhimurium LT2
agaucuuccggcgu

SEQ ID NO: 1827615 - RNA, 17 nt, Salmonella typhimurium LT2
agaucugucgccaugac

SEQ ID NO: 1827616 - RNA, 21 nt, Salmonella typhimurium LT2
agaugaccgaguuccagucca

SEQ ID NO: 1827617 - RNA, 17 nt, Salmonella typhimurium LT2
agaucgagacgcgucag

SEQ ID NO: 1827618 - RNA, 13 nt, Salmonella typhimurium LT2
agauccuggcgcu

SEQ ID NO: 1827619 - RNA, 13 nt, Salmonella typhimurium LT2
agaucaaagcgua

SEQ ID NO: 1827620 - RNA, 14 nt, Salmonella typhimurium LT2
agaucguauccggc

SEQ ID NO: 1827621 - RNA, 18 nt, Salmonella typhimurium LT2
agauguuuuaccaguaca

SEQ ID NO: 1827622 - RNA, 16 nt, Salmonella typhimurium LT2
agauuaacagcgcgac

SEQ ID NO: 1827623 - RNA, 18 nt, Salmonella typhimurium LT2
agauucaaacugauaagg

SEQ ID NO: 1827624 - RNA, 22 nt, Salmonella typhimurium LT2
agaugucgcaauaaacgggcag

SEQ ID NO: 1827625 - RNA, 12 nt, Salmonella typhimurium LT2
agcaccaguacc

SEQ ID NO: 1827626 - RNA, 21 nt, Salmonella typhimurium LT2
agcaccauggcuauccacgcc

SEQ ID NO: 1827627 - RNA, 21 nt, Salmonella typhimurium LT2
agcaauagguuugaccagaua

SEQ ID NO: 1827628 - RNA, 24 nt, Salmonella typhimurium LT2
agcaacuuuuccgccucgcgcacc

SEQ ID NO: 1827629 - RNA, 17 nt, Salmonella typhimurium LT2
agcaauguaagaauaac

SEQ ID NO: 1827630 - RNA, 20 nt, Salmonella typhimurium LT2
agcaauggguaggccggaua

SEQ ID NO: 1827631 - RNA, 23 nt, Salmonella typhimurium LT2
aggcgauauuguccgucagcgca

SEQ ID NO: 1827632 - RNA, 16 nt, Salmonella typhimurium LT2
aggccuaccagccgag

SEQ ID NO: 1827633 - RNA, 13 nt, Salmonella typhimurium LT2
aggccuaccagcc

SEQ ID NO: 1827634 - RNA, 20 nt, Salmonella typhimurium LT2
aggcgcccgagcgccgcuuu

SEQ ID NO: 1827635 - RNA, 13 nt, Salmonella typhimurium LT2
aggcgcugcuggc

SEQ ID NO: 1827636 - RNA, 17 nt, Salmonella typhimurium LT2
aggcggaaaucagcaca

SEQ ID NO: 1827637 - RNA, 20 nt, Salmonella typhimurium LT2
aggcgcuagccgcauccggc

SEQ ID NO: 1827638 - RNA, 16 nt, Salmonella typhimurium LT2
aggcgcuaugcugauc

SEQ ID NO: 1827639 - RNA, 16 nt, Salmonella typhimurium LT2
agggaauaucuuccgg

SEQ ID NO: 1827640 - RNA, 19 nt, Salmonella typhimurium LT2
agggaacuccagcagggcg

SEQ ID NO: 1827641 - RNA, 13 nt, Salmonella typhimurium LT2
aggcucagcgcca

SEQ ID NO: 1827642 - RNA, 19 nt, Salmonella typhimurium LT2
aggcucaaaguuaccggca

SEQ ID NO: 1827643 - RNA, 14 nt, Salmonella typhimurium LT2
aggcugcgcgaauu

SEQ ID NO: 1827644 - RNA, 23 nt, Salmonella typhimurium LT2
aggcgugcguauugccccgucag

SEQ ID NO: 1827645 - RNA, 18 nt, Salmonella typhimurium LT2
aggcgugguggauaucca

SEQ ID NO: 1827646 - RNA, 22 nt, Salmonella typhimurium LT2
aggcguuucgccgccauccggc

SEQ ID NO: 1827647 - RNA, 21 nt, Salmonella typhimurium LT2
aggcggguauggcgccaauau

SEQ ID NO: 1827648 - RNA, 14 nt, Salmonella typhimurium LT2
aggcgugacguuca

SEQ ID NO: 1827649 - RNA, 23 nt, Salmonella typhimurium LT2
agcugcccuguucggcgcggaaa

SEQ ID NO: 1827650 - RNA, 20 nt, Salmonella typhimurium LT2
aggccaucugaucgcugagc

SEQ ID NO: 1827651 - RNA, 21 nt, Salmonella typhimurium LT2
aggcauguugcgcaaucacgc

SEQ ID NO: 1827652 - RNA, 21 nt, Salmonella typhimurium LT2
aggauguuuugcggcuucagc

SEQ ID NO: 1827653 - RNA, 22 nt, Salmonella typhimurium LT2
aggcauuaguaauaaagcguag

SEQ ID NO: 1827654 - RNA, 17 nt, Salmonella typhimurium LT2
aggcauuucuaccggca

SEQ ID NO: 1827655 - RNA, 18 nt, Salmonella typhimurium LT2
aggccggauaaggcgcag

SEQ ID NO: 1827656 - RNA, 14 nt, Salmonella typhimurium LT2
aggccccgccaucc

SEQ ID NO: 1827657 - RNA, 17 nt, Salmonella typhimurium LT2
aggccccgccauccggc

SEQ ID NO: 1827658 - RNA, 16 nt, Salmonella typhimurium LT2
aggucagguaagcgcu

SEQ ID NO: 1827659 - RNA, 18 nt, Salmonella typhimurium LT2
aggucaucaacuggcggc

SEQ ID NO: 1827660 - RNA, 20 nt, Salmonella typhimurium LT2
aggugaauaguauugccguc

SEQ ID NO: 1827661 - RNA, 14 nt, Salmonella typhimurium LT2
agggguuccggcaa

SEQ ID NO: 1827662 - RNA, 23 nt, Salmonella typhimurium LT2
aggggggccugauggcgcugcgc

SEQ ID NO: 1827663 - RNA, 17 nt, Salmonella typhimurium LT2
agggcaaucugaguauu

SEQ ID NO: 1827664 - RNA, 22 nt, Salmonella typhimurium LT2
agggaucaagcaauaccagaaa

SEQ ID NO: 1827665 - RNA, 23 nt, Salmonella typhimurium LT2
agggcaguuacacuauugucguc

SEQ ID NO: 1827666 - RNA, 16 nt, Salmonella typhimurium LT2
agguaauuuggcgaga

SEQ ID NO: 1827667 - RNA, 18 nt, Salmonella typhimurium LT2
aggguggacaugauaagc

SEQ ID NO: 1827668 - RNA, 19 nt, Salmonella typhimurium LT2
aguccuuaucccugcggcu

SEQ ID NO: 1827669 - RNA, 22 nt, Salmonella typhimurium LT2
aguccugccggacugauaccgc

SEQ ID NO: 1827670 - RNA, 17 nt, Salmonella typhimurium LT2
agucccuccgcuuccac

SEQ ID NO: 1827671 - RNA, 20 nt, Salmonella typhimurium LT2
aguccaacaaggauauccgc

SEQ ID NO: 1827672 - RNA, 12 nt, Salmonella typhimurium LT2
agucaucgccgc

SEQ ID NO: 1827673 - RNA, 23 nt, Salmonella typhimurium LT2
agucauaauacucaauauccugc

SEQ ID NO: 1827674 - RNA, 20 nt, Salmonella typhimurium LT2
aguaauuugaacauauccgc

SEQ ID NO: 1827675 - RNA, 18 nt, Salmonella typhimurium LT2
aguaauuucuugcgccag

SEQ ID NO: 1827676 - RNA, 19 nt, Salmonella typhimurium LT2
aguaacucuauaucgacag

SEQ ID NO: 1827677 - RNA, 18 nt, Salmonella typhimurium LT2
aguaagaggguggcgagc

SEQ ID NO: 1827678 - RNA, 23 nt, Salmonella typhimurium LT2
aguaccggcaggacaaucauaau

SEQ ID NO: 1827679 - RNA, 15 nt, Salmonella typhimurium LT2
aguaucgcgccgcca

SEQ ID NO: 1827680 - RNA, 14 nt, Salmonella typhimurium LT2
aguaucuuauccgg

SEQ ID NO: 1827681 - RNA, 16 nt, Salmonella typhimurium LT2
agguggguuccagcgc

SEQ ID NO: 1827682 - RNA, 15 nt, Salmonella typhimurium LT2
agguggaauacaaac

SEQ ID NO: 1827683 - RNA, 13 nt, Salmonella typhimurium LT2
agguuaugcgcac

SEQ ID NO: 1827684 - RNA, 20 nt, Salmonella typhimurium LT2
agguuaacccacaacgcacc

SEQ ID NO: 1827685 - RNA, 14 nt, Salmonella typhimurium LT2
agguuccgacaaua

SEQ ID NO: 1827686 - RNA, 14 nt, Salmonella typhimurium LT2
aguaaacagcauca

SEQ ID NO: 1827687 - RNA, 12 nt, Salmonella typhimurium LT2
aguaaaggcguu

SEQ ID NO: 1827688 - RNA, 16 nt, Salmonella typhimurium LT2
agguuucuucaucaaa

SEQ ID NO: 1827689 - RNA, 23 nt, Salmonella typhimurium LT2
agugucuucccugaccagcgacg

SEQ ID NO: 1827690 - RNA, 13 nt, Salmonella typhimurium LT2
aguucauccagca

SEQ ID NO: 1827691 - RNA, 12 nt, Salmonella typhimurium LT2
aguugcagcgcc

SEQ ID NO: 1827692 - RNA, 14 nt, Salmonella typhimurium LT2
auaaacucagcgcc

SEQ ID NO: 1827693 - RNA, 21 nt, Salmonella typhimurium LT2
auaaacgucccgacgaauaac

SEQ ID NO: 1827694 - RNA, 14 nt, Salmonella typhimurium LT2
auaaaauagcgauc

SEQ ID NO: 1827695 - RNA, 15 nt, Salmonella typhimurium LT2
auaaacacacaccga

SEQ ID NO: 1827696 - RNA, 12 nt, Salmonella typhimurium LT2
auaaaauaagca

SEQ ID NO: 1827697 - RNA, 16 nt, Salmonella typhimurium LT2
auaaaggucacaucau

SEQ ID NO: 1827698 - RNA, 20 nt, Salmonella typhimurium LT2
auaaagcgaccgaucaucau

SEQ ID NO: 1827699 - RNA, 22 nt, Salmonella typhimurium LT2
auaaagcccgcuuuuagcgcgg

SEQ ID NO: 1827700 - RNA, 18 nt, Salmonella typhimurium LT2
auaaauccccgccgccau

SEQ ID NO: 1827701 - RNA, 13 nt, Salmonella typhimurium LT2
auaaaucagcgcg

SEQ ID NO: 1827702 - RNA, 12 nt, Salmonella typhimurium LT2
auaaaucaucau

SEQ ID NO: 1827703 - RNA, 15 nt, Salmonella typhimurium LT2
auaaauagugacgcc

SEQ ID NO: 1827704 - RNA, 13 nt, Salmonella typhimurium LT2
aguuuuccgccau

SEQ ID NO: 1827705 - RNA, 14 nt, Salmonella typhimurium LT2
aguuuuccgccauu

SEQ ID NO: 1827706 - RNA, 15 nt, Salmonella typhimurium LT2
aguuuuccuucagca

SEQ ID NO: 1827707 - RNA, 14 nt, Salmonella typhimurium LT2
auaaaaccggcaua

SEQ ID NO: 1827708 - RNA, 18 nt, Salmonella typhimurium LT2
auaaaagcccuuaucgcc

SEQ ID NO: 1827709 - RNA, 14 nt, Salmonella typhimurium LT2
auaaaagccgccau

SEQ ID NO: 1827710 - RNA, 14 nt, Salmonella typhimurium LT2
auaaaacgcgauau

SEQ ID NO: 1827711 - RNA, 21 nt, Salmonella typhimurium LT2
auaagcgcagcgccaucaggc

SEQ ID NO: 1827712 - RNA, 14 nt, Salmonella typhimurium LT2
auaagcauagcgcc

SEQ ID NO: 1827713 - RNA, 20 nt, Salmonella typhimurium LT2
auaagcguagcgcauccggc

SEQ ID NO: 1827714 - RNA, 21 nt, Salmonella typhimurium LT2
auaagcguagcgccaucaggc

SEQ ID NO: 1827715 - RNA, 21 nt, Salmonella typhimurium LT2
auaagcguagcgccauccggc

SEQ ID NO: 1827716 - RNA, 21 nt, Salmonella typhimurium LT2
auaagcgccgcgccaucgggc

SEQ ID NO: 1827717 - RNA, 18 nt, Salmonella typhimurium LT2
auaagcgccgucauccgc

SEQ ID NO: 1827718 - RNA, 16 nt, Salmonella typhimurium LT2
auaagcgucagcgugc

SEQ ID NO: 1827719 - RNA, 21 nt, Salmonella typhimurium LT2
auaagcgugagcgcauccggc

SEQ ID NO: 1827720 - RNA, 17 nt, Salmonella typhimurium LT2
auaagcgugcgucaucc

SEQ ID NO: 1827721 - RNA, 20 nt, Salmonella typhimurium LT2
auaagcgugcgucauccggc

SEQ ID NO: 1827722 - RNA, 17 nt, Salmonella typhimurium LT2
auaagcguuaaugcguu

SEQ ID NO: 1827723 - RNA, 21 nt, Salmonella typhimurium LT2
auaagcgcagcgccauccggc

SEQ ID NO: 1827724 - RNA, 14 nt, Salmonella typhimurium LT2
auaacaaacgccgc

SEQ ID NO: 1827725 - RNA, 18 nt, Salmonella typhimurium LT2
auaaauuuuuuaacagaa

SEQ ID NO: 1827726 - RNA, 17 nt, Salmonella typhimurium LT2
auaaucgccgccagcuc

SEQ ID NO: 1827727 - RNA, 13 nt, Salmonella typhimurium LT2
auaaucgccggac

SEQ ID NO: 1827728 - RNA, 15 nt, Salmonella typhimurium LT2
auaagcgaacaggcc

SEQ ID NO: 1827729 - RNA, 22 nt, Salmonella typhimurium LT2
auaaggcguuucgccgccaucc

SEQ ID NO: 1827730 - RNA, 18 nt, Salmonella typhimurium LT2
auacagcacuucccgcuc

SEQ ID NO: 1827731 - RNA, 13 nt, Salmonella typhimurium LT2
auaauggcgccga

SEQ ID NO: 1827732 - RNA, 22 nt, Salmonella typhimurium LT2
auaauguuguccacaaacgccg

SEQ ID NO: 1827733 - RNA, 16 nt, Salmonella typhimurium LT2
auaaugcagccauccu

SEQ ID NO: 1827734 - RNA, 15 nt, Salmonella typhimurium LT2
auaaugacauccaga

SEQ ID NO: 1827735 - RNA, 22 nt, Salmonella typhimurium LT2
auacauagcaggccauaaugca

SEQ ID NO: 1827736 - RNA, 20 nt, Salmonella typhimurium LT2
auacgucauaucaguugccc

SEQ ID NO: 1827737 - RNA, 14 nt, Salmonella typhimurium LT2
auacgucugcgcug

SEQ ID NO: 1827738 - RNA, 14 nt, Salmonella typhimurium LT2
auacgucauaucau

SEQ ID NO: 1827739 - RNA, 19 nt, Salmonella typhimurium LT2
auacucacgacuuucacca

SEQ ID NO: 1827740 - RNA, 17 nt, Salmonella typhimurium LT2
auagcaauacuuuccag

SEQ ID NO: 1827741 - RNA, 20 nt, Salmonella typhimurium LT2
auagcaauacuuuccagcug

SEQ ID NO: 1827742 - RNA, 15 nt, Salmonella typhimurium LT2
auagagugcgauuug

SEQ ID NO: 1827743 - RNA, 15 nt, Salmonella typhimurium LT2
auagagauccuggcg

SEQ ID NO: 1827744 - RNA, 22 nt, Salmonella typhimurium LT2
auacugacgagcgacgaggcau

SEQ ID NO: 1827745 - RNA, 15 nt, Salmonella typhimurium LT2
auacugacacgccag

SEQ ID NO: 1827746 - RNA, 16 nt, Salmonella typhimurium LT2
auacucccggcgcugg

SEQ ID NO: 1827747 - RNA, 12 nt, Salmonella typhimurium LT2
auacuccgacgg

SEQ ID NO: 1827748 - RNA, 13 nt, Salmonella typhimurium LT2
auacucugcgcug

SEQ ID NO: 1827749 - RNA, 18 nt, Salmonella typhimurium LT2
aucaacaccagcagcgcg

SEQ ID NO: 1827750 - RNA, 23 nt, Salmonella typhimurium LT2
aucaacgaccaugguucccgcca

SEQ ID NO: 1827751 - RNA, 17 nt, Salmonella typhimurium LT2
aucaacgccgcgccauc

SEQ ID NO: 1827752 - RNA, 12 nt, Salmonella typhimurium LT2
aucaaacgucac

SEQ ID NO: 1827753 - RNA, 21 nt, Salmonella typhimurium LT2
aucaaacuccgcgcuggcaau

SEQ ID NO: 1827754 - RNA, 13 nt, Salmonella typhimurium LT2
aucaaagcgugau

SEQ ID NO: 1827755 - RNA, 13 nt, Salmonella typhimurium LT2
auauuuguaucug

SEQ ID NO: 1827756 - RNA, 14 nt, Salmonella typhimurium LT2
auauuucaagccgc

SEQ ID NO: 1827757 - RNA, 22 nt, Salmonella typhimurium LT2
aucaauaagcgaauugccgucg

SEQ ID NO: 1827758 - RNA, 14 nt, Salmonella typhimurium LT2
aucaaugcgaugau

SEQ ID NO: 1827759 - RNA, 15 nt, Salmonella typhimurium LT2
aucaaugucugaugg

SEQ ID NO: 1827760 - RNA, 19 nt, Salmonella typhimurium LT2
aucacaacgucaucccgaa

SEQ ID NO: 1827761 - RNA, 18 nt, Salmonella typhimurium LT2
aucaagauugaguccaua

SEQ ID NO: 1827762 - RNA, 22 nt, Salmonella typhimurium LT2
aucaacugggugugaucgccgc

SEQ ID NO: 1827763 - RNA, 13 nt, Salmonella typhimurium LT2
aucaacggguuaa

SEQ ID NO: 1827764 - RNA, 14 nt, Salmonella typhimurium LT2
auauccgcugcggu

SEQ ID NO: 1827765 - RNA, 13 nt, Salmonella typhimurium LT2
auaucccuucuca

SEQ ID NO: 1827766 - RNA, 12 nt, Salmonella typhimurium LT2
auaucaaugcgc

SEQ ID NO: 1827767 - RNA, 22 nt, Salmonella typhimurium LT2
auaucaccaucuuuuugcucaa

SEQ ID NO: 1827768 - RNA, 21 nt, Salmonella typhimurium LT2
auagccguccauguucggcau

SEQ ID NO: 1827769 - RNA, 14 nt, Salmonella typhimurium LT2
auagccuuccaccg

SEQ ID NO: 1827770 - RNA, 20 nt, Salmonella typhimurium LT2
auagccuacccuuucacccg

SEQ ID NO: 1827771 - RNA, 16 nt, Salmonella typhimurium LT2
auagccccaguaaauu

SEQ ID NO: 1827772 - RNA, 16 nt, Salmonella typhimurium LT2
auauguucccgacggc

SEQ ID NO: 1827773 - RNA, 22 nt, Salmonella typhimurium LT2
auaugucugauucuuaucugug

SEQ ID NO: 1827774 - RNA, 23 nt, Salmonella typhimurium LT2
auaugcgcggcgaucagacgcug

SEQ ID NO: 1827775 - RNA, 20 nt, Salmonella typhimurium LT2
auauggcgggccugugccug

SEQ ID NO: 1827776 - RNA, 22 nt, Salmonella typhimurium LT2
auaugccaggcuuccugcgcug

SEQ ID NO: 1827777 - RNA, 20 nt, Salmonella typhimurium LT2
auaugcaggggcaguaaauu

SEQ ID NO: 1827778 - RNA, 21 nt, Salmonella typhimurium LT2
auaugccagcucaaaucgcgg

SEQ ID NO: 1827779 - RNA, 21 nt, Salmonella typhimurium LT2
auaugaucgaaaaugcgcaug

SEQ ID NO: 1827780 - RNA, 12 nt, Salmonella typhimurium LT2
aucagcaucacc

SEQ ID NO: 1827781 - RNA, 19 nt, Salmonella typhimurium LT2
aucagcauagcgccuucag

SEQ ID NO: 1827782 - RNA, 11 nt, Salmonella typhimurium LT2
aucagcagcga

SEQ ID NO: 1827783 - RNA, 22 nt, Salmonella typhimurium LT2
aucagccugagcgccagcgugc

SEQ ID NO: 1827784 - RNA, 16 nt, Salmonella typhimurium LT2
aucagccagccgccaa

SEQ ID NO: 1827785 - RNA, 15 nt, Salmonella typhimurium LT2
aucagccagccgcca

SEQ ID NO: 1827786 - RNA, 13 nt, Salmonella typhimurium LT2
aucacuuccgcca

SEQ ID NO: 1827787 - RNA, 14 nt, Salmonella typhimurium LT2
aucacuucgcgcau

SEQ ID NO: 1827788 - RNA, 16 nt, Salmonella typhimurium LT2
aucacuuuugccguca

SEQ ID NO: 1827789 - RNA, 14 nt, Salmonella typhimurium LT2
aucagaauaaugcu

SEQ ID NO: 1827790 - RNA, 19 nt, Salmonella typhimurium LT2
aucacuauuugugcggcau

SEQ ID NO: 1827791 - RNA, 22 nt, Salmonella typhimurium LT2
aucagaguaauuuguugcgcuu

SEQ ID NO: 1827792 - RNA, 16 nt, Salmonella typhimurium LT2
aucagacuguuacgcu

SEQ ID NO: 1827793 - RNA, 15 nt, Salmonella typhimurium LT2
aucagaacugguagg

SEQ ID NO: 1827794 - RNA, 14 nt, Salmonella typhimurium LT2
aucagcaagaugac

SEQ ID NO: 1827795 - RNA, 14 nt, Salmonella typhimurium LT2
aucagcaacgcgcc

SEQ ID NO: 1827796 - RNA, 23 nt, Salmonella typhimurium LT2
aucagauucgcuacugcaucugc

SEQ ID NO: 1827797 - RNA, 17 nt, Salmonella typhimurium LT2
aucagaugaccaccgau

SEQ ID NO: 1827798 - RNA, 22 nt, Salmonella typhimurium LT2
aucacgguacgcaucaccaggc

SEQ ID NO: 1827799 - RNA, 21 nt, Salmonella typhimurium LT2
aucacggguuuuacuggcgcg

SEQ ID NO: 1827800 - RNA, 18 nt, Salmonella typhimurium LT2
aucacguuuugcagcgcc

SEQ ID NO: 1827801 - RNA, 22 nt, Salmonella typhimurium LT2
aucacguuuuuuacgucagcaa

SEQ ID NO: 1827802 - RNA, 16 nt, Salmonella typhimurium LT2
aucacgccgaugacca

SEQ ID NO: 1827803 - RNA, 21 nt, Salmonella typhimurium LT2
aucacgauauguuugccguca

SEQ ID NO: 1827804 - RNA, 16 nt, Salmonella typhimurium LT2
aucaccuuacgcucgc

SEQ ID NO: 1827805 - RNA, 18 nt, Salmonella typhimurium LT2
aucaccauucccagcgcc

SEQ ID NO: 1827806 - RNA, 13 nt, Salmonella typhimurium LT2
aucaccgacaggu

SEQ ID NO: 1827807 - RNA, 17 nt, Salmonella typhimurium LT2
aucaccagcaccgccag

SEQ ID NO: 1827808 - RNA, 14 nt, Salmonella typhimurium LT2
aucaccagccgauc

SEQ ID NO: 1827809 - RNA, 14 nt, Salmonella typhimurium LT2
aucacaaucagcca

SEQ ID NO: 1827810 - RNA, 12 nt, Salmonella typhimurium LT2
aucacagacaga

SEQ ID NO: 1827811 - RNA, 19 nt, Salmonella typhimurium LT2
cccuuacaaaaaucaugcc

SEQ ID NO: 1827812 - RNA, 16 nt, Salmonella typhimurium LT2
cccuggacgcgagcca

SEQ ID NO: 1827813 - RNA, 20 nt, Salmonella typhimurium LT2
cccugcuggcgaaccaccag

SEQ ID NO: 1827814 - RNA, 13 nt, Salmonella typhimurium LT2
ccgaacaggccau

SEQ ID NO: 1827815 - RNA, 21 nt, Salmonella typhimurium LT2
ccgaagaaagcuaucgccauc

SEQ ID NO: 1827816 - RNA, 18 nt, Salmonella typhimurium LT2
ccgaagaacagauucauu

SEQ ID NO: 1827817 - RNA, 20 nt, Salmonella typhimurium LT2
cccgguggcgguaccggcau

SEQ ID NO: 1827818 - RNA, 14 nt, Salmonella typhimurium LT2
cccugagcaaucag

SEQ ID NO: 1827819 - RNA, 15 nt, Salmonella typhimurium LT2
ccgaccgucggcgca

SEQ ID NO: 1827820 - RNA, 17 nt, Salmonella typhimurium LT2
ccgaccuguaccgcgac

SEQ ID NO: 1827821 - RNA, 17 nt, Salmonella typhimurium LT2
ccgacgaaauagcguuc

SEQ ID NO: 1827822 - RNA, 21 nt, Salmonella typhimurium LT2
ccgacauagcugaacaauccc

SEQ ID NO: 1827823 - RNA, 14 nt, Salmonella typhimurium LT2
ccgacagcggcgca

SEQ ID NO: 1827824 - RNA, 13 nt, Salmonella typhimurium LT2
ccgacaucgccag

SEQ ID NO: 1827825 - RNA, 21 nt, Salmonella typhimurium LT2
ccgaccaaugacgcuauccgc

SEQ ID NO: 1827826 - RNA, 24 nt, Salmonella typhimurium LT2
cccggcaauuaccgccagcggcgu

SEQ ID NO: 1827827 - RNA, 19 nt, Salmonella typhimurium LT2
cccggcaauuaccgccagc

SEQ ID NO: 1827828 - RNA, 21 nt, Salmonella typhimurium LT2
cccggacgaaccuggcgguaa

SEQ ID NO: 1827829 - RNA, 14 nt, Salmonella typhimurium LT2
cccggccugacgca

SEQ ID NO: 1827830 - RNA, 18 nt, Salmonella typhimurium LT2
cccggccuacacaucauc

SEQ ID NO: 1827831 - RNA, 22 nt, Salmonella typhimurium LT2
cccggccuacacaucaucuuua

SEQ ID NO: 1827832 - RNA, 17 nt, Salmonella typhimurium LT2
cccggcguauagcgcuu

SEQ ID NO: 1827833 - RNA, 20 nt, Salmonella typhimurium LT2
cccggcguuuugccgggcgu

SEQ ID NO: 1827834 - RNA, 21 nt, Salmonella typhimurium LT2
cccaucauugacuucaacgca

SEQ ID NO: 1827835 - RNA, 12 nt, Salmonella typhimurium LT2
cccaucaaucac

SEQ ID NO: 1827836 - RNA, 20 nt, Salmonella typhimurium LT2
cccagucgauaaucgguagc

SEQ ID NO: 1827837 - RNA, 17 nt, Salmonella typhimurium LT2
cccagugcgcggucaua

SEQ ID NO: 1827838 - RNA, 16 nt, Salmonella typhimurium LT2
cccagugcccgaacgc

SEQ ID NO: 1827839 - RNA, 13 nt, Salmonella typhimurium LT2
cccaggccagaug

SEQ ID NO: 1827840 - RNA, 22 nt, Salmonella typhimurium LT2
cccagcggaugucggucaucag

SEQ ID NO: 1827841 - RNA, 15 nt, Salmonella typhimurium LT2
cccagcgcgaccugc

SEQ ID NO: 1827842 - RNA, 15 nt, Salmonella typhimurium LT2
ccauucgcccaguca

SEQ ID NO: 1827843 - RNA, 15 nt, Salmonella typhimurium LT2
ccauucgcucgauaa

SEQ ID NO: 1827844 - RNA, 13 nt, Salmonella typhimurium LT2
ccauugccagaua

SEQ ID NO: 1827845 - RNA, 20 nt, Salmonella typhimurium LT2
ccauucuucgucgucaucac

SEQ ID NO: 1827846 - RNA, 21 nt, Salmonella typhimurium LT2
cccagagcgcggccuuugccu

SEQ ID NO: 1827847 - RNA, 24 nt, Salmonella typhimurium LT2
cccacgggaagaugugccacuccg

SEQ ID NO: 1827848 - RNA, 21 nt, Salmonella typhimurium LT2
cccacgcggcguacgcugcaa

SEQ ID NO: 1827849 - RNA, 12 nt, Salmonella typhimurium LT2
ccccaccauguc

SEQ ID NO: 1827850 - RNA, 19 nt, Salmonella typhimurium LT2
cccauugaaaucgccucau

SEQ ID NO: 1827851 - RNA, 19 nt, Salmonella typhimurium LT2
ccccacaaucccgccagac

SEQ ID NO: 1827852 - RNA, 14 nt, Salmonella typhimurium LT2
ccccaaacgcucau

SEQ ID NO: 1827853 - RNA, 21 nt, Salmonella typhimurium LT2
ccccaggcgauaccgcgcugg

SEQ ID NO: 1827854 - RNA, 15 nt, Salmonella typhimurium LT2
ccccagcgccagccg

SEQ ID NO: 1827855 - RNA, 18 nt, Salmonella typhimurium LT2
ccccagcgguaccaccag

SEQ ID NO: 1827856 - RNA, 19 nt, Salmonella typhimurium LT2
ccccaguaauccggcaacu

SEQ ID NO: 1827857 - RNA, 21 nt, Salmonella typhimurium LT2
ccccauguucaguucaaccug

SEQ ID NO: 1827858 - RNA, 14 nt, Salmonella typhimurium LT2
ccccgccauccggc

SEQ ID NO: 1827859 - RNA, 18 nt, Salmonella typhimurium LT2
ccccgauaaaccaggcag

SEQ ID NO: 1827860 - RNA, 12 nt, Salmonella typhimurium LT2
ccccgcagcgaa

SEQ ID NO: 1827861 - RNA, 17 nt, Salmonella typhimurium LT2
ccaucgacagcgccaua

SEQ ID NO: 1827862 - RNA, 12 nt, Salmonella typhimurium LT2
ccauccggcauc

SEQ ID NO: 1827863 - RNA, 12 nt, Salmonella typhimurium LT2
ccauccggcauu

SEQ ID NO: 1827864 - RNA, 13 nt, Salmonella typhimurium LT2
ccauccgauugcu

SEQ ID NO: 1827865 - RNA, 15 nt, Salmonella typhimurium LT2
ccaguuguucgauaa

SEQ ID NO: 1827866 - RNA, 23 nt, Salmonella typhimurium LT2
ccauaauuuauccuccgaacagg

SEQ ID NO: 1827867 - RNA, 12 nt, Salmonella typhimurium LT2
ccauaccggacu

SEQ ID NO: 1827868 - RNA, 19 nt, Salmonella typhimurium LT2
ccauagaaaucagcagguc

SEQ ID NO: 1827869 - RNA, 20 nt, Salmonella typhimurium LT2
ccauacgcccacgcggcgua

SEQ ID NO: 1827870 - RNA, 23 nt, Salmonella typhimurium LT2
ccaucgcggcgcaaaucgccauc

SEQ ID NO: 1827871 - RNA, 22 nt, Salmonella typhimurium LT2
ccaucgcgacuucaaucgccaa

SEQ ID NO: 1827872 - RNA, 17 nt, Salmonella typhimurium LT2
ccaucgcgaucaucagc

SEQ ID NO: 1827873 - RNA, 23 nt, Salmonella typhimurium LT2
ccaucgcguugcaaucgccugaa

SEQ ID NO: 1827874 - RNA, 14 nt, Salmonella typhimurium LT2
ccaugauaaucagc

SEQ ID NO: 1827875 - RNA, 22 nt, Salmonella typhimurium LT2
ccaugagcgaaacuccagcgau

SEQ ID NO: 1827876 - RNA, 16 nt, Salmonella typhimurium LT2
ccaugaguucaauaug

SEQ ID NO: 1827877 - RNA, 17 nt, Salmonella typhimurium LT2
ccauuaucgcgccggaa

SEQ ID NO: 1827878 - RNA, 18 nt, Salmonella typhimurium LT2
ccauuaauauuuuaucac

SEQ ID NO: 1827879 - RNA, 19 nt, Salmonella typhimurium LT2
ccauguuuaccaucgcguu

SEQ ID NO: 1827880 - RNA, 15 nt, Salmonella typhimurium LT2
ccauggcccaaaagg

SEQ ID NO: 1827881 - RNA, 23 nt, Salmonella typhimurium LT2
ccagucggacagcgacacuccgc

SEQ ID NO: 1827882 - RNA, 22 nt, Salmonella typhimurium LT2
ccaguugcuucauaucgccauu

SEQ ID NO: 1827883 - RNA, 17 nt, Salmonella typhimurium LT2
ccaguuguuccagcagc

SEQ ID NO: 1827884 - RNA, 13 nt, Salmonella typhimurium LT2
ccaguucaaucag

SEQ ID NO: 1827885 - RNA, 18 nt, Salmonella typhimurium LT2
ccaguucuggcugcgcuu

SEQ ID NO: 1827886 - RNA, 16 nt, Salmonella typhimurium LT2
ccaguuauagcgcaga

SEQ ID NO: 1827887 - RNA, 12 nt, Salmonella typhimurium LT2
ccaguuaacaga

SEQ ID NO: 1827888 - RNA, 23 nt, Salmonella typhimurium LT2
ccagugguuccauuccagaacga

SEQ ID NO: 1827889 - RNA, 21 nt, Salmonella typhimurium LT2
ccaguggucguuagccagaug

SEQ ID NO: 1827890 - RNA, 14 nt, Salmonella typhimurium LT2
ccagugggcgucaa

SEQ ID NO: 1827891 - RNA, 18 nt, Salmonella typhimurium LT2
ccaguggcgucgguuaua

SEQ ID NO: 1827892 - RNA, 22 nt, Salmonella typhimurium LT2
ccaggauccguucaucggcaua

SEQ ID NO: 1827893 - RNA, 13 nt, Salmonella typhimurium LT2
ccagauucugaug

SEQ ID NO: 1827894 - RNA, 22 nt, Salmonella typhimurium LT2
ccagauuaucggccagcgccag

SEQ ID NO: 1827895 - RNA, 18 nt, Salmonella typhimurium LT2
ccagaggcuaaucaggaa

SEQ ID NO: 1827896 - RNA, 20 nt, Salmonella typhimurium LT2
ccagauuuuccaggccgcca

SEQ ID NO: 1827897 - RNA, 23 nt, Salmonella typhimurium LT2
ccagcaaaucaauuugauggcua

SEQ ID NO: 1827898 - RNA, 22 nt, Salmonella typhimurium LT2
ccagcaccaucuuuuccggcag

SEQ ID NO: 1827899 - RNA, 13 nt, Salmonella typhimurium LT2
ccagcacagcggu

SEQ ID NO: 1827900 - RNA, 18 nt, Salmonella typhimurium LT2
ccagcaaggcugccgcca

SEQ ID NO: 1827901 - RNA, 15 nt, Salmonella typhimurium LT2
ccagcaaugccgccg

SEQ ID NO: 1827902 - RNA, 22 nt, Salmonella typhimurium LT2
ccagcaucaugggcucaucaaa

SEQ ID NO: 1827903 - RNA, 12 nt, Salmonella typhimurium LT2
ccagcacgccuu

SEQ ID NO: 1827904 - RNA, 12 nt, Salmonella typhimurium LT2
ccagcacgccua

SEQ ID NO: 1827905 - RNA, 18 nt, Salmonella typhimurium LT2
ccacguaacucggcagcg

SEQ ID NO: 1827906 - RNA, 23 nt, Salmonella typhimurium LT2
ccacggguagagcuuuuuauuac

SEQ ID NO: 1827907 - RNA, 11 nt, Salmonella typhimurium LT2
ccacgguaauu

SEQ ID NO: 1827908 - RNA, 16 nt, Salmonella typhimurium LT2
ccacggccccgggcga

SEQ ID NO: 1827909 - RNA, 18 nt, Salmonella typhimurium LT2
ccacggccccgggcgacc

SEQ ID NO: 1827910 - RNA, 20 nt, Salmonella typhimurium LT2
ccacggaugauccucauaaa

SEQ ID NO: 1827911 - RNA, 18 nt, Salmonella typhimurium LT2
ccacggccaacuuauccg

SEQ ID NO: 1827912 - RNA, 17 nt, Salmonella typhimurium LT2
ccacggaauacgacgcg

SEQ ID NO: 1827913 - RNA, 15 nt, Salmonella typhimurium LT2
ccagaacaucuaccg

SEQ ID NO: 1827914 - RNA, 12 nt, Salmonella typhimurium LT2
ccagaaaggcgc

SEQ ID NO: 1827915 - RNA, 18 nt, Salmonella typhimurium LT2
ccagaaucaccgacagca

SEQ ID NO: 1827916 - RNA, 13 nt, Salmonella typhimurium LT2
ccagaaucacguc

SEQ ID NO: 1827917 - RNA, 16 nt, Salmonella typhimurium LT2
ccagaaucguggcgcc

SEQ ID NO: 1827918 - RNA, 15 nt, Salmonella typhimurium LT2
ccagacgggccaggc

SEQ ID NO: 1827919 - RNA, 14 nt, Salmonella typhimurium LT2
ccagacaagcacau

SEQ ID NO: 1827920 - RNA, 21 nt, Salmonella typhimurium LT2
ccagacaaaauucagacucaa

SEQ ID NO: 1827921 - RNA, 13 nt, Salmonella typhimurium LT2
ccagcggcgacag

SEQ ID NO: 1827922 - RNA, 19 nt, Salmonella typhimurium LT2
ccagcuauuuuucaccaua

SEQ ID NO: 1827923 - RNA, 21 nt, Salmonella typhimurium LT2
ccagcuaaaaagcugucgcca

SEQ ID NO: 1827924 - RNA, 21 nt, Salmonella typhimurium LT2
ccagcuauagcgcaaacgcgc

SEQ ID NO: 1827925 - RNA, 18 nt, Salmonella typhimurium LT2
ccagcguugaauaucgua

SEQ ID NO: 1827926 - RNA, 18 nt, Salmonella typhimurium LT2
ccagcguuggugccgcca

SEQ ID NO: 1827927 - RNA, 21 nt, Salmonella typhimurium LT2
ccagcguuggugccgccagau

SEQ ID NO: 1827928 - RNA, 16 nt, Salmonella typhimurium LT2
ccagcguuagcgcaaa

SEQ ID NO: 1827929 - RNA, 23 nt, Salmonella typhimurium LT2
ccagcucuuucaacuuccgcguu

SEQ ID NO: 1827930 - RNA, 24 nt, Salmonella typhimurium LT2
ccagcuguccggcuacaggcguca

SEQ ID NO: 1827931 - RNA, 15 nt, Salmonella typhimurium LT2
ccaggagauaucaaa

SEQ ID NO: 1827932 - RNA, 22 nt, Salmonella typhimurium LT2
ccaggacaacgccgguacgcag

SEQ ID NO: 1827933 - RNA, 23 nt, Salmonella typhimurium LT2
ccaggaacgguacggucgucaua

SEQ ID NO: 1827934 - RNA, 16 nt, Salmonella typhimurium LT2
ccagcgcaaucacguu

SEQ ID NO: 1827935 - RNA, 15 nt, Salmonella typhimurium LT2
ccagcgcccccagca

SEQ ID NO: 1827936 - RNA, 21 nt, Salmonella typhimurium LT2
ccagcggaauccccgccgcca

SEQ ID NO: 1827937 - RNA, 21 nt, Salmonella typhimurium LT2
ccagccugaggaugauacugc

SEQ ID NO: 1827938 - RNA, 16 nt, Salmonella typhimurium LT2
ccagcgaaaugcgaau

SEQ ID NO: 1827939 - RNA, 21 nt, Salmonella typhimurium LT2
ccagcgaaaugcgaauccggc

SEQ ID NO: 1827940 - RNA, 18 nt, Salmonella typhimurium LT2
ccagccuaccugccgcca

SEQ ID NO: 1827941 - RNA, 22 nt, Salmonella typhimurium LT2
ccagccgugaauggucacauuc

SEQ ID NO: 1827942 - RNA, 19 nt, Salmonella typhimurium LT2
ccagcgaugagcgccagca

SEQ ID NO: 1827943 - RNA, 18 nt, Salmonella typhimurium LT2
ccagcgaucaggcgucag

SEQ ID NO: 1827944 - RNA, 19 nt, Salmonella typhimurium LT2
ccagcgaccaccgucccag

SEQ ID NO: 1827945 - RNA, 14 nt, Salmonella typhimurium LT2
cauucagagcgucu

SEQ ID NO: 1827946 - RNA, 17 nt, Salmonella typhimurium LT2
cauucgacgcugaaccu

SEQ ID NO: 1827947 - RNA, 21 nt, Salmonella typhimurium LT2
cauucgcgagccuuuuaucaa

SEQ ID NO: 1827948 - RNA, 13 nt, Salmonella typhimurium LT2
cauuaucaccauu

SEQ ID NO: 1827949 - RNA, 14 nt, Salmonella typhimurium LT2
cauucaacgcauca

SEQ ID NO: 1827950 - RNA, 16 nt, Salmonella typhimurium LT2
cauucaacgggcgaua

SEQ ID NO: 1827951 - RNA, 16 nt, Salmonella typhimurium LT2
cauuagcggugcguca

SEQ ID NO: 1827952 - RNA, 23 nt, Salmonella typhimurium LT2
cauuaaagagcgaaugcgcgcca

SEQ ID NO: 1827953 - RNA, 17 nt, Salmonella typhimurium LT2
cauuaaccuugcccaug

SEQ ID NO: 1827954 - RNA, 14 nt, Salmonella typhimurium LT2
cauuacccaccgga

SEQ ID NO: 1827955 - RNA, 19 nt, Salmonella typhimurium LT2
cauuacgaucugacgaggc

SEQ ID NO: 1827956 - RNA, 20 nt, Salmonella typhimurium LT2
cauuaaucaguucaggaaca

SEQ ID NO: 1827957 - RNA, 15 nt, Salmonella typhimurium LT2
ccaacacggcgcuca

SEQ ID NO: 1827958 - RNA, 23 nt, Salmonella typhimurium LT2
ccaacacggcgcucaggaucgcc

SEQ ID NO: 1827959 - RNA, 13 nt, Salmonella typhimurium LT2
ccaacaaucgccc

SEQ ID NO: 1827960 - RNA, 17 nt, Salmonella typhimurium LT2
ccaaaauagauaaucgc

SEQ ID NO: 1827961 - RNA, 18 nt, Salmonella typhimurium LT2
ccaaaacccagaaucagc

SEQ ID NO: 1827962 - RNA, 17 nt, Salmonella typhimurium LT2
cauuucugccugauggc

SEQ ID NO: 1827963 - RNA, 23 nt, Salmonella typhimurium LT2
cauuucccuuccccuuucaccag

SEQ ID NO: 1827964 - RNA, 21 nt, Salmonella typhimurium LT2
cauuucagcgaguuccaccau

SEQ ID NO: 1827965 - RNA, 16 nt, Salmonella typhimurium LT2
cauugauaaagcgcuc

SEQ ID NO: 1827966 - RNA, 22 nt, Salmonella typhimurium LT2
cauugauauagaguccagccau

SEQ ID NO: 1827967 - RNA, 16 nt, Salmonella typhimurium LT2
cauucgguacggcgcu

SEQ ID NO: 1827968 - RNA, 19 nt, Salmonella typhimurium LT2
caugcucgcuuuccauuac

SEQ ID NO: 1827969 - RNA, 18 nt, Salmonella typhimurium LT2
caugggcgggauccugca

SEQ ID NO: 1827970 - RNA, 21 nt, Salmonella typhimurium LT2
caugggacgggucuccaucag

SEQ ID NO: 1827971 - RNA, 19 nt, Salmonella typhimurium LT2
cauguucccaugucagcgc

SEQ ID NO: 1827972 - RNA, 17 nt, Salmonella typhimurium LT2
cauguuaaauacgccgc

SEQ ID NO: 1827973 - RNA, 12 nt, Salmonella typhimurium LT2
caugcaccagcc

SEQ ID NO: 1827974 - RNA, 13 nt, Salmonella typhimurium LT2
caugcccaccgga

SEQ ID NO: 1827975 - RNA, 20 nt, Salmonella typhimurium LT2
caugcccacaggcagggcga

SEQ ID NO: 1827976 - RNA, 22 nt, Salmonella typhimurium LT2
caugaugggcgcacagcgccau

SEQ ID NO: 1827977 - RNA, 20 nt, Salmonella typhimurium LT2
caugaugggcgcacagcgcc

SEQ ID NO: 1827978 - RNA, 19 nt, Salmonella typhimurium LT2
caugccggcuuuccgcacc

SEQ ID NO: 1827979 - RNA, 21 nt, Salmonella typhimurium LT2
ccaacauacaugccugcgcca

SEQ ID NO: 1827980 - RNA, 21 nt, Salmonella typhimurium LT2
ccaacaucaguucagaaacgg

SEQ ID NO: 1827981 - RNA, 18 nt, Salmonella typhimurium LT2
ccaaccacuacugcguca

SEQ ID NO: 1827982 - RNA, 22 nt, Salmonella typhimurium LT2
ccaauauuaaagaugccugaaa

SEQ ID NO: 1827983 - RNA, 17 nt, Salmonella typhimurium LT2
ccaaucaacgccgccag

SEQ ID NO: 1827984 - RNA, 17 nt, Salmonella typhimurium LT2
ccaaucacuaacgguac

SEQ ID NO: 1827985 - RNA, 14 nt, Salmonella typhimurium LT2
ccacaacggagaua

SEQ ID NO: 1827986 - RNA, 22 nt, Salmonella typhimurium LT2
ccacaacgugauaaccaacagg

SEQ ID NO: 1827987 - RNA, 21 nt, Salmonella typhimurium LT2
ccacaaagagugccagaaaca

SEQ ID NO: 1827988 - RNA, 15 nt, Salmonella typhimurium LT2
ccacaaacgccggau

SEQ ID NO: 1827989 - RNA, 15 nt, Salmonella typhimurium LT2
ccacaaacgccguca

SEQ ID NO: 1827990 - RNA, 19 nt, Salmonella typhimurium LT2
ccacaaacgccgucacaaa

SEQ ID NO: 1827991 - RNA, 18 nt, Salmonella typhimurium LT2
ccaaucgcggcgacaucg

SEQ ID NO: 1827992 - RNA, 12 nt, Salmonella typhimurium LT2
ccaaugcggaaa

SEQ ID NO: 1827993 - RNA, 20 nt, Salmonella typhimurium LT2
ccaaugccgccuuuaucgac

SEQ ID NO: 1827994 - RNA, 22 nt, Salmonella typhimurium LT2
ccaauguuaauaagcagaacgu

SEQ ID NO: 1827995 - RNA, 21 nt, Salmonella typhimurium LT2
ccacagguaaaauugccgcca

SEQ ID NO: 1827996 - RNA, 12 nt, Salmonella typhimurium LT2
ccacaggcgucg

SEQ ID NO: 1827997 - RNA, 17 nt, Salmonella typhimurium LT2
ccacaggcagggcgaug

SEQ ID NO: 1827998 - RNA, 11 nt, Salmonella typhimurium LT2
ccacagcgcca

SEQ ID NO: 1827999 - RNA, 16 nt, Salmonella typhimurium LT2
ccacagauuaugcagc

SEQ ID NO: 1828000 - RNA, 22 nt, Salmonella typhimurium LT2
ccaccaggauaaaggccgggaa

SEQ ID NO: 1828001 - RNA, 15 nt, Salmonella typhimurium LT2
ccaccagcggacggc

SEQ ID NO: 1828002 - RNA, 12 nt, Salmonella typhimurium LT2
ccaccgccagaa

SEQ ID NO: 1828003 - RNA, 16 nt, Salmonella typhimurium LT2
caggcgaauagcgcgc

SEQ ID NO: 1828004 - RNA, 17 nt, Salmonella typhimurium LT2
caggcgaauagcgcgcu

SEQ ID NO: 1828005 - RNA, 19 nt, Salmonella typhimurium LT2
caggcgccgccauccggca

SEQ ID NO: 1828006 - RNA, 20 nt, Salmonella typhimurium LT2
caggcgccgccauccggcac

SEQ ID NO: 1828007 - RNA, 18 nt, Salmonella typhimurium LT2
caggccggacaggcgacg

SEQ ID NO: 1828008 - RNA, 13 nt, Salmonella typhimurium LT2
caggcccgccaga

SEQ ID NO: 1828009 - RNA, 16 nt, Salmonella typhimurium LT2
caggcacgccggcaau

SEQ ID NO: 1828010 - RNA, 22 nt, Salmonella typhimurium LT2
caggcuucgcgcagccagcgcc

SEQ ID NO: 1828011 - RNA, 22 nt, Salmonella typhimurium LT2
caggcuuaaucccgacgcgcga

SEQ ID NO: 1828012 - RNA, 17 nt, Salmonella typhimurium LT2
caggcuuuaguuuccgg

SEQ ID NO: 1828013 - RNA, 18 nt, Salmonella typhimurium LT2
cagggaaagaucaaacag

SEQ ID NO: 1828014 - RNA, 19 nt, Salmonella typhimurium LT2
cagggaauaagcacccaug

SEQ ID NO: 1828015 - RNA, 18 nt, Salmonella typhimurium LT2
cagggcguuuuccagcgc

SEQ ID NO: 1828016 - RNA, 20 nt, Salmonella typhimurium LT2
caggcguagcgccaucaggc

SEQ ID NO: 1828017 - RNA, 22 nt, Salmonella typhimurium LT2
caggcggguauggcgccaauau

SEQ ID NO: 1828018 - RNA, 15 nt, Salmonella typhimurium LT2
caggcuaaggcgucg

SEQ ID NO: 1828019 - RNA, 19 nt, Salmonella typhimurium LT2
caggcguugagauaauagc

SEQ ID NO: 1828020 - RNA, 17 nt, Salmonella typhimurium LT2
caggcgugauugagcag

SEQ ID NO: 1828021 - RNA, 14 nt, Salmonella typhimurium LT2
caggcucagcgcca

SEQ ID NO: 1828022 - RNA, 23 nt, Salmonella typhimurium LT2
caggcuauaacgcaccaccugca

SEQ ID NO: 1828023 - RNA, 21 nt, Salmonella typhimurium LT2
cagcugcugcgcuuuccaggc

SEQ ID NO: 1828024 - RNA, 21 nt, Salmonella typhimurium LT2
cagcugccacaccacaugcga

SEQ ID NO: 1828025 - RNA, 16 nt, Salmonella typhimurium LT2
cagcuugaucaucagg

SEQ ID NO: 1828026 - RNA, 17 nt, Salmonella typhimurium LT2
cagcucgucggccagcg

SEQ ID NO: 1828027 - RNA, 18 nt, Salmonella typhimurium LT2
cagcucgucggccagcgc

SEQ ID NO: 1828028 - RNA, 19 nt, Salmonella typhimurium LT2
caggauauacuucaucagg

SEQ ID NO: 1828029 - RNA, 12 nt, Salmonella typhimurium LT2
caggauaucgcc

SEQ ID NO: 1828030 - RNA, 12 nt, Salmonella typhimurium LT2
caggauaaagac

SEQ ID NO: 1828031 - RNA, 16 nt, Salmonella typhimurium LT2
caggauguaagacagc

SEQ ID NO: 1828032 - RNA, 18 nt, Salmonella typhimurium LT2
caggaguaugcgacggua

SEQ ID NO: 1828033 - RNA, 15 nt, Salmonella typhimurium LT2
caggcaauuuaucgu

SEQ ID NO: 1828034 - RNA, 20 nt, Salmonella typhimurium LT2
caggcaauaaacaucagcca

SEQ ID NO: 1828035 - RNA, 16 nt, Salmonella typhimurium LT2
caggcaaagcucaacg

SEQ ID NO: 1828036 - RNA, 21 nt, Salmonella typhimurium LT2
caggcaaaggaaugcuuuaca

SEQ ID NO: 1828037 - RNA, 19 nt, Salmonella typhimurium LT2
caggcaaaaaaaaccggca

SEQ ID NO: 1828038 - RNA, 23 nt, Salmonella typhimurium LT2
caggaugugaggcagauacgcgg

SEQ ID NO: 1828039 - RNA, 15 nt, Salmonella typhimurium LT2
caggaauaaagguca

SEQ ID NO: 1828040 - RNA, 17 nt, Salmonella typhimurium LT2
cagcguaauacaggcga

SEQ ID NO: 1828041 - RNA, 15 nt, Salmonella typhimurium LT2
cagcguaccagcggu

SEQ ID NO: 1828042 - RNA, 22 nt, Salmonella typhimurium LT2
cagcguaagaauucguccagau

SEQ ID NO: 1828043 - RNA, 20 nt, Salmonella typhimurium LT2
cagcguaggccaggcauccg

SEQ ID NO: 1828044 - RNA, 16 nt, Salmonella typhimurium LT2
cagcguauacgccgga

SEQ ID NO: 1828045 - RNA, 19 nt, Salmonella typhimurium LT2
cagcgcgccagcgccaaua

SEQ ID NO: 1828046 - RNA, 17 nt, Salmonella typhimurium LT2
cagcgggcuggcauuca

SEQ ID NO: 1828047 - RNA, 16 nt, Salmonella typhimurium LT2
cagcgguagccagcgc

SEQ ID NO: 1828048 - RNA, 15 nt, Salmonella typhimurium LT2
cagcgugccgguaaa

SEQ ID NO: 1828049 - RNA, 18 nt, Salmonella typhimurium LT2
cagcuccauccaccagcc

SEQ ID NO: 1828050 - RNA, 16 nt, Salmonella typhimurium LT2
cagcuccauagaaauc

SEQ ID NO: 1828051 - RNA, 19 nt, Salmonella typhimurium LT2
cagcuaaaaacagcgcaau

SEQ ID NO: 1828052 - RNA, 21 nt, Salmonella typhimurium LT2
cagcguuuucauaucugcgcc

SEQ ID NO: 1828053 - RNA, 14 nt, Salmonella typhimurium LT2
cagcucgacgacgu

SEQ ID NO: 1828054 - RNA, 19 nt, Salmonella typhimurium LT2
caguucgccacggucggca

SEQ ID NO: 1828055 - RNA, 22 nt, Salmonella typhimurium LT2
caguuaauucguccccagcgau

SEQ ID NO: 1828056 - RNA, 19 nt, Salmonella typhimurium LT2
caguuagcuucagcaaacg

SEQ ID NO: 1828057 - RNA, 18 nt, Salmonella typhimurium LT2
caguguuuauuaaaacuc

SEQ ID NO: 1828058 - RNA, 20 nt, Salmonella typhimurium LT2
cagugauuacaaaaugugca

SEQ ID NO: 1828059 - RNA, 13 nt, Salmonella typhimurium LT2
cagugcaaaggcc

SEQ ID NO: 1828060 - RNA, 20 nt, Salmonella typhimurium LT2
cagugcggcaaccaccagca

SEQ ID NO: 1828061 - RNA, 19 nt, Salmonella typhimurium LT2
cauaaugacguccaggccg

SEQ ID NO: 1828062 - RNA, 22 nt, Salmonella typhimurium LT2
cauaaugcugccagcaugauaa

SEQ ID NO: 1828063 - RNA, 22 nt, Salmonella typhimurium LT2
cauaaugugaugcagacgggcg

SEQ ID NO: 1828064 - RNA, 14 nt, Salmonella typhimurium LT2
cauaauuuuccugu

SEQ ID NO: 1828065 - RNA, 14 nt, Salmonella typhimurium LT2
cauaccggugcgcc

SEQ ID NO: 1828066 - RNA, 15 nt, Salmonella typhimurium LT2
cauaccggugcgccc

SEQ ID NO: 1828067 - RNA, 16 nt, Salmonella typhimurium LT2
cauacgcccacgcggc

SEQ ID NO: 1828068 - RNA, 21 nt, Salmonella typhimurium LT2
cauacgcccacgcggcguacg

SEQ ID NO: 1828069 - RNA, 22 nt, Salmonella typhimurium LT2
caguuuuggcaaucacaagcug

SEQ ID NO: 1828070 - RNA, 14 nt, Salmonella typhimurium LT2
cauaaacgcggcca

SEQ ID NO: 1828071 - RNA, 19 nt, Salmonella typhimurium LT2
cauaaagaagcgugcgccg

SEQ ID NO: 1828072 - RNA, 20 nt, Salmonella typhimurium LT2
cauaagccgcguucugucga

SEQ ID NO: 1828073 - RNA, 14 nt, Salmonella typhimurium LT2
caguugauacauuu

SEQ ID NO: 1828074 - RNA, 19 nt, Salmonella typhimurium LT2
caguucuucccugcaauau

SEQ ID NO: 1828075 - RNA, 16 nt, Salmonella typhimurium LT2
caguuuuuuccagcgc

SEQ ID NO: 1828076 - RNA, 14 nt, Salmonella typhimurium LT2
caguuuuugcgcca

SEQ ID NO: 1828077 - RNA, 22 nt, Salmonella typhimurium LT2
cagugaacguucacuaacccgc

SEQ ID NO: 1828078 - RNA, 23 nt, Salmonella typhimurium LT2
cagugacauuuaucuuccggcau

SEQ ID NO: 1828079 - RNA, 21 nt, Salmonella typhimurium LT2
cagucucaaacgccugcauca

SEQ ID NO: 1828080 - RNA, 22 nt, Salmonella typhimurium LT2
cagucguaguggaucagcagau

SEQ ID NO: 1828081 - RNA, 21 nt, Salmonella typhimurium LT2
caguccgguggcgaaaacgcu

SEQ ID NO: 1828082 - RNA, 15 nt, Salmonella typhimurium LT2
caguaugagcgaacg

SEQ ID NO: 1828083 - RNA, 20 nt, Salmonella typhimurium LT2
caguaaucccggucgcgcca

SEQ ID NO: 1828084 - RNA, 21 nt, Salmonella typhimurium LT2
caggugcggauaguccugcgc

SEQ ID NO: 1828085 - RNA, 18 nt, Salmonella typhimurium LT2
caggugauagugcguucg

SEQ ID NO: 1828086 - RNA, 15 nt, Salmonella typhimurium LT2
cagguuagcagccac

SEQ ID NO: 1828087 - RNA, 22 nt, Salmonella typhimurium LT2
cagguuauuguugcuacgcgcc

SEQ ID NO: 1828088 - RNA, 16 nt, Salmonella typhimurium LT2
cagguuagugauguuc

SEQ ID NO: 1828089 - RNA, 16 nt, Salmonella typhimurium LT2
cagguuaucgguaauu

SEQ ID NO: 1828090 - RNA, 22 nt, Salmonella typhimurium LT2
cauccggccuggcgcaacguuu

SEQ ID NO: 1828091 - RNA, 18 nt, Salmonella typhimurium LT2
cauccggcauuuaugcug

SEQ ID NO: 1828092 - RNA, 23 nt, Salmonella typhimurium LT2
cauccggcauuuuuuaugcccgc

SEQ ID NO: 1828093 - RNA, 20 nt, Salmonella typhimurium LT2
cauccggcaauuuauaccgc

SEQ ID NO: 1828094 - RNA, 23 nt, Salmonella typhimurium LT2
cauccggcacggucaaucaucag

SEQ ID NO: 1828095 - RNA, 16 nt, Salmonella typhimurium LT2
cauccggcgcugauga

SEQ ID NO: 1828096 - RNA, 19 nt, Salmonella typhimurium LT2
cauccuguuuuuucagcgc

SEQ ID NO: 1828097 - RNA, 23 nt, Salmonella typhimurium LT2
caucaggcaugaccugccggaug

SEQ ID NO: 1828098 - RNA, 13 nt, Salmonella typhimurium LT2
caucaggcaaccc

SEQ ID NO: 1828099 - RNA, 22 nt, Salmonella typhimurium LT2
cauccccacaggaucaccgcca

SEQ ID NO: 1828100 - RNA, 23 nt, Salmonella typhimurium LT2
cauccaugccaagcggcaucucg

SEQ ID NO: 1828101 - RNA, 15 nt, Salmonella typhimurium LT2
cauccaugcggcaga

SEQ ID NO: 1828102 - RNA, 14 nt, Salmonella typhimurium LT2
cauccaucagcgcg

SEQ ID NO: 1828103 - RNA, 14 nt, Salmonella typhimurium LT2
caucagcacaaaau

SEQ ID NO: 1828104 - RNA, 23 nt, Salmonella typhimurium LT2
caucagcccuaucgcugcgcugc

SEQ ID NO: 1828105 - RNA, 15 nt, Salmonella typhimurium LT2
caucagccugaaaga

SEQ ID NO: 1828106 - RNA, 10 nt, Salmonella typhimurium LT2
caucagcgcu

SEQ ID NO: 1828107 - RNA, 19 nt, Salmonella typhimurium LT2
caucaauauuggugucgua

SEQ ID NO: 1828108 - RNA, 17 nt, Salmonella typhimurium LT2
caucaauaauccggcaa

SEQ ID NO: 1828109 - RNA, 18 nt, Salmonella typhimurium LT2
caucaauaauccggcaau

SEQ ID NO: 1828110 - RNA, 17 nt, Salmonella typhimurium LT2
caucaauaaaaucaccg

SEQ ID NO: 1828111 - RNA, 14 nt, Salmonella typhimurium LT2
cauagcaucguuac

SEQ ID NO: 1828112 - RNA, 22 nt, Salmonella typhimurium LT2
cauagccaguggaacaaacgca

SEQ ID NO: 1828113 - RNA, 12 nt, Salmonella typhimurium LT2
cauagcaucacc

SEQ ID NO: 1828114 - RNA, 15 nt, Salmonella typhimurium LT2
cauagcgccccagua

SEQ ID NO: 1828115 - RNA, 23 nt, Salmonella typhimurium LT2
cauagagcgggucaacgccaagc

SEQ ID NO: 1828116 - RNA, 17 nt, Salmonella typhimurium LT2
caucggcccacgcgcag

SEQ ID NO: 1828117 - RNA, 18 nt, Salmonella typhimurium LT2
caucggccgcuaucugcu

SEQ ID NO: 1828118 - RNA, 16 nt, Salmonella typhimurium LT2
caucggcauaacccgc

SEQ ID NO: 1828119 - RNA, 18 nt, Salmonella typhimurium LT2
caucgcguugcaaucgcc

SEQ ID NO: 1828120 - RNA, 15 nt, Salmonella typhimurium LT2
caucgcuaaccggcg

SEQ ID NO: 1828121 - RNA, 17 nt, Salmonella typhimurium LT2
caucgcuuuuugcagau

SEQ ID NO: 1828122 - RNA, 14 nt, Salmonella typhimurium LT2
caucggcaaacgcc

SEQ ID NO: 1828123 - RNA, 21 nt, Salmonella typhimurium LT2
caucgcgaucaucagcacgcc

SEQ ID NO: 1828124 - RNA, 16 nt, Salmonella typhimurium LT2
caucgcgccaucggcu

SEQ ID NO: 1828125 - RNA, 22 nt, Salmonella typhimurium LT2
caucgcgccaaacgggcaagcc

SEQ ID NO: 1828126 - RNA, 14 nt, Salmonella typhimurium LT2
caucgcggucagcg

SEQ ID NO: 1828127 - RNA, 14 nt, Salmonella typhimurium LT2
caucgccgcuaugc

SEQ ID NO: 1828128 - RNA, 19 nt, Salmonella typhimurium LT2
caucgccacuaccagcgua

SEQ ID NO: 1828129 - RNA, 21 nt, Salmonella typhimurium LT2
caucgccacuaccagcguacc

SEQ ID NO: 1828130 - RNA, 18 nt, Salmonella typhimurium LT2
caucgcaaauucaucgcc

SEQ ID NO: 1828131 - RNA, 19 nt, Salmonella typhimurium LT2
caucgauuuugaccugaau

SEQ ID NO: 1828132 - RNA, 16 nt, Salmonella typhimurium LT2
caucgauauaagcgcc

SEQ ID NO: 1828133 - RNA, 13 nt, Salmonella typhimurium LT2
cagcaauacgccc

SEQ ID NO: 1828134 - RNA, 16 nt, Salmonella typhimurium LT2
cagcaagacucgcgcc

SEQ ID NO: 1828135 - RNA, 18 nt, Salmonella typhimurium LT2
cagcagccaugccagcgc

SEQ ID NO: 1828136 - RNA, 20 nt, Salmonella typhimurium LT2
cagcagccgggccagacgcu

SEQ ID NO: 1828137 - RNA, 20 nt, Salmonella typhimurium LT2
cagcagccgguauccagcgc

SEQ ID NO: 1828138 - RNA, 12 nt, Salmonella typhimurium LT2
cagcagcgcgau

SEQ ID NO: 1828139 - RNA, 16 nt, Salmonella typhimurium LT2
cagcccgauacccgcc

SEQ ID NO: 1828140 - RNA, 23 nt, Salmonella typhimurium LT2
cagccgacgcucuuccucaauau

SEQ ID NO: 1828141 - RNA, 13 nt, Salmonella typhimurium LT2
cagccccaggcca

SEQ ID NO: 1828142 - RNA, 22 nt, Salmonella typhimurium LT2
cagccauaaucaguacugcgcc

SEQ ID NO: 1828143 - RNA, 21 nt, Salmonella typhimurium LT2
cagccacgguguggcccagcg

SEQ ID NO: 1828144 - RNA, 22 nt, Salmonella typhimurium LT2
cagccacaauuugcugcuguua

SEQ ID NO: 1828145 - RNA, 23 nt, Salmonella typhimurium LT2
cagcauguuucuccugccagcga

SEQ ID NO: 1828146 - RNA, 22 nt, Salmonella typhimurium LT2
cagcauguuucuccugccagcg

SEQ ID NO: 1828147 - RNA, 19 nt, Salmonella typhimurium LT2
cagcaugguguguucccgc

SEQ ID NO: 1828148 - RNA, 16 nt, Salmonella typhimurium LT2
cagcaguuugguaaua

SEQ ID NO: 1828149 - RNA, 22 nt, Salmonella typhimurium LT2
cagcauaauaaagcagcggcgg

SEQ ID NO: 1828150 - RNA, 15 nt, Salmonella typhimurium LT2
cagcauccugcguuc

SEQ ID NO: 1828151 - RNA, 13 nt, Salmonella typhimurium LT2
cagcgauugacgg

SEQ ID NO: 1828152 - RNA, 12 nt, Salmonella typhimurium LT2
cagcgcaacgcc

SEQ ID NO: 1828153 - RNA, 22 nt, Salmonella typhimurium LT2
cagcgcaacgccuucguccggg

SEQ ID NO: 1828154 - RNA, 14 nt, Salmonella typhimurium LT2
cagcgcaaucugcu

SEQ ID NO: 1828155 - RNA, 21 nt, Salmonella typhimurium LT2
cagcgauccagaccggcauga

SEQ ID NO: 1828156 - RNA, 18 nt, Salmonella typhimurium LT2
cagcgauaguuguuacgg

SEQ ID NO: 1828157 - RNA, 16 nt, Salmonella typhimurium LT2
cagcgagcgcauacgc

SEQ ID NO: 1828158 - RNA, 19 nt, Salmonella typhimurium LT2
cagcgagcgcauacgcugu

SEQ ID NO: 1828159 - RNA, 16 nt, Salmonella typhimurium LT2
cagcgaccacgccacc

SEQ ID NO: 1828160 - RNA, 19 nt, Salmonella typhimurium LT2
cagcgaccacgacgccgga

SEQ ID NO: 1828161 - RNA, 22 nt, Salmonella typhimurium LT2
cagccgauaacucuucaucgcg

SEQ ID NO: 1828162 - RNA, 14 nt, Salmonella typhimurium LT2
cagccgaucaucgu

SEQ ID NO: 1828163 - RNA, 18 nt, Salmonella typhimurium LT2
cagccgggcauaugauua

SEQ ID NO: 1828164 - RNA, 14 nt, Salmonella typhimurium LT2
cagccuaucgccau

SEQ ID NO: 1828165 - RNA, 18 nt, Salmonella typhimurium LT2
cagcgccgcgcaggcgau

SEQ ID NO: 1828166 - RNA, 20 nt, Salmonella typhimurium LT2
cagcgccggaaaaccgguca

SEQ ID NO: 1828167 - RNA, 12 nt, Salmonella typhimurium LT2
cagcgccggaau

SEQ ID NO: 1828168 - RNA, 11 nt, Salmonella typhimurium LT2
cagcgccggac

SEQ ID NO: 1828169 - RNA, 19 nt, Salmonella typhimurium LT2
cagcgccugcugcaacguc

SEQ ID NO: 1828170 - RNA, 15 nt, Salmonella typhimurium LT2
cagcgccagcgcuga

SEQ ID NO: 1828171 - RNA, 18 nt, Salmonella typhimurium LT2
cagcgcccgagcgacgcc

SEQ ID NO: 1828172 - RNA, 23 nt, Salmonella typhimurium LT2
cagcgcaucgauauaagcgccgu

SEQ ID NO: 1828173 - RNA, 12 nt, Salmonella typhimurium LT2
cagcgccaauac

SEQ ID NO: 1828174 - RNA, 12 nt, Salmonella typhimurium LT2
cagcgccagcgc

SEQ ID NO: 1828175 - RNA, 16 nt, Salmonella typhimurium LT2
cagcgccagaaacugu

SEQ ID NO: 1828176 - RNA, 20 nt, Salmonella typhimurium LT2
cacgcccauacacaccagca

SEQ ID NO: 1828177 - RNA, 13 nt, Salmonella typhimurium LT2
cacgccaucgcgg

SEQ ID NO: 1828178 - RNA, 15 nt, Salmonella typhimurium LT2
cacgccauugcuguc

SEQ ID NO: 1828179 - RNA, 21 nt, Salmonella typhimurium LT2
cacgcgggcgguauuauccgc

SEQ ID NO: 1828180 - RNA, 15 nt, Salmonella typhimurium LT2
cacgccguccagcac

SEQ ID NO: 1828181 - RNA, 21 nt, Salmonella typhimurium LT2
cacgccgucgaugauggcggc

SEQ ID NO: 1828182 - RNA, 17 nt, Salmonella typhimurium LT2
cacgccuaaugaagcgc

SEQ ID NO: 1828183 - RNA, 21 nt, Salmonella typhimurium LT2
cacgcugggcgaauacccagc

SEQ ID NO: 1828184 - RNA, 22 nt, Salmonella typhimurium LT2
cacggaacaacggcacacaggc

SEQ ID NO: 1828185 - RNA, 15 nt, Salmonella typhimurium LT2
cacggaauacgacgc

SEQ ID NO: 1828186 - RNA, 15 nt, Salmonella typhimurium LT2
cacgcuucccagcgu

SEQ ID NO: 1828187 - RNA, 17 nt, Salmonella typhimurium LT2
cacgcuuauccagccac

SEQ ID NO: 1828188 - RNA, 18 nt, Salmonella typhimurium LT2
cacggccaacuuauccga

SEQ ID NO: 1828189 - RNA, 13 nt, Salmonella typhimurium LT2
cacgcucccggaa

SEQ ID NO: 1828190 - RNA, 22 nt, Salmonella typhimurium LT2
cacgcuccuucuucgccgucau

SEQ ID NO: 1828191 - RNA, 13 nt, Salmonella typhimurium LT2
cacgcuccagcgg

SEQ ID NO: 1828192 - RNA, 19 nt, Salmonella typhimurium LT2
cacgcucaauggcgcgcca

SEQ ID NO: 1828193 - RNA, 19 nt, Salmonella typhimurium LT2
cacgcugccacccggcaac

SEQ ID NO: 1828194 - RNA, 19 nt, Salmonella typhimurium LT2
cacuacgcagcuccagcuc

SEQ ID NO: 1828195 - RNA, 16 nt, Salmonella typhimurium LT2
cacuacgcagcuccag

SEQ ID NO: 1828196 - RNA, 22 nt, Salmonella typhimurium LT2
cacuaugcuccgggccgugauc

SEQ ID NO: 1828197 - RNA, 15 nt, Salmonella typhimurium LT2
cacuaccagacacag

SEQ ID NO: 1828198 - RNA, 17 nt, Salmonella typhimurium LT2
cacguugucccaggcca

SEQ ID NO: 1828199 - RNA, 14 nt, Salmonella typhimurium LT2
cacgugcauaaagc

SEQ ID NO: 1828200 - RNA, 17 nt, Salmonella typhimurium LT2
cacggucaaucaucaga

SEQ ID NO: 1828201 - RNA, 17 nt, Salmonella typhimurium LT2
cacgucauuaaagcgcu

SEQ ID NO: 1828202 - RNA, 16 nt, Salmonella typhimurium LT2
cacgguuuauccccgc

SEQ ID NO: 1828203 - RNA, 14 nt, Salmonella typhimurium LT2
cacguacaaacgcu

SEQ ID NO: 1828204 - RNA, 19 nt, Salmonella typhimurium LT2
cacguacccaaauaucaaa

SEQ ID NO: 1828205 - RNA, 15 nt, Salmonella typhimurium LT2
cagacgcgcagcacc

SEQ ID NO: 1828206 - RNA, 18 nt, Salmonella typhimurium LT2
cagacggcaaacaaccgu

SEQ ID NO: 1828207 - RNA, 17 nt, Salmonella typhimurium LT2
cagacggcugggcugaa

SEQ ID NO: 1828208 - RNA, 22 nt, Salmonella typhimurium LT2
cagacgguuggcuauacgcggc

SEQ ID NO: 1828209 - RNA, 19 nt, Salmonella typhimurium LT2
cagacugggauagccaauc

SEQ ID NO: 1828210 - RNA, 15 nt, Salmonella typhimurium LT2
cagacuuagggcgga

SEQ ID NO: 1828211 - RNA, 16 nt, Salmonella typhimurium LT2
cagacuuagggcggaa

SEQ ID NO: 1828212 - RNA, 20 nt, Salmonella typhimurium LT2
cagacguuacaucuccuggu

SEQ ID NO: 1828213 - RNA, 18 nt, Salmonella typhimurium LT2
cagacuaaaaagcgcguc

SEQ ID NO: 1828214 - RNA, 17 nt, Salmonella typhimurium LT2
cagacuaaaaagcgcgu

SEQ ID NO: 1828215 - RNA, 16 nt, Salmonella typhimurium LT2
cagacuuuuuugccga

SEQ ID NO: 1828216 - RNA, 14 nt, Salmonella typhimurium LT2
cagaguacgucgcc

SEQ ID NO: 1828217 - RNA, 20 nt, Salmonella typhimurium LT2
cagaguaaaaaaaccggcga

SEQ ID NO: 1828218 - RNA, 13 nt, Salmonella typhimurium LT2
cagaguccagcgg

SEQ ID NO: 1828219 - RNA, 13 nt, Salmonella typhimurium LT2
cagcaaacggcau

SEQ ID NO: 1828220 - RNA, 23 nt, Salmonella typhimurium LT2
cagcaaaccaucggaguccagca

SEQ ID NO: 1828221 - RNA, 23 nt, Salmonella typhimurium LT2
cagcaaaauuuugcgcagaccgc

SEQ ID NO: 1828222 - RNA, 24 nt, Salmonella typhimurium LT2
cagcaaaaagaaucgccaggcgca

SEQ ID NO: 1828223 - RNA, 20 nt, Salmonella typhimurium LT2
cagcaaaaaaugcggcgcau

SEQ ID NO: 1828224 - RNA, 22 nt, Salmonella typhimurium LT2
cagauugauacggguaaucaga

SEQ ID NO: 1828225 - RNA, 24 nt, Salmonella typhimurium LT2
cagaugcccgcagaucugucgcca

SEQ ID NO: 1828226 - RNA, 17 nt, Salmonella typhimurium LT2
cagauugccacaggacc

SEQ ID NO: 1828227 - RNA, 15 nt, Salmonella typhimurium LT2
cagaucguaugcgcc

SEQ ID NO: 1828228 - RNA, 18 nt, Salmonella typhimurium LT2
cagauaaaucagcccgau

SEQ ID NO: 1828229 - RNA, 17 nt, Salmonella typhimurium LT2
cagauaaagcagcgaca

SEQ ID NO: 1828230 - RNA, 22 nt, Salmonella typhimurium LT2
cagaucaugguauucggcgacc

SEQ ID NO: 1828231 - RNA, 12 nt, Salmonella typhimurium LT2
cagauccagcgc

SEQ ID NO: 1828232 - RNA, 14 nt, Salmonella typhimurium LT2
cagauccagcgccg

SEQ ID NO: 1828233 - RNA, 15 nt, Salmonella typhimurium LT2
cagauccagcgccgu

SEQ ID NO: 1828234 - RNA, 17 nt, Salmonella typhimurium LT2
cagaccgucaugacguc

SEQ ID NO: 1828235 - RNA, 19 nt, Salmonella typhimurium LT2
cagaccuuaucgcagucag

SEQ ID NO: 1828236 - RNA, 12 nt, Salmonella typhimurium LT2
cagaccuuaucg

SEQ ID NO: 1828237 - RNA, 19 nt, Salmonella typhimurium LT2
cagaccguagauaagcgcc

SEQ ID NO: 1828238 - RNA, 16 nt, Salmonella typhimurium LT2
cagacgaucggcguga

SEQ ID NO: 1828239 - RNA, 23 nt, Salmonella typhimurium LT2
cagacgauauucaagcuguugga

SEQ ID NO: 1828240 - RNA, 23 nt, Salmonella typhimurium LT2
cagacgaugauaauacauugccg

SEQ ID NO: 1828241 - RNA, 20 nt, Salmonella typhimurium LT2
cagacauauuuucaacggca

SEQ ID NO: 1828242 - RNA, 13 nt, Salmonella typhimurium LT2
cagacacugccac

SEQ ID NO: 1828243 - RNA, 18 nt, Salmonella typhimurium LT2
cagacacugccaccgcuc

SEQ ID NO: 1828244 - RNA, 12 nt, Salmonella typhimurium LT2
cagacagcagau

SEQ ID NO: 1828245 - RNA, 19 nt, Salmonella typhimurium LT2
cagacagauaacaccagcg

SEQ ID NO: 1828246 - RNA, 22 nt, Salmonella typhimurium LT2
cagaccccaguaauccggcaac

SEQ ID NO: 1828247 - RNA, 16 nt, Salmonella typhimurium LT2
cagaccccgcaucgcc

SEQ ID NO: 1828248 - RNA, 18 nt, Salmonella typhimurium LT2
cagaccauucaaccagcc

SEQ ID NO: 1828249 - RNA, 21 nt, Salmonella typhimurium LT2
cagaccccaguaauccggcaa

SEQ ID NO: 1828250 - RNA, 15 nt, Salmonella typhimurium LT2
cacuucuuccagcgu

SEQ ID NO: 1828251 - RNA, 21 nt, Salmonella typhimurium LT2
cacuucuucauaaaacccgcu

SEQ ID NO: 1828252 - RNA, 14 nt, Salmonella typhimurium LT2
cacuucuuugacca

SEQ ID NO: 1828253 - RNA, 18 nt, Salmonella typhimurium LT2
cagacaauaccagggcga

SEQ ID NO: 1828254 - RNA, 16 nt, Salmonella typhimurium LT2
cagacaacgccgccug

SEQ ID NO: 1828255 - RNA, 17 nt, Salmonella typhimurium LT2
cagacaaccgggcauca

SEQ ID NO: 1828256 - RNA, 13 nt, Salmonella typhimurium LT2
cagacaacgccgc

SEQ ID NO: 1828257 - RNA, 18 nt, Salmonella typhimurium LT2
cagaauuuuuaaccguca

SEQ ID NO: 1828258 - RNA, 19 nt, Salmonella typhimurium LT2
cagaacuuccagaaggcga

SEQ ID NO: 1828259 - RNA, 22 nt, Salmonella typhimurium LT2
cagaaaucauauaaaacagccu

SEQ ID NO: 1828260 - RNA, 20 nt, Salmonella typhimurium LT2
cagaaagugggucacaucgc

SEQ ID NO: 1828261 - RNA, 17 nt, Salmonella typhimurium LT2
cagaaaaaauuacagcc

SEQ ID NO: 1828262 - RNA, 14 nt, Salmonella typhimurium LT2
cacuuuugccguca

SEQ ID NO: 1828263 - RNA, 15 nt, Salmonella typhimurium LT2
gauauggccgcguuu

SEQ ID NO: 1828264 - RNA, 16 nt, Salmonella typhimurium LT2
gauauagcgccaugcg

SEQ ID NO: 1828265 - RNA, 20 nt, Salmonella typhimurium LT2
gauauaaccgucuucaucca

SEQ ID NO: 1828266 - RNA, 11 nt, Salmonella typhimurium LT2
gauauaacgca

SEQ ID NO: 1828267 - RNA, 20 nt, Salmonella typhimurium LT2
gauauucugcacgcacgacg

SEQ ID NO: 1828268 - RNA, 19 nt, Salmonella typhimurium LT2
gauauugcguaagcagcug

SEQ ID NO: 1828269 - RNA, 12 nt, Salmonella typhimurium LT2
gauauuccgcgc

SEQ ID NO: 1828270 - RNA, 13 nt, Salmonella typhimurium LT2
gaucagcagaucc

SEQ ID NO: 1828271 - RNA, 13 nt, Salmonella typhimurium LT2
gaucagccgcgac

SEQ ID NO: 1828272 - RNA, 21 nt, Salmonella typhimurium LT2
gaucagccugagcgccagcgu

SEQ ID NO: 1828273 - RNA, 15 nt, Salmonella typhimurium LT2
gauagcgaggcagca

SEQ ID NO: 1828274 - RNA, 17 nt, Salmonella typhimurium LT2
gauagcgaucagcgcca

SEQ ID NO: 1828275 - RNA, 15 nt, Salmonella typhimurium LT2
gauagccuuccaccg

SEQ ID NO: 1828276 - RNA, 18 nt, Salmonella typhimurium LT2
gauagccaccggcagcgu

SEQ ID NO: 1828277 - RNA, 17 nt, Salmonella typhimurium LT2
gauagccguucuccagc

SEQ ID NO: 1828278 - RNA, 18 nt, Salmonella typhimurium LT2
gauagccguucuccagcg

SEQ ID NO: 1828279 - RNA, 22 nt, Salmonella typhimurium LT2
gauagccguugucauggcgcca

SEQ ID NO: 1828280 - RNA, 12 nt, Salmonella typhimurium LT2
gauagccgccag

SEQ ID NO: 1828281 - RNA, 23 nt, Salmonella typhimurium LT2
gauagcgccccaaagcgcauccg

SEQ ID NO: 1828282 - RNA, 15 nt, Salmonella typhimurium LT2
gauagcgcgccagca

SEQ ID NO: 1828283 - RNA, 21 nt, Salmonella typhimurium LT2
gauagcgccuuguuuaucaga

SEQ ID NO: 1828284 - RNA, 21 nt, Salmonella typhimurium LT2
gauacgcagaaccgccgcgau

SEQ ID NO: 1828285 - RNA, 17 nt, Salmonella typhimurium LT2
gauagaccacgccauca

SEQ ID NO: 1828286 - RNA, 18 nt, Salmonella typhimurium LT2
gauagagacugccgccgu

SEQ ID NO: 1828287 - RNA, 17 nt, Salmonella typhimurium LT2
gauaaacgacagcgcca

SEQ ID NO: 1828288 - RNA, 18 nt, Salmonella typhimurium LT2
gauaaacgacagcgccau

SEQ ID NO: 1828289 - RNA, 15 nt, Salmonella typhimurium LT2
gauaaagaauagccu

SEQ ID NO: 1828290 - RNA, 15 nt, Salmonella typhimurium LT2
gauaaagcagcgaca

SEQ ID NO: 1828291 - RNA, 13 nt, Salmonella typhimurium LT2
gauaaagcagcga

SEQ ID NO: 1828292 - RNA, 23 nt, Salmonella typhimurium LT2
gauaaagcccgucccuuccgcca

SEQ ID NO: 1828293 - RNA, 20 nt, Salmonella typhimurium LT2
gauacagccgacuauuccgc

SEQ ID NO: 1828294 - RNA, 12 nt, Salmonella typhimurium LT2
gauaaaucagcc

SEQ ID NO: 1828295 - RNA, 20 nt, Salmonella typhimurium LT2
gauaccuaaucccuggcgaa

SEQ ID NO: 1828296 - RNA, 16 nt, Salmonella typhimurium LT2
gauaaacaccggaauu

SEQ ID NO: 1828297 - RNA, 15 nt, Salmonella typhimurium LT2
gaguucaauaagcga

SEQ ID NO: 1828298 - RNA, 20 nt, Salmonella typhimurium LT2
gagugcuuauguaggccuga

SEQ ID NO: 1828299 - RNA, 12 nt, Salmonella typhimurium LT2
gagucguuaucc

SEQ ID NO: 1828300 - RNA, 14 nt, Salmonella typhimurium LT2
gagucgcuuaucug

SEQ ID NO: 1828301 - RNA, 23 nt, Salmonella typhimurium LT2
gagguugagauccugauccugca

SEQ ID NO: 1828302 - RNA, 22 nt, Salmonella typhimurium LT2
gagguucccgccgccaucgcca

SEQ ID NO: 1828303 - RNA, 16 nt, Salmonella typhimurium LT2
gaggccaccagcgcca

SEQ ID NO: 1828304 - RNA, 15 nt, Salmonella typhimurium LT2
gaggcggucuggauu

SEQ ID NO: 1828305 - RNA, 18 nt, Salmonella typhimurium LT2
gaucuucaucccauccgg

SEQ ID NO: 1828306 - RNA, 14 nt, Salmonella typhimurium LT2
gaucguccggcgau

SEQ ID NO: 1828307 - RNA, 23 nt, Salmonella typhimurium LT2
gaucgguugcaggaagggcagca

SEQ ID NO: 1828308 - RNA, 15 nt, Salmonella typhimurium LT2
gaucguaugcagcca

SEQ ID NO: 1828309 - RNA, 21 nt, Salmonella typhimurium LT2
gaucggcuugagcaccacgcg

SEQ ID NO: 1828310 - RNA, 17 nt, Salmonella typhimurium LT2
gaucggggcgaccggcu

SEQ ID NO: 1828311 - RNA, 18 nt, Salmonella typhimurium LT2
gaucggcguuuccaugga

SEQ ID NO: 1828312 - RNA, 17 nt, Salmonella typhimurium LT2
gaucgccaucgacagca

SEQ ID NO: 1828313 - RNA, 14 nt, Salmonella typhimurium LT2
gaucgccgccaucg

SEQ ID NO: 1828314 - RNA, 20 nt, Salmonella typhimurium LT2
gaucgcccgguugcaauucc

SEQ ID NO: 1828315 - RNA, 20 nt, Salmonella typhimurium LT2
gaucgauauccgugcgcaau

SEQ ID NO: 1828316 - RNA, 21 nt, Salmonella typhimurium LT2
gauccuguccugggccgccac

SEQ ID NO: 1828317 - RNA, 22 nt, Salmonella typhimurium LT2
gauccuguaacgcauaagcgcg

SEQ ID NO: 1828318 - RNA, 21 nt, Salmonella typhimurium LT2
gaucgaacaauuaccgauggu

SEQ ID NO: 1828319 - RNA, 18 nt, Salmonella typhimurium LT2
gauccagcgauugacggu

SEQ ID NO: 1828320 - RNA, 15 nt, Salmonella typhimurium LT2
gaucaucuccgacgu

SEQ ID NO: 1828321 - RNA, 17 nt, Salmonella typhimurium LT2
gaucaguggauaacgcg

SEQ ID NO: 1828322 - RNA, 16 nt, Salmonella typhimurium LT2
gaucaucguaccaaua

SEQ ID NO: 1828323 - RNA, 22 nt, Salmonella typhimurium LT2
gaucauccggguuaaaccagcu

SEQ ID NO: 1828324 - RNA, 11 nt, Salmonella typhimurium LT2
gaucagcgcca

SEQ ID NO: 1828325 - RNA, 18 nt, Salmonella typhimurium LT2
gaucagcggcgccgcaau

SEQ ID NO: 1828326 - RNA, 19 nt, Salmonella typhimurium LT2
gaucaggcgaccauccacc

SEQ ID NO: 1828327 - RNA, 23 nt, Salmonella typhimurium LT2
gaugccugguggcgacgcguggc

SEQ ID NO: 1828328 - RNA, 18 nt, Salmonella typhimurium LT2
gaugcgaguagcaaaucc

SEQ ID NO: 1828329 - RNA, 20 nt, Salmonella typhimurium LT2
gaugcgaaucuucaucgucg

SEQ ID NO: 1828330 - RNA, 19 nt, Salmonella typhimurium LT2
gaugaccggcuauccaugc

SEQ ID NO: 1828331 - RNA, 18 nt, Salmonella typhimurium LT2
gaugaccgaagcaggcgg

SEQ ID NO: 1828332 - RNA, 12 nt, Salmonella typhimurium LT2
gaugcucgaacc

SEQ ID NO: 1828333 - RNA, 17 nt, Salmonella typhimurium LT2
gaugcucagggcauccg

SEQ ID NO: 1828334 - RNA, 22 nt, Salmonella typhimurium LT2
gaugcggcuagcgccuuauccg

SEQ ID NO: 1828335 - RNA, 21 nt, Salmonella typhimurium LT2
gauggcgcuaaugcuuauccg

SEQ ID NO: 1828336 - RNA, 19 nt, Salmonella typhimurium LT2
gauggcgcuacgccugaac

SEQ ID NO: 1828337 - RNA, 20 nt, Salmonella typhimurium LT2
gauggcugcacccggagaga

SEQ ID NO: 1828338 - RNA, 19 nt, Salmonella typhimurium LT2
gauggcgcgacgcuuauca

SEQ ID NO: 1828339 - RNA, 15 nt, Salmonella typhimurium LT2
gauggcuuuacccgg

SEQ ID NO: 1828340 - RNA, 15 nt, Salmonella typhimurium LT2
gaugcucgcucauca

SEQ ID NO: 1828341 - RNA, 16 nt, Salmonella typhimurium LT2
gauggagcggcgcuua

SEQ ID NO: 1828342 - RNA, 23 nt, Salmonella typhimurium LT2
gauggcgacuaacgucuuauccg

SEQ ID NO: 1828343 - RNA, 20 nt, Salmonella typhimurium LT2
gauuauuuuccaaccacggu

SEQ ID NO: 1828344 - RNA, 13 nt, Salmonella typhimurium LT2
gauucgccagcgu

SEQ ID NO: 1828345 - RNA, 18 nt, Salmonella typhimurium LT2
gauucuaacauaaugaau

SEQ ID NO: 1828346 - RNA, 13 nt, Salmonella typhimurium LT2
gauucugcagcga

SEQ ID NO: 1828347 - RNA, 22 nt, Salmonella typhimurium LT2
gauuacucgucaccgaauagcg

SEQ ID NO: 1828348 - RNA, 14 nt, Salmonella typhimurium LT2
gauuacgcgucuga

SEQ ID NO: 1828349 - RNA, 19 nt, Salmonella typhimurium LT2
gauuacgugcccggcguga

SEQ ID NO: 1828350 - RNA, 16 nt, Salmonella typhimurium LT2
gauuuccggcggcaga

SEQ ID NO: 1828351 - RNA, 16 nt, Salmonella typhimurium LT2
gcaaacuguguacgcc

SEQ ID NO: 1828352 - RNA, 21 nt, Salmonella typhimurium LT2
gcaaaccgaauucguccacac

SEQ ID NO: 1828353 - RNA, 13 nt, Salmonella typhimurium LT2
gcaaaccagcacc

SEQ ID NO: 1828354 - RNA, 15 nt, Salmonella typhimurium LT2
gcaaauauuccauca

SEQ ID NO: 1828355 - RNA, 16 nt, Salmonella typhimurium LT2
gcaaaucccguaccgg

SEQ ID NO: 1828356 - RNA, 11 nt, Salmonella typhimurium LT2
gcaaauauccu

SEQ ID NO: 1828357 - RNA, 16 nt, Salmonella typhimurium LT2
gcaaauacaucgccac

SEQ ID NO: 1828358 - RNA, 19 nt, Salmonella typhimurium LT2
gcaaagcaggugagauaac

SEQ ID NO: 1828359 - RNA, 10 nt, Salmonella typhimurium LT2
gcaaacugcc

SEQ ID NO: 1828360 - RNA, 14 nt, Salmonella typhimurium LT2
gcaaagaaggcauu

SEQ ID NO: 1828361 - RNA, 18 nt, Salmonella typhimurium LT2
gcaaaggaaugcuuuaca

SEQ ID NO: 1828362 - RNA, 18 nt, Salmonella typhimurium LT2
gcaaagcgggcgacgaug

SEQ ID NO: 1828363 - RNA, 22 nt, Salmonella typhimurium LT2
gcaagacacagcgucgcgcgau

SEQ ID NO: 1828364 - RNA, 16 nt, Salmonella typhimurium LT2
gcaagauuaaccagca

SEQ ID NO: 1828365 - RNA, 16 nt, Salmonella typhimurium LT2
gcaagacucgcgccuu

SEQ ID NO: 1828366 - RNA, 18 nt, Salmonella typhimurium LT2
gcaagagagcaacauacc

SEQ ID NO: 1828367 - RNA, 19 nt, Salmonella typhimurium LT2
gcaagccaaacucuuccac

SEQ ID NO: 1828368 - RNA, 21 nt, Salmonella typhimurium LT2
gcaagcauaaaaaacaucaug

SEQ ID NO: 1828369 - RNA, 16 nt, Salmonella typhimurium LT2
gcaagcaucugauaua

SEQ ID NO: 1828370 - RNA, 18 nt, Salmonella typhimurium LT2
gcaacuguugcgccagca

SEQ ID NO: 1828371 - RNA, 13 nt, Salmonella typhimurium LT2
gcaacugcgccaa

SEQ ID NO: 1828372 - RNA, 19 nt, Salmonella typhimurium LT2
gcaagcggcaaucgccuca

SEQ ID NO: 1828373 - RNA, 14 nt, Salmonella typhimurium LT2
gcaagcgcgccaua

SEQ ID NO: 1828374 - RNA, 14 nt, Salmonella typhimurium LT2
gcaagcgccagcau

SEQ ID NO: 1828375 - RNA, 15 nt, Salmonella typhimurium LT2
gcaauuucauucacc

SEQ ID NO: 1828376 - RNA, 19 nt, Salmonella typhimurium LT2
gcaauuucauucaccaccg

SEQ ID NO: 1828377 - RNA, 16 nt, Salmonella typhimurium LT2
gcacacaauagcaauc

SEQ ID NO: 1828378 - RNA, 15 nt, Salmonella typhimurium LT2
gcacaaucgccguga

SEQ ID NO: 1828379 - RNA, 13 nt, Salmonella typhimurium LT2
gcacaaucugaau

SEQ ID NO: 1828380 - RNA, 17 nt, Salmonella typhimurium LT2
gcaaugauaacggcgcc

SEQ ID NO: 1828381 - RNA, 17 nt, Salmonella typhimurium LT2
gcaaugacgguaagcau

SEQ ID NO: 1828382 - RNA, 22 nt, Salmonella typhimurium LT2
gcaauucagguaauacgcgucu

SEQ ID NO: 1828383 - RNA, 13 nt, Salmonella typhimurium LT2
gcaaucagcauuu

SEQ ID NO: 1828384 - RNA, 15 nt, Salmonella typhimurium LT2
gcaauaacgccgaua

SEQ ID NO: 1828385 - RNA, 21 nt, Salmonella typhimurium LT2
gcaauaacacaggcggcgcua

SEQ ID NO: 1828386 - RNA, 15 nt, Salmonella typhimurium LT2
gcaauaaaauauccu

SEQ ID NO: 1828387 - RNA, 18 nt, Salmonella typhimurium LT2
gcaagucgcgggcgcuaa

SEQ ID NO: 1828388 - RNA, 12 nt, Salmonella typhimurium LT2
gcaaucaucaga

SEQ ID NO: 1828389 - RNA, 13 nt, Salmonella typhimurium LT2
gcaaucagcgccc

SEQ ID NO: 1828390 - RNA, 15 nt, Salmonella typhimurium LT2
gcaaucucuuccgcc

SEQ ID NO: 1828391 - RNA, 17 nt, Salmonella typhimurium LT2
gcaaucccgaccagcgu

SEQ ID NO: 1828392 - RNA, 20 nt, Salmonella typhimurium LT2
gcaaccgcaucacgcgaagc

SEQ ID NO: 1828393 - RNA, 12 nt, Salmonella typhimurium LT2
gcaacccggcua

SEQ ID NO: 1828394 - RNA, 15 nt, Salmonella typhimurium LT2
gcaaccccucaucgg

SEQ ID NO: 1828395 - RNA, 15 nt, Salmonella typhimurium LT2
gcaacccgccgccau

SEQ ID NO: 1828396 - RNA, 23 nt, Salmonella typhimurium LT2
gcaaccauuaccgccaacaucgc

SEQ ID NO: 1828397 - RNA, 16 nt, Salmonella typhimurium LT2
gcaaccagcccaugaa

SEQ ID NO: 1828398 - RNA, 23 nt, Salmonella typhimurium LT2
gcaacaguucacgacugauaggc

SEQ ID NO: 1828399 - RNA, 12 nt, Salmonella typhimurium LT2
gcaacaggguga

SEQ ID NO: 1828400 - RNA, 16 nt, Salmonella typhimurium LT2
gcaacagggugauuuc

SEQ ID NO: 1828401 - RNA, 21 nt, Salmonella typhimurium LT2
gcaacaacaguugcagcaccu

SEQ ID NO: 1828402 - RNA, 14 nt, Salmonella typhimurium LT2
gcaacaacaggcca

SEQ ID NO: 1828403 - RNA, 20 nt, Salmonella typhimurium LT2
gcaacagauacggcgcgucg

SEQ ID NO: 1828404 - RNA, 17 nt, Salmonella typhimurium LT2
gcaaccuuaaacaucgc

SEQ ID NO: 1828405 - RNA, 17 nt, Salmonella typhimurium LT2
gcaacgaaaaucauccg

SEQ ID NO: 1828406 - RNA, 17 nt, Salmonella typhimurium LT2
gcaacgccgcauccugu

SEQ ID NO: 1828407 - RNA, 14 nt, Salmonella typhimurium LT2
gcaacggaagcuga

SEQ ID NO: 1828408 - RNA, 17 nt, Salmonella typhimurium LT2
gcaacguccgcagccga

SEQ ID NO: 1828409 - RNA, 14 nt, Salmonella typhimurium LT2
gcaacgucaugacc

SEQ ID NO: 1828410 - RNA, 14 nt, Salmonella typhimurium LT2
gcaacucaucguca

SEQ ID NO: 1828411 - RNA, 21 nt, Salmonella typhimurium LT2
gcaccucgaccagacugauaa

SEQ ID NO: 1828412 - RNA, 19 nt, Salmonella typhimurium LT2
gcacccggcuuacaacauu

SEQ ID NO: 1828413 - RNA, 21 nt, Salmonella typhimurium LT2
gcacguuaaagccgaccaucg

SEQ ID NO: 1828414 - RNA, 15 nt, Salmonella typhimurium LT2
gcacuguuugcugac

SEQ ID NO: 1828415 - RNA, 22 nt, Salmonella typhimurium LT2
gcacuucacgcuccuugagcgc

SEQ ID NO: 1828416 - RNA, 20 nt, Salmonella typhimurium LT2
gcacuuccugaaucaccagc

SEQ ID NO: 1828417 - RNA, 15 nt, Salmonella typhimurium LT2
gcacuuccagccacg

SEQ ID NO: 1828418 - RNA, 20 nt, Salmonella typhimurium LT2
gcacuucaaugucguuaucg

SEQ ID NO: 1828419 - RNA, 17 nt, Salmonella typhimurium LT2
gcacucuucuucgcguu

SEQ ID NO: 1828420 - RNA, 21 nt, Salmonella typhimurium LT2
gcacugacgucaacucgcggc

SEQ ID NO: 1828421 - RNA, 16 nt, Salmonella typhimurium LT2
gcagauuuuucgccag

SEQ ID NO: 1828422 - RNA, 14 nt, Salmonella typhimurium LT2
gcagacugcgccac

SEQ ID NO: 1828423 - RNA, 17 nt, Salmonella typhimurium LT2
gcagagauagccagcga

SEQ ID NO: 1828424 - RNA, 18 nt, Salmonella typhimurium LT2
gcagacuaaaaagcgcgu

SEQ ID NO: 1828425 - RNA, 17 nt, Salmonella typhimurium LT2
gcagacuaaaaagcgcg

SEQ ID NO: 1828426 - RNA, 22 nt, Salmonella typhimurium LT2
gcagaugguauaaaucacgcug

SEQ ID NO: 1828427 - RNA, 20 nt, Salmonella typhimurium LT2
gcagaccuguucuguaggcu

SEQ ID NO: 1828428 - RNA, 22 nt, Salmonella typhimurium LT2
gcagacauauuuucaacggcau

SEQ ID NO: 1828429 - RNA, 15 nt, Salmonella typhimurium LT2
gcagccccggcaucc

SEQ ID NO: 1828430 - RNA, 16 nt, Salmonella typhimurium LT2
gcagccccagcgccag

SEQ ID NO: 1828431 - RNA, 16 nt, Salmonella typhimurium LT2
gcagccaugccagcgc

SEQ ID NO: 1828432 - RNA, 23 nt, Salmonella typhimurium LT2
gcagcccugcgucgcguaccagc

SEQ ID NO: 1828433 - RNA, 14 nt, Salmonella typhimurium LT2
gcagccgacagcgu

SEQ ID NO: 1828434 - RNA, 22 nt, Salmonella typhimurium LT2
gcagccgaggcuuaauacagca

SEQ ID NO: 1828435 - RNA, 14 nt, Salmonella typhimurium LT2
gcagccgccaccac

SEQ ID NO: 1828436 - RNA, 12 nt, Salmonella typhimurium LT2
gcagccggaauc

SEQ ID NO: 1828437 - RNA, 13 nt, Salmonella typhimurium LT2
gcagccggauaga

SEQ ID NO: 1828438 - RNA, 16 nt, Salmonella typhimurium LT2
gcagcgaugacagcag

SEQ ID NO: 1828439 - RNA, 17 nt, Salmonella typhimurium LT2
gcagcgcgauaucauuc

SEQ ID NO: 1828440 - RNA, 18 nt, Salmonella typhimurium LT2
gcagcgcggccagcgccu

SEQ ID NO: 1828441 - RNA, 16 nt, Salmonella typhimurium LT2
gcagcgcggccugcgu

SEQ ID NO: 1828442 - RNA, 20 nt, Salmonella typhimurium LT2
gcagcggcgguuauccgcca

SEQ ID NO: 1828443 - RNA, 15 nt, Salmonella typhimurium LT2
gcagcgggauauccc

SEQ ID NO: 1828444 - RNA, 14 nt, Salmonella typhimurium LT2
gcaggcagcgucgc

SEQ ID NO: 1828445 - RNA, 17 nt, Salmonella typhimurium LT2
gcaggccaaaaaagccg

SEQ ID NO: 1828446 - RNA, 21 nt, Salmonella typhimurium LT2
gcaggcgccuuauccggccug

SEQ ID NO: 1828447 - RNA, 14 nt, Salmonella typhimurium LT2
gcaggucgcguagu

SEQ ID NO: 1828448 - RNA, 21 nt, Salmonella typhimurium LT2
gcagggcgauauccagcgcca

SEQ ID NO: 1828449 - RNA, 15 nt, Salmonella typhimurium LT2
gcaggcuacgguacu

SEQ ID NO: 1828450 - RNA, 22 nt, Salmonella typhimurium LT2
gcaggcggugcgcagccacggc

SEQ ID NO: 1828451 - RNA, 23 nt, Salmonella typhimurium LT2
gcaucacaaaccagacgcguaac

SEQ ID NO: 1828452 - RNA, 18 nt, Salmonella typhimurium LT2
gcaucgacauccgauuuc

SEQ ID NO: 1828453 - RNA, 18 nt, Salmonella typhimurium LT2
gcaucgcgcgagauacgc

SEQ ID NO: 1828454 - RNA, 21 nt, Salmonella typhimurium LT2
gcaucgccgguagcuucagcg

SEQ ID NO: 1828455 - RNA, 17 nt, Salmonella typhimurium LT2
gcaucgcauuaacgucc

SEQ ID NO: 1828456 - RNA, 16 nt, Salmonella typhimurium LT2
gcaucgacgccagcgg

SEQ ID NO: 1828457 - RNA, 16 nt, Salmonella typhimurium LT2
gcaucgacguucagca

SEQ ID NO: 1828458 - RNA, 21 nt, Salmonella typhimurium LT2
gcauaaaaaaagcgccggauu

SEQ ID NO: 1828459 - RNA, 17 nt, Salmonella typhimurium LT2
gcaguuuuccagcgccu

SEQ ID NO: 1828460 - RNA, 19 nt, Salmonella typhimurium LT2
gcaguuuugcuucaugcac

SEQ ID NO: 1828461 - RNA, 19 nt, Salmonella typhimurium LT2
gcauaaaaccgccgcccau

SEQ ID NO: 1828462 - RNA, 23 nt, Salmonella typhimurium LT2
gcauaaauaauaccguccgcgug

SEQ ID NO: 1828463 - RNA, 16 nt, Salmonella typhimurium LT2
gcauaaugcagccauc

SEQ ID NO: 1828464 - RNA, 17 nt, Salmonella typhimurium LT2
gcauaaauuggcucaga

SEQ ID NO: 1828465 - RNA, 16 nt, Salmonella typhimurium LT2
gcauagccccagcgca

SEQ ID NO: 1828466 - RNA, 20 nt, Salmonella typhimurium LT2
gcauuuucgucugccggaaa

SEQ ID NO: 1828467 - RNA, 17 nt, Salmonella typhimurium LT2
gccaaaccagacccgcu

SEQ ID NO: 1828468 - RNA, 23 nt, Salmonella typhimurium LT2
gccaaaacccagaaucagcaaca

SEQ ID NO: 1828469 - RNA, 22 nt, Salmonella typhimurium LT2
gcauuuuucauggugaacaugg

SEQ ID NO: 1828470 - RNA, 17 nt, Salmonella typhimurium LT2
gccaaaaaaggcagcca

SEQ ID NO: 1828471 - RNA, 12 nt, Salmonella typhimurium LT2
gccaaagcgccc

SEQ ID NO: 1828472 - RNA, 14 nt, Salmonella typhimurium LT2
gccaaauagcgcca

SEQ ID NO: 1828473 - RNA, 23 nt, Salmonella typhimurium LT2
gccaacaaagaggcugcgcgaau

SEQ ID NO: 1828474 - RNA, 16 nt, Salmonella typhimurium LT2
gccaacaggucgauga

SEQ ID NO: 1828475 - RNA, 16 nt, Salmonella typhimurium LT2
gccaacauagcggcaa

SEQ ID NO: 1828476 - RNA, 14 nt, Salmonella typhimurium LT2
gccaaccccggcaa

SEQ ID NO: 1828477 - RNA, 21 nt, Salmonella typhimurium LT2
gccaacgcccgguugcgaaua

SEQ ID NO: 1828478 - RNA, 19 nt, Salmonella typhimurium LT2
gccaacgccgcccagcgaa

SEQ ID NO: 1828479 - RNA, 15 nt, Salmonella typhimurium LT2
gcauuauaagcgcca

SEQ ID NO: 1828480 - RNA, 21 nt, Salmonella typhimurium LT2
gcauuaacccggccccgacaa

SEQ ID NO: 1828481 - RNA, 14 nt, Salmonella typhimurium LT2
gcauuaauggcgau

SEQ ID NO: 1828482 - RNA, 17 nt, Salmonella typhimurium LT2
gcauuaucgaugcguau

SEQ ID NO: 1828483 - RNA, 21 nt, Salmonella typhimurium LT2
gcauugcccuucgcgcgauaa

SEQ ID NO: 1828484 - RNA, 21 nt, Salmonella typhimurium LT2
gcauugccaugaugagcgcca

SEQ ID NO: 1828485 - RNA, 23 nt, Salmonella typhimurium LT2
gcauugccauguuaauaccagcg

SEQ ID NO: 1828486 - RNA, 18 nt, Salmonella typhimurium LT2
gcauguucacaucgcuca

SEQ ID NO: 1828487 - RNA, 21 nt, Salmonella typhimurium LT2
gcaugguguguucccgcgcca

SEQ ID NO: 1828488 - RNA, 12 nt, Salmonella typhimurium LT2
gcaugaccaucc

SEQ ID NO: 1828489 - RNA, 16 nt, Salmonella typhimurium LT2
gcauggcagauaaacc

SEQ ID NO: 1828490 - RNA, 17 nt, Salmonella typhimurium LT2
gcaucgguucugcgaca

SEQ ID NO: 1828491 - RNA, 14 nt, Salmonella typhimurium LT2
gcaucgucggcgau

SEQ ID NO: 1828492 - RNA, 16 nt, Salmonella typhimurium LT2
gcaugaagcagcaggc

SEQ ID NO: 1828493 - RNA, 15 nt, Salmonella typhimurium LT2
gccggaagcgcgaau

SEQ ID NO: 1828494 - RNA, 22 nt, Salmonella typhimurium LT2
gccggaaugcgaauaaucgccg

SEQ ID NO: 1828495 - RNA, 19 nt, Salmonella typhimurium LT2
gccggagagcaguacgcca

SEQ ID NO: 1828496 - RNA, 16 nt, Salmonella typhimurium LT2
gccggauaaggcguaa

SEQ ID NO: 1828497 - RNA, 20 nt, Salmonella typhimurium LT2
gccggauaagcgcagcgcca

SEQ ID NO: 1828498 - RNA, 21 nt, Salmonella typhimurium LT2
gccggauaagcguaagcgcca

SEQ ID NO: 1828499 - RNA, 21 nt, Salmonella typhimurium LT2
gccggauaagcguagcgccau

SEQ ID NO: 1828500 - RNA, 21 nt, Salmonella typhimurium LT2
gccggauaagcguuagcgcca

SEQ ID NO: 1828501 - RNA, 20 nt, Salmonella typhimurium LT2
gccgcuuugcgaacagcgca

SEQ ID NO: 1828502 - RNA, 17 nt, Salmonella typhimurium LT2
gccgcuuuugcauuaac

SEQ ID NO: 1828503 - RNA, 24 nt, Salmonella typhimurium LT2
gccgcuuuuuaauuuaugcgccag

SEQ ID NO: 1828504 - RNA, 19 nt, Salmonella typhimurium LT2
gccggcaaaaccaugcacc

SEQ ID NO: 1828505 - RNA, 19 nt, Salmonella typhimurium LT2
gccggauuccagaauacga

SEQ ID NO: 1828506 - RNA, 21 nt, Salmonella typhimurium LT2
gccggauuagcgacagcgcua

SEQ ID NO: 1828507 - RNA, 18 nt, Salmonella typhimurium LT2
gccggaugugagcgcauc

SEQ ID NO: 1828508 - RNA, 19 nt, Salmonella typhimurium LT2
gccggauaucgcuauccgg

SEQ ID NO: 1828509 - RNA, 19 nt, Salmonella typhimurium LT2
gccggauagcguagcgcca

SEQ ID NO: 1828510 - RNA, 20 nt, Salmonella typhimurium LT2
gccggauagcguagcgccau

SEQ ID NO: 1828511 - RNA, 20 nt, Salmonella typhimurium LT2
gccggauggcgguuggccua

SEQ ID NO: 1828512 - RNA, 17 nt, Salmonella typhimurium LT2
gccggcaggcagcgcca

SEQ ID NO: 1828513 - RNA, 18 nt, Salmonella typhimurium LT2
gccgcugaccgccggaaa

SEQ ID NO: 1828514 - RNA, 20 nt, Salmonella typhimurium LT2
gccgcucaucaccagcagca

SEQ ID NO: 1828515 - RNA, 17 nt, Salmonella typhimurium LT2
gccgcuacugccgccau

SEQ ID NO: 1828516 - RNA, 19 nt, Salmonella typhimurium LT2
gccgcgcguaaauaccacc

SEQ ID NO: 1828517 - RNA, 20 nt, Salmonella typhimurium LT2
gccgcgauagaccacgccau

SEQ ID NO: 1828518 - RNA, 24 nt, Salmonella typhimurium LT2
gccgcggaccuuuugccgcccagu

SEQ ID NO: 1828519 - RNA, 21 nt, Salmonella typhimurium LT2
gccggccgcaguuuuccagcg

SEQ ID NO: 1828520 - RNA, 17 nt, Salmonella typhimurium LT2
gccggcuucuccaccau

SEQ ID NO: 1828521 - RNA, 17 nt, Salmonella typhimurium LT2
gccgcaggacagcgaca

SEQ ID NO: 1828522 - RNA, 23 nt, Salmonella typhimurium LT2
gccgcagcucauaacggcuuaac

SEQ ID NO: 1828523 - RNA, 15 nt, Salmonella typhimurium LT2
gccgcaguugccagg

SEQ ID NO: 1828524 - RNA, 22 nt, Salmonella typhimurium LT2
gccgcauggagcaucagcgccg

SEQ ID NO: 1828525 - RNA, 14 nt, Salmonella typhimurium LT2
gccgccaaagcgcc

SEQ ID NO: 1828526 - RNA, 18 nt, Salmonella typhimurium LT2
gccgccaaacuccaccug

SEQ ID NO: 1828527 - RNA, 17 nt, Salmonella typhimurium LT2
gccgcauuuuuccagcc

SEQ ID NO: 1828528 - RNA, 20 nt, Salmonella typhimurium LT2
gccgcauuuuuucuucaguu

SEQ ID NO: 1828529 - RNA, 15 nt, Salmonella typhimurium LT2
gccgccaacgccggc

SEQ ID NO: 1828530 - RNA, 11 nt, Salmonella typhimurium LT2
gccgcccaucc

SEQ ID NO: 1828531 - RNA, 17 nt, Salmonella typhimurium LT2
gccgcccaucgccacag

SEQ ID NO: 1828532 - RNA, 15 nt, Salmonella typhimurium LT2
gccgccauggcgaau

SEQ ID NO: 1828533 - RNA, 20 nt, Salmonella typhimurium LT2
gccgcccguuuuuuccagug

SEQ ID NO: 1828534 - RNA, 14 nt, Salmonella typhimurium LT2
gccgcccugcauca

SEQ ID NO: 1828535 - RNA, 15 nt, Salmonella typhimurium LT2
gccgccucgcguagc

SEQ ID NO: 1828536 - RNA, 19 nt, Salmonella typhimurium LT2
gccgccggugucuccguca

SEQ ID NO: 1828537 - RNA, 15 nt, Salmonella typhimurium LT2
gccgccguaacgugc

SEQ ID NO: 1828538 - RNA, 16 nt, Salmonella typhimurium LT2
gccgccguccaggccu

SEQ ID NO: 1828539 - RNA, 18 nt, Salmonella typhimurium LT2
gccgcaaacuccaccacg

SEQ ID NO: 1828540 - RNA, 15 nt, Salmonella typhimurium LT2
gccgcagcgccauaa

SEQ ID NO: 1828541 - RNA, 20 nt, Salmonella typhimurium LT2
gccgcagaaaauggucugcu

SEQ ID NO: 1828542 - RNA, 14 nt, Salmonella typhimurium LT2
gccgcaacggucgg

SEQ ID NO: 1828543 - RNA, 13 nt, Salmonella typhimurium LT2
gccgaucagcgcc

SEQ ID NO: 1828544 - RNA, 14 nt, Salmonella typhimurium LT2
gccgauaccggcaa

SEQ ID NO: 1828545 - RNA, 19 nt, Salmonella typhimurium LT2
gccgagcagaucgcggcaa

SEQ ID NO: 1828546 - RNA, 16 nt, Salmonella typhimurium LT2
gccgacguuaucgccg

SEQ ID NO: 1828547 - RNA, 19 nt, Salmonella typhimurium LT2
gccgaccgccaggucggcu

SEQ ID NO: 1828548 - RNA, 13 nt, Salmonella typhimurium LT2
gccgaccgccagg

SEQ ID NO: 1828549 - RNA, 15 nt, Salmonella typhimurium LT2
gcccuauaacagcgc

SEQ ID NO: 1828550 - RNA, 21 nt, Salmonella typhimurium LT2
gccgacagacgccauaucgcc

SEQ ID NO: 1828551 - RNA, 17 nt, Salmonella typhimurium LT2
gccauccaccaggcaug

SEQ ID NO: 1828552 - RNA, 14 nt, Salmonella typhimurium LT2
gccaucaugcccac

SEQ ID NO: 1828553 - RNA, 18 nt, Salmonella typhimurium LT2
gccaucaggcaaucuuua

SEQ ID NO: 1828554 - RNA, 16 nt, Salmonella typhimurium LT2
gccaucaggccuacga

SEQ ID NO: 1828555 - RNA, 19 nt, Salmonella typhimurium LT2
gccaucaggccuacgauua

SEQ ID NO: 1828556 - RNA, 22 nt, Salmonella typhimurium LT2
gccaucgcuuugagcagcgcca

SEQ ID NO: 1828557 - RNA, 22 nt, Salmonella typhimurium LT2
gccaucaacuucucgcaggcca

SEQ ID NO: 1828558 - RNA, 13 nt, Salmonella typhimurium LT2
gccaucaccaucg

SEQ ID NO: 1828559 - RNA, 21 nt, Salmonella typhimurium LT2
gccaucaauccauuucgccag

SEQ ID NO: 1828560 - RNA, 17 nt, Salmonella typhimurium LT2
gccaucagacaggcaug

SEQ ID NO: 1828561 - RNA, 16 nt, Salmonella typhimurium LT2
gccaucagagccgaaa

SEQ ID NO: 1828562 - RNA, 19 nt, Salmonella typhimurium LT2
gccaucacgcugcggucuu

SEQ ID NO: 1828563 - RNA, 16 nt, Salmonella typhimurium LT2
gccauaucgccggcaa

SEQ ID NO: 1828564 - RNA, 13 nt, Salmonella typhimurium LT2
gccaucaacgcca

SEQ ID NO: 1828565 - RNA, 16 nt, Salmonella typhimurium LT2
gccauuaaugcaggca

SEQ ID NO: 1828566 - RNA, 17 nt, Salmonella typhimurium LT2
gccauuaaacucaucgc

SEQ ID NO: 1828567 - RNA, 23 nt, Salmonella typhimurium LT2
gccauuccccacgccaucgcggc

SEQ ID NO: 1828568 - RNA, 21 nt, Salmonella typhimurium LT2
gccauucgcuuccgccgggaa

SEQ ID NO: 1828569 - RNA, 17 nt, Salmonella typhimurium LT2
gccaugagacgcguaaa

SEQ ID NO: 1828570 - RNA, 18 nt, Salmonella typhimurium LT2
gccauuucugcucacggu

SEQ ID NO: 1828571 - RNA, 16 nt, Salmonella typhimurium LT2
gcccaaaacgcgccag

SEQ ID NO: 1828572 - RNA, 18 nt, Salmonella typhimurium LT2
gcccaacggaugcgccau

SEQ ID NO: 1828573 - RNA, 19 nt, Salmonella typhimurium LT2
gccaguagcucgccgcuga

SEQ ID NO: 1828574 - RNA, 22 nt, Salmonella typhimurium LT2
gccaggucugaaccacgguguc

SEQ ID NO: 1828575 - RNA, 21 nt, Salmonella typhimurium LT2
gccagguacaucgcgcuuaac

SEQ ID NO: 1828576 - RNA, 15 nt, Salmonella typhimurium LT2
gccagggcggaagca

SEQ ID NO: 1828577 - RNA, 21 nt, Salmonella typhimurium LT2
gccaggccaucgccgccauca

SEQ ID NO: 1828578 - RNA, 16 nt, Salmonella typhimurium LT2
gccaggauaucgcccg

SEQ ID NO: 1828579 - RNA, 14 nt, Salmonella typhimurium LT2
gccaggauaucgcc

SEQ ID NO: 1828580 - RNA, 16 nt, Salmonella typhimurium LT2
gccagcgcugacauca

SEQ ID NO: 1828581 - RNA, 18 nt, Salmonella typhimurium LT2
gccagcggccagggcguc

SEQ ID NO: 1828582 - RNA, 18 nt, Salmonella typhimurium LT2
gccagcggcgccaucacc

SEQ ID NO: 1828583 - RNA, 16 nt, Salmonella typhimurium LT2
gccagcgugcguauga

SEQ ID NO: 1828584 - RNA, 17 nt, Salmonella typhimurium LT2
gccagcgacagguguua

SEQ ID NO: 1828585 - RNA, 21 nt, Salmonella typhimurium LT2
gccagccagucgccaggcaag

SEQ ID NO: 1828586 - RNA, 20 nt, Salmonella typhimurium LT2
gccagccccaccguccacau

SEQ ID NO: 1828587 - RNA, 12 nt, Salmonella typhimurium LT2
gccagccggaaa

SEQ ID NO: 1828588 - RNA, 17 nt, Salmonella typhimurium LT2
gccagcaguugcagcgu

SEQ ID NO: 1828589 - RNA, 22 nt, Salmonella typhimurium LT2
gccagcagguaucccaauaccg

SEQ ID NO: 1828590 - RNA, 22 nt, Salmonella typhimurium LT2
gccagcaaugccgccgccaggu

SEQ ID NO: 1828591 - RNA, 20 nt, Salmonella typhimurium LT2
gccagcaaggcugccgccag

SEQ ID NO: 1828592 - RNA, 23 nt, Salmonella typhimurium LT2
gccagaugaucagcauagcgccu

SEQ ID NO: 1828593 - RNA, 23 nt, Salmonella typhimurium LT2
gccagagaaagucgcuccagggc

SEQ ID NO: 1828594 - RNA, 17 nt, Salmonella typhimurium LT2
gccagacccagcgcuaa

SEQ ID NO: 1828595 - RNA, 15 nt, Salmonella typhimurium LT2
gccagacgcgcagca

SEQ ID NO: 1828596 - RNA, 14 nt, Salmonella typhimurium LT2
gccacuccgccagu

SEQ ID NO: 1828597 - RNA, 17 nt, Salmonella typhimurium LT2
gccacgccauacguccg

SEQ ID NO: 1828598 - RNA, 16 nt, Salmonella typhimurium LT2
gccaacgccggcaaca

SEQ ID NO: 1828599 - RNA, 21 nt, Salmonella typhimurium LT2
gccacgacgcucaacgauuuc

SEQ ID NO: 1828600 - RNA, 17 nt, Salmonella typhimurium LT2
gccacgacuaucguuac

SEQ ID NO: 1828601 - RNA, 21 nt, Salmonella typhimurium LT2
gccacgagaaauccacauuag

SEQ ID NO: 1828602 - RNA, 20 nt, Salmonella typhimurium LT2
gcccgauggcgcugcgcgca

SEQ ID NO: 1828603 - RNA, 16 nt, Salmonella typhimurium LT2
gcccgccaauauccgg

SEQ ID NO: 1828604 - RNA, 15 nt, Salmonella typhimurium LT2
gcccgaaucgccgcu

SEQ ID NO: 1828605 - RNA, 19 nt, Salmonella typhimurium LT2
gcccgagcgacgcccugcc

SEQ ID NO: 1828606 - RNA, 21 nt, Salmonella typhimurium LT2
gcccgacaucaaacugcuggc

SEQ ID NO: 1828607 - RNA, 20 nt, Salmonella typhimurium LT2
gccccuuucgcaaucaugcg

SEQ ID NO: 1828608 - RNA, 15 nt, Salmonella typhimurium LT2
gccccuaaggcagcg

SEQ ID NO: 1828609 - RNA, 15 nt, Salmonella typhimurium LT2
gcccccuccagccag

SEQ ID NO: 1828610 - RNA, 20 nt, Salmonella typhimurium LT2
gcccccuccagccagcgcca

SEQ ID NO: 1828611 - RNA, 21 nt, Salmonella typhimurium LT2
gccccgcuucccgaugccagc

SEQ ID NO: 1828612 - RNA, 21 nt, Salmonella typhimurium LT2
gccccagcgccagcugcguca

SEQ ID NO: 1828613 - RNA, 21 nt, Salmonella typhimurium LT2
gccccaggccaauuccgccau

SEQ ID NO: 1828614 - RNA, 13 nt, Salmonella typhimurium LT2
gcccagucacggc

SEQ ID NO: 1828615 - RNA, 18 nt, Salmonella typhimurium LT2
gcccauucaacgggcgau

SEQ ID NO: 1828616 - RNA, 15 nt, Salmonella typhimurium LT2
gcccauuaugccgca

SEQ ID NO: 1828617 - RNA, 13 nt, Salmonella typhimurium LT2
gcccauuugcgag

SEQ ID NO: 1828618 - RNA, 20 nt, Salmonella typhimurium LT2
gcccauuucauggccgauca

SEQ ID NO: 1828619 - RNA, 11 nt, Salmonella typhimurium LT2
gcccagcgccg

SEQ ID NO: 1828620 - RNA, 21 nt, Salmonella typhimurium LT2
gcccagcgcaaccugcgcccg

SEQ ID NO: 1828621 - RNA, 19 nt, Salmonella typhimurium LT2
gcccaauguuuuaccggca

SEQ ID NO: 1828622 - RNA, 20 nt, Salmonella typhimurium LT2
gcccgguaagcgcagcgcca

SEQ ID NO: 1828623 - RNA, 19 nt, Salmonella typhimurium LT2
gcccggucacacuuaccgg

SEQ ID NO: 1828624 - RNA, 18 nt, Salmonella typhimurium LT2
gcccgguacguuaaccgg

SEQ ID NO: 1828625 - RNA, 23 nt, Salmonella typhimurium LT2
gcccgucagagcgaggcccaucg

SEQ ID NO: 1828626 - RNA, 23 nt, Salmonella typhimurium LT2
gcccggcuggacgucaugccgcc

SEQ ID NO: 1828627 - RNA, 14 nt, Salmonella typhimurium LT2
gcccggcuccguca

SEQ ID NO: 1828628 - RNA, 21 nt, Salmonella typhimurium LT2
gcccggcaugucgccagccag

SEQ ID NO: 1828629 - RNA, 14 nt, Salmonella typhimurium LT2
gcccgcucguuuca

SEQ ID NO: 1828630 - RNA, 14 nt, Salmonella typhimurium LT2
gcccgcuuccguca

SEQ ID NO: 1828631 - RNA, 13 nt, Salmonella typhimurium LT2
gcccgcgccaucc

SEQ ID NO: 1828632 - RNA, 23 nt, Salmonella typhimurium LT2
gcccgcgccgggguggauggcgc

SEQ ID NO: 1828633 - RNA, 21 nt, Salmonella typhimurium LT2
gcccgcggcgaucaccacgcc

SEQ ID NO: 1828634 - RNA, 14 nt, Salmonella typhimurium LT2
cguccgccaacagc

SEQ ID NO: 1828635 - RNA, 14 nt, Salmonella typhimurium LT2
cguccauaagcgcg

SEQ ID NO: 1828636 - RNA, 13 nt, Salmonella typhimurium LT2
cgucauucuggua

SEQ ID NO: 1828637 - RNA, 16 nt, Salmonella typhimurium LT2
cgucauuaaagcgcuc

SEQ ID NO: 1828638 - RNA, 13 nt, Salmonella typhimurium LT2
cgucauuacggua

SEQ ID NO: 1828639 - RNA, 11 nt, Salmonella typhimurium LT2
cgucagcgcca

SEQ ID NO: 1828640 - RNA, 15 nt, Salmonella typhimurium LT2
cgucagcgccauccg

SEQ ID NO: 1828641 - RNA, 14 nt, Salmonella typhimurium LT2
cgucaggcgauagc

SEQ ID NO: 1828642 - RNA, 18 nt, Salmonella typhimurium LT2
cgucagguuuaaucggcg

SEQ ID NO: 1828643 - RNA, 19 nt, Salmonella typhimurium LT2
cgucauccgcguaaucgcg

SEQ ID NO: 1828644 - RNA, 12 nt, Salmonella typhimurium LT2
cgucaucccggu

SEQ ID NO: 1828645 - RNA, 19 nt, Salmonella typhimurium LT2
cgucauccggcaagcgcug

SEQ ID NO: 1828646 - RNA, 15 nt, Salmonella typhimurium LT2
cgucgaccauacgca

SEQ ID NO: 1828647 - RNA, 14 nt, Salmonella typhimurium LT2
cgucgagacggugu

SEQ ID NO: 1828648 - RNA, 16 nt, Salmonella typhimurium LT2
cguccguuagcuggca

SEQ ID NO: 1828649 - RNA, 18 nt, Salmonella typhimurium LT2
cguccgucaggaugggcu

SEQ ID NO: 1828650 - RNA, 22 nt, Salmonella typhimurium LT2
cguccggggccagcgccaguac

SEQ ID NO: 1828651 - RNA, 14 nt, Salmonella typhimurium LT2
cgucgccauccggc

SEQ ID NO: 1828652 - RNA, 13 nt, Salmonella typhimurium LT2
cguaguacgcgcg

SEQ ID NO: 1828653 - RNA, 19 nt, Salmonella typhimurium LT2
cguaguacgcgcgccggug

SEQ ID NO: 1828654 - RNA, 18 nt, Salmonella typhimurium LT2
cgucaaaaccaaacagcg

SEQ ID NO: 1828655 - RNA, 19 nt, Salmonella typhimurium LT2
cgucaaacagcuuaacgau

SEQ ID NO: 1828656 - RNA, 22 nt, Salmonella typhimurium LT2
cgucaacaaugcuuucaccagu

SEQ ID NO: 1828657 - RNA, 19 nt, Salmonella typhimurium LT2
cgucaacaccugcaucacg

SEQ ID NO: 1828658 - RNA, 20 nt, Salmonella typhimurium LT2
cguauugagcagcggcugga

SEQ ID NO: 1828659 - RNA, 14 nt, Salmonella typhimurium LT2
cguauuagcaaauc

SEQ ID NO: 1828660 - RNA, 19 nt, Salmonella typhimurium LT2
cgucagcccaaaacgcgcc

SEQ ID NO: 1828661 - RNA, 17 nt, Salmonella typhimurium LT2
cgucaccaucagcguca

SEQ ID NO: 1828662 - RNA, 17 nt, Salmonella typhimurium LT2
cguaccgcuaucgccaa

SEQ ID NO: 1828663 - RNA, 16 nt, Salmonella typhimurium LT2
cguacgcggcuugcca

SEQ ID NO: 1828664 - RNA, 14 nt, Salmonella typhimurium LT2
cguacggcgucgug

SEQ ID NO: 1828665 - RNA, 14 nt, Salmonella typhimurium LT2
cguacucagcagac

SEQ ID NO: 1828666 - RNA, 20 nt, Salmonella typhimurium LT2
cguagaucucuaucggcaaa

SEQ ID NO: 1828667 - RNA, 13 nt, Salmonella typhimurium LT2
cguagaucgccag

SEQ ID NO: 1828668 - RNA, 11 nt, Salmonella typhimurium LT2
cguagcgccau

SEQ ID NO: 1828669 - RNA, 19 nt, Salmonella typhimurium LT2
cguagcgccaucaggcaua

SEQ ID NO: 1828670 - RNA, 20 nt, Salmonella typhimurium LT2
cguagcguacugcagcgucu

SEQ ID NO: 1828671 - RNA, 19 nt, Salmonella typhimurium LT2
cguagcuguaacaguccgu

SEQ ID NO: 1828672 - RNA, 15 nt, Salmonella typhimurium LT2
cguaacgguucggua

SEQ ID NO: 1828673 - RNA, 14 nt, Salmonella typhimurium LT2
cguaaauucugauu

SEQ ID NO: 1828674 - RNA, 17 nt, Salmonella typhimurium LT2
cguaaauacccaggcca

SEQ ID NO: 1828675 - RNA, 17 nt, Salmonella typhimurium LT2
cguaacgugcuccagcg

SEQ ID NO: 1828676 - RNA, 12 nt, Salmonella typhimurium LT2
cguaagcgcguu

SEQ ID NO: 1828677 - RNA, 15 nt, Salmonella typhimurium LT2
cgguuuaagccgcug

SEQ ID NO: 1828678 - RNA, 13 nt, Salmonella typhimurium LT2
cgguuuacgccau

SEQ ID NO: 1828679 - RNA, 21 nt, Salmonella typhimurium LT2
cgguuuaguaguaaucgauac

SEQ ID NO: 1828680 - RNA, 19 nt, Salmonella typhimurium LT2
cguaaacggcagccgccac

SEQ ID NO: 1828681 - RNA, 20 nt, Salmonella typhimurium LT2
cgguuguccacugaccggaa

SEQ ID NO: 1828682 - RNA, 17 nt, Salmonella typhimurium LT2
cgguucagucagcgcga

SEQ ID NO: 1828683 - RNA, 15 nt, Salmonella typhimurium LT2
cgguugccugcguca

SEQ ID NO: 1828684 - RNA, 16 nt, Salmonella typhimurium LT2
cgguugccaaugcgga

SEQ ID NO: 1828685 - RNA, 18 nt, Salmonella typhimurium LT2
cggugucaaagcgccaga

SEQ ID NO: 1828686 - RNA, 14 nt, Salmonella typhimurium LT2
cgguguagcuggca

SEQ ID NO: 1828687 - RNA, 19 nt, Salmonella typhimurium LT2
cguggcggaaaauccgcau

SEQ ID NO: 1828688 - RNA, 21 nt, Salmonella typhimurium LT2
cgugguaucgcggcagcgcug

SEQ ID NO: 1828689 - RNA, 21 nt, Salmonella typhimurium LT2
cguguccggguucgcggcaaa

SEQ ID NO: 1828690 - RNA, 18 nt, Salmonella typhimurium LT2
cguguacggccugauaac

SEQ ID NO: 1828691 - RNA, 14 nt, Salmonella typhimurium LT2
cguguaccgucacu

SEQ ID NO: 1828692 - RNA, 17 nt, Salmonella typhimurium LT2
cguggugcuuagcuggc

SEQ ID NO: 1828693 - RNA, 16 nt, Salmonella typhimurium LT2
cguguaaggcaaucgc

SEQ ID NO: 1828694 - RNA, 14 nt, Salmonella typhimurium LT2
cguguaaucgccgu

SEQ ID NO: 1828695 - RNA, 21 nt, Salmonella typhimurium LT2
cguguaagagcuggucggauc

SEQ ID NO: 1828696 - RNA, 12 nt, Salmonella typhimurium LT2
cguguaaaugac

SEQ ID NO: 1828697 - RNA, 13 nt, Salmonella typhimurium LT2
cguucaucaggca

SEQ ID NO: 1828698 - RNA, 17 nt, Salmonella typhimurium LT2
cguucauccaugauggc

SEQ ID NO: 1828699 - RNA, 20 nt, Salmonella typhimurium LT2
cguucugcugugccgggaaa

SEQ ID NO: 1828700 - RNA, 17 nt, Salmonella typhimurium LT2
cguucugguugaccgga

SEQ ID NO: 1828701 - RNA, 20 nt, Salmonella typhimurium LT2
cguucgcauauucugcgaaa

SEQ ID NO: 1828702 - RNA, 15 nt, Salmonella typhimurium LT2
cguuccccaacagcg

SEQ ID NO: 1828703 - RNA, 19 nt, Salmonella typhimurium LT2
cguguucuguacuuccggc

SEQ ID NO: 1828704 - RNA, 22 nt, Salmonella typhimurium LT2
cguuaaauaccagcaccugaau

SEQ ID NO: 1828705 - RNA, 19 nt, Salmonella typhimurium LT2
cguuaccagcaucaauagc

SEQ ID NO: 1828706 - RNA, 20 nt, Salmonella typhimurium LT2
cguuacccgauaccgccagc

SEQ ID NO: 1828707 - RNA, 17 nt, Salmonella typhimurium LT2
cguuaccgcucaaacgc

SEQ ID NO: 1828708 - RNA, 17 nt, Salmonella typhimurium LT2
cguucaaagccgccauc

SEQ ID NO: 1828709 - RNA, 13 nt, Salmonella typhimurium LT2
cguucaaaucgca

SEQ ID NO: 1828710 - RNA, 22 nt, Salmonella typhimurium LT2
cguuaggaaagcaguaacgcau

SEQ ID NO: 1828711 - RNA, 23 nt, Salmonella typhimurium LT2
cguuaucguagugccacaacgcc

SEQ ID NO: 1828712 - RNA, 16 nt, Salmonella typhimurium LT2
cgucucuuucauggaa

SEQ ID NO: 1828713 - RNA, 14 nt, Salmonella typhimurium LT2
cgucuuauccggua

SEQ ID NO: 1828714 - RNA, 12 nt, Salmonella typhimurium LT2
cgugaccaucgc

SEQ ID NO: 1828715 - RNA, 16 nt, Salmonella typhimurium LT2
cgugaccauuccggua

SEQ ID NO: 1828716 - RNA, 19 nt, Salmonella typhimurium LT2
cgugacaugcgcauugacg

SEQ ID NO: 1828717 - RNA, 15 nt, Salmonella typhimurium LT2
cgucuacgucaggaa

SEQ ID NO: 1828718 - RNA, 13 nt, Salmonella typhimurium LT2
cgugagcgcaucc

SEQ ID NO: 1828719 - RNA, 20 nt, Salmonella typhimurium LT2
cgugagcaaccaacgcgaua

SEQ ID NO: 1828720 - RNA, 13 nt, Salmonella typhimurium LT2
cgugagcgcguca

SEQ ID NO: 1828721 - RNA, 18 nt, Salmonella typhimurium LT2
cgugauucacccgcguga

SEQ ID NO: 1828722 - RNA, 19 nt, Salmonella typhimurium LT2
cgugagaaguaagcgccag

SEQ ID NO: 1828723 - RNA, 11 nt, Salmonella typhimurium LT2
cgugaccugcu

SEQ ID NO: 1828724 - RNA, 14 nt, Salmonella typhimurium LT2
cguggcaaucagca

SEQ ID NO: 1828725 - RNA, 22 nt, Salmonella typhimurium LT2
cguggaugauguuucuucgccc

SEQ ID NO: 1828726 - RNA, 14 nt, Salmonella typhimurium LT2
cguggauagccauc

SEQ ID NO: 1828727 - RNA, 20 nt, Salmonella typhimurium LT2
cugaauguucucgcuugccg

SEQ ID NO: 1828728 - RNA, 16 nt, Salmonella typhimurium LT2
cugaauucgccaccag

SEQ ID NO: 1828729 - RNA, 14 nt, Salmonella typhimurium LT2
cugaaugccaucca

SEQ ID NO: 1828730 - RNA, 20 nt, Salmonella typhimurium LT2
cugaaugccauccagcacca

SEQ ID NO: 1828731 - RNA, 16 nt, Salmonella typhimurium LT2
cugacagcgcgcgaau

SEQ ID NO: 1828732 - RNA, 17 nt, Salmonella typhimurium LT2
cugaauaacagcaccau

SEQ ID NO: 1828733 - RNA, 14 nt, Salmonella typhimurium LT2
cugaauaacccgca

SEQ ID NO: 1828734 - RNA, 17 nt, Salmonella typhimurium LT2
cugaacuguaaccggcg

SEQ ID NO: 1828735 - RNA, 16 nt, Salmonella typhimurium LT2
cugaacgccaggccgu

SEQ ID NO: 1828736 - RNA, 21 nt, Salmonella typhimurium LT2
cucugagcauacacauucagg

SEQ ID NO: 1828737 - RNA, 15 nt, Salmonella typhimurium LT2
cucugcgcaauguuc

SEQ ID NO: 1828738 - RNA, 20 nt, Salmonella typhimurium LT2
cugaaaaaccgucggcaaua

SEQ ID NO: 1828739 - RNA, 14 nt, Salmonella typhimurium LT2
cugaacaucgccgu

SEQ ID NO: 1828740 - RNA, 13 nt, Salmonella typhimurium LT2
cucuugucaggca

SEQ ID NO: 1828741 - RNA, 23 nt, Salmonella typhimurium LT2
cucuuucgcuguaggccggauaa

SEQ ID NO: 1828742 - RNA, 12 nt, Salmonella typhimurium LT2
cucuuucaugga

SEQ ID NO: 1828743 - RNA, 14 nt, Salmonella typhimurium LT2
cucguugcgucgug

SEQ ID NO: 1828744 - RNA, 11 nt, Salmonella typhimurium LT2
cucuaaagcgc

SEQ ID NO: 1828745 - RNA, 14 nt, Salmonella typhimurium LT2
cucuaccggauaaa

SEQ ID NO: 1828746 - RNA, 17 nt, Salmonella typhimurium LT2
cucuaacgucagcgcca

SEQ ID NO: 1828747 - RNA, 20 nt, Salmonella typhimurium LT2
cucgucgguaaaaaugcaau

SEQ ID NO: 1828748 - RNA, 17 nt, Salmonella typhimurium LT2
cugaugagcgcagcgac

SEQ ID NO: 1828749 - RNA, 18 nt, Salmonella typhimurium LT2
cugaugagcaauaccuga

SEQ ID NO: 1828750 - RNA, 17 nt, Salmonella typhimurium LT2
cugaucgcugagcgcca

SEQ ID NO: 1828751 - RNA, 21 nt, Salmonella typhimurium LT2
cugaucguggccacacuucgg

SEQ ID NO: 1828752 - RNA, 17 nt, Salmonella typhimurium LT2
cugcaacaacucgagca

SEQ ID NO: 1828753 - RNA, 20 nt, Salmonella typhimurium LT2
cugcaccaaauccuccagcg

SEQ ID NO: 1828754 - RNA, 22 nt, Salmonella typhimurium LT2
cugauauacgaagcgccauccg

SEQ ID NO: 1828755 - RNA, 14 nt, Salmonella typhimurium LT2
cugauagccgccag

SEQ ID NO: 1828756 - RNA, 20 nt, Salmonella typhimurium LT2
cugagcggcucauccagcaa

SEQ ID NO: 1828757 - RNA, 16 nt, Salmonella typhimurium LT2
cugagcgccagcgugc

SEQ ID NO: 1828758 - RNA, 22 nt, Salmonella typhimurium LT2
cugacgugaugauaggucagcg

SEQ ID NO: 1828759 - RNA, 13 nt, Salmonella typhimurium LT2
cugaccagcgacg

SEQ ID NO: 1828760 - RNA, 17 nt, Salmonella typhimurium LT2
cugaccgcguuuccacg

SEQ ID NO: 1828761 - RNA, 15 nt, Salmonella typhimurium LT2
cugccuuauccggcc

SEQ ID NO: 1828762 - RNA, 16 nt, Salmonella typhimurium LT2
cugcgaaucccggcca

SEQ ID NO: 1828763 - RNA, 22 nt, Salmonella typhimurium LT2
cugccguccgaucucguuaacg

SEQ ID NO: 1828764 - RNA, 17 nt, Salmonella typhimurium LT2
cugccguaccguugccg

SEQ ID NO: 1828765 - RNA, 22 nt, Salmonella typhimurium LT2
cugccgauugccgcucagcucg

SEQ ID NO: 1828766 - RNA, 14 nt, Salmonella typhimurium LT2
cugccgcaucugac

SEQ ID NO: 1828767 - RNA, 18 nt, Salmonella typhimurium LT2
cugcccuuucuucaacgg

SEQ ID NO: 1828768 - RNA, 12 nt, Salmonella typhimurium LT2
cugccgccaucg

SEQ ID NO: 1828769 - RNA, 17 nt, Salmonella typhimurium LT2
cugccgcccuuucccga

SEQ ID NO: 1828770 - RNA, 18 nt, Salmonella typhimurium LT2
cugccgccguaacgugcu

SEQ ID NO: 1828771 - RNA, 15 nt, Salmonella typhimurium LT2
cugccggauggcggc

SEQ ID NO: 1828772 - RNA, 17 nt, Salmonella typhimurium LT2
cugcaggugcguuggcu

SEQ ID NO: 1828773 - RNA, 15 nt, Salmonella typhimurium LT2
cugcaucgacauccg

SEQ ID NO: 1828774 - RNA, 17 nt, Salmonella typhimurium LT2
cugcaucgugagcgcgu

SEQ ID NO: 1828775 - RNA, 16 nt, Salmonella typhimurium LT2
cugcaucaacaggcga

SEQ ID NO: 1828776 - RNA, 13 nt, Salmonella typhimurium LT2
cugcauaaacgcg

SEQ ID NO: 1828777 - RNA, 20 nt, Salmonella typhimurium LT2
cugccaccacgcggccuccg

SEQ ID NO: 1828778 - RNA, 23 nt, Salmonella typhimurium LT2
cugccaccacgcggccuccggcg

SEQ ID NO: 1828779 - RNA, 19 nt, Salmonella typhimurium LT2
cugcccgccgccaccaugu

SEQ ID NO: 1828780 - RNA, 17 nt, Salmonella typhimurium LT2
cugccauuguuccggcg

SEQ ID NO: 1828781 - RNA, 18 nt, Salmonella typhimurium LT2
cugccauuguuccggcga

SEQ ID NO: 1828782 - RNA, 19 nt, Salmonella typhimurium LT2
cugccagucugcccggcaa

SEQ ID NO: 1828783 - RNA, 17 nt, Salmonella typhimurium LT2
cugccauagccgguaug

SEQ ID NO: 1828784 - RNA, 15 nt, Salmonella typhimurium LT2
cugccagaccggcga

SEQ ID NO: 1828785 - RNA, 15 nt, Salmonella typhimurium LT2
cugccagcaccagca

SEQ ID NO: 1828786 - RNA, 15 nt, Salmonella typhimurium LT2
cugccaggccaucug

SEQ ID NO: 1828787 - RNA, 20 nt, Salmonella typhimurium LT2
cugccaggacgauauccacg

SEQ ID NO: 1828788 - RNA, 16 nt, Salmonella typhimurium LT2
cugccaggauccguuc

SEQ ID NO: 1828789 - RNA, 17 nt, Salmonella typhimurium LT2
cucggcauacaccgcca

SEQ ID NO: 1828790 - RNA, 21 nt, Salmonella typhimurium LT2
cucgcugccggaaagccccag

SEQ ID NO: 1828791 - RNA, 15 nt, Salmonella typhimurium LT2
cucgcugauggagau

SEQ ID NO: 1828792 - RNA, 15 nt, Salmonella typhimurium LT2
cucgcggcggaccgc

SEQ ID NO: 1828793 - RNA, 21 nt, Salmonella typhimurium LT2
cucgcaggccaaacagcggcu

SEQ ID NO: 1828794 - RNA, 15 nt, Salmonella typhimurium LT2
cucgcacauaucgca

SEQ ID NO: 1828795 - RNA, 12 nt, Salmonella typhimurium LT2
cucgccagcgca

SEQ ID NO: 1828796 - RNA, 19 nt, Salmonella typhimurium LT2
cuccgcccggugcucaaua

SEQ ID NO: 1828797 - RNA, 19 nt, Salmonella typhimurium LT2
cuccgccgauaagcguugu

SEQ ID NO: 1828798 - RNA, 21 nt, Salmonella typhimurium LT2
cucccugccaggccaucugau

SEQ ID NO: 1828799 - RNA, 23 nt, Salmonella typhimurium LT2
cucccuuucuucucaacgccgga

SEQ ID NO: 1828800 - RNA, 20 nt, Salmonella typhimurium LT2
cuccgcguagcccagcgccg

SEQ ID NO: 1828801 - RNA, 14 nt, Salmonella typhimurium LT2
cuccgcgcuggcaa

SEQ ID NO: 1828802 - RNA, 12 nt, Salmonella typhimurium LT2
cuccgcuuccac

SEQ ID NO: 1828803 - RNA, 13 nt, Salmonella typhimurium LT2
cuccggcacuggc

SEQ ID NO: 1828804 - RNA, 23 nt, Salmonella typhimurium LT2
cuccggcgcgaacggcaucuacu

SEQ ID NO: 1828805 - RNA, 17 nt, Salmonella typhimurium LT2
cuccugugcucccgcgc

SEQ ID NO: 1828806 - RNA, 20 nt, Salmonella typhimurium LT2
cuccuguugaagauuagccg

SEQ ID NO: 1828807 - RNA, 16 nt, Salmonella typhimurium LT2
cuccggcucgucccgc

SEQ ID NO: 1828808 - RNA, 21 nt, Salmonella typhimurium LT2
cuccgggccgugauccugguc

SEQ ID NO: 1828809 - RNA, 18 nt, Salmonella typhimurium LT2
cuccucgcaggcucgucg

SEQ ID NO: 1828810 - RNA, 13 nt, Salmonella typhimurium LT2
cucgacgccuucu

SEQ ID NO: 1828811 - RNA, 16 nt, Salmonella typhimurium LT2
cuagcgccuuauccgg

SEQ ID NO: 1828812 - RNA, 14 nt, Salmonella typhimurium LT2
cuauacgcggcgua

SEQ ID NO: 1828813 - RNA, 16 nt, Salmonella typhimurium LT2
cucaacauugccggca

SEQ ID NO: 1828814 - RNA, 21 nt, Salmonella typhimurium LT2
cucaacccggacauccauccg

SEQ ID NO: 1828815 - RNA, 15 nt, Salmonella typhimurium LT2
cuaugccaagcgcaa

SEQ ID NO: 1828816 - RNA, 15 nt, Salmonella typhimurium LT2
cucaaaccccagauu

SEQ ID NO: 1828817 - RNA, 16 nt, Salmonella typhimurium LT2
cucaagcguucucacg

SEQ ID NO: 1828818 - RNA, 16 nt, Salmonella typhimurium LT2
cucaauaucguugccg

SEQ ID NO: 1828819 - RNA, 16 nt, Salmonella typhimurium LT2
cucaauauuaucuucg

SEQ ID NO: 1828820 - RNA, 15 nt, Salmonella typhimurium LT2
cucaauuauuaaucu

SEQ ID NO: 1828821 - RNA, 16 nt, Salmonella typhimurium LT2
cuacaggcgucacggc

SEQ ID NO: 1828822 - RNA, 17 nt, Salmonella typhimurium LT2
cuacagggcguuuuaua

SEQ ID NO: 1828823 - RNA, 14 nt, Salmonella typhimurium LT2
cguucugugcgccg

SEQ ID NO: 1828824 - RNA, 18 nt, Salmonella typhimurium LT2
cuacguucaucaggcaau

SEQ ID NO: 1828825 - RNA, 13 nt, Salmonella typhimurium LT2
cuaccgcuuccca

SEQ ID NO: 1828826 - RNA, 23 nt, Salmonella typhimurium LT2
cuaccggaccgguauuaccaaua

SEQ ID NO: 1828827 - RNA, 15 nt, Salmonella typhimurium LT2
cuaccgcgccagccg

SEQ ID NO: 1828828 - RNA, 14 nt, Salmonella typhimurium LT2
cuacucccgucgcc

SEQ ID NO: 1828829 - RNA, 11 nt, Salmonella typhimurium LT2
cucccaacaga

SEQ ID NO: 1828830 - RNA, 16 nt, Salmonella typhimurium LT2
cuccauugcagcgugg

SEQ ID NO: 1828831 - RNA, 16 nt, Salmonella typhimurium LT2
cuccagcuucaucauc

SEQ ID NO: 1828832 - RNA, 19 nt, Salmonella typhimurium LT2
cuccaggccaagcgccugu

SEQ ID NO: 1828833 - RNA, 22 nt, Salmonella typhimurium LT2
cuccagcgccugcugcaacguc

SEQ ID NO: 1828834 - RNA, 13 nt, Salmonella typhimurium LT2
cuccagcagacga

SEQ ID NO: 1828835 - RNA, 15 nt, Salmonella typhimurium LT2
cuccagccagcgcca

SEQ ID NO: 1828836 - RNA, 14 nt, Salmonella typhimurium LT2
cucauuacgccacg

SEQ ID NO: 1828837 - RNA, 16 nt, Salmonella typhimurium LT2
cucauuaugccucccg

SEQ ID NO: 1828838 - RNA, 19 nt, Salmonella typhimurium LT2
cucacauucauugccgcca

SEQ ID NO: 1828839 - RNA, 21 nt, Salmonella typhimurium LT2
cucacauucauugccgccagu

SEQ ID NO: 1828840 - RNA, 15 nt, Salmonella typhimurium LT2
cucagcgcggcagcc

SEQ ID NO: 1828841 - RNA, 21 nt, Salmonella typhimurium LT2
cucaucaguuugcgauaagcg

SEQ ID NO: 1828842 - RNA, 19 nt, Salmonella typhimurium LT2
cucaggguccccauauccc

SEQ ID NO: 1828843 - RNA, 17 nt, Salmonella typhimurium LT2
cucaggguuuucuaccg

SEQ ID NO: 1828844 - RNA, 13 nt, Salmonella typhimurium LT2
cucauccagcaac

SEQ ID NO: 1828845 - RNA, 11 nt, Salmonella typhimurium LT2
cucaucgacuu

SEQ ID NO: 1828846 - RNA, 14 nt, Salmonella typhimurium LT2
cucaucgacgauaa

SEQ ID NO: 1828847 - RNA, 19 nt, Salmonella typhimurium LT2
gacagcaggaacggcagga

SEQ ID NO: 1828848 - RNA, 19 nt, Salmonella typhimurium LT2
gacagcgcgcccagcaggg

SEQ ID NO: 1828849 - RNA, 13 nt, Salmonella typhimurium LT2
gaccagauauccc

SEQ ID NO: 1828850 - RNA, 21 nt, Salmonella typhimurium LT2
gaccagauaaucaaacgcgcc

SEQ ID NO: 1828851 - RNA, 18 nt, Salmonella typhimurium LT2
gacaucgccaaccgcgac

SEQ ID NO: 1828852 - RNA, 14 nt, Salmonella typhimurium LT2
gacauccgccaucc

SEQ ID NO: 1828853 - RNA, 15 nt, Salmonella typhimurium LT2
gacauccgccaucca

SEQ ID NO: 1828854 - RNA, 11 nt, Salmonella typhimurium LT2
gacaucagcca

SEQ ID NO: 1828855 - RNA, 16 nt, Salmonella typhimurium LT2
gacaguaguaucaucc

SEQ ID NO: 1828856 - RNA, 21 nt, Salmonella typhimurium LT2
gacaguccgggccgugacaca

SEQ ID NO: 1828857 - RNA, 23 nt, Salmonella typhimurium LT2
gaaucuauuauuaaucugguauc

SEQ ID NO: 1828858 - RNA, 15 nt, Salmonella typhimurium LT2
gaaugaauagcggca

SEQ ID NO: 1828859 - RNA, 20 nt, Salmonella typhimurium LT2
gaaucccgccaucguccagc

SEQ ID NO: 1828860 - RNA, 22 nt, Salmonella typhimurium LT2
gaaucagcaacacaaucaggcg

SEQ ID NO: 1828861 - RNA, 21 nt, Salmonella typhimurium LT2
gaaucacauccgccagcgccu

SEQ ID NO: 1828862 - RNA, 17 nt, Salmonella typhimurium LT2
gaauacggagaacggca

SEQ ID NO: 1828863 - RNA, 20 nt, Salmonella typhimurium LT2
gaauaccaagucucaagagu

SEQ ID NO: 1828864 - RNA, 18 nt, Salmonella typhimurium LT2
gaauaaccucaacgucgc

SEQ ID NO: 1828865 - RNA, 18 nt, Salmonella typhimurium LT2
gaauaauacacgcgacaa

SEQ ID NO: 1828866 - RNA, 17 nt, Salmonella typhimurium LT2
gaauaaucauccgcuuc

SEQ ID NO: 1828867 - RNA, 15 nt, Salmonella typhimurium LT2
gaauaaucucaucgc

SEQ ID NO: 1828868 - RNA, 20 nt, Salmonella typhimurium LT2
gaacucggucaggguaauag

SEQ ID NO: 1828869 - RNA, 16 nt, Salmonella typhimurium LT2
gaacucgucuuauccg

SEQ ID NO: 1828870 - RNA, 13 nt, Salmonella typhimurium LT2
gaacugcagcgcg

SEQ ID NO: 1828871 - RNA, 20 nt, Salmonella typhimurium LT2
gaacugcccggagccaaugu

SEQ ID NO: 1828872 - RNA, 17 nt, Salmonella typhimurium LT2
gaacucuucgcaaccgg

SEQ ID NO: 1828873 - RNA, 10 nt, Salmonella typhimurium LT2
gaauggcuuc

SEQ ID NO: 1828874 - RNA, 21 nt, Salmonella typhimurium LT2
gaauuuuguagguuccgacaa

SEQ ID NO: 1828875 - RNA, 23 nt, Salmonella typhimurium LT2
gacaaaacuuuuggugcccaucg

SEQ ID NO: 1828876 - RNA, 22 nt, Salmonella typhimurium LT2
gaauuuaucaauaaccgccagc

SEQ ID NO: 1828877 - RNA, 19 nt, Salmonella typhimurium LT2
gaauuuggucguaagaauu

SEQ ID NO: 1828878 - RNA, 22 nt, Salmonella typhimurium LT2
gacaaucucaaugccacgccgu

SEQ ID NO: 1828879 - RNA, 15 nt, Salmonella typhimurium LT2
gacaauaugaccacu

SEQ ID NO: 1828880 - RNA, 20 nt, Salmonella typhimurium LT2
gacacaguauucaccuggaa

SEQ ID NO: 1828881 - RNA, 19 nt, Salmonella typhimurium LT2
gacacagguaagccuggca

SEQ ID NO: 1828882 - RNA, 15 nt, Salmonella typhimurium LT2
gacaacggcggauga

SEQ ID NO: 1828883 - RNA, 19 nt, Salmonella typhimurium LT2
gacaacguaaacggcagcc

SEQ ID NO: 1828884 - RNA, 20 nt, Salmonella typhimurium LT2
gacaacuucuuugcuauccg

SEQ ID NO: 1828885 - RNA, 14 nt, Salmonella typhimurium LT2
gaccguauccgcca

SEQ ID NO: 1828886 - RNA, 20 nt, Salmonella typhimurium LT2
gacgaaauagcguucugguu

SEQ ID NO: 1828887 - RNA, 15 nt, Salmonella typhimurium LT2
gaccuuuuucaucac

SEQ ID NO: 1828888 - RNA, 14 nt, Salmonella typhimurium LT2
gaccgcacagcaga

SEQ ID NO: 1828889 - RNA, 21 nt, Salmonella typhimurium LT2
gaccgccaagcgcggacagca

SEQ ID NO: 1828890 - RNA, 18 nt, Salmonella typhimurium LT2
gaccgauugacugaagau

SEQ ID NO: 1828891 - RNA, 23 nt, Salmonella typhimurium LT2
gaccaguugcaggcauagcggac

SEQ ID NO: 1828892 - RNA, 15 nt, Salmonella typhimurium LT2
gaccauaauuuccgg

SEQ ID NO: 1828893 - RNA, 22 nt, Salmonella typhimurium LT2
gaccauaauuuccggcgcaucg

SEQ ID NO: 1828894 - RNA, 14 nt, Salmonella typhimurium LT2
gaccaguuauucgg

SEQ ID NO: 1828895 - RNA, 17 nt, Salmonella typhimurium LT2
gaccagguugccagcgg

SEQ ID NO: 1828896 - RNA, 23 nt, Salmonella typhimurium LT2
gaccaucaauccgggugccguag

SEQ ID NO: 1828897 - RNA, 16 nt, Salmonella typhimurium LT2
gaccaugcauauaaga

SEQ ID NO: 1828898 - RNA, 13 nt, Salmonella typhimurium LT2
gacccgaaccugc

SEQ ID NO: 1828899 - RNA, 14 nt, Salmonella typhimurium LT2
gacccgaaccugcg

SEQ ID NO: 1828900 - RNA, 13 nt, Salmonella typhimurium LT2
gaccgauagagac

SEQ ID NO: 1828901 - RNA, 21 nt, Salmonella typhimurium LT2
gacgcuuugcuguacauaucc

SEQ ID NO: 1828902 - RNA, 17 nt, Salmonella typhimurium LT2
gacgcuuaccgcgucuu

SEQ ID NO: 1828903 - RNA, 14 nt, Salmonella typhimurium LT2
gacgcugauagcca

SEQ ID NO: 1828904 - RNA, 12 nt, Salmonella typhimurium LT2
gacgcuggcgca

SEQ ID NO: 1828905 - RNA, 20 nt, Salmonella typhimurium LT2
gacgcuggaaguacgccucg

SEQ ID NO: 1828906 - RNA, 18 nt, Salmonella typhimurium LT2
gacgcugcgcuuauccgg

SEQ ID NO: 1828907 - RNA, 16 nt, Salmonella typhimurium LT2
gacgcuccugaaucgc

SEQ ID NO: 1828908 - RNA, 23 nt, Salmonella typhimurium LT2
gacgcguagcgucuuauccggcc

SEQ ID NO: 1828909 - RNA, 21 nt, Salmonella typhimurium LT2
gacgcguagcgucuuauccgg

SEQ ID NO: 1828910 - RNA, 22 nt, Salmonella typhimurium LT2
gacgcguaaccccugcccgcga

SEQ ID NO: 1828911 - RNA, 13 nt, Salmonella typhimurium LT2
gacgcgccagcgg

SEQ ID NO: 1828912 - RNA, 14 nt, Salmonella typhimurium LT2
gacgcgcaggccgu

SEQ ID NO: 1828913 - RNA, 13 nt, Salmonella typhimurium LT2
gacgcgcaggccg

SEQ ID NO: 1828914 - RNA, 17 nt, Salmonella typhimurium LT2
gacgcgcacccggcuac

SEQ ID NO: 1828915 - RNA, 14 nt, Salmonella typhimurium LT2
gacgcaugaaacgc

SEQ ID NO: 1828916 - RNA, 20 nt, Salmonella typhimurium LT2
gacgcaggcgccuuauccgg

SEQ ID NO: 1828917 - RNA, 15 nt, Salmonella typhimurium LT2
gacgcccugcgccag

SEQ ID NO: 1828918 - RNA, 16 nt, Salmonella typhimurium LT2
gacggcuccagcgcca

SEQ ID NO: 1828919 - RNA, 17 nt, Salmonella typhimurium LT2
gacggcuccagcgccag

SEQ ID NO: 1828920 - RNA, 21 nt, Salmonella typhimurium LT2
gacggcggcugcgaugccauc

SEQ ID NO: 1828921 - RNA, 20 nt, Salmonella typhimurium LT2
gacggauacgcugcgucagg

SEQ ID NO: 1828922 - RNA, 17 nt, Salmonella typhimurium LT2
gacgucuuucuuaacgc

SEQ ID NO: 1828923 - RNA, 19 nt, Salmonella typhimurium LT2
gacgucuuucuucgcugca

SEQ ID NO: 1828924 - RNA, 21 nt, Salmonella typhimurium LT2
gacguaauaccgaaauccgcu

SEQ ID NO: 1828925 - RNA, 18 nt, Salmonella typhimurium LT2
gacgucgccauauccaag

SEQ ID NO: 1828926 - RNA, 13 nt, Salmonella typhimurium LT2
gacguuccgcgac

SEQ ID NO: 1828927 - RNA, 15 nt, Salmonella typhimurium LT2
gacguuauuagccgg

SEQ ID NO: 1828928 - RNA, 17 nt, Salmonella typhimurium LT2
gacguuaucgccgacaa

SEQ ID NO: 1828929 - RNA, 16 nt, Salmonella typhimurium LT2
gacguggggguucaag

SEQ ID NO: 1828930 - RNA, 20 nt, Salmonella typhimurium LT2
gacguggggguucaaguccc

SEQ ID NO: 1828931 - RNA, 19 nt, Salmonella typhimurium LT2
gagauguuuuaccaguaca

SEQ ID NO: 1828932 - RNA, 14 nt, Salmonella typhimurium LT2
gagauuggcucuuu

SEQ ID NO: 1828933 - RNA, 17 nt, Salmonella typhimurium LT2
gagcaaucaguucacgc

SEQ ID NO: 1828934 - RNA, 19 nt, Salmonella typhimurium LT2
gagauaauagcugaacaua

SEQ ID NO: 1828935 - RNA, 18 nt, Salmonella typhimurium LT2
gagauauuuugucaggcc

SEQ ID NO: 1828936 - RNA, 18 nt, Salmonella typhimurium LT2
gagauauacaucugauua

SEQ ID NO: 1828937 - RNA, 18 nt, Salmonella typhimurium LT2
gagauauagaccagcgcc

SEQ ID NO: 1828938 - RNA, 20 nt, Salmonella typhimurium LT2
gagauacugcgaucgccggc

SEQ ID NO: 1828939 - RNA, 16 nt, Salmonella typhimurium LT2
gagagcguauccagca

SEQ ID NO: 1828940 - RNA, 15 nt, Salmonella typhimurium LT2
gagagaaaaucacgc

SEQ ID NO: 1828941 - RNA, 18 nt, Salmonella typhimurium LT2
gagaagccuuuuuucacc

SEQ ID NO: 1828942 - RNA, 19 nt, Salmonella typhimurium LT2
gagaauucugcgcgucggc

SEQ ID NO: 1828943 - RNA, 16 nt, Salmonella typhimurium LT2
gagaauuuccaguuca

SEQ ID NO: 1828944 - RNA, 14 nt, Salmonella typhimurium LT2
gagaauauuaacgg

SEQ ID NO: 1828945 - RNA, 23 nt, Salmonella typhimurium LT2
gagaauguggguauccacgccug

SEQ ID NO: 1828946 - RNA, 14 nt, Salmonella typhimurium LT2
gacugauaccgcgu

SEQ ID NO: 1828947 - RNA, 20 nt, Salmonella typhimurium LT2
gacguuuacgccgccauccg

SEQ ID NO: 1828948 - RNA, 17 nt, Salmonella typhimurium LT2
gacguuuggcuuauccg

SEQ ID NO: 1828949 - RNA, 16 nt, Salmonella typhimurium LT2
gacuacguucaucagg

SEQ ID NO: 1828950 - RNA, 13 nt, Salmonella typhimurium LT2
gacuacuuaccgg

SEQ ID NO: 1828951 - RNA, 16 nt, Salmonella typhimurium LT2
gacuccucaaccgacg

SEQ ID NO: 1828952 - RNA, 22 nt, Salmonella typhimurium LT2
gacuccccacaaucccgccaga

SEQ ID NO: 1828953 - RNA, 21 nt, Salmonella typhimurium LT2
gacucaucuuuuacaggccgg

SEQ ID NO: 1828954 - RNA, 17 nt, Salmonella typhimurium LT2
gacuuaaauggcgcugu

SEQ ID NO: 1828955 - RNA, 14 nt, Salmonella typhimurium LT2
gacuguccacgacg

SEQ ID NO: 1828956 - RNA, 15 nt, Salmonella typhimurium LT2
gacugcugccggaaa

SEQ ID NO: 1828957 - RNA, 18 nt, Salmonella typhimurium LT2
gacugcuaacagucgauc

SEQ ID NO: 1828958 - RNA, 19 nt, Salmonella typhimurium LT2
gacugccuacgcggccaaa

SEQ ID NO: 1828959 - RNA, 20 nt, Salmonella typhimurium LT2
gacugccggcaaaaccaugc

SEQ ID NO: 1828960 - RNA, 22 nt, Salmonella typhimurium LT2
gagaaaaccccguacaggacgg

SEQ ID NO: 1828961 - RNA, 17 nt, Salmonella typhimurium LT2
gagaaaaacaucauggc

SEQ ID NO: 1828962 - RNA, 14 nt, Salmonella typhimurium LT2
gagaaaaagcgaag

SEQ ID NO: 1828963 - RNA, 22 nt, Salmonella typhimurium LT2
gacuucacccacugcacgcgau

SEQ ID NO: 1828964 - RNA, 18 nt, Salmonella typhimurium LT2
gacuuaucaggccuacgg

SEQ ID NO: 1828965 - RNA, 22 nt, Salmonella typhimurium LT2
gacuucuuagguuuguagcgca

SEQ ID NO: 1828966 - RNA, 16 nt, Salmonella typhimurium LT2
cuguucaucaaagaaa

SEQ ID NO: 1828967 - RNA, 14 nt, Salmonella typhimurium LT2
cuguuaucaggaua

SEQ ID NO: 1828968 - RNA, 17 nt, Salmonella typhimurium LT2
cuguuaugaaacccgcc

SEQ ID NO: 1828969 - RNA, 15 nt, Salmonella typhimurium LT2
cuguuccagccgcca

SEQ ID NO: 1828970 - RNA, 17 nt, Salmonella typhimurium LT2
cuguuccuuacagcuuc

SEQ ID NO: 1828971 - RNA, 18 nt, Salmonella typhimurium LT2
cuguucgcuuaaccguga

SEQ ID NO: 1828972 - RNA, 20 nt, Salmonella typhimurium LT2
cugugccugacagcaaugag

SEQ ID NO: 1828973 - RNA, 19 nt, Salmonella typhimurium LT2
cuuagcuggccaaucagcg

SEQ ID NO: 1828974 - RNA, 19 nt, Salmonella typhimurium LT2
cuuaacagaauugcgccac

SEQ ID NO: 1828975 - RNA, 21 nt, Salmonella typhimurium LT2
cuguuuuucacuaauccccau

SEQ ID NO: 1828976 - RNA, 14 nt, Salmonella typhimurium LT2
cuuaaaugccgccg

SEQ ID NO: 1828977 - RNA, 13 nt, Salmonella typhimurium LT2
cuuaaacgccgga

SEQ ID NO: 1828978 - RNA, 20 nt, Salmonella typhimurium LT2
cuuaaaguacuucacaauca

SEQ ID NO: 1828979 - RNA, 23 nt, Salmonella typhimurium LT2
cuguucuucacgcgaagcgccga

SEQ ID NO: 1828980 - RNA, 18 nt, Salmonella typhimurium LT2
cuguucguucaaaucgca

SEQ ID NO: 1828981 - RNA, 23 nt, Salmonella typhimurium LT2
cuguugccccgcuuucagcguug

SEQ ID NO: 1828982 - RNA, 20 nt, Salmonella typhimurium LT2
cuguccgcccaacaccagca

SEQ ID NO: 1828983 - RNA, 15 nt, Salmonella typhimurium LT2
cugucgaugcggauc

SEQ ID NO: 1828984 - RNA, 14 nt, Salmonella typhimurium LT2
cuguaggccggaua

SEQ ID NO: 1828985 - RNA, 15 nt, Salmonella typhimurium LT2
cuguagcucagguuc

SEQ ID NO: 1828986 - RNA, 18 nt, Salmonella typhimurium LT2
cuguagcgcuuuuuccag

SEQ ID NO: 1828987 - RNA, 16 nt, Salmonella typhimurium LT2
cuguacuuuaaccgga

SEQ ID NO: 1828988 - RNA, 14 nt, Salmonella typhimurium LT2
cuguacgcgggaaa

SEQ ID NO: 1828989 - RNA, 14 nt, Salmonella typhimurium LT2
cugguugaccggaa

SEQ ID NO: 1828990 - RNA, 20 nt, Salmonella typhimurium LT2
cugguucaacaucagcgcua

SEQ ID NO: 1828991 - RNA, 22 nt, Salmonella typhimurium LT2
cuguaccugauggacaauccgc

SEQ ID NO: 1828992 - RNA, 22 nt, Salmonella typhimurium LT2
cuguaccguuuuguaggccgga

SEQ ID NO: 1828993 - RNA, 15 nt, Salmonella typhimurium LT2
cuguaccgccauccg

SEQ ID NO: 1828994 - RNA, 15 nt, Salmonella typhimurium LT2
cuguaaccuacgcca

SEQ ID NO: 1828995 - RNA, 17 nt, Salmonella typhimurium LT2
cuguaacuucacgccau

SEQ ID NO: 1828996 - RNA, 20 nt, Salmonella typhimurium LT2
cuguaacagacgcaggccgu

SEQ ID NO: 1828997 - RNA, 21 nt, Salmonella typhimurium LT2
cuguaaaccgccuccaggccg

SEQ ID NO: 1828998 - RNA, 15 nt, Salmonella typhimurium LT2
cuucgaugcgcucau

SEQ ID NO: 1828999 - RNA, 22 nt, Salmonella typhimurium LT2
cuucggaaugacaaacgccacc

SEQ ID NO: 1829000 - RNA, 19 nt, Salmonella typhimurium LT2
cuucgccuucgccggcaac

SEQ ID NO: 1829001 - RNA, 21 nt, Salmonella typhimurium LT2
cuucgccuuucaccagcgccu

SEQ ID NO: 1829002 - RNA, 20 nt, Salmonella typhimurium LT2
cuucacuuucaagccagccg

SEQ ID NO: 1829003 - RNA, 18 nt, Salmonella typhimurium LT2
cuucacggucaaacgcgg

SEQ ID NO: 1829004 - RNA, 13 nt, Salmonella typhimurium LT2
cuucagccggaua

SEQ ID NO: 1829005 - RNA, 23 nt, Salmonella typhimurium LT2
cuucacccuucuucuggcucaga

SEQ ID NO: 1829006 - RNA, 13 nt, Salmonella typhimurium LT2
cuuaucaggccua

SEQ ID NO: 1829007 - RNA, 14 nt, Salmonella typhimurium LT2
cuuaucaaaccagu

SEQ ID NO: 1829008 - RNA, 20 nt, Salmonella typhimurium LT2
cuucaccuuucgccgccaga

SEQ ID NO: 1829009 - RNA, 19 nt, Salmonella typhimurium LT2
cuucacgcgaagcgccgau

SEQ ID NO: 1829010 - RNA, 20 nt, Salmonella typhimurium LT2
cuucacgcuaaucccgcucg

SEQ ID NO: 1829011 - RNA, 17 nt, Salmonella typhimurium LT2
cuucagcgacaucguca

SEQ ID NO: 1829012 - RNA, 14 nt, Salmonella typhimurium LT2
cuuccaguugaaaa

SEQ ID NO: 1829013 - RNA, 21 nt, Salmonella typhimurium LT2
cuggcagguauuaauccugcg

SEQ ID NO: 1829014 - RNA, 21 nt, Salmonella typhimurium LT2
cuggagaccaccggcaaagcg

SEQ ID NO: 1829015 - RNA, 16 nt, Salmonella typhimurium LT2
cuggaggaacagcgcc

SEQ ID NO: 1829016 - RNA, 19 nt, Salmonella typhimurium LT2
cuggauagcaccauaaacg

SEQ ID NO: 1829017 - RNA, 19 nt, Salmonella typhimurium LT2
cuggauaagcgcagcgcca

SEQ ID NO: 1829018 - RNA, 20 nt, Salmonella typhimurium LT2
cuggauaagcgcagcgccau

SEQ ID NO: 1829019 - RNA, 13 nt, Salmonella typhimurium LT2
cuggcgcagcgcu

SEQ ID NO: 1829020 - RNA, 17 nt, Salmonella typhimurium LT2
cuggcgccgucacguuc

SEQ ID NO: 1829021 - RNA, 22 nt, Salmonella typhimurium LT2
cuggcgaccgccaccauccggc

SEQ ID NO: 1829022 - RNA, 20 nt, Salmonella typhimurium LT2
cuggcgaauaaaauucagcg

SEQ ID NO: 1829023 - RNA, 21 nt, Salmonella typhimurium LT2
cugggcauuaccccagcaucu

SEQ ID NO: 1829024 - RNA, 14 nt, Salmonella typhimurium LT2
cuggcuuuccugau

SEQ ID NO: 1829025 - RNA, 23 nt, Salmonella typhimurium LT2
cugggauagccaaucacgucgcc

SEQ ID NO: 1829026 - RNA, 21 nt, Salmonella typhimurium LT2
cuggcggucaauacguaacgc

SEQ ID NO: 1829027 - RNA, 18 nt, Salmonella typhimurium LT2
cugguaagcgcagcgcca

SEQ ID NO: 1829028 - RNA, 19 nt, Salmonella typhimurium LT2
cugguaaugucauccagcg

SEQ ID NO: 1829029 - RNA, 14 nt, Salmonella typhimurium LT2
cugguacggcguaa

SEQ ID NO: 1829030 - RNA, 17 nt, Salmonella typhimurium LT2
cugguacguccauccgc

SEQ ID NO: 1829031 - RNA, 16 nt, Salmonella typhimurium LT2
cugguacguccauccg

SEQ ID NO: 1829032 - RNA, 23 nt, Salmonella typhimurium LT2
cuggucgagauacugcaacgcca

SEQ ID NO: 1829033 - RNA, 23 nt, Salmonella typhimurium LT2
gaacgccgccugcgccagcgccg

SEQ ID NO: 1829034 - RNA, 15 nt, Salmonella typhimurium LT2
gaacgcgcgcgcugu

SEQ ID NO: 1829035 - RNA, 19 nt, Salmonella typhimurium LT2
gaaccguaaacgccugcac

SEQ ID NO: 1829036 - RNA, 19 nt, Salmonella typhimurium LT2
gaaccggcaucggcagcgu

SEQ ID NO: 1829037 - RNA, 19 nt, Salmonella typhimurium LT2
gaaccgucuuguacaggcg

SEQ ID NO: 1829038 - RNA, 21 nt, Salmonella typhimurium LT2
gaaccguugcgcccaucauca

SEQ ID NO: 1829039 - RNA, 14 nt, Salmonella typhimurium LT2
gaacccaucaggga

SEQ ID NO: 1829040 - RNA, 13 nt, Salmonella typhimurium LT2
gaacccaggcacc

SEQ ID NO: 1829041 - RNA, 16 nt, Salmonella typhimurium LT2
gaacagcggcggcacg

SEQ ID NO: 1829042 - RNA, 17 nt, Salmonella typhimurium LT2
gaacaggcucagcgcca

SEQ ID NO: 1829043 - RNA, 13 nt, Salmonella typhimurium LT2
gaacaggcagcgu

SEQ ID NO: 1829044 - RNA, 17 nt, Salmonella typhimurium LT2
gaacaucuuucugaaca

SEQ ID NO: 1829045 - RNA, 13 nt, Salmonella typhimurium LT2
gaacauggcuucg

SEQ ID NO: 1829046 - RNA, 17 nt, Salmonella typhimurium LT2
gaacauuuuuucagccu

SEQ ID NO: 1829047 - RNA, 19 nt, Salmonella typhimurium LT2
gaacaucgguuuguucaua

SEQ ID NO: 1829048 - RNA, 17 nt, Salmonella typhimurium LT2
gaacauaaaaacgcgcu

SEQ ID NO: 1829049 - RNA, 13 nt, Salmonella typhimurium LT2
gaacaguuucgcc

SEQ ID NO: 1829050 - RNA, 15 nt, Salmonella typhimurium LT2
gaacagggccgcauc

SEQ ID NO: 1829051 - RNA, 16 nt, Salmonella typhimurium LT2
gaacaaacuccagcac

SEQ ID NO: 1829052 - RNA, 14 nt, Salmonella typhimurium LT2
gaacaacgccaggu

SEQ ID NO: 1829053 - RNA, 20 nt, Salmonella typhimurium LT2
gaaaucaucaauggcgauuu

SEQ ID NO: 1829054 - RNA, 21 nt, Salmonella typhimurium LT2
gaaaucaucaauggcgauuuu

SEQ ID NO: 1829055 - RNA, 16 nt, Salmonella typhimurium LT2
gaaauccgcuuugagc

SEQ ID NO: 1829056 - RNA, 16 nt, Salmonella typhimurium LT2
gaaauucugcaggcca

SEQ ID NO: 1829057 - RNA, 13 nt, Salmonella typhimurium LT2
gaaauucgcgcca

SEQ ID NO: 1829058 - RNA, 12 nt, Salmonella typhimurium LT2
gaaaugcgaauc

SEQ ID NO: 1829059 - RNA, 19 nt, Salmonella typhimurium LT2
gaaaugcccauccacgcca

SEQ ID NO: 1829060 - RNA, 22 nt, Salmonella typhimurium LT2
gaaaugcccauccacgccagcu

SEQ ID NO: 1829061 - RNA, 24 nt, Salmonella typhimurium LT2
gaaaugcggguccugaucggcggc

SEQ ID NO: 1829062 - RNA, 15 nt, Salmonella typhimurium LT2
cuuuagccauucccg

SEQ ID NO: 1829063 - RNA, 14 nt, Salmonella typhimurium LT2
cuuuauaaauggca

SEQ ID NO: 1829064 - RNA, 20 nt, Salmonella typhimurium LT2
cuuuaccgccaaacgccgca

SEQ ID NO: 1829065 - RNA, 13 nt, Salmonella typhimurium LT2
cuuuaaucacccg

SEQ ID NO: 1829066 - RNA, 21 nt, Salmonella typhimurium LT2
cuuuaaucacccgcgccagca

SEQ ID NO: 1829067 - RNA, 13 nt, Salmonella typhimurium LT2
cuuuaauuccgcc

SEQ ID NO: 1829068 - RNA, 15 nt, Salmonella typhimurium LT2
cuuuacccggcgcaa

SEQ ID NO: 1829069 - RNA, 23 nt, Salmonella typhimurium LT2
cuuuacccggcgcaaacuucgca

SEQ ID NO: 1829070 - RNA, 15 nt, Salmonella typhimurium LT2
cuuuacccaccagcc

SEQ ID NO: 1829071 - RNA, 15 nt, Salmonella typhimurium LT2
cuuguuauaaacagc

SEQ ID NO: 1829072 - RNA, 15 nt, Salmonella typhimurium LT2
cuucguucauccguc

SEQ ID NO: 1829073 - RNA, 15 nt, Salmonella typhimurium LT2
cuucguuauaaggcc

SEQ ID NO: 1829074 - RNA, 12 nt, Salmonella typhimurium LT2
cuucuaccguca

SEQ ID NO: 1829075 - RNA, 15 nt, Salmonella typhimurium LT2
cuugcccauucgccg

SEQ ID NO: 1829076 - RNA, 15 nt, Salmonella typhimurium LT2
cuucggcuccagcgc

SEQ ID NO: 1829077 - RNA, 21 nt, Salmonella typhimurium LT2
cuugcgcguccgccuuugacg

SEQ ID NO: 1829078 - RNA, 21 nt, Salmonella typhimurium LT2
gaaaggcgucagccgccauca

SEQ ID NO: 1829079 - RNA, 15 nt, Salmonella typhimurium LT2
gaaagcugcaccagg

SEQ ID NO: 1829080 - RNA, 17 nt, Salmonella typhimurium LT2
gaaaguuuucgccacgu

SEQ ID NO: 1829081 - RNA, 21 nt, Salmonella typhimurium LT2
gaaauaaaucgauagcgauuu

SEQ ID NO: 1829082 - RNA, 21 nt, Salmonella typhimurium LT2
gaaauaaagaaaguagaucac

SEQ ID NO: 1829083 - RNA, 21 nt, Salmonella typhimurium LT2
gaaaucacgcucaucggcggc

SEQ ID NO: 1829084 - RNA, 16 nt, Salmonella typhimurium LT2
gaaaucagcacaaagu

SEQ ID NO: 1829085 - RNA, 18 nt, Salmonella typhimurium LT2
gaaauauuaucgccauca

SEQ ID NO: 1829086 - RNA, 17 nt, Salmonella typhimurium LT2
gaaauaagagucaggau

SEQ ID NO: 1829087 - RNA, 18 nt, Salmonella typhimurium LT2
gaaagaaaacuuuccaac

SEQ ID NO: 1829088 - RNA, 14 nt, Salmonella typhimurium LT2
gaaacucgcguagc

SEQ ID NO: 1829089 - RNA, 21 nt, Salmonella typhimurium LT2
gaaagacggcagcgccauccg

SEQ ID NO: 1829090 - RNA, 23 nt, Salmonella typhimurium LT2
gaaagacgcgcucggcagcagcg

SEQ ID NO: 1829091 - RNA, 17 nt, Salmonella typhimurium LT2
gaaagaauaaucgccgc

SEQ ID NO: 1829092 - RNA, 18 nt, Salmonella typhimurium LT2
gaaagaauuacugaauac

SEQ ID NO: 1829093 - RNA, 14 nt, Salmonella typhimurium LT2
gaaaagcagaggcc

SEQ ID NO: 1829094 - RNA, 22 nt, Salmonella typhimurium LT2
gaaaacgaaucgaaucguucgc

SEQ ID NO: 1829095 - RNA, 21 nt, Salmonella typhimurium LT2
cuuuuuuauggccaaccagau

SEQ ID NO: 1829096 - RNA, 13 nt, Salmonella typhimurium LT2
cuuuuugcauucg

SEQ ID NO: 1829097 - RNA, 20 nt, Salmonella typhimurium LT2
cuuuuucuuaagcugagccu

SEQ ID NO: 1829098 - RNA, 13 nt, Salmonella typhimurium LT2
cuuuuugagcggc

SEQ ID NO: 1829099 - RNA, 16 nt, Salmonella typhimurium LT2
cuuuuucccggugcgu

SEQ ID NO: 1829100 - RNA, 20 nt, Salmonella typhimurium LT2
cuuuuucgcucuuaucaccg

SEQ ID NO: 1829101 - RNA, 15 nt, Salmonella typhimurium LT2
cuuuuucaacagcac

SEQ ID NO: 1829102 - RNA, 17 nt, Salmonella typhimurium LT2
cuuuaucgcacggcgau

SEQ ID NO: 1829103 - RNA, 20 nt, Salmonella typhimurium LT2
cuuuaugaauaucaacgcca

SEQ ID NO: 1829104 - RNA, 23 nt, Salmonella typhimurium LT2
cuuuauugacuaguccugauaua

SEQ ID NO: 1829105 - RNA, 15 nt, Salmonella typhimurium LT2
cuuuuaacgcuuccg

SEQ ID NO: 1829106 - RNA, 22 nt, Salmonella typhimurium LT2
cuuuuaccggcgaagucgccau

SEQ ID NO: 1829107 - RNA, 18 nt, Salmonella typhimurium LT2
cuuuuacaaaacaaccgu

SEQ ID NO: 1829108 - RNA, 15 nt, Salmonella typhimurium LT2
cuuuucagcgccaga

SEQ ID NO: 1829109 - RNA, 21 nt, Salmonella typhimurium LT2
cuuuucauucagcgcgauaaa

SEQ ID NO: 1829110 - RNA, 19 nt, Salmonella typhimurium LT2
cuuuuguaucccguagccg

SEQ ID NO: 1829111 - RNA, 19 nt, Salmonella typhimurium LT2
cuuuuuacucagggcgaaa

SEQ ID NO: 1829112 - RNA, 14 nt, Salmonella typhimurium LT2
cuuuuuagcagcaa

SEQ ID NO: 1829113 - RNA, 19 nt, Salmonella typhimurium LT2
cgacauggcgguaaucgcg

SEQ ID NO: 1829114 - RNA, 21 nt, Salmonella typhimurium LT2
cgacauuaacgaugccuuaug

SEQ ID NO: 1829115 - RNA, 19 nt, Salmonella typhimurium LT2
cgacaugguuuccagcgaa

SEQ ID NO: 1829116 - RNA, 12 nt, Salmonella typhimurium LT2
cgaccaccagcu

SEQ ID NO: 1829117 - RNA, 18 nt, Salmonella typhimurium LT2
cgaccaugguucccgcca

SEQ ID NO: 1829118 - RNA, 19 nt, Salmonella typhimurium LT2
cgaccagaaucaucauguc

SEQ ID NO: 1829119 - RNA, 13 nt, Salmonella typhimurium LT2
cgaaucucaaugc

SEQ ID NO: 1829120 - RNA, 16 nt, Salmonella typhimurium LT2
cgaaucgaauacagcg

SEQ ID NO: 1829121 - RNA, 19 nt, Salmonella typhimurium LT2
cgaagaucguuauccagca

SEQ ID NO: 1829122 - RNA, 13 nt, Salmonella typhimurium LT2
cgaaggucgcgcc

SEQ ID NO: 1829123 - RNA, 16 nt, Salmonella typhimurium LT2
cgaaugcgccagcgag

SEQ ID NO: 1829124 - RNA, 13 nt, Salmonella typhimurium LT2
cgaaugcuuccgg

SEQ ID NO: 1829125 - RNA, 14 nt, Salmonella typhimurium LT2
cgacagcguaaugc

SEQ ID NO: 1829126 - RNA, 11 nt, Salmonella typhimurium LT2
cgacagcgcca

SEQ ID NO: 1829127 - RNA, 20 nt, Salmonella typhimurium LT2
cgacagcgccaucagcauca

SEQ ID NO: 1829128 - RNA, 21 nt, Salmonella typhimurium LT2
cgacagcgccauccggcaguu

SEQ ID NO: 1829129 - RNA, 23 nt, Salmonella typhimurium LT2
cgacagccgcuaucacagcggca

SEQ ID NO: 1829130 - RNA, 15 nt, Salmonella typhimurium LT2
cgacagcccgccagc

SEQ ID NO: 1829131 - RNA, 11 nt, Salmonella typhimurium LT2
ccuuccagcgc

SEQ ID NO: 1829132 - RNA, 13 nt, Salmonella typhimurium LT2
ccuuccagcgcca

SEQ ID NO: 1829133 - RNA, 14 nt, Salmonella typhimurium LT2
ccuuccagcgccau

SEQ ID NO: 1829134 - RNA, 14 nt, Salmonella typhimurium LT2
ccuucacagguggu

SEQ ID NO: 1829135 - RNA, 22 nt, Salmonella typhimurium LT2
ccuuaugggucacauccagaca

SEQ ID NO: 1829136 - RNA, 20 nt, Salmonella typhimurium LT2
ccuguugaacaaugguauaa

SEQ ID NO: 1829137 - RNA, 15 nt, Salmonella typhimurium LT2
ccuuauccagacgcu

SEQ ID NO: 1829138 - RNA, 21 nt, Salmonella typhimurium LT2
ccugucgaucauccacccggc

SEQ ID NO: 1829139 - RNA, 17 nt, Salmonella typhimurium LT2
ccuguccgcucgacuuc

SEQ ID NO: 1829140 - RNA, 16 nt, Salmonella typhimurium LT2
ccugugcaaucagcga

SEQ ID NO: 1829141 - RNA, 24 nt, Salmonella typhimurium LT2
ccuguguaucgcccugccagcuca

SEQ ID NO: 1829142 - RNA, 17 nt, Salmonella typhimurium LT2
ccuucucuuuaugcguc

SEQ ID NO: 1829143 - RNA, 22 nt, Salmonella typhimurium LT2
ccuucuccggucaucaccagau

SEQ ID NO: 1829144 - RNA, 12 nt, Salmonella typhimurium LT2
ccuucuucaucu

SEQ ID NO: 1829145 - RNA, 16 nt, Salmonella typhimurium LT2
ccuugcgaagaccgca

SEQ ID NO: 1829146 - RNA, 12 nt, Salmonella typhimurium LT2
cgaaacugccua

SEQ ID NO: 1829147 - RNA, 20 nt, Salmonella typhimurium LT2
ccuuuuuauggcccgccagc

SEQ ID NO: 1829148 - RNA, 23 nt, Salmonella typhimurium LT2
ccuuugucgaaauugccgcccgu

SEQ ID NO: 1829149 - RNA, 12 nt, Salmonella typhimurium LT2
ccuuugcccuca

SEQ ID NO: 1829150 - RNA, 18 nt, Salmonella typhimurium LT2
ccuuuuaccggcgaaguc

SEQ ID NO: 1829151 - RNA, 18 nt, Salmonella typhimurium LT2
ccuuuucccccagcaucu

SEQ ID NO: 1829152 - RNA, 11 nt, Salmonella typhimurium LT2
cgaacaggcgu

SEQ ID NO: 1829153 - RNA, 23 nt, Salmonella typhimurium LT2
cgaaccaacgacccccaccaugu

SEQ ID NO: 1829154 - RNA, 20 nt, Salmonella typhimurium LT2
cgaaccauuugccugccgca

SEQ ID NO: 1829155 - RNA, 11 nt, Salmonella typhimurium LT2
cgaacaucugc

SEQ ID NO: 1829156 - RNA, 14 nt, Salmonella typhimurium LT2
cgaacaguucgguc

SEQ ID NO: 1829157 - RNA, 14 nt, Salmonella typhimurium LT2
cgaagacggcgaaa

SEQ ID NO: 1829158 - RNA, 20 nt, Salmonella typhimurium LT2
cgaacggccugaucgaucgc

SEQ ID NO: 1829159 - RNA, 21 nt, Salmonella typhimurium LT2
cgaacgccgccugcgccagcg

SEQ ID NO: 1829160 - RNA, 15 nt, Salmonella typhimurium LT2
cgaacgacucacgcg

SEQ ID NO: 1829161 - RNA, 23 nt, Salmonella typhimurium LT2
cgaaccaucgacccccaccaugu

SEQ ID NO: 1829162 - RNA, 16 nt, Salmonella typhimurium LT2
cgacugaccagaccga

SEQ ID NO: 1829163 - RNA, 20 nt, Salmonella typhimurium LT2
cgagagaauuaacagcgcga

SEQ ID NO: 1829164 - RNA, 22 nt, Salmonella typhimurium LT2
cgagauuuuucugcgccaccag

SEQ ID NO: 1829165 - RNA, 23 nt, Salmonella typhimurium LT2
cgagcccgaggcgaaacggcgga

SEQ ID NO: 1829166 - RNA, 17 nt, Salmonella typhimurium LT2
cgagcuucucgccggaa

SEQ ID NO: 1829167 - RNA, 22 nt, Salmonella typhimurium LT2
cgagcugcgcuuuuucaucauc

SEQ ID NO: 1829168 - RNA, 19 nt, Salmonella typhimurium LT2
cgagcuauguuuaagccag

SEQ ID NO: 1829169 - RNA, 17 nt, Salmonella typhimurium LT2
cgagcgcggaggggcga

SEQ ID NO: 1829170 - RNA, 18 nt, Salmonella typhimurium LT2
cgaggcgaaacggcggaa

SEQ ID NO: 1829171 - RNA, 23 nt, Salmonella typhimurium LT2
cgaggauacggucgacaccagcg

SEQ ID NO: 1829172 - RNA, 17 nt, Salmonella typhimurium LT2
cgacggcgaccagcaaa

SEQ ID NO: 1829173 - RNA, 18 nt, Salmonella typhimurium LT2
cgacggcaggggcgugau

SEQ ID NO: 1829174 - RNA, 14 nt, Salmonella typhimurium LT2
cgacgcgcugcggu

SEQ ID NO: 1829175 - RNA, 23 nt, Salmonella typhimurium LT2
cgacgcuuugcuguacauaucca

SEQ ID NO: 1829176 - RNA, 17 nt, Salmonella typhimurium LT2
cgaccguuuccgccagu

SEQ ID NO: 1829177 - RNA, 16 nt, Salmonella typhimurium LT2
cgacgccaaacccgcc

SEQ ID NO: 1829178 - RNA, 19 nt, Salmonella typhimurium LT2
cgacgccaaacccgccaca

SEQ ID NO: 1829179 - RNA, 13 nt, Salmonella typhimurium LT2
cgacgcccgcuug

SEQ ID NO: 1829180 - RNA, 20 nt, Salmonella typhimurium LT2
cgccaucaacuccuccggcg

SEQ ID NO: 1829181 - RNA, 18 nt, Salmonella typhimurium LT2
cgccaucaacagcaggca

SEQ ID NO: 1829182 - RNA, 13 nt, Salmonella typhimurium LT2
cgccaucaggcga

SEQ ID NO: 1829183 - RNA, 18 nt, Salmonella typhimurium LT2
cgccaucaggcuggguaa

SEQ ID NO: 1829184 - RNA, 14 nt, Salmonella typhimurium LT2
cgccaucagcauca

SEQ ID NO: 1829185 - RNA, 16 nt, Salmonella typhimurium LT2
cgccaucagcaucauc

SEQ ID NO: 1829186 - RNA, 13 nt, Salmonella typhimurium LT2
cgccauccaccag

SEQ ID NO: 1829187 - RNA, 21 nt, Salmonella typhimurium LT2
cgccauaaugcuuaauucaua

SEQ ID NO: 1829188 - RNA, 21 nt, Salmonella typhimurium LT2
cgccauaauggcccagcguac

SEQ ID NO: 1829189 - RNA, 21 nt, Salmonella typhimurium LT2
cgccauaagcgaacaggccga

SEQ ID NO: 1829190 - RNA, 22 nt, Salmonella typhimurium LT2
cgccauauccgcagacuuuagc

SEQ ID NO: 1829191 - RNA, 15 nt, Salmonella typhimurium LT2
cgccauagccggcga

SEQ ID NO: 1829192 - RNA, 15 nt, Salmonella typhimurium LT2
cgccaguuggcguac

SEQ ID NO: 1829193 - RNA, 19 nt, Salmonella typhimurium LT2
cgccaucuccuccucauuc

SEQ ID NO: 1829194 - RNA, 15 nt, Salmonella typhimurium LT2
cgccaugauccagcg

SEQ ID NO: 1829195 - RNA, 14 nt, Salmonella typhimurium LT2
cgccaucgccagua

SEQ ID NO: 1829196 - RNA, 15 nt, Salmonella typhimurium LT2
cgccauccggcauuu

SEQ ID NO: 1829197 - RNA, 13 nt, Salmonella typhimurium LT2
cgccauccggcga

SEQ ID NO: 1829198 - RNA, 18 nt, Salmonella typhimurium LT2
cgccauccggcgaugccg

SEQ ID NO: 1829199 - RNA, 16 nt, Salmonella typhimurium LT2
cgccauccggcaauuu

SEQ ID NO: 1829200 - RNA, 20 nt, Salmonella typhimurium LT2
cgccaucaugcagccggcga

SEQ ID NO: 1829201 - RNA, 13 nt, Salmonella typhimurium LT2
cgccauccggcau

SEQ ID NO: 1829202 - RNA, 14 nt, Salmonella typhimurium LT2
cgccauccggcaga

SEQ ID NO: 1829203 - RNA, 14 nt, Salmonella typhimurium LT2
cgccauccggcagu

SEQ ID NO: 1829204 - RNA, 14 nt, Salmonella typhimurium LT2
cgccaguuccgcca

SEQ ID NO: 1829205 - RNA, 21 nt, Salmonella typhimurium LT2
cgccaguucauucgccaccag

SEQ ID NO: 1829206 - RNA, 14 nt, Salmonella typhimurium LT2
cgccaguucagcgu

SEQ ID NO: 1829207 - RNA, 17 nt, Salmonella typhimurium LT2
cgccaguucauccagca

SEQ ID NO: 1829208 - RNA, 18 nt, Salmonella typhimurium LT2
cgccaguucauccagcag

SEQ ID NO: 1829209 - RNA, 19 nt, Salmonella typhimurium LT2
cgccaggucucauagcgcc

SEQ ID NO: 1829210 - RNA, 19 nt, Salmonella typhimurium LT2
cgccaguacuuuggccuaa

SEQ ID NO: 1829211 - RNA, 16 nt, Salmonella typhimurium LT2
cgccacgccuaaacug

SEQ ID NO: 1829212 - RNA, 18 nt, Salmonella typhimurium LT2
cgccaccuuaaucgacuu

SEQ ID NO: 1829213 - RNA, 16 nt, Salmonella typhimurium LT2
cgccaauaguuaacgc

SEQ ID NO: 1829214 - RNA, 19 nt, Salmonella typhimurium LT2
cgccaccucgcgacgguga

SEQ ID NO: 1829215 - RNA, 19 nt, Salmonella typhimurium LT2
cgccacuacgccgaugacg

SEQ ID NO: 1829216 - RNA, 16 nt, Salmonella typhimurium LT2
cgccagaauagcgcag

SEQ ID NO: 1829217 - RNA, 16 nt, Salmonella typhimurium LT2
cgccagaacugcguaa

SEQ ID NO: 1829218 - RNA, 17 nt, Salmonella typhimurium LT2
cgccagacgcugauagc

SEQ ID NO: 1829219 - RNA, 20 nt, Salmonella typhimurium LT2
cgccagacgaacggccugau

SEQ ID NO: 1829220 - RNA, 16 nt, Salmonella typhimurium LT2
cgccagacucagccag

SEQ ID NO: 1829221 - RNA, 19 nt, Salmonella typhimurium LT2
cgccagccugaacaucuuc

SEQ ID NO: 1829222 - RNA, 19 nt, Salmonella typhimurium LT2
cgccagcgcugacaucauc

SEQ ID NO: 1829223 - RNA, 12 nt, Salmonella typhimurium LT2
cgccagcgcgac

SEQ ID NO: 1829224 - RNA, 22 nt, Salmonella typhimurium LT2
cgccagcauggucuccagcaaa

SEQ ID NO: 1829225 - RNA, 13 nt, Salmonella typhimurium LT2
cgccagccagccg

SEQ ID NO: 1829226 - RNA, 17 nt, Salmonella typhimurium LT2
cgcauucucgccgugac

SEQ ID NO: 1829227 - RNA, 14 nt, Salmonella typhimurium LT2
cgcauuuuuaucgg

SEQ ID NO: 1829228 - RNA, 13 nt, Salmonella typhimurium LT2
cgcauucucgccg

SEQ ID NO: 1829229 - RNA, 16 nt, Salmonella typhimurium LT2
cgcauucucgccguga

SEQ ID NO: 1829230 - RNA, 21 nt, Salmonella typhimurium LT2
cgccaaaacccagaaucagca

SEQ ID NO: 1829231 - RNA, 15 nt, Salmonella typhimurium LT2
cgccaaagcgcugcu

SEQ ID NO: 1829232 - RNA, 16 nt, Salmonella typhimurium LT2
cgccaaccagaccgga

SEQ ID NO: 1829233 - RNA, 19 nt, Salmonella typhimurium LT2
cgccaacgccacugccaua

SEQ ID NO: 1829234 - RNA, 12 nt, Salmonella typhimurium LT2
cgccaacgccaa

SEQ ID NO: 1829235 - RNA, 23 nt, Salmonella typhimurium LT2
cgccaaccucccaaccaguauga

SEQ ID NO: 1829236 - RNA, 14 nt, Salmonella typhimurium LT2
cgcauccagggagu

SEQ ID NO: 1829237 - RNA, 22 nt, Salmonella typhimurium LT2
cgcaucacgcgaagcggcguca

SEQ ID NO: 1829238 - RNA, 22 nt, Salmonella typhimurium LT2
cgcaucagggcgacgucagacg

SEQ ID NO: 1829239 - RNA, 11 nt, Salmonella typhimurium LT2
cgcaucaggca

SEQ ID NO: 1829240 - RNA, 18 nt, Salmonella typhimurium LT2
cgcaugucguauccccag

SEQ ID NO: 1829241 - RNA, 14 nt, Salmonella typhimurium LT2
cgcauaagcgcgaa

SEQ ID NO: 1829242 - RNA, 16 nt, Salmonella typhimurium LT2
cgcauaauuacgccca

SEQ ID NO: 1829243 - RNA, 18 nt, Salmonella typhimurium LT2
cgcauaccgaacagaaaa

SEQ ID NO: 1829244 - RNA, 13 nt, Salmonella typhimurium LT2
cgcauacgcagca

SEQ ID NO: 1829245 - RNA, 17 nt, Salmonella typhimurium LT2
cgcauacgcagcacuuu

SEQ ID NO: 1829246 - RNA, 19 nt, Salmonella typhimurium LT2
cgcaguugggcgcgcgacu

SEQ ID NO: 1829247 - RNA, 19 nt, Salmonella typhimurium LT2
cgcaucaacgccaggcaga

SEQ ID NO: 1829248 - RNA, 17 nt, Salmonella typhimurium LT2
cgcaucaaugcccagcg

SEQ ID NO: 1829249 - RNA, 15 nt, Salmonella typhimurium LT2
cgcauauuccggcga

SEQ ID NO: 1829250 - RNA, 14 nt, Salmonella typhimurium LT2
cgcauaucccacug

SEQ ID NO: 1829251 - RNA, 14 nt, Salmonella typhimurium LT2
cgcaguacggcgca

SEQ ID NO: 1829252 - RNA, 17 nt, Salmonella typhimurium LT2
cgcagugaccagcauca

SEQ ID NO: 1829253 - RNA, 22 nt, Salmonella typhimurium LT2
cgcagucagccuugaccgccug

SEQ ID NO: 1829254 - RNA, 13 nt, Salmonella typhimurium LT2
cgcaggcgauagc

SEQ ID NO: 1829255 - RNA, 23 nt, Salmonella typhimurium LT2
cgcagcguucgaaugcuuccggc

SEQ ID NO: 1829256 - RNA, 19 nt, Salmonella typhimurium LT2
cgcagcgcuuugccgcugc

SEQ ID NO: 1829257 - RNA, 14 nt, Salmonella typhimurium LT2
cgcagagcgcauca

SEQ ID NO: 1829258 - RNA, 15 nt, Salmonella typhimurium LT2
cgcagcauaucgccg

SEQ ID NO: 1829259 - RNA, 22 nt, Salmonella typhimurium LT2
cgcagcaucauaaaucgacauc

SEQ ID NO: 1829260 - RNA, 17 nt, Salmonella typhimurium LT2
cgcagccgcaaucagcg

SEQ ID NO: 1829261 - RNA, 17 nt, Salmonella typhimurium LT2
cgcagccgccauccggc

SEQ ID NO: 1829262 - RNA, 16 nt, Salmonella typhimurium LT2
cgcagccccagcgcca

SEQ ID NO: 1829263 - RNA, 20 nt, Salmonella typhimurium LT2
cgcaccaaaguuaaucagcg

SEQ ID NO: 1829264 - RNA, 15 nt, Salmonella typhimurium LT2
cgcacauaaucaccg

SEQ ID NO: 1829265 - RNA, 23 nt, Salmonella typhimurium LT2
cgcaccagccggugcucgccguu

SEQ ID NO: 1829266 - RNA, 18 nt, Salmonella typhimurium LT2
cgcaaucugcucgacgcg

SEQ ID NO: 1829267 - RNA, 13 nt, Salmonella typhimurium LT2
cgcaaucgguaaa

SEQ ID NO: 1829268 - RNA, 22 nt, Salmonella typhimurium LT2
cgcaaucggcuuugacguaaua

SEQ ID NO: 1829269 - RNA, 22 nt, Salmonella typhimurium LT2
cgcaaucauacauagcaggcca

SEQ ID NO: 1829270 - RNA, 23 nt, Salmonella typhimurium LT2
cgcaauacguuugguaccgcugg

SEQ ID NO: 1829271 - RNA, 15 nt, Salmonella typhimurium LT2
cgcaauacuguaagc

SEQ ID NO: 1829272 - RNA, 16 nt, Salmonella typhimurium LT2
cgcaauaacgccgaua

SEQ ID NO: 1829273 - RNA, 15 nt, Salmonella typhimurium LT2
cgcaagacacgcuuc

SEQ ID NO: 1829274 - RNA, 19 nt, Salmonella typhimurium LT2
cgcaacugggaaugcuaug

SEQ ID NO: 1829275 - RNA, 12 nt, Salmonella typhimurium LT2
cgcaacgugcag

SEQ ID NO: 1829276 - RNA, 15 nt, Salmonella typhimurium LT2
cgcaacucaucguca

SEQ ID NO: 1829277 - RNA, 22 nt, Salmonella typhimurium LT2
cgcaaccgguaucaaacccuuc

SEQ ID NO: 1829278 - RNA, 21 nt, Salmonella typhimurium LT2
cgcaacauugcgccucaccgg

SEQ ID NO: 1829279 - RNA, 11 nt, Salmonella typhimurium LT2
cgcaaacugcc

SEQ ID NO: 1829280 - RNA, 17 nt, Salmonella typhimurium LT2
cgcaaaaucgcaaacgc

SEQ ID NO: 1829281 - RNA, 14 nt, Salmonella typhimurium LT2
cgcaaaaccuucau

SEQ ID NO: 1829282 - RNA, 14 nt, Salmonella typhimurium LT2
cgauugcgccagac

SEQ ID NO: 1829283 - RNA, 21 nt, Salmonella typhimurium LT2
cgauugccgcucagcucgacg

SEQ ID NO: 1829284 - RNA, 16 nt, Salmonella typhimurium LT2
cgauucgcaugaauuc

SEQ ID NO: 1829285 - RNA, 21 nt, Salmonella typhimurium LT2
cgaugucguccugcgcgacgc

SEQ ID NO: 1829286 - RNA, 14 nt, Salmonella typhimurium LT2
cgaugcccggcaau

SEQ ID NO: 1829287 - RNA, 19 nt, Salmonella typhimurium LT2
cgaugcccgguaagcgcaa

SEQ ID NO: 1829288 - RNA, 12 nt, Salmonella typhimurium LT2
cgauagcgccgc

SEQ ID NO: 1829289 - RNA, 19 nt, Salmonella typhimurium LT2
cgauagcgacggcgcgcca

SEQ ID NO: 1829290 - RNA, 18 nt, Salmonella typhimurium LT2
cgauagcgaccugcggac

SEQ ID NO: 1829291 - RNA, 20 nt, Salmonella typhimurium LT2
cgauaguguaaacgcgccau

SEQ ID NO: 1829292 - RNA, 16 nt, Salmonella typhimurium LT2
cgauagucagcgcaau

SEQ ID NO: 1829293 - RNA, 17 nt, Salmonella typhimurium LT2
cgauauccgugccgccg

SEQ ID NO: 1829294 - RNA, 21 nt, Salmonella typhimurium LT2
cgauauagcgcauggcggcca

SEQ ID NO: 1829295 - RNA, 17 nt, Salmonella typhimurium LT2
cgauauccacaauguug

SEQ ID NO: 1829296 - RNA, 14 nt, Salmonella typhimurium LT2
cgauaaaucgccac

SEQ ID NO: 1829297 - RNA, 20 nt, Salmonella typhimurium LT2
cgauaacacggcuggcaaug

SEQ ID NO: 1829298 - RNA, 15 nt, Salmonella typhimurium LT2
cgauaaccaccagcg

SEQ ID NO: 1829299 - RNA, 19 nt, Salmonella typhimurium LT2
cgauaaacucaaucaggcu

SEQ ID NO: 1829300 - RNA, 14 nt, Salmonella typhimurium LT2
cgauaaacucagcg

SEQ ID NO: 1829301 - RNA, 18 nt, Salmonella typhimurium LT2
cgauaaacgccucgcucu

SEQ ID NO: 1829302 - RNA, 16 nt, Salmonella typhimurium LT2
cgauaaauaccguaau

SEQ ID NO: 1829303 - RNA, 20 nt, Salmonella typhimurium LT2
cgauaagauccgggcuggca

SEQ ID NO: 1829304 - RNA, 18 nt, Salmonella typhimurium LT2
cgauaagcgccgcgccau

SEQ ID NO: 1829305 - RNA, 14 nt, Salmonella typhimurium LT2
cgauaauacgcgcg

SEQ ID NO: 1829306 - RNA, 18 nt, Salmonella typhimurium LT2
cgaucccaauugaucggc

SEQ ID NO: 1829307 - RNA, 22 nt, Salmonella typhimurium LT2
cgauccuucaaucgguacgcca

SEQ ID NO: 1829308 - RNA, 13 nt, Salmonella typhimurium LT2
cgaucaucauucc

SEQ ID NO: 1829309 - RNA, 13 nt, Salmonella typhimurium LT2
cgaucagcgccac

SEQ ID NO: 1829310 - RNA, 20 nt, Salmonella typhimurium LT2
cgaucacggcgaaucgccug

SEQ ID NO: 1829311 - RNA, 12 nt, Salmonella typhimurium LT2
cgaucaccagca

SEQ ID NO: 1829312 - RNA, 19 nt, Salmonella typhimurium LT2
cgaucacggcgaaucgccu

SEQ ID NO: 1829313 - RNA, 20 nt, Salmonella typhimurium LT2
cgaucgguuuguuaugcgga

SEQ ID NO: 1829314 - RNA, 22 nt, Salmonella typhimurium LT2
cgaucgcuggacgucgucacca

SEQ ID NO: 1829315 - RNA, 23 nt, Salmonella typhimurium LT2
cgaugacagcaggaacggcagga

SEQ ID NO: 1829316 - RNA, 13 nt, Salmonella typhimurium LT2
cgaugagcaaagu

SEQ ID NO: 1829317 - RNA, 13 nt, Salmonella typhimurium LT2
cgaugagcgccag

SEQ ID NO: 1829318 - RNA, 13 nt, Salmonella typhimurium LT2
cgaugagcgugac

SEQ ID NO: 1829319 - RNA, 23 nt, Salmonella typhimurium LT2
cgaugaucgucgcgaucgcgcca

SEQ ID NO: 1829320 - RNA, 23 nt, Salmonella typhimurium LT2
ccgcuuacucguuuugccgauac

SEQ ID NO: 1829321 - RNA, 23 nt, Salmonella typhimurium LT2
ccgcuucaccuuucgccgccaga

SEQ ID NO: 1829322 - RNA, 20 nt, Salmonella typhimurium LT2
ccgcuuuucggcguuuaucc

SEQ ID NO: 1829323 - RNA, 20 nt, Salmonella typhimurium LT2
ccgcuuuuuguagacucgcg

SEQ ID NO: 1829324 - RNA, 16 nt, Salmonella typhimurium LT2
ccgcuuugaggaucaa

SEQ ID NO: 1829325 - RNA, 19 nt, Salmonella typhimurium LT2
ccgcuugcaccauggcggc

SEQ ID NO: 1829326 - RNA, 23 nt, Salmonella typhimurium LT2
ccgcuaugcaauuguuccugcgu

SEQ ID NO: 1829327 - RNA, 23 nt, Salmonella typhimurium LT2
ccgcuauaagcggcgucauccgg

SEQ ID NO: 1829328 - RNA, 14 nt, Salmonella typhimurium LT2
ccgcguaaucgcga

SEQ ID NO: 1829329 - RNA, 15 nt, Salmonella typhimurium LT2
ccgcggcgaucacca

SEQ ID NO: 1829330 - RNA, 22 nt, Salmonella typhimurium LT2
ccgcgcccaguuucuucaggcc

SEQ ID NO: 1829331 - RNA, 15 nt, Salmonella typhimurium LT2
ccggcaauucaauca

SEQ ID NO: 1829332 - RNA, 13 nt, Salmonella typhimurium LT2
ccggcaccagcca

SEQ ID NO: 1829333 - RNA, 14 nt, Salmonella typhimurium LT2
ccggcaggcgucau

SEQ ID NO: 1829334 - RNA, 16 nt, Salmonella typhimurium LT2
ccggccacagcgccag

SEQ ID NO: 1829335 - RNA, 17 nt, Salmonella typhimurium LT2
ccggcaugacaucagaa

SEQ ID NO: 1829336 - RNA, 22 nt, Salmonella typhimurium LT2
ccggauaacggcgcgaaagcgc

SEQ ID NO: 1829337 - RNA, 14 nt, Salmonella typhimurium LT2
ccggauaagacgcu

SEQ ID NO: 1829338 - RNA, 21 nt, Salmonella typhimurium LT2
ccggauaagcauuagcgccau

SEQ ID NO: 1829339 - RNA, 20 nt, Salmonella typhimurium LT2
ccggauaagcgcagcgccau

SEQ ID NO: 1829340 - RNA, 20 nt, Salmonella typhimurium LT2
ccggauaagcguagcgccau

SEQ ID NO: 1829341 - RNA, 20 nt, Salmonella typhimurium LT2
ccggauaagcgugagcgcau

SEQ ID NO: 1829342 - RNA, 23 nt, Salmonella typhimurium LT2
ccggauaauuuauccaguaacgc

SEQ ID NO: 1829343 - RNA, 19 nt, Salmonella typhimurium LT2
ccggauagcguagcgccau

SEQ ID NO: 1829344 - RNA, 22 nt, Salmonella typhimurium LT2
ccggauaguuacccggcaacgu

SEQ ID NO: 1829345 - RNA, 14 nt, Salmonella typhimurium LT2
ccggauagcgcugu

SEQ ID NO: 1829346 - RNA, 15 nt, Salmonella typhimurium LT2
ccggaucaccggcau

SEQ ID NO: 1829347 - RNA, 16 nt, Salmonella typhimurium LT2
ccggaucaccggcauu

SEQ ID NO: 1829348 - RNA, 20 nt, Salmonella typhimurium LT2
ccggaucaccggcauuucac

SEQ ID NO: 1829349 - RNA, 13 nt, Salmonella typhimurium LT2
ccggaucgcguuu

SEQ ID NO: 1829350 - RNA, 12 nt, Salmonella typhimurium LT2
ccggaucgccau

SEQ ID NO: 1829351 - RNA, 18 nt, Salmonella typhimurium LT2
ccggauggggcaucagcc

SEQ ID NO: 1829352 - RNA, 15 nt, Salmonella typhimurium LT2
ccggauuacgcgucu

SEQ ID NO: 1829353 - RNA, 11 nt, Salmonella typhimurium LT2
ccggauuuagc

SEQ ID NO: 1829354 - RNA, 23 nt, Salmonella typhimurium LT2
ccggauggcggcgugaacgccuu

SEQ ID NO: 1829355 - RNA, 16 nt, Salmonella typhimurium LT2
ccggauggcggcugau

SEQ ID NO: 1829356 - RNA, 22 nt, Salmonella typhimurium LT2
ccggauggcgcuaaugcuuauc

SEQ ID NO: 1829357 - RNA, 14 nt, Salmonella typhimurium LT2
ccggauggcgcugc

SEQ ID NO: 1829358 - RNA, 18 nt, Salmonella typhimurium LT2
ccggauggcgcugcgcuu

SEQ ID NO: 1829359 - RNA, 23 nt, Salmonella typhimurium LT2
ccggauggcggcauaaacgccuu

SEQ ID NO: 1829360 - RNA, 22 nt, Salmonella typhimurium LT2
ccggaugaggcgcagccgccau

SEQ ID NO: 1829361 - RNA, 22 nt, Salmonella typhimurium LT2
ccggaugacacaucaccuccag

SEQ ID NO: 1829362 - RNA, 17 nt, Salmonella typhimurium LT2
ccggaucgggcuuccag

SEQ ID NO: 1829363 - RNA, 19 nt, Salmonella typhimurium LT2
ccggacgacggcaacgcgu

SEQ ID NO: 1829364 - RNA, 15 nt, Salmonella typhimurium LT2
ccggacgccguccag

SEQ ID NO: 1829365 - RNA, 16 nt, Salmonella typhimurium LT2
ccggacaguucgccaa

SEQ ID NO: 1829366 - RNA, 13 nt, Salmonella typhimurium LT2
ccggaaugcgaau

SEQ ID NO: 1829367 - RNA, 17 nt, Salmonella typhimurium LT2
ccggacuccagcaacgc

SEQ ID NO: 1829368 - RNA, 15 nt, Salmonella typhimurium LT2
ccgcaaagcccauca

SEQ ID NO: 1829369 - RNA, 21 nt, Salmonella typhimurium LT2
ccgcaaagcccaucagcgcca

SEQ ID NO: 1829370 - RNA, 16 nt, Salmonella typhimurium LT2
ccgauuuuuuaucucg

SEQ ID NO: 1829371 - RNA, 18 nt, Salmonella typhimurium LT2
ccgauggcguaagcuuau

SEQ ID NO: 1829372 - RNA, 14 nt, Salmonella typhimurium LT2
ccgaugcccggcaa

SEQ ID NO: 1829373 - RNA, 19 nt, Salmonella typhimurium LT2
ccgacgauaaacagauaug

SEQ ID NO: 1829374 - RNA, 14 nt, Salmonella typhimurium LT2
ccgcagccgacgca

SEQ ID NO: 1829375 - RNA, 23 nt, Salmonella typhimurium LT2
ccgcagcacccguucgcugcauu

SEQ ID NO: 1829376 - RNA, 12 nt, Salmonella typhimurium LT2
ccgcacugcauc

SEQ ID NO: 1829377 - RNA, 23 nt, Salmonella typhimurium LT2
ccgcaauaacgccgauaaccagc

SEQ ID NO: 1829378 - RNA, 13 nt, Salmonella typhimurium LT2
ccgcaauaacagg

SEQ ID NO: 1829379 - RNA, 13 nt, Salmonella typhimurium LT2
ccgcagcgccaua

SEQ ID NO: 1829380 - RNA, 23 nt, Salmonella typhimurium LT2
ccgccaacgccaacauagccaca

SEQ ID NO: 1829381 - RNA, 16 nt, Salmonella typhimurium LT2
ccgccaacgauacagc

SEQ ID NO: 1829382 - RNA, 22 nt, Salmonella typhimurium LT2
ccgccaaagcaaaccaucgucg

SEQ ID NO: 1829383 - RNA, 13 nt, Salmonella typhimurium LT2
ccgccaagcgcgg

SEQ ID NO: 1829384 - RNA, 15 nt, Salmonella typhimurium LT2
ccgccaccaccgauc

SEQ ID NO: 1829385 - RNA, 16 nt, Salmonella typhimurium LT2
ccgccauagccggcga

SEQ ID NO: 1829386 - RNA, 13 nt, Salmonella typhimurium LT2
ccgccauaacggc

SEQ ID NO: 1829387 - RNA, 13 nt, Salmonella typhimurium LT2
ccgccauaauagc

SEQ ID NO: 1829388 - RNA, 20 nt, Salmonella typhimurium LT2
ccgccaugaaaaaaacgcau

SEQ ID NO: 1829389 - RNA, 21 nt, Salmonella typhimurium LT2
ccgccagcauacaaagcagau

SEQ ID NO: 1829390 - RNA, 18 nt, Salmonella typhimurium LT2
ccgccaggguaucaucaa

SEQ ID NO: 1829391 - RNA, 15 nt, Salmonella typhimurium LT2
ccgccggauggcggc

SEQ ID NO: 1829392 - RNA, 18 nt, Salmonella typhimurium LT2
ccgccgccaucgccagua

SEQ ID NO: 1829393 - RNA, 20 nt, Salmonella typhimurium LT2
ccgccuggaacccaggcacc

SEQ ID NO: 1829394 - RNA, 21 nt, Salmonella typhimurium LT2
ccgccuugcggcgccaggaca

SEQ ID NO: 1829395 - RNA, 14 nt, Salmonella typhimurium LT2
ccgcgccagcaggu

SEQ ID NO: 1829396 - RNA, 16 nt, Salmonella typhimurium LT2
ccgcgcacgccgcucg

SEQ ID NO: 1829397 - RNA, 13 nt, Salmonella typhimurium LT2
ccgcgcacgcgcg

SEQ ID NO: 1829398 - RNA, 20 nt, Salmonella typhimurium LT2
ccgcgcacgcgcgcgcguca

SEQ ID NO: 1829399 - RNA, 11 nt, Salmonella typhimurium LT2
ccguccggcag

SEQ ID NO: 1829400 - RNA, 15 nt, Salmonella typhimurium LT2
ccgucccagcggaug

SEQ ID NO: 1829401 - RNA, 14 nt, Salmonella typhimurium LT2
ccgucaccgccagu

SEQ ID NO: 1829402 - RNA, 23 nt, Salmonella typhimurium LT2
ccgucacguagucuucgucguag

SEQ ID NO: 1829403 - RNA, 18 nt, Salmonella typhimurium LT2
ccgucagagcgaggccca

SEQ ID NO: 1829404 - RNA, 15 nt, Salmonella typhimurium LT2
ccguagcgacgccau

SEQ ID NO: 1829405 - RNA, 22 nt, Salmonella typhimurium LT2
ccguagauaagcgccacgucgg

SEQ ID NO: 1829406 - RNA, 23 nt, Salmonella typhimurium LT2
ccguacucuuucggcgccugaug

SEQ ID NO: 1829407 - RNA, 19 nt, Salmonella typhimurium LT2
ccguaggccggauaagacg

SEQ ID NO: 1829408 - RNA, 21 nt, Salmonella typhimurium LT2
ccguaguuugauugccggaug

SEQ ID NO: 1829409 - RNA, 19 nt, Salmonella typhimurium LT2
ccgguuauaccgccauccg

SEQ ID NO: 1829410 - RNA, 16 nt, Salmonella typhimurium LT2
ccggguggcagcguga

SEQ ID NO: 1829411 - RNA, 17 nt, Salmonella typhimurium LT2
ccgggcuauuugcagau

SEQ ID NO: 1829412 - RNA, 19 nt, Salmonella typhimurium LT2
ccgguaagcgcagcgccac

SEQ ID NO: 1829413 - RNA, 20 nt, Salmonella typhimurium LT2
ccgguaaacgcuccggcagg

SEQ ID NO: 1829414 - RNA, 22 nt, Salmonella typhimurium LT2
ccgguaauaauuggcauccagc

SEQ ID NO: 1829415 - RNA, 13 nt, Salmonella typhimurium LT2
ccgguagcguggu

SEQ ID NO: 1829416 - RNA, 14 nt, Salmonella typhimurium LT2
ccgguagcauccgc

SEQ ID NO: 1829417 - RNA, 19 nt, Salmonella typhimurium LT2
ccgguacgcagcaggcaga

SEQ ID NO: 1829418 - RNA, 20 nt, Salmonella typhimurium LT2
ccgguagagaacgaaauaug

SEQ ID NO: 1829419 - RNA, 20 nt, Salmonella typhimurium LT2
ccgggaucgggacauguuca

SEQ ID NO: 1829420 - RNA, 22 nt, Salmonella typhimurium LT2
ccgggaacagguuuccggcaga

SEQ ID NO: 1829421 - RNA, 17 nt, Salmonella typhimurium LT2
ccggcuuaaugcauggc

SEQ ID NO: 1829422 - RNA, 14 nt, Salmonella typhimurium LT2
ccggcuaugccgga

SEQ ID NO: 1829423 - RNA, 18 nt, Salmonella typhimurium LT2
ccgggcagacaucaccgu

SEQ ID NO: 1829424 - RNA, 22 nt, Salmonella typhimurium LT2
ccgggcgucacccgccggcagu

SEQ ID NO: 1829425 - RNA, 18 nt, Salmonella typhimurium LT2
ccggcgccagaagcuggc

SEQ ID NO: 1829426 - RNA, 15 nt, Salmonella typhimurium LT2
ccggcgcggcgcgca

SEQ ID NO: 1829427 - RNA, 20 nt, Salmonella typhimurium LT2
ccggcgcguuaauaccgugc

SEQ ID NO: 1829428 - RNA, 20 nt, Salmonella typhimurium LT2
ccggcguauugguacaacgc

SEQ ID NO: 1829429 - RNA, 17 nt, Salmonella typhimurium LT2
ccucguccugauccggc

SEQ ID NO: 1829430 - RNA, 13 nt, Salmonella typhimurium LT2
ccugacgggcauu

SEQ ID NO: 1829431 - RNA, 23 nt, Salmonella typhimurium LT2
ccugcaacgcuuuagugccgcca

SEQ ID NO: 1829432 - RNA, 23 nt, Salmonella typhimurium LT2
ccugcaaggcaucgucggcgauu

SEQ ID NO: 1829433 - RNA, 19 nt, Salmonella typhimurium LT2
ccugcaauguuuucagcaa

SEQ ID NO: 1829434 - RNA, 12 nt, Salmonella typhimurium LT2
ccugcucaggcu

SEQ ID NO: 1829435 - RNA, 17 nt, Salmonella typhimurium LT2
ccugcucaggcugaccg

SEQ ID NO: 1829436 - RNA, 13 nt, Salmonella typhimurium LT2
ccugcucaaucgc

SEQ ID NO: 1829437 - RNA, 13 nt, Salmonella typhimurium LT2
ccugcucgccugu

SEQ ID NO: 1829438 - RNA, 17 nt, Salmonella typhimurium LT2
ccugcugcuggacagga

SEQ ID NO: 1829439 - RNA, 16 nt, Salmonella typhimurium LT2
ccuggaagacuucacg

SEQ ID NO: 1829440 - RNA, 20 nt, Salmonella typhimurium LT2
ccuggaagacuucacgccau

SEQ ID NO: 1829441 - RNA, 24 nt, Salmonella typhimurium LT2
ccuggagugacuaaaagacgccau

SEQ ID NO: 1829442 - RNA, 18 nt, Salmonella typhimurium LT2
ccuggagagcagcgccag

SEQ ID NO: 1829443 - RNA, 14 nt, Salmonella typhimurium LT2
ccuggagaucagca

SEQ ID NO: 1829444 - RNA, 20 nt, Salmonella typhimurium LT2
ccuggacccacaagcccgga

SEQ ID NO: 1829445 - RNA, 14 nt, Salmonella typhimurium LT2
ccuggacgcgagcc

SEQ ID NO: 1829446 - RNA, 17 nt, Salmonella typhimurium LT2
ccugcaggcaacguuac

SEQ ID NO: 1829447 - RNA, 14 nt, Salmonella typhimurium LT2
ccugcgccuugacg

SEQ ID NO: 1829448 - RNA, 22 nt, Salmonella typhimurium LT2
ccugcgccaguucauccagcag

SEQ ID NO: 1829449 - RNA, 15 nt, Salmonella typhimurium LT2
ccugcgcgccuugcg

SEQ ID NO: 1829450 - RNA, 14 nt, Salmonella typhimurium LT2
ccugcgcugacggc

SEQ ID NO: 1829451 - RNA, 14 nt, Salmonella typhimurium LT2
ccguucuccagcgu

SEQ ID NO: 1829452 - RNA, 22 nt, Salmonella typhimurium LT2
ccguugccacccaaugauccgg

SEQ ID NO: 1829453 - RNA, 19 nt, Salmonella typhimurium LT2
ccuacaagaauuuaucgca

SEQ ID NO: 1829454 - RNA, 15 nt, Salmonella typhimurium LT2
ccuaaugagccagau

SEQ ID NO: 1829455 - RNA, 15 nt, Salmonella typhimurium LT2
ccuacaaaaucgccc

SEQ ID NO: 1829456 - RNA, 17 nt, Salmonella typhimurium LT2
ccuaauaaccagcccca

SEQ ID NO: 1829457 - RNA, 17 nt, Salmonella typhimurium LT2
ccuaacguguuaucgcu

SEQ ID NO: 1829458 - RNA, 23 nt, Salmonella typhimurium LT2
ccuaagccggcaggcagcgccag

SEQ ID NO: 1829459 - RNA, 13 nt, Salmonella typhimurium LT2
ccucaacgcucau

SEQ ID NO: 1829460 - RNA, 18 nt, Salmonella typhimurium LT2
ccucaaagacccggaacu

SEQ ID NO: 1829461 - RNA, 22 nt, Salmonella typhimurium LT2
ccucaacgcccugcucccacag

SEQ ID NO: 1829462 - RNA, 17 nt, Salmonella typhimurium LT2
ccucacuggagacggau

SEQ ID NO: 1829463 - RNA, 17 nt, Salmonella typhimurium LT2
ccucaccguccgccagg

SEQ ID NO: 1829464 - RNA, 17 nt, Salmonella typhimurium LT2
ccuccagccagcgccag

SEQ ID NO: 1829465 - RNA, 20 nt, Salmonella typhimurium LT2
ccgucguuaaucagcgcggu

SEQ ID NO: 1829466 - RNA, 23 nt, Salmonella typhimurium LT2
ccgucguuaaucagcgcgguggg

SEQ ID NO: 1829467 - RNA, 20 nt, Salmonella typhimurium LT2
ccgucuaaccgggccugaug

SEQ ID NO: 1829468 - RNA, 13 nt, Salmonella typhimurium LT2
ccgugagcggaua

SEQ ID NO: 1829469 - RNA, 22 nt, Salmonella typhimurium LT2
ccgugcgccgacaucgccaccg

SEQ ID NO: 1829470 - RNA, 12 nt, Salmonella typhimurium LT2
ccguggcuggcg

SEQ ID NO: 1829471 - RNA, 18 nt, Salmonella typhimurium LT2
ccgucggggauggcggau

SEQ ID NO: 1829472 - RNA, 17 nt, Salmonella typhimurium LT2
ccgucggggauggcgga

SEQ ID NO: 1829473 - RNA, 14 nt, Salmonella typhimurium LT2
ccgucgccggccug

SEQ ID NO: 1829474 - RNA, 13 nt, Salmonella typhimurium LT2
ccgucgccgauac

SEQ ID NO: 1829475 - RNA, 14 nt, Salmonella typhimurium LT2
cgccgaacaggcca

SEQ ID NO: 1829476 - RNA, 21 nt, Salmonella typhimurium LT2
cgccaugcaucaauggcguca

SEQ ID NO: 1829477 - RNA, 20 nt, Salmonella typhimurium LT2
cgcccgaucguccgccuccg

SEQ ID NO: 1829478 - RNA, 15 nt, Salmonella typhimurium LT2
cgcccuccuguugaa

SEQ ID NO: 1829479 - RNA, 21 nt, Salmonella typhimurium LT2
cgcccguagcgacgccauccg

SEQ ID NO: 1829480 - RNA, 14 nt, Salmonella typhimurium LT2
cgccgcgggcagca

SEQ ID NO: 1829481 - RNA, 20 nt, Salmonella typhimurium LT2
cgccgcgcggaucgccaucg

SEQ ID NO: 1829482 - RNA, 16 nt, Salmonella typhimurium LT2
cgccgcgcucgcguaa

SEQ ID NO: 1829483 - RNA, 13 nt, Salmonella typhimurium LT2
cgccgcgccaucg

SEQ ID NO: 1829484 - RNA, 20 nt, Salmonella typhimurium LT2
cgccggacaguucgccaacg

SEQ ID NO: 1829485 - RNA, 18 nt, Salmonella typhimurium LT2
cgccgcuguucagcagaa

SEQ ID NO: 1829486 - RNA, 18 nt, Salmonella typhimurium LT2
cgccgcuguaauaccagc

SEQ ID NO: 1829487 - RNA, 15 nt, Salmonella typhimurium LT2
cgccgcuggcgggca

SEQ ID NO: 1829488 - RNA, 22 nt, Salmonella typhimurium LT2
cgccgcucgaaucgccaugccg

SEQ ID NO: 1829489 - RNA, 18 nt, Salmonella typhimurium LT2
cgccgcugcgagcagcga

SEQ ID NO: 1829490 - RNA, 23 nt, Salmonella typhimurium LT2
cgccgccgggaucagcggcugca

SEQ ID NO: 1829491 - RNA, 15 nt, Salmonella typhimurium LT2
cgccgccugcacggc

SEQ ID NO: 1829492 - RNA, 16 nt, Salmonella typhimurium LT2
cgccgcgcaggcgaua

SEQ ID NO: 1829493 - RNA, 21 nt, Salmonella typhimurium LT2
cgccgcgcagcaucugauagc

SEQ ID NO: 1829494 - RNA, 20 nt, Salmonella typhimurium LT2
cgccgcgauagaccacgcca

SEQ ID NO: 1829495 - RNA, 14 nt, Salmonella typhimurium LT2
cgccgccaucgcca

SEQ ID NO: 1829496 - RNA, 14 nt, Salmonella typhimurium LT2
cgccgccaucguuc

SEQ ID NO: 1829497 - RNA, 17 nt, Salmonella typhimurium LT2
cgccgccagugagguga

SEQ ID NO: 1829498 - RNA, 21 nt, Salmonella typhimurium LT2
cgccgccaaaaacaaacgauu

SEQ ID NO: 1829499 - RNA, 17 nt, Salmonella typhimurium LT2
cgccgauaacacggcug

SEQ ID NO: 1829500 - RNA, 13 nt, Salmonella typhimurium LT2
cgccgcaucgcgg

SEQ ID NO: 1829501 - RNA, 13 nt, Salmonella typhimurium LT2
cgccgcagggcgc

SEQ ID NO: 1829502 - RNA, 14 nt, Salmonella typhimurium LT2
cgcgauuucaucgu

SEQ ID NO: 1829503 - RNA, 19 nt, Salmonella typhimurium LT2
cgcgcaaagggugaaauca

SEQ ID NO: 1829504 - RNA, 22 nt, Salmonella typhimurium LT2
cgcgaugcgcuugcuccgcaga

SEQ ID NO: 1829505 - RNA, 12 nt, Salmonella typhimurium LT2
cgcgauccgcca

SEQ ID NO: 1829506 - RNA, 22 nt, Salmonella typhimurium LT2
cgcgaugaucgucgcgaucgcg

SEQ ID NO: 1829507 - RNA, 15 nt, Salmonella typhimurium LT2
cgcgaugacucauau

SEQ ID NO: 1829508 - RNA, 18 nt, Salmonella typhimurium LT2
cgcgaugagcugcgguaa

SEQ ID NO: 1829509 - RNA, 19 nt, Salmonella typhimurium LT2
cgcgagcguucaaaaucaa

SEQ ID NO: 1829510 - RNA, 16 nt, Salmonella typhimurium LT2
cgcgagugcaggauca

SEQ ID NO: 1829511 - RNA, 18 nt, Salmonella typhimurium LT2
cgcgagugaucccaacau

SEQ ID NO: 1829512 - RNA, 18 nt, Salmonella typhimurium LT2
cgcgauaugucucuccag

SEQ ID NO: 1829513 - RNA, 16 nt, Salmonella typhimurium LT2
cgcgauacugccgccc

SEQ ID NO: 1829514 - RNA, 18 nt, Salmonella typhimurium LT2
cgcgaaaacagcuggcga

SEQ ID NO: 1829515 - RNA, 17 nt, Salmonella typhimurium LT2
cgccuuucuucacgaua

SEQ ID NO: 1829516 - RNA, 18 nt, Salmonella typhimurium LT2
cgcgaaacugcugccgca

SEQ ID NO: 1829517 - RNA, 15 nt, Salmonella typhimurium LT2
cgccuuucacgccga

SEQ ID NO: 1829518 - RNA, 14 nt, Salmonella typhimurium LT2
cgccuuuacccuua

SEQ ID NO: 1829519 - RNA, 16 nt, Salmonella typhimurium LT2
cgcgaauacucgcgcu

SEQ ID NO: 1829520 - RNA, 19 nt, Salmonella typhimurium LT2
cgcgaacggcaucuacugc

SEQ ID NO: 1829521 - RNA, 13 nt, Salmonella typhimurium LT2
cgcgaacgcgaug

SEQ ID NO: 1829522 - RNA, 18 nt, Salmonella typhimurium LT2
cgcgaauaucuuuauccu

SEQ ID NO: 1829523 - RNA, 21 nt, Salmonella typhimurium LT2
cgcgaaucgccucuucgaccg

SEQ ID NO: 1829524 - RNA, 14 nt, Salmonella typhimurium LT2
cgcgacguccgcca

SEQ ID NO: 1829525 - RNA, 22 nt, Salmonella typhimurium LT2
cgcgacuggaacgucaucauua

SEQ ID NO: 1829526 - RNA, 16 nt, Salmonella typhimurium LT2
cgcgacgcuuaucagc

SEQ ID NO: 1829527 - RNA, 14 nt, Salmonella typhimurium LT2
cgcgacauggcggu

SEQ ID NO: 1829528 - RNA, 15 nt, Salmonella typhimurium LT2
cgcgaccucaucaaa

SEQ ID NO: 1829529 - RNA, 15 nt, Salmonella typhimurium LT2
cgccucguuugcuga

SEQ ID NO: 1829530 - RNA, 23 nt, Salmonella typhimurium LT2
cgccucguuugcugagcagccag

SEQ ID NO: 1829531 - RNA, 13 nt, Salmonella typhimurium LT2
cgccucuaaggcg

SEQ ID NO: 1829532 - RNA, 16 nt, Salmonella typhimurium LT2
cgccucgcgauccgcc

SEQ ID NO: 1829533 - RNA, 18 nt, Salmonella typhimurium LT2
cgccucgcgcaccauaau

SEQ ID NO: 1829534 - RNA, 21 nt, Salmonella typhimurium LT2
cgccugaaugcacugcugaua

SEQ ID NO: 1829535 - RNA, 22 nt, Salmonella typhimurium LT2
cgccugacugguuaaaccgucg

SEQ ID NO: 1829536 - RNA, 18 nt, Salmonella typhimurium LT2
cgccugcuccguccacgc

SEQ ID NO: 1829537 - RNA, 15 nt, Salmonella typhimurium LT2
cgccugcuccaccag

SEQ ID NO: 1829538 - RNA, 16 nt, Salmonella typhimurium LT2
cgccugccugcgcuac

SEQ ID NO: 1829539 - RNA, 14 nt, Salmonella typhimurium LT2
cgccucagccaacc

SEQ ID NO: 1829540 - RNA, 24 nt, Salmonella typhimurium LT2
cgccgugaguuucagcaucauauc

SEQ ID NO: 1829541 - RNA, 21 nt, Salmonella typhimurium LT2
cgccguuaaccgucuggcugc

SEQ ID NO: 1829542 - RNA, 22 nt, Salmonella typhimurium LT2
cgccggcaguccuugcagccag

SEQ ID NO: 1829543 - RNA, 20 nt, Salmonella typhimurium LT2
cgccggcaguuuaagcgccg

SEQ ID NO: 1829544 - RNA, 15 nt, Salmonella typhimurium LT2
cgccgggcacgcuga

SEQ ID NO: 1829545 - RNA, 24 nt, Salmonella typhimurium LT2
cgccggggauaucaaugcgcguaa

SEQ ID NO: 1829546 - RNA, 14 nt, Salmonella typhimurium LT2
cgccgguuguccac

SEQ ID NO: 1829547 - RNA, 19 nt, Salmonella typhimurium LT2
cgccgguuguccacugacc

SEQ ID NO: 1829548 - RNA, 22 nt, Salmonella typhimurium LT2
cgccguaaaacaacagcggcgu

SEQ ID NO: 1829549 - RNA, 20 nt, Salmonella typhimurium LT2
cgccgucacaaagcccaccg

SEQ ID NO: 1829550 - RNA, 21 nt, Salmonella typhimurium LT2
cgccguauucgacacaggcgu

SEQ ID NO: 1829551 - RNA, 15 nt, Salmonella typhimurium LT2
cgccguccaggccug

SEQ ID NO: 1829552 - RNA, 14 nt, Salmonella typhimurium LT2
cgccgucauccgcg

SEQ ID NO: 1829553 - RNA, 16 nt, Salmonella typhimurium LT2
cgcgccugccgccagc

SEQ ID NO: 1829554 - RNA, 17 nt, Salmonella typhimurium LT2
cgcgccuuacguaccgg

SEQ ID NO: 1829555 - RNA, 15 nt, Salmonella typhimurium LT2
cgcgccugacgcgga

SEQ ID NO: 1829556 - RNA, 16 nt, Salmonella typhimurium LT2
cgcgcgacccagcgca

SEQ ID NO: 1829557 - RNA, 14 nt, Salmonella typhimurium LT2
cgcgccgccgccaa

SEQ ID NO: 1829558 - RNA, 12 nt, Salmonella typhimurium LT2
cgcgcgccaguc

SEQ ID NO: 1829559 - RNA, 19 nt, Salmonella typhimurium LT2
cgcgcgucgcuaaucagca

SEQ ID NO: 1829560 - RNA, 21 nt, Salmonella typhimurium LT2
cgcgcucaccuccgccaccag

SEQ ID NO: 1829561 - RNA, 15 nt, Salmonella typhimurium LT2
cgcgcucacgauaag

SEQ ID NO: 1829562 - RNA, 21 nt, Salmonella typhimurium LT2
cgcgcucuuccgccagcgcca

SEQ ID NO: 1829563 - RNA, 16 nt, Salmonella typhimurium LT2
cgcgcuauuccaguuu

SEQ ID NO: 1829564 - RNA, 19 nt, Salmonella typhimurium LT2
cgcgcuagcuucagguguu

SEQ ID NO: 1829565 - RNA, 22 nt, Salmonella typhimurium LT2
cgcgcguuugcaauaucgaugc

SEQ ID NO: 1829566 - RNA, 17 nt, Salmonella typhimurium LT2
cgcggaugguggcguaa

SEQ ID NO: 1829567 - RNA, 17 nt, Salmonella typhimurium LT2
cgcggauaugcagcagc

SEQ ID NO: 1829568 - RNA, 20 nt, Salmonella typhimurium LT2
cgcggaggguuuugccguca

SEQ ID NO: 1829569 - RNA, 13 nt, Salmonella typhimurium LT2
cgcggaaucguca

SEQ ID NO: 1829570 - RNA, 19 nt, Salmonella typhimurium LT2
cgcggaaggaccgucgcac

SEQ ID NO: 1829571 - RNA, 13 nt, Salmonella typhimurium LT2
cgcggacacgaua

SEQ ID NO: 1829572 - RNA, 16 nt, Salmonella typhimurium LT2
cgcgcuggcgcgccug

SEQ ID NO: 1829573 - RNA, 12 nt, Salmonella typhimurium LT2
cgcggcguacgc

SEQ ID NO: 1829574 - RNA, 22 nt, Salmonella typhimurium LT2
cgcggcgguucauccugcgcca

SEQ ID NO: 1829575 - RNA, 21 nt, Salmonella typhimurium LT2
cgcggcuaccgaaggcgcuuu

SEQ ID NO: 1829576 - RNA, 18 nt, Salmonella typhimurium LT2
cgcggccuccggcgcgaa

SEQ ID NO: 1829577 - RNA, 18 nt, Salmonella typhimurium LT2
cgcgggcgcuaaaccggc

SEQ ID NO: 1829578 - RNA, 24 nt, Salmonella typhimurium LT2
cgcggcuucaucaccaucgccgga

SEQ ID NO: 1829579 - RNA, 17 nt, Salmonella typhimurium LT2
cgcgguggguagcggca

SEQ ID NO: 1829580 - RNA, 14 nt, Salmonella typhimurium LT2
cgcugcaacccgcc

SEQ ID NO: 1829581 - RNA, 14 nt, Salmonella typhimurium LT2
cgcugaugacgcgc

SEQ ID NO: 1829582 - RNA, 23 nt, Salmonella typhimurium LT2
cgcugccacaauggcaggcagca

SEQ ID NO: 1829583 - RNA, 22 nt, Salmonella typhimurium LT2
cgcucggcauacaccgccagcg

SEQ ID NO: 1829584 - RNA, 23 nt, Salmonella typhimurium LT2
cgcucggccagauaacgcgcaua

SEQ ID NO: 1829585 - RNA, 23 nt, Salmonella typhimurium LT2
cgcucguuaacccaaauccgcau

SEQ ID NO: 1829586 - RNA, 22 nt, Salmonella typhimurium LT2
cgcucucgccacgcuccaucau

SEQ ID NO: 1829587 - RNA, 22 nt, Salmonella typhimurium LT2
cgcucgugauugauucgcgcca

SEQ ID NO: 1829588 - RNA, 23 nt, Salmonella typhimurium LT2
cgcugaaaaugacuucaucgcca

SEQ ID NO: 1829589 - RNA, 15 nt, Salmonella typhimurium LT2
cgcucuuuacauaau

SEQ ID NO: 1829590 - RNA, 21 nt, Salmonella typhimurium LT2
cgcugaaaggcauuucuaccg

SEQ ID NO: 1829591 - RNA, 21 nt, Salmonella typhimurium LT2
cgcugacaaaucggcuccggc

SEQ ID NO: 1829592 - RNA, 22 nt, Salmonella typhimurium LT2
cgcuaauccggccugucaggau

SEQ ID NO: 1829593 - RNA, 20 nt, Salmonella typhimurium LT2
cgcuaagggcaccagcaaca

SEQ ID NO: 1829594 - RNA, 23 nt, Salmonella typhimurium LT2
cgcuaaugcccggcgcggcauca

SEQ ID NO: 1829595 - RNA, 13 nt, Salmonella typhimurium LT2
cgcuacagggcgu

SEQ ID NO: 1829596 - RNA, 20 nt, Salmonella typhimurium LT2
cgcuaaaugggcaggagaug

SEQ ID NO: 1829597 - RNA, 15 nt, Salmonella typhimurium LT2
cgcuaagccagccaa

SEQ ID NO: 1829598 - RNA, 17 nt, Salmonella typhimurium LT2
cgcgugcucgcggcgga

SEQ ID NO: 1829599 - RNA, 21 nt, Salmonella typhimurium LT2
cgcgguucaguuucuccggcg

SEQ ID NO: 1829600 - RNA, 13 nt, Salmonella typhimurium LT2
cgcgguuaacagc

SEQ ID NO: 1829601 - RNA, 12 nt, Salmonella typhimurium LT2
cgcuauuugcag

SEQ ID NO: 1829602 - RNA, 12 nt, Salmonella typhimurium LT2
cgcucagcaucg

SEQ ID NO: 1829603 - RNA, 14 nt, Salmonella typhimurium LT2
cgcucacgauaacg

SEQ ID NO: 1829604 - RNA, 15 nt, Salmonella typhimurium LT2
cgcuauaagcggcgu

SEQ ID NO: 1829605 - RNA, 22 nt, Salmonella typhimurium LT2
cgcuauaagcggcgucauccgg

SEQ ID NO: 1829606 - RNA, 23 nt, Salmonella typhimurium LT2
cgcuauaagcggcgucauccgga

SEQ ID NO: 1829607 - RNA, 13 nt, Salmonella typhimurium LT2
cgcuaucggcaua

SEQ ID NO: 1829608 - RNA, 17 nt, Salmonella typhimurium LT2
cgcuacguuuaucuggc

SEQ ID NO: 1829609 - RNA, 14 nt, Salmonella typhimurium LT2
cgcuacucagcguc

SEQ ID NO: 1829610 - RNA, 18 nt, Salmonella typhimurium LT2
cgcuacuccgcccuaauc

SEQ ID NO: 1829611 - RNA, 18 nt, Salmonella typhimurium LT2
cgcuaccgcaauacgcuu

SEQ ID NO: 1829612 - RNA, 20 nt, Salmonella typhimurium LT2
cgcuacgcuuaucaggccua

SEQ ID NO: 1829613 - RNA, 14 nt, Salmonella typhimurium LT2
cgcuacgcaggcca

SEQ ID NO: 1829614 - RNA, 14 nt, Salmonella typhimurium LT2
cgcuucuucuacca

SEQ ID NO: 1829615 - RNA, 18 nt, Salmonella typhimurium LT2
cgcuugacucugaagcgg

SEQ ID NO: 1829616 - RNA, 18 nt, Salmonella typhimurium LT2
cgcuucuaccugcacauc

SEQ ID NO: 1829617 - RNA, 19 nt, Salmonella typhimurium LT2
cgcuugcccggaucgccau

SEQ ID NO: 1829618 - RNA, 20 nt, Salmonella typhimurium LT2
cgcuuugcuuauccggccua

SEQ ID NO: 1829619 - RNA, 22 nt, Salmonella typhimurium LT2
cgcuuugcuuauccggccuaca

SEQ ID NO: 1829620 - RNA, 13 nt, Salmonella typhimurium LT2
cgcuuugaucagc

SEQ ID NO: 1829621 - RNA, 15 nt, Salmonella typhimurium LT2
cgcuuugccagcauc

SEQ ID NO: 1829622 - RNA, 17 nt, Salmonella typhimurium LT2
cgcuuugcuuauccggc

SEQ ID NO: 1829623 - RNA, 17 nt, Salmonella typhimurium LT2
cgcuuucuucuucacga

SEQ ID NO: 1829624 - RNA, 15 nt, Salmonella typhimurium LT2
cgcuuuucagcgcca

SEQ ID NO: 1829625 - RNA, 14 nt, Salmonella typhimurium LT2
cgcuuuuugcgcca

SEQ ID NO: 1829626 - RNA, 19 nt, Salmonella typhimurium LT2
cgcuuuuuaccggcgacca

SEQ ID NO: 1829627 - RNA, 14 nt, Salmonella typhimurium LT2
cgcuuucauacgac

SEQ ID NO: 1829628 - RNA, 14 nt, Salmonella typhimurium LT2
cgcuuuaccgccuu

SEQ ID NO: 1829629 - RNA, 20 nt, Salmonella typhimurium LT2
cgcuuuaauggcuuucaccg

SEQ ID NO: 1829630 - RNA, 14 nt, Salmonella typhimurium LT2
cggaagaucgccau

SEQ ID NO: 1829631 - RNA, 17 nt, Salmonella typhimurium LT2
cggaagacuggcgcagc

SEQ ID NO: 1829632 - RNA, 20 nt, Salmonella typhimurium LT2
cggaaaaauaguggcuggcg

SEQ ID NO: 1829633 - RNA, 16 nt, Salmonella typhimurium LT2
cggaaaccccagguca

SEQ ID NO: 1829634 - RNA, 21 nt, Salmonella typhimurium LT2
cggaaaccuguucccggcaga

SEQ ID NO: 1829635 - RNA, 22 nt, Salmonella typhimurium LT2
cggaaaggacuuaucaggccua

SEQ ID NO: 1829636 - RNA, 19 nt, Salmonella typhimurium LT2
cgcuuaucaggccuacaac

SEQ ID NO: 1829637 - RNA, 12 nt, Salmonella typhimurium LT2
cgcuuagcggca

SEQ ID NO: 1829638 - RNA, 17 nt, Salmonella typhimurium LT2
cgcuuaucaggccuaca

SEQ ID NO: 1829639 - RNA, 21 nt, Salmonella typhimurium LT2
cgcuuauccggcuuauccggc

SEQ ID NO: 1829640 - RNA, 20 nt, Salmonella typhimurium LT2
cgcuuaucaggccuacaacg

SEQ ID NO: 1829641 - RNA, 23 nt, Salmonella typhimurium LT2
cgcuuaucaggccuacaucuggc

SEQ ID NO: 1829642 - RNA, 17 nt, Salmonella typhimurium LT2
cgcuuaucaggccuacg

SEQ ID NO: 1829643 - RNA, 20 nt, Salmonella typhimurium LT2
cgcuguuguugacaccacgg

SEQ ID NO: 1829644 - RNA, 21 nt, Salmonella typhimurium LT2
cgcuuacacauuuuauccggc

SEQ ID NO: 1829645 - RNA, 19 nt, Salmonella typhimurium LT2
cgcuuaacuccggcgacca

SEQ ID NO: 1829646 - RNA, 14 nt, Salmonella typhimurium LT2
cgcuuaacuccggc

SEQ ID NO: 1829647 - RNA, 16 nt, Salmonella typhimurium LT2
cgcuucgaugcguuca

SEQ ID NO: 1829648 - RNA, 13 nt, Salmonella typhimurium LT2
cgcuuccgucacc

SEQ ID NO: 1829649 - RNA, 14 nt, Salmonella typhimurium LT2
cgcuucgcgcgcca

SEQ ID NO: 1829650 - RNA, 20 nt, Salmonella typhimurium LT2
cgcuucgcuuaccaggccua

SEQ ID NO: 1829651 - RNA, 17 nt, Salmonella typhimurium LT2
cgcuucgcuuauccggc

SEQ ID NO: 1829652 - RNA, 22 nt, Salmonella typhimurium LT2
cgcuucacgagcggucaggcca

SEQ ID NO: 1829653 - RNA, 19 nt, Salmonella typhimurium LT2
cgcuuauuccuccgccgau

SEQ ID NO: 1829654 - RNA, 19 nt, Salmonella typhimurium LT2
cgcuuauucggccuacaga

SEQ ID NO: 1829655 - RNA, 17 nt, Salmonella typhimurium LT2
cgcuuaucgggcuuacg

SEQ ID NO: 1829656 - RNA, 14 nt, Salmonella typhimurium LT2
cgcuucacgcggau

SEQ ID NO: 1829657 - RNA, 14 nt, Salmonella typhimurium LT2
cgcuucccacaguc

SEQ ID NO: 1829658 - RNA, 17 nt, Salmonella typhimurium LT2
cgcuuccaguuuugcca

SEQ ID NO: 1829659 - RNA, 15 nt, Salmonella typhimurium LT2
cgcuuccagcgcguc

SEQ ID NO: 1829660 - RNA, 22 nt, Salmonella typhimurium LT2
cgcuuccagaugaagcgcaucg

SEQ ID NO: 1829661 - RNA, 14 nt, Salmonella typhimurium LT2
cgcuuccagcgccg

SEQ ID NO: 1829662 - RNA, 14 nt, Salmonella typhimurium LT2
cgcugcgccagauc

SEQ ID NO: 1829663 - RNA, 18 nt, Salmonella typhimurium LT2
cgcugcgccagauccggc

SEQ ID NO: 1829664 - RNA, 12 nt, Salmonella typhimurium LT2
cgcuggcgcugc

SEQ ID NO: 1829665 - RNA, 12 nt, Salmonella typhimurium LT2
cgcuggcgugac

SEQ ID NO: 1829666 - RNA, 18 nt, Salmonella typhimurium LT2
cgcugucguuccacacgu

SEQ ID NO: 1829667 - RNA, 15 nt, Salmonella typhimurium LT2
cgcugucggcgguaa

SEQ ID NO: 1829668 - RNA, 14 nt, Salmonella typhimurium LT2
cgcugucggcguug

SEQ ID NO: 1829669 - RNA, 16 nt, Salmonella typhimurium LT2
cgcugucgccacgcac

SEQ ID NO: 1829670 - RNA, 13 nt, Salmonella typhimurium LT2
cggcgccagccac

SEQ ID NO: 1829671 - RNA, 15 nt, Salmonella typhimurium LT2
cggcgcagcgcgcga

SEQ ID NO: 1829672 - RNA, 15 nt, Salmonella typhimurium LT2
cggcgccacgcgcca

SEQ ID NO: 1829673 - RNA, 23 nt, Salmonella typhimurium LT2
cggcgcccagccugcccgccuga

SEQ ID NO: 1829674 - RNA, 15 nt, Salmonella typhimurium LT2
cggcgcccagcgugc

SEQ ID NO: 1829675 - RNA, 16 nt, Salmonella typhimurium LT2
cggcgcaaaucgccau

SEQ ID NO: 1829676 - RNA, 21 nt, Salmonella typhimurium LT2
cggcgcaaccauuaccgccaa

SEQ ID NO: 1829677 - RNA, 12 nt, Salmonella typhimurium LT2
cggcgcagcgaa

SEQ ID NO: 1829678 - RNA, 19 nt, Salmonella typhimurium LT2
cggcgcgauauccaccacu

SEQ ID NO: 1829679 - RNA, 19 nt, Salmonella typhimurium LT2
cggccuguuaaugcaauau

SEQ ID NO: 1829680 - RNA, 13 nt, Salmonella typhimurium LT2
cggccugcggcga

SEQ ID NO: 1829681 - RNA, 20 nt, Salmonella typhimurium LT2
cggcaugaugggcgcacagc

SEQ ID NO: 1829682 - RNA, 15 nt, Salmonella typhimurium LT2
cggcaugacaucaga

SEQ ID NO: 1829683 - RNA, 15 nt, Salmonella typhimurium LT2
cggccacaggcgucg

SEQ ID NO: 1829684 - RNA, 14 nt, Salmonella typhimurium LT2
cggccacagcgcca

SEQ ID NO: 1829685 - RNA, 15 nt, Salmonella typhimurium LT2
cggccacaauugcca

SEQ ID NO: 1829686 - RNA, 17 nt, Salmonella typhimurium LT2
cggcaggcuggcgguaa

SEQ ID NO: 1829687 - RNA, 19 nt, Salmonella typhimurium LT2
cggcaggcuggcgguaaca

SEQ ID NO: 1829688 - RNA, 17 nt, Salmonella typhimurium LT2
cggcaucggcagcguca

SEQ ID NO: 1829689 - RNA, 17 nt, Salmonella typhimurium LT2
cggcaucgcuacggcga

SEQ ID NO: 1829690 - RNA, 17 nt, Salmonella typhimurium LT2
cggccagcaagcggcga

SEQ ID NO: 1829691 - RNA, 23 nt, Salmonella typhimurium LT2
cggccauuccauaacccggcuga

SEQ ID NO: 1829692 - RNA, 20 nt, Salmonella typhimurium LT2
cggccaucaugcaggccgga

SEQ ID NO: 1829693 - RNA, 22 nt, Salmonella typhimurium LT2
cggccaggcaaagauccaccag

SEQ ID NO: 1829694 - RNA, 22 nt, Salmonella typhimurium LT2
cggcaauggccgcagcgccaua

SEQ ID NO: 1829695 - RNA, 20 nt, Salmonella typhimurium LT2
cggcaacgucacgugacgca

SEQ ID NO: 1829696 - RNA, 17 nt, Salmonella typhimurium LT2
cggcaauucagguaaua

SEQ ID NO: 1829697 - RNA, 21 nt, Salmonella typhimurium LT2
cggcacauauuccggcgcugg

SEQ ID NO: 1829698 - RNA, 23 nt, Salmonella typhimurium LT2
cggcaacccuuuggccaccagcu

SEQ ID NO: 1829699 - RNA, 20 nt, Salmonella typhimurium LT2
cggcaacccgacugccacca

SEQ ID NO: 1829700 - RNA, 12 nt, Salmonella typhimurium LT2
cggcagcgcgaa

SEQ ID NO: 1829701 - RNA, 14 nt, Salmonella typhimurium LT2
cggcagacgauagc

SEQ ID NO: 1829702 - RNA, 20 nt, Salmonella typhimurium LT2
cggcacgcuaaaccacauga

SEQ ID NO: 1829703 - RNA, 18 nt, Salmonella typhimurium LT2
cggaguagacccacauau

SEQ ID NO: 1829704 - RNA, 20 nt, Salmonella typhimurium LT2
cggagguuuucucauccagc

SEQ ID NO: 1829705 - RNA, 21 nt, Salmonella typhimurium LT2
cggauacaagguauccgccau

SEQ ID NO: 1829706 - RNA, 21 nt, Salmonella typhimurium LT2
cggauagcucgcuguaccgcc

SEQ ID NO: 1829707 - RNA, 19 nt, Salmonella typhimurium LT2
cggauaguaucuuauccgg

SEQ ID NO: 1829708 - RNA, 23 nt, Salmonella typhimurium LT2
cggauagacuuaggaauacccag

SEQ ID NO: 1829709 - RNA, 22 nt, Salmonella typhimurium LT2
cggauagcaacgcgaagcagcu

SEQ ID NO: 1829710 - RNA, 14 nt, Salmonella typhimurium LT2
cggaucggauuuac

SEQ ID NO: 1829711 - RNA, 14 nt, Salmonella typhimurium LT2
cggcaaccagccca

SEQ ID NO: 1829712 - RNA, 21 nt, Salmonella typhimurium LT2
cggcaaaucccggacacauaa

SEQ ID NO: 1829713 - RNA, 15 nt, Salmonella typhimurium LT2
cggcaaacagccuca

SEQ ID NO: 1829714 - RNA, 18 nt, Salmonella typhimurium LT2
cggcaaaccuaccggcau

SEQ ID NO: 1829715 - RNA, 16 nt, Salmonella typhimurium LT2
cggcaaaaacgccggu

SEQ ID NO: 1829716 - RNA, 14 nt, Salmonella typhimurium LT2
cggauggcggcgga

SEQ ID NO: 1829717 - RNA, 13 nt, Salmonella typhimurium LT2
cggauggcgacgc

SEQ ID NO: 1829718 - RNA, 15 nt, Salmonella typhimurium LT2
cggauggagcggcgc

SEQ ID NO: 1829719 - RNA, 16 nt, Salmonella typhimurium LT2
cggauggcaacgccag

SEQ ID NO: 1829720 - RNA, 21 nt, Salmonella typhimurium LT2
cggauggcaacgccagagcgu

SEQ ID NO: 1829721 - RNA, 20 nt, Salmonella typhimurium LT2
cggaugacgacaucugcaca

SEQ ID NO: 1829722 - RNA, 22 nt, Salmonella typhimurium LT2
cgggcuggcuggcgcaauguuc

SEQ ID NO: 1829723 - RNA, 13 nt, Salmonella typhimurium LT2
cggggaagcgacg

SEQ ID NO: 1829724 - RNA, 12 nt, Salmonella typhimurium LT2
cgggcugaccgc

SEQ ID NO: 1829725 - RNA, 22 nt, Salmonella typhimurium LT2
cgggcguuucacauuccggcgc

SEQ ID NO: 1829726 - RNA, 13 nt, Salmonella typhimurium LT2
cgggcuauaggcc

SEQ ID NO: 1829727 - RNA, 18 nt, Salmonella typhimurium LT2
cgggcuauaggccaucac

SEQ ID NO: 1829728 - RNA, 14 nt, Salmonella typhimurium LT2
cggggccagcgcca

SEQ ID NO: 1829729 - RNA, 20 nt, Salmonella typhimurium LT2
cgggggcgaucagcagguca

SEQ ID NO: 1829730 - RNA, 15 nt, Salmonella typhimurium LT2
cggguccugaucggc

SEQ ID NO: 1829731 - RNA, 16 nt, Salmonella typhimurium LT2
cggguucacaucauua

SEQ ID NO: 1829732 - RNA, 17 nt, Salmonella typhimurium LT2
cgguaacgcaacucauc

SEQ ID NO: 1829733 - RNA, 22 nt, Salmonella typhimurium LT2
cgguaacgcaacucaucgucau

SEQ ID NO: 1829734 - RNA, 20 nt, Salmonella typhimurium LT2
cgguaaauuucacuucgccc

SEQ ID NO: 1829735 - RNA, 16 nt, Salmonella typhimurium LT2
cgguaaucccuucacg

SEQ ID NO: 1829736 - RNA, 15 nt, Salmonella typhimurium LT2
cgguaauugcgccgu

SEQ ID NO: 1829737 - RNA, 13 nt, Salmonella typhimurium LT2
cgguacagcaucc

SEQ ID NO: 1829738 - RNA, 19 nt, Salmonella typhimurium LT2
cgguaccaaagucaucaau

SEQ ID NO: 1829739 - RNA, 22 nt, Salmonella typhimurium LT2
cgguagcuguaccagaucgccu

SEQ ID NO: 1829740 - RNA, 14 nt, Salmonella typhimurium LT2
cgguagcgccgaug

SEQ ID NO: 1829741 - RNA, 22 nt, Salmonella typhimurium LT2
cggucaggguaauagagggcgc

SEQ ID NO: 1829742 - RNA, 22 nt, Salmonella typhimurium LT2
cggucaguccaagcguuuuacg

SEQ ID NO: 1829743 - RNA, 19 nt, Salmonella typhimurium LT2
cggucgacaccagcgauaa

SEQ ID NO: 1829744 - RNA, 18 nt, Salmonella typhimurium LT2
cggugaaacuguuuuacg

SEQ ID NO: 1829745 - RNA, 14 nt, Salmonella typhimurium LT2
cggucggcgcgucg

SEQ ID NO: 1829746 - RNA, 13 nt, Salmonella typhimurium LT2
cggucgcugauaa

SEQ ID NO: 1829747 - RNA, 17 nt, Salmonella typhimurium LT2
cggucgccugccgcaug

SEQ ID NO: 1829748 - RNA, 15 nt, Salmonella typhimurium LT2
cggcugacgcgcuau

SEQ ID NO: 1829749 - RNA, 16 nt, Salmonella typhimurium LT2
cggcugaccugaacgc

SEQ ID NO: 1829750 - RNA, 23 nt, Salmonella typhimurium LT2
cggcugaguucaggcacgugcau

SEQ ID NO: 1829751 - RNA, 15 nt, Salmonella typhimurium LT2
cggcuucuccaccau

SEQ ID NO: 1829752 - RNA, 17 nt, Salmonella typhimurium LT2
cggcuugagcaccacgc

SEQ ID NO: 1829753 - RNA, 22 nt, Salmonella typhimurium LT2
cgggagagcguauccagcaccu

SEQ ID NO: 1829754 - RNA, 18 nt, Salmonella typhimurium LT2
cgggagauuguuaucgac

SEQ ID NO: 1829755 - RNA, 17 nt, Salmonella typhimurium LT2
cgggacggcggccagca

SEQ ID NO: 1829756 - RNA, 13 nt, Salmonella typhimurium LT2
cgggauacggcga

SEQ ID NO: 1829757 - RNA, 14 nt, Salmonella typhimurium LT2
cgggccugccaggu

SEQ ID NO: 1829758 - RNA, 21 nt, Salmonella typhimurium LT2
cgggccugauaagcacaggcc

SEQ ID NO: 1829759 - RNA, 16 nt, Salmonella typhimurium LT2
cgggccuacagguaca

SEQ ID NO: 1829760 - RNA, 19 nt, Salmonella typhimurium LT2
cgggcccguugccuggcga

SEQ ID NO: 1829761 - RNA, 21 nt, Salmonella typhimurium LT2
cgggaucucgcacaucaugau

SEQ ID NO: 1829762 - RNA, 18 nt, Salmonella typhimurium LT2
cgggauuggaucgacgcu

SEQ ID NO: 1829763 - RNA, 15 nt, Salmonella typhimurium LT2
cgggcaaacagcacu

SEQ ID NO: 1829764 - RNA, 12 nt, Salmonella typhimurium LT2
cggcuccggcaa

SEQ ID NO: 1829765 - RNA, 20 nt, Salmonella typhimurium LT2
cggcucauccagcagcauga

SEQ ID NO: 1829766 - RNA, 21 nt, Salmonella typhimurium LT2
cggcuacaggcgucacggcga

SEQ ID NO: 1829767 - RNA, 23 nt, Salmonella typhimurium LT2
cggcguuagugcccagcgcgacc

SEQ ID NO: 1829768 - RNA, 15 nt, Salmonella typhimurium LT2
cggcuacgccuuacc

SEQ ID NO: 1829769 - RNA, 21 nt, Salmonella typhimurium LT2
cggcucagacaguagcggcga

SEQ ID NO: 1829770 - RNA, 19 nt, Salmonella typhimurium LT2
cggcguaucauagcggcua

SEQ ID NO: 1829771 - RNA, 22 nt, Salmonella typhimurium LT2
cggcgucaaauccaccgccagc

SEQ ID NO: 1829772 - RNA, 22 nt, Salmonella typhimurium LT2
cggcgucuggguuugcagcaga

SEQ ID NO: 1829773 - RNA, 22 nt, Salmonella typhimurium LT2
cggcgucuucauccucgccaua

SEQ ID NO: 1829774 - RNA, 18 nt, Salmonella typhimurium LT2
cggcgugccgauucccgc

SEQ ID NO: 1829775 - RNA, 17 nt, Salmonella typhimurium LT2
cggcggguuaauggcag

SEQ ID NO: 1829776 - RNA, 18 nt, Salmonella typhimurium LT2
cggcgguuauccgccagc

SEQ ID NO: 1829777 - RNA, 15 nt, Salmonella typhimurium LT2
cggcguaaacacguu

SEQ ID NO: 1829778 - RNA, 16 nt, Salmonella typhimurium LT2
aaaagcacaucaggaa

SEQ ID NO: 1829779 - RNA, 14 nt, Salmonella typhimurium LT2
aaaaguauggcggu

SEQ ID NO: 1829780 - RNA, 18 nt, Salmonella typhimurium LT2
aaaaguauggcgguuccg

SEQ ID NO: 1829781 - RNA, 11 nt, Salmonella typhimurium LT2
aaaauccaggg

SEQ ID NO: 1829782 - RNA, 16 nt, Salmonella typhimurium LT2
aaaauccaguaaugcc

SEQ ID NO: 1829783 - RNA, 15 nt, Salmonella typhimurium LT2
aaaauccggcaggca

SEQ ID NO: 1829784 - RNA, 16 nt, Salmonella typhimurium LT2
aaaauaucugaauaac

SEQ ID NO: 1829785 - RNA, 13 nt, Salmonella typhimurium LT2
aaaauagccugaa

SEQ ID NO: 1829786 - RNA, 21 nt, Salmonella typhimurium LT2
aaaauagcuuaccuggcgauc

SEQ ID NO: 1829787 - RNA, 18 nt, Salmonella typhimurium LT2
aaaaugcucaguauggcc

SEQ ID NO: 1829788 - RNA, 20 nt, Salmonella typhimurium LT2
aaaaugaucagaccaucggc

SEQ ID NO: 1829789 - RNA, 17 nt, Salmonella typhimurium LT2
aaaaucugaauucgcca

SEQ ID NO: 1829790 - RNA, 12 nt, Salmonella typhimurium LT2
aaaaaaugccgu

SEQ ID NO: 1829791 - RNA, 13 nt, Salmonella typhimurium LT2
aaaaaauccagua

SEQ ID NO: 1829792 - RNA, 20 nt, Salmonella typhimurium LT2
aaaaauuacgaaaaggucuu

SEQ ID NO: 1829793 - RNA, 16 nt, Salmonella typhimurium LT2
aaaacgcucgcgcugu

SEQ ID NO: 1829794 - RNA, 21 nt, Salmonella typhimurium LT2
aaaacucuccaugccaucggc

SEQ ID NO: 1829795 - RNA, 16 nt, Salmonella typhimurium LT2
aaaacugaguucgcca

SEQ ID NO: 1829796 - RNA, 21 nt, Salmonella typhimurium LT2
aaaaagaggccggauggcggu

SEQ ID NO: 1829797 - RNA, 15 nt, Salmonella typhimurium LT2
aaacgcgcucgccag

SEQ ID NO: 1829798 - RNA, 16 nt, Salmonella typhimurium LT2
aaacgcgccgcugcgu

SEQ ID NO: 1829799 - RNA, 20 nt, Salmonella typhimurium LT2
aaacgccccuucaucagcca

SEQ ID NO: 1829800 - RNA, 13 nt, Salmonella typhimurium LT2
aaagcaguaacgc

SEQ ID NO: 1829801 - RNA, 17 nt, Salmonella typhimurium LT2
aaagacggcagcgccau

SEQ ID NO: 1829802 - RNA, 23 nt, Salmonella typhimurium LT2
aaagguaaacgcgaccagcgcac

SEQ ID NO: 1829803 - RNA, 19 nt, Salmonella typhimurium LT2
aaagguaauaucauccggu

SEQ ID NO: 1829804 - RNA, 19 nt, Salmonella typhimurium LT2
aaagguggguuccagcgcc

SEQ ID NO: 1829805 - RNA, 13 nt, Salmonella typhimurium LT2
aaaguaucaacgg

SEQ ID NO: 1829806 - RNA, 18 nt, Salmonella typhimurium LT2
aaaggucgccgcaucggc

SEQ ID NO: 1829807 - RNA, 18 nt, Salmonella typhimurium LT2
aaagccgccauccggcau

SEQ ID NO: 1829808 - RNA, 13 nt, Salmonella typhimurium LT2
aaagcccgguuca

SEQ ID NO: 1829809 - RNA, 22 nt, Salmonella typhimurium LT2
aaagccccggcucaagccaggu

SEQ ID NO: 1829810 - RNA, 16 nt, Salmonella typhimurium LT2
aaagcccaucagcgcc

SEQ ID NO: 1829811 - RNA, 17 nt, Salmonella typhimurium LT2
aaagcgaccggcacuca

SEQ ID NO: 1829812 - RNA, 18 nt, Salmonella typhimurium LT2
aaagcggauacuccugca

SEQ ID NO: 1829813 - RNA, 11 nt, Salmonella typhimurium LT2
aaagcgcaucc

SEQ ID NO: 1829814 - RNA, 14 nt, Salmonella typhimurium LT2
aaagcgcauccagc

SEQ ID NO: 1829815 - RNA, 20 nt, Salmonella typhimurium LT2
aaagcgccagauaugaucga

SEQ ID NO: 1829816 - RNA, 16 nt, Salmonella typhimurium LT2
aaagcgccauccggca

SEQ ID NO: 1829817 - RNA, 17 nt, Salmonella typhimurium LT2
aaagcgcccaaugccga

SEQ ID NO: 1829818 - RNA, 19 nt, Salmonella typhimurium LT2
aaaccacaaucacagcgca

SEQ ID NO: 1829819 - RNA, 18 nt, Salmonella typhimurium LT2
aaacagccugucgccguc

SEQ ID NO: 1829820 - RNA, 15 nt, Salmonella typhimurium LT2
aaacaauuuccccca

SEQ ID NO: 1829821 - RNA, 17 nt, Salmonella typhimurium LT2
aaacaaacauugcugga

SEQ ID NO: 1829822 - RNA, 11 nt, Salmonella typhimurium LT2
aaaccgaucuc

SEQ ID NO: 1829823 - RNA, 15 nt, Salmonella typhimurium LT2
aaaccgaucucccag

SEQ ID NO: 1829824 - RNA, 19 nt, Salmonella typhimurium LT2
aaacccgauucugccaguu

SEQ ID NO: 1829825 - RNA, 15 nt, Salmonella typhimurium LT2
aaacccaccagcagg

SEQ ID NO: 1829826 - RNA, 12 nt, Salmonella typhimurium LT2
aaaccuccggcu

SEQ ID NO: 1829827 - RNA, 14 nt, Salmonella typhimurium LT2
aaaccuaccggcau

SEQ ID NO: 1829828 - RNA, 22 nt, Salmonella typhimurium LT2
aaaccuuucuucucuucuucaa

SEQ ID NO: 1829829 - RNA, 18 nt, Salmonella typhimurium LT2
aaaccuguucccggcaga

SEQ ID NO: 1829830 - RNA, 21 nt, Salmonella typhimurium LT2
aaaccgcgcggcauaaauccg

SEQ ID NO: 1829831 - RNA, 19 nt, Salmonella typhimurium LT2
aaaccggucaggcagcaga

SEQ ID NO: 1829832 - RNA, 17 nt, Salmonella typhimurium LT2
aaaccggucauauugcc

SEQ ID NO: 1829833 - RNA, 22 nt, Salmonella typhimurium LT2
aaaccggcgcgccuuccagcaa

SEQ ID NO: 1829834 - RNA, 18 nt, Salmonella typhimurium LT2
aaaccgucucgccgcggu

SEQ ID NO: 1829835 - RNA, 22 nt, Salmonella typhimurium LT2
aaauuugcugccaucgcacagu

SEQ ID NO: 1829836 - RNA, 18 nt, Salmonella typhimurium LT2
aaaagaccccgccaggcg

SEQ ID NO: 1829837 - RNA, 17 nt, Salmonella typhimurium LT2
aacaaugggauaaaaug

SEQ ID NO: 1829838 - RNA, 14 nt, Salmonella typhimurium LT2
aacaccagcagcgc

SEQ ID NO: 1829839 - RNA, 11 nt, Salmonella typhimurium LT2
aaaucguccgc

SEQ ID NO: 1829840 - RNA, 18 nt, Salmonella typhimurium LT2
aaaugcccggcuggcgau

SEQ ID NO: 1829841 - RNA, 21 nt, Salmonella typhimurium LT2
aaaugccauauacauauggau

SEQ ID NO: 1829842 - RNA, 13 nt, Salmonella typhimurium LT2
aaauccuccggcg

SEQ ID NO: 1829843 - RNA, 18 nt, Salmonella typhimurium LT2
aaauccuucuuccauucc

SEQ ID NO: 1829844 - RNA, 18 nt, Salmonella typhimurium LT2
aaauccagcuguccggcu

SEQ ID NO: 1829845 - RNA, 16 nt, Salmonella typhimurium LT2
aaaucccacauccggc

SEQ ID NO: 1829846 - RNA, 20 nt, Salmonella typhimurium LT2
aaaucgucagacggcuccag

SEQ ID NO: 1829847 - RNA, 22 nt, Salmonella typhimurium LT2
aaaucgguacgcgucugaauga

SEQ ID NO: 1829848 - RNA, 17 nt, Salmonella typhimurium LT2
aaaacagccauaaugcu

SEQ ID NO: 1829849 - RNA, 20 nt, Salmonella typhimurium LT2
aaaaccguagcuuugcgcca

SEQ ID NO: 1829850 - RNA, 18 nt, Salmonella typhimurium LT2
aaaaccguugucguccgu

SEQ ID NO: 1829851 - RNA, 16 nt, Salmonella typhimurium LT2
aaauccacauuccaga

SEQ ID NO: 1829852 - RNA, 16 nt, Salmonella typhimurium LT2
aaaucaucaauggcga

SEQ ID NO: 1829853 - RNA, 18 nt, Salmonella typhimurium LT2
acaaaacuaccgcgccag

SEQ ID NO: 1829854 - RNA, 14 nt, Salmonella typhimurium LT2
acaaagcguucggc

SEQ ID NO: 1829855 - RNA, 12 nt, Salmonella typhimurium LT2
acaaagucgccu

SEQ ID NO: 1829856 - RNA, 23 nt, Salmonella typhimurium LT2
acaaaagccagauaaagcagcga

SEQ ID NO: 1829857 - RNA, 15 nt, Salmonella typhimurium LT2
aauuuccgcagccag

SEQ ID NO: 1829858 - RNA, 18 nt, Salmonella typhimurium LT2
acaaccgcccccaacuga

SEQ ID NO: 1829859 - RNA, 20 nt, Salmonella typhimurium LT2
acaacgccgguacgcagcag

SEQ ID NO: 1829860 - RNA, 12 nt, Salmonella typhimurium LT2
acaacgccggac

SEQ ID NO: 1829861 - RNA, 20 nt, Salmonella typhimurium LT2
acaaccugcccuuucuucaa

SEQ ID NO: 1829862 - RNA, 22 nt, Salmonella typhimurium LT2
acaacgacuacguucaucaggc

SEQ ID NO: 1829863 - RNA, 14 nt, Salmonella typhimurium LT2
acaacguuacgcca

SEQ ID NO: 1829864 - RNA, 22 nt, Salmonella typhimurium LT2
acaagcuaauccccagcgcucc

SEQ ID NO: 1829865 - RNA, 16 nt, Salmonella typhimurium LT2
acaaguuuauccggca

SEQ ID NO: 1829866 - RNA, 20 nt, Salmonella typhimurium LT2
acaaucaaauggcuggcgcu

SEQ ID NO: 1829867 - RNA, 22 nt, Salmonella typhimurium LT2
acacagcggaaagcaacagcaa

SEQ ID NO: 1829868 - RNA, 18 nt, Salmonella typhimurium LT2
acacaaucaucgacagua

SEQ ID NO: 1829869 - RNA, 19 nt, Salmonella typhimurium LT2
acaaugaugguuaacggaa

SEQ ID NO: 1829870 - RNA, 16 nt, Salmonella typhimurium LT2
aaugcgucgucggcau

SEQ ID NO: 1829871 - RNA, 19 nt, Salmonella typhimurium LT2
aaugcgcuaacgucgccau

SEQ ID NO: 1829872 - RNA, 16 nt, Salmonella typhimurium LT2
aaugcccauccacgcc

SEQ ID NO: 1829873 - RNA, 23 nt, Salmonella typhimurium LT2
aaugcccuuaaauccggccucca

SEQ ID NO: 1829874 - RNA, 14 nt, Salmonella typhimurium LT2
aaugcuuuaaaugc

SEQ ID NO: 1829875 - RNA, 21 nt, Salmonella typhimurium LT2
aaugcugcaucuuacugaccg

SEQ ID NO: 1829876 - RNA, 23 nt, Salmonella typhimurium LT2
aaugccauacuuuuccagcgccu

SEQ ID NO: 1829877 - RNA, 18 nt, Salmonella typhimurium LT2
aaugcauggcagauaaac

SEQ ID NO: 1829878 - RNA, 13 nt, Salmonella typhimurium LT2
aaugcagcgcgau

SEQ ID NO: 1829879 - RNA, 16 nt, Salmonella typhimurium LT2
aaucacgcguuauacg

SEQ ID NO: 1829880 - RNA, 15 nt, Salmonella typhimurium LT2
aaucacgucgcccac

SEQ ID NO: 1829881 - RNA, 21 nt, Salmonella typhimurium LT2
aaucacguuuugcagcgccau

SEQ ID NO: 1829882 - RNA, 14 nt, Salmonella typhimurium LT2
aaucuugcguacca

SEQ ID NO: 1829883 - RNA, 13 nt, Salmonella typhimurium LT2
aaugaagcgcguu

SEQ ID NO: 1829884 - RNA, 20 nt, Salmonella typhimurium LT2
aauucaggcuaaggcgucga

SEQ ID NO: 1829885 - RNA, 23 nt, Salmonella typhimurium LT2
aauuaagccggguagaugccgau

SEQ ID NO: 1829886 - RNA, 14 nt, Salmonella typhimurium LT2
aauuccgcaucagg

SEQ ID NO: 1829887 - RNA, 11 nt, Salmonella typhimurium LT2
aauuccuggaa

SEQ ID NO: 1829888 - RNA, 13 nt, Salmonella typhimurium LT2
aauggucgcgcca

SEQ ID NO: 1829889 - RNA, 14 nt, Salmonella typhimurium LT2
aauguuguuccaga

SEQ ID NO: 1829890 - RNA, 16 nt, Salmonella typhimurium LT2
aauggcggcgcgaacg

SEQ ID NO: 1829891 - RNA, 17 nt, Salmonella typhimurium LT2
aauggcggcuucgccau

SEQ ID NO: 1829892 - RNA, 20 nt, Salmonella typhimurium LT2
aauugaguggacaucgccau

SEQ ID NO: 1829893 - RNA, 17 nt, Salmonella typhimurium LT2
aauugccgucgccggaa

SEQ ID NO: 1829894 - RNA, 15 nt, Salmonella typhimurium LT2
aauugccugauggcg

SEQ ID NO: 1829895 - RNA, 14 nt, Salmonella typhimurium LT2
aauugcgccguuca

SEQ ID NO: 1829896 - RNA, 18 nt, Salmonella typhimurium LT2
aauugguuauauuacuga

SEQ ID NO: 1829897 - RNA, 20 nt, Salmonella typhimurium LT2
aauuguuggucacgauccgc

SEQ ID NO: 1829898 - RNA, 13 nt, Salmonella typhimurium LT2
aauuuccaguuca

SEQ ID NO: 1829899 - RNA, 14 nt, Salmonella typhimurium LT2
aauuuccccaguua

SEQ ID NO: 1829900 - RNA, 14 nt, Salmonella typhimurium LT2
aauuucagugaauc

SEQ ID NO: 1829901 - RNA, 14 nt, Salmonella typhimurium LT2
acaccgccagcguc

SEQ ID NO: 1829902 - RNA, 16 nt, Salmonella typhimurium LT2
acaccgcauccgcauc

SEQ ID NO: 1829903 - RNA, 18 nt, Salmonella typhimurium LT2
acaccggccauugccgcg

SEQ ID NO: 1829904 - RNA, 17 nt, Salmonella typhimurium LT2
acaccacgugcggacgu

SEQ ID NO: 1829905 - RNA, 13 nt, Salmonella typhimurium LT2
aaaauaacgcgau

SEQ ID NO: 1829906 - RNA, 22 nt, Salmonella typhimurium LT2
aaaaguuugcugcgucacgcgu

SEQ ID NO: 1829907 - RNA, 16 nt, Salmonella typhimurium LT2
acacggggcgguaccg

SEQ ID NO: 1829908 - RNA, 23 nt, Salmonella typhimurium LT2
acacggcgccaugauccagcgga

SEQ ID NO: 1829909 - RNA, 12 nt, Salmonella typhimurium LT2
acaccuuacgca

SEQ ID NO: 1829910 - RNA, 19 nt, Salmonella typhimurium LT2
acaccuuauccggccuaca

SEQ ID NO: 1829911 - RNA, 13 nt, Salmonella typhimurium LT2
acaccguuauccg

SEQ ID NO: 1829912 - RNA, 17 nt, Salmonella typhimurium LT2
acaccguuauccggcaa

SEQ ID NO: 1829913 - RNA, 21 nt, Salmonella typhimurium LT2
acaggcggguauggcgccaau

SEQ ID NO: 1829914 - RNA, 12 nt, Salmonella typhimurium LT2
acaggcggcaug

SEQ ID NO: 1829915 - RNA, 22 nt, Salmonella typhimurium LT2
acagcuucaugugccgcgacaa

SEQ ID NO: 1829916 - RNA, 16 nt, Salmonella typhimurium LT2
acagcuugaucaucag

SEQ ID NO: 1829917 - RNA, 17 nt, Salmonella typhimurium LT2
acaggaaacagguacuu

SEQ ID NO: 1829918 - RNA, 14 nt, Salmonella typhimurium LT2
acagcguaaauaag

SEQ ID NO: 1829919 - RNA, 20 nt, Salmonella typhimurium LT2
acagcguauuaagccaacgu

SEQ ID NO: 1829920 - RNA, 21 nt, Salmonella typhimurium LT2
acagcguaucggcuaucaccu

SEQ ID NO: 1829921 - RNA, 14 nt, Salmonella typhimurium LT2
acagcgcuccacgc

SEQ ID NO: 1829922 - RNA, 13 nt, Salmonella typhimurium LT2
acagcgaucacgc

SEQ ID NO: 1829923 - RNA, 21 nt, Salmonella typhimurium LT2
acagcagcgcuuucaccgcgu

SEQ ID NO: 1829924 - RNA, 15 nt, Salmonella typhimurium LT2
acacugauacggcgu

SEQ ID NO: 1829925 - RNA, 17 nt, Salmonella typhimurium LT2
acacuugcgcaucgcau

SEQ ID NO: 1829926 - RNA, 13 nt, Salmonella typhimurium LT2
acagaagcgcugg

SEQ ID NO: 1829927 - RNA, 23 nt, Salmonella typhimurium LT2
acagauucccagugcgcggucau

SEQ ID NO: 1829928 - RNA, 16 nt, Salmonella typhimurium LT2
acagauuccagauguc

SEQ ID NO: 1829929 - RNA, 19 nt, Salmonella typhimurium LT2
aaggcgaacuccagcgcga

SEQ ID NO: 1829930 - RNA, 20 nt, Salmonella typhimurium LT2
aaggcguugugcugcggcau

SEQ ID NO: 1829931 - RNA, 20 nt, Salmonella typhimurium LT2
aaggcuaccgguugcguagc

SEQ ID NO: 1829932 - RNA, 19 nt, Salmonella typhimurium LT2
aaggcauuucaaucgccac

SEQ ID NO: 1829933 - RNA, 16 nt, Salmonella typhimurium LT2
aagcguaacagcgcua

SEQ ID NO: 1829934 - RNA, 16 nt, Salmonella typhimurium LT2
aagcguagccgcgcca

SEQ ID NO: 1829935 - RNA, 13 nt, Salmonella typhimurium LT2
aagcguagcgcca

SEQ ID NO: 1829936 - RNA, 14 nt, Salmonella typhimurium LT2
aagcguagcgccau

SEQ ID NO: 1829937 - RNA, 20 nt, Salmonella typhimurium LT2
aagcggcgucacguucgucg

SEQ ID NO: 1829938 - RNA, 19 nt, Salmonella typhimurium LT2
aagcgcauccgguaaacgc

SEQ ID NO: 1829939 - RNA, 16 nt, Salmonella typhimurium LT2
aagcgcccgcgcgcca

SEQ ID NO: 1829940 - RNA, 20 nt, Salmonella typhimurium LT2
aagccguuuuggcagcgccc

SEQ ID NO: 1829941 - RNA, 20 nt, Salmonella typhimurium LT2
aagcgauuuauccaccgcca

SEQ ID NO: 1829942 - RNA, 14 nt, Salmonella typhimurium LT2
aagcgcagcgccau

SEQ ID NO: 1829943 - RNA, 16 nt, Salmonella typhimurium LT2
aagcgcagcgccaucc

SEQ ID NO: 1829944 - RNA, 14 nt, Salmonella typhimurium LT2
aagcgcaagcgcca

SEQ ID NO: 1829945 - RNA, 17 nt, Salmonella typhimurium LT2
aagcgcaaacuuccaca

SEQ ID NO: 1829946 - RNA, 19 nt, Salmonella typhimurium LT2
aagccggcaggcagcgcca

SEQ ID NO: 1829947 - RNA, 22 nt, Salmonella typhimurium LT2
aagccggauaguaucuuauccg

SEQ ID NO: 1829948 - RNA, 19 nt, Salmonella typhimurium LT2
aagacgguuguuuuucaga

SEQ ID NO: 1829949 - RNA, 21 nt, Salmonella typhimurium LT2
aaguguguaccagcaacgcca

SEQ ID NO: 1829950 - RNA, 18 nt, Salmonella typhimurium LT2
aagugguucguccaucag

SEQ ID NO: 1829951 - RNA, 23 nt, Salmonella typhimurium LT2
aagugccaguaacucaucgccag

SEQ ID NO: 1829952 - RNA, 17 nt, Salmonella typhimurium LT2
aagugccuguucgugcg

SEQ ID NO: 1829953 - RNA, 14 nt, Salmonella typhimurium LT2
aagugcgcacucag

SEQ ID NO: 1829954 - RNA, 23 nt, Salmonella typhimurium LT2
aauaauugcgguggcgcaaaucg

SEQ ID NO: 1829955 - RNA, 20 nt, Salmonella typhimurium LT2
aauaacgaacugauggcgcu

SEQ ID NO: 1829956 - RNA, 13 nt, Salmonella typhimurium LT2
aauaaauccauga

SEQ ID NO: 1829957 - RNA, 19 nt, Salmonella typhimurium LT2
aauacucaauauccugcgg

SEQ ID NO: 1829958 - RNA, 15 nt, Salmonella typhimurium LT2
aauacgcauaaugcg

SEQ ID NO: 1829959 - RNA, 22 nt, Salmonella typhimurium LT2
aauauacgcaccugauaccuca

SEQ ID NO: 1829960 - RNA, 12 nt, Salmonella typhimurium LT2
aauauauuacga

SEQ ID NO: 1829961 - RNA, 15 nt, Salmonella typhimurium LT2
aauaucaaaccacgc

SEQ ID NO: 1829962 - RNA, 15 nt, Salmonella typhimurium LT2
aauaucaauuccaca

SEQ ID NO: 1829963 - RNA, 18 nt, Salmonella typhimurium LT2
aauaucggcucaauaccc

SEQ ID NO: 1829964 - RNA, 15 nt, Salmonella typhimurium LT2
aaucaaauccaacuc

SEQ ID NO: 1829965 - RNA, 14 nt, Salmonella typhimurium LT2
aauauuaucagcaa

SEQ ID NO: 1829966 - RNA, 16 nt, Salmonella typhimurium LT2
aauauuaucagcaaua

SEQ ID NO: 1829967 - RNA, 16 nt, Salmonella typhimurium LT2
aauaugcgucagcgcg

SEQ ID NO: 1829968 - RNA, 13 nt, Salmonella typhimurium LT2
aauaugcgucaga

SEQ ID NO: 1829969 - RNA, 13 nt, Salmonella typhimurium LT2
aauaugagcacag

SEQ ID NO: 1829970 - RNA, 19 nt, Salmonella typhimurium LT2
aaccggaguggccgcaaau

SEQ ID NO: 1829971 - RNA, 17 nt, Salmonella typhimurium LT2
aaccggcgaauagcgcc

SEQ ID NO: 1829972 - RNA, 20 nt, Salmonella typhimurium LT2
aacaccuuauccggccuaca

SEQ ID NO: 1829973 - RNA, 20 nt, Salmonella typhimurium LT2
aacacguuaucugaccuaca

SEQ ID NO: 1829974 - RNA, 23 nt, Salmonella typhimurium LT2
aacacggcgcucaggaucgccgg

SEQ ID NO: 1829975 - RNA, 19 nt, Salmonella typhimurium LT2
aaccucggcuugcuucauc

SEQ ID NO: 1829976 - RNA, 16 nt, Salmonella typhimurium LT2
aaccugcgcugacggc

SEQ ID NO: 1829977 - RNA, 13 nt, Salmonella typhimurium LT2
aaccgucggcaau

SEQ ID NO: 1829978 - RNA, 23 nt, Salmonella typhimurium LT2
aacgcggcgacuauugcgccgac

SEQ ID NO: 1829979 - RNA, 22 nt, Salmonella typhimurium LT2
aacgcggcgccagcgacaacgc

SEQ ID NO: 1829980 - RNA, 21 nt, Salmonella typhimurium LT2
aacgcguagccaaaagcgcca

SEQ ID NO: 1829981 - RNA, 20 nt, Salmonella typhimurium LT2
aacgccugcuccguccacgc

SEQ ID NO: 1829982 - RNA, 17 nt, Salmonella typhimurium LT2
aacgcgcucgccagcgc

SEQ ID NO: 1829983 - RNA, 19 nt, Salmonella typhimurium LT2
aacgcuuccggaucgcggc

SEQ ID NO: 1829984 - RNA, 13 nt, Salmonella typhimurium LT2
aacgcugcgccug

SEQ ID NO: 1829985 - RNA, 14 nt, Salmonella typhimurium LT2
aacgcucgcgcugu

SEQ ID NO: 1829986 - RNA, 22 nt, Salmonella typhimurium LT2
aacgcguuaaucacuaccugca

SEQ ID NO: 1829987 - RNA, 16 nt, Salmonella typhimurium LT2
aacgcguucauccagc

SEQ ID NO: 1829988 - RNA, 20 nt, Salmonella typhimurium LT2
aacgccaguggaugcgcuau

SEQ ID NO: 1829989 - RNA, 20 nt, Salmonella typhimurium LT2
aacgccaucagccgcgcuau

SEQ ID NO: 1829990 - RNA, 23 nt, Salmonella typhimurium LT2
aacgccaugacgccaagcugcag

SEQ ID NO: 1829991 - RNA, 19 nt, Salmonella typhimurium LT2
aacgcccaaaaugcggcau

SEQ ID NO: 1829992 - RNA, 14 nt, Salmonella typhimurium LT2
aacgccgugaacgc

SEQ ID NO: 1829993 - RNA, 16 nt, Salmonella typhimurium LT2
aacgccgugcucaucc

SEQ ID NO: 1829994 - RNA, 16 nt, Salmonella typhimurium LT2
aacgccguuaccagca

SEQ ID NO: 1829995 - RNA, 16 nt, Salmonella typhimurium LT2
aacgccgaacaggcca

SEQ ID NO: 1829996 - RNA, 23 nt, Salmonella typhimurium LT2
aacgccugcauaaacgcggccau

SEQ ID NO: 1829997 - RNA, 20 nt, Salmonella typhimurium LT2
aacgccugaugcugcgcauc

SEQ ID NO: 1829998 - RNA, 14 nt, Salmonella typhimurium LT2
aacgagcgcggcau

SEQ ID NO: 1829999 - RNA, 14 nt, Salmonella typhimurium LT2
aacgccaagcgcgg

SEQ ID NO: 1830000 - RNA, 17 nt, Salmonella typhimurium LT2
aacgccaagcgcggcag

SEQ ID NO: 1830001 - RNA, 19 nt, Salmonella typhimurium LT2
aacgaccgcgcucaccgcc

SEQ ID NO: 1830002 - RNA, 17 nt, Salmonella typhimurium LT2
aaccuuaagcgcgaaau

SEQ ID NO: 1830003 - RNA, 13 nt, Salmonella typhimurium LT2
aacggcgagcuuu

SEQ ID NO: 1830004 - RNA, 20 nt, Salmonella typhimurium LT2
aacggcgacgcccgccaucu

SEQ ID NO: 1830005 - RNA, 17 nt, Salmonella typhimurium LT2
aacggccucccagcuau

SEQ ID NO: 1830006 - RNA, 12 nt, Salmonella typhimurium LT2
aacggccagcgc

SEQ ID NO: 1830007 - RNA, 17 nt, Salmonella typhimurium LT2
aacggcccaaucaacgc

SEQ ID NO: 1830008 - RNA, 23 nt, Salmonella typhimurium LT2
aacggcagggauucgcucaccgc

SEQ ID NO: 1830009 - RNA, 13 nt, Salmonella typhimurium LT2
aacggcgccagcu

SEQ ID NO: 1830010 - RNA, 21 nt, Salmonella typhimurium LT2
aacggcgccgugagcuguggu

SEQ ID NO: 1830011 - RNA, 22 nt, Salmonella typhimurium LT2
aacuccggcgaccaguuauucg

SEQ ID NO: 1830012 - RNA, 18 nt, Salmonella typhimurium LT2
aacucgacuuuuuccggc

SEQ ID NO: 1830013 - RNA, 14 nt, Salmonella typhimurium LT2
aacucaguuuccag

SEQ ID NO: 1830014 - RNA, 15 nt, Salmonella typhimurium LT2
aacucaauccauucc

SEQ ID NO: 1830015 - RNA, 13 nt, Salmonella typhimurium LT2
aacucaucgccag

SEQ ID NO: 1830016 - RNA, 12 nt, Salmonella typhimurium LT2
aacucagcgcca

SEQ ID NO: 1830017 - RNA, 16 nt, Salmonella typhimurium LT2
aacucuccaugccauc

SEQ ID NO: 1830018 - RNA, 16 nt, Salmonella typhimurium LT2
aacugacgaucguggc

SEQ ID NO: 1830019 - RNA, 22 nt, Salmonella typhimurium LT2
aacucuuucuugaauauggcgg

SEQ ID NO: 1830020 - RNA, 15 nt, Salmonella typhimurium LT2
aacugaguucgccau

SEQ ID NO: 1830021 - RNA, 23 nt, Salmonella typhimurium LT2
aacugcaccuuuuuuuccagcgu

SEQ ID NO: 1830022 - RNA, 21 nt, Salmonella typhimurium LT2
aacugcgccugaagauacgcc

SEQ ID NO: 1830023 - RNA, 15 nt, Salmonella typhimurium LT2
aacugcgcguauccg

SEQ ID NO: 1830024 - RNA, 21 nt, Salmonella typhimurium LT2
aacuuaccaguuauagcgcag

SEQ ID NO: 1830025 - RNA, 12 nt, Salmonella typhimurium LT2
aacuuccgccac

SEQ ID NO: 1830026 - RNA, 17 nt, Salmonella typhimurium LT2
aacuucuccuccaucag

SEQ ID NO: 1830027 - RNA, 15 nt, Salmonella typhimurium LT2
aacuggcggcgcacg

SEQ ID NO: 1830028 - RNA, 15 nt, Salmonella typhimurium LT2
aacuggauuccuggc

SEQ ID NO: 1830029 - RNA, 19 nt, Salmonella typhimurium LT2
aagaaguucuucuggcgca

SEQ ID NO: 1830030 - RNA, 19 nt, Salmonella typhimurium LT2
aagaaucgccaggcgcagc

SEQ ID NO: 1830031 - RNA, 12 nt, Salmonella typhimurium LT2
aagaauuccacc

SEQ ID NO: 1830032 - RNA, 15 nt, Salmonella typhimurium LT2
aagacacgcuuccag

SEQ ID NO: 1830033 - RNA, 19 nt, Salmonella typhimurium LT2
acgacggcuaaguuaaccg

SEQ ID NO: 1830034 - RNA, 13 nt, Salmonella typhimurium LT2
aaacaagaucgcc

SEQ ID NO: 1830035 - RNA, 14 nt, Salmonella typhimurium LT2
acgacugaguauug

SEQ ID NO: 1830036 - RNA, 13 nt, Salmonella typhimurium LT2
acgacugaguauu

SEQ ID NO: 1830037 - RNA, 15 nt, Salmonella typhimurium LT2
acgaguggcgcggaa

SEQ ID NO: 1830038 - RNA, 20 nt, Salmonella typhimurium LT2
acgaggcugccgaugauccc

SEQ ID NO: 1830039 - RNA, 12 nt, Salmonella typhimurium LT2
acgauacgucau

SEQ ID NO: 1830040 - RNA, 19 nt, Salmonella typhimurium LT2
acgauacgucauaucaucc

SEQ ID NO: 1830041 - RNA, 20 nt, Salmonella typhimurium LT2
acgauaaagcugggucagga

SEQ ID NO: 1830042 - RNA, 22 nt, Salmonella typhimurium LT2
acgauaauaucgucaccaggau

SEQ ID NO: 1830043 - RNA, 16 nt, Salmonella typhimurium LT2
acgaucgagucaggcg

SEQ ID NO: 1830044 - RNA, 22 nt, Salmonella typhimurium LT2
acgauguucgucccugcaacgc

SEQ ID NO: 1830045 - RNA, 22 nt, Salmonella typhimurium LT2
acgcacaguacgcccggcgggu

SEQ ID NO: 1830046 - RNA, 23 nt, Salmonella typhimurium LT2
acgauuacugugauuacgacuua

SEQ ID NO: 1830047 - RNA, 22 nt, Salmonella typhimurium LT2
acgcaacucacgccauuccgcu

SEQ ID NO: 1830048 - RNA, 19 nt, Salmonella typhimurium LT2
acgcaacaacaggccagaa

SEQ ID NO: 1830049 - RNA, 18 nt, Salmonella typhimurium LT2
acgcaacaccaucccgcu

SEQ ID NO: 1830050 - RNA, 17 nt, Salmonella typhimurium LT2
acgaauaagaaucagau

SEQ ID NO: 1830051 - RNA, 16 nt, Salmonella typhimurium LT2
acgaagucuggcugca

SEQ ID NO: 1830052 - RNA, 18 nt, Salmonella typhimurium LT2
acgacagcgccaucagca

SEQ ID NO: 1830053 - RNA, 21 nt, Salmonella typhimurium LT2
acgacacccgauacacgccga

SEQ ID NO: 1830054 - RNA, 17 nt, Salmonella typhimurium LT2
acgacacuuuuugccga

SEQ ID NO: 1830055 - RNA, 13 nt, Salmonella typhimurium LT2
acgacacggcgca

SEQ ID NO: 1830056 - RNA, 22 nt, Salmonella typhimurium LT2
acgaccagguaauggacgcaaa

SEQ ID NO: 1830057 - RNA, 15 nt, Salmonella typhimurium LT2
acgaccgcgcucacc

SEQ ID NO: 1830058 - RNA, 15 nt, Salmonella typhimurium LT2
acgacgaauauccag

SEQ ID NO: 1830059 - RNA, 14 nt, Salmonella typhimurium LT2
acgaaacgcaucgu

SEQ ID NO: 1830060 - RNA, 21 nt, Salmonella typhimurium LT2
accuuuuugauccguuucaga

SEQ ID NO: 1830061 - RNA, 18 nt, Salmonella typhimurium LT2
accuuugacgccugcauc

SEQ ID NO: 1830062 - RNA, 22 nt, Salmonella typhimurium LT2
accuuugcccgagcgcuggcau

SEQ ID NO: 1830063 - RNA, 21 nt, Salmonella typhimurium LT2
acgaacaggauauuaccgcca

SEQ ID NO: 1830064 - RNA, 19 nt, Salmonella typhimurium LT2
acgaacaguucggucaacg

SEQ ID NO: 1830065 - RNA, 16 nt, Salmonella typhimurium LT2
acgaaccggcgccguu

SEQ ID NO: 1830066 - RNA, 16 nt, Salmonella typhimurium LT2
accugcacuccggcuc

SEQ ID NO: 1830067 - RNA, 17 nt, Salmonella typhimurium LT2
accugauugauacgcgc

SEQ ID NO: 1830068 - RNA, 23 nt, Salmonella typhimurium LT2
accugcaaaaacgccagaccgac

SEQ ID NO: 1830069 - RNA, 16 nt, Salmonella typhimurium LT2
accugauuugucgcgc

SEQ ID NO: 1830070 - RNA, 18 nt, Salmonella typhimurium LT2
accugauuaaucagcuca

SEQ ID NO: 1830071 - RNA, 21 nt, Salmonella typhimurium LT2
accugauuaaucagcucagca

SEQ ID NO: 1830072 - RNA, 14 nt, Salmonella typhimurium LT2
accguuauccggca

SEQ ID NO: 1830073 - RNA, 17 nt, Salmonella typhimurium LT2
accguucagaucgccaa

SEQ ID NO: 1830074 - RNA, 20 nt, Salmonella typhimurium LT2
accguucaucuaucgccagc

SEQ ID NO: 1830075 - RNA, 23 nt, Salmonella typhimurium LT2
accguuaccguuuaacgcaucgc

SEQ ID NO: 1830076 - RNA, 22 nt, Salmonella typhimurium LT2
accguggcuuuccccugacggg

SEQ ID NO: 1830077 - RNA, 20 nt, Salmonella typhimurium LT2
accuaucaggcguugaccgc

SEQ ID NO: 1830078 - RNA, 19 nt, Salmonella typhimurium LT2
accguuuaaaaacaucauu

SEQ ID NO: 1830079 - RNA, 19 nt, Salmonella typhimurium LT2
accuacaccguauccggcc

SEQ ID NO: 1830080 - RNA, 11 nt, Salmonella typhimurium LT2
accuaccagcg

SEQ ID NO: 1830081 - RNA, 18 nt, Salmonella typhimurium LT2
accuaccugcucaaucgc

SEQ ID NO: 1830082 - RNA, 16 nt, Salmonella typhimurium LT2
accucuauaguaaauu

SEQ ID NO: 1830083 - RNA, 16 nt, Salmonella typhimurium LT2
accugacggcagccac

SEQ ID NO: 1830084 - RNA, 19 nt, Salmonella typhimurium LT2
accugaccacgacgaccgc

SEQ ID NO: 1830085 - RNA, 15 nt, Salmonella typhimurium LT2
accugagucuggaca

SEQ ID NO: 1830086 - RNA, 20 nt, Salmonella typhimurium LT2
accugaaugccauccagcac

SEQ ID NO: 1830087 - RNA, 19 nt, Salmonella typhimurium LT2
accugaacgccuaccgcuu

SEQ ID NO: 1830088 - RNA, 21 nt, Salmonella typhimurium LT2
accucuuuuaacgaacgcgcg

SEQ ID NO: 1830089 - RNA, 20 nt, Salmonella typhimurium LT2
accucgcuucccugacgcgc

SEQ ID NO: 1830090 - RNA, 16 nt, Salmonella typhimurium LT2
accguaaucaucgcga

SEQ ID NO: 1830091 - RNA, 17 nt, Salmonella typhimurium LT2
accgguuuuucgccgac

SEQ ID NO: 1830092 - RNA, 18 nt, Salmonella typhimurium LT2
accgguuuuuuccugcac

SEQ ID NO: 1830093 - RNA, 23 nt, Salmonella typhimurium LT2
accgguuuguuauugaucacggu

SEQ ID NO: 1830094 - RNA, 13 nt, Salmonella typhimurium LT2
accguauccggcc

SEQ ID NO: 1830095 - RNA, 17 nt, Salmonella typhimurium LT2
accgucaccacgcgcga

SEQ ID NO: 1830096 - RNA, 15 nt, Salmonella typhimurium LT2
accguagaucgccag

SEQ ID NO: 1830097 - RNA, 16 nt, Salmonella typhimurium LT2
accguagcaucaucaa

SEQ ID NO: 1830098 - RNA, 18 nt, Salmonella typhimurium LT2
accguagcuuugcgccag

SEQ ID NO: 1830099 - RNA, 15 nt, Salmonella typhimurium LT2
accgucauccugcaa

SEQ ID NO: 1830100 - RNA, 17 nt, Salmonella typhimurium LT2
accgucagcaccagcga

SEQ ID NO: 1830101 - RNA, 17 nt, Salmonella typhimurium LT2
accgucgaucucggcca

SEQ ID NO: 1830102 - RNA, 13 nt, Salmonella typhimurium LT2
accgucgcggcau

SEQ ID NO: 1830103 - RNA, 19 nt, Salmonella typhimurium LT2
accgugaccuucaccugaa

SEQ ID NO: 1830104 - RNA, 18 nt, Salmonella typhimurium LT2
accgugagaaucgaucag

SEQ ID NO: 1830105 - RNA, 13 nt, Salmonella typhimurium LT2
accgugagcgcgc

SEQ ID NO: 1830106 - RNA, 21 nt, Salmonella typhimurium LT2
accgugaguaucgaucgucau

SEQ ID NO: 1830107 - RNA, 18 nt, Salmonella typhimurium LT2
accgucuucauccaugcg

SEQ ID NO: 1830108 - RNA, 13 nt, Salmonella typhimurium LT2
accgucuggcgag

SEQ ID NO: 1830109 - RNA, 14 nt, Salmonella typhimurium LT2
accggggcguacca

SEQ ID NO: 1830110 - RNA, 15 nt, Salmonella typhimurium LT2
accgggguucagacc

SEQ ID NO: 1830111 - RNA, 18 nt, Salmonella typhimurium LT2
accgggugcacgaacugc

SEQ ID NO: 1830112 - RNA, 18 nt, Salmonella typhimurium LT2
accggcacauccagcugu

SEQ ID NO: 1830113 - RNA, 14 nt, Salmonella typhimurium LT2
accggcaaucgccu

SEQ ID NO: 1830114 - RNA, 22 nt, Salmonella typhimurium LT2
accggcaaucgccugcaacgcu

SEQ ID NO: 1830115 - RNA, 17 nt, Salmonella typhimurium LT2
accgggccugaugcgcg

SEQ ID NO: 1830116 - RNA, 14 nt, Salmonella typhimurium LT2
accgguugcgcgcu

SEQ ID NO: 1830117 - RNA, 15 nt, Salmonella typhimurium LT2
accgguucgcggcag

SEQ ID NO: 1830118 - RNA, 20 nt, Salmonella typhimurium LT2
accggucucuuaauaccggc

SEQ ID NO: 1830119 - RNA, 18 nt, Salmonella typhimurium LT2
accgguaaucccuucacg

SEQ ID NO: 1830120 - RNA, 15 nt, Salmonella typhimurium LT2
accgcguuccaucgc

SEQ ID NO: 1830121 - RNA, 18 nt, Salmonella typhimurium LT2
accggaggagugcgccag

SEQ ID NO: 1830122 - RNA, 17 nt, Salmonella typhimurium LT2
accggauuuagcggcag

SEQ ID NO: 1830123 - RNA, 22 nt, Salmonella typhimurium LT2
accggauacccagccacaugau

SEQ ID NO: 1830124 - RNA, 22 nt, Salmonella typhimurium LT2
accgcugcgugcgcgccaccgg

SEQ ID NO: 1830125 - RNA, 13 nt, Salmonella typhimurium LT2
accgccuccaggc

SEQ ID NO: 1830126 - RNA, 22 nt, Salmonella typhimurium LT2
accgccugcggcauacuuucgc

SEQ ID NO: 1830127 - RNA, 17 nt, Salmonella typhimurium LT2
accgccugcucaagcug

SEQ ID NO: 1830128 - RNA, 21 nt, Salmonella typhimurium LT2
accgcgaucgaugugauaaau

SEQ ID NO: 1830129 - RNA, 13 nt, Salmonella typhimurium LT2
accgccgcgcuau

SEQ ID NO: 1830130 - RNA, 13 nt, Salmonella typhimurium LT2
accgcaucggcau

SEQ ID NO: 1830131 - RNA, 18 nt, Salmonella typhimurium LT2
accgcauaacgcgcuggu

SEQ ID NO: 1830132 - RNA, 23 nt, Salmonella typhimurium LT2
accgcauaacgcgcuggucagca

SEQ ID NO: 1830133 - RNA, 13 nt, Salmonella typhimurium LT2
accgcaggcagcg

SEQ ID NO: 1830134 - RNA, 11 nt, Salmonella typhimurium LT2
accgccagaug

SEQ ID NO: 1830135 - RNA, 15 nt, Salmonella typhimurium LT2
accgaugacggcaaa

SEQ ID NO: 1830136 - RNA, 16 nt, Salmonella typhimurium LT2
accgauuucagcgugg

SEQ ID NO: 1830137 - RNA, 15 nt, Salmonella typhimurium LT2
acccgcuuccaguuu

SEQ ID NO: 1830138 - RNA, 22 nt, Salmonella typhimurium LT2
acccgcuuacaguuuaucugcg

SEQ ID NO: 1830139 - RNA, 21 nt, Salmonella typhimurium LT2
accgacaaccugaaugccauc

SEQ ID NO: 1830140 - RNA, 19 nt, Salmonella typhimurium LT2
accgacacauucaggcuuu

SEQ ID NO: 1830141 - RNA, 16 nt, Salmonella typhimurium LT2
accgauagcgcggaau

SEQ ID NO: 1830142 - RNA, 14 nt, Salmonella typhimurium LT2
accgacgcgaauug

SEQ ID NO: 1830143 - RNA, 22 nt, Salmonella typhimurium LT2
accgacgcauuuuuccguauug

SEQ ID NO: 1830144 - RNA, 14 nt, Salmonella typhimurium LT2
acauaaauccggau

SEQ ID NO: 1830145 - RNA, 18 nt, Salmonella typhimurium LT2
acaguucagacaccacgc

SEQ ID NO: 1830146 - RNA, 23 nt, Salmonella typhimurium LT2
acaguucagacaccacgccggaa

SEQ ID NO: 1830147 - RNA, 11 nt, Salmonella typhimurium LT2
accaggcgcac

SEQ ID NO: 1830148 - RNA, 13 nt, Salmonella typhimurium LT2
accaguaaccgcc

SEQ ID NO: 1830149 - RNA, 21 nt, Salmonella typhimurium LT2
accaucaauauuggugucgua

SEQ ID NO: 1830150 - RNA, 13 nt, Salmonella typhimurium LT2
accaucgccggag

SEQ ID NO: 1830151 - RNA, 14 nt, Salmonella typhimurium LT2
accaucgcgccgcu

SEQ ID NO: 1830152 - RNA, 18 nt, Salmonella typhimurium LT2
accaucguugccagcggc

SEQ ID NO: 1830153 - RNA, 19 nt, Salmonella typhimurium LT2
accaucuuuuccggcaggg

SEQ ID NO: 1830154 - RNA, 16 nt, Salmonella typhimurium LT2
accaucuuuuccggca

SEQ ID NO: 1830155 - RNA, 17 nt, Salmonella typhimurium LT2
accaugcaccacaccgg

SEQ ID NO: 1830156 - RNA, 24 nt, Salmonella typhimurium LT2
aaaauaucggccugaaugcucuca

SEQ ID NO: 1830157 - RNA, 19 nt, Salmonella typhimurium LT2
aaaauagccgccaugcgac

SEQ ID NO: 1830158 - RNA, 11 nt, Salmonella typhimurium LT2
aaaaucgacug

SEQ ID NO: 1830159 - RNA, 13 nt, Salmonella typhimurium LT2
accaguuuauccg

SEQ ID NO: 1830160 - RNA, 14 nt, Salmonella typhimurium LT2
accaguuuauccgc

SEQ ID NO: 1830161 - RNA, 18 nt, Salmonella typhimurium LT2
accauauccaacgcgguu

SEQ ID NO: 1830162 - RNA, 21 nt, Salmonella typhimurium LT2
accaucaaauaauacgccggc

SEQ ID NO: 1830163 - RNA, 24 nt, Salmonella typhimurium LT2
accauauucgccaccgcgcgcuua

SEQ ID NO: 1830164 - RNA, 21 nt, Salmonella typhimurium LT2
acccccagccauuuccgccau

SEQ ID NO: 1830165 - RNA, 18 nt, Salmonella typhimurium LT2
accauucauguuucgaca

SEQ ID NO: 1830166 - RNA, 21 nt, Salmonella typhimurium LT2
accauucccacgcauaguccu

SEQ ID NO: 1830167 - RNA, 19 nt, Salmonella typhimurium LT2
acccagcgcuaacggcggu

SEQ ID NO: 1830168 - RNA, 14 nt, Salmonella typhimurium LT2
acccagcgcgacau

SEQ ID NO: 1830169 - RNA, 19 nt, Salmonella typhimurium LT2
acccagcgucccggcgucu

SEQ ID NO: 1830170 - RNA, 23 nt, Salmonella typhimurium LT2
aaaauuaugaauaaccaucggac

SEQ ID NO: 1830171 - RNA, 15 nt, Salmonella typhimurium LT2
acccgcaaugugcag

SEQ ID NO: 1830172 - RNA, 12 nt, Salmonella typhimurium LT2
acccgaugcgag

SEQ ID NO: 1830173 - RNA, 15 nt, Salmonella typhimurium LT2
accccggcgcgggca

SEQ ID NO: 1830174 - RNA, 15 nt, Salmonella typhimurium LT2
acccgccugcgccuu

SEQ ID NO: 1830175 - RNA, 16 nt, Salmonella typhimurium LT2
acccgcgcucagcguc

SEQ ID NO: 1830176 - RNA, 23 nt, Salmonella typhimurium LT2
acggucaaacagauccagcgccg

SEQ ID NO: 1830177 - RNA, 16 nt, Salmonella typhimurium LT2
acgguaauugacgcgu

SEQ ID NO: 1830178 - RNA, 22 nt, Salmonella typhimurium LT2
acgguaacagcuugaucaucag

SEQ ID NO: 1830179 - RNA, 17 nt, Salmonella typhimurium LT2
acggucgacaccagcga

SEQ ID NO: 1830180 - RNA, 23 nt, Salmonella typhimurium LT2
acgguuaaugaaaucgucgccaa

SEQ ID NO: 1830181 - RNA, 15 nt, Salmonella typhimurium LT2
acgggcacccgguca

SEQ ID NO: 1830182 - RNA, 19 nt, Salmonella typhimurium LT2
acgggcgaugguguuggcg

SEQ ID NO: 1830183 - RNA, 19 nt, Salmonella typhimurium LT2
acgggcagcggcuucaaua

SEQ ID NO: 1830184 - RNA, 22 nt, Salmonella typhimurium LT2
acgggcggaaaacauucgcccg

SEQ ID NO: 1830185 - RNA, 17 nt, Salmonella typhimurium LT2
acggcguaacgguucgg

SEQ ID NO: 1830186 - RNA, 14 nt, Salmonella typhimurium LT2
acggcgucaauucc

SEQ ID NO: 1830187 - RNA, 19 nt, Salmonella typhimurium LT2
acgggaacuuucgggcaaa

SEQ ID NO: 1830188 - RNA, 14 nt, Salmonella typhimurium LT2
acgggaacggcgua

SEQ ID NO: 1830189 - RNA, 18 nt, Salmonella typhimurium LT2
acgggaaucuccgggaaa

SEQ ID NO: 1830190 - RNA, 19 nt, Salmonella typhimurium LT2
acggcggcugcgaugccau

SEQ ID NO: 1830191 - RNA, 20 nt, Salmonella typhimurium LT2
acuaaacuaaugccuggcag

SEQ ID NO: 1830192 - RNA, 21 nt, Salmonella typhimurium LT2
acuaaaggcagcgcgcugucu

SEQ ID NO: 1830193 - RNA, 13 nt, Salmonella typhimurium LT2
acuaauuuaagcg

SEQ ID NO: 1830194 - RNA, 22 nt, Salmonella typhimurium LT2
acuaaguucucguucaacggca

SEQ ID NO: 1830195 - RNA, 18 nt, Salmonella typhimurium LT2
acuaaccagcgcgguuua

SEQ ID NO: 1830196 - RNA, 21 nt, Salmonella typhimurium LT2
acguuaaagccgaccaucgcg

SEQ ID NO: 1830197 - RNA, 22 nt, Salmonella typhimurium LT2
acguuaaagccgaccaucgcgc

SEQ ID NO: 1830198 - RNA, 16 nt, Salmonella typhimurium LT2
acguuaacgccgcauu

SEQ ID NO: 1830199 - RNA, 20 nt, Salmonella typhimurium LT2
acguuauuggcccccaucgc

SEQ ID NO: 1830200 - RNA, 22 nt, Salmonella typhimurium LT2
acguucagcgcgguacggccca

SEQ ID NO: 1830201 - RNA, 15 nt, Salmonella typhimurium LT2
acguuccgcaaucgc

SEQ ID NO: 1830202 - RNA, 15 nt, Salmonella typhimurium LT2
acguuucgcuaucgc

SEQ ID NO: 1830203 - RNA, 13 nt, Salmonella typhimurium LT2
acguuuacgccgc

SEQ ID NO: 1830204 - RNA, 16 nt, Salmonella typhimurium LT2
acguuuuuagcagugc

SEQ ID NO: 1830205 - RNA, 19 nt, Salmonella typhimurium LT2
acguuuuucagccgcgcau

SEQ ID NO: 1830206 - RNA, 18 nt, Salmonella typhimurium LT2
acguuuugcagcgccauc

SEQ ID NO: 1830207 - RNA, 21 nt, Salmonella typhimurium LT2
acguuuggcuuauccgcgugg

SEQ ID NO: 1830208 - RNA, 14 nt, Salmonella typhimurium LT2
acguagcgcauugc

SEQ ID NO: 1830209 - RNA, 22 nt, Salmonella typhimurium LT2
acgguuucuacuuccaccaccu

SEQ ID NO: 1830210 - RNA, 19 nt, Salmonella typhimurium LT2
acgguuucagugauaaagc

SEQ ID NO: 1830211 - RNA, 19 nt, Salmonella typhimurium LT2
acgguuggcuauacgcggc

SEQ ID NO: 1830212 - RNA, 20 nt, Salmonella typhimurium LT2
acguaggccugauaagcgca

SEQ ID NO: 1830213 - RNA, 21 nt, Salmonella typhimurium LT2
acguaggccugauaagcgcag

SEQ ID NO: 1830214 - RNA, 23 nt, Salmonella typhimurium LT2
acguagucguuguaggccugaua

SEQ ID NO: 1830215 - RNA, 14 nt, Salmonella typhimurium LT2
acgucgcgaaucgu

SEQ ID NO: 1830216 - RNA, 17 nt, Salmonella typhimurium LT2
acgugcuccagcgccug

SEQ ID NO: 1830217 - RNA, 20 nt, Salmonella typhimurium LT2
acgugcgguauaucacgcca

SEQ ID NO: 1830218 - RNA, 21 nt, Salmonella typhimurium LT2
acgcuccagcuggcuggcauu

SEQ ID NO: 1830219 - RNA, 22 nt, Salmonella typhimurium LT2
acgcucccggaaccgaccgcga

SEQ ID NO: 1830220 - RNA, 23 nt, Salmonella typhimurium LT2
acgcucacuuuucuuuccugcaa

SEQ ID NO: 1830221 - RNA, 13 nt, Salmonella typhimurium LT2
acgcugauagcca

SEQ ID NO: 1830222 - RNA, 21 nt, Salmonella typhimurium LT2
acgcugaccuuuuucauccuc

SEQ ID NO: 1830223 - RNA, 19 nt, Salmonella typhimurium LT2
acgcugacgcgaucgccgu

SEQ ID NO: 1830224 - RNA, 22 nt, Salmonella typhimurium LT2
acgcucgcggaagcgaccggcg

SEQ ID NO: 1830225 - RNA, 19 nt, Salmonella typhimurium LT2
acgcgggguaaaauggacu

SEQ ID NO: 1830226 - RNA, 16 nt, Salmonella typhimurium LT2
acgcggguccgcggag

SEQ ID NO: 1830227 - RNA, 15 nt, Salmonella typhimurium LT2
acgcggcuuauccgg

SEQ ID NO: 1830228 - RNA, 22 nt, Salmonella typhimurium LT2
acgcgcuguaacuucacgccau

SEQ ID NO: 1830229 - RNA, 19 nt, Salmonella typhimurium LT2
acgcggacgccaccacagu

SEQ ID NO: 1830230 - RNA, 22 nt, Salmonella typhimurium LT2
aaacaguuccgcaaagcccauc

SEQ ID NO: 1830231 - RNA, 15 nt, Salmonella typhimurium LT2
acgcgaaggccagca

SEQ ID NO: 1830232 - RNA, 18 nt, Salmonella typhimurium LT2
acgcgaaggccagcacca

SEQ ID NO: 1830233 - RNA, 16 nt, Salmonella typhimurium LT2
acgcgacaacgccgga

SEQ ID NO: 1830234 - RNA, 16 nt, Salmonella typhimurium LT2
aaacauaagcaaaucc

SEQ ID NO: 1830235 - RNA, 15 nt, Salmonella typhimurium LT2
aaacauaagcaaauc

SEQ ID NO: 1830236 - RNA, 14 nt, Salmonella typhimurium LT2
acgccuuuaagcug

SEQ ID NO: 1830237 - RNA, 18 nt, Salmonella typhimurium LT2
acgccuuucacgccgaag

SEQ ID NO: 1830238 - RNA, 19 nt, Salmonella typhimurium LT2
acgcacuguuggcguugau

SEQ ID NO: 1830239 - RNA, 15 nt, Salmonella typhimurium LT2
acgcacuuuuaucgg

SEQ ID NO: 1830240 - RNA, 20 nt, Salmonella typhimurium LT2
acgcagaaccgccgcgauag

SEQ ID NO: 1830241 - RNA, 16 nt, Salmonella typhimurium LT2
acgcgcuaucaauauu

SEQ ID NO: 1830242 - RNA, 18 nt, Salmonella typhimurium LT2
acgcgcgucgcuaaucag

SEQ ID NO: 1830243 - RNA, 14 nt, Salmonella typhimurium LT2
acgcgcagcaccga

SEQ ID NO: 1830244 - RNA, 14 nt, Salmonella typhimurium LT2
acgcgcauaccgcu

SEQ ID NO: 1830245 - RNA, 22 nt, Salmonella typhimurium LT2
acggagaugaucguuuccagca

SEQ ID NO: 1830246 - RNA, 20 nt, Salmonella typhimurium LT2
acggagauuaacagcgcgac

SEQ ID NO: 1830247 - RNA, 16 nt, Salmonella typhimurium LT2
acggaccggcaaucgc

SEQ ID NO: 1830248 - RNA, 16 nt, Salmonella typhimurium LT2
acgcuuuuuaccggcg

SEQ ID NO: 1830249 - RNA, 20 nt, Salmonella typhimurium LT2
acggaaccgcguuuacgccg

SEQ ID NO: 1830250 - RNA, 22 nt, Salmonella typhimurium LT2
acggaaccaaaugcccagcuca

SEQ ID NO: 1830251 - RNA, 14 nt, Salmonella typhimurium LT2
acggaauaugcgcu

SEQ ID NO: 1830252 - RNA, 20 nt, Salmonella typhimurium LT2
acgcuuuacgcuuaucccag

SEQ ID NO: 1830253 - RNA, 14 nt, Salmonella typhimurium LT2
acggaaaccagaua

SEQ ID NO: 1830254 - RNA, 21 nt, Salmonella typhimurium LT2
acgcuuugcuguacauaucca

SEQ ID NO: 1830255 - RNA, 14 nt, Salmonella typhimurium LT2
acgcuuaucgccgu

SEQ ID NO: 1830256 - RNA, 16 nt, Salmonella typhimurium LT2
acgcuucauaucgccc

SEQ ID NO: 1830257 - RNA, 22 nt, Salmonella typhimurium LT2
acgcuucccagcgucgccagua

SEQ ID NO: 1830258 - RNA, 20 nt, Salmonella typhimurium LT2
acgcuucggcuccagcgccu

SEQ ID NO: 1830259 - RNA, 14 nt, Salmonella typhimurium LT2
acgcuggcacagga

SEQ ID NO: 1830260 - RNA, 17 nt, Salmonella typhimurium LT2
acgcuggaagaggcgcc

SEQ ID NO: 1830261 - RNA, 18 nt, Salmonella typhimurium LT2
acgcugcaaaaagccuug

SEQ ID NO: 1830262 - RNA, 20 nt, Salmonella typhimurium LT2
acgcugcaacccgccgccau

SEQ ID NO: 1830263 - RNA, 20 nt, Salmonella typhimurium LT2
acgcugguuguccugguaca

SEQ ID NO: 1830264 - RNA, 15 nt, Salmonella typhimurium LT2
acgcuguaaaccggc

SEQ ID NO: 1830265 - RNA, 23 nt, Salmonella typhimurium LT2
acgcuuaucaggccuaccagucg

SEQ ID NO: 1830266 - RNA, 19 nt, Salmonella typhimurium LT2
acgcuuaucaggccuacaa

SEQ ID NO: 1830267 - RNA, 20 nt, Salmonella typhimurium LT2
acgcuuaucaggccuacaac

SEQ ID NO: 1830268 - RNA, 20 nt, Salmonella typhimurium LT2
acgcuuaucaggccuacauc

SEQ ID NO: 1830269 - RNA, 14 nt, Salmonella typhimurium LT2
acggcagcgccauc

SEQ ID NO: 1830270 - RNA, 12 nt, Salmonella typhimurium LT2
acggauaagcca

SEQ ID NO: 1830271 - RNA, 17 nt, Salmonella typhimurium LT2
agacgauaccagggcga

SEQ ID NO: 1830272 - RNA, 16 nt, Salmonella typhimurium LT2
agacgaauaaucucau

SEQ ID NO: 1830273 - RNA, 18 nt, Salmonella typhimurium LT2
agaccggcaucucaucuu

SEQ ID NO: 1830274 - RNA, 19 nt, Salmonella typhimurium LT2
agaccucguucggcgcacc

SEQ ID NO: 1830275 - RNA, 18 nt, Salmonella typhimurium LT2
agaccgcuuaacuccggc

SEQ ID NO: 1830276 - RNA, 15 nt, Salmonella typhimurium LT2
agaccguggauaaga

SEQ ID NO: 1830277 - RNA, 18 nt, Salmonella typhimurium LT2
agacacuggaaacagcca

SEQ ID NO: 1830278 - RNA, 14 nt, Salmonella typhimurium LT2
agacaacccgucac

SEQ ID NO: 1830279 - RNA, 17 nt, Salmonella typhimurium LT2
agacaauaccagggcga

SEQ ID NO: 1830280 - RNA, 16 nt, Salmonella typhimurium LT2
agaauuuuuagcgugc

SEQ ID NO: 1830281 - RNA, 19 nt, Salmonella typhimurium LT2
agacauuugcgcacggcgc

SEQ ID NO: 1830282 - RNA, 23 nt, Salmonella typhimurium LT2
agacaucggucagaccguaaauc

SEQ ID NO: 1830283 - RNA, 22 nt, Salmonella typhimurium LT2
agacagcccuauaacagcgcca

SEQ ID NO: 1830284 - RNA, 21 nt, Salmonella typhimurium LT2
agacagcgcgcccagcagggc

SEQ ID NO: 1830285 - RNA, 21 nt, Salmonella typhimurium LT2
agacauacgggaauuccaguc

SEQ ID NO: 1830286 - RNA, 12 nt, Salmonella typhimurium LT2
agacacuuuccg

SEQ ID NO: 1830287 - RNA, 15 nt, Salmonella typhimurium LT2
agacagaaucaggcc

SEQ ID NO: 1830288 - RNA, 18 nt, Salmonella typhimurium LT2
agacagacaaccagcagg

SEQ ID NO: 1830289 - RNA, 23 nt, Salmonella typhimurium LT2
agaccacgaaucaggauauucgc

SEQ ID NO: 1830290 - RNA, 16 nt, Salmonella typhimurium LT2
agaccauccaugaaau

SEQ ID NO: 1830291 - RNA, 16 nt, Salmonella typhimurium LT2
agaccagcgccggagc

SEQ ID NO: 1830292 - RNA, 17 nt, Salmonella typhimurium LT2
agacccgcaauaacgcc

SEQ ID NO: 1830293 - RNA, 17 nt, Salmonella typhimurium LT2
agacccgacaguaaaac

SEQ ID NO: 1830294 - RNA, 13 nt, Salmonella typhimurium LT2
agacccggcauug

SEQ ID NO: 1830295 - RNA, 14 nt, Salmonella typhimurium LT2
agacuaaaaagcgc

SEQ ID NO: 1830296 - RNA, 16 nt, Salmonella typhimurium LT2
agacuaaaaagcgcgu

SEQ ID NO: 1830297 - RNA, 16 nt, Salmonella typhimurium LT2
agacucaggcgcaucu

SEQ ID NO: 1830298 - RNA, 16 nt, Salmonella typhimurium LT2
agacguuuacgccgcc

SEQ ID NO: 1830299 - RNA, 22 nt, Salmonella typhimurium LT2
agacgucaacaccuccaguuca

SEQ ID NO: 1830300 - RNA, 16 nt, Salmonella typhimurium LT2
agacgcuucauaucgc

SEQ ID NO: 1830301 - RNA, 22 nt, Salmonella typhimurium LT2
agacggcggcuuaccgaaucuu

SEQ ID NO: 1830302 - RNA, 13 nt, Salmonella typhimurium LT2
agagcguauccag

SEQ ID NO: 1830303 - RNA, 20 nt, Salmonella typhimurium LT2
agagcggcaacacauccggc

SEQ ID NO: 1830304 - RNA, 16 nt, Salmonella typhimurium LT2
agagcaguacgccaaa

SEQ ID NO: 1830305 - RNA, 17 nt, Salmonella typhimurium LT2
agagaagucugagcgca

SEQ ID NO: 1830306 - RNA, 18 nt, Salmonella typhimurium LT2
agagaauuuuuagcgugc

SEQ ID NO: 1830307 - RNA, 14 nt, Salmonella typhimurium LT2
agagacgccaacgu

SEQ ID NO: 1830308 - RNA, 16 nt, Salmonella typhimurium LT2
agagaguauaagcgcc

SEQ ID NO: 1830309 - RNA, 16 nt, Salmonella typhimurium LT2
agagagaugucgcaau

SEQ ID NO: 1830310 - RNA, 16 nt, Salmonella typhimurium LT2
agaugcggaugccgca

SEQ ID NO: 1830311 - RNA, 23 nt, Salmonella typhimurium LT2
agaugcgccagauucaugauuuc

SEQ ID NO: 1830312 - RNA, 14 nt, Salmonella typhimurium LT2
agauggcgcuaaaa

SEQ ID NO: 1830313 - RNA, 15 nt, Salmonella typhimurium LT2
agaucggacaucggc

SEQ ID NO: 1830314 - RNA, 22 nt, Salmonella typhimurium LT2
agaucgcuuaacaacuccagca

SEQ ID NO: 1830315 - RNA, 23 nt, Salmonella typhimurium LT2
agaucguaagaauaaucauccgc

SEQ ID NO: 1830316 - RNA, 21 nt, Salmonella typhimurium LT2
agaugaaacgugaaauauuuc

SEQ ID NO: 1830317 - RNA, 17 nt, Salmonella typhimurium LT2
agaucuuuuugcuccug

SEQ ID NO: 1830318 - RNA, 20 nt, Salmonella typhimurium LT2
agaucuuuugcgccuuccag

SEQ ID NO: 1830319 - RNA, 23 nt, Salmonella typhimurium LT2
agaucuuuugcgccuuccaguuc

SEQ ID NO: 1830320 - RNA, 22 nt, Salmonella typhimurium LT2
agagugauaguggcgucgccau

SEQ ID NO: 1830321 - RNA, 23 nt, Salmonella typhimurium LT2
agagugauaguggcgucgccaua

SEQ ID NO: 1830322 - RNA, 16 nt, Salmonella typhimurium LT2
agaguugagccagaua

SEQ ID NO: 1830323 - RNA, 17 nt, Salmonella typhimurium LT2
agauaaccaauaaugca

SEQ ID NO: 1830324 - RNA, 14 nt, Salmonella typhimurium LT2
agauaaagcagcga

SEQ ID NO: 1830325 - RNA, 17 nt, Salmonella typhimurium LT2
agagcgucucauccggc

SEQ ID NO: 1830326 - RNA, 19 nt, Salmonella typhimurium LT2
agagcguuuguaaugccgu

SEQ ID NO: 1830327 - RNA, 17 nt, Salmonella typhimurium LT2
agagguuaccgggcuaa

SEQ ID NO: 1830328 - RNA, 21 nt, Salmonella typhimurium LT2
agaggccuuuugcagcagcga

SEQ ID NO: 1830329 - RNA, 16 nt, Salmonella typhimurium LT2
agaggaugcuccgcca

SEQ ID NO: 1830330 - RNA, 15 nt, Salmonella typhimurium LT2
agaggcuaaucagga

SEQ ID NO: 1830331 - RNA, 17 nt, Salmonella typhimurium LT2
agaucccagggcggcgu

SEQ ID NO: 1830332 - RNA, 17 nt, Salmonella typhimurium LT2
agauccaccagguccga

SEQ ID NO: 1830333 - RNA, 18 nt, Salmonella typhimurium LT2
agauaaugcuuucgccag

SEQ ID NO: 1830334 - RNA, 17 nt, Salmonella typhimurium LT2
agauacggcuccagcac

SEQ ID NO: 1830335 - RNA, 16 nt, Salmonella typhimurium LT2
agauauuuuccaucac

SEQ ID NO: 1830336 - RNA, 23 nt, Salmonella typhimurium LT2
acuuuugaacauaaagucagaca

SEQ ID NO: 1830337 - RNA, 12 nt, Salmonella typhimurium LT2
acuuuucugcgu

SEQ ID NO: 1830338 - RNA, 22 nt, Salmonella typhimurium LT2
acuuuucugcguccugcuuaug

SEQ ID NO: 1830339 - RNA, 13 nt, Salmonella typhimurium LT2
acuuuuccggcac

SEQ ID NO: 1830340 - RNA, 18 nt, Salmonella typhimurium LT2
acuuuuacuuucaagaca

SEQ ID NO: 1830341 - RNA, 17 nt, Salmonella typhimurium LT2
agaaaaacaucauggcu

SEQ ID NO: 1830342 - RNA, 19 nt, Salmonella typhimurium LT2
acuuccggcgaugccacca

SEQ ID NO: 1830343 - RNA, 22 nt, Salmonella typhimurium LT2
acuuccagcgcgccgucaucgc

SEQ ID NO: 1830344 - RNA, 15 nt, Salmonella typhimurium LT2
acuuugaccagcauc

SEQ ID NO: 1830345 - RNA, 23 nt, Salmonella typhimurium LT2
acuuugcucaccacgucauccgg

SEQ ID NO: 1830346 - RNA, 17 nt, Salmonella typhimurium LT2
acuuugcgccggcaguc

SEQ ID NO: 1830347 - RNA, 17 nt, Salmonella typhimurium LT2
acuuugaccagcaucgc

SEQ ID NO: 1830348 - RNA, 18 nt, Salmonella typhimurium LT2
agaaacaacacgaucgau

SEQ ID NO: 1830349 - RNA, 18 nt, Salmonella typhimurium LT2
agaaacggaaaucacgca

SEQ ID NO: 1830350 - RNA, 21 nt, Salmonella typhimurium LT2
agaaauucugcaggccaaaua

SEQ ID NO: 1830351 - RNA, 12 nt, Salmonella typhimurium LT2
agaaaucgccgg

SEQ ID NO: 1830352 - RNA, 15 nt, Salmonella typhimurium LT2
agaagcacaucgggc

SEQ ID NO: 1830353 - RNA, 18 nt, Salmonella typhimurium LT2
agaacuggcgcgaugacu

SEQ ID NO: 1830354 - RNA, 17 nt, Salmonella typhimurium LT2
agaaccaacgucaucau

SEQ ID NO: 1830355 - RNA, 12 nt, Salmonella typhimurium LT2
agaaucaccucu

SEQ ID NO: 1830356 - RNA, 14 nt, Salmonella typhimurium LT2
agaauaaacggcag

SEQ ID NO: 1830357 - RNA, 19 nt, Salmonella typhimurium LT2
agaagucgaaggcgcagcc

SEQ ID NO: 1830358 - RNA, 22 nt, Salmonella typhimurium LT2
agaagggagguauaaucagcau

SEQ ID NO: 1830359 - RNA, 15 nt, Salmonella typhimurium LT2
agaauucugcgcguc

SEQ ID NO: 1830360 - RNA, 20 nt, Salmonella typhimurium LT2
agaaucgccaggaucgccgc

SEQ ID NO: 1830361 - RNA, 23 nt, Salmonella typhimurium LT2
agaauguuauaaccgaugcagcc

SEQ ID NO: 1830362 - RNA, 16 nt, Salmonella typhimurium LT2
acugcaacgccagaug

SEQ ID NO: 1830363 - RNA, 19 nt, Salmonella typhimurium LT2
acugcaaaucuucggcaaa

SEQ ID NO: 1830364 - RNA, 22 nt, Salmonella typhimurium LT2
acugcaccaaauccuccagcgg

SEQ ID NO: 1830365 - RNA, 16 nt, Salmonella typhimurium LT2
acucuuuuuccgcgag

SEQ ID NO: 1830366 - RNA, 22 nt, Salmonella typhimurium LT2
acugauaguuuaaauccagcgc

SEQ ID NO: 1830367 - RNA, 22 nt, Salmonella typhimurium LT2
acugauaccccagcgaucccaa

SEQ ID NO: 1830368 - RNA, 18 nt, Salmonella typhimurium LT2
acugacguugcgaaucag

SEQ ID NO: 1830369 - RNA, 17 nt, Salmonella typhimurium LT2
acugacacgccaguuca

SEQ ID NO: 1830370 - RNA, 22 nt, Salmonella typhimurium LT2
acugaaaaaagcgaucaccucu

SEQ ID NO: 1830371 - RNA, 21 nt, Salmonella typhimurium LT2
acugguaaugucauccagcga

SEQ ID NO: 1830372 - RNA, 17 nt, Salmonella typhimurium LT2
acuuagcccaggccaau

SEQ ID NO: 1830373 - RNA, 14 nt, Salmonella typhimurium LT2
acuuaccaccgugc

SEQ ID NO: 1830374 - RNA, 15 nt, Salmonella typhimurium LT2
acuuacuguuucacg

SEQ ID NO: 1830375 - RNA, 16 nt, Salmonella typhimurium LT2
acuuagaacgcggaag

SEQ ID NO: 1830376 - RNA, 17 nt, Salmonella typhimurium LT2
acuguugcaguuuacga

SEQ ID NO: 1830377 - RNA, 21 nt, Salmonella typhimurium LT2
acuggcgccuuuuggcagcag

SEQ ID NO: 1830378 - RNA, 15 nt, Salmonella typhimurium LT2
acugcgcguggcaaa

SEQ ID NO: 1830379 - RNA, 11 nt, Salmonella typhimurium LT2
acugcgccauu

SEQ ID NO: 1830380 - RNA, 23 nt, Salmonella typhimurium LT2
gccagcagacaggugaacauuac

SEQ ID NO: 1830381 - RNA, 18 nt, Salmonella typhimurium LT2
gccacuucuuugaccagc

SEQ ID NO: 1830382 - RNA, 16 nt, Salmonella typhimurium LT2
gccagcaacgcgcuaa

SEQ ID NO: 1830383 - RNA, 22 nt, Salmonella typhimurium LT2
gccagauuaucggccagcgcca

SEQ ID NO: 1830384 - RNA, 17 nt, Salmonella typhimurium LT2
gccagauuaucggccag

SEQ ID NO: 1830385 - RNA, 16 nt, Salmonella typhimurium LT2
gccagcaccaggcucg

SEQ ID NO: 1830386 - RNA, 16 nt, Salmonella typhimurium LT2
gccagcgggccgguaa

SEQ ID NO: 1830387 - RNA, 18 nt, Salmonella typhimurium LT2
gccagcgccggcgaauca

SEQ ID NO: 1830388 - RNA, 14 nt, Salmonella typhimurium LT2
gccagccgcgccau

SEQ ID NO: 1830389 - RNA, 20 nt, Salmonella typhimurium LT2
gccagcccuaaggucacgcc

SEQ ID NO: 1830390 - RNA, 22 nt, Salmonella typhimurium LT2
gccagcccugcgaucaucauuc

SEQ ID NO: 1830391 - RNA, 15 nt, Salmonella typhimurium LT2
gccagccugcgccag

SEQ ID NO: 1830392 - RNA, 23 nt, Salmonella typhimurium LT2
gccaguccgguggcgaaaacgcu

SEQ ID NO: 1830393 - RNA, 22 nt, Salmonella typhimurium LT2
gccaguaaucccggucgcgcca

SEQ ID NO: 1830394 - RNA, 18 nt, Salmonella typhimurium LT2
gccaguaagggaauaucu

SEQ ID NO: 1830395 - RNA, 19 nt, Salmonella typhimurium LT2
gccaguaacucaucgccag

SEQ ID NO: 1830396 - RNA, 18 nt, Salmonella typhimurium LT2
gccaguaagcucaggcca

SEQ ID NO: 1830397 - RNA, 17 nt, Salmonella typhimurium LT2
gccagguuuucaggccg

SEQ ID NO: 1830398 - RNA, 19 nt, Salmonella typhimurium LT2
gccagguauugagcgaaac

SEQ ID NO: 1830399 - RNA, 16 nt, Salmonella typhimurium LT2
gccagcguugaccagc

SEQ ID NO: 1830400 - RNA, 20 nt, Salmonella typhimurium LT2
gccagcucgucggccagcgc

SEQ ID NO: 1830401 - RNA, 13 nt, Salmonella typhimurium LT2
gccaggcacgccg

SEQ ID NO: 1830402 - RNA, 14 nt, Salmonella typhimurium LT2
gccaggaacgguac

SEQ ID NO: 1830403 - RNA, 14 nt, Salmonella typhimurium LT2
gcaguccguccaga

SEQ ID NO: 1830404 - RNA, 13 nt, Salmonella typhimurium LT2
gccacagcggaau

SEQ ID NO: 1830405 - RNA, 23 nt, Salmonella typhimurium LT2
gccaauuuaugccggggcgcuuc

SEQ ID NO: 1830406 - RNA, 15 nt, Salmonella typhimurium LT2
gccaauaaugccgcc

SEQ ID NO: 1830407 - RNA, 19 nt, Salmonella typhimurium LT2
gccaauaacgucuggugau

SEQ ID NO: 1830408 - RNA, 14 nt, Salmonella typhimurium LT2
gccacaggaccacg

SEQ ID NO: 1830409 - RNA, 12 nt, Salmonella typhimurium LT2
gccacagcgcca

SEQ ID NO: 1830410 - RNA, 20 nt, Salmonella typhimurium LT2
gccacaggcggcauggguaa

SEQ ID NO: 1830411 - RNA, 12 nt, Salmonella typhimurium LT2
gccacaggcguc

SEQ ID NO: 1830412 - RNA, 16 nt, Salmonella typhimurium LT2
gccaccagcacaaugg

SEQ ID NO: 1830413 - RNA, 21 nt, Salmonella typhimurium LT2
gccacgcucgcuggugccaau

SEQ ID NO: 1830414 - RNA, 14 nt, Salmonella typhimurium LT2
gccacuaccagcgu

SEQ ID NO: 1830415 - RNA, 16 nt, Salmonella typhimurium LT2
gccacuacgccgauga

SEQ ID NO: 1830416 - RNA, 20 nt, Salmonella typhimurium LT2
gccacguauuucgcagcgau

SEQ ID NO: 1830417 - RNA, 16 nt, Salmonella typhimurium LT2
gccaccgguggcauca

SEQ ID NO: 1830418 - RNA, 16 nt, Salmonella typhimurium LT2
gccacccggcaaccua

SEQ ID NO: 1830419 - RNA, 16 nt, Salmonella typhimurium LT2
gcccaacugccagcgg

SEQ ID NO: 1830420 - RNA, 18 nt, Salmonella typhimurium LT2
gcccaaauaguccagcag

SEQ ID NO: 1830421 - RNA, 22 nt, Salmonella typhimurium LT2
gcccaaaaugcggcauccggcu

SEQ ID NO: 1830422 - RNA, 19 nt, Salmonella typhimurium LT2
gccauuuuugcaucaucac

SEQ ID NO: 1830423 - RNA, 19 nt, Salmonella typhimurium LT2
gcccacaucuguuugagaa

SEQ ID NO: 1830424 - RNA, 17 nt, Salmonella typhimurium LT2
gcccacaggcagggcga

SEQ ID NO: 1830425 - RNA, 16 nt, Salmonella typhimurium LT2
gccaugcgcggcauca

SEQ ID NO: 1830426 - RNA, 23 nt, Salmonella typhimurium LT2
aagacauccgggccaacggcauc

SEQ ID NO: 1830427 - RNA, 17 nt, Salmonella typhimurium LT2
aagacacagauuccaga

SEQ ID NO: 1830428 - RNA, 20 nt, Salmonella typhimurium LT2
aagacacagcgucgcgcgau

SEQ ID NO: 1830429 - RNA, 13 nt, Salmonella typhimurium LT2
gccaugaucgccg

SEQ ID NO: 1830430 - RNA, 13 nt, Salmonella typhimurium LT2
aagaccuccgccc

SEQ ID NO: 1830431 - RNA, 17 nt, Salmonella typhimurium LT2
aagacccgaaccugcga

SEQ ID NO: 1830432 - RNA, 21 nt, Salmonella typhimurium LT2
gccauuccagccgguguuaac

SEQ ID NO: 1830433 - RNA, 20 nt, Salmonella typhimurium LT2
gccauuccuuuaaauauccg

SEQ ID NO: 1830434 - RNA, 16 nt, Salmonella typhimurium LT2
gccauuccccacgcca

SEQ ID NO: 1830435 - RNA, 17 nt, Salmonella typhimurium LT2
gccauugcguaaacgcu

SEQ ID NO: 1830436 - RNA, 15 nt, Salmonella typhimurium LT2
gccauugcugcuaua

SEQ ID NO: 1830437 - RNA, 16 nt, Salmonella typhimurium LT2
gcccacgggccgccau

SEQ ID NO: 1830438 - RNA, 22 nt, Salmonella typhimurium LT2
gcccacuucacauuacuuccgg

SEQ ID NO: 1830439 - RNA, 15 nt, Salmonella typhimurium LT2
gcccaccuucgcgga

SEQ ID NO: 1830440 - RNA, 14 nt, Salmonella typhimurium LT2
gcccagcagggcca

SEQ ID NO: 1830441 - RNA, 15 nt, Salmonella typhimurium LT2
gcccagcuugcccag

SEQ ID NO: 1830442 - RNA, 16 nt, Salmonella typhimurium LT2
gcccaggauacagccg

SEQ ID NO: 1830443 - RNA, 16 nt, Salmonella typhimurium LT2
gcccagcccggaaaua

SEQ ID NO: 1830444 - RNA, 14 nt, Salmonella typhimurium LT2
gcccagcccggaaa

SEQ ID NO: 1830445 - RNA, 23 nt, Salmonella typhimurium LT2
gcccagcgccgugucaucauuac

SEQ ID NO: 1830446 - RNA, 15 nt, Salmonella typhimurium LT2
gcccagcgccggaua

SEQ ID NO: 1830447 - RNA, 15 nt, Salmonella typhimurium LT2
gcccagcgccgggaa

SEQ ID NO: 1830448 - RNA, 13 nt, Salmonella typhimurium LT2
gccccagcaccag

SEQ ID NO: 1830449 - RNA, 16 nt, Salmonella typhimurium LT2
gccccagcgcaaacga

SEQ ID NO: 1830450 - RNA, 14 nt, Salmonella typhimurium LT2
gcccauaccagcgc

SEQ ID NO: 1830451 - RNA, 20 nt, Salmonella typhimurium LT2
gcccaguuucaucaucgccg

SEQ ID NO: 1830452 - RNA, 19 nt, Salmonella typhimurium LT2
gcccaucaucaucggcaca

SEQ ID NO: 1830453 - RNA, 18 nt, Salmonella typhimurium LT2
gcccaucgccagggcuuc

SEQ ID NO: 1830454 - RNA, 15 nt, Salmonella typhimurium LT2
gccccggcuuaccgc

SEQ ID NO: 1830455 - RNA, 13 nt, Salmonella typhimurium LT2
gcccgaucguccg

SEQ ID NO: 1830456 - RNA, 19 nt, Salmonella typhimurium LT2
gcccgcaugguaaacgcau

SEQ ID NO: 1830457 - RNA, 20 nt, Salmonella typhimurium LT2
gcccgauaagcaagcgccau

SEQ ID NO: 1830458 - RNA, 20 nt, Salmonella typhimurium LT2
gcccgauaagcgccgcgcca

SEQ ID NO: 1830459 - RNA, 14 nt, Salmonella typhimurium LT2
gcccgauaagcgcu

SEQ ID NO: 1830460 - RNA, 22 nt, Salmonella typhimurium LT2
gccccucgucuucgaccgccau

SEQ ID NO: 1830461 - RNA, 22 nt, Salmonella typhimurium LT2
gccccuggcugaaagcaaccag

SEQ ID NO: 1830462 - RNA, 19 nt, Salmonella typhimurium LT2
gccgcuaaaacacccgcaa

SEQ ID NO: 1830463 - RNA, 16 nt, Salmonella typhimurium LT2
gccgcgugcucgcggc

SEQ ID NO: 1830464 - RNA, 19 nt, Salmonella typhimurium LT2
gccgcuacugccgccaucg

SEQ ID NO: 1830465 - RNA, 19 nt, Salmonella typhimurium LT2
gccgcuacucagcccaucc

SEQ ID NO: 1830466 - RNA, 15 nt, Salmonella typhimurium LT2
gccgcuaucgaccag

SEQ ID NO: 1830467 - RNA, 19 nt, Salmonella typhimurium LT2
gccgcuaucugcuccgcca

SEQ ID NO: 1830468 - RNA, 13 nt, Salmonella typhimurium LT2
gccgcuaugacga

SEQ ID NO: 1830469 - RNA, 19 nt, Salmonella typhimurium LT2
gccgcucagcucgacgacg

SEQ ID NO: 1830470 - RNA, 13 nt, Salmonella typhimurium LT2
gccgcgggcagca

SEQ ID NO: 1830471 - RNA, 15 nt, Salmonella typhimurium LT2
gccgcgggcagcagc

SEQ ID NO: 1830472 - RNA, 18 nt, Salmonella typhimurium LT2
gccgccgggcuucacggu

SEQ ID NO: 1830473 - RNA, 22 nt, Salmonella typhimurium LT2
gccgccgggaucagcggcugca

SEQ ID NO: 1830474 - RNA, 21 nt, Salmonella typhimurium LT2
gccgccagaucgugccagaua

SEQ ID NO: 1830475 - RNA, 20 nt, Salmonella typhimurium LT2
gccgcgccagaccgcuuaac

SEQ ID NO: 1830476 - RNA, 17 nt, Salmonella typhimurium LT2
gccgccuaucgccagca

SEQ ID NO: 1830477 - RNA, 22 nt, Salmonella typhimurium LT2
gccgccucgcuuaaaccaccau

SEQ ID NO: 1830478 - RNA, 19 nt, Salmonella typhimurium LT2
gccgccucgcguagcgcca

SEQ ID NO: 1830479 - RNA, 16 nt, Salmonella typhimurium LT2
gccgccucgcgauccg

SEQ ID NO: 1830480 - RNA, 19 nt, Salmonella typhimurium LT2
gcccuucuccggucaucac

SEQ ID NO: 1830481 - RNA, 12 nt, Salmonella typhimurium LT2
gccgaacaggcc

SEQ ID NO: 1830482 - RNA, 16 nt, Salmonella typhimurium LT2
gccgaauauugcgcca

SEQ ID NO: 1830483 - RNA, 21 nt, Salmonella typhimurium LT2
gccgaauaagcgacagcgcca

SEQ ID NO: 1830484 - RNA, 16 nt, Salmonella typhimurium LT2
gccgaccauccagaca

SEQ ID NO: 1830485 - RNA, 14 nt, Salmonella typhimurium LT2
gccgacaucgccac

SEQ ID NO: 1830486 - RNA, 21 nt, Salmonella typhimurium LT2
gccgacagcguaaugcgccag

SEQ ID NO: 1830487 - RNA, 13 nt, Salmonella typhimurium LT2
aagaucagcagag

SEQ ID NO: 1830488 - RNA, 22 nt, Salmonella typhimurium LT2
aagauagcgggcaaugccacca

SEQ ID NO: 1830489 - RNA, 17 nt, Salmonella typhimurium LT2
aagauaggagacgccgc

SEQ ID NO: 1830490 - RNA, 15 nt, Salmonella typhimurium LT2
gcccgcucugcgcca

SEQ ID NO: 1830491 - RNA, 15 nt, Salmonella typhimurium LT2
gcccuccuccagcgc

SEQ ID NO: 1830492 - RNA, 21 nt, Salmonella typhimurium LT2
gcccucgggucgaauuccagu

SEQ ID NO: 1830493 - RNA, 13 nt, Salmonella typhimurium LT2
gcccugauggcgc

SEQ ID NO: 1830494 - RNA, 17 nt, Salmonella typhimurium LT2
gcccuuccgucagcguc

SEQ ID NO: 1830495 - RNA, 18 nt, Salmonella typhimurium LT2
gcccuguuucgcaggccg

SEQ ID NO: 1830496 - RNA, 17 nt, Salmonella typhimurium LT2
gcccuuaaauccggccu

SEQ ID NO: 1830497 - RNA, 22 nt, Salmonella typhimurium LT2
gcccuguggaaacuccagcggc

SEQ ID NO: 1830498 - RNA, 15 nt, Salmonella typhimurium LT2
gcccugcccgccagg

SEQ ID NO: 1830499 - RNA, 18 nt, Salmonella typhimurium LT2
gcccugcccaugaagcga

SEQ ID NO: 1830500 - RNA, 20 nt, Salmonella typhimurium LT2
gcccugccaccagcguaccg

SEQ ID NO: 1830501 - RNA, 17 nt, Salmonella typhimurium LT2
aagcaccgccagcgccg

SEQ ID NO: 1830502 - RNA, 19 nt, Salmonella typhimurium LT2
gccgaugcugaauagccag

SEQ ID NO: 1830503 - RNA, 12 nt, Salmonella typhimurium LT2
gccgaugccgcc

SEQ ID NO: 1830504 - RNA, 21 nt, Salmonella typhimurium LT2
gccgcauccccauagacagua

SEQ ID NO: 1830505 - RNA, 12 nt, Salmonella typhimurium LT2
gccgcagcgccg

SEQ ID NO: 1830506 - RNA, 11 nt, Salmonella typhimurium LT2
gccgcagcgcc

SEQ ID NO: 1830507 - RNA, 12 nt, Salmonella typhimurium LT2
gccgcagcgcca

SEQ ID NO: 1830508 - RNA, 17 nt, Salmonella typhimurium LT2
gccgaucaccagcgcau

SEQ ID NO: 1830509 - RNA, 15 nt, Salmonella typhimurium LT2
gccgaucaccagcgc

SEQ ID NO: 1830510 - RNA, 22 nt, Salmonella typhimurium LT2
gccgagucgguaagucugauaa

SEQ ID NO: 1830511 - RNA, 18 nt, Salmonella typhimurium LT2
gccgaucaccagcgcauc

SEQ ID NO: 1830512 - RNA, 20 nt, Salmonella typhimurium LT2
gccgagcagauuuuucgcca

SEQ ID NO: 1830513 - RNA, 19 nt, Salmonella typhimurium LT2
aagaugugccacuccgcca

SEQ ID NO: 1830514 - RNA, 20 nt, Salmonella typhimurium LT2
gccgaggcuuaauacagcaa

SEQ ID NO: 1830515 - RNA, 16 nt, Salmonella typhimurium LT2
gccgaggcauccagaa

SEQ ID NO: 1830516 - RNA, 21 nt, Salmonella typhimurium LT2
gcacacagcggaaagcaacag

SEQ ID NO: 1830517 - RNA, 18 nt, Salmonella typhimurium LT2
gcacaauggucagcgccg

SEQ ID NO: 1830518 - RNA, 18 nt, Salmonella typhimurium LT2
gcacaaaaggcuggaaca

SEQ ID NO: 1830519 - RNA, 19 nt, Salmonella typhimurium LT2
gcacaaaaaguaguuccag

SEQ ID NO: 1830520 - RNA, 23 nt, Salmonella typhimurium LT2
gcaauuucacugucgccaggcca

SEQ ID NO: 1830521 - RNA, 21 nt, Salmonella typhimurium LT2
gcaacagguuaaccaugcccg

SEQ ID NO: 1830522 - RNA, 17 nt, Salmonella typhimurium LT2
gcaauuccggucaucgc

SEQ ID NO: 1830523 - RNA, 16 nt, Salmonella typhimurium LT2
gcaauucgcguucaga

SEQ ID NO: 1830524 - RNA, 18 nt, Salmonella typhimurium LT2
gcacacgcccagggcacg

SEQ ID NO: 1830525 - RNA, 21 nt, Salmonella typhimurium LT2
gcacaggcggguauggcgcca

SEQ ID NO: 1830526 - RNA, 23 nt, Salmonella typhimurium LT2
gcacagcgguagcaucucacgcu

SEQ ID NO: 1830527 - RNA, 12 nt, Salmonella typhimurium LT2
gcacaucauuau

SEQ ID NO: 1830528 - RNA, 18 nt, Salmonella typhimurium LT2
gcacaucauuauccagcc

SEQ ID NO: 1830529 - RNA, 16 nt, Salmonella typhimurium LT2
gcaccaccugcuguug

SEQ ID NO: 1830530 - RNA, 22 nt, Salmonella typhimurium LT2
gcaccaccugcuguugcggaau

SEQ ID NO: 1830531 - RNA, 18 nt, Salmonella typhimurium LT2
gcaccagauagcguauua

SEQ ID NO: 1830532 - RNA, 15 nt, Salmonella typhimurium LT2
gcaccagcagguggu

SEQ ID NO: 1830533 - RNA, 22 nt, Salmonella typhimurium LT2
gcaccagcgaguagccugcgaa

SEQ ID NO: 1830534 - RNA, 18 nt, Salmonella typhimurium LT2
gcaccccggccacguagc

SEQ ID NO: 1830535 - RNA, 22 nt, Salmonella typhimurium LT2
gcaccuguaaccuuaaaaggcg

SEQ ID NO: 1830536 - RNA, 18 nt, Salmonella typhimurium LT2
gcaccuguuucugcuggc

SEQ ID NO: 1830537 - RNA, 14 nt, Salmonella typhimurium LT2
gcacgacaacgcgc

SEQ ID NO: 1830538 - RNA, 12 nt, Salmonella typhimurium LT2
gcacgccagcgg

SEQ ID NO: 1830539 - RNA, 19 nt, Salmonella typhimurium LT2
gcacgaugcauaugcacag

SEQ ID NO: 1830540 - RNA, 17 nt, Salmonella typhimurium LT2
gcacggucaaucaucag

SEQ ID NO: 1830541 - RNA, 16 nt, Salmonella typhimurium LT2
gcacggucaaucauca

SEQ ID NO: 1830542 - RNA, 17 nt, Salmonella typhimurium LT2
gcagcaaugugcgccag

SEQ ID NO: 1830543 - RNA, 14 nt, Salmonella typhimurium LT2
gcagauuaccggca

SEQ ID NO: 1830544 - RNA, 22 nt, Salmonella typhimurium LT2
gcagauuuaacgcuuucgccag

SEQ ID NO: 1830545 - RNA, 21 nt, Salmonella typhimurium LT2
gcagaauuucuacacagcgcg

SEQ ID NO: 1830546 - RNA, 14 nt, Salmonella typhimurium LT2
gcagaacagcgacg

SEQ ID NO: 1830547 - RNA, 22 nt, Salmonella typhimurium LT2
gcacuuucauugccguuaacug

SEQ ID NO: 1830548 - RNA, 18 nt, Salmonella typhimurium LT2
gcacuuuaagcggcagcu

SEQ ID NO: 1830549 - RNA, 15 nt, Salmonella typhimurium LT2
gcacuucgauaaacg

SEQ ID NO: 1830550 - RNA, 19 nt, Salmonella typhimurium LT2
gcacuguauaugcuacacg

SEQ ID NO: 1830551 - RNA, 14 nt, Salmonella typhimurium LT2
gcacuacaucauuc

SEQ ID NO: 1830552 - RNA, 18 nt, Salmonella typhimurium LT2
gcacgucgguaaagcgca

SEQ ID NO: 1830553 - RNA, 17 nt, Salmonella typhimurium LT2
gcagcguaauacaggcg

SEQ ID NO: 1830554 - RNA, 20 nt, Salmonella typhimurium LT2
gcagcgucgucgguaaacgg

SEQ ID NO: 1830555 - RNA, 15 nt, Salmonella typhimurium LT2
gcagcguuuccagcc

SEQ ID NO: 1830556 - RNA, 15 nt, Salmonella typhimurium LT2
gcaggaaauccagca

SEQ ID NO: 1830557 - RNA, 14 nt, Salmonella typhimurium LT2
gcaggaaucguccg

SEQ ID NO: 1830558 - RNA, 15 nt, Salmonella typhimurium LT2
gcaggauacggcgcu

SEQ ID NO: 1830559 - RNA, 16 nt, Salmonella typhimurium LT2
gcaggaucaccggcag

SEQ ID NO: 1830560 - RNA, 21 nt, Salmonella typhimurium LT2
gcagcucuucgccguuaucgg

SEQ ID NO: 1830561 - RNA, 19 nt, Salmonella typhimurium LT2
gcagcuuacugugccgccg

SEQ ID NO: 1830562 - RNA, 15 nt, Salmonella typhimurium LT2
gcagcgcgcggauga

SEQ ID NO: 1830563 - RNA, 18 nt, Salmonella typhimurium LT2
gcagcgcggaaggaccgu

SEQ ID NO: 1830564 - RNA, 13 nt, Salmonella typhimurium LT2
gcagcgccgccug

SEQ ID NO: 1830565 - RNA, 12 nt, Salmonella typhimurium LT2
gcagccggauag

SEQ ID NO: 1830566 - RNA, 20 nt, Salmonella typhimurium LT2
gcagccggauagacaugacc

SEQ ID NO: 1830567 - RNA, 16 nt, Salmonella typhimurium LT2
gcaggccggcagccug

SEQ ID NO: 1830568 - RNA, 18 nt, Salmonella typhimurium LT2
gcaggcccgauaagcgcc

SEQ ID NO: 1830569 - RNA, 14 nt, Salmonella typhimurium LT2
gcaggccaggcguu

SEQ ID NO: 1830570 - RNA, 13 nt, Salmonella typhimurium LT2
gcaggcagcgcca

SEQ ID NO: 1830571 - RNA, 19 nt, Salmonella typhimurium LT2
gcaggccaaaaaaacgaag

SEQ ID NO: 1830572 - RNA, 21 nt, Salmonella typhimurium LT2
gcaggcaauauaccgucagca

SEQ ID NO: 1830573 - RNA, 17 nt, Salmonella typhimurium LT2
gcaggcgccgccauccg

SEQ ID NO: 1830574 - RNA, 20 nt, Salmonella typhimurium LT2
gcaggcggugcgcagccacg

SEQ ID NO: 1830575 - RNA, 15 nt, Salmonella typhimurium LT2
gcagggcaauagcga

SEQ ID NO: 1830576 - RNA, 17 nt, Salmonella typhimurium LT2
gcaguaacuucagcauc

SEQ ID NO: 1830577 - RNA, 22 nt, Salmonella typhimurium LT2
gcagguuuugcagauccgcgau

SEQ ID NO: 1830578 - RNA, 18 nt, Salmonella typhimurium LT2
gcagguugccgaugacuc

SEQ ID NO: 1830579 - RNA, 13 nt, Salmonella typhimurium LT2
gcaguacggcgca

SEQ ID NO: 1830580 - RNA, 21 nt, Salmonella typhimurium LT2
gcaguacgcgcaaccgcauca

SEQ ID NO: 1830581 - RNA, 14 nt, Salmonella typhimurium LT2
gcaguacgcgccau

SEQ ID NO: 1830582 - RNA, 15 nt, Salmonella typhimurium LT2
gcaguaagccagcgg

SEQ ID NO: 1830583 - RNA, 15 nt, Salmonella typhimurium LT2
gcagucacagaucca

SEQ ID NO: 1830584 - RNA, 18 nt, Salmonella typhimurium LT2
aagaaauugggcuuccac

SEQ ID NO: 1830585 - RNA, 19 nt, Salmonella typhimurium LT2
gcagguaucguauccgguc

SEQ ID NO: 1830586 - RNA, 15 nt, Salmonella typhimurium LT2
gcagggcaugauuac

SEQ ID NO: 1830587 - RNA, 18 nt, Salmonella typhimurium LT2
gcagggcgauauccagcg

SEQ ID NO: 1830588 - RNA, 16 nt, Salmonella typhimurium LT2
gaggcuuaauacagca

SEQ ID NO: 1830589 - RNA, 16 nt, Salmonella typhimurium LT2
gagguaaucagaucgg

SEQ ID NO: 1830590 - RNA, 18 nt, Salmonella typhimurium LT2
gagguuuucucauccagc

SEQ ID NO: 1830591 - RNA, 17 nt, Salmonella typhimurium LT2
gagguuuccggcgggag

SEQ ID NO: 1830592 - RNA, 19 nt, Salmonella typhimurium LT2
gaggucguuucccccgcga

SEQ ID NO: 1830593 - RNA, 23 nt, Salmonella typhimurium LT2
gaggauacggucgacaccagcga

SEQ ID NO: 1830594 - RNA, 23 nt, Salmonella typhimurium LT2
gagcugccaguucauuccgcccu

SEQ ID NO: 1830595 - RNA, 15 nt, Salmonella typhimurium LT2
gagcuggcggcggau

SEQ ID NO: 1830596 - RNA, 14 nt, Salmonella typhimurium LT2
gagcgggccgucag

SEQ ID NO: 1830597 - RNA, 18 nt, Salmonella typhimurium LT2
aacugcaaaucuucggca

SEQ ID NO: 1830598 - RNA, 14 nt, Salmonella typhimurium LT2
gagcggcucaucca

SEQ ID NO: 1830599 - RNA, 21 nt, Salmonella typhimurium LT2
gagcggcuacgccugauaagc

SEQ ID NO: 1830600 - RNA, 14 nt, Salmonella typhimurium LT2
aacucuccugucgu

SEQ ID NO: 1830601 - RNA, 14 nt, Salmonella typhimurium LT2
aacugacagcguuu

SEQ ID NO: 1830602 - RNA, 16 nt, Salmonella typhimurium LT2
aacucggcagcgcgac

SEQ ID NO: 1830603 - RNA, 15 nt, Salmonella typhimurium LT2
gagccgcgcagcgca

SEQ ID NO: 1830604 - RNA, 21 nt, Salmonella typhimurium LT2
gagcggaucaaacuccgcgcu

SEQ ID NO: 1830605 - RNA, 13 nt, Salmonella typhimurium LT2
gagcgcguccaga

SEQ ID NO: 1830606 - RNA, 13 nt, Salmonella typhimurium LT2
gagcgcauccggc

SEQ ID NO: 1830607 - RNA, 17 nt, Salmonella typhimurium LT2
gagcgccagcaacagcg

SEQ ID NO: 1830608 - RNA, 19 nt, Salmonella typhimurium LT2
gaucaccucuuccagcguc

SEQ ID NO: 1830609 - RNA, 14 nt, Salmonella typhimurium LT2
gauagcgcuuucca

SEQ ID NO: 1830610 - RNA, 16 nt, Salmonella typhimurium LT2
gauagcgagcgauaga

SEQ ID NO: 1830611 - RNA, 14 nt, Salmonella typhimurium LT2
gauagcgaaccauc

SEQ ID NO: 1830612 - RNA, 17 nt, Salmonella typhimurium LT2
gauagcguuuuccagcu

SEQ ID NO: 1830613 - RNA, 18 nt, Salmonella typhimurium LT2
gauaguugagcagcgcga

SEQ ID NO: 1830614 - RNA, 17 nt, Salmonella typhimurium LT2
gauaguugagcagcgcg

SEQ ID NO: 1830615 - RNA, 19 nt, Salmonella typhimurium LT2
gauaguguaaacgcgccau

SEQ ID NO: 1830616 - RNA, 17 nt, Salmonella typhimurium LT2
gauauagaccagcgccg

SEQ ID NO: 1830617 - RNA, 19 nt, Salmonella typhimurium LT2
gauacguuccagcagcgca

SEQ ID NO: 1830618 - RNA, 14 nt, Salmonella typhimurium LT2
gauacuauaacgcu

SEQ ID NO: 1830619 - RNA, 18 nt, Salmonella typhimurium LT2
gauacugcuccggcgcga

SEQ ID NO: 1830620 - RNA, 22 nt, Salmonella typhimurium LT2
gauacuuauuacgguaucagcg

SEQ ID NO: 1830621 - RNA, 17 nt, Salmonella typhimurium LT2
gauacggcuccagcaca

SEQ ID NO: 1830622 - RNA, 15 nt, Salmonella typhimurium LT2
gauaagcuuacgcca

SEQ ID NO: 1830623 - RNA, 19 nt, Salmonella typhimurium LT2
gauaagcgugcgucauccg

SEQ ID NO: 1830624 - RNA, 17 nt, Salmonella typhimurium LT2
gauaagcguuagcgcca

SEQ ID NO: 1830625 - RNA, 20 nt, Salmonella typhimurium LT2
gauaagcguuagcgccaccg

SEQ ID NO: 1830626 - RNA, 23 nt, Salmonella typhimurium LT2
gauaagcguuguaguuucagccc

SEQ ID NO: 1830627 - RNA, 22 nt, Salmonella typhimurium LT2
gauaaggcguaaccgccauccg

SEQ ID NO: 1830628 - RNA, 22 nt, Salmonella typhimurium LT2
gauaaggcggagccgccauccg

SEQ ID NO: 1830629 - RNA, 22 nt, Salmonella typhimurium LT2
gauaaggcgcagccgccauccg

SEQ ID NO: 1830630 - RNA, 22 nt, Salmonella typhimurium LT2
gauaaggcgcuagccgcauccg

SEQ ID NO: 1830631 - RNA, 18 nt, Salmonella typhimurium LT2
gauaaggcguuugcgccg

SEQ ID NO: 1830632 - RNA, 15 nt, Salmonella typhimurium LT2
gauaccaguacaaca

SEQ ID NO: 1830633 - RNA, 18 nt, Salmonella typhimurium LT2
gauacaggcgcuguacgc

SEQ ID NO: 1830634 - RNA, 14 nt, Salmonella typhimurium LT2
gauacaguucgaca

SEQ ID NO: 1830635 - RNA, 16 nt, Salmonella typhimurium LT2
gauacagcguaucggc

SEQ ID NO: 1830636 - RNA, 20 nt, Salmonella typhimurium LT2
gauaagcgcagcgccaucug

SEQ ID NO: 1830637 - RNA, 20 nt, Salmonella typhimurium LT2
gauaagcgcagcgccaucag

SEQ ID NO: 1830638 - RNA, 19 nt, Salmonella typhimurium LT2
gauaagcguagcgcauccg

SEQ ID NO: 1830639 - RNA, 19 nt, Salmonella typhimurium LT2
gauaagcgccgcgccaucg

SEQ ID NO: 1830640 - RNA, 17 nt, Salmonella typhimurium LT2
gauaagcguagcgccau

SEQ ID NO: 1830641 - RNA, 23 nt, Salmonella typhimurium LT2
gauaagcguagcgccaucaggcu

SEQ ID NO: 1830642 - RNA, 20 nt, Salmonella typhimurium LT2
gauaagcgugagcgcauccg

SEQ ID NO: 1830643 - RNA, 20 nt, Salmonella typhimurium LT2
gauaagcguagcgccauccg

SEQ ID NO: 1830644 - RNA, 18 nt, Salmonella typhimurium LT2
gauaagcgucgccagcgu

SEQ ID NO: 1830645 - RNA, 11 nt, Salmonella typhimurium LT2
gauaaccagaa

SEQ ID NO: 1830646 - RNA, 19 nt, Salmonella typhimurium LT2
gauaacaguauuuguucag

SEQ ID NO: 1830647 - RNA, 19 nt, Salmonella typhimurium LT2
gaguaaauaaaaaccauuu

SEQ ID NO: 1830648 - RNA, 13 nt, Salmonella typhimurium LT2
gaucauacugaac

SEQ ID NO: 1830649 - RNA, 20 nt, Salmonella typhimurium LT2
gaucaucguaccaauaccca

SEQ ID NO: 1830650 - RNA, 12 nt, Salmonella typhimurium LT2
gauccagcgccg

SEQ ID NO: 1830651 - RNA, 23 nt, Salmonella typhimurium LT2
gauccagaccggcaugauggcga

SEQ ID NO: 1830652 - RNA, 17 nt, Salmonella typhimurium LT2
gauccguagacgguaac

SEQ ID NO: 1830653 - RNA, 14 nt, Salmonella typhimurium LT2
gaucgagucaggcg

SEQ ID NO: 1830654 - RNA, 14 nt, Salmonella typhimurium LT2
gaucgaggcgcugg

SEQ ID NO: 1830655 - RNA, 18 nt, Salmonella typhimurium LT2
gaucgaggcgcuggcgag

SEQ ID NO: 1830656 - RNA, 14 nt, Salmonella typhimurium LT2
gaucgaaucucccg

SEQ ID NO: 1830657 - RNA, 16 nt, Salmonella typhimurium LT2
gaucgaagauuccgcg

SEQ ID NO: 1830658 - RNA, 23 nt, Salmonella typhimurium LT2
gaucgacauaagaguccauucgg

SEQ ID NO: 1830659 - RNA, 20 nt, Salmonella typhimurium LT2
gaugggccgaguaauccgua

SEQ ID NO: 1830660 - RNA, 21 nt, Salmonella typhimurium LT2
gaugggccgaguaauccguag

SEQ ID NO: 1830661 - RNA, 19 nt, Salmonella typhimurium LT2
gauggcgcuucgcuuacca

SEQ ID NO: 1830662 - RNA, 21 nt, Salmonella typhimurium LT2
gauggcgcugucgcuuauucg

SEQ ID NO: 1830663 - RNA, 20 nt, Salmonella typhimurium LT2
gauggcgcugcgcuuaucag

SEQ ID NO: 1830664 - RNA, 20 nt, Salmonella typhimurium LT2
gauggcgcugcgcuuauccg

SEQ ID NO: 1830665 - RNA, 20 nt, Salmonella typhimurium LT2
gauggcgcuucgcuuaucag

SEQ ID NO: 1830666 - RNA, 19 nt, Salmonella typhimurium LT2
gauggcgcuucgcuuaucg

SEQ ID NO: 1830667 - RNA, 19 nt, Salmonella typhimurium LT2
gauggcgcugcgcgcaucg

SEQ ID NO: 1830668 - RNA, 13 nt, Salmonella typhimurium LT2
gauggccucauca

SEQ ID NO: 1830669 - RNA, 14 nt, Salmonella typhimurium LT2
gauguauuuaucca

SEQ ID NO: 1830670 - RNA, 14 nt, Salmonella typhimurium LT2
aacuucaucgccac

SEQ ID NO: 1830671 - RNA, 13 nt, Salmonella typhimurium LT2
gaugcgccauccc

SEQ ID NO: 1830672 - RNA, 21 nt, Salmonella typhimurium LT2
gauggagcggcgcuuauucgg

SEQ ID NO: 1830673 - RNA, 22 nt, Salmonella typhimurium LT2
gaugcugauguccgcagccgca

SEQ ID NO: 1830674 - RNA, 14 nt, Salmonella typhimurium LT2
gcaaaucgccauca

SEQ ID NO: 1830675 - RNA, 17 nt, Salmonella typhimurium LT2
gcaaaucgcccaucaca

SEQ ID NO: 1830676 - RNA, 18 nt, Salmonella typhimurium LT2
gcaaaucaucgccaugac

SEQ ID NO: 1830677 - RNA, 19 nt, Salmonella typhimurium LT2
gcaaaucaucgccaugacc

SEQ ID NO: 1830678 - RNA, 23 nt, Salmonella typhimurium LT2
gcaaaucaaaaggcaaugccuuu

SEQ ID NO: 1830679 - RNA, 19 nt, Salmonella typhimurium LT2
gcaaauucgucgccgccaa

SEQ ID NO: 1830680 - RNA, 15 nt, Salmonella typhimurium LT2
gcaacagcaagucgc

SEQ ID NO: 1830681 - RNA, 12 nt, Salmonella typhimurium LT2
gcaacagauuga

SEQ ID NO: 1830682 - RNA, 18 nt, Salmonella typhimurium LT2
gauuuuucggcgcgcugg

SEQ ID NO: 1830683 - RNA, 23 nt, Salmonella typhimurium LT2
gauuuuucugcgccaccagcgca

SEQ ID NO: 1830684 - RNA, 19 nt, Salmonella typhimurium LT2
gcaaacgcggugaaggcaa

SEQ ID NO: 1830685 - RNA, 22 nt, Salmonella typhimurium LT2
gcaaacgguaaacgugccacag

SEQ ID NO: 1830686 - RNA, 17 nt, Salmonella typhimurium LT2
gcaaacuaaacgacgug

SEQ ID NO: 1830687 - RNA, 17 nt, Salmonella typhimurium LT2
gauuuccgguuccagcg

SEQ ID NO: 1830688 - RNA, 20 nt, Salmonella typhimurium LT2
gauuuccggcaccagaaucc

SEQ ID NO: 1830689 - RNA, 19 nt, Salmonella typhimurium LT2
gauuucacaaucaucgcau

SEQ ID NO: 1830690 - RNA, 16 nt, Salmonella typhimurium LT2
gauuuagcggcagcca

SEQ ID NO: 1830691 - RNA, 16 nt, Salmonella typhimurium LT2
gauuucgcaacagcau

SEQ ID NO: 1830692 - RNA, 16 nt, Salmonella typhimurium LT2
gauucgcccacggaug

SEQ ID NO: 1830693 - RNA, 18 nt, Salmonella typhimurium LT2
gauucgccagcgugcuua

SEQ ID NO: 1830694 - RNA, 17 nt, Salmonella typhimurium LT2
gauucgcccacggauga

SEQ ID NO: 1830695 - RNA, 16 nt, Salmonella typhimurium LT2
gauugccggaugacgc

SEQ ID NO: 1830696 - RNA, 12 nt, Salmonella typhimurium LT2
gauugccgauau

SEQ ID NO: 1830697 - RNA, 22 nt, Salmonella typhimurium LT2
gauugaucucaucgaucaccca

SEQ ID NO: 1830698 - RNA, 16 nt, Salmonella typhimurium LT2
gauuaauacguacuga

SEQ ID NO: 1830699 - RNA, 20 nt, Salmonella typhimurium LT2
gauuaaucgucaucccgguu

SEQ ID NO: 1830700 - RNA, 12 nt, Salmonella typhimurium LT2
gauuaaugcgau

SEQ ID NO: 1830701 - RNA, 15 nt, Salmonella typhimurium LT2
gauuacaaagggcaa

SEQ ID NO: 1830702 - RNA, 18 nt, Salmonella typhimurium LT2
gauuacgacuuacgcagc

SEQ ID NO: 1830703 - RNA, 23 nt, Salmonella typhimurium LT2
aacugcugcucgguuuugccgac

SEQ ID NO: 1830704 - RNA, 20 nt, Salmonella typhimurium LT2
aacugcgaguucaccaguuu

SEQ ID NO: 1830705 - RNA, 14 nt, Salmonella typhimurium LT2
gaugaagcuacagg

SEQ ID NO: 1830706 - RNA, 13 nt, Salmonella typhimurium LT2
gaugacguccaga

SEQ ID NO: 1830707 - RNA, 22 nt, Salmonella typhimurium LT2
gaugacuuugacggaaccauuc

SEQ ID NO: 1830708 - RNA, 21 nt, Salmonella typhimurium LT2
gaugacgccgcuuauagcggc

SEQ ID NO: 1830709 - RNA, 23 nt, Salmonella typhimurium LT2
gaugagcaaaguaaaacaagccg

SEQ ID NO: 1830710 - RNA, 13 nt, Salmonella typhimurium LT2
gaugagcgcgaaa

SEQ ID NO: 1830711 - RNA, 19 nt, Salmonella typhimurium LT2
gaugacccccagauagccc

SEQ ID NO: 1830712 - RNA, 19 nt, Salmonella typhimurium LT2
gaucuugucacaauaacgc

SEQ ID NO: 1830713 - RNA, 17 nt, Salmonella typhimurium LT2
gaucuuauuagcgauuu

SEQ ID NO: 1830714 - RNA, 17 nt, Salmonella typhimurium LT2
gaucuucaucccauccg

SEQ ID NO: 1830715 - RNA, 14 nt, Salmonella typhimurium LT2
gaucgccgccgaau

SEQ ID NO: 1830716 - RNA, 18 nt, Salmonella typhimurium LT2
gaucgccgacgaccggcg

SEQ ID NO: 1830717 - RNA, 20 nt, Salmonella typhimurium LT2
gaucgccgacgaccggcgca

SEQ ID NO: 1830718 - RNA, 16 nt, Salmonella typhimurium LT2
gaucucauggagcugc

SEQ ID NO: 1830719 - RNA, 21 nt, Salmonella typhimurium LT2
gaugcagccuggagagcagcg

SEQ ID NO: 1830720 - RNA, 16 nt, Salmonella typhimurium LT2
gaugccaucagagccg

SEQ ID NO: 1830721 - RNA, 17 nt, Salmonella typhimurium LT2
aacugguacguccaucc

SEQ ID NO: 1830722 - RNA, 19 nt, Salmonella typhimurium LT2
aacugggugugaucgccgc

SEQ ID NO: 1830723 - RNA, 16 nt, Salmonella typhimurium LT2
gaugaucgaggucagc

SEQ ID NO: 1830724 - RNA, 14 nt, Salmonella typhimurium LT2
gaugauaggucagc

SEQ ID NO: 1830725 - RNA, 13 nt, Salmonella typhimurium LT2
gaugccugaaggc

SEQ ID NO: 1830726 - RNA, 15 nt, Salmonella typhimurium LT2
gaugcgcaacguuuc

SEQ ID NO: 1830727 - RNA, 19 nt, Salmonella typhimurium LT2
gaugccgaccgucggcgca

SEQ ID NO: 1830728 - RNA, 20 nt, Salmonella typhimurium LT2
gaugccgaccgucggcgcaa

SEQ ID NO: 1830729 - RNA, 21 nt, Salmonella typhimurium LT2
cguccaugaccaccagcgcga

SEQ ID NO: 1830730 - RNA, 19 nt, Salmonella typhimurium LT2
cguccaacacgcugcguaa

SEQ ID NO: 1830731 - RNA, 14 nt, Salmonella typhimurium LT2
cgucauucaccgug

SEQ ID NO: 1830732 - RNA, 16 nt, Salmonella typhimurium LT2
cgucauuuuuaucgac

SEQ ID NO: 1830733 - RNA, 21 nt, Salmonella typhimurium LT2
cgucaugcuguuaccguaagc

SEQ ID NO: 1830734 - RNA, 16 nt, Salmonella typhimurium LT2
cgucaucgggcuguua

SEQ ID NO: 1830735 - RNA, 17 nt, Salmonella typhimurium LT2
cgucaucggcgcgcugg

SEQ ID NO: 1830736 - RNA, 13 nt, Salmonella typhimurium LT2
cgucaugccgcca

SEQ ID NO: 1830737 - RNA, 19 nt, Salmonella typhimurium LT2
cgucacgaaugucgcguca

SEQ ID NO: 1830738 - RNA, 18 nt, Salmonella typhimurium LT2
cgucaccugauagcgggu

SEQ ID NO: 1830739 - RNA, 14 nt, Salmonella typhimurium LT2
cgucaccugauagc

SEQ ID NO: 1830740 - RNA, 18 nt, Salmonella typhimurium LT2
cgucacgcguucgaccgu

SEQ ID NO: 1830741 - RNA, 17 nt, Salmonella typhimurium LT2
cgucgacaaagccaacg

SEQ ID NO: 1830742 - RNA, 14 nt, Salmonella typhimurium LT2
cguccggcaucaca

SEQ ID NO: 1830743 - RNA, 21 nt, Salmonella typhimurium LT2
cgucccagcacaaucccggca

SEQ ID NO: 1830744 - RNA, 19 nt, Salmonella typhimurium LT2
cgucgcgcucguaggccag

SEQ ID NO: 1830745 - RNA, 15 nt, Salmonella typhimurium LT2
cgucgcuaaucagca

SEQ ID NO: 1830746 - RNA, 13 nt, Salmonella typhimurium LT2
cgucgccagcguu

SEQ ID NO: 1830747 - RNA, 14 nt, Salmonella typhimurium LT2
cgucgccauaucca

SEQ ID NO: 1830748 - RNA, 16 nt, Salmonella typhimurium LT2
cgucgccauccggcaa

SEQ ID NO: 1830749 - RNA, 18 nt, Salmonella typhimurium LT2
cgucgaggaagcugcgca

SEQ ID NO: 1830750 - RNA, 17 nt, Salmonella typhimurium LT2
cgucgaucucaggcuua

SEQ ID NO: 1830751 - RNA, 15 nt, Salmonella typhimurium LT2
cgguuucgaccagca

SEQ ID NO: 1830752 - RNA, 16 nt, Salmonella typhimurium LT2
cgguuuucacuggcau

SEQ ID NO: 1830753 - RNA, 17 nt, Salmonella typhimurium LT2
cgguugauaaucgcuau

SEQ ID NO: 1830754 - RNA, 20 nt, Salmonella typhimurium LT2
cgguugccagggaaugccau

SEQ ID NO: 1830755 - RNA, 20 nt, Salmonella typhimurium LT2
cgguucacggccaaagcgcg

SEQ ID NO: 1830756 - RNA, 21 nt, Salmonella typhimurium LT2
cgguucacggccaaagcgcga

SEQ ID NO: 1830757 - RNA, 18 nt, Salmonella typhimurium LT2
cguacgggcaaagcgacg

SEQ ID NO: 1830758 - RNA, 15 nt, Salmonella typhimurium LT2
cguaccuccagcgac

SEQ ID NO: 1830759 - RNA, 16 nt, Salmonella typhimurium LT2
cguaccguugccgccg

SEQ ID NO: 1830760 - RNA, 23 nt, Salmonella typhimurium LT2
cguaccguauccuuccagcccgu

SEQ ID NO: 1830761 - RNA, 16 nt, Salmonella typhimurium LT2
cguaccgcuaucgcca

SEQ ID NO: 1830762 - RNA, 22 nt, Salmonella typhimurium LT2
cguacucagaucggcagacagu

SEQ ID NO: 1830763 - RNA, 15 nt, Salmonella typhimurium LT2
cguacgguuacaacc

SEQ ID NO: 1830764 - RNA, 15 nt, Salmonella typhimurium LT2
cguaacucggcagcg

SEQ ID NO: 1830765 - RNA, 15 nt, Salmonella typhimurium LT2
cguacaaaggggcca

SEQ ID NO: 1830766 - RNA, 13 nt, Salmonella typhimurium LT2
cguaacgccgucg

SEQ ID NO: 1830767 - RNA, 19 nt, Salmonella typhimurium LT2
cguaacgccgucggcagcc

SEQ ID NO: 1830768 - RNA, 12 nt, Salmonella typhimurium LT2
cguacagacgcu

SEQ ID NO: 1830769 - RNA, 20 nt, Salmonella typhimurium LT2
cguagcguucauucccgcca

SEQ ID NO: 1830770 - RNA, 14 nt, Salmonella typhimurium LT2
aacccgaucgccau

SEQ ID NO: 1830771 - RNA, 12 nt, Salmonella typhimurium LT2
cguagcgccaac

SEQ ID NO: 1830772 - RNA, 16 nt, Salmonella typhimurium LT2
cguagcgccaucaggc

SEQ ID NO: 1830773 - RNA, 18 nt, Salmonella typhimurium LT2
cguagcgccaucaggcau

SEQ ID NO: 1830774 - RNA, 14 nt, Salmonella typhimurium LT2
cguagcgccauccg

SEQ ID NO: 1830775 - RNA, 13 nt, Salmonella typhimurium LT2
aaccccaucgccu

SEQ ID NO: 1830776 - RNA, 21 nt, Salmonella typhimurium LT2
cguagccgaccaccauccggc

SEQ ID NO: 1830777 - RNA, 19 nt, Salmonella typhimurium LT2
cguagccgccgagcgccgu

SEQ ID NO: 1830778 - RNA, 15 nt, Salmonella typhimurium LT2
cguagcgcauccggc

SEQ ID NO: 1830779 - RNA, 19 nt, Salmonella typhimurium LT2
cguagccgggugcgcgucg

SEQ ID NO: 1830780 - RNA, 20 nt, Salmonella typhimurium LT2
cguagauuuucaucauaucu

SEQ ID NO: 1830781 - RNA, 16 nt, Salmonella typhimurium LT2
cguagcagaagacgcu

SEQ ID NO: 1830782 - RNA, 19 nt, Salmonella typhimurium LT2
cguaggccggauaagcgug

SEQ ID NO: 1830783 - RNA, 19 nt, Salmonella typhimurium LT2
cguaggccggauaaggcau

SEQ ID NO: 1830784 - RNA, 20 nt, Salmonella typhimurium LT2
cguaggccggauaagacgcg

SEQ ID NO: 1830785 - RNA, 23 nt, Salmonella typhimurium LT2
cguaggccggauaagacgcgcag

SEQ ID NO: 1830786 - RNA, 19 nt, Salmonella typhimurium LT2
cguaggccugauaagcgca

SEQ ID NO: 1830787 - RNA, 18 nt, Salmonella typhimurium LT2
cguaggccggauaaggcg

SEQ ID NO: 1830788 - RNA, 13 nt, Salmonella typhimurium LT2
cguaggccggaua

SEQ ID NO: 1830789 - RNA, 15 nt, Salmonella typhimurium LT2
cguagucagcgacgc

SEQ ID NO: 1830790 - RNA, 15 nt, Salmonella typhimurium LT2
cguagucaggcagca

SEQ ID NO: 1830791 - RNA, 13 nt, Salmonella typhimurium LT2
cguaguaagcgga

SEQ ID NO: 1830792 - RNA, 20 nt, Salmonella typhimurium LT2
cguauccggcaagucagacc

SEQ ID NO: 1830793 - RNA, 17 nt, Salmonella typhimurium LT2
cguauccgccaccauga

SEQ ID NO: 1830794 - RNA, 20 nt, Salmonella typhimurium LT2
cgucaaaaugaucagaccau

SEQ ID NO: 1830795 - RNA, 17 nt, Salmonella typhimurium LT2
cguaugcagccaggcca

SEQ ID NO: 1830796 - RNA, 17 nt, Salmonella typhimurium LT2
aacccgcuacgcgugau

SEQ ID NO: 1830797 - RNA, 16 nt, Salmonella typhimurium LT2
cguggcgcaaccgaua

SEQ ID NO: 1830798 - RNA, 21 nt, Salmonella typhimurium LT2
cguggcgagcuucucgccgga

SEQ ID NO: 1830799 - RNA, 12 nt, Salmonella typhimurium LT2
cgugcggcgaag

SEQ ID NO: 1830800 - RNA, 20 nt, Salmonella typhimurium LT2
cgugccuuccgcaauacagc

SEQ ID NO: 1830801 - RNA, 21 nt, Salmonella typhimurium LT2
cgugcgaauuucggcaaugac

SEQ ID NO: 1830802 - RNA, 15 nt, Salmonella typhimurium LT2
cgugccguccggcau

SEQ ID NO: 1830803 - RNA, 20 nt, Salmonella typhimurium LT2
cguguugauuaaugcgauaa

SEQ ID NO: 1830804 - RNA, 14 nt, Salmonella typhimurium LT2
cguggugccgguug

SEQ ID NO: 1830805 - RNA, 17 nt, Salmonella typhimurium LT2
cguggugggguucccga

SEQ ID NO: 1830806 - RNA, 19 nt, Salmonella typhimurium LT2
cguucagauaggcgcgaaa

SEQ ID NO: 1830807 - RNA, 15 nt, Salmonella typhimurium LT2
cguucacguaaucgc

SEQ ID NO: 1830808 - RNA, 17 nt, Salmonella typhimurium LT2
cguucacguaaucgccg

SEQ ID NO: 1830809 - RNA, 18 nt, Salmonella typhimurium LT2
cguucacguaaucgccgu

SEQ ID NO: 1830810 - RNA, 12 nt, Salmonella typhimurium LT2
cguucagcaucg

SEQ ID NO: 1830811 - RNA, 13 nt, Salmonella typhimurium LT2
cguucagcgccgg

SEQ ID NO: 1830812 - RNA, 18 nt, Salmonella typhimurium LT2
cguuauugaccaucgcca

SEQ ID NO: 1830813 - RNA, 17 nt, Salmonella typhimurium LT2
cguuaucugaccuacag

SEQ ID NO: 1830814 - RNA, 22 nt, Salmonella typhimurium LT2
cguuaugcgcuugcgcaauuuc

SEQ ID NO: 1830815 - RNA, 21 nt, Salmonella typhimurium LT2
cguuaugggaagggugacggc

SEQ ID NO: 1830816 - RNA, 20 nt, Salmonella typhimurium LT2
cguuaacccgcuuacaguuu

SEQ ID NO: 1830817 - RNA, 15 nt, Salmonella typhimurium LT2
cguuaacccggcauu

SEQ ID NO: 1830818 - RNA, 22 nt, Salmonella typhimurium LT2
cguuaaccgucuggcugccauc

SEQ ID NO: 1830819 - RNA, 15 nt, Salmonella typhimurium LT2
cguuaauuuucacgc

SEQ ID NO: 1830820 - RNA, 13 nt, Salmonella typhimurium LT2
cguucgucgccgg

SEQ ID NO: 1830821 - RNA, 12 nt, Salmonella typhimurium LT2
cguugaugauaa

SEQ ID NO: 1830822 - RNA, 14 nt, Salmonella typhimurium LT2
cguugauggcguaa

SEQ ID NO: 1830823 - RNA, 15 nt, Salmonella typhimurium LT2
cguugcaaucgccug

SEQ ID NO: 1830824 - RNA, 15 nt, Salmonella typhimurium LT2
cguugccgaacgcgg

SEQ ID NO: 1830825 - RNA, 19 nt, Salmonella typhimurium LT2
cgugaucgccaaagcguaa

SEQ ID NO: 1830826 - RNA, 19 nt, Salmonella typhimurium LT2
cgugauaaagcugacgcgc

SEQ ID NO: 1830827 - RNA, 20 nt, Salmonella typhimurium LT2
cgugaguuucagcaucauau

SEQ ID NO: 1830828 - RNA, 21 nt, Salmonella typhimurium LT2
cgugauuuuggccucauccgc

SEQ ID NO: 1830829 - RNA, 15 nt, Salmonella typhimurium LT2
cgugauuucaugcgg

SEQ ID NO: 1830830 - RNA, 17 nt, Salmonella typhimurium LT2
cgugauugagcagauca

SEQ ID NO: 1830831 - RNA, 13 nt, Salmonella typhimurium LT2
cgugauugcugac

SEQ ID NO: 1830832 - RNA, 17 nt, Salmonella typhimurium LT2
cgugaugggcgaucgcc

SEQ ID NO: 1830833 - RNA, 22 nt, Salmonella typhimurium LT2
cgugaugauaggucagcgauuc

SEQ ID NO: 1830834 - RNA, 17 nt, Salmonella typhimurium LT2
cgugaccguuucaaaga

SEQ ID NO: 1830835 - RNA, 14 nt, Salmonella typhimurium LT2
cgugaccugcugac

SEQ ID NO: 1830836 - RNA, 16 nt, Salmonella typhimurium LT2
cgugacuguucacauc

SEQ ID NO: 1830837 - RNA, 16 nt, Salmonella typhimurium LT2
cgugcauaaagcgguu

SEQ ID NO: 1830838 - RNA, 12 nt, Salmonella typhimurium LT2
cgugccagcguc

SEQ ID NO: 1830839 - RNA, 23 nt, Salmonella typhimurium LT2
cgucugcugaccaaacugcggaa

SEQ ID NO: 1830840 - RNA, 23 nt, Salmonella typhimurium LT2
cgugaaaauaaaauauccagcgu

SEQ ID NO: 1830841 - RNA, 22 nt, Salmonella typhimurium LT2
cgugaaccgaaauccaccagcg

SEQ ID NO: 1830842 - RNA, 24 nt, Salmonella typhimurium LT2
cgucuuuuagucacuccaggcguu

SEQ ID NO: 1830843 - RNA, 22 nt, Salmonella typhimurium LT2
cgucuguuucaacacauccagc

SEQ ID NO: 1830844 - RNA, 14 nt, Salmonella typhimurium LT2
cgucuuauccggcc

SEQ ID NO: 1830845 - RNA, 19 nt, Salmonella typhimurium LT2
cgucugguacggccaccag

SEQ ID NO: 1830846 - RNA, 20 nt, Salmonella typhimurium LT2
aaccgaaauccaccagcgga

SEQ ID NO: 1830847 - RNA, 23 nt, Salmonella typhimurium LT2
cgugaauggucacauucugaccg

SEQ ID NO: 1830848 - RNA, 20 nt, Salmonella typhimurium LT2
cugcaaugguaaaacgcugg

SEQ ID NO: 1830849 - RNA, 18 nt, Salmonella typhimurium LT2
cugcaccuuuuuuuccag

SEQ ID NO: 1830850 - RNA, 20 nt, Salmonella typhimurium LT2
cugcaccuuuuuuuccagcg

SEQ ID NO: 1830851 - RNA, 14 nt, Salmonella typhimurium LT2
cugcacaaucgcca

SEQ ID NO: 1830852 - RNA, 16 nt, Salmonella typhimurium LT2
cugcacucgauggcuu

SEQ ID NO: 1830853 - RNA, 13 nt, Salmonella typhimurium LT2
cugcagcagcuuc

SEQ ID NO: 1830854 - RNA, 17 nt, Salmonella typhimurium LT2
cugcaacagcaccagca

SEQ ID NO: 1830855 - RNA, 14 nt, Salmonella typhimurium LT2
cugcaacgacgcgg

SEQ ID NO: 1830856 - RNA, 12 nt, Salmonella typhimurium LT2
cugauugagcau

SEQ ID NO: 1830857 - RNA, 22 nt, Salmonella typhimurium LT2
cugauuaccuaccagcgcgcca

SEQ ID NO: 1830858 - RNA, 14 nt, Salmonella typhimurium LT2
cugauguaccugcg

SEQ ID NO: 1830859 - RNA, 16 nt, Salmonella typhimurium LT2
cugaugaacguagucg

SEQ ID NO: 1830860 - RNA, 15 nt, Salmonella typhimurium LT2
cugaugaacuacgcc

SEQ ID NO: 1830861 - RNA, 20 nt, Salmonella typhimurium LT2
cugaugcgcguuuagcgcca

SEQ ID NO: 1830862 - RNA, 13 nt, Salmonella typhimurium LT2
cugaugcugcgca

SEQ ID NO: 1830863 - RNA, 17 nt, Salmonella typhimurium LT2
cugauggcgcugcgcca

SEQ ID NO: 1830864 - RNA, 18 nt, Salmonella typhimurium LT2
cugauggcgcuacgcuua

SEQ ID NO: 1830865 - RNA, 18 nt, Salmonella typhimurium LT2
cugauggcgcagcgccau

SEQ ID NO: 1830866 - RNA, 19 nt, Salmonella typhimurium LT2
cugauggcgcagcgccauc

SEQ ID NO: 1830867 - RNA, 19 nt, Salmonella typhimurium LT2
cugcaucgugagcgcguca

SEQ ID NO: 1830868 - RNA, 12 nt, Salmonella typhimurium LT2
cugcauuucuug

SEQ ID NO: 1830869 - RNA, 19 nt, Salmonella typhimurium LT2
cugccaacgauauucgcug

SEQ ID NO: 1830870 - RNA, 12 nt, Salmonella typhimurium LT2
cugccaaccauc

SEQ ID NO: 1830871 - RNA, 15 nt, Salmonella typhimurium LT2
cugcauaauccaacg

SEQ ID NO: 1830872 - RNA, 16 nt, Salmonella typhimurium LT2
cugcauaggcuuuacc

SEQ ID NO: 1830873 - RNA, 22 nt, Salmonella typhimurium LT2
cugcauaaacgcggccaucacg

SEQ ID NO: 1830874 - RNA, 16 nt, Salmonella typhimurium LT2
cugcagggugaagaug

SEQ ID NO: 1830875 - RNA, 15 nt, Salmonella typhimurium LT2
cugcagcuccgcaau

SEQ ID NO: 1830876 - RNA, 15 nt, Salmonella typhimurium LT2
cugccagggcaucgc

SEQ ID NO: 1830877 - RNA, 21 nt, Salmonella typhimurium LT2
cugccagccgccgccggacug

SEQ ID NO: 1830878 - RNA, 15 nt, Salmonella typhimurium LT2
cugccagcgaaccgc

SEQ ID NO: 1830879 - RNA, 14 nt, Salmonella typhimurium LT2
cugcccagccgcca

SEQ ID NO: 1830880 - RNA, 16 nt, Salmonella typhimurium LT2
cugcccgcgccaucca

SEQ ID NO: 1830881 - RNA, 22 nt, Salmonella typhimurium LT2
cugaaaaccgcaucaagcccau

SEQ ID NO: 1830882 - RNA, 15 nt, Salmonella typhimurium LT2
cugaaaauagcgcca

SEQ ID NO: 1830883 - RNA, 24 nt, Salmonella typhimurium LT2
cugaacagcggcggcacggcguca

SEQ ID NO: 1830884 - RNA, 18 nt, Salmonella typhimurium LT2
cucuuuuaacgaacgcgc

SEQ ID NO: 1830885 - RNA, 15 nt, Salmonella typhimurium LT2
cucuuccaaccgugu

SEQ ID NO: 1830886 - RNA, 13 nt, Salmonella typhimurium LT2
cucuuccagcguc

SEQ ID NO: 1830887 - RNA, 19 nt, Salmonella typhimurium LT2
cucuacgccggcgcguaau

SEQ ID NO: 1830888 - RNA, 17 nt, Salmonella typhimurium LT2
cucggcgucaucccggu

SEQ ID NO: 1830889 - RNA, 18 nt, Salmonella typhimurium LT2
cucucaccgcccaggcca

SEQ ID NO: 1830890 - RNA, 19 nt, Salmonella typhimurium LT2
cucugcugugccaguaccg

SEQ ID NO: 1830891 - RNA, 22 nt, Salmonella typhimurium LT2
cucugcuuuuaucggcaucugu

SEQ ID NO: 1830892 - RNA, 13 nt, Salmonella typhimurium LT2
cucugcgcacgac

SEQ ID NO: 1830893 - RNA, 13 nt, Salmonella typhimurium LT2
cugaaccaggccg

SEQ ID NO: 1830894 - RNA, 20 nt, Salmonella typhimurium LT2
cugaaccagcggcaccagca

SEQ ID NO: 1830895 - RNA, 22 nt, Salmonella typhimurium LT2
cugaagaaaaggaauaccugcg

SEQ ID NO: 1830896 - RNA, 17 nt, Salmonella typhimurium LT2
cugaagacgaaacgcuu

SEQ ID NO: 1830897 - RNA, 19 nt, Salmonella typhimurium LT2
cugaagauaaacagcagcg

SEQ ID NO: 1830898 - RNA, 22 nt, Salmonella typhimurium LT2
cugaagccagcaaucagcccau

SEQ ID NO: 1830899 - RNA, 19 nt, Salmonella typhimurium LT2
cugaagcguaacagcgcua

SEQ ID NO: 1830900 - RNA, 19 nt, Salmonella typhimurium LT2
cugaauaacagcaccauua

SEQ ID NO: 1830901 - RNA, 13 nt, Salmonella typhimurium LT2
cugaccagaccga

SEQ ID NO: 1830902 - RNA, 23 nt, Salmonella typhimurium LT2
cugaccaguuguuccgcgcugau

SEQ ID NO: 1830903 - RNA, 14 nt, Salmonella typhimurium LT2
cugaaugaagccuu

SEQ ID NO: 1830904 - RNA, 15 nt, Salmonella typhimurium LT2
cugaaugaagccuua

SEQ ID NO: 1830905 - RNA, 14 nt, Salmonella typhimurium LT2
cugaaugacgccgu

SEQ ID NO: 1830906 - RNA, 14 nt, Salmonella typhimurium LT2
cugaaugccauccc

SEQ ID NO: 1830907 - RNA, 16 nt, Salmonella typhimurium LT2
cugaaucguagcgugc

SEQ ID NO: 1830908 - RNA, 18 nt, Salmonella typhimurium LT2
cugaauauucggcuccag

SEQ ID NO: 1830909 - RNA, 12 nt, Salmonella typhimurium LT2
cugaauucgcca

SEQ ID NO: 1830910 - RNA, 16 nt, Salmonella typhimurium LT2
cugacggggcgcgugc

SEQ ID NO: 1830911 - RNA, 19 nt, Salmonella typhimurium LT2
cugacggccugucuccgca

SEQ ID NO: 1830912 - RNA, 17 nt, Salmonella typhimurium LT2
cugacggcagccacgcc

SEQ ID NO: 1830913 - RNA, 21 nt, Salmonella typhimurium LT2
cugacugguuuguugcgucug

SEQ ID NO: 1830914 - RNA, 19 nt, Salmonella typhimurium LT2
cugagacucaguagcgcau

SEQ ID NO: 1830915 - RNA, 15 nt, Salmonella typhimurium LT2
cugacucaucacauc

SEQ ID NO: 1830916 - RNA, 18 nt, Salmonella typhimurium LT2
cugacgcccaucagcauc

SEQ ID NO: 1830917 - RNA, 20 nt, Salmonella typhimurium LT2
cugacgaccauugccaaugc

SEQ ID NO: 1830918 - RNA, 21 nt, Salmonella typhimurium LT2
cugacgaaaacccgccaccau

SEQ ID NO: 1830919 - RNA, 19 nt, Salmonella typhimurium LT2
cugauacggcguuggcugc

SEQ ID NO: 1830920 - RNA, 14 nt, Salmonella typhimurium LT2
cugauacagccaaa

SEQ ID NO: 1830921 - RNA, 19 nt, Salmonella typhimurium LT2
cugauaagcgaagcgccau

SEQ ID NO: 1830922 - RNA, 12 nt, Salmonella typhimurium LT2
cugauaagcgca

SEQ ID NO: 1830923 - RNA, 19 nt, Salmonella typhimurium LT2
cugauaagcgcagcgccau

SEQ ID NO: 1830924 - RNA, 15 nt, Salmonella typhimurium LT2
cugauaagcguagcg

SEQ ID NO: 1830925 - RNA, 15 nt, Salmonella typhimurium LT2
cugauaagcacaggc

SEQ ID NO: 1830926 - RNA, 12 nt, Salmonella typhimurium LT2
cugauagcccau

SEQ ID NO: 1830927 - RNA, 17 nt, Salmonella typhimurium LT2
cugauaaucccguuccg

SEQ ID NO: 1830928 - RNA, 19 nt, Salmonella typhimurium LT2
cugauauacgaagcgccau

SEQ ID NO: 1830929 - RNA, 20 nt, Salmonella typhimurium LT2
cugauaguuuaaauccagcg

SEQ ID NO: 1830930 - RNA, 23 nt, Salmonella typhimurium LT2
cugagauggcacaauaaccagau

SEQ ID NO: 1830931 - RNA, 16 nt, Salmonella typhimurium LT2
cugaggcgccgucaau

SEQ ID NO: 1830932 - RNA, 19 nt, Salmonella typhimurium LT2
cugagcggcucauccagca

SEQ ID NO: 1830933 - RNA, 23 nt, Salmonella typhimurium LT2
cugagcgcgcaaucgggccugcu

SEQ ID NO: 1830934 - RNA, 20 nt, Salmonella typhimurium LT2
cucacauucauugccgccag

SEQ ID NO: 1830935 - RNA, 19 nt, Salmonella typhimurium LT2
cucaauggcgcgccagcca

SEQ ID NO: 1830936 - RNA, 15 nt, Salmonella typhimurium LT2
cucaauugaggccgu

SEQ ID NO: 1830937 - RNA, 13 nt, Salmonella typhimurium LT2
cucacgcaaugcc

SEQ ID NO: 1830938 - RNA, 22 nt, Salmonella typhimurium LT2
cucaccuuuuuauuuacugccg

SEQ ID NO: 1830939 - RNA, 19 nt, Salmonella typhimurium LT2
cucaccuccgccaccagcg

SEQ ID NO: 1830940 - RNA, 17 nt, Salmonella typhimurium LT2
cucacgacuuucaccag

SEQ ID NO: 1830941 - RNA, 22 nt, Salmonella typhimurium LT2
cucacgggcguagucagcgacg

SEQ ID NO: 1830942 - RNA, 14 nt, Salmonella typhimurium LT2
cucacgcucauagc

SEQ ID NO: 1830943 - RNA, 17 nt, Salmonella typhimurium LT2
cucacuuuucuuuccug

SEQ ID NO: 1830944 - RNA, 19 nt, Salmonella typhimurium LT2
cucagcuaaaaacagcgca

SEQ ID NO: 1830945 - RNA, 12 nt, Salmonella typhimurium LT2
cucagccaggcg

SEQ ID NO: 1830946 - RNA, 21 nt, Salmonella typhimurium LT2
cucagcauguccgccuaccag

SEQ ID NO: 1830947 - RNA, 14 nt, Salmonella typhimurium LT2
cucagaucggcaga

SEQ ID NO: 1830948 - RNA, 18 nt, Salmonella typhimurium LT2
cucauuuuguugcuccag

SEQ ID NO: 1830949 - RNA, 15 nt, Salmonella typhimurium LT2
cuccaucauaucgcg

SEQ ID NO: 1830950 - RNA, 14 nt, Salmonella typhimurium LT2
cuccaucaucgcca

SEQ ID NO: 1830951 - RNA, 15 nt, Salmonella typhimurium LT2
cuccaguaauucccg

SEQ ID NO: 1830952 - RNA, 12 nt, Salmonella typhimurium LT2
cuccagcguacu

SEQ ID NO: 1830953 - RNA, 22 nt, Salmonella typhimurium LT2
cuccagcuggcuggcauugccg

SEQ ID NO: 1830954 - RNA, 21 nt, Salmonella typhimurium LT2
cuauuuuggagaaacggugcu

SEQ ID NO: 1830955 - RNA, 17 nt, Salmonella typhimurium LT2
cucaagcccgcgucguu

SEQ ID NO: 1830956 - RNA, 14 nt, Salmonella typhimurium LT2
cucaauagcggcgc

SEQ ID NO: 1830957 - RNA, 19 nt, Salmonella typhimurium LT2
cucaacauugccggcauca

SEQ ID NO: 1830958 - RNA, 23 nt, Salmonella typhimurium LT2
cucaacgcguucauccagcgcgc

SEQ ID NO: 1830959 - RNA, 17 nt, Salmonella typhimurium LT2
cuauguuugcugagaau

SEQ ID NO: 1830960 - RNA, 12 nt, Salmonella typhimurium LT2
cuaugugcgcca

SEQ ID NO: 1830961 - RNA, 13 nt, Salmonella typhimurium LT2
cuauguagcgcug

SEQ ID NO: 1830962 - RNA, 14 nt, Salmonella typhimurium LT2
cuauccagucagcg

SEQ ID NO: 1830963 - RNA, 20 nt, Salmonella typhimurium LT2
cuaucugcuccgccagcaau

SEQ ID NO: 1830964 - RNA, 20 nt, Salmonella typhimurium LT2
cuaucgguaguguuaucgcc

SEQ ID NO: 1830965 - RNA, 15 nt, Salmonella typhimurium LT2
cuacguucaucaggc

SEQ ID NO: 1830966 - RNA, 23 nt, Salmonella typhimurium LT2
cguugcgacaaccuguaggccgg

SEQ ID NO: 1830967 - RNA, 14 nt, Salmonella typhimurium LT2
cuauaacagcgcca

SEQ ID NO: 1830968 - RNA, 21 nt, Salmonella typhimurium LT2
cuaucaggcaauacgcugccg

SEQ ID NO: 1830969 - RNA, 14 nt, Salmonella typhimurium LT2
cuauccagcucacc

SEQ ID NO: 1830970 - RNA, 15 nt, Salmonella typhimurium LT2
cuauccagcucaccg

SEQ ID NO: 1830971 - RNA, 14 nt, Salmonella typhimurium LT2
cuccuccagcgcgu

SEQ ID NO: 1830972 - RNA, 22 nt, Salmonella typhimurium LT2
cuccggguugccugauggcgcu

SEQ ID NO: 1830973 - RNA, 15 nt, Salmonella typhimurium LT2
cuccugcgccagccg

SEQ ID NO: 1830974 - RNA, 20 nt, Salmonella typhimurium LT2
cuccugguccguaaccuggc

SEQ ID NO: 1830975 - RNA, 23 nt, Salmonella typhimurium LT2
cuccuguaagucagguagcguca

SEQ ID NO: 1830976 - RNA, 14 nt, Salmonella typhimurium LT2
cuccggacguaccc

SEQ ID NO: 1830977 - RNA, 21 nt, Salmonella typhimurium LT2
cuccggcuuaaugcauggcag

SEQ ID NO: 1830978 - RNA, 21 nt, Salmonella typhimurium LT2
cucgcagguacgacacccgau

SEQ ID NO: 1830979 - RNA, 21 nt, Salmonella typhimurium LT2
cucgcggcggaccgcaacguc

SEQ ID NO: 1830980 - RNA, 13 nt, Salmonella typhimurium LT2
cucgcccgccaga

SEQ ID NO: 1830981 - RNA, 12 nt, Salmonella typhimurium LT2
cucggcagcagc

SEQ ID NO: 1830982 - RNA, 22 nt, Salmonella typhimurium LT2
cucggcauacaccgccagcguc

SEQ ID NO: 1830983 - RNA, 23 nt, Salmonella typhimurium LT2
aacggagauauagaccagcgccg

SEQ ID NO: 1830984 - RNA, 21 nt, Salmonella typhimurium LT2
gaccgccgaugcugaauagcc

SEQ ID NO: 1830985 - RNA, 17 nt, Salmonella typhimurium LT2
aacgcggcccugaaacc

SEQ ID NO: 1830986 - RNA, 20 nt, Salmonella typhimurium LT2
aacgcggauggcguuaacgc

SEQ ID NO: 1830987 - RNA, 22 nt, Salmonella typhimurium LT2
aacgcgucuuaucuggccuaca

SEQ ID NO: 1830988 - RNA, 21 nt, Salmonella typhimurium LT2
aacgcuuuccaguugcggcau

SEQ ID NO: 1830989 - RNA, 17 nt, Salmonella typhimurium LT2
aacgcuuuugcgcacug

SEQ ID NO: 1830990 - RNA, 22 nt, Salmonella typhimurium LT2
aacgcuuuuucaaagaugaaac

SEQ ID NO: 1830991 - RNA, 16 nt, Salmonella typhimurium LT2
gacccaucaauaacga

SEQ ID NO: 1830992 - RNA, 21 nt, Salmonella typhimurium LT2
gaccagccuaccugccgccau

SEQ ID NO: 1830993 - RNA, 23 nt, Salmonella typhimurium LT2
aacgccgucgacaaagccaacgc

SEQ ID NO: 1830994 - RNA, 12 nt, Salmonella typhimurium LT2
gaccagcaucag

SEQ ID NO: 1830995 - RNA, 19 nt, Salmonella typhimurium LT2
aacgauguaucgcgcggau

SEQ ID NO: 1830996 - RNA, 15 nt, Salmonella typhimurium LT2
aacgaugucaucgcc

SEQ ID NO: 1830997 - RNA, 23 nt, Salmonella typhimurium LT2
aacgaugugacuggggugagcga

SEQ ID NO: 1830998 - RNA, 18 nt, Salmonella typhimurium LT2
aacgauuucaucagcgac

SEQ ID NO: 1830999 - RNA, 14 nt, Salmonella typhimurium LT2
gaccagcaccaucu

SEQ ID NO: 1831000 - RNA, 15 nt, Salmonella typhimurium LT2
aacgccgcgccauca

SEQ ID NO: 1831001 - RNA, 13 nt, Salmonella typhimurium LT2
aacgccgccagcu

SEQ ID NO: 1831002 - RNA, 13 nt, Salmonella typhimurium LT2
aacgccgccaucc

SEQ ID NO: 1831003 - RNA, 20 nt, Salmonella typhimurium LT2
gacaucggagauuucauccu

SEQ ID NO: 1831004 - RNA, 11 nt, Salmonella typhimurium LT2
gaauugcgcca

SEQ ID NO: 1831005 - RNA, 20 nt, Salmonella typhimurium LT2
gaauugccgugguaucgaaa

SEQ ID NO: 1831006 - RNA, 11 nt, Salmonella typhimurium LT2
gaaugcgaaua

SEQ ID NO: 1831007 - RNA, 19 nt, Salmonella typhimurium LT2
gaauuucuacacagcgcga

SEQ ID NO: 1831008 - RNA, 16 nt, Salmonella typhimurium LT2
gaauuuacucgccaau

SEQ ID NO: 1831009 - RNA, 18 nt, Salmonella typhimurium LT2
gacaaucucaaugccacg

SEQ ID NO: 1831010 - RNA, 15 nt, Salmonella typhimurium LT2
gacaaugauuugcaa

SEQ ID NO: 1831011 - RNA, 17 nt, Salmonella typhimurium LT2
gacaauaucucccgguu

SEQ ID NO: 1831012 - RNA, 20 nt, Salmonella typhimurium LT2
gacaauauucgccgcgauaa

SEQ ID NO: 1831013 - RNA, 13 nt, Salmonella typhimurium LT2
gacaacgcauugc

SEQ ID NO: 1831014 - RNA, 19 nt, Salmonella typhimurium LT2
gacaaaugaagccugggau

SEQ ID NO: 1831015 - RNA, 18 nt, Salmonella typhimurium LT2
gaacuggcugauaaagcu

SEQ ID NO: 1831016 - RNA, 13 nt, Salmonella typhimurium LT2
gaacugauggcgc

SEQ ID NO: 1831017 - RNA, 13 nt, Salmonella typhimurium LT2
gaauaaacgguaa

SEQ ID NO: 1831018 - RNA, 13 nt, Salmonella typhimurium LT2
gaaguuugcacuu

SEQ ID NO: 1831019 - RNA, 15 nt, Salmonella typhimurium LT2
gaaguuaccgcgcca

SEQ ID NO: 1831020 - RNA, 19 nt, Salmonella typhimurium LT2
gaauauugcgccacgcugu

SEQ ID NO: 1831021 - RNA, 18 nt, Salmonella typhimurium LT2
gaauaugagcacagccca

SEQ ID NO: 1831022 - RNA, 18 nt, Salmonella typhimurium LT2
gaauauagcuaaugcaau

SEQ ID NO: 1831023 - RNA, 23 nt, Salmonella typhimurium LT2
gaauaguauugccgucaaaggcu

SEQ ID NO: 1831024 - RNA, 21 nt, Salmonella typhimurium LT2
gaauaaucgccggacggcgca

SEQ ID NO: 1831025 - RNA, 16 nt, Salmonella typhimurium LT2
gaauaaucucugcgac

SEQ ID NO: 1831026 - RNA, 19 nt, Salmonella typhimurium LT2
gaauaagcugaaugguaaa

SEQ ID NO: 1831027 - RNA, 13 nt, Salmonella typhimurium LT2
gaaucgaaccugc

SEQ ID NO: 1831028 - RNA, 21 nt, Salmonella typhimurium LT2
gaaugccguauaccagcguca

SEQ ID NO: 1831029 - RNA, 15 nt, Salmonella typhimurium LT2
gacacaguauucacc

SEQ ID NO: 1831030 - RNA, 16 nt, Salmonella typhimurium LT2
gacacagaugccguuu

SEQ ID NO: 1831031 - RNA, 17 nt, Salmonella typhimurium LT2
gacacauaaccugaaua

SEQ ID NO: 1831032 - RNA, 20 nt, Salmonella typhimurium LT2
gacacggaacaacgcaacac

SEQ ID NO: 1831033 - RNA, 22 nt, Salmonella typhimurium LT2
gacauauuuucgaugcacgcca

SEQ ID NO: 1831034 - RNA, 13 nt, Salmonella typhimurium LT2
gacauccauccgg

SEQ ID NO: 1831035 - RNA, 17 nt, Salmonella typhimurium LT2
gacaucacguucgcgca

SEQ ID NO: 1831036 - RNA, 23 nt, Salmonella typhimurium LT2
gacaucagaaaauagugaauggc

SEQ ID NO: 1831037 - RNA, 19 nt, Salmonella typhimurium LT2
gacaucagccagccgccaa

SEQ ID NO: 1831038 - RNA, 15 nt, Salmonella typhimurium LT2
gacauacauaacgcg

SEQ ID NO: 1831039 - RNA, 17 nt, Salmonella typhimurium LT2
aacgacgaauauccaga

SEQ ID NO: 1831040 - RNA, 19 nt, Salmonella typhimurium LT2
aacgacgcuccagaaucuc

SEQ ID NO: 1831041 - RNA, 17 nt, Salmonella typhimurium LT2
gacacuggaaacagcca

SEQ ID NO: 1831042 - RNA, 22 nt, Salmonella typhimurium LT2
gacacugauauaccguccagac

SEQ ID NO: 1831043 - RNA, 14 nt, Salmonella typhimurium LT2
gacagacgcaucuu

SEQ ID NO: 1831044 - RNA, 17 nt, Salmonella typhimurium LT2
gacagacguugcgccac

SEQ ID NO: 1831045 - RNA, 17 nt, Salmonella typhimurium LT2
gacgauagccaugcccg

SEQ ID NO: 1831046 - RNA, 14 nt, Salmonella typhimurium LT2
gacgaucagcgcca

SEQ ID NO: 1831047 - RNA, 15 nt, Salmonella typhimurium LT2
gacgaucagcgcauu

SEQ ID NO: 1831048 - RNA, 15 nt, Salmonella typhimurium LT2
gacgauagucagcgc

SEQ ID NO: 1831049 - RNA, 16 nt, Salmonella typhimurium LT2
gacgauagucagcgca

SEQ ID NO: 1831050 - RNA, 20 nt, Salmonella typhimurium LT2
aacguaaacggcagccgcca

SEQ ID NO: 1831051 - RNA, 16 nt, Salmonella typhimurium LT2
aacgguuuauccccgc

SEQ ID NO: 1831052 - RNA, 19 nt, Salmonella typhimurium LT2
aacguaaauacccaggcca

SEQ ID NO: 1831053 - RNA, 14 nt, Salmonella typhimurium LT2
aacgucaccgcuuu

SEQ ID NO: 1831054 - RNA, 15 nt, Salmonella typhimurium LT2
gaccuuaauccagcc

SEQ ID NO: 1831055 - RNA, 13 nt, Salmonella typhimurium LT2
gacgaaucagcga

SEQ ID NO: 1831056 - RNA, 21 nt, Salmonella typhimurium LT2
gacgaaucagcgauugcgcca

SEQ ID NO: 1831057 - RNA, 14 nt, Salmonella typhimurium LT2
aacggccagcgcag

SEQ ID NO: 1831058 - RNA, 12 nt, Salmonella typhimurium LT2
gacgcagcagcu

SEQ ID NO: 1831059 - RNA, 15 nt, Salmonella typhimurium LT2
gacgccaaccgccau

SEQ ID NO: 1831060 - RNA, 12 nt, Salmonella typhimurium LT2
gacgccaggcag

SEQ ID NO: 1831061 - RNA, 12 nt, Salmonella typhimurium LT2
gacgccagccga

SEQ ID NO: 1831062 - RNA, 18 nt, Salmonella typhimurium LT2
gacgccauuccccagcua

SEQ ID NO: 1831063 - RNA, 20 nt, Salmonella typhimurium LT2
gacgauuugcgcucgcgcca

SEQ ID NO: 1831064 - RNA, 15 nt, Salmonella typhimurium LT2
gacgcacaaucgccg

SEQ ID NO: 1831065 - RNA, 14 nt, Salmonella typhimurium LT2
gacgcaacucacgc

SEQ ID NO: 1831066 - RNA, 16 nt, Salmonella typhimurium LT2
gacgcccucaauaucu

SEQ ID NO: 1831067 - RNA, 16 nt, Salmonella typhimurium LT2
gacgccgccauccggu

SEQ ID NO: 1831068 - RNA, 21 nt, Salmonella typhimurium LT2
gacgccggguaaacgcagcgu

SEQ ID NO: 1831069 - RNA, 15 nt, Salmonella typhimurium LT2
gacgccggucaugcc

SEQ ID NO: 1831070 - RNA, 18 nt, Salmonella typhimurium LT2
gacgccuguaaugccgcc

SEQ ID NO: 1831071 - RNA, 21 nt, Salmonella typhimurium LT2
gacgccguucaaagccgccau

SEQ ID NO: 1831072 - RNA, 12 nt, Salmonella typhimurium LT2
gacgggcuggcg

SEQ ID NO: 1831073 - RNA, 15 nt, Salmonella typhimurium LT2
aacguccagcggcca

SEQ ID NO: 1831074 - RNA, 23 nt, Salmonella typhimurium LT2
aacgucauugcgaucuccuuuaa

SEQ ID NO: 1831075 - RNA, 20 nt, Salmonella typhimurium LT2
gacggccugucuccgcagca

SEQ ID NO: 1831076 - RNA, 23 nt, Salmonella typhimurium LT2
aacgucuuuuuccagcagcucca

SEQ ID NO: 1831077 - RNA, 22 nt, Salmonella typhimurium LT2
aacgugcgguauaucacgccau

SEQ ID NO: 1831078 - RNA, 15 nt, Salmonella typhimurium LT2
gacggcggccagcau

SEQ ID NO: 1831079 - RNA, 18 nt, Salmonella typhimurium LT2
gacggcuaaguuaaccgg

SEQ ID NO: 1831080 - RNA, 21 nt, Salmonella typhimurium LT2
gacggcugaccugaacgccua

SEQ ID NO: 1831081 - RNA, 24 nt, Salmonella typhimurium LT2
gacggcgucaccaccgcaggcagc

SEQ ID NO: 1831082 - RNA, 20 nt, Salmonella typhimurium LT2
gacgcugcgcuuauccggcc

SEQ ID NO: 1831083 - RNA, 22 nt, Salmonella typhimurium LT2
gacgcugccacaauggcaggca

SEQ ID NO: 1831084 - RNA, 20 nt, Salmonella typhimurium LT2
gacgcuuaccgggccugcgu

SEQ ID NO: 1831085 - RNA, 18 nt, Salmonella typhimurium LT2
gacgcuucgcuuauccgg

SEQ ID NO: 1831086 - RNA, 19 nt, Salmonella typhimurium LT2
gacgcuugagcgccuuauc

SEQ ID NO: 1831087 - RNA, 14 nt, Salmonella typhimurium LT2
gacgcuuuuauccg

SEQ ID NO: 1831088 - RNA, 15 nt, Salmonella typhimurium LT2
gacgcuuuuauccgg

SEQ ID NO: 1831089 - RNA, 17 nt, Salmonella typhimurium LT2
gacggaaaccagcauaa

SEQ ID NO: 1831090 - RNA, 13 nt, Salmonella typhimurium LT2
gacggcagcgcca

SEQ ID NO: 1831091 - RNA, 19 nt, Salmonella typhimurium LT2
gacgcgcucaccuccgcca

SEQ ID NO: 1831092 - RNA, 18 nt, Salmonella typhimurium LT2
gacgcgcgauaucagcga

SEQ ID NO: 1831093 - RNA, 14 nt, Salmonella typhimurium LT2
gacgcgcacccggc

SEQ ID NO: 1831094 - RNA, 14 nt, Salmonella typhimurium LT2
gacgcggcuccggc

SEQ ID NO: 1831095 - RNA, 21 nt, Salmonella typhimurium LT2
gacgcuacgcgucgccauccg

SEQ ID NO: 1831096 - RNA, 14 nt, Salmonella typhimurium LT2
gacgcuaucguccu

SEQ ID NO: 1831097 - RNA, 19 nt, Salmonella typhimurium LT2
gacgcuauucaugccgacc

SEQ ID NO: 1831098 - RNA, 13 nt, Salmonella typhimurium LT2
gacgcuaacgcgc

SEQ ID NO: 1831099 - RNA, 13 nt, Salmonella typhimurium LT2
cuuccgccaccac

SEQ ID NO: 1831100 - RNA, 17 nt, Salmonella typhimurium LT2
cuuccgccagcgcguuc

SEQ ID NO: 1831101 - RNA, 14 nt, Salmonella typhimurium LT2
cuuccggcaucaca

SEQ ID NO: 1831102 - RNA, 18 nt, Salmonella typhimurium LT2
cuuccgggauagcacuac

SEQ ID NO: 1831103 - RNA, 17 nt, Salmonella typhimurium LT2
cuucgacaaacagcugu

SEQ ID NO: 1831104 - RNA, 14 nt, Salmonella typhimurium LT2
cuucgaaacgaucg

SEQ ID NO: 1831105 - RNA, 15 nt, Salmonella typhimurium LT2
cuucgcuguccauuu

SEQ ID NO: 1831106 - RNA, 14 nt, Salmonella typhimurium LT2
cuucgcuuccugga

SEQ ID NO: 1831107 - RNA, 23 nt, Salmonella typhimurium LT2
cuucgccaaucgccgccgccagg

SEQ ID NO: 1831108 - RNA, 15 nt, Salmonella typhimurium LT2
cuucgccaaucgccg

SEQ ID NO: 1831109 - RNA, 16 nt, Salmonella typhimurium LT2
cuucgcccaucgccgc

SEQ ID NO: 1831110 - RNA, 15 nt, Salmonella typhimurium LT2
cuucgccauccggua

SEQ ID NO: 1831111 - RNA, 19 nt, Salmonella typhimurium LT2
cuuccagaauggaacaaua

SEQ ID NO: 1831112 - RNA, 16 nt, Salmonella typhimurium LT2
cuuccacugcggcauu

SEQ ID NO: 1831113 - RNA, 19 nt, Salmonella typhimurium LT2
cuuccacugcggcauuacg

SEQ ID NO: 1831114 - RNA, 18 nt, Salmonella typhimurium LT2
cuucaugguacagaucca

SEQ ID NO: 1831115 - RNA, 12 nt, Salmonella typhimurium LT2
cuucaucgccac

SEQ ID NO: 1831116 - RNA, 16 nt, Salmonella typhimurium LT2
cuucaucccauccggg

SEQ ID NO: 1831117 - RNA, 22 nt, Salmonella typhimurium LT2
cuuaugaaaccccaaaucagca

SEQ ID NO: 1831118 - RNA, 20 nt, Salmonella typhimurium LT2
cuuauggauaagcgucgcca

SEQ ID NO: 1831119 - RNA, 21 nt, Salmonella typhimurium LT2
cuuauucgcucugagucgcca

SEQ ID NO: 1831120 - RNA, 15 nt, Salmonella typhimurium LT2
cuucagccagacgcu

SEQ ID NO: 1831121 - RNA, 21 nt, Salmonella typhimurium LT2
cuucagccggauauucgguga

SEQ ID NO: 1831122 - RNA, 18 nt, Salmonella typhimurium LT2
cuggucaucgaaccgggu

SEQ ID NO: 1831123 - RNA, 18 nt, Salmonella typhimurium LT2
cugucaaaacccagccca

SEQ ID NO: 1831124 - RNA, 16 nt, Salmonella typhimurium LT2
cuguaugugcucgucg

SEQ ID NO: 1831125 - RNA, 22 nt, Salmonella typhimurium LT2
cuguagcgcuuuuuccagcgca

SEQ ID NO: 1831126 - RNA, 16 nt, Salmonella typhimurium LT2
cugucggcgagguacu

SEQ ID NO: 1831127 - RNA, 16 nt, Salmonella typhimurium LT2
cugucaucaaugagcg

SEQ ID NO: 1831128 - RNA, 18 nt, Salmonella typhimurium LT2
cugucacguuuuaucgag

SEQ ID NO: 1831129 - RNA, 20 nt, Salmonella typhimurium LT2
cugucgccgguuagcgccgc

SEQ ID NO: 1831130 - RNA, 23 nt, Salmonella typhimurium LT2
cugugaggcgucuuccagcauuc

SEQ ID NO: 1831131 - RNA, 12 nt, Salmonella typhimurium LT2
cugugccgcugg

SEQ ID NO: 1831132 - RNA, 14 nt, Salmonella typhimurium LT2
cugugcgccgcugg

SEQ ID NO: 1831133 - RNA, 13 nt, Salmonella typhimurium LT2
cuguuugcagugg

SEQ ID NO: 1831134 - RNA, 15 nt, Salmonella typhimurium LT2
cuguuucgccaggcc

SEQ ID NO: 1831135 - RNA, 16 nt, Salmonella typhimurium LT2
cuguuuccaguuaccg

SEQ ID NO: 1831136 - RNA, 23 nt, Salmonella typhimurium LT2
cuguuucaacacauccagcguca

SEQ ID NO: 1831137 - RNA, 15 nt, Salmonella typhimurium LT2
cuguuuaauccggua

SEQ ID NO: 1831138 - RNA, 19 nt, Salmonella typhimurium LT2
cuguucaacaugcugaccg

SEQ ID NO: 1831139 - RNA, 15 nt, Salmonella typhimurium LT2
cuguucaaaagccug

SEQ ID NO: 1831140 - RNA, 15 nt, Salmonella typhimurium LT2
cuguuaucacgguau

SEQ ID NO: 1831141 - RNA, 15 nt, Salmonella typhimurium LT2
cuguuaaaaccggcu

SEQ ID NO: 1831142 - RNA, 22 nt, Salmonella typhimurium LT2
cuguggaaacuccagcggcagg

SEQ ID NO: 1831143 - RNA, 19 nt, Salmonella typhimurium LT2
cuuaucuuucagcgccgga

SEQ ID NO: 1831144 - RNA, 12 nt, Salmonella typhimurium LT2
cuuaucgccgua

SEQ ID NO: 1831145 - RNA, 15 nt, Salmonella typhimurium LT2
cuuaacguuaccuuu

SEQ ID NO: 1831146 - RNA, 22 nt, Salmonella typhimurium LT2
cuuaauaccauagcggcucagg

SEQ ID NO: 1831147 - RNA, 15 nt, Salmonella typhimurium LT2
cuuaaacgccggauu

SEQ ID NO: 1831148 - RNA, 13 nt, Salmonella typhimurium LT2
cuuaaaggcggca

SEQ ID NO: 1831149 - RNA, 20 nt, Salmonella typhimurium LT2
cuggcggucgggaacgcugu

SEQ ID NO: 1831150 - RNA, 14 nt, Salmonella typhimurium LT2
cuggcggcucaggg

SEQ ID NO: 1831151 - RNA, 22 nt, Salmonella typhimurium LT2
cuggcuaucccgaugcucaggg

SEQ ID NO: 1831152 - RNA, 12 nt, Salmonella typhimurium LT2
cuggcucaggcg

SEQ ID NO: 1831153 - RNA, 17 nt, Salmonella typhimurium LT2
cuggcucccgcagccac

SEQ ID NO: 1831154 - RNA, 15 nt, Salmonella typhimurium LT2
cuggucagcgcgcca

SEQ ID NO: 1831155 - RNA, 19 nt, Salmonella typhimurium LT2
cugggugugaucgccgcga

SEQ ID NO: 1831156 - RNA, 20 nt, Salmonella typhimurium LT2
cuggcugccgccauuugcgc

SEQ ID NO: 1831157 - RNA, 20 nt, Salmonella typhimurium LT2
cuggcuucuuaaaauagcca

SEQ ID NO: 1831158 - RNA, 24 nt, Salmonella typhimurium LT2
cuggcaacauagcaucguuaccgc

SEQ ID NO: 1831159 - RNA, 13 nt, Salmonella typhimurium LT2
cuggcaagcgcca

SEQ ID NO: 1831160 - RNA, 20 nt, Salmonella typhimurium LT2
cuggcaauaaagcagggcgg

SEQ ID NO: 1831161 - RNA, 17 nt, Salmonella typhimurium LT2
cuggaggaacagcgccg

SEQ ID NO: 1831162 - RNA, 18 nt, Salmonella typhimurium LT2
cuggagcguaagcgcggu

SEQ ID NO: 1831163 - RNA, 17 nt, Salmonella typhimurium LT2
cuggauacguuccagca

SEQ ID NO: 1831164 - RNA, 15 nt, Salmonella typhimurium LT2
cugcccuguuccagg

SEQ ID NO: 1831165 - RNA, 13 nt, Salmonella typhimurium LT2
cuggccacgccga

SEQ ID NO: 1831166 - RNA, 20 nt, Salmonella typhimurium LT2
cuggccacuggauuaucgaa

SEQ ID NO: 1831167 - RNA, 21 nt, Salmonella typhimurium LT2
cuggcgaaagcgaccggcacu

SEQ ID NO: 1831168 - RNA, 22 nt, Salmonella typhimurium LT2
cuggcgaauaaaauucagcgca

SEQ ID NO: 1831169 - RNA, 16 nt, Salmonella typhimurium LT2
cuggccugauaagcgc

SEQ ID NO: 1831170 - RNA, 20 nt, Salmonella typhimurium LT2
cuggccguuuucccggcaau

SEQ ID NO: 1831171 - RNA, 22 nt, Salmonella typhimurium LT2
cuggcgccuuuuggcagcagcg

SEQ ID NO: 1831172 - RNA, 21 nt, Salmonella typhimurium LT2
cuggcgcaacguuugccagcg

SEQ ID NO: 1831173 - RNA, 12 nt, Salmonella typhimurium LT2
cuuuagggcgcu

SEQ ID NO: 1831174 - RNA, 14 nt, Salmonella typhimurium LT2
cuuuacaccccacu

SEQ ID NO: 1831175 - RNA, 19 nt, Salmonella typhimurium LT2
cuuuacccuuacggccacu

SEQ ID NO: 1831176 - RNA, 15 nt, Salmonella typhimurium LT2
cuuuaagugcaucgc

SEQ ID NO: 1831177 - RNA, 14 nt, Salmonella typhimurium LT2
cuuuaaauucagca

SEQ ID NO: 1831178 - RNA, 16 nt, Salmonella typhimurium LT2
aaccguucuuccuggg

SEQ ID NO: 1831179 - RNA, 20 nt, Salmonella typhimurium LT2
aaccguucaucuaucgccag

SEQ ID NO: 1831180 - RNA, 16 nt, Salmonella typhimurium LT2
aaccguugcgcccauc

SEQ ID NO: 1831181 - RNA, 22 nt, Salmonella typhimurium LT2
cuuucaauacuccacaguucaa

SEQ ID NO: 1831182 - RNA, 15 nt, Salmonella typhimurium LT2
cuuucacagcuccug

SEQ ID NO: 1831183 - RNA, 22 nt, Salmonella typhimurium LT2
cuuuauuaaaaagcagccagac

SEQ ID NO: 1831184 - RNA, 21 nt, Salmonella typhimurium LT2
cuucgguuucguuaaucggca

SEQ ID NO: 1831185 - RNA, 17 nt, Salmonella typhimurium LT2
cuucguagacucaggcg

SEQ ID NO: 1831186 - RNA, 17 nt, Salmonella typhimurium LT2
cuucguuagcggcguug

SEQ ID NO: 1831187 - RNA, 13 nt, Salmonella typhimurium LT2
cuucgugaaaacc

SEQ ID NO: 1831188 - RNA, 22 nt, Salmonella typhimurium LT2
cuuucgccgcuuuaaucaccau

SEQ ID NO: 1831189 - RNA, 14 nt, Salmonella typhimurium LT2
cuuucugguaaccg

SEQ ID NO: 1831190 - RNA, 17 nt, Salmonella typhimurium LT2
cuuucucuaugguggcu

SEQ ID NO: 1831191 - RNA, 13 nt, Salmonella typhimurium LT2
cuuuccugacaaa

SEQ ID NO: 1831192 - RNA, 15 nt, Salmonella typhimurium LT2
cuuuccguacgguuu

SEQ ID NO: 1831193 - RNA, 17 nt, Salmonella typhimurium LT2
cuuuccagcucaaccgc

SEQ ID NO: 1831194 - RNA, 13 nt, Salmonella typhimurium LT2
cuuucccggcaug

SEQ ID NO: 1831195 - RNA, 16 nt, Salmonella typhimurium LT2
cuuugcgaacagcgca

SEQ ID NO: 1831196 - RNA, 16 nt, Salmonella typhimurium LT2
cuuugaacagccagaa

SEQ ID NO: 1831197 - RNA, 17 nt, Salmonella typhimurium LT2
cuuugaccagcaucgcc

SEQ ID NO: 1831198 - RNA, 18 nt, Salmonella typhimurium LT2
cuuugaaaaucacaucgc

SEQ ID NO: 1831199 - RNA, 15 nt, Salmonella typhimurium LT2
cuuugagcagcgcca

SEQ ID NO: 1831200 - RNA, 18 nt, Salmonella typhimurium LT2
cuuugcauuacggcgaau

SEQ ID NO: 1831201 - RNA, 21 nt, Salmonella typhimurium LT2
cuuugcccucaaagacccgga

SEQ ID NO: 1831202 - RNA, 16 nt, Salmonella typhimurium LT2
cuuuuuaggcuauaaa

SEQ ID NO: 1831203 - RNA, 18 nt, Salmonella typhimurium LT2
cuuuuggcggccagcgug

SEQ ID NO: 1831204 - RNA, 23 nt, Salmonella typhimurium LT2
cuuuuggggccgauaccggcaac

SEQ ID NO: 1831205 - RNA, 12 nt, Salmonella typhimurium LT2
cuuuuaaacggc

SEQ ID NO: 1831206 - RNA, 14 nt, Salmonella typhimurium LT2
cuuuuaccggcgaa

SEQ ID NO: 1831207 - RNA, 19 nt, Salmonella typhimurium LT2
cuuuuaaaauaaaucggca

SEQ ID NO: 1831208 - RNA, 14 nt, Salmonella typhimurium LT2
cuuuuccagcgccu

SEQ ID NO: 1831209 - RNA, 19 nt, Salmonella typhimurium LT2
cuuuucauccacagcgcca

SEQ ID NO: 1831210 - RNA, 23 nt, Salmonella typhimurium LT2
gaaaacgcuuuccaguugcggca

SEQ ID NO: 1831211 - RNA, 23 nt, Salmonella typhimurium LT2
gaaaaauaguggcuggcguccgc

SEQ ID NO: 1831212 - RNA, 17 nt, Salmonella typhimurium LT2
gaaaaaucuggcguuuc

SEQ ID NO: 1831213 - RNA, 21 nt, Salmonella typhimurium LT2
gaaaaccauaauaaugccaaa

SEQ ID NO: 1831214 - RNA, 21 nt, Salmonella typhimurium LT2
gaaaaaagcgcccagcgccgg

SEQ ID NO: 1831215 - RNA, 15 nt, Salmonella typhimurium LT2
cuuuuuuugugcgcu

SEQ ID NO: 1831216 - RNA, 18 nt, Salmonella typhimurium LT2
cuuuuugcgccgcgaaca

SEQ ID NO: 1831217 - RNA, 22 nt, Salmonella typhimurium LT2
cuuuuucccggugcgugcgccg

SEQ ID NO: 1831218 - RNA, 13 nt, Salmonella typhimurium LT2
cuuuuuucaccag

SEQ ID NO: 1831219 - RNA, 14 nt, Salmonella typhimurium LT2
gaacgccuuauccg

SEQ ID NO: 1831220 - RNA, 21 nt, Salmonella typhimurium LT2
gaacgucuuuuuccagcagcu

SEQ ID NO: 1831221 - RNA, 12 nt, Salmonella typhimurium LT2
gaacuccagcag

SEQ ID NO: 1831222 - RNA, 23 nt, Salmonella typhimurium LT2
gaacucgaagcggucagugauuu

SEQ ID NO: 1831223 - RNA, 13 nt, Salmonella typhimurium LT2
gaacccacuauac

SEQ ID NO: 1831224 - RNA, 13 nt, Salmonella typhimurium LT2
gaaccgacggugc

SEQ ID NO: 1831225 - RNA, 14 nt, Salmonella typhimurium LT2
gaaccggcaucggc

SEQ ID NO: 1831226 - RNA, 15 nt, Salmonella typhimurium LT2
aaccuaacgccugca

SEQ ID NO: 1831227 - RNA, 19 nt, Salmonella typhimurium LT2
aaccugcgccgguuccggc

SEQ ID NO: 1831228 - RNA, 13 nt, Salmonella typhimurium LT2
aaccugcgcugac

SEQ ID NO: 1831229 - RNA, 21 nt, Salmonella typhimurium LT2
aaccugcucggcuaucgccac

SEQ ID NO: 1831230 - RNA, 14 nt, Salmonella typhimurium LT2
aaccugagcgcgaa

SEQ ID NO: 1831231 - RNA, 18 nt, Salmonella typhimurium LT2
gaaaaggaauaccugcgc

SEQ ID NO: 1831232 - RNA, 23 nt, Salmonella typhimurium LT2
gaaaauacugauuaauugcgaca

SEQ ID NO: 1831233 - RNA, 14 nt, Salmonella typhimurium LT2
gaaaagccggaaua

SEQ ID NO: 1831234 - RNA, 13 nt, Salmonella typhimurium LT2
aaccuuccggcac

SEQ ID NO: 1831235 - RNA, 15 nt, Salmonella typhimurium LT2
gaaaauauacaccug

SEQ ID NO: 1831236 - RNA, 17 nt, Salmonella typhimurium LT2
aaccuuugucgcguacu

SEQ ID NO: 1831237 - RNA, 22 nt, Salmonella typhimurium LT2
aaccuuugucgcguacuuucgc

SEQ ID NO: 1831238 - RNA, 19 nt, Salmonella typhimurium LT2
gaaaaugacuucaucgcca

SEQ ID NO: 1831239 - RNA, 20 nt, Salmonella typhimurium LT2
gaaaaucagcgacuggucau

SEQ ID NO: 1831240 - RNA, 16 nt, Salmonella typhimurium LT2
gaaacaggcugacaaa

SEQ ID NO: 1831241 - RNA, 14 nt, Salmonella typhimurium LT2
gaaacagccaauca

SEQ ID NO: 1831242 - RNA, 15 nt, Salmonella typhimurium LT2
gaaaauuccuggauu

SEQ ID NO: 1831243 - RNA, 15 nt, Salmonella typhimurium LT2
gaaacgggaaagccc

SEQ ID NO: 1831244 - RNA, 14 nt, Salmonella typhimurium LT2
gaaacccgccaccg

SEQ ID NO: 1831245 - RNA, 22 nt, Salmonella typhimurium LT2
gaaacgcggcccugaaaccgcc

SEQ ID NO: 1831246 - RNA, 18 nt, Salmonella typhimurium LT2
gaaauaaaucgauagcga

SEQ ID NO: 1831247 - RNA, 15 nt, Salmonella typhimurium LT2
gaaaucaagcgguuu

SEQ ID NO: 1831248 - RNA, 12 nt, Salmonella typhimurium LT2
gaaaucaacgug

SEQ ID NO: 1831249 - RNA, 15 nt, Salmonella typhimurium LT2
gaaauagacgagcga

SEQ ID NO: 1831250 - RNA, 23 nt, Salmonella typhimurium LT2
gaacaauaccguuagcgucaauc

SEQ ID NO: 1831251 - RNA, 17 nt, Salmonella typhimurium LT2
gaacaauaugcgcauca

SEQ ID NO: 1831252 - RNA, 17 nt, Salmonella typhimurium LT2
gcgcggggaacacgcga

SEQ ID NO: 1831253 - RNA, 22 nt, Salmonella typhimurium LT2
gcgcgucagcguguaaucgccg

SEQ ID NO: 1831254 - RNA, 15 nt, Salmonella typhimurium LT2
gcgcggcugcggauu

SEQ ID NO: 1831255 - RNA, 16 nt, Salmonella typhimurium LT2
gcgcggcgaaggucgc

SEQ ID NO: 1831256 - RNA, 15 nt, Salmonella typhimurium LT2
gcgcguucgccguca

SEQ ID NO: 1831257 - RNA, 19 nt, Salmonella typhimurium LT2
gcgcguucgccgucacgcc

SEQ ID NO: 1831258 - RNA, 12 nt, Salmonella typhimurium LT2
gcgcguucgcca

SEQ ID NO: 1831259 - RNA, 16 nt, Salmonella typhimurium LT2
gcgcguccagcggcaa

SEQ ID NO: 1831260 - RNA, 21 nt, Salmonella typhimurium LT2
gcgcguccucacacugauggc

SEQ ID NO: 1831261 - RNA, 13 nt, Salmonella typhimurium LT2
gcgcguccagacg

SEQ ID NO: 1831262 - RNA, 18 nt, Salmonella typhimurium LT2
gcgcucaugccacgccau

SEQ ID NO: 1831263 - RNA, 22 nt, Salmonella typhimurium LT2
gcgcuccagaccaccagcgaca

SEQ ID NO: 1831264 - RNA, 12 nt, Salmonella typhimurium LT2
gcgcucagcguc

SEQ ID NO: 1831265 - RNA, 12 nt, Salmonella typhimurium LT2
gcgcucaucaga

SEQ ID NO: 1831266 - RNA, 15 nt, Salmonella typhimurium LT2
gcgcuccgcacgccg

SEQ ID NO: 1831267 - RNA, 23 nt, Salmonella typhimurium LT2
gcgcuccaggaugugaggcagau

SEQ ID NO: 1831268 - RNA, 13 nt, Salmonella typhimurium LT2
gcgcuauccggcc

SEQ ID NO: 1831269 - RNA, 22 nt, Salmonella typhimurium LT2
gcgcucaacacauaacgcccga

SEQ ID NO: 1831270 - RNA, 21 nt, Salmonella typhimurium LT2
gcgcucacgcuuauccggccu

SEQ ID NO: 1831271 - RNA, 17 nt, Salmonella typhimurium LT2
gcgcucacuaccgcgau

SEQ ID NO: 1831272 - RNA, 19 nt, Salmonella typhimurium LT2
gcgcuaaacagcgccgcga

SEQ ID NO: 1831273 - RNA, 14 nt, Salmonella typhimurium LT2
gcgcuaaaccggcg

SEQ ID NO: 1831274 - RNA, 21 nt, Salmonella typhimurium LT2
gcgcguuucugcgccucagcc

SEQ ID NO: 1831275 - RNA, 22 nt, Salmonella typhimurium LT2
gcgcuaacgucgccaucaggcg

SEQ ID NO: 1831276 - RNA, 18 nt, Salmonella typhimurium LT2
gcgcuaaugcuuauccgg

SEQ ID NO: 1831277 - RNA, 15 nt, Salmonella typhimurium LT2
gcgcuagugccgcca

SEQ ID NO: 1831278 - RNA, 17 nt, Salmonella typhimurium LT2
gcgcuacguuuaucugg

SEQ ID NO: 1831279 - RNA, 20 nt, Salmonella typhimurium LT2
gcgcuacgcuuaucaggccu

SEQ ID NO: 1831280 - RNA, 19 nt, Salmonella typhimurium LT2
gcgcuacgcuuauccggcu

SEQ ID NO: 1831281 - RNA, 16 nt, Salmonella typhimurium LT2
gcgcuacgcuuaucgg

SEQ ID NO: 1831282 - RNA, 14 nt, Salmonella typhimurium LT2
gcgcgcgcguuaac

SEQ ID NO: 1831283 - RNA, 21 nt, Salmonella typhimurium LT2
gcgcgcguacccugcgugaac

SEQ ID NO: 1831284 - RNA, 17 nt, Salmonella typhimurium LT2
gcgcgccuuccagcaau

SEQ ID NO: 1831285 - RNA, 15 nt, Salmonella typhimurium LT2
gcgcgccuugcgcag

SEQ ID NO: 1831286 - RNA, 23 nt, Salmonella typhimurium LT2
gcgcgccugcuccaccagcgcau

SEQ ID NO: 1831287 - RNA, 13 nt, Salmonella typhimurium LT2
gcgcgccugacgc

SEQ ID NO: 1831288 - RNA, 23 nt, Salmonella typhimurium LT2
gcgcggcaauuucacugucgcca

SEQ ID NO: 1831289 - RNA, 17 nt, Salmonella typhimurium LT2
gcgcggcacacagcacu

SEQ ID NO: 1831290 - RNA, 24 nt, Salmonella typhimurium LT2
gcgcgcuuucaccgccucaucggc

SEQ ID NO: 1831291 - RNA, 22 nt, Salmonella typhimurium LT2
gcgcgcuuuucgccagcgcauc

SEQ ID NO: 1831292 - RNA, 12 nt, Salmonella typhimurium LT2
gcgcgccagcgg

SEQ ID NO: 1831293 - RNA, 14 nt, Salmonella typhimurium LT2
gcgcgccagcgcca

SEQ ID NO: 1831294 - RNA, 12 nt, Salmonella typhimurium LT2
gcgcgccaccau

SEQ ID NO: 1831295 - RNA, 24 nt, Salmonella typhimurium LT2
gcgcgccgccucgcgauccgccag

SEQ ID NO: 1831296 - RNA, 22 nt, Salmonella typhimurium LT2
gcgcgccgcuggcgaccagccu

SEQ ID NO: 1831297 - RNA, 15 nt, Salmonella typhimurium LT2
gcgcgcccgcuuccg

SEQ ID NO: 1831298 - RNA, 12 nt, Salmonella typhimurium LT2
gcgcgcccugcg

SEQ ID NO: 1831299 - RNA, 19 nt, Salmonella typhimurium LT2
gcgcgccgcacaucggcag

SEQ ID NO: 1831300 - RNA, 21 nt, Salmonella typhimurium LT2
gcgcgaaucgacaauccgcca

SEQ ID NO: 1831301 - RNA, 15 nt, Salmonella typhimurium LT2
gcgcgacaacaucgc

SEQ ID NO: 1831302 - RNA, 16 nt, Salmonella typhimurium LT2
gcgcgaucaucgcauu

SEQ ID NO: 1831303 - RNA, 15 nt, Salmonella typhimurium LT2
gcgccauuuccagcc

SEQ ID NO: 1831304 - RNA, 17 nt, Salmonella typhimurium LT2
gcgccauuugccagaua

SEQ ID NO: 1831305 - RNA, 14 nt, Salmonella typhimurium LT2
gcgcccaaugccga

SEQ ID NO: 1831306 - RNA, 15 nt, Salmonella typhimurium LT2
gcgccaucgggcauu

SEQ ID NO: 1831307 - RNA, 15 nt, Salmonella typhimurium LT2
gcgccauccggcaca

SEQ ID NO: 1831308 - RNA, 16 nt, Salmonella typhimurium LT2
gcgccauccggcauca

SEQ ID NO: 1831309 - RNA, 13 nt, Salmonella typhimurium LT2
gcgccauccggcu

SEQ ID NO: 1831310 - RNA, 21 nt, Salmonella typhimurium LT2
gcgccaucaggcacaaugcga

SEQ ID NO: 1831311 - RNA, 14 nt, Salmonella typhimurium LT2
gcgccaucagcauc

SEQ ID NO: 1831312 - RNA, 18 nt, Salmonella typhimurium LT2
gcgccauccaccaggcau

SEQ ID NO: 1831313 - RNA, 13 nt, Salmonella typhimurium LT2
gcgccaucaggcu

SEQ ID NO: 1831314 - RNA, 17 nt, Salmonella typhimurium LT2
gcgccaucaggccuacg

SEQ ID NO: 1831315 - RNA, 16 nt, Salmonella typhimurium LT2
gcgccagucaucgccg

SEQ ID NO: 1831316 - RNA, 15 nt, Salmonella typhimurium LT2
gcgccacuuuuccgg

SEQ ID NO: 1831317 - RNA, 20 nt, Salmonella typhimurium LT2
gcgccaguucauccagcagc

SEQ ID NO: 1831318 - RNA, 18 nt, Salmonella typhimurium LT2
gcgccauaauccauuacg

SEQ ID NO: 1831319 - RNA, 13 nt, Salmonella typhimurium LT2
gcgccgcagcgcc

SEQ ID NO: 1831320 - RNA, 19 nt, Salmonella typhimurium LT2
gcgccgagguuuucaucca

SEQ ID NO: 1831321 - RNA, 15 nt, Salmonella typhimurium LT2
gcgcccggcgcaucg

SEQ ID NO: 1831322 - RNA, 14 nt, Salmonella typhimurium LT2
gcgcccgccaccag

SEQ ID NO: 1831323 - RNA, 13 nt, Salmonella typhimurium LT2
gcgccgucauccg

SEQ ID NO: 1831324 - RNA, 21 nt, Salmonella typhimurium LT2
gcgccgucacucccugcguca

SEQ ID NO: 1831325 - RNA, 16 nt, Salmonella typhimurium LT2
gcgccgguuccggcau

SEQ ID NO: 1831326 - RNA, 17 nt, Salmonella typhimurium LT2
gcgccggacuccagcaa

SEQ ID NO: 1831327 - RNA, 14 nt, Salmonella typhimurium LT2
gcgccgccauccgg

SEQ ID NO: 1831328 - RNA, 16 nt, Salmonella typhimurium LT2
gcgccacuuccagcgc

SEQ ID NO: 1831329 - RNA, 15 nt, Salmonella typhimurium LT2
gcgccaccaucgucg

SEQ ID NO: 1831330 - RNA, 19 nt, Salmonella typhimurium LT2
gcgccaccaucgucgccag

SEQ ID NO: 1831331 - RNA, 20 nt, Salmonella typhimurium LT2
gcgcauugcgucccagcaca

SEQ ID NO: 1831332 - RNA, 21 nt, Salmonella typhimurium LT2
gcgcauugcgucccagcacaa

SEQ ID NO: 1831333 - RNA, 21 nt, Salmonella typhimurium LT2
gcgcaguuuacgcagcgccuu

SEQ ID NO: 1831334 - RNA, 19 nt, Salmonella typhimurium LT2
gcgcagcgccaucaggcau

SEQ ID NO: 1831335 - RNA, 20 nt, Salmonella typhimurium LT2
gcgcagcgccaucaggcaug

SEQ ID NO: 1831336 - RNA, 18 nt, Salmonella typhimurium LT2
gcgcagcgccaucaggcc

SEQ ID NO: 1831337 - RNA, 19 nt, Salmonella typhimurium LT2
gcgcagcgccaucaggccu

SEQ ID NO: 1831338 - RNA, 18 nt, Salmonella typhimurium LT2
gcgcagcgccaucaggca

SEQ ID NO: 1831339 - RNA, 14 nt, Salmonella typhimurium LT2
gcgcagcaguugca

SEQ ID NO: 1831340 - RNA, 21 nt, Salmonella typhimurium LT2
gcgcagauauuuuccaucacg

SEQ ID NO: 1831341 - RNA, 14 nt, Salmonella typhimurium LT2
gcgcaauuccagca

SEQ ID NO: 1831342 - RNA, 13 nt, Salmonella typhimurium LT2
gcgcaaugcugac

SEQ ID NO: 1831343 - RNA, 17 nt, Salmonella typhimurium LT2
gcgauacugacgagcga

SEQ ID NO: 1831344 - RNA, 17 nt, Salmonella typhimurium LT2
gcgauagagcgcgguca

SEQ ID NO: 1831345 - RNA, 13 nt, Salmonella typhimurium LT2
gcgcacggucgcu

SEQ ID NO: 1831346 - RNA, 14 nt, Salmonella typhimurium LT2
gccguuuuccagcc

SEQ ID NO: 1831347 - RNA, 20 nt, Salmonella typhimurium LT2
gccguuuuccggucgcgcaa

SEQ ID NO: 1831348 - RNA, 17 nt, Salmonella typhimurium LT2
gccguuuuggcagcgcc

SEQ ID NO: 1831349 - RNA, 19 nt, Salmonella typhimurium LT2
gccguuuuuaacaccggca

SEQ ID NO: 1831350 - RNA, 19 nt, Salmonella typhimurium LT2
gccguuuuaacgucaucac

SEQ ID NO: 1831351 - RNA, 22 nt, Salmonella typhimurium LT2
gccguuuuaacgucaucaccag

SEQ ID NO: 1831352 - RNA, 16 nt, Salmonella typhimurium LT2
gccguuucaacccccu

SEQ ID NO: 1831353 - RNA, 12 nt, Salmonella typhimurium LT2
gccguuccgcua

SEQ ID NO: 1831354 - RNA, 14 nt, Salmonella typhimurium LT2
gccguuaucuacgg

SEQ ID NO: 1831355 - RNA, 23 nt, Salmonella typhimurium LT2
gccguuaaucgauaagccagcga

SEQ ID NO: 1831356 - RNA, 22 nt, Salmonella typhimurium LT2
gccgucggcgauauuuccacgg

SEQ ID NO: 1831357 - RNA, 18 nt, Salmonella typhimurium LT2
gccgucggcgccagccac

SEQ ID NO: 1831358 - RNA, 18 nt, Salmonella typhimurium LT2
gccugaauaaucggcguc

SEQ ID NO: 1831359 - RNA, 21 nt, Salmonella typhimurium LT2
gccugaagccagcaaucagcc

SEQ ID NO: 1831360 - RNA, 17 nt, Salmonella typhimurium LT2
gccugaaaauagcgcca

SEQ ID NO: 1831361 - RNA, 16 nt, Salmonella typhimurium LT2
gccugaaagauuauuu

SEQ ID NO: 1831362 - RNA, 20 nt, Salmonella typhimurium LT2
gccugauaagcgcagcgcca

SEQ ID NO: 1831363 - RNA, 19 nt, Salmonella typhimurium LT2
gccugauaagcacaggcca

SEQ ID NO: 1831364 - RNA, 23 nt, Salmonella typhimurium LT2
gccugaugcacauuguccggcag

SEQ ID NO: 1831365 - RNA, 19 nt, Salmonella typhimurium LT2
gccucagccaaccuacgcg

SEQ ID NO: 1831366 - RNA, 14 nt, Salmonella typhimurium LT2
gccuaucaccgcga

SEQ ID NO: 1831367 - RNA, 13 nt, Salmonella typhimurium LT2
gccuaucaggccu

SEQ ID NO: 1831368 - RNA, 18 nt, Salmonella typhimurium LT2
gccuaguucugcgccagu

SEQ ID NO: 1831369 - RNA, 12 nt, Salmonella typhimurium LT2
gccuaucgccau

SEQ ID NO: 1831370 - RNA, 13 nt, Salmonella typhimurium LT2
gccgggcggcugu

SEQ ID NO: 1831371 - RNA, 23 nt, Salmonella typhimurium LT2
gccgggcguuucacauuccggcg

SEQ ID NO: 1831372 - RNA, 14 nt, Salmonella typhimurium LT2
gccgguucgcgacu

SEQ ID NO: 1831373 - RNA, 16 nt, Salmonella typhimurium LT2
gccgguuucauaacac

SEQ ID NO: 1831374 - RNA, 16 nt, Salmonella typhimurium LT2
gccgguuauaccgcca

SEQ ID NO: 1831375 - RNA, 21 nt, Salmonella typhimurium LT2
gccggguaagcgcaagcgcca

SEQ ID NO: 1831376 - RNA, 20 nt, Salmonella typhimurium LT2
gccgguacgcagcaggcaga

SEQ ID NO: 1831377 - RNA, 14 nt, Salmonella typhimurium LT2
gccggucagcguca

SEQ ID NO: 1831378 - RNA, 21 nt, Salmonella typhimurium LT2
gccggucaugccaucccgcga

SEQ ID NO: 1831379 - RNA, 23 nt, Salmonella typhimurium LT2
gcgaaucgccuguaccgggcaga

SEQ ID NO: 1831380 - RNA, 17 nt, Salmonella typhimurium LT2
gcgaauccgacaugacg

SEQ ID NO: 1831381 - RNA, 17 nt, Salmonella typhimurium LT2
gcgacaaccuguaggcc

SEQ ID NO: 1831382 - RNA, 13 nt, Salmonella typhimurium LT2
gcgacaacgccgg

SEQ ID NO: 1831383 - RNA, 14 nt, Salmonella typhimurium LT2
gcgacaacgccgga

SEQ ID NO: 1831384 - RNA, 19 nt, Salmonella typhimurium LT2
gcgaauuucggcaaugacg

SEQ ID NO: 1831385 - RNA, 22 nt, Salmonella typhimurium LT2
gcgaauuuuauuaagcaggccg

SEQ ID NO: 1831386 - RNA, 23 nt, Salmonella typhimurium LT2
gcgacaaaucugccgggagcaga

SEQ ID NO: 1831387 - RNA, 18 nt, Salmonella typhimurium LT2
gcgaauuucaaucgccag

SEQ ID NO: 1831388 - RNA, 19 nt, Salmonella typhimurium LT2
aagcccggccacagcgcca

SEQ ID NO: 1831389 - RNA, 15 nt, Salmonella typhimurium LT2
aagcccggccuuauc

SEQ ID NO: 1831390 - RNA, 20 nt, Salmonella typhimurium LT2
aagccccuggcgcgccagcu

SEQ ID NO: 1831391 - RNA, 18 nt, Salmonella typhimurium LT2
gcgaccaauauccgcagg

SEQ ID NO: 1831392 - RNA, 14 nt, Salmonella typhimurium LT2
gcgacauccgcuuu

SEQ ID NO: 1831393 - RNA, 14 nt, Salmonella typhimurium LT2
gcgagaaucgccag

SEQ ID NO: 1831394 - RNA, 14 nt, Salmonella typhimurium LT2
gcgacuuugcgccg

SEQ ID NO: 1831395 - RNA, 16 nt, Salmonella typhimurium LT2
gcgagaaaaucccauu

SEQ ID NO: 1831396 - RNA, 15 nt, Salmonella typhimurium LT2
gcgaguuaagcgccc

SEQ ID NO: 1831397 - RNA, 20 nt, Salmonella typhimurium LT2
gcgaacguuacccggccagc

SEQ ID NO: 1831398 - RNA, 15 nt, Salmonella typhimurium LT2
gcgaacuugccggaa

SEQ ID NO: 1831399 - RNA, 16 nt, Salmonella typhimurium LT2
gcgaacuugccggaac

SEQ ID NO: 1831400 - RNA, 21 nt, Salmonella typhimurium LT2
gcgaacugguuauacaguuca

SEQ ID NO: 1831401 - RNA, 18 nt, Salmonella typhimurium LT2
gcgaaucacauccgccag

SEQ ID NO: 1831402 - RNA, 14 nt, Salmonella typhimurium LT2
gcgaauagcgccag

SEQ ID NO: 1831403 - RNA, 14 nt, Salmonella typhimurium LT2
gcgaauaaucgccg

SEQ ID NO: 1831404 - RNA, 24 nt, Salmonella typhimurium LT2
gcgaauaaugcauccgccagauga

SEQ ID NO: 1831405 - RNA, 21 nt, Salmonella typhimurium LT2
gcgaaaguaaccaacgucauu

SEQ ID NO: 1831406 - RNA, 12 nt, Salmonella typhimurium LT2
gcgaacagcgcu

SEQ ID NO: 1831407 - RNA, 12 nt, Salmonella typhimurium LT2
gcgaacagcgca

SEQ ID NO: 1831408 - RNA, 20 nt, Salmonella typhimurium LT2
gcgaacgccuuauccggccu

SEQ ID NO: 1831409 - RNA, 13 nt, Salmonella typhimurium LT2
gcgaacgauacca

SEQ ID NO: 1831410 - RNA, 17 nt, Salmonella typhimurium LT2
gcgaaccggaccagcac

SEQ ID NO: 1831411 - RNA, 20 nt, Salmonella typhimurium LT2
gccuuauugugccgcggcuu

SEQ ID NO: 1831412 - RNA, 18 nt, Salmonella typhimurium LT2
gccuucagucaacagugu

SEQ ID NO: 1831413 - RNA, 21 nt, Salmonella typhimurium LT2
gccuucauauuaaauuccggc

SEQ ID NO: 1831414 - RNA, 18 nt, Salmonella typhimurium LT2
gccuucguuauaaggccu

SEQ ID NO: 1831415 - RNA, 13 nt, Salmonella typhimurium LT2
gccuucugugaua

SEQ ID NO: 1831416 - RNA, 19 nt, Salmonella typhimurium LT2
gccugucuccgcagcaggc

SEQ ID NO: 1831417 - RNA, 20 nt, Salmonella typhimurium LT2
gccugcaugacccauuauuc

SEQ ID NO: 1831418 - RNA, 16 nt, Salmonella typhimurium LT2
gccuguugacgcgcau

SEQ ID NO: 1831419 - RNA, 16 nt, Salmonella typhimurium LT2
gccugcaggccggaua

SEQ ID NO: 1831420 - RNA, 14 nt, Salmonella typhimurium LT2
gccuugcggcgcca

SEQ ID NO: 1831421 - RNA, 22 nt, Salmonella typhimurium LT2
gccuugcccguauugaagcgau

SEQ ID NO: 1831422 - RNA, 15 nt, Salmonella typhimurium LT2
gccuugguugccgca

SEQ ID NO: 1831423 - RNA, 20 nt, Salmonella typhimurium LT2
gccuuugucgaaauugccgc

SEQ ID NO: 1831424 - RNA, 17 nt, Salmonella typhimurium LT2
gccuuugacgccgggaa

SEQ ID NO: 1831425 - RNA, 22 nt, Salmonella typhimurium LT2
gccuuucagucgacaacaucau

SEQ ID NO: 1831426 - RNA, 19 nt, Salmonella typhimurium LT2
gcgaaagaaaauuguccac

SEQ ID NO: 1831427 - RNA, 20 nt, Salmonella typhimurium LT2
gcgaaagcacucggcgccuu

SEQ ID NO: 1831428 - RNA, 18 nt, Salmonella typhimurium LT2
gcgaaacgccuuauccgg

SEQ ID NO: 1831429 - RNA, 21 nt, Salmonella typhimurium LT2
gcgaaacgccuuauccggccu

SEQ ID NO: 1831430 - RNA, 18 nt, Salmonella typhimurium LT2
gcgaaaaaguucacgcuu

SEQ ID NO: 1831431 - RNA, 13 nt, Salmonella typhimurium LT2
gccuuuuggcagc

SEQ ID NO: 1831432 - RNA, 16 nt, Salmonella typhimurium LT2
gccuuuuugcagcgcg

SEQ ID NO: 1831433 - RNA, 15 nt, Salmonella typhimurium LT2
gcgaaaagccggaau

SEQ ID NO: 1831434 - RNA, 16 nt, Salmonella typhimurium LT2
aagcgcugggcgauaa

SEQ ID NO: 1831435 - RNA, 19 nt, Salmonella typhimurium LT2
aagcgcguuucugcgccuc

SEQ ID NO: 1831436 - RNA, 20 nt, Salmonella typhimurium LT2
aagcgcucaugccacgccau

SEQ ID NO: 1831437 - RNA, 16 nt, Salmonella typhimurium LT2
gcggcccauucgccca

SEQ ID NO: 1831438 - RNA, 16 nt, Salmonella typhimurium LT2
gcggccaugaucgccg

SEQ ID NO: 1831439 - RNA, 23 nt, Salmonella typhimurium LT2
aagcggauucuucgaugaugccg

SEQ ID NO: 1831440 - RNA, 17 nt, Salmonella typhimurium LT2
gcggccuuuauccagcg

SEQ ID NO: 1831441 - RNA, 17 nt, Salmonella typhimurium LT2
gcggccuucgcagaucg

SEQ ID NO: 1831442 - RNA, 13 nt, Salmonella typhimurium LT2
aagcgcagcgcca

SEQ ID NO: 1831443 - RNA, 16 nt, Salmonella typhimurium LT2
aagcgcagcgccauca

SEQ ID NO: 1831444 - RNA, 21 nt, Salmonella typhimurium LT2
aagcgcaaacuuccacacggc

SEQ ID NO: 1831445 - RNA, 22 nt, Salmonella typhimurium LT2
gcggcaggcuuucuuugcggaa

SEQ ID NO: 1831446 - RNA, 22 nt, Salmonella typhimurium LT2
gcggcacggcgucaauuccgcg

SEQ ID NO: 1831447 - RNA, 14 nt, Salmonella typhimurium LT2
aagcgacagcgcca

SEQ ID NO: 1831448 - RNA, 13 nt, Salmonella typhimurium LT2
aagcgaagcgcca

SEQ ID NO: 1831449 - RNA, 14 nt, Salmonella typhimurium LT2
gcgcucgcccuucg

SEQ ID NO: 1831450 - RNA, 15 nt, Salmonella typhimurium LT2
gcgcucgccagcgca

SEQ ID NO: 1831451 - RNA, 17 nt, Salmonella typhimurium LT2
aagcgccacgcgucagg

SEQ ID NO: 1831452 - RNA, 13 nt, Salmonella typhimurium LT2
aagcgccgcgcca

SEQ ID NO: 1831453 - RNA, 19 nt, Salmonella typhimurium LT2
aagcgccuugucugaccgg

SEQ ID NO: 1831454 - RNA, 15 nt, Salmonella typhimurium LT2
aagcgcgaaucgccu

SEQ ID NO: 1831455 - RNA, 17 nt, Salmonella typhimurium LT2
aagcgcgcggcugcggg

SEQ ID NO: 1831456 - RNA, 16 nt, Salmonella typhimurium LT2
aagcgcggacagcaga

SEQ ID NO: 1831457 - RNA, 21 nt, Salmonella typhimurium LT2
gcggcguacugcaacgcgcau

SEQ ID NO: 1831458 - RNA, 19 nt, Salmonella typhimurium LT2
aagcuaauccccagcgcuc

SEQ ID NO: 1831459 - RNA, 17 nt, Salmonella typhimurium LT2
aagcuaauccccgucac

SEQ ID NO: 1831460 - RNA, 22 nt, Salmonella typhimurium LT2
aagcuaauccccgucaccacgc

SEQ ID NO: 1831461 - RNA, 23 nt, Salmonella typhimurium LT2
aagcguuucucuugugcuuccag

SEQ ID NO: 1831462 - RNA, 14 nt, Salmonella typhimurium LT2
gcggcgucauccgg

SEQ ID NO: 1831463 - RNA, 12 nt, Salmonella typhimurium LT2
gcggcgccauca

SEQ ID NO: 1831464 - RNA, 15 nt, Salmonella typhimurium LT2
gcggcgccauccggc

SEQ ID NO: 1831465 - RNA, 14 nt, Salmonella typhimurium LT2
aagcguuagcgcca

SEQ ID NO: 1831466 - RNA, 15 nt, Salmonella typhimurium LT2
aagcguucaucaggc

SEQ ID NO: 1831467 - RNA, 17 nt, Salmonella typhimurium LT2
aagcguucaucaggcau

SEQ ID NO: 1831468 - RNA, 11 nt, Salmonella typhimurium LT2
gcggcggauaa

SEQ ID NO: 1831469 - RNA, 15 nt, Salmonella typhimurium LT2
aagcgucagcgccau

SEQ ID NO: 1831470 - RNA, 16 nt, Salmonella typhimurium LT2
aagcguagcgccauca

SEQ ID NO: 1831471 - RNA, 21 nt, Salmonella typhimurium LT2
aagcguagcgccaucaggcau

SEQ ID NO: 1831472 - RNA, 21 nt, Salmonella typhimurium LT2
aagcgguguaaaagccagcaa

SEQ ID NO: 1831473 - RNA, 19 nt, Salmonella typhimurium LT2
gcgggcaauuccggucauc

SEQ ID NO: 1831474 - RNA, 12 nt, Salmonella typhimurium LT2
gcggcuuauccg

SEQ ID NO: 1831475 - RNA, 12 nt, Salmonella typhimurium LT2
gcggcuucagcg

SEQ ID NO: 1831476 - RNA, 15 nt, Salmonella typhimurium LT2
gcggcuucagcgaca

SEQ ID NO: 1831477 - RNA, 17 nt, Salmonella typhimurium LT2
gcggcuuuuucaucauc

SEQ ID NO: 1831478 - RNA, 15 nt, Salmonella typhimurium LT2
gcgggccguggccag

SEQ ID NO: 1831479 - RNA, 16 nt, Salmonella typhimurium LT2
gcggcuguucaccacg

SEQ ID NO: 1831480 - RNA, 17 nt, Salmonella typhimurium LT2
gcggcuguagccagccu

SEQ ID NO: 1831481 - RNA, 15 nt, Salmonella typhimurium LT2
gcggcugaugcagau

SEQ ID NO: 1831482 - RNA, 23 nt, Salmonella typhimurium LT2
gcguauagcgcuugucgcgcuau

SEQ ID NO: 1831483 - RNA, 23 nt, Salmonella typhimurium LT2
gcguaucauagcggcuaccgcgu

SEQ ID NO: 1831484 - RNA, 15 nt, Salmonella typhimurium LT2
gcgucaauuccgcgc

SEQ ID NO: 1831485 - RNA, 15 nt, Salmonella typhimurium LT2
gcgucacauggcgaa

SEQ ID NO: 1831486 - RNA, 13 nt, Salmonella typhimurium LT2
gcguagagagcgg

SEQ ID NO: 1831487 - RNA, 20 nt, Salmonella typhimurium LT2
gcguagcccagcgccgcauc

SEQ ID NO: 1831488 - RNA, 13 nt, Salmonella typhimurium LT2
gcgucccagcaca

SEQ ID NO: 1831489 - RNA, 15 nt, Salmonella typhimurium LT2
gcgucccucgccggu

SEQ ID NO: 1831490 - RNA, 13 nt, Salmonella typhimurium LT2
gcguccagcggca

SEQ ID NO: 1831491 - RNA, 17 nt, Salmonella typhimurium LT2
gcgucagcgugcgguaa

SEQ ID NO: 1831492 - RNA, 19 nt, Salmonella typhimurium LT2
gcgucgcguaccagcgccc

SEQ ID NO: 1831493 - RNA, 15 nt, Salmonella typhimurium LT2
gcgucggcuucauca

SEQ ID NO: 1831494 - RNA, 18 nt, Salmonella typhimurium LT2
gcguccguucugauacuc

SEQ ID NO: 1831495 - RNA, 21 nt, Salmonella typhimurium LT2
gcgucccuuucccuuccagcg

SEQ ID NO: 1831496 - RNA, 18 nt, Salmonella typhimurium LT2
gcgucgcauucgauacgc

SEQ ID NO: 1831497 - RNA, 20 nt, Salmonella typhimurium LT2
gcgucgcauucgauacgcac

SEQ ID NO: 1831498 - RNA, 21 nt, Salmonella typhimurium LT2
gcgugcguucauggcgcgaca

SEQ ID NO: 1831499 - RNA, 23 nt, Salmonella typhimurium LT2
gcgugguaucgcggcagcgcugc

SEQ ID NO: 1831500 - RNA, 20 nt, Salmonella typhimurium LT2
gcgugguaucucgucgccag

SEQ ID NO: 1831501 - RNA, 14 nt, Salmonella typhimurium LT2
gcguuacgcgccac

SEQ ID NO: 1831502 - RNA, 13 nt, Salmonella typhimurium LT2
gcguuaaugcauu

SEQ ID NO: 1831503 - RNA, 18 nt, Salmonella typhimurium LT2
gcguuaauggccugauga

SEQ ID NO: 1831504 - RNA, 20 nt, Salmonella typhimurium LT2
gcguuaacggcuucguuuca

SEQ ID NO: 1831505 - RNA, 16 nt, Salmonella typhimurium LT2
gcguuauugaccaucg

SEQ ID NO: 1831506 - RNA, 18 nt, Salmonella typhimurium LT2
gcguucaauauucgcgcc

SEQ ID NO: 1831507 - RNA, 22 nt, Salmonella typhimurium LT2
gcgucuucuuccacuucagcca

SEQ ID NO: 1831508 - RNA, 21 nt, Salmonella typhimurium LT2
gcgugauccacagcguaggcc

SEQ ID NO: 1831509 - RNA, 20 nt, Salmonella typhimurium LT2
gcgugauggaacaucuccca

SEQ ID NO: 1831510 - RNA, 16 nt, Salmonella typhimurium LT2
gcgucuuaucuggccu

SEQ ID NO: 1831511 - RNA, 21 nt, Salmonella typhimurium LT2
gcgucuucgaugccaugaacg

SEQ ID NO: 1831512 - RNA, 22 nt, Salmonella typhimurium LT2
gcguaacguugauuuggaggcc

SEQ ID NO: 1831513 - RNA, 15 nt, Salmonella typhimurium LT2
gcguaaaaccgcgcu

SEQ ID NO: 1831514 - RNA, 23 nt, Salmonella typhimurium LT2
gcguacaaucgcguuuuccagca

SEQ ID NO: 1831515 - RNA, 13 nt, Salmonella typhimurium LT2
gcguaauccagcu

SEQ ID NO: 1831516 - RNA, 20 nt, Salmonella typhimurium LT2
gcguaauggccaccagcaca

SEQ ID NO: 1831517 - RNA, 18 nt, Salmonella typhimurium LT2
gcguaaugguguccacaa

SEQ ID NO: 1831518 - RNA, 12 nt, Salmonella typhimurium LT2
gcguaccagcgg

SEQ ID NO: 1831519 - RNA, 14 nt, Salmonella typhimurium LT2
gcguaccagcgguc

SEQ ID NO: 1831520 - RNA, 14 nt, Salmonella typhimurium LT2
gcguaccagcgccc

SEQ ID NO: 1831521 - RNA, 23 nt, Salmonella typhimurium LT2
gcguacaggauguccaggcgaca

SEQ ID NO: 1831522 - RNA, 23 nt, Salmonella typhimurium LT2
gcgguugcggcggggauaaucag

SEQ ID NO: 1831523 - RNA, 18 nt, Salmonella typhimurium LT2
gcgguuuuauugucagaa

SEQ ID NO: 1831524 - RNA, 15 nt, Salmonella typhimurium LT2
gcgguuuagccgcca

SEQ ID NO: 1831525 - RNA, 13 nt, Salmonella typhimurium LT2
gcgguuuauccgg

SEQ ID NO: 1831526 - RNA, 15 nt, Salmonella typhimurium LT2
gcgguuacguccggc

SEQ ID NO: 1831527 - RNA, 14 nt, Salmonella typhimurium LT2
gcgguuacguucgg

SEQ ID NO: 1831528 - RNA, 23 nt, Salmonella typhimurium LT2
gcggucagggugaaucccgccau

SEQ ID NO: 1831529 - RNA, 22 nt, Salmonella typhimurium LT2
gcggucaccuucggucccaucg

SEQ ID NO: 1831530 - RNA, 16 nt, Salmonella typhimurium LT2
gcggucagaagucagc

SEQ ID NO: 1831531 - RNA, 16 nt, Salmonella typhimurium LT2
gcgguaaguacggcaa

SEQ ID NO: 1831532 - RNA, 13 nt, Salmonella typhimurium LT2
gcgguaaucgccg

SEQ ID NO: 1831533 - RNA, 16 nt, Salmonella typhimurium LT2
gcgguaaucgccgcga

SEQ ID NO: 1831534 - RNA, 18 nt, Salmonella typhimurium LT2
gcgguaaucgccgcgaca

SEQ ID NO: 1831535 - RNA, 22 nt, Salmonella typhimurium LT2
gcgguaaauacgcggcacguuu

SEQ ID NO: 1831536 - RNA, 13 nt, Salmonella typhimurium LT2
gcgguaggcguca

SEQ ID NO: 1831537 - RNA, 17 nt, Salmonella typhimurium LT2
gcgguacagcaucccgc

SEQ ID NO: 1831538 - RNA, 21 nt, Salmonella typhimurium LT2
gcgguacagcgagcuauccgg

SEQ ID NO: 1831539 - RNA, 13 nt, Salmonella typhimurium LT2
gcggugaucccag

SEQ ID NO: 1831540 - RNA, 12 nt, Salmonella typhimurium LT2
gcguucagcgcc

SEQ ID NO: 1831541 - RNA, 14 nt, Salmonella typhimurium LT2
gcguucauccagcg

SEQ ID NO: 1831542 - RNA, 13 nt, Salmonella typhimurium LT2
gcguucauggcaa

SEQ ID NO: 1831543 - RNA, 18 nt, Salmonella typhimurium LT2
gcguucauggcgcgacau

SEQ ID NO: 1831544 - RNA, 14 nt, Salmonella typhimurium LT2
gcucaggcgcgaau

SEQ ID NO: 1831545 - RNA, 18 nt, Salmonella typhimurium LT2
gcucagggcaaagucuuc

SEQ ID NO: 1831546 - RNA, 21 nt, Salmonella typhimurium LT2
gcucauaauggaccagaacau

SEQ ID NO: 1831547 - RNA, 20 nt, Salmonella typhimurium LT2
gcucauagccgcuuuccgcc

SEQ ID NO: 1831548 - RNA, 18 nt, Salmonella typhimurium LT2
gcucauaucguugcggau

SEQ ID NO: 1831549 - RNA, 18 nt, Salmonella typhimurium LT2
gcucaucaaacagcggca

SEQ ID NO: 1831550 - RNA, 18 nt, Salmonella typhimurium LT2
gcucaucacaucgcgcag

SEQ ID NO: 1831551 - RNA, 16 nt, Salmonella typhimurium LT2
gcucaucaccagcagc

SEQ ID NO: 1831552 - RNA, 20 nt, Salmonella typhimurium LT2
gcucauaaauugcagcgacc

SEQ ID NO: 1831553 - RNA, 13 nt, Salmonella typhimurium LT2
gcucauaaacgcg

SEQ ID NO: 1831554 - RNA, 20 nt, Salmonella typhimurium LT2
gcucaucggcggcaaagccg

SEQ ID NO: 1831555 - RNA, 15 nt, Salmonella typhimurium LT2
gcucccgcagccacu

SEQ ID NO: 1831556 - RNA, 15 nt, Salmonella typhimurium LT2
gcucccgcgccuaug

SEQ ID NO: 1831557 - RNA, 14 nt, Salmonella typhimurium LT2
gcuccauccaccag

SEQ ID NO: 1831558 - RNA, 18 nt, Salmonella typhimurium LT2
gcucccacucuuccagca

SEQ ID NO: 1831559 - RNA, 21 nt, Salmonella typhimurium LT2
gcuccagcggaagaucgccau

SEQ ID NO: 1831560 - RNA, 14 nt, Salmonella typhimurium LT2
gcucaugcgcgucc

SEQ ID NO: 1831561 - RNA, 21 nt, Salmonella typhimurium LT2
gcuccagaccaccagcgacau

SEQ ID NO: 1831562 - RNA, 15 nt, Salmonella typhimurium LT2
gcuccagaccaccag

SEQ ID NO: 1831563 - RNA, 15 nt, Salmonella typhimurium LT2
gcuccaccagcgcau

SEQ ID NO: 1831564 - RNA, 22 nt, Salmonella typhimurium LT2
gcucgccaguaucggcaggacu

SEQ ID NO: 1831565 - RNA, 21 nt, Salmonella typhimurium LT2
gcucccgcgucacgaccggcg

SEQ ID NO: 1831566 - RNA, 23 nt, Salmonella typhimurium LT2
gcucccggaaccgaccgcgauaa

SEQ ID NO: 1831567 - RNA, 15 nt, Salmonella typhimurium LT2
gcuccgggccgauac

SEQ ID NO: 1831568 - RNA, 21 nt, Salmonella typhimurium LT2
gcucgcacugauagccgccag

SEQ ID NO: 1831569 - RNA, 16 nt, Salmonella typhimurium LT2
gcucucuuuuggcgac

SEQ ID NO: 1831570 - RNA, 22 nt, Salmonella typhimurium LT2
gcugaaacagaauaaacggcag

SEQ ID NO: 1831571 - RNA, 22 nt, Salmonella typhimurium LT2
gcugaauggcaaccuuaccggc

SEQ ID NO: 1831572 - RNA, 20 nt, Salmonella typhimurium LT2
gcugaaugaagccuuagcgg

SEQ ID NO: 1831573 - RNA, 18 nt, Salmonella typhimurium LT2
gcucguuguuuaauacgc

SEQ ID NO: 1831574 - RNA, 22 nt, Salmonella typhimurium LT2
gcucuccgccgcgggcagcagc

SEQ ID NO: 1831575 - RNA, 18 nt, Salmonella typhimurium LT2
gcucuccuacaccaccag

SEQ ID NO: 1831576 - RNA, 16 nt, Salmonella typhimurium LT2
gcugaguucaggcacg

SEQ ID NO: 1831577 - RNA, 20 nt, Salmonella typhimurium LT2
gcugagugguucgccaucca

SEQ ID NO: 1831578 - RNA, 14 nt, Salmonella typhimurium LT2
gcugaguucaggca

SEQ ID NO: 1831579 - RNA, 19 nt, Salmonella typhimurium LT2
gcugauaacuaauggcauu

SEQ ID NO: 1831580 - RNA, 23 nt, Salmonella typhimurium LT2
gcugagcggcucauccagcaaca

SEQ ID NO: 1831581 - RNA, 22 nt, Salmonella typhimurium LT2
gcugagccuucaccguaucgcc

SEQ ID NO: 1831582 - RNA, 21 nt, Salmonella typhimurium LT2
gcugcauuucuuguugacgac

SEQ ID NO: 1831583 - RNA, 15 nt, Salmonella typhimurium LT2
gcugccgacuacgcc

SEQ ID NO: 1831584 - RNA, 22 nt, Salmonella typhimurium LT2
gcugccgacuacgccuccugcc

SEQ ID NO: 1831585 - RNA, 22 nt, Salmonella typhimurium LT2
gcugcacaaucgccagccccag

SEQ ID NO: 1831586 - RNA, 23 nt, Salmonella typhimurium LT2
gcugaugcccagguuagcagcca

SEQ ID NO: 1831587 - RNA, 19 nt, Salmonella typhimurium LT2
gcugcagcccuuacgcuuu

SEQ ID NO: 1831588 - RNA, 18 nt, Salmonella typhimurium LT2
gcugccggaaagccccag

SEQ ID NO: 1831589 - RNA, 15 nt, Salmonella typhimurium LT2
gcugcgccagauccg

SEQ ID NO: 1831590 - RNA, 22 nt, Salmonella typhimurium LT2
gcugcgccagccagacggcgcc

SEQ ID NO: 1831591 - RNA, 14 nt, Salmonella typhimurium LT2
gcugcgccagccau

SEQ ID NO: 1831592 - RNA, 18 nt, Salmonella typhimurium LT2
gcugcgccugcgggucca

SEQ ID NO: 1831593 - RNA, 16 nt, Salmonella typhimurium LT2
gcugcguaaccgccag

SEQ ID NO: 1831594 - RNA, 23 nt, Salmonella typhimurium LT2
gcugcuauucgguagucgcugac

SEQ ID NO: 1831595 - RNA, 19 nt, Salmonella typhimurium LT2
gcugcucaacauacgggcu

SEQ ID NO: 1831596 - RNA, 21 nt, Salmonella typhimurium LT2
ggaaagacggcagcgccaucc

SEQ ID NO: 1831597 - RNA, 15 nt, Salmonella typhimurium LT2
ggaaagacggcagcg

SEQ ID NO: 1831598 - RNA, 22 nt, Salmonella typhimurium LT2
ggaaacucgccgccaugacgca

SEQ ID NO: 1831599 - RNA, 23 nt, Salmonella typhimurium LT2
ggaaacgcugcgccuggucuucc

SEQ ID NO: 1831600 - RNA, 15 nt, Salmonella typhimurium LT2
ggaaaaagccgccgu

SEQ ID NO: 1831601 - RNA, 22 nt, Salmonella typhimurium LT2
ggaaaaauaguggcuggcgucc

SEQ ID NO: 1831602 - RNA, 14 nt, Salmonella typhimurium LT2
ggaaaauuccugga

SEQ ID NO: 1831603 - RNA, 22 nt, Salmonella typhimurium LT2
ggaaacaguuuaguugccguuu

SEQ ID NO: 1831604 - RNA, 21 nt, Salmonella typhimurium LT2
ggaaacauaaggguaagcaau

SEQ ID NO: 1831605 - RNA, 19 nt, Salmonella typhimurium LT2
gcuuugcuuauccggccua

SEQ ID NO: 1831606 - RNA, 15 nt, Salmonella typhimurium LT2
gcuuuguaaagcgcc

SEQ ID NO: 1831607 - RNA, 22 nt, Salmonella typhimurium LT2
gcuuugcguaaaaaaacaucau

SEQ ID NO: 1831608 - RNA, 22 nt, Salmonella typhimurium LT2
gcuuuuaucugggucaggaacu

SEQ ID NO: 1831609 - RNA, 17 nt, Salmonella typhimurium LT2
gcuuuuccauacgcuuu

SEQ ID NO: 1831610 - RNA, 17 nt, Salmonella typhimurium LT2
gcuuucgccaccagcga

SEQ ID NO: 1831611 - RNA, 16 nt, Salmonella typhimurium LT2
gcuuugcgccggcagu

SEQ ID NO: 1831612 - RNA, 20 nt, Salmonella typhimurium LT2
gcuuucuugcucagcgaccg

SEQ ID NO: 1831613 - RNA, 16 nt, Salmonella typhimurium LT2
gcuuugagcagcgcca

SEQ ID NO: 1831614 - RNA, 13 nt, Salmonella typhimurium LT2
gcuugucgaucau

SEQ ID NO: 1831615 - RNA, 16 nt, Salmonella typhimurium LT2
gcuugucgaucaucag

SEQ ID NO: 1831616 - RNA, 22 nt, Salmonella typhimurium LT2
gcuuguuuacgcccucaucggc

SEQ ID NO: 1831617 - RNA, 14 nt, Salmonella typhimurium LT2
gcuuuaaagcaggc

SEQ ID NO: 1831618 - RNA, 16 nt, Salmonella typhimurium LT2
gcuuuagugccgccau

SEQ ID NO: 1831619 - RNA, 15 nt, Salmonella typhimurium LT2
gcuuuaccgggccua

SEQ ID NO: 1831620 - RNA, 23 nt, Salmonella typhimurium LT2
gcuuucaucauucgcaccaccgg

SEQ ID NO: 1831621 - RNA, 14 nt, Salmonella typhimurium LT2
gcuugcgcuauccg

SEQ ID NO: 1831622 - RNA, 19 nt, Salmonella typhimurium LT2
gcuugcccgauggcgcugc

SEQ ID NO: 1831623 - RNA, 14 nt, Salmonella typhimurium LT2
gcuugcgccgccau

SEQ ID NO: 1831624 - RNA, 17 nt, Salmonella typhimurium LT2
gcuugcgcauggccuga

SEQ ID NO: 1831625 - RNA, 14 nt, Salmonella typhimurium LT2
gcuugcccggccua

SEQ ID NO: 1831626 - RNA, 13 nt, Salmonella typhimurium LT2
gcuucuuggcgau

SEQ ID NO: 1831627 - RNA, 20 nt, Salmonella typhimurium LT2
gcuucuucaaacuuagcgac

SEQ ID NO: 1831628 - RNA, 14 nt, Salmonella typhimurium LT2
gcuucuucaacguu

SEQ ID NO: 1831629 - RNA, 15 nt, Salmonella typhimurium LT2
gcuucugcgccuuug

SEQ ID NO: 1831630 - RNA, 22 nt, Salmonella typhimurium LT2
gcuucguucuguaucaucgauu

SEQ ID NO: 1831631 - RNA, 13 nt, Salmonella typhimurium LT2
gcuucuccaccau

SEQ ID NO: 1831632 - RNA, 16 nt, Salmonella typhimurium LT2
gcuucccacagucggc

SEQ ID NO: 1831633 - RNA, 19 nt, Salmonella typhimurium LT2
gcuucccagcgucgccagu

SEQ ID NO: 1831634 - RNA, 22 nt, Salmonella typhimurium LT2
gcuucaggugugguacggcuuu

SEQ ID NO: 1831635 - RNA, 22 nt, Salmonella typhimurium LT2
gcuucagcaaacggcuggauaa

SEQ ID NO: 1831636 - RNA, 17 nt, Salmonella typhimurium LT2
gcuucgguccggcgcua

SEQ ID NO: 1831637 - RNA, 19 nt, Salmonella typhimurium LT2
gcuucgguugccugcguca

SEQ ID NO: 1831638 - RNA, 15 nt, Salmonella typhimurium LT2
gcuuccucgccaccg

SEQ ID NO: 1831639 - RNA, 18 nt, Salmonella typhimurium LT2
gcuucgccaucuccauca

SEQ ID NO: 1831640 - RNA, 15 nt, Salmonella typhimurium LT2
gcuucgcgcgccagu

SEQ ID NO: 1831641 - RNA, 21 nt, Salmonella typhimurium LT2
gcuggcgguaacaggcaccag

SEQ ID NO: 1831642 - RNA, 21 nt, Salmonella typhimurium LT2
gcugcucguaaguuuccugcg

SEQ ID NO: 1831643 - RNA, 21 nt, Salmonella typhimurium LT2
gcuggucagcaacgccuccag

SEQ ID NO: 1831644 - RNA, 16 nt, Salmonella typhimurium LT2
gcuggguucauccagc

SEQ ID NO: 1831645 - RNA, 21 nt, Salmonella typhimurium LT2
gcugguuggcgcgcucgcauu

SEQ ID NO: 1831646 - RNA, 21 nt, Salmonella typhimurium LT2
gcuggucgccgcccaucgggc

SEQ ID NO: 1831647 - RNA, 13 nt, Salmonella typhimurium LT2
gcuggucgcgaua

SEQ ID NO: 1831648 - RNA, 17 nt, Salmonella typhimurium LT2
gcuguccgggcguuuca

SEQ ID NO: 1831649 - RNA, 12 nt, Salmonella typhimurium LT2
gcuguacgacug

SEQ ID NO: 1831650 - RNA, 14 nt, Salmonella typhimurium LT2
gcuguaaaccggcc

SEQ ID NO: 1831651 - RNA, 17 nt, Salmonella typhimurium LT2
gcuguaacuucacgcca

SEQ ID NO: 1831652 - RNA, 14 nt, Salmonella typhimurium LT2
gcugucggucagga

SEQ ID NO: 1831653 - RNA, 17 nt, Salmonella typhimurium LT2
gcugucgauuuccggcg

SEQ ID NO: 1831654 - RNA, 19 nt, Salmonella typhimurium LT2
gcugucgcucacgauaacg

SEQ ID NO: 1831655 - RNA, 21 nt, Salmonella typhimurium LT2
gcuguggaaaaucagcgacug

SEQ ID NO: 1831656 - RNA, 20 nt, Salmonella typhimurium LT2
gcugugcgaaugccguuaac

SEQ ID NO: 1831657 - RNA, 19 nt, Salmonella typhimurium LT2
gcuguuaaaaccggcugcc

SEQ ID NO: 1831658 - RNA, 22 nt, Salmonella typhimurium LT2
gcuguuaauuugcaucaggcca

SEQ ID NO: 1831659 - RNA, 20 nt, Salmonella typhimurium LT2
gcuuaauccgugaauguccu

SEQ ID NO: 1831660 - RNA, 16 nt, Salmonella typhimurium LT2
gcuuaaccgggaucgg

SEQ ID NO: 1831661 - RNA, 19 nt, Salmonella typhimurium LT2
gcuuaacgccaguuccgcc

SEQ ID NO: 1831662 - RNA, 20 nt, Salmonella typhimurium LT2
gcuuaacgccaguuccgcca

SEQ ID NO: 1831663 - RNA, 14 nt, Salmonella typhimurium LT2
gcuuaaaaaauccu

SEQ ID NO: 1831664 - RNA, 15 nt, Salmonella typhimurium LT2
gcuuaccacuuugcg

SEQ ID NO: 1831665 - RNA, 17 nt, Salmonella typhimurium LT2
gcuuacaggcacgccug

SEQ ID NO: 1831666 - RNA, 20 nt, Salmonella typhimurium LT2
gcuucaccuuucgccgccag

SEQ ID NO: 1831667 - RNA, 23 nt, Salmonella typhimurium LT2
gcuucacgcggauugccgcccgu

SEQ ID NO: 1831668 - RNA, 14 nt, Salmonella typhimurium LT2
gcuucacgccacag

SEQ ID NO: 1831669 - RNA, 17 nt, Salmonella typhimurium LT2
gcuuacggcaaacugaa

SEQ ID NO: 1831670 - RNA, 14 nt, Salmonella typhimurium LT2
gcuuauccggccua

SEQ ID NO: 1831671 - RNA, 18 nt, Salmonella typhimurium LT2
gcuuauccggccuacagc

SEQ ID NO: 1831672 - RNA, 12 nt, Salmonella typhimurium LT2
gcuuauccagcc

SEQ ID NO: 1831673 - RNA, 20 nt, Salmonella typhimurium LT2
gcuuaucaggccuacgguuu

SEQ ID NO: 1831674 - RNA, 20 nt, Salmonella typhimurium LT2
gcuuauccggccuacgauuu

SEQ ID NO: 1831675 - RNA, 19 nt, Salmonella typhimurium LT2
ggccgcgccgcgcacgccg

SEQ ID NO: 1831676 - RNA, 22 nt, Salmonella typhimurium LT2
ggccggauaaggcguucacgcc

SEQ ID NO: 1831677 - RNA, 23 nt, Salmonella typhimurium LT2
ggccggauaagcgucagcgccau

SEQ ID NO: 1831678 - RNA, 22 nt, Salmonella typhimurium LT2
ggccggaugccagucaauaagc

SEQ ID NO: 1831679 - RNA, 18 nt, Salmonella typhimurium LT2
ggccggaauacguaauac

SEQ ID NO: 1831680 - RNA, 14 nt, Salmonella typhimurium LT2
ggccgcuuugcgaa

SEQ ID NO: 1831681 - RNA, 19 nt, Salmonella typhimurium LT2
ggccgcuuuucggcguuua

SEQ ID NO: 1831682 - RNA, 20 nt, Salmonella typhimurium LT2
ggccggauaagcgcagcgcc

SEQ ID NO: 1831683 - RNA, 22 nt, Salmonella typhimurium LT2
ggccggauaagcaaagcgccau

SEQ ID NO: 1831684 - RNA, 14 nt, Salmonella typhimurium LT2
ggccugauaagcgc

SEQ ID NO: 1831685 - RNA, 20 nt, Salmonella typhimurium LT2
ggccugauaagcgcagcgca

SEQ ID NO: 1831686 - RNA, 20 nt, Salmonella typhimurium LT2
ggccugauaagcauagcgcc

SEQ ID NO: 1831687 - RNA, 19 nt, Salmonella typhimurium LT2
ggccugauaagcacaggcc

SEQ ID NO: 1831688 - RNA, 18 nt, Salmonella typhimurium LT2
ggccuacaagccgccucg

SEQ ID NO: 1831689 - RNA, 16 nt, Salmonella typhimurium LT2
ggccuaagaccagcac

SEQ ID NO: 1831690 - RNA, 22 nt, Salmonella typhimurium LT2
ggccggguacugaaugccaucc

SEQ ID NO: 1831691 - RNA, 15 nt, Salmonella typhimurium LT2
ggccgucccacgcgc

SEQ ID NO: 1831692 - RNA, 16 nt, Salmonella typhimurium LT2
ggccaggcauccggcc

SEQ ID NO: 1831693 - RNA, 20 nt, Salmonella typhimurium LT2
ggcccgauaagcaaagcgcc

SEQ ID NO: 1831694 - RNA, 22 nt, Salmonella typhimurium LT2
ggcccgauaagcaaagcgccau

SEQ ID NO: 1831695 - RNA, 11 nt, Salmonella typhimurium LT2
ggcccgccagc

SEQ ID NO: 1831696 - RNA, 20 nt, Salmonella typhimurium LT2
ggcccgguaagcgcagcgcc

SEQ ID NO: 1831697 - RNA, 12 nt, Salmonella typhimurium LT2
ggcccguugccu

SEQ ID NO: 1831698 - RNA, 18 nt, Salmonella typhimurium LT2
ggcccggugugccgcuug

SEQ ID NO: 1831699 - RNA, 16 nt, Salmonella typhimurium LT2
ggccgacgauaaacag

SEQ ID NO: 1831700 - RNA, 21 nt, Salmonella typhimurium LT2
ggccgaauaagcgacagcgcc

SEQ ID NO: 1831701 - RNA, 21 nt, Salmonella typhimurium LT2
ggccgauuuuuuaucucgccg

SEQ ID NO: 1831702 - RNA, 17 nt, Salmonella typhimurium LT2
ggccgauggucgcgcca

SEQ ID NO: 1831703 - RNA, 20 nt, Salmonella typhimurium LT2
ggccgacguaaacgucggcc

SEQ ID NO: 1831704 - RNA, 12 nt, Salmonella typhimurium LT2
ggccacagcgcc

SEQ ID NO: 1831705 - RNA, 22 nt, Salmonella typhimurium LT2
ggccaauggcucaacuccgccg

SEQ ID NO: 1831706 - RNA, 14 nt, Salmonella typhimurium LT2
ggccaagcagcgcc

SEQ ID NO: 1831707 - RNA, 16 nt, Salmonella typhimurium LT2
ggccaacauagcggca

SEQ ID NO: 1831708 - RNA, 15 nt, Salmonella typhimurium LT2
ggccagcgccggcga

SEQ ID NO: 1831709 - RNA, 15 nt, Salmonella typhimurium LT2
ggccagaugcggcga

SEQ ID NO: 1831710 - RNA, 22 nt, Salmonella typhimurium LT2
ggccagagcaagcucuguucaa

SEQ ID NO: 1831711 - RNA, 17 nt, Salmonella typhimurium LT2
ggcagauugacgucggu

SEQ ID NO: 1831712 - RNA, 18 nt, Salmonella typhimurium LT2
ggcagagcggcaacacau

SEQ ID NO: 1831713 - RNA, 12 nt, Salmonella typhimurium LT2
ggcaggcaucgc

SEQ ID NO: 1831714 - RNA, 13 nt, Salmonella typhimurium LT2
ggcaggcagcgcc

SEQ ID NO: 1831715 - RNA, 19 nt, Salmonella typhimurium LT2
ggcaggccuuucggcagcg

SEQ ID NO: 1831716 - RNA, 14 nt, Salmonella typhimurium LT2
ggcaggccuaacac

SEQ ID NO: 1831717 - RNA, 21 nt, Salmonella typhimurium LT2
ggcaguuuuucuacgaugacg

SEQ ID NO: 1831718 - RNA, 18 nt, Salmonella typhimurium LT2
ggcaucuuaucaggccua

SEQ ID NO: 1831719 - RNA, 12 nt, Salmonella typhimurium LT2
ggcaucucgcca

SEQ ID NO: 1831720 - RNA, 21 nt, Salmonella typhimurium LT2
ggcauagaaaaagaacugcaa

SEQ ID NO: 1831721 - RNA, 16 nt, Salmonella typhimurium LT2
ggcauuuucuuaccug

SEQ ID NO: 1831722 - RNA, 23 nt, Salmonella typhimurium LT2
ggccaaaacccaccagcagggca

SEQ ID NO: 1831723 - RNA, 14 nt, Salmonella typhimurium LT2
ggccaaacagcggc

SEQ ID NO: 1831724 - RNA, 18 nt, Salmonella typhimurium LT2
ggcauucuuuuagcgcuc

SEQ ID NO: 1831725 - RNA, 17 nt, Salmonella typhimurium LT2
ggcauuucaaucgccac

SEQ ID NO: 1831726 - RNA, 20 nt, Salmonella typhimurium LT2
ggcauuuacaccuuauccgg

SEQ ID NO: 1831727 - RNA, 22 nt, Salmonella typhimurium LT2
ggcaugaugggcgcacagcgcc

SEQ ID NO: 1831728 - RNA, 22 nt, Salmonella typhimurium LT2
ggcauguucccaugucagcgca

SEQ ID NO: 1831729 - RNA, 20 nt, Salmonella typhimurium LT2
ggcauguucacaucgcucag

SEQ ID NO: 1831730 - RNA, 21 nt, Salmonella typhimurium LT2
ggcaaugcccccucggcagca

SEQ ID NO: 1831731 - RNA, 12 nt, Salmonella typhimurium LT2
ggcaauggcuua

SEQ ID NO: 1831732 - RNA, 13 nt, Salmonella typhimurium LT2
ggcacaucaggca

SEQ ID NO: 1831733 - RNA, 19 nt, Salmonella typhimurium LT2
ggcaagaauuucaaucauc

SEQ ID NO: 1831734 - RNA, 22 nt, Salmonella typhimurium LT2
ggcaagccuguuuaauccggua

SEQ ID NO: 1831735 - RNA, 21 nt, Salmonella typhimurium LT2
ggcaaucgcgguaugcgauac

SEQ ID NO: 1831736 - RNA, 20 nt, Salmonella typhimurium LT2
ggcaaacggcgccagcucau

SEQ ID NO: 1831737 - RNA, 16 nt, Salmonella typhimurium LT2
ggcaaaauggcgaugc

SEQ ID NO: 1831738 - RNA, 19 nt, Salmonella typhimurium LT2
ggcaaaaaauauagccauu

SEQ ID NO: 1831739 - RNA, 16 nt, Salmonella typhimurium LT2
ggcaaagcccugacga

SEQ ID NO: 1831740 - RNA, 17 nt, Salmonella typhimurium LT2
ggcaaagaagcuuacaa

SEQ ID NO: 1831741 - RNA, 15 nt, Salmonella typhimurium LT2
ggcaccucguccaga

SEQ ID NO: 1831742 - RNA, 15 nt, Salmonella typhimurium LT2
ggcacgccugugcuu

SEQ ID NO: 1831743 - RNA, 18 nt, Salmonella typhimurium LT2
ggcacauauuccggcgcu

SEQ ID NO: 1831744 - RNA, 16 nt, Salmonella typhimurium LT2
ggcaccguuagugauu

SEQ ID NO: 1831745 - RNA, 15 nt, Salmonella typhimurium LT2
ggaacaagcaaaccu

SEQ ID NO: 1831746 - RNA, 23 nt, Salmonella typhimurium LT2
ggaaaucaaaccaccccagguua

SEQ ID NO: 1831747 - RNA, 12 nt, Salmonella typhimurium LT2
ggaucgccaucg

SEQ ID NO: 1831748 - RNA, 12 nt, Salmonella typhimurium LT2
ggaugaucguca

SEQ ID NO: 1831749 - RNA, 18 nt, Salmonella typhimurium LT2
ggaugaacucaauccauu

SEQ ID NO: 1831750 - RNA, 19 nt, Salmonella typhimurium LT2
ggaugaccaguuaagcaaa

SEQ ID NO: 1831751 - RNA, 20 nt, Salmonella typhimurium LT2
ggaucugcgcauuaacgccg

SEQ ID NO: 1831752 - RNA, 22 nt, Salmonella typhimurium LT2
ggauggcgacgcaggcgccuua

SEQ ID NO: 1831753 - RNA, 20 nt, Salmonella typhimurium LT2
ggauggcgacguuaacgccg

SEQ ID NO: 1831754 - RNA, 20 nt, Salmonella typhimurium LT2
ggaugcgagaaugucgccau

SEQ ID NO: 1831755 - RNA, 14 nt, Salmonella typhimurium LT2
ggauguacucaucc

SEQ ID NO: 1831756 - RNA, 23 nt, Salmonella typhimurium LT2
ggauggggcaucagccgccaucc

SEQ ID NO: 1831757 - RNA, 22 nt, Salmonella typhimurium LT2
ggauucucuaacgucagcgcca

SEQ ID NO: 1831758 - RNA, 16 nt, Salmonella typhimurium LT2
ggauucuuccucucgc

SEQ ID NO: 1831759 - RNA, 22 nt, Salmonella typhimurium LT2
ggauuggucgcgccgcgcgcaa

SEQ ID NO: 1831760 - RNA, 13 nt, Salmonella typhimurium LT2
ggcgccauccggc

SEQ ID NO: 1831761 - RNA, 18 nt, Salmonella typhimurium LT2
ggcgccaugauccagcgg

SEQ ID NO: 1831762 - RNA, 20 nt, Salmonella typhimurium LT2
ggcgcauuuucggcagcgcg

SEQ ID NO: 1831763 - RNA, 15 nt, Salmonella typhimurium LT2
ggcgcagcgccauca

SEQ ID NO: 1831764 - RNA, 22 nt, Salmonella typhimurium LT2
ggcgcagccguacacaaucauc

SEQ ID NO: 1831765 - RNA, 11 nt, Salmonella typhimurium LT2
ggcgcagcgcg

SEQ ID NO: 1831766 - RNA, 22 nt, Salmonella typhimurium LT2
ggcgcagccgccauccggcaca

SEQ ID NO: 1831767 - RNA, 20 nt, Salmonella typhimurium LT2
ggcgcacgucgguaaagcgc

SEQ ID NO: 1831768 - RNA, 16 nt, Salmonella typhimurium LT2
ggcgauuuuguaggcc

SEQ ID NO: 1831769 - RNA, 14 nt, Salmonella typhimurium LT2
ggcgauucaucgac

SEQ ID NO: 1831770 - RNA, 20 nt, Salmonella typhimurium LT2
ggcgauggucauuccagcua

SEQ ID NO: 1831771 - RNA, 19 nt, Salmonella typhimurium LT2
ggcgaucgcuaaucaggac

SEQ ID NO: 1831772 - RNA, 14 nt, Salmonella typhimurium LT2
ggcgaucgcuuucg

SEQ ID NO: 1831773 - RNA, 16 nt, Salmonella typhimurium LT2
ggcgaucgcuaaucag

SEQ ID NO: 1831774 - RNA, 15 nt, Salmonella typhimurium LT2
ggcgaucagcggcgc

SEQ ID NO: 1831775 - RNA, 21 nt, Salmonella typhimurium LT2
ggcgaucaccagcaccgccag

SEQ ID NO: 1831776 - RNA, 20 nt, Salmonella typhimurium LT2
ggcgauauuguccgucagcg

SEQ ID NO: 1831777 - RNA, 23 nt, Salmonella typhimurium LT2
ggcgauaaggucgcuauccagca

SEQ ID NO: 1831778 - RNA, 19 nt, Salmonella typhimurium LT2
ggcgauaaccucucaccgc

SEQ ID NO: 1831779 - RNA, 13 nt, Salmonella typhimurium LT2
ggcgauagcgccc

SEQ ID NO: 1831780 - RNA, 17 nt, Salmonella typhimurium LT2
ggcgauaacccgcgcau

SEQ ID NO: 1831781 - RNA, 20 nt, Salmonella typhimurium LT2
ggcgauaaaaauauccgcca

SEQ ID NO: 1831782 - RNA, 15 nt, Salmonella typhimurium LT2
ggcgaggcguaaaac

SEQ ID NO: 1831783 - RNA, 17 nt, Salmonella typhimurium LT2
ggcgagggaggcaaucg

SEQ ID NO: 1831784 - RNA, 19 nt, Salmonella typhimurium LT2
ggccuggagcguaagcgcg

SEQ ID NO: 1831785 - RNA, 17 nt, Salmonella typhimurium LT2
ggcgcuuugcuuauccg

SEQ ID NO: 1831786 - RNA, 15 nt, Salmonella typhimurium LT2
ggcgcuuugcuuauc

SEQ ID NO: 1831787 - RNA, 18 nt, Salmonella typhimurium LT2
ggcgcugucgcuuaccgg

SEQ ID NO: 1831788 - RNA, 17 nt, Salmonella typhimurium LT2
ggcgcuucgcuuaucgg

SEQ ID NO: 1831789 - RNA, 14 nt, Salmonella typhimurium LT2
ggcgcuugcuuauc

SEQ ID NO: 1831790 - RNA, 15 nt, Salmonella typhimurium LT2
ggcgcuucgcuuauc

SEQ ID NO: 1831791 - RNA, 23 nt, Salmonella typhimurium LT2
ggcggcaguggacuaugcuccag

SEQ ID NO: 1831792 - RNA, 20 nt, Salmonella typhimurium LT2
ggcggcauaaacgccuuauc

SEQ ID NO: 1831793 - RNA, 23 nt, Salmonella typhimurium LT2
ggcggcauaaacgccuuauccgg

SEQ ID NO: 1831794 - RNA, 16 nt, Salmonella typhimurium LT2
ggcggcaaaaacgccg

SEQ ID NO: 1831795 - RNA, 15 nt, Salmonella typhimurium LT2
ggcggcuuuacccgg

SEQ ID NO: 1831796 - RNA, 19 nt, Salmonella typhimurium LT2
ggcggcuucgccauccggu

SEQ ID NO: 1831797 - RNA, 19 nt, Salmonella typhimurium LT2
ggcggcugcgccuuauccg

SEQ ID NO: 1831798 - RNA, 20 nt, Salmonella typhimurium LT2
ggcggcugcgccuuacccgg

SEQ ID NO: 1831799 - RNA, 20 nt, Salmonella typhimurium LT2
ggcggcgugaacgccuuauc

SEQ ID NO: 1831800 - RNA, 23 nt, Salmonella typhimurium LT2
ggcggcguaaacaccuuauccgg

SEQ ID NO: 1831801 - RNA, 20 nt, Salmonella typhimurium LT2
ggcggcguaaacaccuuauc

SEQ ID NO: 1831802 - RNA, 21 nt, Salmonella typhimurium LT2
ggcggcgaaacgccuuauccg

SEQ ID NO: 1831803 - RNA, 23 nt, Salmonella typhimurium LT2
ggcgcuaaaccggcggaauagcu

SEQ ID NO: 1831804 - RNA, 15 nt, Salmonella typhimurium LT2
ggcgcuacgcuuauc

SEQ ID NO: 1831805 - RNA, 14 nt, Salmonella typhimurium LT2
ggcgcguugccgcc

SEQ ID NO: 1831806 - RNA, 19 nt, Salmonella typhimurium LT2
ggcgcuaaugcuuauccgg

SEQ ID NO: 1831807 - RNA, 20 nt, Salmonella typhimurium LT2
ggcgcugcgcuuauccggcc

SEQ ID NO: 1831808 - RNA, 20 nt, Salmonella typhimurium LT2
ggcgcugcgcuuaucagacc

SEQ ID NO: 1831809 - RNA, 20 nt, Salmonella typhimurium LT2
ggcgcugcgcgcaucgggcc

SEQ ID NO: 1831810 - RNA, 17 nt, Salmonella typhimurium LT2
ggcgcugcgcuuaccgg

SEQ ID NO: 1831811 - RNA, 15 nt, Salmonella typhimurium LT2
ggcgcugcgcuuauc

SEQ ID NO: 1831812 - RNA, 18 nt, Salmonella typhimurium LT2
ggcgcugcgccaucaggc

SEQ ID NO: 1831813 - RNA, 23 nt, Salmonella typhimurium LT2
ggcgcugaguuucucccgccaga

SEQ ID NO: 1831814 - RNA, 16 nt, Salmonella typhimurium LT2
ggcgcugaugacgcgc

SEQ ID NO: 1831815 - RNA, 22 nt, Salmonella typhimurium LT2
ggcgcgaacgccuuauccggcc

SEQ ID NO: 1831816 - RNA, 22 nt, Salmonella typhimurium LT2
ggcgcguaaguuugcguacuca

SEQ ID NO: 1831817 - RNA, 15 nt, Salmonella typhimurium LT2
ggcuaauauccagcc

SEQ ID NO: 1831818 - RNA, 12 nt, Salmonella typhimurium LT2
ggcuaacgcgcc

SEQ ID NO: 1831819 - RNA, 22 nt, Salmonella typhimurium LT2
ggcguuuucauuagccgccagc

SEQ ID NO: 1831820 - RNA, 15 nt, Salmonella typhimurium LT2
ggcguuuuccagcgc

SEQ ID NO: 1831821 - RNA, 19 nt, Salmonella typhimurium LT2
ggcguuucguuuagcgccu

SEQ ID NO: 1831822 - RNA, 18 nt, Salmonella typhimurium LT2
ggcguucccgcaggccgg

SEQ ID NO: 1831823 - RNA, 20 nt, Salmonella typhimurium LT2
ggcguguagccaaucagccc

SEQ ID NO: 1831824 - RNA, 21 nt, Salmonella typhimurium LT2
ggcgugguggauauccagcau

SEQ ID NO: 1831825 - RNA, 12 nt, Salmonella typhimurium LT2
ggcuauccggcu

SEQ ID NO: 1831826 - RNA, 16 nt, Salmonella typhimurium LT2
ggcuaccucuuauccg

SEQ ID NO: 1831827 - RNA, 13 nt, Salmonella typhimurium LT2
ggcucauccagca

SEQ ID NO: 1831828 - RNA, 14 nt, Salmonella typhimurium LT2
ggcucauccagcag

SEQ ID NO: 1831829 - RNA, 22 nt, Salmonella typhimurium LT2
ggcucauuuuauccaacagcgc

SEQ ID NO: 1831830 - RNA, 22 nt, Salmonella typhimurium LT2
ggcgucgguuauagacgccggu

SEQ ID NO: 1831831 - RNA, 21 nt, Salmonella typhimurium LT2
ggcgucucgcacucgccgcca

SEQ ID NO: 1831832 - RNA, 13 nt, Salmonella typhimurium LT2
ggcgugacgcgcc

SEQ ID NO: 1831833 - RNA, 22 nt, Salmonella typhimurium LT2
ggcgugaccgccuuauccggcc

SEQ ID NO: 1831834 - RNA, 15 nt, Salmonella typhimurium LT2
ggcgugaaccgguaa

SEQ ID NO: 1831835 - RNA, 15 nt, Salmonella typhimurium LT2
ggcgucuuccagcau

SEQ ID NO: 1831836 - RNA, 18 nt, Salmonella typhimurium LT2
ggcgucgccuguccggcc

SEQ ID NO: 1831837 - RNA, 19 nt, Salmonella typhimurium LT2
ggcgucgccugugccguug

SEQ ID NO: 1831838 - RNA, 21 nt, Salmonella typhimurium LT2
ggcgucgcuggucugacggau

SEQ ID NO: 1831839 - RNA, 18 nt, Salmonella typhimurium LT2
ggcgucgcauucgauacg

SEQ ID NO: 1831840 - RNA, 13 nt, Salmonella typhimurium LT2
ggcugaaagcgcc

SEQ ID NO: 1831841 - RNA, 17 nt, Salmonella typhimurium LT2
ggcugaccuucccuucg

SEQ ID NO: 1831842 - RNA, 12 nt, Salmonella typhimurium LT2
ggcugccgccau

SEQ ID NO: 1831843 - RNA, 17 nt, Salmonella typhimurium LT2
ggcugccuuaauucucc

SEQ ID NO: 1831844 - RNA, 13 nt, Salmonella typhimurium LT2
ggcugcgccugcg

SEQ ID NO: 1831845 - RNA, 17 nt, Salmonella typhimurium LT2
ggcugauuuaaucgcuu

SEQ ID NO: 1831846 - RNA, 17 nt, Salmonella typhimurium LT2
ggcugcaaagcaucugc

SEQ ID NO: 1831847 - RNA, 21 nt, Salmonella typhimurium LT2
ggcugagaaucaccuggcagc

SEQ ID NO: 1831848 - RNA, 16 nt, Salmonella typhimurium LT2
ggcugccaucggcauu

SEQ ID NO: 1831849 - RNA, 21 nt, Salmonella typhimurium LT2
ggcuuugacaaaacucauggc

SEQ ID NO: 1831850 - RNA, 21 nt, Salmonella typhimurium LT2
ggcuuucacaccguuauccgg

SEQ ID NO: 1831851 - RNA, 18 nt, Salmonella typhimurium LT2
ggcuuuaguucagcauau

SEQ ID NO: 1831852 - RNA, 16 nt, Salmonella typhimurium LT2
ggcuuuaugcacgccg

SEQ ID NO: 1831853 - RNA, 18 nt, Salmonella typhimurium LT2
ggcuuguaggccggauaa

SEQ ID NO: 1831854 - RNA, 18 nt, Salmonella typhimurium LT2
gggaaaagguuccggcga

SEQ ID NO: 1831855 - RNA, 19 nt, Salmonella typhimurium LT2
ggcuuaguaggcuggcgac

SEQ ID NO: 1831856 - RNA, 18 nt, Salmonella typhimurium LT2
ggcuuaacacccggauau

SEQ ID NO: 1831857 - RNA, 18 nt, Salmonella typhimurium LT2
ggcuuaaugcgcacgcca

SEQ ID NO: 1831858 - RNA, 22 nt, Salmonella typhimurium LT2
ggcuguuuugcuucuucagccu

SEQ ID NO: 1831859 - RNA, 16 nt, Salmonella typhimurium LT2
ggcuggacgucaugcc

SEQ ID NO: 1831860 - RNA, 20 nt, Salmonella typhimurium LT2
gguucgccgcgcgcauaggc

SEQ ID NO: 1831861 - RNA, 12 nt, Salmonella typhimurium LT2
gguucgccuucc

SEQ ID NO: 1831862 - RNA, 18 nt, Salmonella typhimurium LT2
gguucccgagcggccaaa

SEQ ID NO: 1831863 - RNA, 13 nt, Salmonella typhimurium LT2
gguuccaggcacu

SEQ ID NO: 1831864 - RNA, 13 nt, Salmonella typhimurium LT2
gguucaucgccac

SEQ ID NO: 1831865 - RNA, 14 nt, Salmonella typhimurium LT2
gguuauccagcagc

SEQ ID NO: 1831866 - RNA, 16 nt, Salmonella typhimurium LT2
gguuauaccgccaucc

SEQ ID NO: 1831867 - RNA, 20 nt, Salmonella typhimurium LT2
gguuaacccacaacgcacca

SEQ ID NO: 1831868 - RNA, 14 nt, Salmonella typhimurium LT2
gguuacgcgacgug

SEQ ID NO: 1831869 - RNA, 23 nt, Salmonella typhimurium LT2
gguguuuacgccgccauccggca

SEQ ID NO: 1831870 - RNA, 17 nt, Salmonella typhimurium LT2
gguugcgcgcuggauca

SEQ ID NO: 1831871 - RNA, 15 nt, Salmonella typhimurium LT2
gguugcccggcgcca

SEQ ID NO: 1831872 - RNA, 17 nt, Salmonella typhimurium LT2
gguuucacgcucuucgc

SEQ ID NO: 1831873 - RNA, 18 nt, Salmonella typhimurium LT2
gguuuacguagcagcgcg

SEQ ID NO: 1831874 - RNA, 23 nt, Salmonella typhimurium LT2
gguugucaaauuugcugccaucg

SEQ ID NO: 1831875 - RNA, 14 nt, Salmonella typhimurium LT2
ggugucaaagcgcc

SEQ ID NO: 1831876 - RNA, 15 nt, Salmonella typhimurium LT2
ggugauggagccuuc

SEQ ID NO: 1831877 - RNA, 13 nt, Salmonella typhimurium LT2
gguggcgcugcgc

SEQ ID NO: 1831878 - RNA, 18 nt, Salmonella typhimurium LT2
guacuuucuccugggaua

SEQ ID NO: 1831879 - RNA, 22 nt, Salmonella typhimurium LT2
guacuuuucauccacagcgcca

SEQ ID NO: 1831880 - RNA, 21 nt, Salmonella typhimurium LT2
guacuuguugcuggcaggcca

SEQ ID NO: 1831881 - RNA, 18 nt, Salmonella typhimurium LT2
guagagcggauaagcgca

SEQ ID NO: 1831882 - RNA, 13 nt, Salmonella typhimurium LT2
guagccgcgccag

SEQ ID NO: 1831883 - RNA, 19 nt, Salmonella typhimurium LT2
guagccgcaaaugccaucc

SEQ ID NO: 1831884 - RNA, 16 nt, Salmonella typhimurium LT2
guagcccgcuuuaccg

SEQ ID NO: 1831885 - RNA, 14 nt, Salmonella typhimurium LT2
guagcgucaccggc

SEQ ID NO: 1831886 - RNA, 17 nt, Salmonella typhimurium LT2
guauacagacagcagau

SEQ ID NO: 1831887 - RNA, 14 nt, Salmonella typhimurium LT2
guauagccaggcag

SEQ ID NO: 1831888 - RNA, 12 nt, Salmonella typhimurium LT2
guaggccggaua

SEQ ID NO: 1831889 - RNA, 19 nt, Salmonella typhimurium LT2
guaggccggauaaggcgcu

SEQ ID NO: 1831890 - RNA, 13 nt, Salmonella typhimurium LT2
guaggccggauaa

SEQ ID NO: 1831891 - RNA, 19 nt, Salmonella typhimurium LT2
guaggccggauaagcgcag

SEQ ID NO: 1831892 - RNA, 19 nt, Salmonella typhimurium LT2
guaggcaggauaaggcguu

SEQ ID NO: 1831893 - RNA, 20 nt, Salmonella typhimurium LT2
guaggccggauuaaggcguu

SEQ ID NO: 1831894 - RNA, 19 nt, Salmonella typhimurium LT2
guaggccggauaaggcguu

SEQ ID NO: 1831895 - RNA, 19 nt, Salmonella typhimurium LT2
guaggccugauaagcguag

SEQ ID NO: 1831896 - RNA, 18 nt, Salmonella typhimurium LT2
guaggccugauaagcgca

SEQ ID NO: 1831897 - RNA, 19 nt, Salmonella typhimurium LT2
guaggccugauaagcgcag

SEQ ID NO: 1831898 - RNA, 20 nt, Salmonella typhimurium LT2
guaacgcaacucaucgucau

SEQ ID NO: 1831899 - RNA, 21 nt, Salmonella typhimurium LT2
guaaccggccagccugcgcca

SEQ ID NO: 1831900 - RNA, 23 nt, Salmonella typhimurium LT2
guaacgugcgguauaucacgcca

SEQ ID NO: 1831901 - RNA, 21 nt, Salmonella typhimurium LT2
guaacgguguuucaucuucau

SEQ ID NO: 1831902 - RNA, 14 nt, Salmonella typhimurium LT2
guaacguagcaauc

SEQ ID NO: 1831903 - RNA, 22 nt, Salmonella typhimurium LT2
guaauucucacagaaucaucag

SEQ ID NO: 1831904 - RNA, 17 nt, Salmonella typhimurium LT2
guaauugacgcgucagg

SEQ ID NO: 1831905 - RNA, 18 nt, Salmonella typhimurium LT2
guaauugaggauugccgc

SEQ ID NO: 1831906 - RNA, 19 nt, Salmonella typhimurium LT2
guaauugccauuacgauaa

SEQ ID NO: 1831907 - RNA, 24 nt, Salmonella typhimurium LT2
guaaugacuggcuuugcgccacuu

SEQ ID NO: 1831908 - RNA, 12 nt, Salmonella typhimurium LT2
guaaacgucggc

SEQ ID NO: 1831909 - RNA, 18 nt, Salmonella typhimurium LT2
guaaacuggauaagcgca

SEQ ID NO: 1831910 - RNA, 15 nt, Salmonella typhimurium LT2
guaaacgcgccaucg

SEQ ID NO: 1831911 - RNA, 18 nt, Salmonella typhimurium LT2
guaaacggcagccgccac

SEQ ID NO: 1831912 - RNA, 20 nt, Salmonella typhimurium LT2
guaaaccguguuccagcgcc

SEQ ID NO: 1831913 - RNA, 20 nt, Salmonella typhimurium LT2
guaaauuuguuuaaucauaa

SEQ ID NO: 1831914 - RNA, 19 nt, Salmonella typhimurium LT2
guaacauaaaagcgauuua

SEQ ID NO: 1831915 - RNA, 17 nt, Salmonella typhimurium LT2
guaacaccgcggcgcuc

SEQ ID NO: 1831916 - RNA, 21 nt, Salmonella typhimurium LT2
guaaacaugcuggaugacaaa

SEQ ID NO: 1831917 - RNA, 15 nt, Salmonella typhimurium LT2
gguuucaucgccgau

SEQ ID NO: 1831918 - RNA, 12 nt, Salmonella typhimurium LT2
guaccggcaggu

SEQ ID NO: 1831919 - RNA, 14 nt, Salmonella typhimurium LT2
guaccagcgcgaac

SEQ ID NO: 1831920 - RNA, 17 nt, Salmonella typhimurium LT2
guaccagcaacgccagc

SEQ ID NO: 1831921 - RNA, 15 nt, Salmonella typhimurium LT2
guacgcaagcguaag

SEQ ID NO: 1831922 - RNA, 15 nt, Salmonella typhimurium LT2
guacgcccggcgggu

SEQ ID NO: 1831923 - RNA, 18 nt, Salmonella typhimurium LT2
guacgccucuuucagccg

SEQ ID NO: 1831924 - RNA, 15 nt, Salmonella typhimurium LT2
guacgcgcgcggcgu

SEQ ID NO: 1831925 - RNA, 16 nt, Salmonella typhimurium LT2
guacuccaggcgcugc

SEQ ID NO: 1831926 - RNA, 18 nt, Salmonella typhimurium LT2
guacgcugacgaagauua

SEQ ID NO: 1831927 - RNA, 18 nt, Salmonella typhimurium LT2
guacggccaccaggccug

SEQ ID NO: 1831928 - RNA, 13 nt, Salmonella typhimurium LT2
guacggauggcgu

SEQ ID NO: 1831929 - RNA, 12 nt, Salmonella typhimurium LT2
ggugaagacgcu

SEQ ID NO: 1831930 - RNA, 19 nt, Salmonella typhimurium LT2
ggucgucugaaagcgacuc

SEQ ID NO: 1831931 - RNA, 24 nt, Salmonella typhimurium LT2
ggugacuuccugauccgccuuacg

SEQ ID NO: 1831932 - RNA, 16 nt, Salmonella typhimurium LT2
ggugacugucgagaug

SEQ ID NO: 1831933 - RNA, 23 nt, Salmonella typhimurium LT2
ggucgcguccggggccagcgcca

SEQ ID NO: 1831934 - RNA, 14 nt, Salmonella typhimurium LT2
ggucggcgcauggc

SEQ ID NO: 1831935 - RNA, 13 nt, Salmonella typhimurium LT2
ggucgucaucggc

SEQ ID NO: 1831936 - RNA, 11 nt, Salmonella typhimurium LT2
ggucguccagu

SEQ ID NO: 1831937 - RNA, 16 nt, Salmonella typhimurium LT2
gguaguguuaucgccg

SEQ ID NO: 1831938 - RNA, 21 nt, Salmonella typhimurium LT2
ggucagggugaaucccgccau

SEQ ID NO: 1831939 - RNA, 16 nt, Salmonella typhimurium LT2
ggucaucgcccaugac

SEQ ID NO: 1831940 - RNA, 17 nt, Salmonella typhimurium LT2
ggucaucgcccaugaca

SEQ ID NO: 1831941 - RNA, 13 nt, Salmonella typhimurium LT2
ggucgacgccuua

SEQ ID NO: 1831942 - RNA, 21 nt, Salmonella typhimurium LT2
ggguaaaugcgcgcggcugcc

SEQ ID NO: 1831943 - RNA, 17 nt, Salmonella typhimurium LT2
ggguaaacgcagcguca

SEQ ID NO: 1831944 - RNA, 20 nt, Salmonella typhimurium LT2
gggucacgauaaccaggucg

SEQ ID NO: 1831945 - RNA, 17 nt, Salmonella typhimurium LT2
gggaacuagcgaaucac

SEQ ID NO: 1831946 - RNA, 14 nt, Salmonella typhimurium LT2
gggguguuacgcca

SEQ ID NO: 1831947 - RNA, 16 nt, Salmonella typhimurium LT2
gguacgcaucaccagg

SEQ ID NO: 1831948 - RNA, 22 nt, Salmonella typhimurium LT2
gguacuuuucauccacagcgcc

SEQ ID NO: 1831949 - RNA, 17 nt, Salmonella typhimurium LT2
gguagacaaacagcgcg

SEQ ID NO: 1831950 - RNA, 20 nt, Salmonella typhimurium LT2
ggguuuaaugcagaaaccgg

SEQ ID NO: 1831951 - RNA, 22 nt, Salmonella typhimurium LT2
ggguuucccccuccauacccua

SEQ ID NO: 1831952 - RNA, 19 nt, Salmonella typhimurium LT2
ggguuugccagcaccagca

SEQ ID NO: 1831953 - RNA, 19 nt, Salmonella typhimurium LT2
ggguuuguaggccggguaa

SEQ ID NO: 1831954 - RNA, 18 nt, Salmonella typhimurium LT2
ggguuugaccgccggaaa

SEQ ID NO: 1831955 - RNA, 17 nt, Salmonella typhimurium LT2
gguaaaauugccgccaa

SEQ ID NO: 1831956 - RNA, 15 nt, Salmonella typhimurium LT2
gguaauuugcgccau

SEQ ID NO: 1831957 - RNA, 14 nt, Salmonella typhimurium LT2
gggucugaauagcg

SEQ ID NO: 1831958 - RNA, 23 nt, Salmonella typhimurium LT2
gggucgguuucaguucguagagc

SEQ ID NO: 1831959 - RNA, 15 nt, Salmonella typhimurium LT2
guccagaugcgccag

SEQ ID NO: 1831960 - RNA, 20 nt, Salmonella typhimurium LT2
guccagauggcgguucgcca

SEQ ID NO: 1831961 - RNA, 14 nt, Salmonella typhimurium LT2
gucauuaaagcgcu

SEQ ID NO: 1831962 - RNA, 17 nt, Salmonella typhimurium LT2
gucauuaagaaacugag

SEQ ID NO: 1831963 - RNA, 15 nt, Salmonella typhimurium LT2
guccacaaacgccgg

SEQ ID NO: 1831964 - RNA, 22 nt, Salmonella typhimurium LT2
gucauggcgccaccagcgauuu

SEQ ID NO: 1831965 - RNA, 23 nt, Salmonella typhimurium LT2
gucaucgucugcgucuucuucca

SEQ ID NO: 1831966 - RNA, 21 nt, Salmonella typhimurium LT2
gucaugccuuuuuuaccaauu

SEQ ID NO: 1831967 - RNA, 12 nt, Salmonella typhimurium LT2
gucaugcgccac

SEQ ID NO: 1831968 - RNA, 20 nt, Salmonella typhimurium LT2
gucauaauacucaauauccu

SEQ ID NO: 1831969 - RNA, 20 nt, Salmonella typhimurium LT2
gucaguguuuccauacauuu

SEQ ID NO: 1831970 - RNA, 22 nt, Salmonella typhimurium LT2
gucaggacguuauuaagcgaau

SEQ ID NO: 1831971 - RNA, 17 nt, Salmonella typhimurium LT2
guccauuucuugcauca

SEQ ID NO: 1831972 - RNA, 14 nt, Salmonella typhimurium LT2
guccaugcaugacg

SEQ ID NO: 1831973 - RNA, 17 nt, Salmonella typhimurium LT2
gucccccagggaugcgc

SEQ ID NO: 1831974 - RNA, 20 nt, Salmonella typhimurium LT2
gucccccagggaugcgccac

SEQ ID NO: 1831975 - RNA, 19 nt, Salmonella typhimurium LT2
gucccaccagcgcggcaca

SEQ ID NO: 1831976 - RNA, 14 nt, Salmonella typhimurium LT2
guccagcggcagcu

SEQ ID NO: 1831977 - RNA, 12 nt, Salmonella typhimurium LT2
guccgccagcgu

SEQ ID NO: 1831978 - RNA, 14 nt, Salmonella typhimurium LT2
guccggcggcagcc

SEQ ID NO: 1831979 - RNA, 17 nt, Salmonella typhimurium LT2
gucgaccauacgcagca

SEQ ID NO: 1831980 - RNA, 23 nt, Salmonella typhimurium LT2
gucgaacugaauggucggcugcu

SEQ ID NO: 1831981 - RNA, 23 nt, Salmonella typhimurium LT2
guccgggcuccauagggcagggu

SEQ ID NO: 1831982 - RNA, 18 nt, Salmonella typhimurium LT2
gucgcaaucuggcgcaau

SEQ ID NO: 1831983 - RNA, 22 nt, Salmonella typhimurium LT2
gucgccagaauguuauaaccga

SEQ ID NO: 1831984 - RNA, 17 nt, Salmonella typhimurium LT2
gucgccccaaucgccag

SEQ ID NO: 1831985 - RNA, 17 nt, Salmonella typhimurium LT2
gucgccaccugcguggu

SEQ ID NO: 1831986 - RNA, 21 nt, Salmonella typhimurium LT2
gucgcacuucgcguuagccgg

SEQ ID NO: 1831987 - RNA, 16 nt, Salmonella typhimurium LT2
gucgccggggcgcugg

SEQ ID NO: 1831988 - RNA, 13 nt, Salmonella typhimurium LT2
gucgcgccagcga

SEQ ID NO: 1831989 - RNA, 10 nt, Salmonella typhimurium LT2
gucgccuucg

SEQ ID NO: 1831990 - RNA, 13 nt, Salmonella typhimurium LT2
gucgcgcucgcca

SEQ ID NO: 1831991 - RNA, 16 nt, Salmonella typhimurium LT2
gucgcgccgugcccag

SEQ ID NO: 1831992 - RNA, 19 nt, Salmonella typhimurium LT2
gucucgcacucgccgccaa

SEQ ID NO: 1831993 - RNA, 15 nt, Salmonella typhimurium LT2
gucugauggcgcugc

SEQ ID NO: 1831994 - RNA, 20 nt, Salmonella typhimurium LT2
gucugauaagcgcagcgcca

SEQ ID NO: 1831995 - RNA, 18 nt, Salmonella typhimurium LT2
gucugcccgcgccaucca

SEQ ID NO: 1831996 - RNA, 16 nt, Salmonella typhimurium LT2
gucucaaucgcaaauu

SEQ ID NO: 1831997 - RNA, 17 nt, Salmonella typhimurium LT2
gucuacacuuugcgccg

SEQ ID NO: 1831998 - RNA, 16 nt, Salmonella typhimurium LT2
gucugcgcgccggaac

SEQ ID NO: 1831999 - RNA, 20 nt, Salmonella typhimurium LT2
gucugcuguaggccggauaa

SEQ ID NO: 1832000 - RNA, 20 nt, Salmonella typhimurium LT2
gucugucaaaacccagccca

SEQ ID NO: 1832001 - RNA, 16 nt, Salmonella typhimurium LT2
gucugguaaacgcaau

SEQ ID NO: 1832002 - RNA, 20 nt, Salmonella typhimurium LT2
gugaaaagcgggggcgacag

SEQ ID NO: 1832003 - RNA, 18 nt, Salmonella typhimurium LT2
gugaaaaaugacgccggg

SEQ ID NO: 1832004 - RNA, 15 nt, Salmonella typhimurium LT2
gucuuuuacacugau

SEQ ID NO: 1832005 - RNA, 21 nt, Salmonella typhimurium LT2
gucuugauagcgaucagcgcc

SEQ ID NO: 1832006 - RNA, 11 nt, Salmonella typhimurium LT2
gucuugccagc

SEQ ID NO: 1832007 - RNA, 17 nt, Salmonella typhimurium LT2
gucuuauccggccugca

SEQ ID NO: 1832008 - RNA, 15 nt, Salmonella typhimurium LT2
gucuucccgcaaacu

SEQ ID NO: 1832009 - RNA, 18 nt, Salmonella typhimurium LT2
gucuucagcaauuacccg

SEQ ID NO: 1832010 - RNA, 20 nt, Salmonella typhimurium LT2
gucuuauuucuccugcgcca

SEQ ID NO: 1832011 - RNA, 13 nt, Salmonella typhimurium LT2
gucuucugccagc

SEQ ID NO: 1832012 - RNA, 14 nt, Salmonella typhimurium LT2
gugaacugcgccug

SEQ ID NO: 1832013 - RNA, 16 nt, Salmonella typhimurium LT2
gugaaccggacgcuuc

SEQ ID NO: 1832014 - RNA, 14 nt, Salmonella typhimurium LT2
gugacguucaucau

SEQ ID NO: 1832015 - RNA, 13 nt, Salmonella typhimurium LT2
gugaccgccuucg

SEQ ID NO: 1832016 - RNA, 23 nt, Salmonella typhimurium LT2
gucgggaagagagaaaaucggcg

SEQ ID NO: 1832017 - RNA, 19 nt, Salmonella typhimurium LT2
gucggcuuuuuuaugcccc

SEQ ID NO: 1832018 - RNA, 21 nt, Salmonella typhimurium LT2
gucggccuuuuugcgccgcga

SEQ ID NO: 1832019 - RNA, 14 nt, Salmonella typhimurium LT2
gucgucacgcccgu

SEQ ID NO: 1832020 - RNA, 19 nt, Salmonella typhimurium LT2
gucgugagcaaccaacgcg

SEQ ID NO: 1832021 - RNA, 14 nt, Salmonella typhimurium LT2
gucgucuucauccc

SEQ ID NO: 1832022 - RNA, 19 nt, Salmonella typhimurium LT2
gucgugcgguaccgcguua

SEQ ID NO: 1832023 - RNA, 20 nt, Salmonella typhimurium LT2
gucgugaguggcggcacgca

SEQ ID NO: 1832024 - RNA, 15 nt, Salmonella typhimurium LT2
gucguugcgccguaa

SEQ ID NO: 1832025 - RNA, 21 nt, Salmonella typhimurium LT2
gucguuagccagauggcugca

SEQ ID NO: 1832026 - RNA, 23 nt, Salmonella typhimurium LT2
cgccgcaggccaucauaccgcca

SEQ ID NO: 1832027 - RNA, 18 nt, Salmonella typhimurium LT2
cgccgcaggccaucauac

SEQ ID NO: 1832028 - RNA, 18 nt, Salmonella typhimurium LT2
cgccgcaggacagcgaca

SEQ ID NO: 1832029 - RNA, 16 nt, Salmonella typhimurium LT2
cgccgcaucauacaua

SEQ ID NO: 1832030 - RNA, 20 nt, Salmonella typhimurium LT2
cgccgcagccugauggcgac

SEQ ID NO: 1832031 - RNA, 12 nt, Salmonella typhimurium LT2
cgccgcacagaa

SEQ ID NO: 1832032 - RNA, 17 nt, Salmonella typhimurium LT2
cgccgcacacagcggaa

SEQ ID NO: 1832033 - RNA, 14 nt, Salmonella typhimurium LT2
cgccgcacacgccg

SEQ ID NO: 1832034 - RNA, 15 nt, Salmonella typhimurium LT2
cgccgcacaucggca

SEQ ID NO: 1832035 - RNA, 21 nt, Salmonella typhimurium LT2
cgccgaucagcaccacgcccg

SEQ ID NO: 1832036 - RNA, 20 nt, Salmonella typhimurium LT2
cgccgcaaacuccaccacgu

SEQ ID NO: 1832037 - RNA, 21 nt, Salmonella typhimurium LT2
cgcccagcacuaacagcagca

SEQ ID NO: 1832038 - RNA, 22 nt, Salmonella typhimurium LT2
cgccgacugccaccgucgcggc

SEQ ID NO: 1832039 - RNA, 15 nt, Salmonella typhimurium LT2
cgccgauaaucggcg

SEQ ID NO: 1832040 - RNA, 14 nt, Salmonella typhimurium LT2
cgccgauagcggcg

SEQ ID NO: 1832041 - RNA, 15 nt, Salmonella typhimurium LT2
cgccgccaugacgca

SEQ ID NO: 1832042 - RNA, 12 nt, Salmonella typhimurium LT2
cgccgccauccg

SEQ ID NO: 1832043 - RNA, 17 nt, Salmonella typhimurium LT2
cgccgccauccggcaca

SEQ ID NO: 1832044 - RNA, 14 nt, Salmonella typhimurium LT2
cgccgccauccggc

SEQ ID NO: 1832045 - RNA, 16 nt, Salmonella typhimurium LT2
cgccgccauccggcaa

SEQ ID NO: 1832046 - RNA, 16 nt, Salmonella typhimurium LT2
cgccgccauccggcac

SEQ ID NO: 1832047 - RNA, 12 nt, Salmonella typhimurium LT2
cgccgcccauca

SEQ ID NO: 1832048 - RNA, 20 nt, Salmonella typhimurium LT2
cgccgcccaaugcggcuuua

SEQ ID NO: 1832049 - RNA, 14 nt, Salmonella typhimurium LT2
cgccgccagcgucu

SEQ ID NO: 1832050 - RNA, 13 nt, Salmonella typhimurium LT2
cgccgccagccau

SEQ ID NO: 1832051 - RNA, 21 nt, Salmonella typhimurium LT2
cgccgccaccauguugcgcag

SEQ ID NO: 1832052 - RNA, 12 nt, Salmonella typhimurium LT2
cgccgccaccaa

SEQ ID NO: 1832053 - RNA, 14 nt, Salmonella typhimurium LT2
cgccgccaacgcca

SEQ ID NO: 1832054 - RNA, 14 nt, Salmonella typhimurium LT2
cgccgccgccaucg

SEQ ID NO: 1832055 - RNA, 14 nt, Salmonella typhimurium LT2
cgccgccugcgcca

SEQ ID NO: 1832056 - RNA, 20 nt, Salmonella typhimurium LT2
cgccgccucuucaaacggca

SEQ ID NO: 1832057 - RNA, 18 nt, Salmonella typhimurium LT2
cgccgcccugcaucaugc

SEQ ID NO: 1832058 - RNA, 18 nt, Salmonella typhimurium LT2
cgccgcgccuaccagcgc

SEQ ID NO: 1832059 - RNA, 16 nt, Salmonella typhimurium LT2
cgccgcgcuggauagc

SEQ ID NO: 1832060 - RNA, 22 nt, Salmonella typhimurium LT2
cgccgcgauacggauagcguca

SEQ ID NO: 1832061 - RNA, 17 nt, Salmonella typhimurium LT2
cgccgcuacugccgcca

SEQ ID NO: 1832062 - RNA, 17 nt, Salmonella typhimurium LT2
cgccgcuaucgccgacc

SEQ ID NO: 1832063 - RNA, 19 nt, Salmonella typhimurium LT2
cgccgcuccguacgcguca

SEQ ID NO: 1832064 - RNA, 18 nt, Salmonella typhimurium LT2
cgccgcucuucagcgucc

SEQ ID NO: 1832065 - RNA, 16 nt, Salmonella typhimurium LT2
cgccggaacccgcgac

SEQ ID NO: 1832066 - RNA, 24 nt, Salmonella typhimurium LT2
cgccggaaagcuggucgagauacu

SEQ ID NO: 1832067 - RNA, 13 nt, Salmonella typhimurium LT2
cgccgcugcguau

SEQ ID NO: 1832068 - RNA, 23 nt, Salmonella typhimurium LT2
cgccggacaguucgccaacgcgu

SEQ ID NO: 1832069 - RNA, 13 nt, Salmonella typhimurium LT2
cgccggccuguua

SEQ ID NO: 1832070 - RNA, 21 nt, Salmonella typhimurium LT2
cgccggcagacgauagcgggu

SEQ ID NO: 1832071 - RNA, 19 nt, Salmonella typhimurium LT2
cgccggauggcgacgcgua

SEQ ID NO: 1832072 - RNA, 20 nt, Salmonella typhimurium LT2
aacacgccgacucacgcagc

SEQ ID NO: 1832073 - RNA, 23 nt, Salmonella typhimurium LT2
aacacgaugaugucauaaucgcc

SEQ ID NO: 1832074 - RNA, 16 nt, Salmonella typhimurium LT2
cgccgggcuauccggc

SEQ ID NO: 1832075 - RNA, 20 nt, Salmonella typhimurium LT2
cgccggucaugccaucccgc

SEQ ID NO: 1832076 - RNA, 13 nt, Salmonella typhimurium LT2
cgccgucaggcua

SEQ ID NO: 1832077 - RNA, 21 nt, Salmonella typhimurium LT2
cgccuguuugacgaaaucgca

SEQ ID NO: 1832078 - RNA, 20 nt, Salmonella typhimurium LT2
cgccuuacccggccuacaca

SEQ ID NO: 1832079 - RNA, 14 nt, Salmonella typhimurium LT2
cgccuuacguaccg

SEQ ID NO: 1832080 - RNA, 16 nt, Salmonella typhimurium LT2
cgccuuaucaggccug

SEQ ID NO: 1832081 - RNA, 20 nt, Salmonella typhimurium LT2
cgccuuauccgaccuacaag

SEQ ID NO: 1832082 - RNA, 20 nt, Salmonella typhimurium LT2
cgccuuauccggccuacaac

SEQ ID NO: 1832083 - RNA, 15 nt, Salmonella typhimurium LT2
cgccuuauccggccu

SEQ ID NO: 1832084 - RNA, 18 nt, Salmonella typhimurium LT2
cgccuuauccggccuacg

SEQ ID NO: 1832085 - RNA, 19 nt, Salmonella typhimurium LT2
cgccuuauccugccuacag

SEQ ID NO: 1832086 - RNA, 23 nt, Salmonella typhimurium LT2
cgccuucaggcaucagauaaaca

SEQ ID NO: 1832087 - RNA, 18 nt, Salmonella typhimurium LT2
cgccuucagugauaaagc

SEQ ID NO: 1832088 - RNA, 20 nt, Salmonella typhimurium LT2
cgccugugcuuucgccacca

SEQ ID NO: 1832089 - RNA, 23 nt, Salmonella typhimurium LT2
cgccugugcuuucgccaccagcg

SEQ ID NO: 1832090 - RNA, 14 nt, Salmonella typhimurium LT2
cgccuguagcguaa

SEQ ID NO: 1832091 - RNA, 19 nt, Salmonella typhimurium LT2
cgccuggcaguucagucgg

SEQ ID NO: 1832092 - RNA, 19 nt, Salmonella typhimurium LT2
cgccuggaugacgaacagg

SEQ ID NO: 1832093 - RNA, 18 nt, Salmonella typhimurium LT2
cgccugggauaagcagaa

SEQ ID NO: 1832094 - RNA, 17 nt, Salmonella typhimurium LT2
cgccugggauagcgcug

SEQ ID NO: 1832095 - RNA, 19 nt, Salmonella typhimurium LT2
cgccuggcgaaacgccuga

SEQ ID NO: 1832096 - RNA, 17 nt, Salmonella typhimurium LT2
cgccuggcggcagaccg

SEQ ID NO: 1832097 - RNA, 18 nt, Salmonella typhimurium LT2
cgccuggcggcagaccgc

SEQ ID NO: 1832098 - RNA, 22 nt, Salmonella typhimurium LT2
cgccuccaccguuugcagccag

SEQ ID NO: 1832099 - RNA, 19 nt, Salmonella typhimurium LT2
cgccuccggccugccuggu

SEQ ID NO: 1832100 - RNA, 15 nt, Salmonella typhimurium LT2
cgccugaucgcgcag

SEQ ID NO: 1832101 - RNA, 17 nt, Salmonella typhimurium LT2
cgccugaugcugcgcau

SEQ ID NO: 1832102 - RNA, 19 nt, Salmonella typhimurium LT2
cgccugauaaaacgcaggc

SEQ ID NO: 1832103 - RNA, 20 nt, Salmonella typhimurium LT2
cgccuuucgcgaccaccagg

SEQ ID NO: 1832104 - RNA, 17 nt, Salmonella typhimurium LT2
cgccuuuacgcccggua

SEQ ID NO: 1832105 - RNA, 20 nt, Salmonella typhimurium LT2
cgccuuuuuucaccggcacc

SEQ ID NO: 1832106 - RNA, 16 nt, Salmonella typhimurium LT2
cgcgaacgccaggcca

SEQ ID NO: 1832107 - RNA, 16 nt, Salmonella typhimurium LT2
cgccuuccugcaggcg

SEQ ID NO: 1832108 - RNA, 21 nt, Salmonella typhimurium LT2
cgccuucucgauuucacgaua

SEQ ID NO: 1832109 - RNA, 19 nt, Salmonella typhimurium LT2
cgccuugaggcguuuuagc

SEQ ID NO: 1832110 - RNA, 17 nt, Salmonella typhimurium LT2
cgccuuguugcggauga

SEQ ID NO: 1832111 - RNA, 15 nt, Salmonella typhimurium LT2
cgccuugcgauaacc

SEQ ID NO: 1832112 - RNA, 22 nt, Salmonella typhimurium LT2
cgcgaauagugauaccagccaa

SEQ ID NO: 1832113 - RNA, 13 nt, Salmonella typhimurium LT2
cgcgaagcggcgc

SEQ ID NO: 1832114 - RNA, 19 nt, Salmonella typhimurium LT2
cgcgaauuaugacgggaaa

SEQ ID NO: 1832115 - RNA, 21 nt, Salmonella typhimurium LT2
cgcgaaucgacaauccgccac

SEQ ID NO: 1832116 - RNA, 13 nt, Salmonella typhimurium LT2
cgcgaauccgcca

SEQ ID NO: 1832117 - RNA, 17 nt, Salmonella typhimurium LT2
cgcgacccauugccgga

SEQ ID NO: 1832118 - RNA, 21 nt, Salmonella typhimurium LT2
cgcgaccagcgugaccgguaa

SEQ ID NO: 1832119 - RNA, 13 nt, Salmonella typhimurium LT2
cgcgaccgcauca

SEQ ID NO: 1832120 - RNA, 18 nt, Salmonella typhimurium LT2
cgcgaccgcaucaaugcc

SEQ ID NO: 1832121 - RNA, 14 nt, Salmonella typhimurium LT2
cgcgacauggcgaa

SEQ ID NO: 1832122 - RNA, 16 nt, Salmonella typhimurium LT2
cgcgacauggcgguaa

SEQ ID NO: 1832123 - RNA, 17 nt, Salmonella typhimurium LT2
cgcgaccaacagcauca

SEQ ID NO: 1832124 - RNA, 16 nt, Salmonella typhimurium LT2
cgcgcccgacgcgcca

SEQ ID NO: 1832125 - RNA, 17 nt, Salmonella typhimurium LT2
cgcgcccgccaccagca

SEQ ID NO: 1832126 - RNA, 14 nt, Salmonella typhimurium LT2
cgcgccgcgcagca

SEQ ID NO: 1832127 - RNA, 13 nt, Salmonella typhimurium LT2
cgcgccagcgaca

SEQ ID NO: 1832128 - RNA, 13 nt, Salmonella typhimurium LT2
cgcgccaucuuuc

SEQ ID NO: 1832129 - RNA, 13 nt, Salmonella typhimurium LT2
cgcgccaugauuc

SEQ ID NO: 1832130 - RNA, 13 nt, Salmonella typhimurium LT2
cgcgccagcgcca

SEQ ID NO: 1832131 - RNA, 17 nt, Salmonella typhimurium LT2
cgcgccacuucuuugac

SEQ ID NO: 1832132 - RNA, 12 nt, Salmonella typhimurium LT2
cgcgcaggcgau

SEQ ID NO: 1832133 - RNA, 15 nt, Salmonella typhimurium LT2
cgcgcaucaacgcca

SEQ ID NO: 1832134 - RNA, 12 nt, Salmonella typhimurium LT2
cgcgccacgcca

SEQ ID NO: 1832135 - RNA, 16 nt, Salmonella typhimurium LT2
cgcgcagaaucagcgu

SEQ ID NO: 1832136 - RNA, 15 nt, Salmonella typhimurium LT2
cgcgcagacuugaau

SEQ ID NO: 1832137 - RNA, 22 nt, Salmonella typhimurium LT2
cgcgauccagccccagcgccag

SEQ ID NO: 1832138 - RNA, 15 nt, Salmonella typhimurium LT2
cgcggauugccgccc

SEQ ID NO: 1832139 - RNA, 22 nt, Salmonella typhimurium LT2
cgcggaucgugauaacgcgaug

SEQ ID NO: 1832140 - RNA, 17 nt, Salmonella typhimurium LT2
cgcggaucgugauaacg

SEQ ID NO: 1832141 - RNA, 19 nt, Salmonella typhimurium LT2
cgcggcagcgcugcggaua

SEQ ID NO: 1832142 - RNA, 14 nt, Salmonella typhimurium LT2
cgcggcagccggaa

SEQ ID NO: 1832143 - RNA, 17 nt, Salmonella typhimurium LT2
cgcggcauuaaaugcgc

SEQ ID NO: 1832144 - RNA, 15 nt, Salmonella typhimurium LT2
cgcggcauuaaaugc

SEQ ID NO: 1832145 - RNA, 16 nt, Salmonella typhimurium LT2
cgcgcuguaacuucac

SEQ ID NO: 1832146 - RNA, 19 nt, Salmonella typhimurium LT2
cgcggauagacgauauagc

SEQ ID NO: 1832147 - RNA, 19 nt, Salmonella typhimurium LT2
cgcggaccuuuugccgccc

SEQ ID NO: 1832148 - RNA, 13 nt, Salmonella typhimurium LT2
cgcggacagcaga

SEQ ID NO: 1832149 - RNA, 13 nt, Salmonella typhimurium LT2
cgcggcguaccgc

SEQ ID NO: 1832150 - RNA, 20 nt, Salmonella typhimurium LT2
cgcggcugguaacaguccgu

SEQ ID NO: 1832151 - RNA, 22 nt, Salmonella typhimurium LT2
aacagccauaaugcugccagca

SEQ ID NO: 1832152 - RNA, 23 nt, Salmonella typhimurium LT2
aacagccauaaugcugccagcau

SEQ ID NO: 1832153 - RNA, 16 nt, Salmonella typhimurium LT2
cgcggccaucacgcug

SEQ ID NO: 1832154 - RNA, 15 nt, Salmonella typhimurium LT2
cgcggcgaaccggca

SEQ ID NO: 1832155 - RNA, 18 nt, Salmonella typhimurium LT2
cgcgucgcagguuaucgg

SEQ ID NO: 1832156 - RNA, 15 nt, Salmonella typhimurium LT2
cgcuaaaaaacaggc

SEQ ID NO: 1832157 - RNA, 23 nt, Salmonella typhimurium LT2
cgcguucgaccguuuccgccagu

SEQ ID NO: 1832158 - RNA, 12 nt, Salmonella typhimurium LT2
cgcuccggcagg

SEQ ID NO: 1832159 - RNA, 23 nt, Salmonella typhimurium LT2
cgcuccguacgcgucacaaucgc

SEQ ID NO: 1832160 - RNA, 16 nt, Salmonella typhimurium LT2
cgcucaggaucgccgg

SEQ ID NO: 1832161 - RNA, 23 nt, Salmonella typhimurium LT2
cgcucagguuguccagcagcagc

SEQ ID NO: 1832162 - RNA, 12 nt, Salmonella typhimurium LT2
cgcuccagggcu

SEQ ID NO: 1832163 - RNA, 18 nt, Salmonella typhimurium LT2
cgcucaggagcgccugac

SEQ ID NO: 1832164 - RNA, 22 nt, Salmonella typhimurium LT2
cgcucagaacaauaucgauagc

SEQ ID NO: 1832165 - RNA, 18 nt, Salmonella typhimurium LT2
cgcuacaauccaggacgu

SEQ ID NO: 1832166 - RNA, 21 nt, Salmonella typhimurium LT2
cgcuaacgucgccaucaggcg

SEQ ID NO: 1832167 - RNA, 13 nt, Salmonella typhimurium LT2
cgcuaaucaucag

SEQ ID NO: 1832168 - RNA, 14 nt, Salmonella typhimurium LT2
cgcuaaucaucagc

SEQ ID NO: 1832169 - RNA, 23 nt, Salmonella typhimurium LT2
cgcggucagggugaaucccgcca

SEQ ID NO: 1832170 - RNA, 16 nt, Salmonella typhimurium LT2
cgcgguaaguacggca

SEQ ID NO: 1832171 - RNA, 15 nt, Salmonella typhimurium LT2
cgcgucccucuccag

SEQ ID NO: 1832172 - RNA, 23 nt, Salmonella typhimurium LT2
cgcgucccauggggggcgcguug

SEQ ID NO: 1832173 - RNA, 14 nt, Salmonella typhimurium LT2
cgcguccagcggca

SEQ ID NO: 1832174 - RNA, 20 nt, Salmonella typhimurium LT2
cgcguacuuucgccaguuca

SEQ ID NO: 1832175 - RNA, 16 nt, Salmonella typhimurium LT2
cgcgucagggcgauaa

SEQ ID NO: 1832176 - RNA, 16 nt, Salmonella typhimurium LT2
cgcguagcgccaacau

SEQ ID NO: 1832177 - RNA, 23 nt, Salmonella typhimurium LT2
cgcuucaaaacagaaccccaucg

SEQ ID NO: 1832178 - RNA, 13 nt, Salmonella typhimurium LT2
cgcuuaucgggcc

SEQ ID NO: 1832179 - RNA, 19 nt, Salmonella typhimurium LT2
cgcuuaucgggccuacaag

SEQ ID NO: 1832180 - RNA, 18 nt, Salmonella typhimurium LT2
cgcuuauucggccuacag

SEQ ID NO: 1832181 - RNA, 14 nt, Salmonella typhimurium LT2
cgcuuauugaugac

SEQ ID NO: 1832182 - RNA, 12 nt, Salmonella typhimurium LT2
cgcuuaucaggc

SEQ ID NO: 1832183 - RNA, 18 nt, Salmonella typhimurium LT2
cgcuuaucaggccuacaa

SEQ ID NO: 1832184 - RNA, 13 nt, Salmonella typhimurium LT2
cgcuuaucaggcc

SEQ ID NO: 1832185 - RNA, 19 nt, Salmonella typhimurium LT2
cgcuuaucaggccuacaag

SEQ ID NO: 1832186 - RNA, 17 nt, Salmonella typhimurium LT2
cgcuuaucaggccuacc

SEQ ID NO: 1832187 - RNA, 18 nt, Salmonella typhimurium LT2
cgcuuaucgccguaaccg

SEQ ID NO: 1832188 - RNA, 13 nt, Salmonella typhimurium LT2
cgcuuauccggcc

SEQ ID NO: 1832189 - RNA, 15 nt, Salmonella typhimurium LT2
cgcuuauccagccac

SEQ ID NO: 1832190 - RNA, 20 nt, Salmonella typhimurium LT2
cgcuucgcuuaucaggccua

SEQ ID NO: 1832191 - RNA, 14 nt, Salmonella typhimurium LT2
cgcuucggcaauuu

SEQ ID NO: 1832192 - RNA, 20 nt, Salmonella typhimurium LT2
cgcuuccuggauguccgacg

SEQ ID NO: 1832193 - RNA, 15 nt, Salmonella typhimurium LT2
cgcuucccagcgucg

SEQ ID NO: 1832194 - RNA, 18 nt, Salmonella typhimurium LT2
cgcuugagcgccuuaucg

SEQ ID NO: 1832195 - RNA, 17 nt, Salmonella typhimurium LT2
cgcuugcccggccuaca

SEQ ID NO: 1832196 - RNA, 14 nt, Salmonella typhimurium LT2
cgcugucgauaaua

SEQ ID NO: 1832197 - RNA, 14 nt, Salmonella typhimurium LT2
cgcugucaccagca

SEQ ID NO: 1832198 - RNA, 19 nt, Salmonella typhimurium LT2
cgcugucacuccggcugca

SEQ ID NO: 1832199 - RNA, 13 nt, Salmonella typhimurium LT2
cgcugucagcaca

SEQ ID NO: 1832200 - RNA, 17 nt, Salmonella typhimurium LT2
cgcuguaaaucugauaa

SEQ ID NO: 1832201 - RNA, 21 nt, Salmonella typhimurium LT2
cgcuguaaauguuguuccaga

SEQ ID NO: 1832202 - RNA, 22 nt, Salmonella typhimurium LT2
cgcuggugcuacgggcgcuguc

SEQ ID NO: 1832203 - RNA, 19 nt, Salmonella typhimurium LT2
cgcuuaccaggccuacacg

SEQ ID NO: 1832204 - RNA, 14 nt, Salmonella typhimurium LT2
cgcuuaccaggccu

SEQ ID NO: 1832205 - RNA, 13 nt, Salmonella typhimurium LT2
cgcuguuguugac

SEQ ID NO: 1832206 - RNA, 19 nt, Salmonella typhimurium LT2
cgcugugcggcgugcagau

SEQ ID NO: 1832207 - RNA, 21 nt, Salmonella typhimurium LT2
cgcugugcggcgugcagauca

SEQ ID NO: 1832208 - RNA, 18 nt, Salmonella typhimurium LT2
cgcugucgcuaauccggc

SEQ ID NO: 1832209 - RNA, 23 nt, Salmonella typhimurium LT2
cgcugucugccggcguuccgcac

SEQ ID NO: 1832210 - RNA, 24 nt, Salmonella typhimurium LT2
cgcugucuauccacugucgggcaa

SEQ ID NO: 1832211 - RNA, 16 nt, Salmonella typhimurium LT2
cggaaccgaccgcgau

SEQ ID NO: 1832212 - RNA, 19 nt, Salmonella typhimurium LT2
cggaaccaaaugcccagcu

SEQ ID NO: 1832213 - RNA, 19 nt, Salmonella typhimurium LT2
cggaaccauuuuccccaga

SEQ ID NO: 1832214 - RNA, 23 nt, Salmonella typhimurium LT2
cggaacgucuuuuuccagcagcu

SEQ ID NO: 1832215 - RNA, 12 nt, Salmonella typhimurium LT2
cggaacguccag

SEQ ID NO: 1832216 - RNA, 20 nt, Salmonella typhimurium LT2
cggaaugccguauaccagcg

SEQ ID NO: 1832217 - RNA, 19 nt, Salmonella typhimurium LT2
cggaaugaccugagcgugc

SEQ ID NO: 1832218 - RNA, 23 nt, Salmonella typhimurium LT2
cggaauucuguucaguggcguag

SEQ ID NO: 1832219 - RNA, 13 nt, Salmonella typhimurium LT2
cggaauugguaga

SEQ ID NO: 1832220 - RNA, 18 nt, Salmonella typhimurium LT2
cggaauugguagacgcgc

SEQ ID NO: 1832221 - RNA, 16 nt, Salmonella typhimurium LT2
cggaaguuaccgcgcc

SEQ ID NO: 1832222 - RNA, 21 nt, Salmonella typhimurium LT2
cggaaguuaccgcgccaggcg

SEQ ID NO: 1832223 - RNA, 13 nt, Salmonella typhimurium LT2
cggaauauugaga

SEQ ID NO: 1832224 - RNA, 20 nt, Salmonella typhimurium LT2
cggaauccccgccgccagua

SEQ ID NO: 1832225 - RNA, 14 nt, Salmonella typhimurium LT2
cggaauccaccaua

SEQ ID NO: 1832226 - RNA, 14 nt, Salmonella typhimurium LT2
cggaaagagguucc

SEQ ID NO: 1832227 - RNA, 14 nt, Salmonella typhimurium LT2
cggaaaagcgccca

SEQ ID NO: 1832228 - RNA, 21 nt, Salmonella typhimurium LT2
cggaaagaagaauaagccgga

SEQ ID NO: 1832229 - RNA, 23 nt, Salmonella typhimurium LT2
cggaaagaagaauaagccggaug

SEQ ID NO: 1832230 - RNA, 17 nt, Salmonella typhimurium LT2
cggaaauuugcagcgcu

SEQ ID NO: 1832231 - RNA, 18 nt, Salmonella typhimurium LT2
cggaacaguaaagcgcaa

SEQ ID NO: 1832232 - RNA, 14 nt, Salmonella typhimurium LT2
cgcuuuuauccggc

SEQ ID NO: 1832233 - RNA, 16 nt, Salmonella typhimurium LT2
cgcuuuuccaggcgac

SEQ ID NO: 1832234 - RNA, 18 nt, Salmonella typhimurium LT2
cgcuuuuccaggcgacca

SEQ ID NO: 1832235 - RNA, 18 nt, Salmonella typhimurium LT2
cgcuuuugcgucaucagu

SEQ ID NO: 1832236 - RNA, 18 nt, Salmonella typhimurium LT2
cgcuuugcuuauccggcc

SEQ ID NO: 1832237 - RNA, 20 nt, Salmonella typhimurium LT2
cgcuuugugcuccaccagcc

SEQ ID NO: 1832238 - RNA, 21 nt, Salmonella typhimurium LT2
cgcuuuuucacgaccagccaa

SEQ ID NO: 1832239 - RNA, 15 nt, Salmonella typhimurium LT2
cgcuuuuuuugcccu

SEQ ID NO: 1832240 - RNA, 23 nt, Salmonella typhimurium LT2
cgcuuucuggggugaauuuuuug

SEQ ID NO: 1832241 - RNA, 14 nt, Salmonella typhimurium LT2
cgcuuuccauuacg

SEQ ID NO: 1832242 - RNA, 14 nt, Salmonella typhimurium LT2
cgcuuuagcgauaa

SEQ ID NO: 1832243 - RNA, 22 nt, Salmonella typhimurium LT2
cgcugcaucguuugcaguuccg

SEQ ID NO: 1832244 - RNA, 23 nt, Salmonella typhimurium LT2
cgcugauucuacucugcucgcca

SEQ ID NO: 1832245 - RNA, 15 nt, Salmonella typhimurium LT2
cgcugcaaaaugaug

SEQ ID NO: 1832246 - RNA, 18 nt, Salmonella typhimurium LT2
cgcugcaacccgccgcca

SEQ ID NO: 1832247 - RNA, 14 nt, Salmonella typhimurium LT2
cgcuccugcucuuc

SEQ ID NO: 1832248 - RNA, 15 nt, Salmonella typhimurium LT2
cgcucgaaucgccau

SEQ ID NO: 1832249 - RNA, 14 nt, Salmonella typhimurium LT2
cgcugaggccugca

SEQ ID NO: 1832250 - RNA, 17 nt, Salmonella typhimurium LT2
cgcugauaaucguauca

SEQ ID NO: 1832251 - RNA, 19 nt, Salmonella typhimurium LT2
cgcugauagccacggcgca

SEQ ID NO: 1832252 - RNA, 19 nt, Salmonella typhimurium LT2
cgcugaguuucucccgcca

SEQ ID NO: 1832253 - RNA, 17 nt, Salmonella typhimurium LT2
cgcugaguggcgggcgu

SEQ ID NO: 1832254 - RNA, 22 nt, Salmonella typhimurium LT2
cgcugagugguucgccauccag

SEQ ID NO: 1832255 - RNA, 14 nt, Salmonella typhimurium LT2
cgcugccacccggc

SEQ ID NO: 1832256 - RNA, 19 nt, Salmonella typhimurium LT2
cgcugccgcccuuucccga

SEQ ID NO: 1832257 - RNA, 14 nt, Salmonella typhimurium LT2
cgcugcgcaggcgu

SEQ ID NO: 1832258 - RNA, 16 nt, Salmonella typhimurium LT2
cgcugcgagcagcgaa

SEQ ID NO: 1832259 - RNA, 21 nt, Salmonella typhimurium LT2
cgcugccuuuaauugccugac

SEQ ID NO: 1832260 - RNA, 16 nt, Salmonella typhimurium LT2
cgcugcgugcgcgcca

SEQ ID NO: 1832261 - RNA, 20 nt, Salmonella typhimurium LT2
cgcugcgcuuaccgggccua

SEQ ID NO: 1832262 - RNA, 20 nt, Salmonella typhimurium LT2
cgcugcgcuuaucaggccua

SEQ ID NO: 1832263 - RNA, 16 nt, Salmonella typhimurium LT2
cgcugcgcuuauccgc

SEQ ID NO: 1832264 - RNA, 17 nt, Salmonella typhimurium LT2
cgcugcgcuuauccggc

SEQ ID NO: 1832265 - RNA, 23 nt, Salmonella typhimurium LT2
cgcuggcaauaaagcagggcggc

SEQ ID NO: 1832266 - RNA, 18 nt, Salmonella typhimurium LT2
cgcugcuggcagcgcuga

SEQ ID NO: 1832267 - RNA, 18 nt, Salmonella typhimurium LT2
cgcugcuguaacagacgc

SEQ ID NO: 1832268 - RNA, 16 nt, Salmonella typhimurium LT2
cgcuggaauaaacggu

SEQ ID NO: 1832269 - RNA, 15 nt, Salmonella typhimurium LT2
cgcuggcggcaggcc

SEQ ID NO: 1832270 - RNA, 16 nt, Salmonella typhimurium LT2
cgcuggcgcgccugcu

SEQ ID NO: 1832271 - RNA, 18 nt, Salmonella typhimurium LT2
cgcuggccgguugggcgc

SEQ ID NO: 1832272 - RNA, 17 nt, Salmonella typhimurium LT2
cgcuggcguccagccug

SEQ ID NO: 1832273 - RNA, 11 nt, Salmonella typhimurium LT2
cgcuggcguac

SEQ ID NO: 1832274 - RNA, 15 nt, Salmonella typhimurium LT2
cgcuggcugccgcca

SEQ ID NO: 1832275 - RNA, 14 nt, Salmonella typhimurium LT2
cgcuggucagcgcg

SEQ ID NO: 1832276 - RNA, 14 nt, Salmonella typhimurium LT2
cgcuggucagcgca

SEQ ID NO: 1832277 - RNA, 16 nt, Salmonella typhimurium LT2
cgcugguaaauccggc

SEQ ID NO: 1832278 - RNA, 16 nt, Salmonella typhimurium LT2
cgggcaaaaugcgucg

SEQ ID NO: 1832279 - RNA, 15 nt, Salmonella typhimurium LT2
cgggaucgccaucac

SEQ ID NO: 1832280 - RNA, 14 nt, Salmonella typhimurium LT2
cgggccagacgcuu

SEQ ID NO: 1832281 - RNA, 18 nt, Salmonella typhimurium LT2
cgggccugccuguuuacg

SEQ ID NO: 1832282 - RNA, 19 nt, Salmonella typhimurium LT2
cgggccgccaucuccggca

SEQ ID NO: 1832283 - RNA, 17 nt, Salmonella typhimurium LT2
cggcuguagccagccug

SEQ ID NO: 1832284 - RNA, 17 nt, Salmonella typhimurium LT2
cggcuggguuuccggau

SEQ ID NO: 1832285 - RNA, 23 nt, Salmonella typhimurium LT2
cggcuuccguuuuguugccgccc

SEQ ID NO: 1832286 - RNA, 22 nt, Salmonella typhimurium LT2
cggcuauuagcguuuuuaccgg

SEQ ID NO: 1832287 - RNA, 23 nt, Salmonella typhimurium LT2
cggcguuucaagcaguuccagca

SEQ ID NO: 1832288 - RNA, 16 nt, Salmonella typhimurium LT2
cggcguuucguuuagc

SEQ ID NO: 1832289 - RNA, 19 nt, Salmonella typhimurium LT2
cggcguuuauccaaauccu

SEQ ID NO: 1832290 - RNA, 21 nt, Salmonella typhimurium LT2
cggcuacgaaccgagcggucg

SEQ ID NO: 1832291 - RNA, 17 nt, Salmonella typhimurium LT2
cggcuacgcagcggcga

SEQ ID NO: 1832292 - RNA, 22 nt, Salmonella typhimurium LT2
cggcguuagugcccagcgcgac

SEQ ID NO: 1832293 - RNA, 13 nt, Salmonella typhimurium LT2
cggcguuccgcac

SEQ ID NO: 1832294 - RNA, 14 nt, Salmonella typhimurium LT2
cggcguaauugcgc

SEQ ID NO: 1832295 - RNA, 23 nt, Salmonella typhimurium LT2
cggcgucuaccuggguagcgcca

SEQ ID NO: 1832296 - RNA, 20 nt, Salmonella typhimurium LT2
cggcgugaacgccuuauccu

SEQ ID NO: 1832297 - RNA, 16 nt, Salmonella typhimurium LT2
cggcgucgcggcaaua

SEQ ID NO: 1832298 - RNA, 21 nt, Salmonella typhimurium LT2
cgggugcgcagccccagcgcc

SEQ ID NO: 1832299 - RNA, 20 nt, Salmonella typhimurium LT2
aaccagcgcgccgccaacgc

SEQ ID NO: 1832300 - RNA, 17 nt, Salmonella typhimurium LT2
aaccagcgcgccgccaa

SEQ ID NO: 1832301 - RNA, 21 nt, Salmonella typhimurium LT2
aaccaggauucaacgcgugau

SEQ ID NO: 1832302 - RNA, 20 nt, Salmonella typhimurium LT2
aaccagccgaucagcgccau

SEQ ID NO: 1832303 - RNA, 21 nt, Salmonella typhimurium LT2
aaccagcagggcaauagcgau

SEQ ID NO: 1832304 - RNA, 16 nt, Salmonella typhimurium LT2
cgggugauuucacgca

SEQ ID NO: 1832305 - RNA, 18 nt, Salmonella typhimurium LT2
cgggucugcgcgccggaa

SEQ ID NO: 1832306 - RNA, 17 nt, Salmonella typhimurium LT2
aaccacaaguuuauccg

SEQ ID NO: 1832307 - RNA, 19 nt, Salmonella typhimurium LT2
aaccacaaucacagcgcag

SEQ ID NO: 1832308 - RNA, 19 nt, Salmonella typhimurium LT2
aaccacuggugacaucgcc

SEQ ID NO: 1832309 - RNA, 15 nt, Salmonella typhimurium LT2
cggguauucaucggc

SEQ ID NO: 1832310 - RNA, 13 nt, Salmonella typhimurium LT2
cgggucagcgucu

SEQ ID NO: 1832311 - RNA, 23 nt, Salmonella typhimurium LT2
cgggucaugguaggccugauaag

SEQ ID NO: 1832312 - RNA, 20 nt, Salmonella typhimurium LT2
cgguauuuuucaccucacuc

SEQ ID NO: 1832313 - RNA, 22 nt, Salmonella typhimurium LT2
cgguaucaaugcgacagcggca

SEQ ID NO: 1832314 - RNA, 16 nt, Salmonella typhimurium LT2
cgguauaucacgccau

SEQ ID NO: 1832315 - RNA, 18 nt, Salmonella typhimurium LT2
cgguacgcuccagggcug

SEQ ID NO: 1832316 - RNA, 20 nt, Salmonella typhimurium LT2
cgguagaaaguacaucauug

SEQ ID NO: 1832317 - RNA, 14 nt, Salmonella typhimurium LT2
cgguacuccgccau

SEQ ID NO: 1832318 - RNA, 18 nt, Salmonella typhimurium LT2
cgguagcuucagcggcgc

SEQ ID NO: 1832319 - RNA, 15 nt, Salmonella typhimurium LT2
cggguuuugaaaucu

SEQ ID NO: 1832320 - RNA, 15 nt, Salmonella typhimurium LT2
cgguaaaccaggcca

SEQ ID NO: 1832321 - RNA, 19 nt, Salmonella typhimurium LT2
cgguaaaaccuaacgccug

SEQ ID NO: 1832322 - RNA, 23 nt, Salmonella typhimurium LT2
aaccaucgacccccaccauguca

SEQ ID NO: 1832323 - RNA, 21 nt, Salmonella typhimurium LT2
aaccaugaacgauguaucgcg

SEQ ID NO: 1832324 - RNA, 23 nt, Salmonella typhimurium LT2
cgguaauagagauccuggcgaaa

SEQ ID NO: 1832325 - RNA, 14 nt, Salmonella typhimurium LT2
cgguaagcacaacg

SEQ ID NO: 1832326 - RNA, 17 nt, Salmonella typhimurium LT2
cgguaagcgcagcgcca

SEQ ID NO: 1832327 - RNA, 18 nt, Salmonella typhimurium LT2
cgguaaaucaacaaccgg

SEQ ID NO: 1832328 - RNA, 23 nt, Salmonella typhimurium LT2
cgguaaagguaauaucauccggu

SEQ ID NO: 1832329 - RNA, 15 nt, Salmonella typhimurium LT2
cgguaacaggcacca

SEQ ID NO: 1832330 - RNA, 20 nt, Salmonella typhimurium LT2
cgguacaaaccccacccgcu

SEQ ID NO: 1832331 - RNA, 17 nt, Salmonella typhimurium LT2
cggucagauuaaucagg

SEQ ID NO: 1832332 - RNA, 12 nt, Salmonella typhimurium LT2
cggucagaccgu

SEQ ID NO: 1832333 - RNA, 15 nt, Salmonella typhimurium LT2
cgguccacaggccgu

SEQ ID NO: 1832334 - RNA, 17 nt, Salmonella typhimurium LT2
cggucauaaccggccga

SEQ ID NO: 1832335 - RNA, 16 nt, Salmonella typhimurium LT2
cggucagcuuuucagc

SEQ ID NO: 1832336 - RNA, 15 nt, Salmonella typhimurium LT2
cggucgacaccagcg

SEQ ID NO: 1832337 - RNA, 23 nt, Salmonella typhimurium LT2
aacaucauucccguaucuucaug

SEQ ID NO: 1832338 - RNA, 12 nt, Salmonella typhimurium LT2
aacaucagcgcg

SEQ ID NO: 1832339 - RNA, 15 nt, Salmonella typhimurium LT2
aacaucgccccggca

SEQ ID NO: 1832340 - RNA, 22 nt, Salmonella typhimurium LT2
cggcccaaccacuacugcguca

SEQ ID NO: 1832341 - RNA, 23 nt, Salmonella typhimurium LT2
cggccgcuaucugcuccgccagc

SEQ ID NO: 1832342 - RNA, 15 nt, Salmonella typhimurium LT2
aacaucagccagcag

SEQ ID NO: 1832343 - RNA, 17 nt, Salmonella typhimurium LT2
cggcagccgacagcgua

SEQ ID NO: 1832344 - RNA, 22 nt, Salmonella typhimurium LT2
cggcagggauucgcucaccgcg

SEQ ID NO: 1832345 - RNA, 16 nt, Salmonella typhimurium LT2
cggcaggcgucauagc

SEQ ID NO: 1832346 - RNA, 20 nt, Salmonella typhimurium LT2
cggcaguaacuucagcauca

SEQ ID NO: 1832347 - RNA, 16 nt, Salmonella typhimurium LT2
cggcaguaagccagcg

SEQ ID NO: 1832348 - RNA, 13 nt, Salmonella typhimurium LT2
cggcagcguuacg

SEQ ID NO: 1832349 - RNA, 16 nt, Salmonella typhimurium LT2
cggcagucgcuacaac

SEQ ID NO: 1832350 - RNA, 17 nt, Salmonella typhimurium LT2
cggcaguccgucgagcg

SEQ ID NO: 1832351 - RNA, 21 nt, Salmonella typhimurium LT2
cggcauacaccgccagcgucu

SEQ ID NO: 1832352 - RNA, 15 nt, Salmonella typhimurium LT2
cggcaucggaaccgg

SEQ ID NO: 1832353 - RNA, 16 nt, Salmonella typhimurium LT2
aacagggguuccggca

SEQ ID NO: 1832354 - RNA, 17 nt, Salmonella typhimurium LT2
aacagggguuccggcaa

SEQ ID NO: 1832355 - RNA, 13 nt, Salmonella typhimurium LT2
cggcacgccagcg

SEQ ID NO: 1832356 - RNA, 17 nt, Salmonella typhimurium LT2
cggcacgguaaaccucu

SEQ ID NO: 1832357 - RNA, 14 nt, Salmonella typhimurium LT2
cggcagcagcuuca

SEQ ID NO: 1832358 - RNA, 20 nt, Salmonella typhimurium LT2
aacauaagcaguaucccacc

SEQ ID NO: 1832359 - RNA, 17 nt, Salmonella typhimurium LT2
aacauaucuccucugcc

SEQ ID NO: 1832360 - RNA, 19 nt, Salmonella typhimurium LT2
aacagugaguuaagacgcu

SEQ ID NO: 1832361 - RNA, 15 nt, Salmonella typhimurium LT2
cggcacugcuuuucg

SEQ ID NO: 1832362 - RNA, 15 nt, Salmonella typhimurium LT2
cggcgcgccagcgca

SEQ ID NO: 1832363 - RNA, 15 nt, Salmonella typhimurium LT2
cggcgcgcgccagcu

SEQ ID NO: 1832364 - RNA, 19 nt, Salmonella typhimurium LT2
cggcgcuaaccagcgcuuc

SEQ ID NO: 1832365 - RNA, 21 nt, Salmonella typhimurium LT2
cggcgcuaucgccuccagacu

SEQ ID NO: 1832366 - RNA, 13 nt, Salmonella typhimurium LT2
cggcggccaaccc

SEQ ID NO: 1832367 - RNA, 22 nt, Salmonella typhimurium LT2
cggcggauaaucuugauccggc

SEQ ID NO: 1832368 - RNA, 16 nt, Salmonella typhimurium LT2
cggcgcuggcgcgcua

SEQ ID NO: 1832369 - RNA, 21 nt, Salmonella typhimurium LT2
cggcgccaggacaacgccggu

SEQ ID NO: 1832370 - RNA, 20 nt, Salmonella typhimurium LT2
cggcgccggggaagcgacga

SEQ ID NO: 1832371 - RNA, 16 nt, Salmonella typhimurium LT2
cggcgccaaucaccgc

SEQ ID NO: 1832372 - RNA, 20 nt, Salmonella typhimurium LT2
cggcgccaaucaccgccagc

SEQ ID NO: 1832373 - RNA, 13 nt, Salmonella typhimurium LT2
cggcgagcggcua

SEQ ID NO: 1832374 - RNA, 20 nt, Salmonella typhimurium LT2
cggcgacgcccgccaucugc

SEQ ID NO: 1832375 - RNA, 14 nt, Salmonella typhimurium LT2
cggcgaccagcaaa

SEQ ID NO: 1832376 - RNA, 20 nt, Salmonella typhimurium LT2
cggcgaaagaaaauugucca

SEQ ID NO: 1832377 - RNA, 18 nt, Salmonella typhimurium LT2
cggccugcguuaacggcu

SEQ ID NO: 1832378 - RNA, 14 nt, Salmonella typhimurium LT2
cggcgaaucaccga

SEQ ID NO: 1832379 - RNA, 21 nt, Salmonella typhimurium LT2
cggcgaacgcuggcuggguaa

SEQ ID NO: 1832380 - RNA, 16 nt, Salmonella typhimurium LT2
cggcgaacaggcguaa

SEQ ID NO: 1832381 - RNA, 20 nt, Salmonella typhimurium LT2
cggcgaacgcgcgcgcuguc

SEQ ID NO: 1832382 - RNA, 20 nt, Salmonella typhimurium LT2
ccggauaagcaaagcgccau

SEQ ID NO: 1832383 - RNA, 16 nt, Salmonella typhimurium LT2
ccggauaacggcgcga

SEQ ID NO: 1832384 - RNA, 22 nt, Salmonella typhimurium LT2
ccggauaagacgcuacgcgucg

SEQ ID NO: 1832385 - RNA, 20 nt, Salmonella typhimurium LT2
ccggaguagguugccgggug

SEQ ID NO: 1832386 - RNA, 15 nt, Salmonella typhimurium LT2
ccggauagcgcuguc

SEQ ID NO: 1832387 - RNA, 21 nt, Salmonella typhimurium LT2
ccggauaagcguaagcgccau

SEQ ID NO: 1832388 - RNA, 21 nt, Salmonella typhimurium LT2
ccggauaagcgucagcgccau

SEQ ID NO: 1832389 - RNA, 13 nt, Salmonella typhimurium LT2
ccggauaaggcgc

SEQ ID NO: 1832390 - RNA, 14 nt, Salmonella typhimurium LT2
ccggauaaggugcu

SEQ ID NO: 1832391 - RNA, 21 nt, Salmonella typhimurium LT2
ccggacuccaggcaacguugu

SEQ ID NO: 1832392 - RNA, 23 nt, Salmonella typhimurium LT2
ccggacugauagucauugacagc

SEQ ID NO: 1832393 - RNA, 17 nt, Salmonella typhimurium LT2
ccggaagacguuucaga

SEQ ID NO: 1832394 - RNA, 18 nt, Salmonella typhimurium LT2
ccggaauagcaggcauca

SEQ ID NO: 1832395 - RNA, 16 nt, Salmonella typhimurium LT2
ccggaccguuaucaaa

SEQ ID NO: 1832396 - RNA, 19 nt, Salmonella typhimurium LT2
ccgcguacaggaagccggu

SEQ ID NO: 1832397 - RNA, 16 nt, Salmonella typhimurium LT2
ccgcgcugcgccgcaa

SEQ ID NO: 1832398 - RNA, 20 nt, Salmonella typhimurium LT2
ccgcgucguuacgcucguca

SEQ ID NO: 1832399 - RNA, 16 nt, Salmonella typhimurium LT2
ccgcgucguucgacga

SEQ ID NO: 1832400 - RNA, 18 nt, Salmonella typhimurium LT2
ccgcguuuuaaaccgcga

SEQ ID NO: 1832401 - RNA, 18 nt, Salmonella typhimurium LT2
ccgcgucuucgaugccau

SEQ ID NO: 1832402 - RNA, 17 nt, Salmonella typhimurium LT2
ccgcuccguacgcguca

SEQ ID NO: 1832403 - RNA, 13 nt, Salmonella typhimurium LT2
ccgcuaauaccga

SEQ ID NO: 1832404 - RNA, 16 nt, Salmonella typhimurium LT2
ccgcucgaaucgccau

SEQ ID NO: 1832405 - RNA, 16 nt, Salmonella typhimurium LT2
ccgcuaccgcuuugac

SEQ ID NO: 1832406 - RNA, 12 nt, Salmonella typhimurium LT2
ccgcucggcaua

SEQ ID NO: 1832407 - RNA, 22 nt, Salmonella typhimurium LT2
ccggcaucacaaaccagacgcg

SEQ ID NO: 1832408 - RNA, 19 nt, Salmonella typhimurium LT2
ccggcaguuuaagcgccga

SEQ ID NO: 1832409 - RNA, 21 nt, Salmonella typhimurium LT2
ccggcaguuuaagcgccgaca

SEQ ID NO: 1832410 - RNA, 16 nt, Salmonella typhimurium LT2
ccggcgaauuucauca

SEQ ID NO: 1832411 - RNA, 23 nt, Salmonella typhimurium LT2
ccggcagggucguacuaaagagc

SEQ ID NO: 1832412 - RNA, 21 nt, Salmonella typhimurium LT2
ccggcaguccgucgagcgcgg

SEQ ID NO: 1832413 - RNA, 19 nt, Salmonella typhimurium LT2
ccggcagucgggcgaacgc

SEQ ID NO: 1832414 - RNA, 22 nt, Salmonella typhimurium LT2
ccggcacgauggucucaaucgc

SEQ ID NO: 1832415 - RNA, 17 nt, Salmonella typhimurium LT2
ccggcaagggucuuaac

SEQ ID NO: 1832416 - RNA, 18 nt, Salmonella typhimurium LT2
ccggcaaccugagcgcga

SEQ ID NO: 1832417 - RNA, 23 nt, Salmonella typhimurium LT2
ccggcacauauuccggcgcuggc

SEQ ID NO: 1832418 - RNA, 13 nt, Salmonella typhimurium LT2
ccggcaaucgccu

SEQ ID NO: 1832419 - RNA, 12 nt, Salmonella typhimurium LT2
ccggcacccagu

SEQ ID NO: 1832420 - RNA, 15 nt, Salmonella typhimurium LT2
ccggcaccacgcaca

SEQ ID NO: 1832421 - RNA, 21 nt, Salmonella typhimurium LT2
ccggauuagcgacagcgcuau

SEQ ID NO: 1832422 - RNA, 16 nt, Salmonella typhimurium LT2
ccggauggcgucugau

SEQ ID NO: 1832423 - RNA, 23 nt, Salmonella typhimurium LT2
ccggauggggcaucagccgccau

SEQ ID NO: 1832424 - RNA, 21 nt, Salmonella typhimurium LT2
ccggauggcggcgucgccugu

SEQ ID NO: 1832425 - RNA, 20 nt, Salmonella typhimurium LT2
ccggauggcggcuuugaacg

SEQ ID NO: 1832426 - RNA, 16 nt, Salmonella typhimurium LT2
ccggaugugagcgcau

SEQ ID NO: 1832427 - RNA, 16 nt, Salmonella typhimurium LT2
ccgccuaccagcacau

SEQ ID NO: 1832428 - RNA, 20 nt, Salmonella typhimurium LT2
ccgccguuucguugccagag

SEQ ID NO: 1832429 - RNA, 15 nt, Salmonella typhimurium LT2
ccgccuggcgcgacu

SEQ ID NO: 1832430 - RNA, 23 nt, Salmonella typhimurium LT2
ccgccuuccgcgguacgaaucgc

SEQ ID NO: 1832431 - RNA, 20 nt, Salmonella typhimurium LT2
ccgccuuuuauaauaaaagc

SEQ ID NO: 1832432 - RNA, 16 nt, Salmonella typhimurium LT2
aaaugccuuauccggc

SEQ ID NO: 1832433 - RNA, 17 nt, Salmonella typhimurium LT2
ccgcgauuuagcguugg

SEQ ID NO: 1832434 - RNA, 18 nt, Salmonella typhimurium LT2
ccgcgauuuagcguuggc

SEQ ID NO: 1832435 - RNA, 19 nt, Salmonella typhimurium LT2
ccgcgcaaucgccgaucgc

SEQ ID NO: 1832436 - RNA, 21 nt, Salmonella typhimurium LT2
ccgcgcagaaucacuucaucc

SEQ ID NO: 1832437 - RNA, 16 nt, Salmonella typhimurium LT2
ccgcgcagcgccagaa

SEQ ID NO: 1832438 - RNA, 21 nt, Salmonella typhimurium LT2
ccgcgccuucgcggugauccc

SEQ ID NO: 1832439 - RNA, 23 nt, Salmonella typhimurium LT2
ccgcgccugggcggcaacccgcu

SEQ ID NO: 1832440 - RNA, 15 nt, Salmonella typhimurium LT2
ccgcgcggaucgcca

SEQ ID NO: 1832441 - RNA, 16 nt, Salmonella typhimurium LT2
ccgcgcggaucgccau

SEQ ID NO: 1832442 - RNA, 16 nt, Salmonella typhimurium LT2
ccgcgcugaucgccac

SEQ ID NO: 1832443 - RNA, 14 nt, Salmonella typhimurium LT2
ccgcgcucgcguaa

SEQ ID NO: 1832444 - RNA, 14 nt, Salmonella typhimurium LT2
ccgccgccagccau

SEQ ID NO: 1832445 - RNA, 17 nt, Salmonella typhimurium LT2
ccgccgacaaucgucac

SEQ ID NO: 1832446 - RNA, 21 nt, Salmonella typhimurium LT2
ccgccaucgcaucgaggcugg

SEQ ID NO: 1832447 - RNA, 13 nt, Salmonella typhimurium LT2
ccgccaucgccag

SEQ ID NO: 1832448 - RNA, 14 nt, Salmonella typhimurium LT2
ccgccauccggcga

SEQ ID NO: 1832449 - RNA, 15 nt, Salmonella typhimurium LT2
ccgccauccggcaca

SEQ ID NO: 1832450 - RNA, 15 nt, Salmonella typhimurium LT2
ccgccauccggcacu

SEQ ID NO: 1832451 - RNA, 15 nt, Salmonella typhimurium LT2
ccgccauccggcaaa

SEQ ID NO: 1832452 - RNA, 13 nt, Salmonella typhimurium LT2
ccgccaucaggca

SEQ ID NO: 1832453 - RNA, 15 nt, Salmonella typhimurium LT2
ccgcagccgacgcau

SEQ ID NO: 1832454 - RNA, 13 nt, Salmonella typhimurium LT2
ccgcagccggaua

SEQ ID NO: 1832455 - RNA, 13 nt, Salmonella typhimurium LT2
ccgcagccugaug

SEQ ID NO: 1832456 - RNA, 20 nt, Salmonella typhimurium LT2
ccgagcaggacgcgcgcgaa

SEQ ID NO: 1832457 - RNA, 16 nt, Salmonella typhimurium LT2
ccgcauaacgcgcugg

SEQ ID NO: 1832458 - RNA, 15 nt, Salmonella typhimurium LT2
ccgcauagacgugcg

SEQ ID NO: 1832459 - RNA, 15 nt, Salmonella typhimurium LT2
ccgcauaugcggcga

SEQ ID NO: 1832460 - RNA, 14 nt, Salmonella typhimurium LT2
ccgcaggccggaua

SEQ ID NO: 1832461 - RNA, 12 nt, Salmonella typhimurium LT2
ccgccagcgcgg

SEQ ID NO: 1832462 - RNA, 12 nt, Salmonella typhimurium LT2
ccgccagcgccu

SEQ ID NO: 1832463 - RNA, 19 nt, Salmonella typhimurium LT2
ccgccagcgcaacgcgcau

SEQ ID NO: 1832464 - RNA, 10 nt, Salmonella typhimurium LT2
ccgccagcgc

SEQ ID NO: 1832465 - RNA, 19 nt, Salmonella typhimurium LT2
ccgccagcgacauggcggu

SEQ ID NO: 1832466 - RNA, 18 nt, Salmonella typhimurium LT2
ccgccagugcauagcagc

SEQ ID NO: 1832467 - RNA, 12 nt, Salmonella typhimurium LT2
ccgccauaacgc

SEQ ID NO: 1832468 - RNA, 13 nt, Salmonella typhimurium LT2
ccgcaucggcgca

SEQ ID NO: 1832469 - RNA, 20 nt, Salmonella typhimurium LT2
ccgcauccuguuuuuucagc

SEQ ID NO: 1832470 - RNA, 21 nt, Salmonella typhimurium LT2
ccgccagacccgcaauaacgc

SEQ ID NO: 1832471 - RNA, 14 nt, Salmonella typhimurium LT2
ccgccaccgccagc

SEQ ID NO: 1832472 - RNA, 19 nt, Salmonella typhimurium LT2
ccgccagaaaagaaccgac

SEQ ID NO: 1832473 - RNA, 20 nt, Salmonella typhimurium LT2
ccugcgcauacgucaugccu

SEQ ID NO: 1832474 - RNA, 23 nt, Salmonella typhimurium LT2
ccugcgccaguucauccagcagc

SEQ ID NO: 1832475 - RNA, 15 nt, Salmonella typhimurium LT2
ccugccugaucgcca

SEQ ID NO: 1832476 - RNA, 14 nt, Salmonella typhimurium LT2
ccugcgcgccugac

SEQ ID NO: 1832477 - RNA, 13 nt, Salmonella typhimurium LT2
ccugcgcuaacga

SEQ ID NO: 1832478 - RNA, 20 nt, Salmonella typhimurium LT2
ccugcgcugucaccagcagc

SEQ ID NO: 1832479 - RNA, 11 nt, Salmonella typhimurium LT2
ccugcgcugac

SEQ ID NO: 1832480 - RNA, 20 nt, Salmonella typhimurium LT2
ccugccguccugaucaaggc

SEQ ID NO: 1832481 - RNA, 13 nt, Salmonella typhimurium LT2
ccugccaguccgc

SEQ ID NO: 1832482 - RNA, 21 nt, Salmonella typhimurium LT2
ccugcggauuuuucgccagua

SEQ ID NO: 1832483 - RNA, 14 nt, Salmonella typhimurium LT2
ccugcucaaucgca

SEQ ID NO: 1832484 - RNA, 18 nt, Salmonella typhimurium LT2
ccugcuccaccagcgcau

SEQ ID NO: 1832485 - RNA, 18 nt, Salmonella typhimurium LT2
ccugcgucgcuucgccaa

SEQ ID NO: 1832486 - RNA, 12 nt, Salmonella typhimurium LT2
ccugcugcggua

SEQ ID NO: 1832487 - RNA, 19 nt, Salmonella typhimurium LT2
ccugcuugucgaucaucag

SEQ ID NO: 1832488 - RNA, 21 nt, Salmonella typhimurium LT2
ccugggccgccacgaccugca

SEQ ID NO: 1832489 - RNA, 14 nt, Salmonella typhimurium LT2
ccuggcuaucccga

SEQ ID NO: 1832490 - RNA, 20 nt, Salmonella typhimurium LT2
ccugggucagcgucaucggc

SEQ ID NO: 1832491 - RNA, 16 nt, Salmonella typhimurium LT2
ccuggauaaaucgccc

SEQ ID NO: 1832492 - RNA, 15 nt, Salmonella typhimurium LT2
ccugcaaaaacgcca

SEQ ID NO: 1832493 - RNA, 15 nt, Salmonella typhimurium LT2
ccugauuucugaccg

SEQ ID NO: 1832494 - RNA, 15 nt, Salmonella typhimurium LT2
ccugauggcgcgcca

SEQ ID NO: 1832495 - RNA, 14 nt, Salmonella typhimurium LT2
ccugauggcgcuac

SEQ ID NO: 1832496 - RNA, 21 nt, Salmonella typhimurium LT2
ccugauggcgcuacgccugaa

SEQ ID NO: 1832497 - RNA, 14 nt, Salmonella typhimurium LT2
ccugauggcgcugc

SEQ ID NO: 1832498 - RNA, 21 nt, Salmonella typhimurium LT2
ccugauauaaucgaaucgccu

SEQ ID NO: 1832499 - RNA, 15 nt, Salmonella typhimurium LT2
ccugaucgccgacga

SEQ ID NO: 1832500 - RNA, 14 nt, Salmonella typhimurium LT2
ccugcacaucgcca

SEQ ID NO: 1832501 - RNA, 22 nt, Salmonella typhimurium LT2
ccugcaauuuccccugcgaaca

SEQ ID NO: 1832502 - RNA, 15 nt, Salmonella typhimurium LT2
ccugcauugccugau

SEQ ID NO: 1832503 - RNA, 20 nt, Salmonella typhimurium LT2
ccugcauuaacggcaacagu

SEQ ID NO: 1832504 - RNA, 11 nt, Salmonella typhimurium LT2
ccugccagauu

SEQ ID NO: 1832505 - RNA, 14 nt, Salmonella typhimurium LT2
ccugacaggccgga

SEQ ID NO: 1832506 - RNA, 22 nt, Salmonella typhimurium LT2
ccugaagccagcaaucagccca

SEQ ID NO: 1832507 - RNA, 23 nt, Salmonella typhimurium LT2
ccugaauaauggguggcagggca

SEQ ID NO: 1832508 - RNA, 15 nt, Salmonella typhimurium LT2
ccugaauagcaggca

SEQ ID NO: 1832509 - RNA, 20 nt, Salmonella typhimurium LT2
ccugauaagcgcagcgccau

SEQ ID NO: 1832510 - RNA, 19 nt, Salmonella typhimurium LT2
ccugauaagcacaggccau

SEQ ID NO: 1832511 - RNA, 19 nt, Salmonella typhimurium LT2
ccugauaagcgcagcgcau

SEQ ID NO: 1832512 - RNA, 23 nt, Salmonella typhimurium LT2
ccugauaacgaaucgcugcgcca

SEQ ID NO: 1832513 - RNA, 19 nt, Salmonella typhimurium LT2
ccugagaaaucaacgugac

SEQ ID NO: 1832514 - RNA, 19 nt, Salmonella typhimurium LT2
ccugaaagaguacgccgau

SEQ ID NO: 1832515 - RNA, 14 nt, Salmonella typhimurium LT2
ccucuuccgccagg

SEQ ID NO: 1832516 - RNA, 16 nt, Salmonella typhimurium LT2
ccucuugucaggcaga

SEQ ID NO: 1832517 - RNA, 12 nt, Salmonella typhimurium LT2
ccucucgccaaa

SEQ ID NO: 1832518 - RNA, 21 nt, Salmonella typhimurium LT2
ccucucuaugaaugccggaug

SEQ ID NO: 1832519 - RNA, 13 nt, Salmonella typhimurium LT2
ccucuuaucaggc

SEQ ID NO: 1832520 - RNA, 16 nt, Salmonella typhimurium LT2
ccucguucggcgcacc

SEQ ID NO: 1832521 - RNA, 16 nt, Salmonella typhimurium LT2
ccucguuuaaugcgaa

SEQ ID NO: 1832522 - RNA, 21 nt, Salmonella typhimurium LT2
ccucgauuaccguguuuaccu

SEQ ID NO: 1832523 - RNA, 22 nt, Salmonella typhimurium LT2
ccucauuuuguugcuccagcau

SEQ ID NO: 1832524 - RNA, 13 nt, Salmonella typhimurium LT2
ccucacuguugau

SEQ ID NO: 1832525 - RNA, 21 nt, Salmonella typhimurium LT2
ccucacgucccguagccugau

SEQ ID NO: 1832526 - RNA, 20 nt, Salmonella typhimurium LT2
ccucacccugaaauccggcu

SEQ ID NO: 1832527 - RNA, 13 nt, Salmonella typhimurium LT2
ccucacgcaacca

SEQ ID NO: 1832528 - RNA, 16 nt, Salmonella typhimurium LT2
ccguggugggcgcgac

SEQ ID NO: 1832529 - RNA, 16 nt, Salmonella typhimurium LT2
ccuccauacacugcau

SEQ ID NO: 1832530 - RNA, 14 nt, Salmonella typhimurium LT2
ccguauugccagau

SEQ ID NO: 1832531 - RNA, 20 nt, Salmonella typhimurium LT2
ccguauugagcagcggcugg

SEQ ID NO: 1832532 - RNA, 13 nt, Salmonella typhimurium LT2
ccguauagcccau

SEQ ID NO: 1832533 - RNA, 18 nt, Salmonella typhimurium LT2
ccguaucagcaagcgcca

SEQ ID NO: 1832534 - RNA, 16 nt, Salmonella typhimurium LT2
ccguauaccagcguca

SEQ ID NO: 1832535 - RNA, 14 nt, Salmonella typhimurium LT2
ccguagaucgccag

SEQ ID NO: 1832536 - RNA, 19 nt, Salmonella typhimurium LT2
ccguagccgggugcgcguc

SEQ ID NO: 1832537 - RNA, 18 nt, Salmonella typhimurium LT2
ccguagcguuaugcgcuu

SEQ ID NO: 1832538 - RNA, 19 nt, Salmonella typhimurium LT2
ccgucaugcugggcgguaa

SEQ ID NO: 1832539 - RNA, 14 nt, Salmonella typhimurium LT2
ccgucaucgcucau

SEQ ID NO: 1832540 - RNA, 15 nt, Salmonella typhimurium LT2
ccgucagcagcaccg

SEQ ID NO: 1832541 - RNA, 18 nt, Salmonella typhimurium LT2
ccgucaaugccgggcaga

SEQ ID NO: 1832542 - RNA, 18 nt, Salmonella typhimurium LT2
ccgucaaaacgcccaucc

SEQ ID NO: 1832543 - RNA, 20 nt, Salmonella typhimurium LT2
ccgucuggggaaaccugaag

SEQ ID NO: 1832544 - RNA, 17 nt, Salmonella typhimurium LT2
ccgucgcggcuuucagc

SEQ ID NO: 1832545 - RNA, 19 nt, Salmonella typhimurium LT2
ccgucgugacuaauagcca

SEQ ID NO: 1832546 - RNA, 12 nt, Salmonella typhimurium LT2
ccguccggcagu

SEQ ID NO: 1832547 - RNA, 13 nt, Salmonella typhimurium LT2
ccgucgccuccag

SEQ ID NO: 1832548 - RNA, 12 nt, Salmonella typhimurium LT2
ccgucgccggaa

SEQ ID NO: 1832549 - RNA, 19 nt, Salmonella typhimurium LT2
ccgugcaaaaucacgcggc

SEQ ID NO: 1832550 - RNA, 19 nt, Salmonella typhimurium LT2
ccgugaugcggacgcugac

SEQ ID NO: 1832551 - RNA, 18 nt, Salmonella typhimurium LT2
ccgugcacuucugcggua

SEQ ID NO: 1832552 - RNA, 20 nt, Salmonella typhimurium LT2
ccgugcgccgacaucgccac

SEQ ID NO: 1832553 - RNA, 17 nt, Salmonella typhimurium LT2
ccgguauuaaagcgcgg

SEQ ID NO: 1832554 - RNA, 22 nt, Salmonella typhimurium LT2
ccgguaugacgcuugagcgccu

SEQ ID NO: 1832555 - RNA, 21 nt, Salmonella typhimurium LT2
ccggucaauacaucacgcaac

SEQ ID NO: 1832556 - RNA, 20 nt, Salmonella typhimurium LT2
ccgguaacguaaauacccag

SEQ ID NO: 1832557 - RNA, 19 nt, Salmonella typhimurium LT2
ccgguaaagugacggcgcu

SEQ ID NO: 1832558 - RNA, 20 nt, Salmonella typhimurium LT2
ccgguaaaucaacaaccggc

SEQ ID NO: 1832559 - RNA, 21 nt, Salmonella typhimurium LT2
ccgguaaaucaacaaccggcu

SEQ ID NO: 1832560 - RNA, 23 nt, Salmonella typhimurium LT2
ccgguaagaaugcgcgucaggcc

SEQ ID NO: 1832561 - RNA, 13 nt, Salmonella typhimurium LT2
ccgguaaggcagg

SEQ ID NO: 1832562 - RNA, 16 nt, Salmonella typhimurium LT2
ccgguaaggcaggcaa

SEQ ID NO: 1832563 - RNA, 18 nt, Salmonella typhimurium LT2
ccgguaaagaaaccggcg

SEQ ID NO: 1832564 - RNA, 21 nt, Salmonella typhimurium LT2
ccggguucguuaacccggcau

SEQ ID NO: 1832565 - RNA, 13 nt, Salmonella typhimurium LT2
ccggguugcggaa

SEQ ID NO: 1832566 - RNA, 17 nt, Salmonella typhimurium LT2
ccgguacguuaaccgga

SEQ ID NO: 1832567 - RNA, 18 nt, Salmonella typhimurium LT2
ccggguguucgauaccgu

SEQ ID NO: 1832568 - RNA, 19 nt, Salmonella typhimurium LT2
ccgggugacgcuaacgcgc

SEQ ID NO: 1832569 - RNA, 21 nt, Salmonella typhimurium LT2
ccggggugacggcaacggcga

SEQ ID NO: 1832570 - RNA, 23 nt, Salmonella typhimurium LT2
ccggcugaacguuguauaaacag

SEQ ID NO: 1832571 - RNA, 22 nt, Salmonella typhimurium LT2
ccggcuuuuuuauaucaggcaa

SEQ ID NO: 1832572 - RNA, 19 nt, Salmonella typhimurium LT2
cgagccaacguauaaaaug

SEQ ID NO: 1832573 - RNA, 17 nt, Salmonella typhimurium LT2
cgagcaucuccagcgca

SEQ ID NO: 1832574 - RNA, 18 nt, Salmonella typhimurium LT2
aacaccgacauccgccau

SEQ ID NO: 1832575 - RNA, 14 nt, Salmonella typhimurium LT2
aacacauccagcgu

SEQ ID NO: 1832576 - RNA, 17 nt, Salmonella typhimurium LT2
aacacaggcggcgcuau

SEQ ID NO: 1832577 - RNA, 11 nt, Salmonella typhimurium LT2
cgagcagccag

SEQ ID NO: 1832578 - RNA, 18 nt, Salmonella typhimurium LT2
cgagauuuuucugcgcca

SEQ ID NO: 1832579 - RNA, 13 nt, Salmonella typhimurium LT2
cgagagcuacagu

SEQ ID NO: 1832580 - RNA, 23 nt, Salmonella typhimurium LT2
cgacgcggcuuuugcccgcgucg

SEQ ID NO: 1832581 - RNA, 15 nt, Salmonella typhimurium LT2
cgacgugacucagcg

SEQ ID NO: 1832582 - RNA, 20 nt, Salmonella typhimurium LT2
cgacguucgauacuauaacg

SEQ ID NO: 1832583 - RNA, 17 nt, Salmonella typhimurium LT2
cgacucauccagcaucg

SEQ ID NO: 1832584 - RNA, 14 nt, Salmonella typhimurium LT2
aacaaggauauccg

SEQ ID NO: 1832585 - RNA, 14 nt, Salmonella typhimurium LT2
cgagccuugccgca

SEQ ID NO: 1832586 - RNA, 17 nt, Salmonella typhimurium LT2
cgagcugcgcguuuagc

SEQ ID NO: 1832587 - RNA, 13 nt, Salmonella typhimurium LT2
cgaguuaagcgcc

SEQ ID NO: 1832588 - RNA, 20 nt, Salmonella typhimurium LT2
cgaguggcgcggaaagccuu

SEQ ID NO: 1832589 - RNA, 14 nt, Salmonella typhimurium LT2
cgauaaaaacagcg

SEQ ID NO: 1832590 - RNA, 14 nt, Salmonella typhimurium LT2
cgauaaauacccga

SEQ ID NO: 1832591 - RNA, 13 nt, Salmonella typhimurium LT2
cgauaaaucgcca

SEQ ID NO: 1832592 - RNA, 17 nt, Salmonella typhimurium LT2
cgauaaacucaaucagg

SEQ ID NO: 1832593 - RNA, 17 nt, Salmonella typhimurium LT2
cgauaaacucagcgcca

SEQ ID NO: 1832594 - RNA, 17 nt, Salmonella typhimurium LT2
cgauaaaguggcauccg

SEQ ID NO: 1832595 - RNA, 16 nt, Salmonella typhimurium LT2
cgauacccccaaccgu

SEQ ID NO: 1832596 - RNA, 16 nt, Salmonella typhimurium LT2
cgauacauccggcagg

SEQ ID NO: 1832597 - RNA, 16 nt, Salmonella typhimurium LT2
cgauacccaccagcgu

SEQ ID NO: 1832598 - RNA, 22 nt, Salmonella typhimurium LT2
cgauaucaacgucuugccauga

SEQ ID NO: 1832599 - RNA, 13 nt, Salmonella typhimurium LT2
cgauauagcgcau

SEQ ID NO: 1832600 - RNA, 21 nt, Salmonella typhimurium LT2
cgauauggaagaaaaaggagc

SEQ ID NO: 1832601 - RNA, 17 nt, Salmonella typhimurium LT2
cgagggaggcaaucgca

SEQ ID NO: 1832602 - RNA, 20 nt, Salmonella typhimurium LT2
aacaaaggcuauccaguggu

SEQ ID NO: 1832603 - RNA, 13 nt, Salmonella typhimurium LT2
aacaacccauucg

SEQ ID NO: 1832604 - RNA, 18 nt, Salmonella typhimurium LT2
aacaaagaggcugcgcga

SEQ ID NO: 1832605 - RNA, 18 nt, Salmonella typhimurium LT2
cgacacccgauacacgcc

SEQ ID NO: 1832606 - RNA, 19 nt, Salmonella typhimurium LT2
cgacacccgauacacgccg

SEQ ID NO: 1832607 - RNA, 18 nt, Salmonella typhimurium LT2
cgacaagcuaauccccag

SEQ ID NO: 1832608 - RNA, 20 nt, Salmonella typhimurium LT2
cgaauuccuuuuuccgccac

SEQ ID NO: 1832609 - RNA, 14 nt, Salmonella typhimurium LT2
cgacaaccagcgaa

SEQ ID NO: 1832610 - RNA, 21 nt, Salmonella typhimurium LT2
cgacaauggcgacgaucagcg

SEQ ID NO: 1832611 - RNA, 13 nt, Salmonella typhimurium LT2
cgacaauggcgac

SEQ ID NO: 1832612 - RNA, 19 nt, Salmonella typhimurium LT2
cgacaccacgcaggcgacc

SEQ ID NO: 1832613 - RNA, 15 nt, Salmonella typhimurium LT2
cgacaggcagcguca

SEQ ID NO: 1832614 - RNA, 15 nt, Salmonella typhimurium LT2
cgacagcgccauccg

SEQ ID NO: 1832615 - RNA, 16 nt, Salmonella typhimurium LT2
cgacagccaguaaugc

SEQ ID NO: 1832616 - RNA, 15 nt, Salmonella typhimurium LT2
cgacaguaccagcag

SEQ ID NO: 1832617 - RNA, 15 nt, Salmonella typhimurium LT2
cgacaggcggcagcu

SEQ ID NO: 1832618 - RNA, 15 nt, Salmonella typhimurium LT2
cgaaucaggcgugau

SEQ ID NO: 1832619 - RNA, 18 nt, Salmonella typhimurium LT2
cgaauccacuguccagau

SEQ ID NO: 1832620 - RNA, 22 nt, Salmonella typhimurium LT2
cgaauguuuuuucgcacgccuc

SEQ ID NO: 1832621 - RNA, 20 nt, Salmonella typhimurium LT2
cgaauccgugcgcagaauau

SEQ ID NO: 1832622 - RNA, 14 nt, Salmonella typhimurium LT2
cgaaggcgauaccg

SEQ ID NO: 1832623 - RNA, 17 nt, Salmonella typhimurium LT2
cgaaggcaacgccgcca

SEQ ID NO: 1832624 - RNA, 17 nt, Salmonella typhimurium LT2
cgaagagaugccggaug

SEQ ID NO: 1832625 - RNA, 21 nt, Salmonella typhimurium LT2
ccugucaggaugaaacgacac

SEQ ID NO: 1832626 - RNA, 19 nt, Salmonella typhimurium LT2
ccugucaguaccucgcaua

SEQ ID NO: 1832627 - RNA, 20 nt, Salmonella typhimurium LT2
ccuguaacgcauaagcgcga

SEQ ID NO: 1832628 - RNA, 21 nt, Salmonella typhimurium LT2
ccuguagggcacugggcgaua

SEQ ID NO: 1832629 - RNA, 18 nt, Salmonella typhimurium LT2
ccuguaaccuuaaaaggc

SEQ ID NO: 1832630 - RNA, 15 nt, Salmonella typhimurium LT2
ccuguaccaccacgc

SEQ ID NO: 1832631 - RNA, 20 nt, Salmonella typhimurium LT2
cgaacugucugaaucaaugc

SEQ ID NO: 1832632 - RNA, 19 nt, Salmonella typhimurium LT2
cgacgcgccacuuccagcg

SEQ ID NO: 1832633 - RNA, 15 nt, Salmonella typhimurium LT2
cgacgcgauagcgca

SEQ ID NO: 1832634 - RNA, 17 nt, Salmonella typhimurium LT2
cgacgccguuuccggug

SEQ ID NO: 1832635 - RNA, 14 nt, Salmonella typhimurium LT2
cgacgaccgccaga

SEQ ID NO: 1832636 - RNA, 15 nt, Salmonella typhimurium LT2
cgacgcacgagaucc

SEQ ID NO: 1832637 - RNA, 24 nt, Salmonella typhimurium LT2
cgaccgugauucgcccguuguccg

SEQ ID NO: 1832638 - RNA, 21 nt, Salmonella typhimurium LT2
cgaccgugagaaucgaucagc

SEQ ID NO: 1832639 - RNA, 19 nt, Salmonella typhimurium LT2
cgaccaguuauucggcaua

SEQ ID NO: 1832640 - RNA, 18 nt, Salmonella typhimurium LT2
cgaccccaauagcgaucg

SEQ ID NO: 1832641 - RNA, 19 nt, Salmonella typhimurium LT2
cgaccagguaauggacgca

SEQ ID NO: 1832642 - RNA, 18 nt, Salmonella typhimurium LT2
cgcccaaauaguccagca

SEQ ID NO: 1832643 - RNA, 20 nt, Salmonella typhimurium LT2
cgcccaaaaugcggcauccg

SEQ ID NO: 1832644 - RNA, 19 nt, Salmonella typhimurium LT2
cgccauucggauaauccag

SEQ ID NO: 1832645 - RNA, 17 nt, Salmonella typhimurium LT2
cgccaugcggaaucacg

SEQ ID NO: 1832646 - RNA, 16 nt, Salmonella typhimurium LT2
cgccaucaggccuacg

SEQ ID NO: 1832647 - RNA, 14 nt, Salmonella typhimurium LT2
cgccaucagcgcga

SEQ ID NO: 1832648 - RNA, 12 nt, Salmonella typhimurium LT2
cgccaucaggca

SEQ ID NO: 1832649 - RNA, 14 nt, Salmonella typhimurium LT2
cgccaucaggcacu

SEQ ID NO: 1832650 - RNA, 12 nt, Salmonella typhimurium LT2
cgccaucaggcc

SEQ ID NO: 1832651 - RNA, 16 nt, Salmonella typhimurium LT2
cgccauauacgccacg

SEQ ID NO: 1832652 - RNA, 18 nt, Salmonella typhimurium LT2
cgccaucaacagcggaga

SEQ ID NO: 1832653 - RNA, 23 nt, Salmonella typhimurium LT2
cgccaucaauuuugcgccuaccg

SEQ ID NO: 1832654 - RNA, 21 nt, Salmonella typhimurium LT2
cgccaucacgcccggaugcgc

SEQ ID NO: 1832655 - RNA, 20 nt, Salmonella typhimurium LT2
cgccaguugggcagaaacgu

SEQ ID NO: 1832656 - RNA, 23 nt, Salmonella typhimurium LT2
cgccaguuuuugcgccauugccg

SEQ ID NO: 1832657 - RNA, 18 nt, Salmonella typhimurium LT2
cgccauaaaucgcggcga

SEQ ID NO: 1832658 - RNA, 19 nt, Salmonella typhimurium LT2
cgccauagccggcgauagc

SEQ ID NO: 1832659 - RNA, 14 nt, Salmonella typhimurium LT2
cgccauccggcaau

SEQ ID NO: 1832660 - RNA, 17 nt, Salmonella typhimurium LT2
cgccauccggcaauccg

SEQ ID NO: 1832661 - RNA, 11 nt, Salmonella typhimurium LT2
cgccauccggc

SEQ ID NO: 1832662 - RNA, 13 nt, Salmonella typhimurium LT2
cgccauccggcaa

SEQ ID NO: 1832663 - RNA, 14 nt, Salmonella typhimurium LT2
cgccauccggcaca

SEQ ID NO: 1832664 - RNA, 16 nt, Salmonella typhimurium LT2
cgccauccggcagaua

SEQ ID NO: 1832665 - RNA, 17 nt, Salmonella typhimurium LT2
cgccaucgacagcgcca

SEQ ID NO: 1832666 - RNA, 15 nt, Salmonella typhimurium LT2
cgccaucguccagcc

SEQ ID NO: 1832667 - RNA, 17 nt, Salmonella typhimurium LT2
cgccaucguccagccau

SEQ ID NO: 1832668 - RNA, 17 nt, Salmonella typhimurium LT2
cgccaucuccaucauuu

SEQ ID NO: 1832669 - RNA, 16 nt, Salmonella typhimurium LT2
cgccaugaucgauagc

SEQ ID NO: 1832670 - RNA, 18 nt, Salmonella typhimurium LT2
cgccaggccacggcugua

SEQ ID NO: 1832671 - RNA, 14 nt, Salmonella typhimurium LT2
cgccaggcacgccg

SEQ ID NO: 1832672 - RNA, 18 nt, Salmonella typhimurium LT2
cgccaggauugccugaug

SEQ ID NO: 1832673 - RNA, 23 nt, Salmonella typhimurium LT2
cgccagcuccauagaaaucagca

SEQ ID NO: 1832674 - RNA, 22 nt, Salmonella typhimurium LT2
cgccagcggauugccauacacg

SEQ ID NO: 1832675 - RNA, 17 nt, Salmonella typhimurium LT2
cgccagcggcagcgcgg

SEQ ID NO: 1832676 - RNA, 19 nt, Salmonella typhimurium LT2
cgccagcgucucagcaggc

SEQ ID NO: 1832677 - RNA, 20 nt, Salmonella typhimurium LT2
cgccagcgccgggauauccu

SEQ ID NO: 1832678 - RNA, 19 nt, Salmonella typhimurium LT2
cgccagguacuuacgcagc

SEQ ID NO: 1832679 - RNA, 16 nt, Salmonella typhimurium LT2
cgccaggcgcagcaaa

SEQ ID NO: 1832680 - RNA, 16 nt, Salmonella typhimurium LT2
cgccaguucagcgucu

SEQ ID NO: 1832681 - RNA, 18 nt, Salmonella typhimurium LT2
cgccagucaccagcagca

SEQ ID NO: 1832682 - RNA, 14 nt, Salmonella typhimurium LT2
cgccagucaucgcc

SEQ ID NO: 1832683 - RNA, 19 nt, Salmonella typhimurium LT2
cgccaguaaugccgugccg

SEQ ID NO: 1832684 - RNA, 17 nt, Salmonella typhimurium LT2
cgccacuuuuccggcac

SEQ ID NO: 1832685 - RNA, 20 nt, Salmonella typhimurium LT2
cgccacugugauacacgccg

SEQ ID NO: 1832686 - RNA, 22 nt, Salmonella typhimurium LT2
cgccacggccagcagccauucg

SEQ ID NO: 1832687 - RNA, 23 nt, Salmonella typhimurium LT2
cgccacguauuucgcagcgauca

SEQ ID NO: 1832688 - RNA, 16 nt, Salmonella typhimurium LT2
cgccacuaccagcgua

SEQ ID NO: 1832689 - RNA, 23 nt, Salmonella typhimurium LT2
cgccagcaauacccagaacuucc

SEQ ID NO: 1832690 - RNA, 21 nt, Salmonella typhimurium LT2
cgccagcaaaauuuugcgcag

SEQ ID NO: 1832691 - RNA, 17 nt, Salmonella typhimurium LT2
cgccagaugcagcggca

SEQ ID NO: 1832692 - RNA, 20 nt, Salmonella typhimurium LT2
cgccagaucgaacagcggca

SEQ ID NO: 1832693 - RNA, 22 nt, Salmonella typhimurium LT2
cgccagaucgaacagcggcaga

SEQ ID NO: 1832694 - RNA, 21 nt, Salmonella typhimurium LT2
cgccagacucagccaggucug

SEQ ID NO: 1832695 - RNA, 18 nt, Salmonella typhimurium LT2
cgccagacucgcuucacg

SEQ ID NO: 1832696 - RNA, 17 nt, Salmonella typhimurium LT2
cgccagauccggcguca

SEQ ID NO: 1832697 - RNA, 18 nt, Salmonella typhimurium LT2
cgccagauccuggcugua

SEQ ID NO: 1832698 - RNA, 18 nt, Salmonella typhimurium LT2
cgccagauaaucacgcca

SEQ ID NO: 1832699 - RNA, 21 nt, Salmonella typhimurium LT2
cgccagagcuucaggcgcgau

SEQ ID NO: 1832700 - RNA, 18 nt, Salmonella typhimurium LT2
cgccagcagggucaggaa

SEQ ID NO: 1832701 - RNA, 23 nt, Salmonella typhimurium LT2
cgccagccagccaguuagcgacc

SEQ ID NO: 1832702 - RNA, 22 nt, Salmonella typhimurium LT2
cgccagcauaugcacacgaagc

SEQ ID NO: 1832703 - RNA, 13 nt, Salmonella typhimurium LT2
cgccagcagcagu

SEQ ID NO: 1832704 - RNA, 14 nt, Salmonella typhimurium LT2
cgccagcacgccua

SEQ ID NO: 1832705 - RNA, 14 nt, Salmonella typhimurium LT2
cgccagccaguccg

SEQ ID NO: 1832706 - RNA, 23 nt, Salmonella typhimurium LT2
cgccagcccugcgaucaucauuc

SEQ ID NO: 1832707 - RNA, 18 nt, Salmonella typhimurium LT2
cgccagcccuuccagcgg

SEQ ID NO: 1832708 - RNA, 18 nt, Salmonella typhimurium LT2
cgccagccuaucgccaua

SEQ ID NO: 1832709 - RNA, 23 nt, Salmonella typhimurium LT2
cgccaauaugcgcaaggccguua

SEQ ID NO: 1832710 - RNA, 19 nt, Salmonella typhimurium LT2
cgccaccacauucaggcgg

SEQ ID NO: 1832711 - RNA, 12 nt, Salmonella typhimurium LT2
cgccaagcgcgg

SEQ ID NO: 1832712 - RNA, 12 nt, Salmonella typhimurium LT2
cgccaagcggca

SEQ ID NO: 1832713 - RNA, 15 nt, Salmonella typhimurium LT2
cgccaacgucgacag

SEQ ID NO: 1832714 - RNA, 18 nt, Salmonella typhimurium LT2
cgccaaagcagcugcugg

SEQ ID NO: 1832715 - RNA, 13 nt, Salmonella typhimurium LT2
cgcaggucgccag

SEQ ID NO: 1832716 - RNA, 14 nt, Salmonella typhimurium LT2
cgcaggucgccaga

SEQ ID NO: 1832717 - RNA, 20 nt, Salmonella typhimurium LT2
cgcaggguuucgauauccag

SEQ ID NO: 1832718 - RNA, 13 nt, Salmonella typhimurium LT2
cgccaaacccgcc

SEQ ID NO: 1832719 - RNA, 14 nt, Salmonella typhimurium LT2
cgccaaacgggcaa

SEQ ID NO: 1832720 - RNA, 14 nt, Salmonella typhimurium LT2
cgccaaaccggcga

SEQ ID NO: 1832721 - RNA, 13 nt, Salmonella typhimurium LT2
cgccaaacgccgc

SEQ ID NO: 1832722 - RNA, 20 nt, Salmonella typhimurium LT2
cgccaccaugaucaccugaa

SEQ ID NO: 1832723 - RNA, 15 nt, Salmonella typhimurium LT2
cgccacgcagcgacg

SEQ ID NO: 1832724 - RNA, 21 nt, Salmonella typhimurium LT2
cgccaccugcguggucauccg

SEQ ID NO: 1832725 - RNA, 18 nt, Salmonella typhimurium LT2
cgccaccuuugacgccug

SEQ ID NO: 1832726 - RNA, 17 nt, Salmonella typhimurium LT2
cgccacgcgccagccgu

SEQ ID NO: 1832727 - RNA, 21 nt, Salmonella typhimurium LT2
cgcacuucacgcuccuugagc

SEQ ID NO: 1832728 - RNA, 22 nt, Salmonella typhimurium LT2
cgcacuucgaaacgaucgauaa

SEQ ID NO: 1832729 - RNA, 15 nt, Salmonella typhimurium LT2
cgcacuacaucauuc

SEQ ID NO: 1832730 - RNA, 18 nt, Salmonella typhimurium LT2
cgcaccacgcaaaccgcu

SEQ ID NO: 1832731 - RNA, 14 nt, Salmonella typhimurium LT2
cgcaccaaccguga

SEQ ID NO: 1832732 - RNA, 16 nt, Salmonella typhimurium LT2
cgcaaccgacacauuc

SEQ ID NO: 1832733 - RNA, 17 nt, Salmonella typhimurium LT2
cgcaaccauuaccgcca

SEQ ID NO: 1832734 - RNA, 13 nt, Salmonella typhimurium LT2
cgcagaaucagcg

SEQ ID NO: 1832735 - RNA, 14 nt, Salmonella typhimurium LT2
cgcagcaucgccau

SEQ ID NO: 1832736 - RNA, 15 nt, Salmonella typhimurium LT2
cgcagacccagacgc

SEQ ID NO: 1832737 - RNA, 23 nt, Salmonella typhimurium LT2
cgcagacccgcaaaccacgucug

SEQ ID NO: 1832738 - RNA, 20 nt, Salmonella typhimurium LT2
cgcagccgccauccggcaca

SEQ ID NO: 1832739 - RNA, 13 nt, Salmonella typhimurium LT2
cgcagccgccauc

SEQ ID NO: 1832740 - RNA, 19 nt, Salmonella typhimurium LT2
cgcagcggcauuggcguua

SEQ ID NO: 1832741 - RNA, 16 nt, Salmonella typhimurium LT2
cgcagcuucaucauuc

SEQ ID NO: 1832742 - RNA, 18 nt, Salmonella typhimurium LT2
cgcaggccggauaagcga

SEQ ID NO: 1832743 - RNA, 16 nt, Salmonella typhimurium LT2
cgcaggcggucagcac

SEQ ID NO: 1832744 - RNA, 23 nt, Salmonella typhimurium LT2
cgcagcucugugugacguugccg

SEQ ID NO: 1832745 - RNA, 20 nt, Salmonella typhimurium LT2
cgaugcuggugaagacgcug

SEQ ID NO: 1832746 - RNA, 23 nt, Salmonella typhimurium LT2
cgaugcuggugaagacgcugcaa

SEQ ID NO: 1832747 - RNA, 17 nt, Salmonella typhimurium LT2
cgauauguggacgccau

SEQ ID NO: 1832748 - RNA, 19 nt, Salmonella typhimurium LT2
cgauauucaagcuguugga

SEQ ID NO: 1832749 - RNA, 16 nt, Salmonella typhimurium LT2
cgauauucacacgcuc

SEQ ID NO: 1832750 - RNA, 21 nt, Salmonella typhimurium LT2
cgauauuguccgucagcgcau

SEQ ID NO: 1832751 - RNA, 22 nt, Salmonella typhimurium LT2
cgauauuguccgucagcgcaug

SEQ ID NO: 1832752 - RNA, 14 nt, Salmonella typhimurium LT2
cgaucuguuaucac

SEQ ID NO: 1832753 - RNA, 19 nt, Salmonella typhimurium LT2
cgaucugguuguccaccag

SEQ ID NO: 1832754 - RNA, 21 nt, Salmonella typhimurium LT2
cgaugcauaugcacagcgcua

SEQ ID NO: 1832755 - RNA, 17 nt, Salmonella typhimurium LT2
cgaugagcguggcguag

SEQ ID NO: 1832756 - RNA, 20 nt, Salmonella typhimurium LT2
cgauguucggguaaacgcug

SEQ ID NO: 1832757 - RNA, 21 nt, Salmonella typhimurium LT2
cgauggcuuucuaccugcaau

SEQ ID NO: 1832758 - RNA, 15 nt, Salmonella typhimurium LT2
cgauuuuuacgccau

SEQ ID NO: 1832759 - RNA, 14 nt, Salmonella typhimurium LT2
cgcaaacgccguga

SEQ ID NO: 1832760 - RNA, 16 nt, Salmonella typhimurium LT2
cgcaaacgccgugaac

SEQ ID NO: 1832761 - RNA, 17 nt, Salmonella typhimurium LT2
cgcaaacgcuggcauaa

SEQ ID NO: 1832762 - RNA, 14 nt, Salmonella typhimurium LT2
cgauucaucgacaa

SEQ ID NO: 1832763 - RNA, 22 nt, Salmonella typhimurium LT2
cgauucugccaguucacgccgc

SEQ ID NO: 1832764 - RNA, 20 nt, Salmonella typhimurium LT2
cgauucugggguucaauagc

SEQ ID NO: 1832765 - RNA, 19 nt, Salmonella typhimurium LT2
cgauucgcgcgucaacggc

SEQ ID NO: 1832766 - RNA, 17 nt, Salmonella typhimurium LT2
aaagcgguccggcaucc

SEQ ID NO: 1832767 - RNA, 14 nt, Salmonella typhimurium LT2
aaagcgccacgcgu

SEQ ID NO: 1832768 - RNA, 15 nt, Salmonella typhimurium LT2
aaagcgccauccggc

SEQ ID NO: 1832769 - RNA, 17 nt, Salmonella typhimurium LT2
aaagcgccauccggcaa

SEQ ID NO: 1832770 - RNA, 19 nt, Salmonella typhimurium LT2
aaagcgcccagcgccggau

SEQ ID NO: 1832771 - RNA, 15 nt, Salmonella typhimurium LT2
aaagcgcgcccuuuc

SEQ ID NO: 1832772 - RNA, 21 nt, Salmonella typhimurium LT2
aaagcgcgcccuuucaguuca

SEQ ID NO: 1832773 - RNA, 23 nt, Salmonella typhimurium LT2
aaagccgugaauaaaaccggcau

SEQ ID NO: 1832774 - RNA, 21 nt, Salmonella typhimurium LT2
ccacaaaaggauacagcgccg

SEQ ID NO: 1832775 - RNA, 14 nt, Salmonella typhimurium LT2
ccacaaacgccgga

SEQ ID NO: 1832776 - RNA, 14 nt, Salmonella typhimurium LT2
ccacaaucccgcca

SEQ ID NO: 1832777 - RNA, 18 nt, Salmonella typhimurium LT2
ccacaaucacagcgcaga

SEQ ID NO: 1832778 - RNA, 16 nt, Salmonella typhimurium LT2
ccacaaguuuauccgg

SEQ ID NO: 1832779 - RNA, 14 nt, Salmonella typhimurium LT2
ccaagcagcgccac

SEQ ID NO: 1832780 - RNA, 14 nt, Salmonella typhimurium LT2
aaagccgcccaucc

SEQ ID NO: 1832781 - RNA, 14 nt, Salmonella typhimurium LT2
aaagccgcagcggu

SEQ ID NO: 1832782 - RNA, 19 nt, Salmonella typhimurium LT2
aaagccggaugugagcgca

SEQ ID NO: 1832783 - RNA, 21 nt, Salmonella typhimurium LT2
aaagccggaugugagcgcauc

SEQ ID NO: 1832784 - RNA, 23 nt, Salmonella typhimurium LT2
aaagccggaugugagcgcauccg

SEQ ID NO: 1832785 - RNA, 15 nt, Salmonella typhimurium LT2
aaagccggcgccauu

SEQ ID NO: 1832786 - RNA, 12 nt, Salmonella typhimurium LT2
ccaaucgccagu

SEQ ID NO: 1832787 - RNA, 17 nt, Salmonella typhimurium LT2
ccaaucgccgccgccag

SEQ ID NO: 1832788 - RNA, 20 nt, Salmonella typhimurium LT2
ccaaauaguccagcagccau

SEQ ID NO: 1832789 - RNA, 18 nt, Salmonella typhimurium LT2
ccaaaucaugccgccaaa

SEQ ID NO: 1832790 - RNA, 19 nt, Salmonella typhimurium LT2
ccaacagcagacagccgau

SEQ ID NO: 1832791 - RNA, 15 nt, Salmonella typhimurium LT2
ccaaaguuaaucagc

SEQ ID NO: 1832792 - RNA, 16 nt, Salmonella typhimurium LT2
ccaaauaguccagcag

SEQ ID NO: 1832793 - RNA, 15 nt, Salmonella typhimurium LT2
ccaaagaaacgcuga

SEQ ID NO: 1832794 - RNA, 14 nt, Salmonella typhimurium LT2
ccaaagauaagacc

SEQ ID NO: 1832795 - RNA, 19 nt, Salmonella typhimurium LT2
ccaacggucgugcgagaua

SEQ ID NO: 1832796 - RNA, 18 nt, Salmonella typhimurium LT2
ccaacgauauucgcuggu

SEQ ID NO: 1832797 - RNA, 19 nt, Salmonella typhimurium LT2
ccaccauaguuucgaacgc

SEQ ID NO: 1832798 - RNA, 21 nt, Salmonella typhimurium LT2
ccaccauaguuucgaacgcca

SEQ ID NO: 1832799 - RNA, 15 nt, Salmonella typhimurium LT2
ccaccauauucgcca

SEQ ID NO: 1832800 - RNA, 21 nt, Salmonella typhimurium LT2
ccaccauacccaacagcagac

SEQ ID NO: 1832801 - RNA, 23 nt, Salmonella typhimurium LT2
ccaccauaaaaccauucaaauuc

SEQ ID NO: 1832802 - RNA, 14 nt, Salmonella typhimurium LT2
ccaccauccggcaa

SEQ ID NO: 1832803 - RNA, 22 nt, Salmonella typhimurium LT2
ccacccgggccggaagagcgca

SEQ ID NO: 1832804 - RNA, 19 nt, Salmonella typhimurium LT2
ccacccgcugauaaaauuc

SEQ ID NO: 1832805 - RNA, 13 nt, Salmonella typhimurium LT2
ccaccagcgccau

SEQ ID NO: 1832806 - RNA, 13 nt, Salmonella typhimurium LT2
ccaccagcgccag

SEQ ID NO: 1832807 - RNA, 13 nt, Salmonella typhimurium LT2
ccaccacggcgca

SEQ ID NO: 1832808 - RNA, 16 nt, Salmonella typhimurium LT2
ccacacugacgcgcca

SEQ ID NO: 1832809 - RNA, 19 nt, Salmonella typhimurium LT2
ccagacggcgcccagccug

SEQ ID NO: 1832810 - RNA, 17 nt, Salmonella typhimurium LT2
ccagaucugcauccggg

SEQ ID NO: 1832811 - RNA, 12 nt, Salmonella typhimurium LT2
ccagaucauuac

SEQ ID NO: 1832812 - RNA, 12 nt, Salmonella typhimurium LT2
ccagauccgguu

SEQ ID NO: 1832813 - RNA, 15 nt, Salmonella typhimurium LT2
ccagaugaagcgcau

SEQ ID NO: 1832814 - RNA, 14 nt, Salmonella typhimurium LT2
ccagauuaucggcc

SEQ ID NO: 1832815 - RNA, 14 nt, Salmonella typhimurium LT2
ccagcaccagcagu

SEQ ID NO: 1832816 - RNA, 15 nt, Salmonella typhimurium LT2
ccagcaccauggcua

SEQ ID NO: 1832817 - RNA, 21 nt, Salmonella typhimurium LT2
ccacgucggauaagguguagc

SEQ ID NO: 1832818 - RNA, 15 nt, Salmonella typhimurium LT2
aaauaacgccagauc

SEQ ID NO: 1832819 - RNA, 14 nt, Salmonella typhimurium LT2
ccacuccgccacaa

SEQ ID NO: 1832820 - RNA, 19 nt, Salmonella typhimurium LT2
ccacuuauuuguauugacg

SEQ ID NO: 1832821 - RNA, 21 nt, Salmonella typhimurium LT2
ccagaaccucaccguccgcca

SEQ ID NO: 1832822 - RNA, 17 nt, Salmonella typhimurium LT2
ccacuggauuaucgaaa

SEQ ID NO: 1832823 - RNA, 13 nt, Salmonella typhimurium LT2
aaaggcggaaauc

SEQ ID NO: 1832824 - RNA, 18 nt, Salmonella typhimurium LT2
aaaggcggaaaucagcac

SEQ ID NO: 1832825 - RNA, 17 nt, Salmonella typhimurium LT2
aaaggcgaacuccagcg

SEQ ID NO: 1832826 - RNA, 12 nt, Salmonella typhimurium LT2
ccaccggcagcg

SEQ ID NO: 1832827 - RNA, 15 nt, Salmonella typhimurium LT2
ccaccggcagcgucg

SEQ ID NO: 1832828 - RNA, 21 nt, Salmonella typhimurium LT2
ccaccugccaggcuucgcgca

SEQ ID NO: 1832829 - RNA, 22 nt, Salmonella typhimurium LT2
ccaccugaaccucuucaccggu

SEQ ID NO: 1832830 - RNA, 16 nt, Salmonella typhimurium LT2
ccacgacaauauccuc

SEQ ID NO: 1832831 - RNA, 19 nt, Salmonella typhimurium LT2
aaagguuguuucaccaacg

SEQ ID NO: 1832832 - RNA, 19 nt, Salmonella typhimurium LT2
aaagguuucgauacagccu

SEQ ID NO: 1832833 - RNA, 19 nt, Salmonella typhimurium LT2
ccacgauggucggcgcugg

SEQ ID NO: 1832834 - RNA, 19 nt, Salmonella typhimurium LT2
aaagugaaggccagacuua

SEQ ID NO: 1832835 - RNA, 18 nt, Salmonella typhimurium LT2
ccacgccaauaugcgcaa

SEQ ID NO: 1832836 - RNA, 21 nt, Salmonella typhimurium LT2
ccacgcauaaugagcgcuuga

SEQ ID NO: 1832837 - RNA, 22 nt, Salmonella typhimurium LT2
ccacgcauaaugagcgcuugau

SEQ ID NO: 1832838 - RNA, 14 nt, Salmonella typhimurium LT2
ccacgcaaaccgcu

SEQ ID NO: 1832839 - RNA, 15 nt, Salmonella typhimurium LT2
ccacgccaucgcggc

SEQ ID NO: 1832840 - RNA, 21 nt, Salmonella typhimurium LT2
ccacgccauaauggcccagcg

SEQ ID NO: 1832841 - RNA, 13 nt, Salmonella typhimurium LT2
ccacgccagccag

SEQ ID NO: 1832842 - RNA, 17 nt, Salmonella typhimurium LT2
ccacgcuucccagcguc

SEQ ID NO: 1832843 - RNA, 19 nt, Salmonella typhimurium LT2
aaaguuuaugccucaagug

SEQ ID NO: 1832844 - RNA, 15 nt, Salmonella typhimurium LT2
ccacgcgccagccgu

SEQ ID NO: 1832845 - RNA, 13 nt, Salmonella typhimurium LT2
aaauccgccagug

SEQ ID NO: 1832846 - RNA, 17 nt, Salmonella typhimurium LT2
ccagcgugacccagaca

SEQ ID NO: 1832847 - RNA, 21 nt, Salmonella typhimurium LT2
aaaucaugaaggagagcauuu

SEQ ID NO: 1832848 - RNA, 11 nt, Salmonella typhimurium LT2
aaaucagcgcg

SEQ ID NO: 1832849 - RNA, 11 nt, Salmonella typhimurium LT2
aaauccggcag

SEQ ID NO: 1832850 - RNA, 23 nt, Salmonella typhimurium LT2
aaauccggcccagcgacagccag

SEQ ID NO: 1832851 - RNA, 14 nt, Salmonella typhimurium LT2
aaauccagcgcgcu

SEQ ID NO: 1832852 - RNA, 11 nt, Salmonella typhimurium LT2
aaaucaugccc

SEQ ID NO: 1832853 - RNA, 20 nt, Salmonella typhimurium LT2
aaaucaugcucauaauggac

SEQ ID NO: 1832854 - RNA, 14 nt, Salmonella typhimurium LT2
ccagcgguuucaua

SEQ ID NO: 1832855 - RNA, 19 nt, Salmonella typhimurium LT2
ccagcgcgccagcgccaau

SEQ ID NO: 1832856 - RNA, 19 nt, Salmonella typhimurium LT2
ccagcggccagggcgucaa

SEQ ID NO: 1832857 - RNA, 18 nt, Salmonella typhimurium LT2
ccagcggcgccaucacca

SEQ ID NO: 1832858 - RNA, 12 nt, Salmonella typhimurium LT2
ccagcaucgccg

SEQ ID NO: 1832859 - RNA, 14 nt, Salmonella typhimurium LT2
ccagcauagucgcu

SEQ ID NO: 1832860 - RNA, 16 nt, Salmonella typhimurium LT2
ccagcaucacaucaaa

SEQ ID NO: 1832861 - RNA, 18 nt, Salmonella typhimurium LT2
ccagccccgaugucgcca

SEQ ID NO: 1832862 - RNA, 17 nt, Salmonella typhimurium LT2
ccagcccccagccgauc

SEQ ID NO: 1832863 - RNA, 13 nt, Salmonella typhimurium LT2
ccagcccggcgca

SEQ ID NO: 1832864 - RNA, 16 nt, Salmonella typhimurium LT2
ccagccgaucaucgua

SEQ ID NO: 1832865 - RNA, 15 nt, Salmonella typhimurium LT2
ccagcgcaggcaacg

SEQ ID NO: 1832866 - RNA, 23 nt, Salmonella typhimurium LT2
ccagcgacauggcggucgccaua

SEQ ID NO: 1832867 - RNA, 20 nt, Salmonella typhimurium LT2
ccagcgaaccgcagcguuga

SEQ ID NO: 1832868 - RNA, 19 nt, Salmonella typhimurium LT2
ccagccgggcaggaaaagc

SEQ ID NO: 1832869 - RNA, 17 nt, Salmonella typhimurium LT2
ccaggaauuuucccaua

SEQ ID NO: 1832870 - RNA, 17 nt, Salmonella typhimurium LT2
ccaggacaacgccggua

SEQ ID NO: 1832871 - RNA, 20 nt, Salmonella typhimurium LT2
ccaggaacaggcccgccaga

SEQ ID NO: 1832872 - RNA, 16 nt, Salmonella typhimurium LT2
ccaggauaaugguguc

SEQ ID NO: 1832873 - RNA, 20 nt, Salmonella typhimurium LT2
ccaggcaagguuaacgucag

SEQ ID NO: 1832874 - RNA, 21 nt, Salmonella typhimurium LT2
ccaggcaaccugucaguaccu

SEQ ID NO: 1832875 - RNA, 19 nt, Salmonella typhimurium LT2
ccagcuucaucaucagcag

SEQ ID NO: 1832876 - RNA, 21 nt, Salmonella typhimurium LT2
ccagcuucaucaucagcagca

SEQ ID NO: 1832877 - RNA, 15 nt, Salmonella typhimurium LT2
ccagcugacgcagca

SEQ ID NO: 1832878 - RNA, 14 nt, Salmonella typhimurium LT2
ccagcucugccggu

SEQ ID NO: 1832879 - RNA, 15 nt, Salmonella typhimurium LT2
ccagcucccgcguca

SEQ ID NO: 1832880 - RNA, 16 nt, Salmonella typhimurium LT2
ccagcuauagcgcaaa

SEQ ID NO: 1832881 - RNA, 13 nt, Salmonella typhimurium LT2
ccaggccggcaua

SEQ ID NO: 1832882 - RNA, 14 nt, Salmonella typhimurium LT2
ccaggcaucgacgc

SEQ ID NO: 1832883 - RNA, 18 nt, Salmonella typhimurium LT2
ccagguuaucgguaauuu

SEQ ID NO: 1832884 - RNA, 16 nt, Salmonella typhimurium LT2
ccaguaccgacgccau

SEQ ID NO: 1832885 - RNA, 23 nt, Salmonella typhimurium LT2
ccaguaauuuuucucccagcaga

SEQ ID NO: 1832886 - RNA, 14 nt, Salmonella typhimurium LT2
ccaguaaugccaua

SEQ ID NO: 1832887 - RNA, 21 nt, Salmonella typhimurium LT2
ccaggucaaaauuaaucgcca

SEQ ID NO: 1832888 - RNA, 18 nt, Salmonella typhimurium LT2
ccaggucaucaccuccag

SEQ ID NO: 1832889 - RNA, 16 nt, Salmonella typhimurium LT2
cccgccaccaucuccu

SEQ ID NO: 1832890 - RNA, 15 nt, Salmonella typhimurium LT2
cccgccaaaccggcg

SEQ ID NO: 1832891 - RNA, 12 nt, Salmonella typhimurium LT2
cccgaucuucau

SEQ ID NO: 1832892 - RNA, 18 nt, Salmonella typhimurium LT2
cccggaucaccggcauuu

SEQ ID NO: 1832893 - RNA, 20 nt, Salmonella typhimurium LT2
cccgcugauaaaauucccgc

SEQ ID NO: 1832894 - RNA, 22 nt, Salmonella typhimurium LT2
cccgcugauaaaauucccgcgc

SEQ ID NO: 1832895 - RNA, 22 nt, Salmonella typhimurium LT2
cccgcucgguaauauauuucac

SEQ ID NO: 1832896 - RNA, 17 nt, Salmonella typhimurium LT2
cccgcgcugaggcgaca

SEQ ID NO: 1832897 - RNA, 16 nt, Salmonella typhimurium LT2
cccgcgcugaauggca

SEQ ID NO: 1832898 - RNA, 15 nt, Salmonella typhimurium LT2
cccgcgcgaucucuu

SEQ ID NO: 1832899 - RNA, 15 nt, Salmonella typhimurium LT2
cccgacaccagccgu

SEQ ID NO: 1832900 - RNA, 16 nt, Salmonella typhimurium LT2
ccccuuuacccaccag

SEQ ID NO: 1832901 - RNA, 16 nt, Salmonella typhimurium LT2
ccccuucaucagccag

SEQ ID NO: 1832902 - RNA, 20 nt, Salmonella typhimurium LT2
ccccugaugcguauccagcg

SEQ ID NO: 1832903 - RNA, 12 nt, Salmonella typhimurium LT2
ccccugcaauuc

SEQ ID NO: 1832904 - RNA, 15 nt, Salmonella typhimurium LT2
ccccgugcccggcau

SEQ ID NO: 1832905 - RNA, 21 nt, Salmonella typhimurium LT2
ccccagcgcuccaccaaccag

SEQ ID NO: 1832906 - RNA, 14 nt, Salmonella typhimurium LT2
ccccaucccggcaa

SEQ ID NO: 1832907 - RNA, 11 nt, Salmonella typhimurium LT2
ccccaacgcgc

SEQ ID NO: 1832908 - RNA, 15 nt, Salmonella typhimurium LT2
ccccaauugcugcau

SEQ ID NO: 1832909 - RNA, 18 nt, Salmonella typhimurium LT2
ccccacaaucccgccaga

SEQ ID NO: 1832910 - RNA, 17 nt, Salmonella typhimurium LT2
ccccggaucaccggcau

SEQ ID NO: 1832911 - RNA, 22 nt, Salmonella typhimurium LT2
ccccggaauggcgaaccacggc

SEQ ID NO: 1832912 - RNA, 17 nt, Salmonella typhimurium LT2
cccccagacucgacgcg

SEQ ID NO: 1832913 - RNA, 13 nt, Salmonella typhimurium LT2
ccauuaugccgca

SEQ ID NO: 1832914 - RNA, 16 nt, Salmonella typhimurium LT2
ccauuacgcuuaucgg

SEQ ID NO: 1832915 - RNA, 15 nt, Salmonella typhimurium LT2
ccauuccgccaacgg

SEQ ID NO: 1832916 - RNA, 22 nt, Salmonella typhimurium LT2
ccauuaaaagccagcacggcuu

SEQ ID NO: 1832917 - RNA, 13 nt, Salmonella typhimurium LT2
aaaucgcccaggu

SEQ ID NO: 1832918 - RNA, 14 nt, Salmonella typhimurium LT2
aaaucggcuccggc

SEQ ID NO: 1832919 - RNA, 15 nt, Salmonella typhimurium LT2
aaaucggcuccggca

SEQ ID NO: 1832920 - RNA, 23 nt, Salmonella typhimurium LT2
aaaucgccaaagaaacgcugauc

SEQ ID NO: 1832921 - RNA, 23 nt, Salmonella typhimurium LT2
cccagaaucagcaacacaaucag

SEQ ID NO: 1832922 - RNA, 13 nt, Salmonella typhimurium LT2
cccacgucauccg

SEQ ID NO: 1832923 - RNA, 21 nt, Salmonella typhimurium LT2
cccacgcuucccagcgucgcc

SEQ ID NO: 1832924 - RNA, 18 nt, Salmonella typhimurium LT2
cccacgguacgacgcggc

SEQ ID NO: 1832925 - RNA, 17 nt, Salmonella typhimurium LT2
cccaccauuccgauagc

SEQ ID NO: 1832926 - RNA, 23 nt, Salmonella typhimurium LT2
ccauuuuggggaaaauaccggua

SEQ ID NO: 1832927 - RNA, 16 nt, Salmonella typhimurium LT2
ccauuugccugccgca

SEQ ID NO: 1832928 - RNA, 14 nt, Salmonella typhimurium LT2
ccauuugcgacauc

SEQ ID NO: 1832929 - RNA, 18 nt, Salmonella typhimurium LT2
cccaaaaugcggcauccg

SEQ ID NO: 1832930 - RNA, 13 nt, Salmonella typhimurium LT2
cccaacagcagac

SEQ ID NO: 1832931 - RNA, 13 nt, Salmonella typhimurium LT2
cccaccagccgca

SEQ ID NO: 1832932 - RNA, 23 nt, Salmonella typhimurium LT2
cccaacugccagcggagaucgcu

SEQ ID NO: 1832933 - RNA, 12 nt, Salmonella typhimurium LT2
cccauugaaauc

SEQ ID NO: 1832934 - RNA, 15 nt, Salmonella typhimurium LT2
cccauguucaugcga

SEQ ID NO: 1832935 - RNA, 19 nt, Salmonella typhimurium LT2
cccauggcaucaaucccgc

SEQ ID NO: 1832936 - RNA, 17 nt, Salmonella typhimurium LT2
cccaucucaggccgaca

SEQ ID NO: 1832937 - RNA, 20 nt, Salmonella typhimurium LT2
cccagugccaccagccggag

SEQ ID NO: 1832938 - RNA, 18 nt, Salmonella typhimurium LT2
cccaguaauccggcaacu

SEQ ID NO: 1832939 - RNA, 16 nt, Salmonella typhimurium LT2
cccaguacggcgcgaa

SEQ ID NO: 1832940 - RNA, 22 nt, Salmonella typhimurium LT2
cccaucaauaagcgaauugccg

SEQ ID NO: 1832941 - RNA, 23 nt, Salmonella typhimurium LT2
cccauaguuucauauccgacaga

SEQ ID NO: 1832942 - RNA, 15 nt, Salmonella typhimurium LT2
cccaguuucaucauc

SEQ ID NO: 1832943 - RNA, 19 nt, Salmonella typhimurium LT2
cccaguuucaucaucgccg

SEQ ID NO: 1832944 - RNA, 11 nt, Salmonella typhimurium LT2
cccagcgcugg

SEQ ID NO: 1832945 - RNA, 15 nt, Salmonella typhimurium LT2
cccagcagcugcugu

SEQ ID NO: 1832946 - RNA, 16 nt, Salmonella typhimurium LT2
ccgacuaccggcacca

SEQ ID NO: 1832947 - RNA, 16 nt, Salmonella typhimurium LT2
ccgacucccccagauu

SEQ ID NO: 1832948 - RNA, 18 nt, Salmonella typhimurium LT2
ccgagaauuucagcacgc

SEQ ID NO: 1832949 - RNA, 23 nt, Salmonella typhimurium LT2
ccgacgcgaauugcgaguaaccu

SEQ ID NO: 1832950 - RNA, 19 nt, Salmonella typhimurium LT2
ccgaccuacaagauuugca

SEQ ID NO: 1832951 - RNA, 17 nt, Salmonella typhimurium LT2
ccgaccacuucaacgcc

SEQ ID NO: 1832952 - RNA, 23 nt, Salmonella typhimurium LT2
ccgacaaacuucaucgccacgcc

SEQ ID NO: 1832953 - RNA, 21 nt, Salmonella typhimurium LT2
ccgaauggcggcuucgccauc

SEQ ID NO: 1832954 - RNA, 16 nt, Salmonella typhimurium LT2
ccgaauaagcgacagc

SEQ ID NO: 1832955 - RNA, 21 nt, Salmonella typhimurium LT2
ccgaauaagcgacagcgccau

SEQ ID NO: 1832956 - RNA, 20 nt, Salmonella typhimurium LT2
ccgacagguuaacaaaggua

SEQ ID NO: 1832957 - RNA, 19 nt, Salmonella typhimurium LT2
ccgacaggcgcgaaacgcc

SEQ ID NO: 1832958 - RNA, 18 nt, Salmonella typhimurium LT2
ccgacaucgccaguugca

SEQ ID NO: 1832959 - RNA, 19 nt, Salmonella typhimurium LT2
cccguuuuucauccagcgg

SEQ ID NO: 1832960 - RNA, 20 nt, Salmonella typhimurium LT2
cccguuuuucauccagcggu

SEQ ID NO: 1832961 - RNA, 17 nt, Salmonella typhimurium LT2
cccuaaagcucaucaau

SEQ ID NO: 1832962 - RNA, 20 nt, Salmonella typhimurium LT2
cccuacgcugacgcgaucgc

SEQ ID NO: 1832963 - RNA, 21 nt, Salmonella typhimurium LT2
cccguuccaggcgaucucguu

SEQ ID NO: 1832964 - RNA, 13 nt, Salmonella typhimurium LT2
cccguuccaggcg

SEQ ID NO: 1832965 - RNA, 13 nt, Salmonella typhimurium LT2
aaaugacagccac

SEQ ID NO: 1832966 - RNA, 17 nt, Salmonella typhimurium LT2
cccgucagucgccagaa

SEQ ID NO: 1832967 - RNA, 12 nt, Salmonella typhimurium LT2
aaaucuccggcg

SEQ ID NO: 1832968 - RNA, 15 nt, Salmonella typhimurium LT2
cccggcuuccaucgc

SEQ ID NO: 1832969 - RNA, 20 nt, Salmonella typhimurium LT2
cccggcaaaccuaccggcau

SEQ ID NO: 1832970 - RNA, 23 nt, Salmonella typhimurium LT2
cccuggcgaauaaaauucagcgc

SEQ ID NO: 1832971 - RNA, 12 nt, Salmonella typhimurium LT2
cccuuccagcga

SEQ ID NO: 1832972 - RNA, 14 nt, Salmonella typhimurium LT2
cccuggcccggucg

SEQ ID NO: 1832973 - RNA, 21 nt, Salmonella typhimurium LT2
cccuucgcggaauuucaggaa

SEQ ID NO: 1832974 - RNA, 22 nt, Salmonella typhimurium LT2
cccuuucuucucaacgccggau

SEQ ID NO: 1832975 - RNA, 13 nt, Salmonella typhimurium LT2
cccuaaaagcgcg

SEQ ID NO: 1832976 - RNA, 22 nt, Salmonella typhimurium LT2
cccugcgaacagcgcuccacgc

SEQ ID NO: 1832977 - RNA, 24 nt, Salmonella typhimurium LT2
cccugccggaaaaugcgccaggaa

SEQ ID NO: 1832978 - RNA, 16 nt, Salmonella typhimurium LT2
cccugcgccagacgcg

SEQ ID NO: 1832979 - RNA, 19 nt, Salmonella typhimurium LT2
cccugcgccagcauggcgu

SEQ ID NO: 1832980 - RNA, 15 nt, Salmonella typhimurium LT2
cccugcgcauacguc

SEQ ID NO: 1832981 - RNA, 12 nt, Salmonella typhimurium LT2
ccgaagccaacg

SEQ ID NO: 1832982 - RNA, 19 nt, Salmonella typhimurium LT2
ccgaagccauuggucauca

SEQ ID NO: 1832983 - RNA, 16 nt, Salmonella typhimurium LT2
cagggugaauaccagc

SEQ ID NO: 1832984 - RNA, 15 nt, Salmonella typhimurium LT2
cagggugaaucccgc

SEQ ID NO: 1832985 - RNA, 21 nt, Salmonella typhimurium LT2
caggucgaccaccugcuguac

SEQ ID NO: 1832986 - RNA, 17 nt, Salmonella typhimurium LT2
cagggcuaacgccggua

SEQ ID NO: 1832987 - RNA, 16 nt, Salmonella typhimurium LT2
caggggucaucggcac

SEQ ID NO: 1832988 - RNA, 16 nt, Salmonella typhimurium LT2
cagggguuccggcaau

SEQ ID NO: 1832989 - RNA, 18 nt, Salmonella typhimurium LT2
cagggcgauauccagcgc

SEQ ID NO: 1832990 - RNA, 22 nt, Salmonella typhimurium LT2
cagugauuuccggguucacauc

SEQ ID NO: 1832991 - RNA, 14 nt, Salmonella typhimurium LT2
caguacgaucauga

SEQ ID NO: 1832992 - RNA, 23 nt, Salmonella typhimurium LT2
cagguuguaucauguuccggcag

SEQ ID NO: 1832993 - RNA, 21 nt, Salmonella typhimurium LT2
caguacgccaaaaaaggcagc

SEQ ID NO: 1832994 - RNA, 18 nt, Salmonella typhimurium LT2
caguagcacccuucgcua

SEQ ID NO: 1832995 - RNA, 14 nt, Salmonella typhimurium LT2
caggcggccaggca

SEQ ID NO: 1832996 - RNA, 13 nt, Salmonella typhimurium LT2
caggcggcaauau

SEQ ID NO: 1832997 - RNA, 18 nt, Salmonella typhimurium LT2
caggcgccuuauccggcc

SEQ ID NO: 1832998 - RNA, 15 nt, Salmonella typhimurium LT2
caggccggcagccug

SEQ ID NO: 1832999 - RNA, 15 nt, Salmonella typhimurium LT2
caggccggaacgacg

SEQ ID NO: 1833000 - RNA, 16 nt, Salmonella typhimurium LT2
caggccuaacacaugc

SEQ ID NO: 1833001 - RNA, 17 nt, Salmonella typhimurium LT2
caggccugcaaaccucu

SEQ ID NO: 1833002 - RNA, 19 nt, Salmonella typhimurium LT2
caggcuuccacgcacgccg

SEQ ID NO: 1833003 - RNA, 13 nt, Salmonella typhimurium LT2
cagggcagcgagc

SEQ ID NO: 1833004 - RNA, 13 nt, Salmonella typhimurium LT2
cagggcauccgcc

SEQ ID NO: 1833005 - RNA, 21 nt, Salmonella typhimurium LT2
caggcugaugugcuccaucag

SEQ ID NO: 1833006 - RNA, 14 nt, Salmonella typhimurium LT2
caggcacuugagaa

SEQ ID NO: 1833007 - RNA, 14 nt, Salmonella typhimurium LT2
caggauacagccga

SEQ ID NO: 1833008 - RNA, 18 nt, Salmonella typhimurium LT2
cagcguguaaucgccgua

SEQ ID NO: 1833009 - RNA, 19 nt, Salmonella typhimurium LT2
cagcguguuucaucucauc

SEQ ID NO: 1833010 - RNA, 15 nt, Salmonella typhimurium LT2
cagcguuacguuaag

SEQ ID NO: 1833011 - RNA, 19 nt, Salmonella typhimurium LT2
aaagauuuguuucaucgcc

SEQ ID NO: 1833012 - RNA, 14 nt, Salmonella typhimurium LT2
caggcagcguaaua

SEQ ID NO: 1833013 - RNA, 22 nt, Salmonella typhimurium LT2
caggcagcguaauacaggcgau

SEQ ID NO: 1833014 - RNA, 17 nt, Salmonella typhimurium LT2
caggccgacaauggcga

SEQ ID NO: 1833015 - RNA, 19 nt, Salmonella typhimurium LT2
caggccgccgcacaggcga

SEQ ID NO: 1833016 - RNA, 16 nt, Salmonella typhimurium LT2
caucgcggucagcggc

SEQ ID NO: 1833017 - RNA, 13 nt, Salmonella typhimurium LT2
caucgcucgcgcc

SEQ ID NO: 1833018 - RNA, 23 nt, Salmonella typhimurium LT2
caucgcgcacuucgaaacgaucg

SEQ ID NO: 1833019 - RNA, 13 nt, Salmonella typhimurium LT2
caucgccagccau

SEQ ID NO: 1833020 - RNA, 21 nt, Salmonella typhimurium LT2
caucaguacaaacgcaccgcc

SEQ ID NO: 1833021 - RNA, 22 nt, Salmonella typhimurium LT2
cauccagcuugccgucgcaggc

SEQ ID NO: 1833022 - RNA, 15 nt, Salmonella typhimurium LT2
caucagcgccggauc

SEQ ID NO: 1833023 - RNA, 20 nt, Salmonella typhimurium LT2
caucaggaaaugaaccagau

SEQ ID NO: 1833024 - RNA, 19 nt, Salmonella typhimurium LT2
caucagggcguaagcgcgu

SEQ ID NO: 1833025 - RNA, 15 nt, Salmonella typhimurium LT2
cauccgugaccugcu

SEQ ID NO: 1833026 - RNA, 16 nt, Salmonella typhimurium LT2
cauccggcacggucaa

SEQ ID NO: 1833027 - RNA, 15 nt, Salmonella typhimurium LT2
cauccggcacgguca

SEQ ID NO: 1833028 - RNA, 21 nt, Salmonella typhimurium LT2
cauccggcaauuccgcaucag

SEQ ID NO: 1833029 - RNA, 21 nt, Salmonella typhimurium LT2
cauagaucuuugggccggaua

SEQ ID NO: 1833030 - RNA, 14 nt, Salmonella typhimurium LT2
cauauucugcgaaa

SEQ ID NO: 1833031 - RNA, 19 nt, Salmonella typhimurium LT2
cauauuuaugcagcgcguc

SEQ ID NO: 1833032 - RNA, 19 nt, Salmonella typhimurium LT2
caucaccugaugucccauc

SEQ ID NO: 1833033 - RNA, 20 nt, Salmonella typhimurium LT2
caucacuuuuggcgacagga

SEQ ID NO: 1833034 - RNA, 19 nt, Salmonella typhimurium LT2
caucacuucgcgcauugcg

SEQ ID NO: 1833035 - RNA, 17 nt, Salmonella typhimurium LT2
caucagccagcagcuca

SEQ ID NO: 1833036 - RNA, 22 nt, Salmonella typhimurium LT2
caucagccaggcggcaaagucu

SEQ ID NO: 1833037 - RNA, 16 nt, Salmonella typhimurium LT2
cauacaccuuugcccg

SEQ ID NO: 1833038 - RNA, 14 nt, Salmonella typhimurium LT2
cauacacaccagca

SEQ ID NO: 1833039 - RNA, 14 nt, Salmonella typhimurium LT2
cauaccgucaccac

SEQ ID NO: 1833040 - RNA, 19 nt, Salmonella typhimurium LT2
cauaccgccgcccagcaca

SEQ ID NO: 1833041 - RNA, 17 nt, Salmonella typhimurium LT2
cauacgccacgcuccag

SEQ ID NO: 1833042 - RNA, 11 nt, Salmonella typhimurium LT2
cauacgggcuu

SEQ ID NO: 1833043 - RNA, 23 nt, Salmonella typhimurium LT2
cauacggucaaacagauccagcg

SEQ ID NO: 1833044 - RNA, 14 nt, Salmonella typhimurium LT2
caguguuuccauac

SEQ ID NO: 1833045 - RNA, 23 nt, Salmonella typhimurium LT2
caguggagaggccaccagcgcca

SEQ ID NO: 1833046 - RNA, 18 nt, Salmonella typhimurium LT2
cauaacgaccuuuacuga

SEQ ID NO: 1833047 - RNA, 19 nt, Salmonella typhimurium LT2
cauaacgcccgacaaucgc

SEQ ID NO: 1833048 - RNA, 14 nt, Salmonella typhimurium LT2
cauaacgccgaugc

SEQ ID NO: 1833049 - RNA, 20 nt, Salmonella typhimurium LT2
cauaaccggcaaccaacgcc

SEQ ID NO: 1833050 - RNA, 18 nt, Salmonella typhimurium LT2
cauaaugauuguccagcc

SEQ ID NO: 1833051 - RNA, 12 nt, Salmonella typhimurium LT2
cauaaugaaucc

SEQ ID NO: 1833052 - RNA, 15 nt, Salmonella typhimurium LT2
caugaauucaacgcc

SEQ ID NO: 1833053 - RNA, 16 nt, Salmonella typhimurium LT2
caugacccagcgcgac

SEQ ID NO: 1833054 - RNA, 14 nt, Salmonella typhimurium LT2
caugaccagcgccg

SEQ ID NO: 1833055 - RNA, 12 nt, Salmonella typhimurium LT2
caugaccagcgc

SEQ ID NO: 1833056 - RNA, 18 nt, Salmonella typhimurium LT2
caugauaaucagcacgcc

SEQ ID NO: 1833057 - RNA, 19 nt, Salmonella typhimurium LT2
caugauaaucagcacgcca

SEQ ID NO: 1833058 - RNA, 16 nt, Salmonella typhimurium LT2
caugacgggggcgauc

SEQ ID NO: 1833059 - RNA, 17 nt, Salmonella typhimurium LT2
caucuucaccuuuccag

SEQ ID NO: 1833060 - RNA, 14 nt, Salmonella typhimurium LT2
caucuuaucaggcc

SEQ ID NO: 1833061 - RNA, 14 nt, Salmonella typhimurium LT2
caucuguagcggcg

SEQ ID NO: 1833062 - RNA, 22 nt, Salmonella typhimurium LT2
caucuuacugaccggcccguug

SEQ ID NO: 1833063 - RNA, 13 nt, Salmonella typhimurium LT2
caucuuuuccuga

SEQ ID NO: 1833064 - RNA, 18 nt, Salmonella typhimurium LT2
caugcauaaugcagccau

SEQ ID NO: 1833065 - RNA, 21 nt, Salmonella typhimurium LT2
caugaucggcuggguuuccgg

SEQ ID NO: 1833066 - RNA, 21 nt, Salmonella typhimurium LT2
caugauaucgagugaaccgga

SEQ ID NO: 1833067 - RNA, 18 nt, Salmonella typhimurium LT2
caugaucgauccgcauca

SEQ ID NO: 1833068 - RNA, 15 nt, Salmonella typhimurium LT2
caugaugagcgccau

SEQ ID NO: 1833069 - RNA, 15 nt, Salmonella typhimurium LT2
caugaugaucgcgau

SEQ ID NO: 1833070 - RNA, 23 nt, Salmonella typhimurium LT2
caugaugaucgcgauagcgcuga

SEQ ID NO: 1833071 - RNA, 23 nt, Salmonella typhimurium LT2
caugauggacguuuccugcgcca

SEQ ID NO: 1833072 - RNA, 15 nt, Salmonella typhimurium LT2
caugauggugaacag

SEQ ID NO: 1833073 - RNA, 16 nt, Salmonella typhimurium LT2
caucggcggcaaugcc

SEQ ID NO: 1833074 - RNA, 20 nt, Salmonella typhimurium LT2
caucggcgcgcuggcgugau

SEQ ID NO: 1833075 - RNA, 14 nt, Salmonella typhimurium LT2
caucggcaucgguc

SEQ ID NO: 1833076 - RNA, 18 nt, Salmonella typhimurium LT2
caucgcuucuacagccac

SEQ ID NO: 1833077 - RNA, 18 nt, Salmonella typhimurium LT2
caucggcaaacaucugcu

SEQ ID NO: 1833078 - RNA, 13 nt, Salmonella typhimurium LT2
caucggcaaagcc

SEQ ID NO: 1833079 - RNA, 17 nt, Salmonella typhimurium LT2
caucggcaaagcccuga

SEQ ID NO: 1833080 - RNA, 13 nt, Salmonella typhimurium LT2
caucgcuugccca

SEQ ID NO: 1833081 - RNA, 14 nt, Salmonella typhimurium LT2
caucggcacauuag

SEQ ID NO: 1833082 - RNA, 22 nt, Salmonella typhimurium LT2
caucggguacggaauaucccgc

SEQ ID NO: 1833083 - RNA, 15 nt, Salmonella typhimurium LT2
caucggucgcgcgca

SEQ ID NO: 1833084 - RNA, 23 nt, Salmonella typhimurium LT2
caucguaccaauacccagcgcca

SEQ ID NO: 1833085 - RNA, 14 nt, Salmonella typhimurium LT2
caucgguucugcga

SEQ ID NO: 1833086 - RNA, 21 nt, Salmonella typhimurium LT2
caucgggacggcggucgcuga

SEQ ID NO: 1833087 - RNA, 15 nt, Salmonella typhimurium LT2
caucgggcaauggca

SEQ ID NO: 1833088 - RNA, 22 nt, Salmonella typhimurium LT2
caucucgucaaacucuuccggg

SEQ ID NO: 1833089 - RNA, 23 nt, Salmonella typhimurium LT2
caucugaccgugaguaucgaucg

SEQ ID NO: 1833090 - RNA, 19 nt, Salmonella typhimurium LT2
caucucuucguucaggcgu

SEQ ID NO: 1833091 - RNA, 22 nt, Salmonella typhimurium LT2
caucugauagcccauccagcac

SEQ ID NO: 1833092 - RNA, 17 nt, Salmonella typhimurium LT2
caucugcggucuccuga

SEQ ID NO: 1833093 - RNA, 13 nt, Salmonella typhimurium LT2
caucuaccagguu

SEQ ID NO: 1833094 - RNA, 22 nt, Salmonella typhimurium LT2
caucgucgccagacccagcgcu

SEQ ID NO: 1833095 - RNA, 21 nt, Salmonella typhimurium LT2
cagcaagccggaagcgcgaau

SEQ ID NO: 1833096 - RNA, 19 nt, Salmonella typhimurium LT2
cagcaaggcggcggugaua

SEQ ID NO: 1833097 - RNA, 15 nt, Salmonella typhimurium LT2
cagcaauaacaggca

SEQ ID NO: 1833098 - RNA, 18 nt, Salmonella typhimurium LT2
cagcaacacaaucaggcg

SEQ ID NO: 1833099 - RNA, 16 nt, Salmonella typhimurium LT2
cagcaacaaaccgaua

SEQ ID NO: 1833100 - RNA, 24 nt, Salmonella typhimurium LT2
cagcaacgugaacugcgccugcau

SEQ ID NO: 1833101 - RNA, 14 nt, Salmonella typhimurium LT2
cagauuaucggcca

SEQ ID NO: 1833102 - RNA, 18 nt, Salmonella typhimurium LT2
cagauucaugauuucuuc

SEQ ID NO: 1833103 - RNA, 14 nt, Salmonella typhimurium LT2
cagauugccgauau

SEQ ID NO: 1833104 - RNA, 18 nt, Salmonella typhimurium LT2
cagaugcugacucgcgca

SEQ ID NO: 1833105 - RNA, 17 nt, Salmonella typhimurium LT2
cagaugacagugcgcca

SEQ ID NO: 1833106 - RNA, 14 nt, Salmonella typhimurium LT2
cagcacgauaucca

SEQ ID NO: 1833107 - RNA, 22 nt, Salmonella typhimurium LT2
cagcacaaacaauuuacgcagc

SEQ ID NO: 1833108 - RNA, 17 nt, Salmonella typhimurium LT2
cagcaauuucucgcccg

SEQ ID NO: 1833109 - RNA, 14 nt, Salmonella typhimurium LT2
cagcaauuccgcca

SEQ ID NO: 1833110 - RNA, 14 nt, Salmonella typhimurium LT2
cagcaccgccagcg

SEQ ID NO: 1833111 - RNA, 16 nt, Salmonella typhimurium LT2
cagcaucgccgguagc

SEQ ID NO: 1833112 - RNA, 15 nt, Salmonella typhimurium LT2
cagccaaauagcgcc

SEQ ID NO: 1833113 - RNA, 17 nt, Salmonella typhimurium LT2
cagcauuggucaucgcc

SEQ ID NO: 1833114 - RNA, 22 nt, Salmonella typhimurium LT2
cagcauuaccagcaauaacagg

SEQ ID NO: 1833115 - RNA, 14 nt, Salmonella typhimurium LT2
cagcauccagcuca

SEQ ID NO: 1833116 - RNA, 21 nt, Salmonella typhimurium LT2
cagcauaaaaccgccgcccau

SEQ ID NO: 1833117 - RNA, 19 nt, Salmonella typhimurium LT2
cagcaucauggcauacagc

SEQ ID NO: 1833118 - RNA, 19 nt, Salmonella typhimurium LT2
cagcagugucugcuucguc

SEQ ID NO: 1833119 - RNA, 20 nt, Salmonella typhimurium LT2
cagcagggcguuuuccagcg

SEQ ID NO: 1833120 - RNA, 21 nt, Salmonella typhimurium LT2
cagcagggucaggaacugcgg

SEQ ID NO: 1833121 - RNA, 17 nt, Salmonella typhimurium LT2
cagcagacuauccgcgc

SEQ ID NO: 1833122 - RNA, 14 nt, Salmonella typhimurium LT2
cagcagacagguga

SEQ ID NO: 1833123 - RNA, 15 nt, Salmonella typhimurium LT2
cagcacuucccacug

SEQ ID NO: 1833124 - RNA, 17 nt, Salmonella typhimurium LT2
cagcagcggaaucgcuu

SEQ ID NO: 1833125 - RNA, 15 nt, Salmonella typhimurium LT2
cagcaggcagacgcg

SEQ ID NO: 1833126 - RNA, 20 nt, Salmonella typhimurium LT2
cagaacugguaggucaaccc

SEQ ID NO: 1833127 - RNA, 21 nt, Salmonella typhimurium LT2
cagaacugguaggucaacccu

SEQ ID NO: 1833128 - RNA, 23 nt, Salmonella typhimurium LT2
cagaaccugcucggcuaucgcca

SEQ ID NO: 1833129 - RNA, 19 nt, Salmonella typhimurium LT2
cacuuuacugaauaacagc

SEQ ID NO: 1833130 - RNA, 13 nt, Salmonella typhimurium LT2
cacuuucaucagc

SEQ ID NO: 1833131 - RNA, 17 nt, Salmonella typhimurium LT2
cacuuuccgaaucaggc

SEQ ID NO: 1833132 - RNA, 23 nt, Salmonella typhimurium LT2
cacuuucgcccggcgccagcuca

SEQ ID NO: 1833133 - RNA, 22 nt, Salmonella typhimurium LT2
cacuuucucggcuuuccagcuc

SEQ ID NO: 1833134 - RNA, 23 nt, Salmonella typhimurium LT2
cagaaauaaaauacgcucaauau

SEQ ID NO: 1833135 - RNA, 19 nt, Salmonella typhimurium LT2
cacuucugacauucagcgc

SEQ ID NO: 1833136 - RNA, 17 nt, Salmonella typhimurium LT2
cacuucgcguuagccgg

SEQ ID NO: 1833137 - RNA, 17 nt, Salmonella typhimurium LT2
cacuucuccacgcgaug

SEQ ID NO: 1833138 - RNA, 12 nt, Salmonella typhimurium LT2
cacuuccagcgc

SEQ ID NO: 1833139 - RNA, 16 nt, Salmonella typhimurium LT2
cacuucacuggcggca

SEQ ID NO: 1833140 - RNA, 15 nt, Salmonella typhimurium LT2
cacucauccagacca

SEQ ID NO: 1833141 - RNA, 19 nt, Salmonella typhimurium LT2
cacguugagaaagggauaa

SEQ ID NO: 1833142 - RNA, 20 nt, Salmonella typhimurium LT2
cacgcgcaguacggcgcaca

SEQ ID NO: 1833143 - RNA, 12 nt, Salmonella typhimurium LT2
cacugauacccc

SEQ ID NO: 1833144 - RNA, 20 nt, Salmonella typhimurium LT2
cacucgaagauacggauucu

SEQ ID NO: 1833145 - RNA, 20 nt, Salmonella typhimurium LT2
cacugauaguccaucaccuc

SEQ ID NO: 1833146 - RNA, 15 nt, Salmonella typhimurium LT2
cacugcuguagcguc

SEQ ID NO: 1833147 - RNA, 23 nt, Salmonella typhimurium LT2
cacugcuguagcgucucaucaaa

SEQ ID NO: 1833148 - RNA, 23 nt, Salmonella typhimurium LT2
cacugcuuccugccgcgaucgcg

SEQ ID NO: 1833149 - RNA, 17 nt, Salmonella typhimurium LT2
cacugauaguccaucac

SEQ ID NO: 1833150 - RNA, 19 nt, Salmonella typhimurium LT2
cacugcccagagaauauug

SEQ ID NO: 1833151 - RNA, 18 nt, Salmonella typhimurium LT2
cagagcgccggcaaagcc

SEQ ID NO: 1833152 - RNA, 16 nt, Salmonella typhimurium LT2
aaagaccgacaucgcc

SEQ ID NO: 1833153 - RNA, 23 nt, Salmonella typhimurium LT2
cagacucaguucgcgacccagau

SEQ ID NO: 1833154 - RNA, 14 nt, Salmonella typhimurium LT2
cagacgucaacacc

SEQ ID NO: 1833155 - RNA, 21 nt, Salmonella typhimurium LT2
cagacaaaaucuuuccagcuc

SEQ ID NO: 1833156 - RNA, 23 nt, Salmonella typhimurium LT2
cagacaaccauauuuaugcagcg

SEQ ID NO: 1833157 - RNA, 20 nt, Salmonella typhimurium LT2
cagacaauaccagggcgauu

SEQ ID NO: 1833158 - RNA, 20 nt, Salmonella typhimurium LT2
cagacacuggaaacagccaa

SEQ ID NO: 1833159 - RNA, 15 nt, Salmonella typhimurium LT2
cagacacugccaccg

SEQ ID NO: 1833160 - RNA, 17 nt, Salmonella typhimurium LT2
cagacgaugugaacgcc

SEQ ID NO: 1833161 - RNA, 12 nt, Salmonella typhimurium LT2
cagacagccgau

SEQ ID NO: 1833162 - RNA, 21 nt, Salmonella typhimurium LT2
cagaguaacccgauacccuga

SEQ ID NO: 1833163 - RNA, 20 nt, Salmonella typhimurium LT2
cagaggucgccgcuguaaua

SEQ ID NO: 1833164 - RNA, 17 nt, Salmonella typhimurium LT2
cagaggggauggcguau

SEQ ID NO: 1833165 - RNA, 20 nt, Salmonella typhimurium LT2
cagagcgucucauccggcag

SEQ ID NO: 1833166 - RNA, 18 nt, Salmonella typhimurium LT2
cagagcuucaggcgcgau

SEQ ID NO: 1833167 - RNA, 20 nt, Salmonella typhimurium LT2
cagaggaaauccuuccagcg

SEQ ID NO: 1833168 - RNA, 21 nt, Salmonella typhimurium LT2
cagauaaagcuucugcgccuu

SEQ ID NO: 1833169 - RNA, 23 nt, Salmonella typhimurium LT2
cagauaucuuccagcgcguccag

SEQ ID NO: 1833170 - RNA, 16 nt, Salmonella typhimurium LT2
cagaucaagcgggugu

SEQ ID NO: 1833171 - RNA, 16 nt, Salmonella typhimurium LT2
cagaucgcgcugcgca

SEQ ID NO: 1833172 - RNA, 17 nt, Salmonella typhimurium LT2
cagaucgcggcaauggc

SEQ ID NO: 1833173 - RNA, 20 nt, Salmonella typhimurium LT2
cagauccgguuucagcguuu

SEQ ID NO: 1833174 - RNA, 16 nt, Salmonella typhimurium LT2
cagauagggccaggcg

SEQ ID NO: 1833175 - RNA, 19 nt, Salmonella typhimurium LT2
cagauccagcgccguugcg

SEQ ID NO: 1833176 - RNA, 22 nt, Salmonella typhimurium LT2
cagaucgucggcguucaacacc

SEQ ID NO: 1833177 - RNA, 16 nt, Salmonella typhimurium LT2
cagaucuucacgcguc

SEQ ID NO: 1833178 - RNA, 18 nt, Salmonella typhimurium LT2
cagcgcgcgacccagcgc

SEQ ID NO: 1833179 - RNA, 19 nt, Salmonella typhimurium LT2
cagcgcgcgacccagcgca

SEQ ID NO: 1833180 - RNA, 20 nt, Salmonella typhimurium LT2
cagcgcgcgcgcaaagcguc

SEQ ID NO: 1833181 - RNA, 18 nt, Salmonella typhimurium LT2
cagcgcgccgucaucgcu

SEQ ID NO: 1833182 - RNA, 13 nt, Salmonella typhimurium LT2
cagcgcgccgcag

SEQ ID NO: 1833183 - RNA, 14 nt, Salmonella typhimurium LT2
cagcgcgccgccaa

SEQ ID NO: 1833184 - RNA, 17 nt, Salmonella typhimurium LT2
cagcgcgaccagcguga

SEQ ID NO: 1833185 - RNA, 14 nt, Salmonella typhimurium LT2
cagcgcgaccagcg

SEQ ID NO: 1833186 - RNA, 16 nt, Salmonella typhimurium LT2
cagcgcgaccagcgug

SEQ ID NO: 1833187 - RNA, 20 nt, Salmonella typhimurium LT2
cagcgcgaauuugccccaga

SEQ ID NO: 1833188 - RNA, 14 nt, Salmonella typhimurium LT2
cagcgcggcgugau

SEQ ID NO: 1833189 - RNA, 17 nt, Salmonella typhimurium LT2
cagcgcggccugcgugc

SEQ ID NO: 1833190 - RNA, 21 nt, Salmonella typhimurium LT2
cagcgcguccuccagcgugca

SEQ ID NO: 1833191 - RNA, 17 nt, Salmonella typhimurium LT2
cagcgcguccagcggca

SEQ ID NO: 1833192 - RNA, 15 nt, Salmonella typhimurium LT2
cagcgcuggcuguuc

SEQ ID NO: 1833193 - RNA, 14 nt, Salmonella typhimurium LT2
cagcgcuuagcggc

SEQ ID NO: 1833194 - RNA, 19 nt, Salmonella typhimurium LT2
cagcgcgucggccggcacc

SEQ ID NO: 1833195 - RNA, 20 nt, Salmonella typhimurium LT2
cagcggaaucgcuuccuggg

SEQ ID NO: 1833196 - RNA, 17 nt, Salmonella typhimurium LT2
cagcggcagcucgugca

SEQ ID NO: 1833197 - RNA, 24 nt, Salmonella typhimurium LT2
cagcggcauuggcguuaccggcag

SEQ ID NO: 1833198 - RNA, 22 nt, Salmonella typhimurium LT2
cagcguaauacaggcgauaucg

SEQ ID NO: 1833199 - RNA, 22 nt, Salmonella typhimurium LT2
cagcgguugcaugaaauccugg

SEQ ID NO: 1833200 - RNA, 20 nt, Salmonella typhimurium LT2
cagcgguuacuuuugaacau

SEQ ID NO: 1833201 - RNA, 14 nt, Salmonella typhimurium LT2
cagcgucgcgcgau

SEQ ID NO: 1833202 - RNA, 19 nt, Salmonella typhimurium LT2
cagcguaaugcgccaggca

SEQ ID NO: 1833203 - RNA, 14 nt, Salmonella typhimurium LT2
cagcgucgccagua

SEQ ID NO: 1833204 - RNA, 18 nt, Salmonella typhimurium LT2
cagcggcgccgcaaugcc

SEQ ID NO: 1833205 - RNA, 22 nt, Salmonella typhimurium LT2
cagcgcccccagcaaaccggca

SEQ ID NO: 1833206 - RNA, 13 nt, Salmonella typhimurium LT2
cagcgccagcgua

SEQ ID NO: 1833207 - RNA, 23 nt, Salmonella typhimurium LT2
cagcgccagcugcgucaugucgu

SEQ ID NO: 1833208 - RNA, 15 nt, Salmonella typhimurium LT2
cagcgcaggcaacgc

SEQ ID NO: 1833209 - RNA, 14 nt, Salmonella typhimurium LT2
cagcgccagcgacu

SEQ ID NO: 1833210 - RNA, 14 nt, Salmonella typhimurium LT2
cagcgccugacggc

SEQ ID NO: 1833211 - RNA, 20 nt, Salmonella typhimurium LT2
cagcgccucggcgcccagcg

SEQ ID NO: 1833212 - RNA, 24 nt, Salmonella typhimurium LT2
cagcgaucaggcgucagcggcuga

SEQ ID NO: 1833213 - RNA, 19 nt, Salmonella typhimurium LT2
cagcgaucaggggucagcg

SEQ ID NO: 1833214 - RNA, 20 nt, Salmonella typhimurium LT2
cagcgaucaggggucagcgu

SEQ ID NO: 1833215 - RNA, 13 nt, Salmonella typhimurium LT2
cagcgauacgcac

SEQ ID NO: 1833216 - RNA, 16 nt, Salmonella typhimurium LT2
cagcgaauuccggcca

SEQ ID NO: 1833217 - RNA, 22 nt, Salmonella typhimurium LT2
cagcgacagccaguaaugcugu

SEQ ID NO: 1833218 - RNA, 19 nt, Salmonella typhimurium LT2
cagcccuauaacagcgcca

SEQ ID NO: 1833219 - RNA, 20 nt, Salmonella typhimurium LT2
cagcccugugccgcuggugc

SEQ ID NO: 1833220 - RNA, 15 nt, Salmonella typhimurium LT2
cagcccugccaccag

SEQ ID NO: 1833221 - RNA, 19 nt, Salmonella typhimurium LT2
cagcccugccaccagcgua

SEQ ID NO: 1833222 - RNA, 14 nt, Salmonella typhimurium LT2
cagcccuuccagcg

SEQ ID NO: 1833223 - RNA, 21 nt, Salmonella typhimurium LT2
cagcccgacuaccggcaccag

SEQ ID NO: 1833224 - RNA, 20 nt, Salmonella typhimurium LT2
cagcccgccagcaccaggcu

SEQ ID NO: 1833225 - RNA, 17 nt, Salmonella typhimurium LT2
cagccgccauccggcac

SEQ ID NO: 1833226 - RNA, 19 nt, Salmonella typhimurium LT2
cagccgcauuuuucauggu

SEQ ID NO: 1833227 - RNA, 13 nt, Salmonella typhimurium LT2
cagccgcagccac

SEQ ID NO: 1833228 - RNA, 19 nt, Salmonella typhimurium LT2
cagccggaacgggcaugac

SEQ ID NO: 1833229 - RNA, 13 nt, Salmonella typhimurium LT2
cagccggucagcg

SEQ ID NO: 1833230 - RNA, 14 nt, Salmonella typhimurium LT2
cagccggucagcgu

SEQ ID NO: 1833231 - RNA, 16 nt, Salmonella typhimurium LT2
cagccgggcauaugau

SEQ ID NO: 1833232 - RNA, 14 nt, Salmonella typhimurium LT2
caccgccagcgucu

SEQ ID NO: 1833233 - RNA, 18 nt, Salmonella typhimurium LT2
caccgauaaacgccagcg

SEQ ID NO: 1833234 - RNA, 11 nt, Salmonella typhimurium LT2
caccgacagca

SEQ ID NO: 1833235 - RNA, 18 nt, Salmonella typhimurium LT2
caccgagacugcccggca

SEQ ID NO: 1833236 - RNA, 19 nt, Salmonella typhimurium LT2
caccucuuccgccaggucg

SEQ ID NO: 1833237 - RNA, 21 nt, Salmonella typhimurium LT2
caccugauuaccuaccagcgc

SEQ ID NO: 1833238 - RNA, 15 nt, Salmonella typhimurium LT2
caccucuuccagcgu

SEQ ID NO: 1833239 - RNA, 15 nt, Salmonella typhimurium LT2
caccgguucgcggca

SEQ ID NO: 1833240 - RNA, 15 nt, Salmonella typhimurium LT2
caccguauccggccu

SEQ ID NO: 1833241 - RNA, 19 nt, Salmonella typhimurium LT2
cacgccgccauccggcaac

SEQ ID NO: 1833242 - RNA, 18 nt, Salmonella typhimurium LT2
cacgccgccauccggcac

SEQ ID NO: 1833243 - RNA, 23 nt, Salmonella typhimurium LT2
cacgccgaugguugccagaccau

SEQ ID NO: 1833244 - RNA, 22 nt, Salmonella typhimurium LT2
cacgcccugaagggcggcugga

SEQ ID NO: 1833245 - RNA, 14 nt, Salmonella typhimurium LT2
cacgccguagcugc

SEQ ID NO: 1833246 - RNA, 18 nt, Salmonella typhimurium LT2
cacgccggagagcgcguu

SEQ ID NO: 1833247 - RNA, 16 nt, Salmonella typhimurium LT2
cacgccaucgccugau

SEQ ID NO: 1833248 - RNA, 17 nt, Salmonella typhimurium LT2
cacgccagucaccagca

SEQ ID NO: 1833249 - RNA, 18 nt, Salmonella typhimurium LT2
cacgccaaccaucggcac

SEQ ID NO: 1833250 - RNA, 22 nt, Salmonella typhimurium LT2
cacgcauaucccacugcacgcc

SEQ ID NO: 1833251 - RNA, 19 nt, Salmonella typhimurium LT2
cacgcaucgggucgcgugc

SEQ ID NO: 1833252 - RNA, 12 nt, Salmonella typhimurium LT2
cacgcagccaug

SEQ ID NO: 1833253 - RNA, 22 nt, Salmonella typhimurium LT2
cacgcacaaaaggcuggaacag

SEQ ID NO: 1833254 - RNA, 18 nt, Salmonella typhimurium LT2
cacgauguucaacgucag

SEQ ID NO: 1833255 - RNA, 21 nt, Salmonella typhimurium LT2
caccuguccgguguccaucag

SEQ ID NO: 1833256 - RNA, 15 nt, Salmonella typhimurium LT2
cacgaaggaaacgcc

SEQ ID NO: 1833257 - RNA, 16 nt, Salmonella typhimurium LT2
cacgaucgagccgucg

SEQ ID NO: 1833258 - RNA, 12 nt, Salmonella typhimurium LT2
cacgauaaagac

SEQ ID NO: 1833259 - RNA, 14 nt, Salmonella typhimurium LT2
cacgacagaacccg

SEQ ID NO: 1833260 - RNA, 14 nt, Salmonella typhimurium LT2
cacgaccagcgaca

SEQ ID NO: 1833261 - RNA, 19 nt, Salmonella typhimurium LT2
cacgacgcucauuaacgac

SEQ ID NO: 1833262 - RNA, 21 nt, Salmonella typhimurium LT2
cacaucguaaaucagcgugau

SEQ ID NO: 1833263 - RNA, 16 nt, Salmonella typhimurium LT2
caccaacggcgacgcc

SEQ ID NO: 1833264 - RNA, 13 nt, Salmonella typhimurium LT2
cacaucggcagga

SEQ ID NO: 1833265 - RNA, 15 nt, Salmonella typhimurium LT2
cacauccgccagcgc

SEQ ID NO: 1833266 - RNA, 20 nt, Salmonella typhimurium LT2
cacauccggcguguaaaccg

SEQ ID NO: 1833267 - RNA, 13 nt, Salmonella typhimurium LT2
cacaguacgcggc

SEQ ID NO: 1833268 - RNA, 13 nt, Salmonella typhimurium LT2
caccacaaaggcg

SEQ ID NO: 1833269 - RNA, 14 nt, Salmonella typhimurium LT2
caccacaaagucgc

SEQ ID NO: 1833270 - RNA, 14 nt, Salmonella typhimurium LT2
caccaaucaucacg

SEQ ID NO: 1833271 - RNA, 13 nt, Salmonella typhimurium LT2
caccaccgcaggc

SEQ ID NO: 1833272 - RNA, 14 nt, Salmonella typhimurium LT2
cacacucucuccag

SEQ ID NO: 1833273 - RNA, 14 nt, Salmonella typhimurium LT2
cacacuacguugga

SEQ ID NO: 1833274 - RNA, 19 nt, Salmonella typhimurium LT2
cacagaauacccuccgcca

SEQ ID NO: 1833275 - RNA, 17 nt, Salmonella typhimurium LT2
cacacugauggcagacc

SEQ ID NO: 1833276 - RNA, 18 nt, Salmonella typhimurium LT2
cacacugcgccgccagcg

SEQ ID NO: 1833277 - RNA, 18 nt, Salmonella typhimurium LT2
cacacugcuguguccagg

SEQ ID NO: 1833278 - RNA, 14 nt, Salmonella typhimurium LT2
cacaccaucgucgc

SEQ ID NO: 1833279 - RNA, 15 nt, Salmonella typhimurium LT2
cacaccguuauccgg

SEQ ID NO: 1833280 - RNA, 14 nt, Salmonella typhimurium LT2
caccagcuuaucag

SEQ ID NO: 1833281 - RNA, 20 nt, Salmonella typhimurium LT2
caccagcacgcaggcauccg

SEQ ID NO: 1833282 - RNA, 18 nt, Salmonella typhimurium LT2
caccagcaccgccagcgc

SEQ ID NO: 1833283 - RNA, 19 nt, Salmonella typhimurium LT2
caccagcaccgccagcgca

SEQ ID NO: 1833284 - RNA, 13 nt, Salmonella typhimurium LT2
caccagccaggcc

SEQ ID NO: 1833285 - RNA, 19 nt, Salmonella typhimurium LT2
caccaccugcuguugcgga

SEQ ID NO: 1833286 - RNA, 21 nt, Salmonella typhimurium LT2
caccagcacaauggucagcgc

SEQ ID NO: 1833287 - RNA, 23 nt, Salmonella typhimurium LT2
caccagaauccacucggcgcugu

SEQ ID NO: 1833288 - RNA, 23 nt, Salmonella typhimurium LT2
caccagaucggcaucuuuaaccg

SEQ ID NO: 1833289 - RNA, 16 nt, Salmonella typhimurium LT2
cacccagugccaccag

SEQ ID NO: 1833290 - RNA, 19 nt, Salmonella typhimurium LT2
caccaucuuuuccggcagg

SEQ ID NO: 1833291 - RNA, 22 nt, Salmonella typhimurium LT2
caccaucgcaaauucaucgccg

SEQ ID NO: 1833292 - RNA, 14 nt, Salmonella typhimurium LT2
caccauccggcgcu

SEQ ID NO: 1833293 - RNA, 16 nt, Salmonella typhimurium LT2
caccauccggcgcugu

SEQ ID NO: 1833294 - RNA, 17 nt, Salmonella typhimurium LT2
caaugauaacggcgcca

SEQ ID NO: 1833295 - RNA, 12 nt, Salmonella typhimurium LT2
caaucggcgucu

SEQ ID NO: 1833296 - RNA, 17 nt, Salmonella typhimurium LT2
caaucgcuuuuaucugg

SEQ ID NO: 1833297 - RNA, 17 nt, Salmonella typhimurium LT2
caaucagcgcggcgaag

SEQ ID NO: 1833298 - RNA, 15 nt, Salmonella typhimurium LT2
caauacgccagccua

SEQ ID NO: 1833299 - RNA, 20 nt, Salmonella typhimurium LT2
caauacgccagccuaucgcc

SEQ ID NO: 1833300 - RNA, 16 nt, Salmonella typhimurium LT2
caauaccaauaucgcc

SEQ ID NO: 1833301 - RNA, 15 nt, Salmonella typhimurium LT2
caauaccacaaccgg

SEQ ID NO: 1833302 - RNA, 15 nt, Salmonella typhimurium LT2
caaucaguacgcgcg

SEQ ID NO: 1833303 - RNA, 17 nt, Salmonella typhimurium LT2
caaucaguucacgcgcc

SEQ ID NO: 1833304 - RNA, 16 nt, Salmonella typhimurium LT2
caaucauauaaucuga

SEQ ID NO: 1833305 - RNA, 16 nt, Salmonella typhimurium LT2
caaucgcgguaugcga

SEQ ID NO: 1833306 - RNA, 12 nt, Salmonella typhimurium LT2
caaucgccaguu

SEQ ID NO: 1833307 - RNA, 20 nt, Salmonella typhimurium LT2
caauuuaaaauccggcugcc

SEQ ID NO: 1833308 - RNA, 13 nt, Salmonella typhimurium LT2
cacaacccaaagg

SEQ ID NO: 1833309 - RNA, 21 nt, Salmonella typhimurium LT2
caauuucuggccccugagcaa

SEQ ID NO: 1833310 - RNA, 22 nt, Salmonella typhimurium LT2
caauguaacaccuguaacguca

SEQ ID NO: 1833311 - RNA, 22 nt, Salmonella typhimurium LT2
caaugguguuuuccagcguaau

SEQ ID NO: 1833312 - RNA, 22 nt, Salmonella typhimurium LT2
caauuggacucgaaccaacgac

SEQ ID NO: 1833313 - RNA, 19 nt, Salmonella typhimurium LT2
cacaauauacaguucgccg

SEQ ID NO: 1833314 - RNA, 15 nt, Salmonella typhimurium LT2
cacaaguuuauccgg

SEQ ID NO: 1833315 - RNA, 18 nt, Salmonella typhimurium LT2
cacaaggucaaugugcuc

SEQ ID NO: 1833316 - RNA, 20 nt, Salmonella typhimurium LT2
cacaauuccggcccaggcca

SEQ ID NO: 1833317 - RNA, 13 nt, Salmonella typhimurium LT2
cacaauuacgcaa

SEQ ID NO: 1833318 - RNA, 13 nt, Salmonella typhimurium LT2
cacaaucagcgcg

SEQ ID NO: 1833319 - RNA, 18 nt, Salmonella typhimurium LT2
caagaaguuccaccgucu

SEQ ID NO: 1833320 - RNA, 23 nt, Salmonella typhimurium LT2
caagaagggauuaugcagacgcu

SEQ ID NO: 1833321 - RNA, 16 nt, Salmonella typhimurium LT2
caagaauuuaucgcaa

SEQ ID NO: 1833322 - RNA, 22 nt, Salmonella typhimurium LT2
caagcacaaaaaguaguuccag

SEQ ID NO: 1833323 - RNA, 16 nt, Salmonella typhimurium LT2
caacagaaucgcgaua

SEQ ID NO: 1833324 - RNA, 15 nt, Salmonella typhimurium LT2
caacucaguuuccag

SEQ ID NO: 1833325 - RNA, 17 nt, Salmonella typhimurium LT2
caagcgccuguucaaca

SEQ ID NO: 1833326 - RNA, 23 nt, Salmonella typhimurium LT2
caauaacagggaauuucuucgcg

SEQ ID NO: 1833327 - RNA, 20 nt, Salmonella typhimurium LT2
caauaaccgugguggcgaaa

SEQ ID NO: 1833328 - RNA, 16 nt, Salmonella typhimurium LT2
caauaaauugaaauuc

SEQ ID NO: 1833329 - RNA, 18 nt, Salmonella typhimurium LT2
caauaauaaaacggcuca

SEQ ID NO: 1833330 - RNA, 23 nt, Salmonella typhimurium LT2
caaguucgugagcgaagcgccgg

SEQ ID NO: 1833331 - RNA, 11 nt, Salmonella typhimurium LT2
augccuggcag

SEQ ID NO: 1833332 - RNA, 19 nt, Salmonella typhimurium LT2
augccuguguaucgcccug

SEQ ID NO: 1833333 - RNA, 17 nt, Salmonella typhimurium LT2
augccugucaucaucaa

SEQ ID NO: 1833334 - RNA, 21 nt, Salmonella typhimurium LT2
augccuuauccggccugcagg

SEQ ID NO: 1833335 - RNA, 20 nt, Salmonella typhimurium LT2
augccggccugauauccacg

SEQ ID NO: 1833336 - RNA, 18 nt, Salmonella typhimurium LT2
augcgccaguucagcguc

SEQ ID NO: 1833337 - RNA, 16 nt, Salmonella typhimurium LT2
augcgccaggcagcac

SEQ ID NO: 1833338 - RNA, 15 nt, Salmonella typhimurium LT2
augcgccagccgcuu

SEQ ID NO: 1833339 - RNA, 14 nt, Salmonella typhimurium LT2
augcgcgucaggcc

SEQ ID NO: 1833340 - RNA, 15 nt, Salmonella typhimurium LT2
augcgcgucaggcca

SEQ ID NO: 1833341 - RNA, 18 nt, Salmonella typhimurium LT2
augcgccccugcaggcga

SEQ ID NO: 1833342 - RNA, 16 nt, Salmonella typhimurium LT2
augcucaacuuccaga

SEQ ID NO: 1833343 - RNA, 13 nt, Salmonella typhimurium LT2
augcucaccgcga

SEQ ID NO: 1833344 - RNA, 14 nt, Salmonella typhimurium LT2
augcccugcuguuc

SEQ ID NO: 1833345 - RNA, 21 nt, Salmonella typhimurium LT2
augccaggcuuccugcgcugu

SEQ ID NO: 1833346 - RNA, 19 nt, Salmonella typhimurium LT2
augcaugguguugguacac

SEQ ID NO: 1833347 - RNA, 21 nt, Salmonella typhimurium LT2
augccaacuuuacuuaguauc

SEQ ID NO: 1833348 - RNA, 21 nt, Salmonella typhimurium LT2
augccaaacaucgcucgcgcc

SEQ ID NO: 1833349 - RNA, 22 nt, Salmonella typhimurium LT2
augcccccuccagccagcgcca

SEQ ID NO: 1833350 - RNA, 17 nt, Salmonella typhimurium LT2
augcccccucggcagca

SEQ ID NO: 1833351 - RNA, 21 nt, Salmonella typhimurium LT2
augccauuucuuuaugcgucu

SEQ ID NO: 1833352 - RNA, 21 nt, Salmonella typhimurium LT2
augccauuugcaaaagacggc

SEQ ID NO: 1833353 - RNA, 13 nt, Salmonella typhimurium LT2
augcccacggcgu

SEQ ID NO: 1833354 - RNA, 20 nt, Salmonella typhimurium LT2
augccauauucaacgaaugc

SEQ ID NO: 1833355 - RNA, 17 nt, Salmonella typhimurium LT2
augccaugaacgacccg

SEQ ID NO: 1833356 - RNA, 21 nt, Salmonella typhimurium LT2
auggguuuccuccaucagcgc

SEQ ID NO: 1833357 - RNA, 17 nt, Salmonella typhimurium LT2
auggcggcguuuuccgg

SEQ ID NO: 1833358 - RNA, 15 nt, Salmonella typhimurium LT2
auggcgcgccagcca

SEQ ID NO: 1833359 - RNA, 17 nt, Salmonella typhimurium LT2
auggucaucguuugggc

SEQ ID NO: 1833360 - RNA, 16 nt, Salmonella typhimurium LT2
auggucauuccagcua

SEQ ID NO: 1833361 - RNA, 15 nt, Salmonella typhimurium LT2
auguaaagcgccauu

SEQ ID NO: 1833362 - RNA, 18 nt, Salmonella typhimurium LT2
augcugcgccagccauaa

SEQ ID NO: 1833363 - RNA, 23 nt, Salmonella typhimurium LT2
augcugcgguugagcuucuuggc

SEQ ID NO: 1833364 - RNA, 18 nt, Salmonella typhimurium LT2
auggaguuccaguucauc

SEQ ID NO: 1833365 - RNA, 15 nt, Salmonella typhimurium LT2
auggauucaugguac

SEQ ID NO: 1833366 - RNA, 18 nt, Salmonella typhimurium LT2
auggcagggcgauaucca

SEQ ID NO: 1833367 - RNA, 17 nt, Salmonella typhimurium LT2
auggcagggacaacgca

SEQ ID NO: 1833368 - RNA, 15 nt, Salmonella typhimurium LT2
auggccgcagcgcca

SEQ ID NO: 1833369 - RNA, 23 nt, Salmonella typhimurium LT2
aucugcgcccauuuccucggcca

SEQ ID NO: 1833370 - RNA, 22 nt, Salmonella typhimurium LT2
aucugaugauggaacagacgcc

SEQ ID NO: 1833371 - RNA, 12 nt, Salmonella typhimurium LT2
aucugauagccc

SEQ ID NO: 1833372 - RNA, 18 nt, Salmonella typhimurium LT2
aucguuaauucauggcca

SEQ ID NO: 1833373 - RNA, 21 nt, Salmonella typhimurium LT2
aucucacgcucauagccgcuu

SEQ ID NO: 1833374 - RNA, 19 nt, Salmonella typhimurium LT2
aucucauagacugccgccg

SEQ ID NO: 1833375 - RNA, 20 nt, Salmonella typhimurium LT2
aucuccaguuguucacggga

SEQ ID NO: 1833376 - RNA, 14 nt, Salmonella typhimurium LT2
aucuccagcgcauu

SEQ ID NO: 1833377 - RNA, 16 nt, Salmonella typhimurium LT2
aucucccccggcacca

SEQ ID NO: 1833378 - RNA, 19 nt, Salmonella typhimurium LT2
aucucgcuaaucaucagcg

SEQ ID NO: 1833379 - RNA, 12 nt, Salmonella typhimurium LT2
aucgucgcgcca

SEQ ID NO: 1833380 - RNA, 20 nt, Salmonella typhimurium LT2
aucgucgcgccaauggcgau

SEQ ID NO: 1833381 - RNA, 15 nt, Salmonella typhimurium LT2
aucgucgccgaucgg

SEQ ID NO: 1833382 - RNA, 19 nt, Salmonella typhimurium LT2
aucguaugcagccaggcca

SEQ ID NO: 1833383 - RNA, 22 nt, Salmonella typhimurium LT2
aucguaccaauacccagcgcca

SEQ ID NO: 1833384 - RNA, 17 nt, Salmonella typhimurium LT2
aucgguucugcgacaua

SEQ ID NO: 1833385 - RNA, 20 nt, Salmonella typhimurium LT2
aucgaacgccgccugcgcca

SEQ ID NO: 1833386 - RNA, 14 nt, Salmonella typhimurium LT2
aucgaacgcuaaau

SEQ ID NO: 1833387 - RNA, 19 nt, Salmonella typhimurium LT2
aucgaauucauuacguaau

SEQ ID NO: 1833388 - RNA, 19 nt, Salmonella typhimurium LT2
aucgggcuuccagcguuga

SEQ ID NO: 1833389 - RNA, 22 nt, Salmonella typhimurium LT2
aucggucuccagcaacagcgcg

SEQ ID NO: 1833390 - RNA, 21 nt, Salmonella typhimurium LT2
aucgggcgggcauuauacgcc

SEQ ID NO: 1833391 - RNA, 20 nt, Salmonella typhimurium LT2
aucgggauuggaucgacgcu

SEQ ID NO: 1833392 - RNA, 20 nt, Salmonella typhimurium LT2
aucgggccgcucagcaucgc

SEQ ID NO: 1833393 - RNA, 22 nt, Salmonella typhimurium LT2
augagcacagcccauaccagcg

SEQ ID NO: 1833394 - RNA, 20 nt, Salmonella typhimurium LT2
augacgcugcgcuuauccgg

SEQ ID NO: 1833395 - RNA, 14 nt, Salmonella typhimurium LT2
augacggcaaagcc

SEQ ID NO: 1833396 - RNA, 19 nt, Salmonella typhimurium LT2
augacgggggcgaucagca

SEQ ID NO: 1833397 - RNA, 20 nt, Salmonella typhimurium LT2
augcaggccaagcagcgcca

SEQ ID NO: 1833398 - RNA, 18 nt, Salmonella typhimurium LT2
augcaggccaagcagcgc

SEQ ID NO: 1833399 - RNA, 19 nt, Salmonella typhimurium LT2
augcauaugcacagcgcua

SEQ ID NO: 1833400 - RNA, 20 nt, Salmonella typhimurium LT2
augcaguucuuucgccagaa

SEQ ID NO: 1833401 - RNA, 15 nt, Salmonella typhimurium LT2
augcaagucgaacgg

SEQ ID NO: 1833402 - RNA, 15 nt, Salmonella typhimurium LT2
aucuggcgacaucug

SEQ ID NO: 1833403 - RNA, 22 nt, Salmonella typhimurium LT2
aucuucuuccggcugccagcca

SEQ ID NO: 1833404 - RNA, 17 nt, Salmonella typhimurium LT2
augaaacgcauccagcc

SEQ ID NO: 1833405 - RNA, 11 nt, Salmonella typhimurium LT2
augaagcgcgu

SEQ ID NO: 1833406 - RNA, 14 nt, Salmonella typhimurium LT2
augacgcaggcgca

SEQ ID NO: 1833407 - RNA, 16 nt, Salmonella typhimurium LT2
augacgcaggcgcaaa

SEQ ID NO: 1833408 - RNA, 13 nt, Salmonella typhimurium LT2
augaccagcgccg

SEQ ID NO: 1833409 - RNA, 20 nt, Salmonella typhimurium LT2
augacacaucaccuccagcg

SEQ ID NO: 1833410 - RNA, 14 nt, Salmonella typhimurium LT2
caaacaguacgccc

SEQ ID NO: 1833411 - RNA, 14 nt, Salmonella typhimurium LT2
caaacagggcguga

SEQ ID NO: 1833412 - RNA, 22 nt, Salmonella typhimurium LT2
caaacagccguaccugcacucc

SEQ ID NO: 1833413 - RNA, 19 nt, Salmonella typhimurium LT2
caaacagccucaucaccgc

SEQ ID NO: 1833414 - RNA, 13 nt, Salmonella typhimurium LT2
caaaauuaaucgc

SEQ ID NO: 1833415 - RNA, 16 nt, Salmonella typhimurium LT2
caaaauuaaucgccag

SEQ ID NO: 1833416 - RNA, 16 nt, Salmonella typhimurium LT2
caaaaugcggcauccg

SEQ ID NO: 1833417 - RNA, 18 nt, Salmonella typhimurium LT2
caaaaucguaauaaagag

SEQ ID NO: 1833418 - RNA, 21 nt, Salmonella typhimurium LT2
caaaaucacgcacacgucuga

SEQ ID NO: 1833419 - RNA, 12 nt, Salmonella typhimurium LT2
caaaaucaaacu

SEQ ID NO: 1833420 - RNA, 22 nt, Salmonella typhimurium LT2
caaaaucccacauccggcugaa

SEQ ID NO: 1833421 - RNA, 20 nt, Salmonella typhimurium LT2
caaaccgaauucguccacac

SEQ ID NO: 1833422 - RNA, 18 nt, Salmonella typhimurium LT2
caaacgauuucaucagcg

SEQ ID NO: 1833423 - RNA, 15 nt, Salmonella typhimurium LT2
caaacucacgggcgu

SEQ ID NO: 1833424 - RNA, 14 nt, Salmonella typhimurium LT2
caaacuucaucgcc

SEQ ID NO: 1833425 - RNA, 17 nt, Salmonella typhimurium LT2
caaauaguccagcagcc

SEQ ID NO: 1833426 - RNA, 18 nt, Salmonella typhimurium LT2
caaaggggccacaggcgg

SEQ ID NO: 1833427 - RNA, 12 nt, Salmonella typhimurium LT2
caaaucaucgcc

SEQ ID NO: 1833428 - RNA, 18 nt, Salmonella typhimurium LT2
caaagcaccauucuucaa

SEQ ID NO: 1833429 - RNA, 12 nt, Salmonella typhimurium LT2
caaagaugauuu

SEQ ID NO: 1833430 - RNA, 15 nt, Salmonella typhimurium LT2
caaagaucucgguga

SEQ ID NO: 1833431 - RNA, 15 nt, Salmonella typhimurium LT2
caaagauaaacgaca

SEQ ID NO: 1833432 - RNA, 18 nt, Salmonella typhimurium LT2
caacacgcgcaccaguuc

SEQ ID NO: 1833433 - RNA, 20 nt, Salmonella typhimurium LT2
caacacgcggucgucaucgg

SEQ ID NO: 1833434 - RNA, 22 nt, Salmonella typhimurium LT2
caacacggcggcuagcgcaguu

SEQ ID NO: 1833435 - RNA, 14 nt, Salmonella typhimurium LT2
caacagaccgcugu

SEQ ID NO: 1833436 - RNA, 21 nt, Salmonella typhimurium LT2
caacacaucgacaugcagauc

SEQ ID NO: 1833437 - RNA, 15 nt, Salmonella typhimurium LT2
caacaccgacauccg

SEQ ID NO: 1833438 - RNA, 21 nt, Salmonella typhimurium LT2
caacaaugcuuucaccaguga

SEQ ID NO: 1833439 - RNA, 15 nt, Salmonella typhimurium LT2
caaauuuucaaccac

SEQ ID NO: 1833440 - RNA, 22 nt, Salmonella typhimurium LT2
caaauuguuggucacgauccgc

SEQ ID NO: 1833441 - RNA, 18 nt, Salmonella typhimurium LT2
caaaucgccaucagcgcg

SEQ ID NO: 1833442 - RNA, 17 nt, Salmonella typhimurium LT2
caaaucgcaggcauuca

SEQ ID NO: 1833443 - RNA, 14 nt, Salmonella typhimurium LT2
auuuuucugcgcca

SEQ ID NO: 1833444 - RNA, 17 nt, Salmonella typhimurium LT2
auuuugcucccuggugc

SEQ ID NO: 1833445 - RNA, 18 nt, Salmonella typhimurium LT2
auuuuguagguuccgaca

SEQ ID NO: 1833446 - RNA, 12 nt, Salmonella typhimurium LT2
auuuuuaagcug

SEQ ID NO: 1833447 - RNA, 19 nt, Salmonella typhimurium LT2
caaaaggauacagcgccgc

SEQ ID NO: 1833448 - RNA, 23 nt, Salmonella typhimurium LT2
caaaacggcuuuaaucacccgcg

SEQ ID NO: 1833449 - RNA, 16 nt, Salmonella typhimurium LT2
caaaacgggcuuccag

SEQ ID NO: 1833450 - RNA, 12 nt, Salmonella typhimurium LT2
caaaacgccggu

SEQ ID NO: 1833451 - RNA, 20 nt, Salmonella typhimurium LT2
caaaacgcauccagcgcaaa

SEQ ID NO: 1833452 - RNA, 15 nt, Salmonella typhimurium LT2
caaaacccaccagca

SEQ ID NO: 1833453 - RNA, 14 nt, Salmonella typhimurium LT2
caaaacccuucgca

SEQ ID NO: 1833454 - RNA, 15 nt, Salmonella typhimurium LT2
caaaaauaucgccgu

SEQ ID NO: 1833455 - RNA, 19 nt, Salmonella typhimurium LT2
caaaaaguaguuccagcau

SEQ ID NO: 1833456 - RNA, 19 nt, Salmonella typhimurium LT2
caaaaagaaucgccaggcg

SEQ ID NO: 1833457 - RNA, 13 nt, Salmonella typhimurium LT2
auuucuugcgcca

SEQ ID NO: 1833458 - RNA, 18 nt, Salmonella typhimurium LT2
auuucugccugauggcgc

SEQ ID NO: 1833459 - RNA, 21 nt, Salmonella typhimurium LT2
auuugcccuguaaauagugcg

SEQ ID NO: 1833460 - RNA, 23 nt, Salmonella typhimurium LT2
auuugcggcaauggccgcagcgc

SEQ ID NO: 1833461 - RNA, 22 nt, Salmonella typhimurium LT2
auuugcggcgucgccugguggc

SEQ ID NO: 1833462 - RNA, 13 nt, Salmonella typhimurium LT2
auuuguuucaucg

SEQ ID NO: 1833463 - RNA, 18 nt, Salmonella typhimurium LT2
auuuucuaugugcgccag

SEQ ID NO: 1833464 - RNA, 18 nt, Salmonella typhimurium LT2
auuuucgucguuucuaca

SEQ ID NO: 1833465 - RNA, 15 nt, Salmonella typhimurium LT2
auuuucggcagcgcg

SEQ ID NO: 1833466 - RNA, 16 nt, Salmonella typhimurium LT2
auuuuccguuaagcug

SEQ ID NO: 1833467 - RNA, 15 nt, Salmonella typhimurium LT2
auuuuagcgcaucgc

SEQ ID NO: 1833468 - RNA, 21 nt, Salmonella typhimurium LT2
auuuuacugccguauccaggg

SEQ ID NO: 1833469 - RNA, 13 nt, Salmonella typhimurium LT2
auuuuauccagga

SEQ ID NO: 1833470 - RNA, 14 nt, Salmonella typhimurium LT2
auuggccagcgugg

SEQ ID NO: 1833471 - RNA, 11 nt, Salmonella typhimurium LT2
auugccgccag

SEQ ID NO: 1833472 - RNA, 20 nt, Salmonella typhimurium LT2
auuguccacggggcggcaau

SEQ ID NO: 1833473 - RNA, 19 nt, Salmonella typhimurium LT2
auuggcgaggaacaucagc

SEQ ID NO: 1833474 - RNA, 18 nt, Salmonella typhimurium LT2
auucguuacccgauaccg

SEQ ID NO: 1833475 - RNA, 13 nt, Salmonella typhimurium LT2
auucguuagcguu

SEQ ID NO: 1833476 - RNA, 14 nt, Salmonella typhimurium LT2
auucgucuucaucu

SEQ ID NO: 1833477 - RNA, 20 nt, Salmonella typhimurium LT2
auucgccuuucacgcguuca

SEQ ID NO: 1833478 - RNA, 21 nt, Salmonella typhimurium LT2
auucguccccagcgauccagc

SEQ ID NO: 1833479 - RNA, 18 nt, Salmonella typhimurium LT2
auugcagcgcguggguga

SEQ ID NO: 1833480 - RNA, 22 nt, Salmonella typhimurium LT2
auucucccugccaggccaucug

SEQ ID NO: 1833481 - RNA, 17 nt, Salmonella typhimurium LT2
auugccaugaugagcgc

SEQ ID NO: 1833482 - RNA, 20 nt, Salmonella typhimurium LT2
auuucaaacguuucaagaug

SEQ ID NO: 1833483 - RNA, 14 nt, Salmonella typhimurium LT2
auuucaaucaucau

SEQ ID NO: 1833484 - RNA, 13 nt, Salmonella typhimurium LT2
auuucaaucgcac

SEQ ID NO: 1833485 - RNA, 14 nt, Salmonella typhimurium LT2
auuuauccuccgaa

SEQ ID NO: 1833486 - RNA, 20 nt, Salmonella typhimurium LT2
auuguggaacuuuaucgcac

SEQ ID NO: 1833487 - RNA, 21 nt, Salmonella typhimurium LT2
auugugguaagcaaucaaggu

SEQ ID NO: 1833488 - RNA, 12 nt, Salmonella typhimurium LT2
auuuaacgccag

SEQ ID NO: 1833489 - RNA, 21 nt, Salmonella typhimurium LT2
auuuacaaaugaccucaagaa

SEQ ID NO: 1833490 - RNA, 17 nt, Salmonella typhimurium LT2
auuucagugaaucgacg

SEQ ID NO: 1833491 - RNA, 13 nt, Salmonella typhimurium LT2
auuucagugguca

SEQ ID NO: 1833492 - RNA, 19 nt, Salmonella typhimurium LT2
auuucauaacuugccgccu

SEQ ID NO: 1833493 - RNA, 15 nt, Salmonella typhimurium LT2
auuuccggcgacgua

SEQ ID NO: 1833494 - RNA, 16 nt, Salmonella typhimurium LT2
auuucggaaugagaga

SEQ ID NO: 1833495 - RNA, 14 nt, Salmonella typhimurium LT2
auuucgccaguucc

SEQ ID NO: 1833496 - RNA, 19 nt, Salmonella typhimurium LT2
auucgcauguugacugcgc

SEQ ID NO: 1833497 - RNA, 18 nt, Salmonella typhimurium LT2
auucgacggccagcgcgc

SEQ ID NO: 1833498 - RNA, 21 nt, Salmonella typhimurium LT2
aaacucuguguuaugaaugac

SEQ ID NO: 1833499 - RNA, 17 nt, Salmonella typhimurium LT2
auuccgccaacgguaag

SEQ ID NO: 1833500 - RNA, 11 nt, Salmonella typhimurium LT2
auuccgccaua

SEQ ID NO: 1833501 - RNA, 15 nt, Salmonella typhimurium LT2
auucccugcgcauac

SEQ ID NO: 1833502 - RNA, 16 nt, Salmonella typhimurium LT2
auuccgcaaacgccgu

SEQ ID NO: 1833503 - RNA, 15 nt, Salmonella typhimurium LT2
aaacucccggcggaa

SEQ ID NO: 1833504 - RNA, 17 nt, Salmonella typhimurium LT2
auucagagcgucuacgc

SEQ ID NO: 1833505 - RNA, 21 nt, Salmonella typhimurium LT2
auuccacagguaaaauugccg

SEQ ID NO: 1833506 - RNA, 22 nt, Salmonella typhimurium LT2
auuccagauagcgcugcgccag

SEQ ID NO: 1833507 - RNA, 23 nt, Salmonella typhimurium LT2
auuccaucauguuaaugauuccg

SEQ ID NO: 1833508 - RNA, 22 nt, Salmonella typhimurium LT2
auuccccugaugcguauccagc

SEQ ID NO: 1833509 - RNA, 20 nt, Salmonella typhimurium LT2
auucccgccugcggacacgg

SEQ ID NO: 1833510 - RNA, 23 nt, Salmonella typhimurium LT2
auucccgccugcggacacggcgu

SEQ ID NO: 1833511 - RNA, 14 nt, Salmonella typhimurium LT2
auuagagccaauau

SEQ ID NO: 1833512 - RNA, 13 nt, Salmonella typhimurium LT2
auuaccgccacuu

SEQ ID NO: 1833513 - RNA, 14 nt, Salmonella typhimurium LT2
auuaccuaccagcg

SEQ ID NO: 1833514 - RNA, 16 nt, Salmonella typhimurium LT2
auuacgccaucagcau

SEQ ID NO: 1833515 - RNA, 22 nt, Salmonella typhimurium LT2
auuacggacgauacaccuucac

SEQ ID NO: 1833516 - RNA, 21 nt, Salmonella typhimurium LT2
auuauggacgggauacggcga

SEQ ID NO: 1833517 - RNA, 16 nt, Salmonella typhimurium LT2
auuacagauauccacc

SEQ ID NO: 1833518 - RNA, 12 nt, Salmonella typhimurium LT2
auuaaucgccag

SEQ ID NO: 1833519 - RNA, 13 nt, Salmonella typhimurium LT2
auuaauauaaucc

SEQ ID NO: 1833520 - RNA, 13 nt, Salmonella typhimurium LT2
aggguaucaucaa

SEQ ID NO: 1833521 - RNA, 14 nt, Salmonella typhimurium LT2
agguaaauccgcca

SEQ ID NO: 1833522 - RNA, 11 nt, Salmonella typhimurium LT2
aggguggcgcc

SEQ ID NO: 1833523 - RNA, 22 nt, Salmonella typhimurium LT2
agggcggaagcagauaccagcc

SEQ ID NO: 1833524 - RNA, 19 nt, Salmonella typhimurium LT2
agggaaggggauuuuccgg

SEQ ID NO: 1833525 - RNA, 13 nt, Salmonella typhimurium LT2
aggcuggaucagg

SEQ ID NO: 1833526 - RNA, 17 nt, Salmonella typhimurium LT2
aggcgucgaccggucca

SEQ ID NO: 1833527 - RNA, 13 nt, Salmonella typhimurium LT2
aggucuccagcuc

SEQ ID NO: 1833528 - RNA, 23 nt, Salmonella typhimurium LT2
aggugcuugcgccgccauccggc

SEQ ID NO: 1833529 - RNA, 21 nt, Salmonella typhimurium LT2
agguguaauaaccguggcggc

SEQ ID NO: 1833530 - RNA, 20 nt, Salmonella typhimurium LT2
agguggcuagcccgcugcgc

SEQ ID NO: 1833531 - RNA, 14 nt, Salmonella typhimurium LT2
agguauccgccaua

SEQ ID NO: 1833532 - RNA, 16 nt, Salmonella typhimurium LT2
aggucgcuauccagca

SEQ ID NO: 1833533 - RNA, 17 nt, Salmonella typhimurium LT2
aggucgcgguggguagc

SEQ ID NO: 1833534 - RNA, 17 nt, Salmonella typhimurium LT2
agguauaaucagcauca

SEQ ID NO: 1833535 - RNA, 15 nt, Salmonella typhimurium LT2
aguacacgucgguau

SEQ ID NO: 1833536 - RNA, 21 nt, Salmonella typhimurium LT2
aguacaauaccuuuaagcgcu

SEQ ID NO: 1833537 - RNA, 14 nt, Salmonella typhimurium LT2
aguacgcaccagcc

SEQ ID NO: 1833538 - RNA, 13 nt, Salmonella typhimurium LT2
agguuaaccaugc

SEQ ID NO: 1833539 - RNA, 17 nt, Salmonella typhimurium LT2
agguucccgccgccauc

SEQ ID NO: 1833540 - RNA, 17 nt, Salmonella typhimurium LT2
agguugaaagaccuaaa

SEQ ID NO: 1833541 - RNA, 17 nt, Salmonella typhimurium LT2
agucccaaugcggaaac

SEQ ID NO: 1833542 - RNA, 21 nt, Salmonella typhimurium LT2
aguccaguacccgcacgcuuu

SEQ ID NO: 1833543 - RNA, 17 nt, Salmonella typhimurium LT2
agucccgggcuaaucgc

SEQ ID NO: 1833544 - RNA, 19 nt, Salmonella typhimurium LT2
agucccguccguuccgcca

SEQ ID NO: 1833545 - RNA, 22 nt, Salmonella typhimurium LT2
aguccaacaaggauauccgcca

SEQ ID NO: 1833546 - RNA, 17 nt, Salmonella typhimurium LT2
agucauauuaucgcgcu

SEQ ID NO: 1833547 - RNA, 18 nt, Salmonella typhimurium LT2
aguccuucuccuucgcca

SEQ ID NO: 1833548 - RNA, 15 nt, Salmonella typhimurium LT2
agucgacaacaucau

SEQ ID NO: 1833549 - RNA, 17 nt, Salmonella typhimurium LT2
agucgacagcccgccag

SEQ ID NO: 1833550 - RNA, 19 nt, Salmonella typhimurium LT2
aguccgccgucgucaccgc

SEQ ID NO: 1833551 - RNA, 19 nt, Salmonella typhimurium LT2
aguccgucguuaaucagcg

SEQ ID NO: 1833552 - RNA, 21 nt, Salmonella typhimurium LT2
aguccgucguuaaucagcgcg

SEQ ID NO: 1833553 - RNA, 16 nt, Salmonella typhimurium LT2
agucgcaucauggcga

SEQ ID NO: 1833554 - RNA, 21 nt, Salmonella typhimurium LT2
agucgcagagcccagcgcgau

SEQ ID NO: 1833555 - RNA, 14 nt, Salmonella typhimurium LT2
agucgcacaaagcg

SEQ ID NO: 1833556 - RNA, 17 nt, Salmonella typhimurium LT2
agucgauaaaucgccac

SEQ ID NO: 1833557 - RNA, 17 nt, Salmonella typhimurium LT2
agucgcgggcgcuaaac

SEQ ID NO: 1833558 - RNA, 17 nt, Salmonella typhimurium LT2
aguggcgggcguuugug

SEQ ID NO: 1833559 - RNA, 23 nt, Salmonella typhimurium LT2
aguggcgcggaaagccuucauca

SEQ ID NO: 1833560 - RNA, 15 nt, Salmonella typhimurium LT2
agugccgccaggcaa

SEQ ID NO: 1833561 - RNA, 14 nt, Salmonella typhimurium LT2
aguguuaucgccga

SEQ ID NO: 1833562 - RNA, 22 nt, Salmonella typhimurium LT2
aguggucgccacgcgacgccag

SEQ ID NO: 1833563 - RNA, 19 nt, Salmonella typhimurium LT2
agugggucacaucgcccug

SEQ ID NO: 1833564 - RNA, 24 nt, Salmonella typhimurium LT2
aguuaccguaaucaucgcgaucgc

SEQ ID NO: 1833565 - RNA, 18 nt, Salmonella typhimurium LT2
agugccacaacgccugau

SEQ ID NO: 1833566 - RNA, 18 nt, Salmonella typhimurium LT2
agugcaggaucaccggca

SEQ ID NO: 1833567 - RNA, 17 nt, Salmonella typhimurium LT2
agugcagcguuuccagc

SEQ ID NO: 1833568 - RNA, 21 nt, Salmonella typhimurium LT2
agucguuauccagaucuucag

SEQ ID NO: 1833569 - RNA, 14 nt, Salmonella typhimurium LT2
auaaaauuauuggc

SEQ ID NO: 1833570 - RNA, 22 nt, Salmonella typhimurium LT2
auaaacgacagcgccaucagca

SEQ ID NO: 1833571 - RNA, 20 nt, Salmonella typhimurium LT2
auaaacgguuucagcagcgg

SEQ ID NO: 1833572 - RNA, 18 nt, Salmonella typhimurium LT2
auaaacgcggccaucacg

SEQ ID NO: 1833573 - RNA, 18 nt, Salmonella typhimurium LT2
auaaauaggcgccgccga

SEQ ID NO: 1833574 - RNA, 16 nt, Salmonella typhimurium LT2
auaaagcgguuuucaa

SEQ ID NO: 1833575 - RNA, 20 nt, Salmonella typhimurium LT2
auaaagcgcucaugccacgc

SEQ ID NO: 1833576 - RNA, 14 nt, Salmonella typhimurium LT2
aguuguuccagcag

SEQ ID NO: 1833577 - RNA, 15 nt, Salmonella typhimurium LT2
aguucaauauccagc

SEQ ID NO: 1833578 - RNA, 16 nt, Salmonella typhimurium LT2
aguucaauauccagcc

SEQ ID NO: 1833579 - RNA, 12 nt, Salmonella typhimurium LT2
aguuaucgccga

SEQ ID NO: 1833580 - RNA, 13 nt, Salmonella typhimurium LT2
aguuaucgccgaa

SEQ ID NO: 1833581 - RNA, 19 nt, Salmonella typhimurium LT2
aguucaggaacaucagcau

SEQ ID NO: 1833582 - RNA, 20 nt, Salmonella typhimurium LT2
auaagcgacagcgccauccg

SEQ ID NO: 1833583 - RNA, 22 nt, Salmonella typhimurium LT2
auaagcgacagcgccauccggc

SEQ ID NO: 1833584 - RNA, 22 nt, Salmonella typhimurium LT2
auaagcgucagcgccauccggc

SEQ ID NO: 1833585 - RNA, 23 nt, Salmonella typhimurium LT2
auaagcgucuuuaaagccuucau

SEQ ID NO: 1833586 - RNA, 13 nt, Salmonella typhimurium LT2
auaagcggcguca

SEQ ID NO: 1833587 - RNA, 17 nt, Salmonella typhimurium LT2
auaagcggcgucauccg

SEQ ID NO: 1833588 - RNA, 19 nt, Salmonella typhimurium LT2
auaagcggcgucauccgga

SEQ ID NO: 1833589 - RNA, 22 nt, Salmonella typhimurium LT2
auaagcguaagcgccauccggc

SEQ ID NO: 1833590 - RNA, 14 nt, Salmonella typhimurium LT2
auaagggccuucau

SEQ ID NO: 1833591 - RNA, 14 nt, Salmonella typhimurium LT2
auaaggcgauaccu

SEQ ID NO: 1833592 - RNA, 12 nt, Salmonella typhimurium LT2
auaauccagcuu

SEQ ID NO: 1833593 - RNA, 21 nt, Salmonella typhimurium LT2
auaaucgcgauacugccgccc

SEQ ID NO: 1833594 - RNA, 23 nt, Salmonella typhimurium LT2
auaaugcgccccgcaacgccgau

SEQ ID NO: 1833595 - RNA, 18 nt, Salmonella typhimurium LT2
auacacgcccucucgcca

SEQ ID NO: 1833596 - RNA, 18 nt, Salmonella typhimurium LT2
auacaagguauccgccau

SEQ ID NO: 1833597 - RNA, 14 nt, Salmonella typhimurium LT2
auacacaauacgcc

SEQ ID NO: 1833598 - RNA, 21 nt, Salmonella typhimurium LT2
auacaccagcucccgcgucac

SEQ ID NO: 1833599 - RNA, 21 nt, Salmonella typhimurium LT2
auacccgaccccgccaucaga

SEQ ID NO: 1833600 - RNA, 18 nt, Salmonella typhimurium LT2
auagcggugaacuugaag

SEQ ID NO: 1833601 - RNA, 15 nt, Salmonella typhimurium LT2
auagcguuuuccagc

SEQ ID NO: 1833602 - RNA, 20 nt, Salmonella typhimurium LT2
auagcguugauaugcucgac

SEQ ID NO: 1833603 - RNA, 18 nt, Salmonella typhimurium LT2
auaggugacuuuccuggc

SEQ ID NO: 1833604 - RNA, 23 nt, Salmonella typhimurium LT2
auagcuggcguagccaguaccga

SEQ ID NO: 1833605 - RNA, 17 nt, Salmonella typhimurium LT2
auagcuaaugcgguagc

SEQ ID NO: 1833606 - RNA, 21 nt, Salmonella typhimurium LT2
auagcuaaugcgguagcgaug

SEQ ID NO: 1833607 - RNA, 15 nt, Salmonella typhimurium LT2
auaccagcgcggcac

SEQ ID NO: 1833608 - RNA, 21 nt, Salmonella typhimurium LT2
auaccagaaaucgcucaugcg

SEQ ID NO: 1833609 - RNA, 17 nt, Salmonella typhimurium LT2
auaccacgcagcggcau

SEQ ID NO: 1833610 - RNA, 17 nt, Salmonella typhimurium LT2
auaccacaucgaccuga

SEQ ID NO: 1833611 - RNA, 18 nt, Salmonella typhimurium LT2
auacagcggcgcgccaau

SEQ ID NO: 1833612 - RNA, 11 nt, Salmonella typhimurium LT2
auacagcacgg

SEQ ID NO: 1833613 - RNA, 21 nt, Salmonella typhimurium LT2
auacagcgccgcgcaggcgau

SEQ ID NO: 1833614 - RNA, 16 nt, Salmonella typhimurium LT2
auaguccagcagccau

SEQ ID NO: 1833615 - RNA, 13 nt, Salmonella typhimurium LT2
auagucagcgcaa

SEQ ID NO: 1833616 - RNA, 23 nt, Salmonella typhimurium LT2
auaggugccgccgcacagaaucg

SEQ ID NO: 1833617 - RNA, 14 nt, Salmonella typhimurium LT2
auagucuucaagcc

SEQ ID NO: 1833618 - RNA, 17 nt, Salmonella typhimurium LT2
auagugacgccgccauc

SEQ ID NO: 1833619 - RNA, 22 nt, Salmonella typhimurium LT2
auauaguugagccauuccagcg

SEQ ID NO: 1833620 - RNA, 13 nt, Salmonella typhimurium LT2
auauccagcacgc

SEQ ID NO: 1833621 - RNA, 18 nt, Salmonella typhimurium LT2
auauauuucacuucauca

SEQ ID NO: 1833622 - RNA, 23 nt, Salmonella typhimurium LT2
auauccauaaacgucccgacgaa

SEQ ID NO: 1833623 - RNA, 23 nt, Salmonella typhimurium LT2
auaucccguggugcguugcgcca

SEQ ID NO: 1833624 - RNA, 15 nt, Salmonella typhimurium LT2
auauccggcgcaucg

SEQ ID NO: 1833625 - RNA, 20 nt, Salmonella typhimurium LT2
auauccucuuuucgaacgcc

SEQ ID NO: 1833626 - RNA, 16 nt, Salmonella typhimurium LT2
auauuccgcgcuaucg

SEQ ID NO: 1833627 - RNA, 19 nt, Salmonella typhimurium LT2
auauugcguaagcagcugc

SEQ ID NO: 1833628 - RNA, 22 nt, Salmonella typhimurium LT2
auauugagacguuauuagccgg

SEQ ID NO: 1833629 - RNA, 14 nt, Salmonella typhimurium LT2
aucaacgccgccag

SEQ ID NO: 1833630 - RNA, 22 nt, Salmonella typhimurium LT2
aucaacaggcuauaacgcacca

SEQ ID NO: 1833631 - RNA, 15 nt, Salmonella typhimurium LT2
auauuggcuggccug

SEQ ID NO: 1833632 - RNA, 23 nt, Salmonella typhimurium LT2
auauuggcgaggaacaucagcca

SEQ ID NO: 1833633 - RNA, 22 nt, Salmonella typhimurium LT2
auauuuugucaggccgcguggg

SEQ ID NO: 1833634 - RNA, 16 nt, Salmonella typhimurium LT2
auauuuucaacggcau

SEQ ID NO: 1833635 - RNA, 22 nt, Salmonella typhimurium LT2
aucaauaaaaucaccgcggcaa

SEQ ID NO: 1833636 - RNA, 21 nt, Salmonella typhimurium LT2
aucaauagcagcuucacgcgc

SEQ ID NO: 1833637 - RNA, 20 nt, Salmonella typhimurium LT2
aucaauauguuccggcgucg

SEQ ID NO: 1833638 - RNA, 17 nt, Salmonella typhimurium LT2
aucaauauaucaggcug

SEQ ID NO: 1833639 - RNA, 13 nt, Salmonella typhimurium LT2
aucacgcaucacu

SEQ ID NO: 1833640 - RNA, 13 nt, Salmonella typhimurium LT2
aucaccggcagau

SEQ ID NO: 1833641 - RNA, 23 nt, Salmonella typhimurium LT2
aucaccgcgaugaccaucaaaua

SEQ ID NO: 1833642 - RNA, 14 nt, Salmonella typhimurium LT2
aucacuuccgccac

SEQ ID NO: 1833643 - RNA, 17 nt, Salmonella typhimurium LT2
aucacuucgcgcauugc

SEQ ID NO: 1833644 - RNA, 23 nt, Salmonella typhimurium LT2
aucagaacaaacuuaucccacaa

SEQ ID NO: 1833645 - RNA, 13 nt, Salmonella typhimurium LT2
aucacggcaacgc

SEQ ID NO: 1833646 - RNA, 18 nt, Salmonella typhimurium LT2
aucacgcgugcgcggcac

SEQ ID NO: 1833647 - RNA, 15 nt, Salmonella typhimurium LT2
aucagccgccauccg

SEQ ID NO: 1833648 - RNA, 12 nt, Salmonella typhimurium LT2
aucaucgaacgc

SEQ ID NO: 1833649 - RNA, 17 nt, Salmonella typhimurium LT2
aucaucgccagcuuauc

SEQ ID NO: 1833650 - RNA, 16 nt, Salmonella typhimurium LT2
aucauagacugcgcuu

SEQ ID NO: 1833651 - RNA, 14 nt, Salmonella typhimurium LT2
aucauaguggcgca

SEQ ID NO: 1833652 - RNA, 15 nt, Salmonella typhimurium LT2
aucaguuaugacaga

SEQ ID NO: 1833653 - RNA, 21 nt, Salmonella typhimurium LT2
aucaguaugagcgaacggcuu

SEQ ID NO: 1833654 - RNA, 20 nt, Salmonella typhimurium LT2
aucagguacauauaggcauu

SEQ ID NO: 1833655 - RNA, 16 nt, Salmonella typhimurium LT2
aucagcugcugcgcuu

SEQ ID NO: 1833656 - RNA, 15 nt, Salmonella typhimurium LT2
auccgcauccgucaa

SEQ ID NO: 1833657 - RNA, 17 nt, Salmonella typhimurium LT2
auccgcaagacacgcuu

SEQ ID NO: 1833658 - RNA, 19 nt, Salmonella typhimurium LT2
auccgccagugaauccacc

SEQ ID NO: 1833659 - RNA, 14 nt, Salmonella typhimurium LT2
auccgccaccuuau

SEQ ID NO: 1833660 - RNA, 14 nt, Salmonella typhimurium LT2
auccggcacgccau

SEQ ID NO: 1833661 - RNA, 17 nt, Salmonella typhimurium LT2
auccggccuacguucca

SEQ ID NO: 1833662 - RNA, 22 nt, Salmonella typhimurium LT2
auccgcuauuaccaguaaugac

SEQ ID NO: 1833663 - RNA, 15 nt, Salmonella typhimurium LT2
auccggcaagcgcug

SEQ ID NO: 1833664 - RNA, 19 nt, Salmonella typhimurium LT2
auccgucaaaaugaucaga

SEQ ID NO: 1833665 - RNA, 18 nt, Salmonella typhimurium LT2
auccgucaaaaugaucag

SEQ ID NO: 1833666 - RNA, 18 nt, Salmonella typhimurium LT2
auccgugaauguccugcg

SEQ ID NO: 1833667 - RNA, 14 nt, Salmonella typhimurium LT2
auccgugaccugcu

SEQ ID NO: 1833668 - RNA, 21 nt, Salmonella typhimurium LT2
auccgguuuucguuaacugga

SEQ ID NO: 1833669 - RNA, 18 nt, Salmonella typhimurium LT2
auccgguucaaggcagga

SEQ ID NO: 1833670 - RNA, 22 nt, Salmonella typhimurium LT2
auccguuuucaguaaaucaacu

SEQ ID NO: 1833671 - RNA, 15 nt, Salmonella typhimurium LT2
auccuccagcggcau

SEQ ID NO: 1833672 - RNA, 21 nt, Salmonella typhimurium LT2
auccggcuguuccaguacgcu

SEQ ID NO: 1833673 - RNA, 14 nt, Salmonella typhimurium LT2
auccggcugcgucg

SEQ ID NO: 1833674 - RNA, 21 nt, Salmonella typhimurium LT2
auccgguaaacgcuccggcag

SEQ ID NO: 1833675 - RNA, 16 nt, Salmonella typhimurium LT2
auccggucauccagcg

SEQ ID NO: 1833676 - RNA, 18 nt, Salmonella typhimurium LT2
auccugcggaacgcggau

SEQ ID NO: 1833677 - RNA, 17 nt, Salmonella typhimurium LT2
auccugcaggguaauua

SEQ ID NO: 1833678 - RNA, 15 nt, Salmonella typhimurium LT2
auccugacaggccgg

SEQ ID NO: 1833679 - RNA, 21 nt, Salmonella typhimurium LT2
auccugaaggacaagcugcgc

SEQ ID NO: 1833680 - RNA, 17 nt, Salmonella typhimurium LT2
auccuuccagcgccaua

SEQ ID NO: 1833681 - RNA, 19 nt, Salmonella typhimurium LT2
auccuguccugggccgcca

SEQ ID NO: 1833682 - RNA, 21 nt, Salmonella typhimurium LT2
auccuguggguucaucgccac

SEQ ID NO: 1833683 - RNA, 24 nt, Salmonella typhimurium LT2
auccuguaccaccacgccuuucac

SEQ ID NO: 1833684 - RNA, 20 nt, Salmonella typhimurium LT2
auccagaucuucagaggccu

SEQ ID NO: 1833685 - RNA, 14 nt, Salmonella typhimurium LT2
auccagauccgguu

SEQ ID NO: 1833686 - RNA, 18 nt, Salmonella typhimurium LT2
auccaccugaucgugcca

SEQ ID NO: 1833687 - RNA, 16 nt, Salmonella typhimurium LT2
auccacggaucgacau

SEQ ID NO: 1833688 - RNA, 19 nt, Salmonella typhimurium LT2
auccagguggaucggaaau

SEQ ID NO: 1833689 - RNA, 17 nt, Salmonella typhimurium LT2
auccagggaaaccaugu

SEQ ID NO: 1833690 - RNA, 14 nt, Salmonella typhimurium LT2
auccagcgccguug

SEQ ID NO: 1833691 - RNA, 18 nt, Salmonella typhimurium LT2
auccagcgggccgacgau

SEQ ID NO: 1833692 - RNA, 19 nt, Salmonella typhimurium LT2
aucaugucaaauucaagcc

SEQ ID NO: 1833693 - RNA, 13 nt, Salmonella typhimurium LT2
auccaacacggcg

SEQ ID NO: 1833694 - RNA, 12 nt, Salmonella typhimurium LT2
aucauuucuaca

SEQ ID NO: 1833695 - RNA, 22 nt, Salmonella typhimurium LT2
auccaccauaguuucgaacgcc

SEQ ID NO: 1833696 - RNA, 14 nt, Salmonella typhimurium LT2
auccaccaccuggu

SEQ ID NO: 1833697 - RNA, 15 nt, Salmonella typhimurium LT2
auccacgcagacgcc

SEQ ID NO: 1833698 - RNA, 14 nt, Salmonella typhimurium LT2
aucccgccagcggc

SEQ ID NO: 1833699 - RNA, 22 nt, Salmonella typhimurium LT2
aucccgccacuguccugacggc

SEQ ID NO: 1833700 - RNA, 15 nt, Salmonella typhimurium LT2
aucccguagccgcuu

SEQ ID NO: 1833701 - RNA, 20 nt, Salmonella typhimurium LT2
auccaugauaaucagcacgc

SEQ ID NO: 1833702 - RNA, 16 nt, Salmonella typhimurium LT2
auccauuaaugccgca

SEQ ID NO: 1833703 - RNA, 20 nt, Salmonella typhimurium LT2
aucccacuccaucgccugau

SEQ ID NO: 1833704 - RNA, 12 nt, Salmonella typhimurium LT2
aucccacgucgc

SEQ ID NO: 1833705 - RNA, 17 nt, Salmonella typhimurium LT2
aucccagccgcgaugau

SEQ ID NO: 1833706 - RNA, 15 nt, Salmonella typhimurium LT2
auccccgccgccauc

SEQ ID NO: 1833707 - RNA, 14 nt, Salmonella typhimurium LT2
auccccgcuggcgc

SEQ ID NO: 1833708 - RNA, 15 nt, Salmonella typhimurium LT2
auccccgcuggcgcg

SEQ ID NO: 1833709 - RNA, 16 nt, Salmonella typhimurium LT2
agcgacuuauccggcc

SEQ ID NO: 1833710 - RNA, 20 nt, Salmonella typhimurium LT2
agcgaccggcacucaccucu

SEQ ID NO: 1833711 - RNA, 14 nt, Salmonella typhimurium LT2
agcgaccggcguca

SEQ ID NO: 1833712 - RNA, 20 nt, Salmonella typhimurium LT2
agcgaauaaucccggcgcca

SEQ ID NO: 1833713 - RNA, 16 nt, Salmonella typhimurium LT2
agcgcaacgcgcauca

SEQ ID NO: 1833714 - RNA, 22 nt, Salmonella typhimurium LT2
agcgcaacgcgcaucaacgcca

SEQ ID NO: 1833715 - RNA, 21 nt, Salmonella typhimurium LT2
agcgaugagcgccagcaacag

SEQ ID NO: 1833716 - RNA, 21 nt, Salmonella typhimurium LT2
agcgauguauuuauccacgcc

SEQ ID NO: 1833717 - RNA, 16 nt, Salmonella typhimurium LT2
agcgauccagaccggc

SEQ ID NO: 1833718 - RNA, 16 nt, Salmonella typhimurium LT2
agcgaucacgccgucc

SEQ ID NO: 1833719 - RNA, 14 nt, Salmonella typhimurium LT2
agcgccauccggca

SEQ ID NO: 1833720 - RNA, 17 nt, Salmonella typhimurium LT2
agcgccauccggcaauc

SEQ ID NO: 1833721 - RNA, 15 nt, Salmonella typhimurium LT2
agcgccauccggcag

SEQ ID NO: 1833722 - RNA, 20 nt, Salmonella typhimurium LT2
agcgccaugcggaaucacgc

SEQ ID NO: 1833723 - RNA, 14 nt, Salmonella typhimurium LT2
agcgccgcuuccag

SEQ ID NO: 1833724 - RNA, 13 nt, Salmonella typhimurium LT2
agcgccgcgcuau

SEQ ID NO: 1833725 - RNA, 19 nt, Salmonella typhimurium LT2
agcgcauuaccgccgccuu

SEQ ID NO: 1833726 - RNA, 23 nt, Salmonella typhimurium LT2
agcgcauuuuuaucagaccugcc

SEQ ID NO: 1833727 - RNA, 19 nt, Salmonella typhimurium LT2
agcgccacacguucgucca

SEQ ID NO: 1833728 - RNA, 17 nt, Salmonella typhimurium LT2
agcgccaauaccaauau

SEQ ID NO: 1833729 - RNA, 14 nt, Salmonella typhimurium LT2
agcgccaacgccac

SEQ ID NO: 1833730 - RNA, 16 nt, Salmonella typhimurium LT2
agcgccaacgccacug

SEQ ID NO: 1833731 - RNA, 17 nt, Salmonella typhimurium LT2
agcgccacggagcauaa

SEQ ID NO: 1833732 - RNA, 15 nt, Salmonella typhimurium LT2
agcgccacgcgucag

SEQ ID NO: 1833733 - RNA, 14 nt, Salmonella typhimurium LT2
agcgcauccggcca

SEQ ID NO: 1833734 - RNA, 17 nt, Salmonella typhimurium LT2
agcgcagcauuggguca

SEQ ID NO: 1833735 - RNA, 22 nt, Salmonella typhimurium LT2
agccuuauaggcgcaucugaaa

SEQ ID NO: 1833736 - RNA, 15 nt, Salmonella typhimurium LT2
agccuucaucaucau

SEQ ID NO: 1833737 - RNA, 20 nt, Salmonella typhimurium LT2
agccugccagcaccagcagc

SEQ ID NO: 1833738 - RNA, 15 nt, Salmonella typhimurium LT2
agccugaaucagcau

SEQ ID NO: 1833739 - RNA, 22 nt, Salmonella typhimurium LT2
agccuucaccccuucaucagua

SEQ ID NO: 1833740 - RNA, 20 nt, Salmonella typhimurium LT2
agcgaaaugcgaauccggcg

SEQ ID NO: 1833741 - RNA, 12 nt, Salmonella typhimurium LT2
agcgaaacugcc

SEQ ID NO: 1833742 - RNA, 15 nt, Salmonella typhimurium LT2
agcgaaacgcgcuau

SEQ ID NO: 1833743 - RNA, 21 nt, Salmonella typhimurium LT2
agccgucgauaaaauccucua

SEQ ID NO: 1833744 - RNA, 22 nt, Salmonella typhimurium LT2
agccgucgcuaucaauaccgcu

SEQ ID NO: 1833745 - RNA, 13 nt, Salmonella typhimurium LT2
agccggagccggu

SEQ ID NO: 1833746 - RNA, 13 nt, Salmonella typhimurium LT2
agccgcugggauu

SEQ ID NO: 1833747 - RNA, 22 nt, Salmonella typhimurium LT2
agccgcuguuuuucaucaucau

SEQ ID NO: 1833748 - RNA, 19 nt, Salmonella typhimurium LT2
agccggcuaucuucuuccg

SEQ ID NO: 1833749 - RNA, 13 nt, Salmonella typhimurium LT2
agccggcgccauu

SEQ ID NO: 1833750 - RNA, 14 nt, Salmonella typhimurium LT2
agccgauaguccgg

SEQ ID NO: 1833751 - RNA, 14 nt, Salmonella typhimurium LT2
agccgauacgcggg

SEQ ID NO: 1833752 - RNA, 14 nt, Salmonella typhimurium LT2
agcccuuccaccag

SEQ ID NO: 1833753 - RNA, 17 nt, Salmonella typhimurium LT2
agccgccacccggcaaa

SEQ ID NO: 1833754 - RNA, 15 nt, Salmonella typhimurium LT2
agccgccaguaacgc

SEQ ID NO: 1833755 - RNA, 21 nt, Salmonella typhimurium LT2
agccgccaguucaauauccag

SEQ ID NO: 1833756 - RNA, 23 nt, Salmonella typhimurium LT2
agccgccaguucaauauccagcc

SEQ ID NO: 1833757 - RNA, 17 nt, Salmonella typhimurium LT2
agccgccagauccuggc

SEQ ID NO: 1833758 - RNA, 15 nt, Salmonella typhimurium LT2
agccgcgcgucagcg

SEQ ID NO: 1833759 - RNA, 22 nt, Salmonella typhimurium LT2
agccgcgcuaucaaaaugcacc

SEQ ID NO: 1833760 - RNA, 15 nt, Salmonella typhimurium LT2
agccgccauccggca

SEQ ID NO: 1833761 - RNA, 18 nt, Salmonella typhimurium LT2
agccgccauccggcauuu

SEQ ID NO: 1833762 - RNA, 15 nt, Salmonella typhimurium LT2
agccgccauccggcc

SEQ ID NO: 1833763 - RNA, 14 nt, Salmonella typhimurium LT2
agccgccauccggc

SEQ ID NO: 1833764 - RNA, 21 nt, Salmonella typhimurium LT2
agccccagcaccaacgccgcu

SEQ ID NO: 1833765 - RNA, 13 nt, Salmonella typhimurium LT2
agccauugccgcg

SEQ ID NO: 1833766 - RNA, 19 nt, Salmonella typhimurium LT2
agccauuggucaucaucag

SEQ ID NO: 1833767 - RNA, 13 nt, Salmonella typhimurium LT2
agccaucggcaaa

SEQ ID NO: 1833768 - RNA, 23 nt, Salmonella typhimurium LT2
agccccccuuugcauuacggcga

SEQ ID NO: 1833769 - RNA, 18 nt, Salmonella typhimurium LT2
agcccuccuccagcgcgu

SEQ ID NO: 1833770 - RNA, 20 nt, Salmonella typhimurium LT2
agcccgauaagcaagcgcca

SEQ ID NO: 1833771 - RNA, 21 nt, Salmonella typhimurium LT2
agcccgauaagcaagcgccau

SEQ ID NO: 1833772 - RNA, 13 nt, Salmonella typhimurium LT2
agcauaucgccgu

SEQ ID NO: 1833773 - RNA, 15 nt, Salmonella typhimurium LT2
agccaauccagaaua

SEQ ID NO: 1833774 - RNA, 19 nt, Salmonella typhimurium LT2
agccaaauagcgccagaca

SEQ ID NO: 1833775 - RNA, 14 nt, Salmonella typhimurium LT2
agccaaaacccuuc

SEQ ID NO: 1833776 - RNA, 15 nt, Salmonella typhimurium LT2
agccaaaaauaacgc

SEQ ID NO: 1833777 - RNA, 20 nt, Salmonella typhimurium LT2
agccagcccuaaggucacgc

SEQ ID NO: 1833778 - RNA, 22 nt, Salmonella typhimurium LT2
agccagcgaugagcgccagcaa

SEQ ID NO: 1833779 - RNA, 19 nt, Salmonella typhimurium LT2
agccaguuagcuucagcaa

SEQ ID NO: 1833780 - RNA, 15 nt, Salmonella typhimurium LT2
agccauauaugaaau

SEQ ID NO: 1833781 - RNA, 20 nt, Salmonella typhimurium LT2
agcaggcuacgguacugccc

SEQ ID NO: 1833782 - RNA, 13 nt, Salmonella typhimurium LT2
agcaggcggcuuc

SEQ ID NO: 1833783 - RNA, 19 nt, Salmonella typhimurium LT2
agcaggcggcuucgcaucc

SEQ ID NO: 1833784 - RNA, 16 nt, Salmonella typhimurium LT2
agcagcugcugguacc

SEQ ID NO: 1833785 - RNA, 20 nt, Salmonella typhimurium LT2
agcauaaugugaugcagacg

SEQ ID NO: 1833786 - RNA, 20 nt, Salmonella typhimurium LT2
agauuuucaucauaucugau

SEQ ID NO: 1833787 - RNA, 16 nt, Salmonella typhimurium LT2
agauucaaccagugca

SEQ ID NO: 1833788 - RNA, 18 nt, Salmonella typhimurium LT2
agauuagguacguacauc

SEQ ID NO: 1833789 - RNA, 23 nt, Salmonella typhimurium LT2
agauuacucccuugccagcgcau

SEQ ID NO: 1833790 - RNA, 23 nt, Salmonella typhimurium LT2
aggcauuuaugccgccauccggc

SEQ ID NO: 1833791 - RNA, 13 nt, Salmonella typhimurium LT2
aggccaggcaucc

SEQ ID NO: 1833792 - RNA, 19 nt, Salmonella typhimurium LT2
aggccgaaacgcagcaucc

SEQ ID NO: 1833793 - RNA, 22 nt, Salmonella typhimurium LT2
aggccgaauaagcgacagcgcc

SEQ ID NO: 1833794 - RNA, 15 nt, Salmonella typhimurium LT2
aggauauaagcgcca

SEQ ID NO: 1833795 - RNA, 15 nt, Salmonella typhimurium LT2
aggauaaccuuccgg

SEQ ID NO: 1833796 - RNA, 22 nt, Salmonella typhimurium LT2
aaacggcgccagcucaucgggc

SEQ ID NO: 1833797 - RNA, 23 nt, Salmonella typhimurium LT2
aaacgguaagaguucacguagcu

SEQ ID NO: 1833798 - RNA, 19 nt, Salmonella typhimurium LT2
aaacgucaugcuguuaccg

SEQ ID NO: 1833799 - RNA, 22 nt, Salmonella typhimurium LT2
aaacguaccuggauaaaucgcc

SEQ ID NO: 1833800 - RNA, 19 nt, Salmonella typhimurium LT2
aggacuuaucaggccuacg

SEQ ID NO: 1833801 - RNA, 21 nt, Salmonella typhimurium LT2
aggaaacagguacuuacccag

SEQ ID NO: 1833802 - RNA, 14 nt, Salmonella typhimurium LT2
agcuuuucugaugg

SEQ ID NO: 1833803 - RNA, 13 nt, Salmonella typhimurium LT2
aggaagcugcgca

SEQ ID NO: 1833804 - RNA, 17 nt, Salmonella typhimurium LT2
aggaagauagcgggcaa

SEQ ID NO: 1833805 - RNA, 13 nt, Salmonella typhimurium LT2
aggaaucguccga

SEQ ID NO: 1833806 - RNA, 18 nt, Salmonella typhimurium LT2
aggaaguugcucccgcac

SEQ ID NO: 1833807 - RNA, 15 nt, Salmonella typhimurium LT2
aggacgauauccacg

SEQ ID NO: 1833808 - RNA, 14 nt, Salmonella typhimurium LT2
agcuucggcggcau

SEQ ID NO: 1833809 - RNA, 21 nt, Salmonella typhimurium LT2
agcuuguuguuuauccugcaa

SEQ ID NO: 1833810 - RNA, 14 nt, Salmonella typhimurium LT2
agcuuuauggcgau

SEQ ID NO: 1833811 - RNA, 16 nt, Salmonella typhimurium LT2
agcugugagaauucug

SEQ ID NO: 1833812 - RNA, 16 nt, Salmonella typhimurium LT2
agcuguuaauuugcau

SEQ ID NO: 1833813 - RNA, 13 nt, Salmonella typhimurium LT2
agcuuauccugcc

SEQ ID NO: 1833814 - RNA, 19 nt, Salmonella typhimurium LT2
agcuuaaaaaauccugcac

SEQ ID NO: 1833815 - RNA, 15 nt, Salmonella typhimurium LT2
agcugcgcuucgaug

SEQ ID NO: 1833816 - RNA, 18 nt, Salmonella typhimurium LT2
agcugguauaggccaggc

SEQ ID NO: 1833817 - RNA, 18 nt, Salmonella typhimurium LT2
agcggaauuaacugcacu

SEQ ID NO: 1833818 - RNA, 13 nt, Salmonella typhimurium LT2
agcggaugacgcu

SEQ ID NO: 1833819 - RNA, 13 nt, Salmonella typhimurium LT2
agcggaugacggc

SEQ ID NO: 1833820 - RNA, 19 nt, Salmonella typhimurium LT2
agcgcuuguuaucuggcau

SEQ ID NO: 1833821 - RNA, 17 nt, Salmonella typhimurium LT2
agcgcuuuuuccagcgc

SEQ ID NO: 1833822 - RNA, 22 nt, Salmonella typhimurium LT2
agcgcugacaucauccacggca

SEQ ID NO: 1833823 - RNA, 19 nt, Salmonella typhimurium LT2
agcgcugcgccagauccgg

SEQ ID NO: 1833824 - RNA, 17 nt, Salmonella typhimurium LT2
agcgcuugucgcgcuau

SEQ ID NO: 1833825 - RNA, 17 nt, Salmonella typhimurium LT2
agcgcguccccgguaag

SEQ ID NO: 1833826 - RNA, 15 nt, Salmonella typhimurium LT2
agcgcgucagcgccu

SEQ ID NO: 1833827 - RNA, 19 nt, Salmonella typhimurium LT2
agcggcaaggaaaaccagu

SEQ ID NO: 1833828 - RNA, 21 nt, Salmonella typhimurium LT2
agcggccagcguaccugcggc

SEQ ID NO: 1833829 - RNA, 19 nt, Salmonella typhimurium LT2
agcggcgcagacacugcca

SEQ ID NO: 1833830 - RNA, 22 nt, Salmonella typhimurium LT2
agcgucgccaguaacaccacga

SEQ ID NO: 1833831 - RNA, 16 nt, Salmonella typhimurium LT2
agcguguaaucgccgu

SEQ ID NO: 1833832 - RNA, 21 nt, Salmonella typhimurium LT2
agcguuagcgccaccgggcau

SEQ ID NO: 1833833 - RNA, 22 nt, Salmonella typhimurium LT2
agcguguuucucuuaugccgcu

SEQ ID NO: 1833834 - RNA, 22 nt, Salmonella typhimurium LT2
agcguaaccgguugucgcgcca

SEQ ID NO: 1833835 - RNA, 21 nt, Salmonella typhimurium LT2
agcguaacgccccccuaccgg

SEQ ID NO: 1833836 - RNA, 19 nt, Salmonella typhimurium LT2
agcguaauuucugguacca

SEQ ID NO: 1833837 - RNA, 13 nt, Salmonella typhimurium LT2
agcgucagcacca

SEQ ID NO: 1833838 - RNA, 13 nt, Salmonella typhimurium LT2
agcguauccagca

SEQ ID NO: 1833839 - RNA, 18 nt, Salmonella typhimurium LT2
agcguagcgcauccggcg

SEQ ID NO: 1833840 - RNA, 14 nt, Salmonella typhimurium LT2
agcguagcgccauc

SEQ ID NO: 1833841 - RNA, 23 nt, Salmonella typhimurium LT2
agcucagcuuuaaugcuuuccag

SEQ ID NO: 1833842 - RNA, 23 nt, Salmonella typhimurium LT2
agcucauaacggcuuaacgccag

SEQ ID NO: 1833843 - RNA, 19 nt, Salmonella typhimurium LT2
agcucauuuuuacagacac

SEQ ID NO: 1833844 - RNA, 14 nt, Salmonella typhimurium LT2
agcugcgccugaaa

SEQ ID NO: 1833845 - RNA, 14 nt, Salmonella typhimurium LT2
agcugaugauuggc

SEQ ID NO: 1833846 - RNA, 11 nt, Salmonella typhimurium LT2
uuuuuuugccc

SEQ ID NO: 1833847 - RNA, 22 nt, Salmonella typhimurium LT2
uuuuuuucaucuuuuaaaauca

SEQ ID NO: 1833848 - RNA, 10 nt, Salmonella typhimurium LT2
uuuuuuccug

SEQ ID NO: 1833849 - RNA, 13 nt, Salmonella typhimurium LT2
uuuuucaucauac

SEQ ID NO: 1833850 - RNA, 16 nt, Salmonella typhimurium LT2
uuuuucauccagcggu

SEQ ID NO: 1833851 - RNA, 12 nt, Salmonella typhimurium LT2
uuuuguggccug

SEQ ID NO: 1833852 - RNA, 20 nt, Salmonella typhimurium LT2
uuuuguggccugcuuaaaca

SEQ ID NO: 1833853 - RNA, 16 nt, Salmonella typhimurium LT2
uuuugugaauaucacc

SEQ ID NO: 1833854 - RNA, 21 nt, Salmonella typhimurium LT2
uuuuguauuccuucggugcca

SEQ ID NO: 1833855 - RNA, 22 nt, Salmonella typhimurium LT2
uuuuguaucugucacuuaagua

SEQ ID NO: 1833856 - RNA, 13 nt, Salmonella typhimurium LT2
uuuuuaaaaaacc

SEQ ID NO: 1833857 - RNA, 14 nt, Salmonella typhimurium LT2
uuuuguuaaauccc

SEQ ID NO: 1833858 - RNA, 13 nt, Salmonella typhimurium LT2
uuuugcuucuuca

SEQ ID NO: 1833859 - RNA, 19 nt, Salmonella typhimurium LT2
uuuuggugacguguuugau

SEQ ID NO: 1833860 - RNA, 17 nt, Salmonella typhimurium LT2
uuuugcccgcucgcuua

SEQ ID NO: 1833861 - RNA, 21 nt, Salmonella typhimurium LT2
uuuugccgcccagucacggcu

SEQ ID NO: 1833862 - RNA, 16 nt, Salmonella typhimurium LT2
uuuugccggaccugcg

SEQ ID NO: 1833863 - RNA, 17 nt, Salmonella typhimurium LT2
uuuugccguugcuguuc

SEQ ID NO: 1833864 - RNA, 15 nt, Salmonella typhimurium LT2
uuuugcgguuuuaau

SEQ ID NO: 1833865 - RNA, 12 nt, Salmonella typhimurium LT2
uuuuuaccaauu

SEQ ID NO: 1833866 - RNA, 12 nt, Salmonella typhimurium LT2
uuuuuaauauca

SEQ ID NO: 1833867 - RNA, 12 nt, Salmonella typhimurium LT2
uuuuuacauucu

SEQ ID NO: 1833868 - RNA, 12 nt, Salmonella typhimurium LT2
uuuuucagaucu

SEQ ID NO: 1833869 - RNA, 12 nt, Salmonella typhimurium LT2
uuuuucagaucg

SEQ ID NO: 1833870 - RNA, 15 nt, Salmonella typhimurium LT2
uuuuucaauuuccag

SEQ ID NO: 1833871 - RNA, 15 nt, Salmonella typhimurium LT2
uuuuucaccaucugc

SEQ ID NO: 1833872 - RNA, 23 nt, Salmonella typhimurium LT2
uuuuuaggcuauaaaaaucaucc

SEQ ID NO: 1833873 - RNA, 12 nt, Salmonella typhimurium LT2
uuuucuucuucg

SEQ ID NO: 1833874 - RNA, 13 nt, Salmonella typhimurium LT2
uuuucugcuuucu

SEQ ID NO: 1833875 - RNA, 14 nt, Salmonella typhimurium LT2
uuuucugcuuucuu

SEQ ID NO: 1833876 - RNA, 23 nt, Salmonella typhimurium LT2
uuuucugcccauuucagcauuaa

SEQ ID NO: 1833877 - RNA, 22 nt, Salmonella typhimurium LT2
uuuucuugcuacauaucuguuu

SEQ ID NO: 1833878 - RNA, 20 nt, Salmonella typhimurium LT2
uuuucgcuucgguaaaaaca

SEQ ID NO: 1833879 - RNA, 18 nt, Salmonella typhimurium LT2
uuuugacaacaaaaagau

SEQ ID NO: 1833880 - RNA, 22 nt, Salmonella typhimurium LT2
uuuugacauccauaauacgacu

SEQ ID NO: 1833881 - RNA, 22 nt, Salmonella typhimurium LT2
uuuugcagcaacugauucaaaa

SEQ ID NO: 1833882 - RNA, 15 nt, Salmonella typhimurium LT2
uuuugcagcaaauac

SEQ ID NO: 1833883 - RNA, 14 nt, Salmonella typhimurium LT2
uuuugcaaaacuga

SEQ ID NO: 1833884 - RNA, 21 nt, Salmonella typhimurium LT2
uuuucagauagcgaaccauca

SEQ ID NO: 1833885 - RNA, 14 nt, Salmonella typhimurium LT2
uuuaccgccgccgu

SEQ ID NO: 1833886 - RNA, 13 nt, Salmonella typhimurium LT2
uuuaccgugaaug

SEQ ID NO: 1833887 - RNA, 17 nt, Salmonella typhimurium LT2
uuuaccuguuuaucuga

SEQ ID NO: 1833888 - RNA, 12 nt, Salmonella typhimurium LT2
uuuucaaagaug

SEQ ID NO: 1833889 - RNA, 15 nt, Salmonella typhimurium LT2
uuuucaaacaaacau

SEQ ID NO: 1833890 - RNA, 14 nt, Salmonella typhimurium LT2
uuuucagcaggccu

SEQ ID NO: 1833891 - RNA, 14 nt, Salmonella typhimurium LT2
uuuucaucugcagu

SEQ ID NO: 1833892 - RNA, 13 nt, Salmonella typhimurium LT2
uuuucauuauaaa

SEQ ID NO: 1833893 - RNA, 23 nt, Salmonella typhimurium LT2
uuuucagccugaagccagcaauc

SEQ ID NO: 1833894 - RNA, 15 nt, Salmonella typhimurium LT2
uuuucaggcacagaa

SEQ ID NO: 1833895 - RNA, 15 nt, Salmonella typhimurium LT2
uuuucgaaaauuucg

SEQ ID NO: 1833896 - RNA, 13 nt, Salmonella typhimurium LT2
uuuucgaaaauuu

SEQ ID NO: 1833897 - RNA, 20 nt, Salmonella typhimurium LT2
uuuuccugcugguagagcau

SEQ ID NO: 1833898 - RNA, 14 nt, Salmonella typhimurium LT2
ucugagaucaaaca

SEQ ID NO: 1833899 - RNA, 21 nt, Salmonella typhimurium LT2
ucugauagggacacauuucuu

SEQ ID NO: 1833900 - RNA, 23 nt, Salmonella typhimurium LT2
ucugagaauuuggguuuauguag

SEQ ID NO: 1833901 - RNA, 21 nt, Salmonella typhimurium LT2
ucugacugcgugagcguggaa

SEQ ID NO: 1833902 - RNA, 22 nt, Salmonella typhimurium LT2
ucucuuuuuuugcuuccgccuu

SEQ ID NO: 1833903 - RNA, 18 nt, Salmonella typhimurium LT2
ucugacgcuuaucaauag

SEQ ID NO: 1833904 - RNA, 22 nt, Salmonella typhimurium LT2
ucugaaucaaugcaucuucacu

SEQ ID NO: 1833905 - RNA, 22 nt, Salmonella typhimurium LT2
ucugaauaaccauuccuauuuu

SEQ ID NO: 1833906 - RNA, 22 nt, Salmonella typhimurium LT2
ucucuggcgccgccagccagga

SEQ ID NO: 1833907 - RNA, 22 nt, Salmonella typhimurium LT2
ucucugugucugacgcuuauca

SEQ ID NO: 1833908 - RNA, 13 nt, Salmonella typhimurium LT2
ucucuccgccugc

SEQ ID NO: 1833909 - RNA, 13 nt, Salmonella typhimurium LT2
ucucuccaguucu

SEQ ID NO: 1833910 - RNA, 19 nt, Salmonella typhimurium LT2
ucucuuaugccgcuuuugc

SEQ ID NO: 1833911 - RNA, 17 nt, Salmonella typhimurium LT2
ucucuuaaguauauaug

SEQ ID NO: 1833912 - RNA, 17 nt, Salmonella typhimurium LT2
ucucuucgacaucuuca

SEQ ID NO: 1833913 - RNA, 14 nt, Salmonella typhimurium LT2
ucucuuucaccagc

SEQ ID NO: 1833914 - RNA, 14 nt, Salmonella typhimurium LT2
ucucuuuagcgcua

SEQ ID NO: 1833915 - RNA, 20 nt, Salmonella typhimurium LT2
ucucuugugcuuccagcucc

SEQ ID NO: 1833916 - RNA, 15 nt, Salmonella typhimurium LT2
ucucuugugcuucca

SEQ ID NO: 1833917 - RNA, 21 nt, Salmonella typhimurium LT2
ucucuucguguaacgcauaca

SEQ ID NO: 1833918 - RNA, 13 nt, Salmonella typhimurium LT2
ucucuucuaucug

SEQ ID NO: 1833919 - RNA, 20 nt, Salmonella typhimurium LT2
ucucuaugguggcugaagag

SEQ ID NO: 1833920 - RNA, 20 nt, Salmonella typhimurium LT2
ucucgucugcugaaaugccu

SEQ ID NO: 1833921 - RNA, 14 nt, Salmonella typhimurium LT2
ucucgucgccaggg

SEQ ID NO: 1833922 - RNA, 20 nt, Salmonella typhimurium LT2
ucucguaaaucaauuuuaau

SEQ ID NO: 1833923 - RNA, 19 nt, Salmonella typhimurium LT2
ucucgcaagauuccagaua

SEQ ID NO: 1833924 - RNA, 18 nt, Salmonella typhimurium LT2
ucucgcacaccagauucc

SEQ ID NO: 1833925 - RNA, 13 nt, Salmonella typhimurium LT2
ucucgaugauaaa

SEQ ID NO: 1833926 - RNA, 23 nt, Salmonella typhimurium LT2
ucucgaugauaaaggucaucaca

SEQ ID NO: 1833927 - RNA, 14 nt, Salmonella typhimurium LT2
ucuccugccagcga

SEQ ID NO: 1833928 - RNA, 17 nt, Salmonella typhimurium LT2
ucuccugaacgcccggc

SEQ ID NO: 1833929 - RNA, 16 nt, Salmonella typhimurium LT2
ucuccugacugccgcc

SEQ ID NO: 1833930 - RNA, 17 nt, Salmonella typhimurium LT2
ucuccgacguuaacugc

SEQ ID NO: 1833931 - RNA, 15 nt, Salmonella typhimurium LT2
ucuccgcgcaaucgc

SEQ ID NO: 1833932 - RNA, 20 nt, Salmonella typhimurium LT2
ucucccgauuguauaaauua

SEQ ID NO: 1833933 - RNA, 21 nt, Salmonella typhimurium LT2
ucucccgccucgucaugcucg

SEQ ID NO: 1833934 - RNA, 13 nt, Salmonella typhimurium LT2
ucucccgggccgc

SEQ ID NO: 1833935 - RNA, 21 nt, Salmonella typhimurium LT2
ucucccgguugauaaucgcua

SEQ ID NO: 1833936 - RNA, 20 nt, Salmonella typhimurium LT2
ucuccgggauagcaaucucg

SEQ ID NO: 1833937 - RNA, 16 nt, Salmonella typhimurium LT2
ucuccggccagacagg

SEQ ID NO: 1833938 - RNA, 17 nt, Salmonella typhimurium LT2
ucuccggccagacaggc

SEQ ID NO: 1833939 - RNA, 17 nt, Salmonella typhimurium LT2
ucuccucugaaaaauau

SEQ ID NO: 1833940 - RNA, 16 nt, Salmonella typhimurium LT2
ucuccucgaugcgccg

SEQ ID NO: 1833941 - RNA, 22 nt, Salmonella typhimurium LT2
ucuccaggcugaugugcuccau

SEQ ID NO: 1833942 - RNA, 11 nt, Salmonella typhimurium LT2
ucuccagcaaa

SEQ ID NO: 1833943 - RNA, 22 nt, Salmonella typhimurium LT2
ucuccagcaggguauuugcgcc

SEQ ID NO: 1833944 - RNA, 14 nt, Salmonella typhimurium LT2
ucucauggagcugc

SEQ ID NO: 1833945 - RNA, 19 nt, Salmonella typhimurium LT2
ucucauggagcugcccguc

SEQ ID NO: 1833946 - RNA, 16 nt, Salmonella typhimurium LT2
ucucaucugaugauua

SEQ ID NO: 1833947 - RNA, 22 nt, Salmonella typhimurium LT2
ucucaucugcaaaauauauaau

SEQ ID NO: 1833948 - RNA, 22 nt, Salmonella typhimurium LT2
ucuacauuucgugcaguccugu

SEQ ID NO: 1833949 - RNA, 17 nt, Salmonella typhimurium LT2
ucugucaacgugccugc

SEQ ID NO: 1833950 - RNA, 23 nt, Salmonella typhimurium LT2
ucugucacuuaaguaaagauuuu

SEQ ID NO: 1833951 - RNA, 15 nt, Salmonella typhimurium LT2
ucugguggaacggcg

SEQ ID NO: 1833952 - RNA, 14 nt, Salmonella typhimurium LT2
ucuggcugcugaug

SEQ ID NO: 1833953 - RNA, 17 nt, Salmonella typhimurium LT2
ucuggcguuggcaucug

SEQ ID NO: 1833954 - RNA, 23 nt, Salmonella typhimurium LT2
ucuggcguuggcaucugucaucg

SEQ ID NO: 1833955 - RNA, 14 nt, Salmonella typhimurium LT2
ucuggcucagacca

SEQ ID NO: 1833956 - RNA, 20 nt, Salmonella typhimurium LT2
ucuggcucagaccauauuca

SEQ ID NO: 1833957 - RNA, 15 nt, Salmonella typhimurium LT2
ucugcacauacgcca

SEQ ID NO: 1833958 - RNA, 22 nt, Salmonella typhimurium LT2
ucugcaaugguaaaacgcuggc

SEQ ID NO: 1833959 - RNA, 19 nt, Salmonella typhimurium LT2
ucugcaacuguugcgccag

SEQ ID NO: 1833960 - RNA, 21 nt, Salmonella typhimurium LT2
ucugcguccugcuuaugaaac

SEQ ID NO: 1833961 - RNA, 14 nt, Salmonella typhimurium LT2
ucugcgucuucuuc

SEQ ID NO: 1833962 - RNA, 13 nt, Salmonella typhimurium LT2
ucugcgugaagac

SEQ ID NO: 1833963 - RNA, 15 nt, Salmonella typhimurium LT2
ucugcgguaacaauc

SEQ ID NO: 1833964 - RNA, 23 nt, Salmonella typhimurium LT2
ucugcgcuaagcguuacggaaaa

SEQ ID NO: 1833965 - RNA, 16 nt, Salmonella typhimurium LT2
ucugcugauaauacug

SEQ ID NO: 1833966 - RNA, 14 nt, Salmonella typhimurium LT2
ucugcuccggcgua

SEQ ID NO: 1833967 - RNA, 19 nt, Salmonella typhimurium LT2
ucugcgugaugcaucagaa

SEQ ID NO: 1833968 - RNA, 11 nt, Salmonella typhimurium LT2
ucuguuauuuc

SEQ ID NO: 1833969 - RNA, 23 nt, Salmonella typhimurium LT2
ucuuaccgcuaaaauacccgacc

SEQ ID NO: 1833970 - RNA, 14 nt, Salmonella typhimurium LT2
ucuuacauaagaga

SEQ ID NO: 1833971 - RNA, 16 nt, Salmonella typhimurium LT2
ucuguuccgaaauaaa

SEQ ID NO: 1833972 - RNA, 16 nt, Salmonella typhimurium LT2
ucuuacggauaaaaac

SEQ ID NO: 1833973 - RNA, 14 nt, Salmonella typhimurium LT2
ucuuagaauagcau

SEQ ID NO: 1833974 - RNA, 16 nt, Salmonella typhimurium LT2
ucuuagaauagcauca

SEQ ID NO: 1833975 - RNA, 16 nt, Salmonella typhimurium LT2
ucuuacugaccggccc

SEQ ID NO: 1833976 - RNA, 24 nt, Salmonella typhimurium LT2
ucuuagguuuguagcgcaaauauc

SEQ ID NO: 1833977 - RNA, 14 nt, Salmonella typhimurium LT2
ucuuagugaaauac

SEQ ID NO: 1833978 - RNA, 15 nt, Salmonella typhimurium LT2
ucuuagugaaauacc

SEQ ID NO: 1833979 - RNA, 21 nt, Salmonella typhimurium LT2
ucuuaucuggccuacaaagaa

SEQ ID NO: 1833980 - RNA, 12 nt, Salmonella typhimurium LT2
ucuuauccgacu

SEQ ID NO: 1833981 - RNA, 22 nt, Salmonella typhimurium LT2
ucuucaacguugucgaacugca

SEQ ID NO: 1833982 - RNA, 19 nt, Salmonella typhimurium LT2
ucuucaacggucucaggcu

SEQ ID NO: 1833983 - RNA, 11 nt, Salmonella typhimurium LT2
ucuuauuuucc

SEQ ID NO: 1833984 - RNA, 12 nt, Salmonella typhimurium LT2
ucuuauuuuccg

SEQ ID NO: 1833985 - RNA, 22 nt, Salmonella typhimurium LT2
ucuucaccuuuccagucaacga

SEQ ID NO: 1833986 - RNA, 14 nt, Salmonella typhimurium LT2
ucuucacccuucuu

SEQ ID NO: 1833987 - RNA, 20 nt, Salmonella typhimurium LT2
ucuucacucaccacaaaggc

SEQ ID NO: 1833988 - RNA, 15 nt, Salmonella typhimurium LT2
ucuuccaccauucgc

SEQ ID NO: 1833989 - RNA, 18 nt, Salmonella typhimurium LT2
ucuuccacgccgucgaug

SEQ ID NO: 1833990 - RNA, 22 nt, Salmonella typhimurium LT2
ucuucaucguuacgcagauagg

SEQ ID NO: 1833991 - RNA, 14 nt, Salmonella typhimurium LT2
ucuucauccaugcg

SEQ ID NO: 1833992 - RNA, 13 nt, Salmonella typhimurium LT2
ucuucaucaugau

SEQ ID NO: 1833993 - RNA, 16 nt, Salmonella typhimurium LT2
ucuucaucaugaugau

SEQ ID NO: 1833994 - RNA, 15 nt, Salmonella typhimurium LT2
ugaaacgcauccagc

SEQ ID NO: 1833995 - RNA, 15 nt, Salmonella typhimurium LT2
ugaaacgugaaauau

SEQ ID NO: 1833996 - RNA, 19 nt, Salmonella typhimurium LT2
ugaaacccgccaccgccag

SEQ ID NO: 1833997 - RNA, 23 nt, Salmonella typhimurium LT2
ugaaaccggcgcgccuuccagca

SEQ ID NO: 1833998 - RNA, 19 nt, Salmonella typhimurium LT2
ugaaaccgaauccuuugga

SEQ ID NO: 1833999 - RNA, 21 nt, Salmonella typhimurium LT2
ugaaagucuucccgcaaacug

SEQ ID NO: 1834000 - RNA, 15 nt, Salmonella typhimurium LT2
ugaaaguaaguuuau

SEQ ID NO: 1834001 - RNA, 19 nt, Salmonella typhimurium LT2
ugaaagaccuaaaccacgu

SEQ ID NO: 1834002 - RNA, 14 nt, Salmonella typhimurium LT2
ugaaaggcauuucu

SEQ ID NO: 1834003 - RNA, 18 nt, Salmonella typhimurium LT2
ugaaaggaagugcaacug

SEQ ID NO: 1834004 - RNA, 19 nt, Salmonella typhimurium LT2
ugaaagcucggcgggguuu

SEQ ID NO: 1834005 - RNA, 20 nt, Salmonella typhimurium LT2
ugaaacauauauauccgcua

SEQ ID NO: 1834006 - RNA, 15 nt, Salmonella typhimurium LT2
ugaaaaucaaaaaca

SEQ ID NO: 1834007 - RNA, 12 nt, Salmonella typhimurium LT2
ugaaaaauagac

SEQ ID NO: 1834008 - RNA, 22 nt, Salmonella typhimurium LT2
ugaaaaacgguauuuccauuuu

SEQ ID NO: 1834009 - RNA, 22 nt, Salmonella typhimurium LT2
ugaaaaggggaucgugcaguaa

SEQ ID NO: 1834010 - RNA, 17 nt, Salmonella typhimurium LT2
ugaaaaccauaauaaug

SEQ ID NO: 1834011 - RNA, 13 nt, Salmonella typhimurium LT2
ugaaaaccuaaau

SEQ ID NO: 1834012 - RNA, 20 nt, Salmonella typhimurium LT2
ugaaccgguaaagcagugca

SEQ ID NO: 1834013 - RNA, 22 nt, Salmonella typhimurium LT2
ugaaccacggagagacaguuca

SEQ ID NO: 1834014 - RNA, 21 nt, Salmonella typhimurium LT2
ugaaccagcggcaccagcacg

SEQ ID NO: 1834015 - RNA, 15 nt, Salmonella typhimurium LT2
ugaacauuuuuucag

SEQ ID NO: 1834016 - RNA, 14 nt, Salmonella typhimurium LT2
ugaacgccaaauac

SEQ ID NO: 1834017 - RNA, 14 nt, Salmonella typhimurium LT2
ugaaccucuucacc

SEQ ID NO: 1834018 - RNA, 14 nt, Salmonella typhimurium LT2
ugaacacccugccc

SEQ ID NO: 1834019 - RNA, 12 nt, Salmonella typhimurium LT2
ugaacaggguga

SEQ ID NO: 1834020 - RNA, 21 nt, Salmonella typhimurium LT2
ugaacaguuucgccagcgcgg

SEQ ID NO: 1834021 - RNA, 18 nt, Salmonella typhimurium LT2
ugaaauucuaugccaagc

SEQ ID NO: 1834022 - RNA, 17 nt, Salmonella typhimurium LT2
ugaaauggcaugagcag

SEQ ID NO: 1834023 - RNA, 22 nt, Salmonella typhimurium LT2
ugaaaucgucagacggcuccag

SEQ ID NO: 1834024 - RNA, 22 nt, Salmonella typhimurium LT2
ugaaaucgucgccaacaccgau

SEQ ID NO: 1834025 - RNA, 16 nt, Salmonella typhimurium LT2
ugaaaucgaacagguu

SEQ ID NO: 1834026 - RNA, 21 nt, Salmonella typhimurium LT2
ugaaauacccgccgauaaacg

SEQ ID NO: 1834027 - RNA, 20 nt, Salmonella typhimurium LT2
ugaaauaaucguguaaucuu

SEQ ID NO: 1834028 - RNA, 15 nt, Salmonella typhimurium LT2
ucuuggagagcauca

SEQ ID NO: 1834029 - RNA, 18 nt, Salmonella typhimurium LT2
ucuugguaccaaacagca

SEQ ID NO: 1834030 - RNA, 15 nt, Salmonella typhimurium LT2
ucuugcucucaggca

SEQ ID NO: 1834031 - RNA, 11 nt, Salmonella typhimurium LT2
ucuugcuauca

SEQ ID NO: 1834032 - RNA, 22 nt, Salmonella typhimurium LT2
ucuuccacuucaaucaacacca

SEQ ID NO: 1834033 - RNA, 18 nt, Salmonella typhimurium LT2
ucuuccauugcuuuuuug

SEQ ID NO: 1834034 - RNA, 12 nt, Salmonella typhimurium LT2
ucuuuccuuuuu

SEQ ID NO: 1834035 - RNA, 15 nt, Salmonella typhimurium LT2
ucuuuccuuuuucag

SEQ ID NO: 1834036 - RNA, 15 nt, Salmonella typhimurium LT2
ucuuuccauuucagc

SEQ ID NO: 1834037 - RNA, 14 nt, Salmonella typhimurium LT2
ucuuucauuuuacc

SEQ ID NO: 1834038 - RNA, 23 nt, Salmonella typhimurium LT2
ucuuucagccggcuaucuucuuc

SEQ ID NO: 1834039 - RNA, 13 nt, Salmonella typhimurium LT2
ucuuucagguucc

SEQ ID NO: 1834040 - RNA, 13 nt, Salmonella typhimurium LT2
ucuuuaugcguca

SEQ ID NO: 1834041 - RNA, 19 nt, Salmonella typhimurium LT2
ucuuuaugggcauuucauu

SEQ ID NO: 1834042 - RNA, 16 nt, Salmonella typhimurium LT2
ucuuuauuaaaaagca

SEQ ID NO: 1834043 - RNA, 12 nt, Salmonella typhimurium LT2
ucuuuaucuucu

SEQ ID NO: 1834044 - RNA, 20 nt, Salmonella typhimurium LT2
ucuuugaccagcgacgauga

SEQ ID NO: 1834045 - RNA, 12 nt, Salmonella typhimurium LT2
ucuuugaauaac

SEQ ID NO: 1834046 - RNA, 19 nt, Salmonella typhimurium LT2
ucuuugcaccgcuaaaaaa

SEQ ID NO: 1834047 - RNA, 18 nt, Salmonella typhimurium LT2
ucuuugcgcgucucuccc

SEQ ID NO: 1834048 - RNA, 18 nt, Salmonella typhimurium LT2
ucuuugcugccaucuucc

SEQ ID NO: 1834049 - RNA, 15 nt, Salmonella typhimurium LT2
ucuuuggacggcauc

SEQ ID NO: 1834050 - RNA, 12 nt, Salmonella typhimurium LT2
ucuuuuaaaaga

SEQ ID NO: 1834051 - RNA, 16 nt, Salmonella typhimurium LT2
ucuuuuaucacccgga

SEQ ID NO: 1834052 - RNA, 12 nt, Salmonella typhimurium LT2
ucuuuuauuauu

SEQ ID NO: 1834053 - RNA, 13 nt, Salmonella typhimurium LT2
ucuuuuauuucau

SEQ ID NO: 1834054 - RNA, 18 nt, Salmonella typhimurium LT2
ucuuuuacgaucgccacc

SEQ ID NO: 1834055 - RNA, 16 nt, Salmonella typhimurium LT2
ucuuuugcgccuucca

SEQ ID NO: 1834056 - RNA, 23 nt, Salmonella typhimurium LT2
ucuuuuucgaucagcauaucgau

SEQ ID NO: 1834057 - RNA, 12 nt, Salmonella typhimurium LT2
ucuuuuuccagc

SEQ ID NO: 1834058 - RNA, 15 nt, Salmonella typhimurium LT2
ucuuuuuauuuuaua

SEQ ID NO: 1834059 - RNA, 20 nt, Salmonella typhimurium LT2
ucuuuugucguccccuggac

SEQ ID NO: 1834060 - RNA, 17 nt, Salmonella typhimurium LT2
ucggccagcaagcggcg

SEQ ID NO: 1834061 - RNA, 21 nt, Salmonella typhimurium LT2
ucggccugcguuaacggcuuc

SEQ ID NO: 1834062 - RNA, 21 nt, Salmonella typhimurium LT2
ucgcuguaccgccauccggcc

SEQ ID NO: 1834063 - RNA, 17 nt, Salmonella typhimurium LT2
ucgcuggugugcagcca

SEQ ID NO: 1834064 - RNA, 18 nt, Salmonella typhimurium LT2
ucgcuggcguagauauuc

SEQ ID NO: 1834065 - RNA, 17 nt, Salmonella typhimurium LT2
ucgcuggccuccagcac

SEQ ID NO: 1834066 - RNA, 15 nt, Salmonella typhimurium LT2
ucgcugcgcucgccc

SEQ ID NO: 1834067 - RNA, 22 nt, Salmonella typhimurium LT2
ucgcgcagacaguggccaucuu

SEQ ID NO: 1834068 - RNA, 19 nt, Salmonella typhimurium LT2
ucgcgcagauagagcgccu

SEQ ID NO: 1834069 - RNA, 20 nt, Salmonella typhimurium LT2
ucgcgcagauagagcgccug

SEQ ID NO: 1834070 - RNA, 22 nt, Salmonella typhimurium LT2
ucggagguauacauccacuggu

SEQ ID NO: 1834071 - RNA, 15 nt, Salmonella typhimurium LT2
ucgcuuuucauacug

SEQ ID NO: 1834072 - RNA, 18 nt, Salmonella typhimurium LT2
ucgcuuucgcuuucucuu

SEQ ID NO: 1834073 - RNA, 20 nt, Salmonella typhimurium LT2
ucggcuugcuucaucugguu

SEQ ID NO: 1834074 - RNA, 22 nt, Salmonella typhimurium LT2
ucggcuggcauuuuuauuuaac

SEQ ID NO: 1834075 - RNA, 17 nt, Salmonella typhimurium LT2
ucggcgugaauaaaaua

SEQ ID NO: 1834076 - RNA, 14 nt, Salmonella typhimurium LT2
ucggcguguuucau

SEQ ID NO: 1834077 - RNA, 13 nt, Salmonella typhimurium LT2
ucggcgucuggag

SEQ ID NO: 1834078 - RNA, 17 nt, Salmonella typhimurium LT2
ucggcguggggcaggcg

SEQ ID NO: 1834079 - RNA, 20 nt, Salmonella typhimurium LT2
ucggcgucgacguuuuucag

SEQ ID NO: 1834080 - RNA, 17 nt, Salmonella typhimurium LT2
ucggcgccagccacaag

SEQ ID NO: 1834081 - RNA, 18 nt, Salmonella typhimurium LT2
ucggcgauugucaucauu

SEQ ID NO: 1834082 - RNA, 14 nt, Salmonella typhimurium LT2
ucggcgcggggaac

SEQ ID NO: 1834083 - RNA, 16 nt, Salmonella typhimurium LT2
ucggcgcggggaacac

SEQ ID NO: 1834084 - RNA, 18 nt, Salmonella typhimurium LT2
ucggcgcggggaacacaa

SEQ ID NO: 1834085 - RNA, 19 nt, Salmonella typhimurium LT2
ucggcgcggggaacacaau

SEQ ID NO: 1834086 - RNA, 21 nt, Salmonella typhimurium LT2
ucgggcagcgcuucucuuucc

SEQ ID NO: 1834087 - RNA, 23 nt, Salmonella typhimurium LT2
ucggcuuuguaucagcauuuaca

SEQ ID NO: 1834088 - RNA, 18 nt, Salmonella typhimurium LT2
ucgggauauaugcaaaac

SEQ ID NO: 1834089 - RNA, 19 nt, Salmonella typhimurium LT2
ucgggaucagcgcgcucca

SEQ ID NO: 1834090 - RNA, 18 nt, Salmonella typhimurium LT2
ucggggauucgccagcgu

SEQ ID NO: 1834091 - RNA, 22 nt, Salmonella typhimurium LT2
ucgggcgguugccacucuucca

SEQ ID NO: 1834092 - RNA, 17 nt, Salmonella typhimurium LT2
ucguaaaucaaaugaga

SEQ ID NO: 1834093 - RNA, 15 nt, Salmonella typhimurium LT2
ucguaaaucaauuuu

SEQ ID NO: 1834094 - RNA, 20 nt, Salmonella typhimurium LT2
ucguaaaucaauuuuaauuu

SEQ ID NO: 1834095 - RNA, 20 nt, Salmonella typhimurium LT2
ucguaaacacgacgccgccg

SEQ ID NO: 1834096 - RNA, 23 nt, Salmonella typhimurium LT2
ucggugcgguuacguccggcauu

SEQ ID NO: 1834097 - RNA, 15 nt, Salmonella typhimurium LT2
ucgguaaccauccau

SEQ ID NO: 1834098 - RNA, 19 nt, Salmonella typhimurium LT2
ucgguaaaaaugcaauguc

SEQ ID NO: 1834099 - RNA, 16 nt, Salmonella typhimurium LT2
ucgguacggcgcugcu

SEQ ID NO: 1834100 - RNA, 16 nt, Salmonella typhimurium LT2
ucgguaugccuuccag

SEQ ID NO: 1834101 - RNA, 15 nt, Salmonella typhimurium LT2
ucggucaguuugccc

SEQ ID NO: 1834102 - RNA, 13 nt, Salmonella typhimurium LT2
ucggucuccagca

SEQ ID NO: 1834103 - RNA, 16 nt, Salmonella typhimurium LT2
ucguacauguccagau

SEQ ID NO: 1834104 - RNA, 16 nt, Salmonella typhimurium LT2
ucguauugacaacaaa

SEQ ID NO: 1834105 - RNA, 13 nt, Salmonella typhimurium LT2
ucguccaccuaaa

SEQ ID NO: 1834106 - RNA, 15 nt, Salmonella typhimurium LT2
ucguauccccagucu

SEQ ID NO: 1834107 - RNA, 20 nt, Salmonella typhimurium LT2
ucgucgucuucaucccaguc

SEQ ID NO: 1834108 - RNA, 14 nt, Salmonella typhimurium LT2
ucgucggccagcgc

SEQ ID NO: 1834109 - RNA, 23 nt, Salmonella typhimurium LT2
ucgucgccaccaugcugguuggg

SEQ ID NO: 1834110 - RNA, 16 nt, Salmonella typhimurium LT2
ucgucgccuuccagcg

SEQ ID NO: 1834111 - RNA, 21 nt, Salmonella typhimurium LT2
ucgucgcgcccaacuccccca

SEQ ID NO: 1834112 - RNA, 23 nt, Salmonella typhimurium LT2
ucuaaaaauaauugauaauaacc

SEQ ID NO: 1834113 - RNA, 11 nt, Salmonella typhimurium LT2
ucuaaaaagga

SEQ ID NO: 1834114 - RNA, 23 nt, Salmonella typhimurium LT2
ucuaaaucaaucacuuauguaca

SEQ ID NO: 1834115 - RNA, 15 nt, Salmonella typhimurium LT2
ucuacaucaagagaa

SEQ ID NO: 1834116 - RNA, 20 nt, Salmonella typhimurium LT2
ucuacaguuugucaucaguc

SEQ ID NO: 1834117 - RNA, 22 nt, Salmonella typhimurium LT2
ucuacaaauggguccauacgcg

SEQ ID NO: 1834118 - RNA, 23 nt, Salmonella typhimurium LT2
ucguuagugauacgcggcugaug

SEQ ID NO: 1834119 - RNA, 20 nt, Salmonella typhimurium LT2
ucguuauuuccgagaucgcc

SEQ ID NO: 1834120 - RNA, 14 nt, Salmonella typhimurium LT2
ucguucaagacagg

SEQ ID NO: 1834121 - RNA, 14 nt, Salmonella typhimurium LT2
ucguuaccagcauc

SEQ ID NO: 1834122 - RNA, 13 nt, Salmonella typhimurium LT2
ucguuaauaaucu

SEQ ID NO: 1834123 - RNA, 14 nt, Salmonella typhimurium LT2
ucguuacccgugcg

SEQ ID NO: 1834124 - RNA, 12 nt, Salmonella typhimurium LT2
ucgugauaaacg

SEQ ID NO: 1834125 - RNA, 16 nt, Salmonella typhimurium LT2
ucgugaugugguugug

SEQ ID NO: 1834126 - RNA, 16 nt, Salmonella typhimurium LT2
ucgugacgcucgacug

SEQ ID NO: 1834127 - RNA, 15 nt, Salmonella typhimurium LT2
ucgugacccacacau

SEQ ID NO: 1834128 - RNA, 17 nt, Salmonella typhimurium LT2
ucgugaggauaauccau

SEQ ID NO: 1834129 - RNA, 13 nt, Salmonella typhimurium LT2
ucguuuauuuaac

SEQ ID NO: 1834130 - RNA, 17 nt, Salmonella typhimurium LT2
ucguuccgguucuuccc

SEQ ID NO: 1834131 - RNA, 15 nt, Salmonella typhimurium LT2
uccuuccuccaccac

SEQ ID NO: 1834132 - RNA, 17 nt, Salmonella typhimurium LT2
uccuuccagcccguucu

SEQ ID NO: 1834133 - RNA, 13 nt, Salmonella typhimurium LT2
uccuucauucaga

SEQ ID NO: 1834134 - RNA, 13 nt, Salmonella typhimurium LT2
uccuuaaucagcu

SEQ ID NO: 1834135 - RNA, 23 nt, Salmonella typhimurium LT2
uccuuacuguagcgccgcuucca

SEQ ID NO: 1834136 - RNA, 20 nt, Salmonella typhimurium LT2
uccuuauuuaauacaucaga

SEQ ID NO: 1834137 - RNA, 16 nt, Salmonella typhimurium LT2
uccuuaugaccgaguc

SEQ ID NO: 1834138 - RNA, 19 nt, Salmonella typhimurium LT2
uccuucuuccauucccacc

SEQ ID NO: 1834139 - RNA, 11 nt, Salmonella typhimurium LT2
uccuucuuccg

SEQ ID NO: 1834140 - RNA, 15 nt, Salmonella typhimurium LT2
uccuucgcuuccugg

SEQ ID NO: 1834141 - RNA, 14 nt, Salmonella typhimurium LT2
uccuugcagccaga

SEQ ID NO: 1834142 - RNA, 20 nt, Salmonella typhimurium LT2
uccugcaucgacauccgauu

SEQ ID NO: 1834143 - RNA, 19 nt, Salmonella typhimurium LT2
uccugcgcugucaccagca

SEQ ID NO: 1834144 - RNA, 13 nt, Salmonella typhimurium LT2
uccugcagcgcca

SEQ ID NO: 1834145 - RNA, 20 nt, Salmonella typhimurium LT2
uccugcaggcgagugcuacc

SEQ ID NO: 1834146 - RNA, 17 nt, Salmonella typhimurium LT2
uccugcagacuccacgu

SEQ ID NO: 1834147 - RNA, 17 nt, Salmonella typhimurium LT2
uccugcaccgccugcgg

SEQ ID NO: 1834148 - RNA, 18 nt, Salmonella typhimurium LT2
ucagcgacucauucagca

SEQ ID NO: 1834149 - RNA, 18 nt, Salmonella typhimurium LT2
ucagcgaguuccaccaua

SEQ ID NO: 1834150 - RNA, 22 nt, Salmonella typhimurium LT2
uccuggaugaguaugugaaaaa

SEQ ID NO: 1834151 - RNA, 16 nt, Salmonella typhimurium LT2
uccugcuucuggagag

SEQ ID NO: 1834152 - RNA, 14 nt, Salmonella typhimurium LT2
uccugcuccugcgg

SEQ ID NO: 1834153 - RNA, 22 nt, Salmonella typhimurium LT2
uccuguaacaacuguuuuucac

SEQ ID NO: 1834154 - RNA, 14 nt, Salmonella typhimurium LT2
uccuguaacagggg

SEQ ID NO: 1834155 - RNA, 22 nt, Salmonella typhimurium LT2
uccuguagcgucuuuugaguga

SEQ ID NO: 1834156 - RNA, 16 nt, Salmonella typhimurium LT2
uccugugaaguaaaaa

SEQ ID NO: 1834157 - RNA, 18 nt, Salmonella typhimurium LT2
uccuguccugggccgcca

SEQ ID NO: 1834158 - RNA, 18 nt, Salmonella typhimurium LT2
uccugucgucaccagcag

SEQ ID NO: 1834159 - RNA, 18 nt, Salmonella typhimurium LT2
ucgaacuuacggcgcgcc

SEQ ID NO: 1834160 - RNA, 23 nt, Salmonella typhimurium LT2
ucgaacgccgccugcgccagcgc

SEQ ID NO: 1834161 - RNA, 20 nt, Salmonella typhimurium LT2
ucgaagugcgaaauuuaaua

SEQ ID NO: 1834162 - RNA, 15 nt, Salmonella typhimurium LT2
ucgaacagcggcaga

SEQ ID NO: 1834163 - RNA, 14 nt, Salmonella typhimurium LT2
ucgaacaucugcgu

SEQ ID NO: 1834164 - RNA, 22 nt, Salmonella typhimurium LT2
ucgaaccaacgacccccaccau

SEQ ID NO: 1834165 - RNA, 19 nt, Salmonella typhimurium LT2
ucgaaaucucgcuaaucau

SEQ ID NO: 1834166 - RNA, 19 nt, Salmonella typhimurium LT2
ucgacaauaaauugcgacc

SEQ ID NO: 1834167 - RNA, 23 nt, Salmonella typhimurium LT2
ucgacaccagcgauaaacgccag

SEQ ID NO: 1834168 - RNA, 21 nt, Salmonella typhimurium LT2
ucgaauaaagacaaugcugcu

SEQ ID NO: 1834169 - RNA, 22 nt, Salmonella typhimurium LT2
ucgaaacccaacaucgcgcugc

SEQ ID NO: 1834170 - RNA, 13 nt, Salmonella typhimurium LT2
ucgaaaaucacug

SEQ ID NO: 1834171 - RNA, 18 nt, Salmonella typhimurium LT2
uccuuuaaucgccgugcc

SEQ ID NO: 1834172 - RNA, 21 nt, Salmonella typhimurium LT2
uccuuuuaccggcgaagucgc

SEQ ID NO: 1834173 - RNA, 15 nt, Salmonella typhimurium LT2
uccuuugccuuucuu

SEQ ID NO: 1834174 - RNA, 16 nt, Salmonella typhimurium LT2
ucgacggccagcgcgc

SEQ ID NO: 1834175 - RNA, 13 nt, Salmonella typhimurium LT2
ucgacggcaaccu

SEQ ID NO: 1834176 - RNA, 22 nt, Salmonella typhimurium LT2
ucgaggaagcugcgcagcacuu

SEQ ID NO: 1834177 - RNA, 20 nt, Salmonella typhimurium LT2
ucgaggagcgcggcggcgcg

SEQ ID NO: 1834178 - RNA, 21 nt, Salmonella typhimurium LT2
ucgagcuuuugcugcgccagc

SEQ ID NO: 1834179 - RNA, 22 nt, Salmonella typhimurium LT2
ucgauauaccaugccgccauuu

SEQ ID NO: 1834180 - RNA, 22 nt, Salmonella typhimurium LT2
ucgauaucugccugcagaccca

SEQ ID NO: 1834181 - RNA, 17 nt, Salmonella typhimurium LT2
ucgcacagaaucaccuu

SEQ ID NO: 1834182 - RNA, 13 nt, Salmonella typhimurium LT2
ucgcaccauagca

SEQ ID NO: 1834183 - RNA, 17 nt, Salmonella typhimurium LT2
ucgcaccauagcagcca

SEQ ID NO: 1834184 - RNA, 22 nt, Salmonella typhimurium LT2
ucgcacccgccaucaugcccac

SEQ ID NO: 1834185 - RNA, 23 nt, Salmonella typhimurium LT2
ucgcacaucaugaugaucuucag

SEQ ID NO: 1834186 - RNA, 17 nt, Salmonella typhimurium LT2
ucgcacgccuuuaagcu

SEQ ID NO: 1834187 - RNA, 20 nt, Salmonella typhimurium LT2
ucgcagggcugcuggugcgc

SEQ ID NO: 1834188 - RNA, 22 nt, Salmonella typhimurium LT2
ucgcaggguaugaauuuuuucc

SEQ ID NO: 1834189 - RNA, 15 nt, Salmonella typhimurium LT2
ucgcagaccauccau

SEQ ID NO: 1834190 - RNA, 15 nt, Salmonella typhimurium LT2
ucgcagacauggcaa

SEQ ID NO: 1834191 - RNA, 23 nt, Salmonella typhimurium LT2
ucgaucuuauuagcgauuuaaug

SEQ ID NO: 1834192 - RNA, 14 nt, Salmonella typhimurium LT2
ucgaugaaaaagag

SEQ ID NO: 1834193 - RNA, 22 nt, Salmonella typhimurium LT2
ucgauuuucugcucaauauuau

SEQ ID NO: 1834194 - RNA, 21 nt, Salmonella typhimurium LT2
ucgauuuccggcggcagaugc

SEQ ID NO: 1834195 - RNA, 20 nt, Salmonella typhimurium LT2
ucgcaacgccggugccugcc

SEQ ID NO: 1834196 - RNA, 22 nt, Salmonella typhimurium LT2
ucgcaacgcuuaucagucccca

SEQ ID NO: 1834197 - RNA, 18 nt, Salmonella typhimurium LT2
ucgccgccaucggcgcgu

SEQ ID NO: 1834198 - RNA, 12 nt, Salmonella typhimurium LT2
ucgccgcgcgca

SEQ ID NO: 1834199 - RNA, 23 nt, Salmonella typhimurium LT2
ucgccgcaucauacauauauucc

SEQ ID NO: 1834200 - RNA, 17 nt, Salmonella typhimurium LT2
ucgccgcugcgagcagc

SEQ ID NO: 1834201 - RNA, 15 nt, Salmonella typhimurium LT2
ucgcccuguauacag

SEQ ID NO: 1834202 - RNA, 17 nt, Salmonella typhimurium LT2
ucgccuguaccgggcag

SEQ ID NO: 1834203 - RNA, 20 nt, Salmonella typhimurium LT2
ucgccuggcaacgucgaccc

SEQ ID NO: 1834204 - RNA, 23 nt, Salmonella typhimurium LT2
ucgccuggugcgggucaaaagcg

SEQ ID NO: 1834205 - RNA, 15 nt, Salmonella typhimurium LT2
ucgcgcaccauaaua

SEQ ID NO: 1834206 - RNA, 20 nt, Salmonella typhimurium LT2
ucgccuucgccggcaacagg

SEQ ID NO: 1834207 - RNA, 23 nt, Salmonella typhimurium LT2
ucgccguaaaacaacagcggcgu

SEQ ID NO: 1834208 - RNA, 23 nt, Salmonella typhimurium LT2
ucgccugcgcucauauacccugc

SEQ ID NO: 1834209 - RNA, 22 nt, Salmonella typhimurium LT2
ucgcccgggcgauaucacggaa

SEQ ID NO: 1834210 - RNA, 14 nt, Salmonella typhimurium LT2
ucgcccggaaaugg

SEQ ID NO: 1834211 - RNA, 23 nt, Salmonella typhimurium LT2
ucgcccguucugaccaguugcag

SEQ ID NO: 1834212 - RNA, 14 nt, Salmonella typhimurium LT2
ucgcccguuuuacc

SEQ ID NO: 1834213 - RNA, 23 nt, Salmonella typhimurium LT2
ucgcccugccagugaaaguuuuc

SEQ ID NO: 1834214 - RNA, 18 nt, Salmonella typhimurium LT2
ucgcccugcgccagacgc

SEQ ID NO: 1834215 - RNA, 22 nt, Salmonella typhimurium LT2
ucgcccacgcccagagcgcggc

SEQ ID NO: 1834216 - RNA, 19 nt, Salmonella typhimurium LT2
ucgcccagcacuaacagca

SEQ ID NO: 1834217 - RNA, 16 nt, Salmonella typhimurium LT2
ucgccccgaauccacu

SEQ ID NO: 1834218 - RNA, 15 nt, Salmonella typhimurium LT2
ucgccaaagcgcugc

SEQ ID NO: 1834219 - RNA, 14 nt, Salmonella typhimurium LT2
ucgccaaagcagcu

SEQ ID NO: 1834220 - RNA, 15 nt, Salmonella typhimurium LT2
ucgccaaagauauag

SEQ ID NO: 1834221 - RNA, 20 nt, Salmonella typhimurium LT2
ucgccaaagucauugcugcc

SEQ ID NO: 1834222 - RNA, 17 nt, Salmonella typhimurium LT2
ucgccaaaucaugccca

SEQ ID NO: 1834223 - RNA, 17 nt, Salmonella typhimurium LT2
ucgccaagaucgccaag

SEQ ID NO: 1834224 - RNA, 13 nt, Salmonella typhimurium LT2
ucgccaucaccag

SEQ ID NO: 1834225 - RNA, 16 nt, Salmonella typhimurium LT2
ucgccaauuaaauauc

SEQ ID NO: 1834226 - RNA, 20 nt, Salmonella typhimurium LT2
ucgccaauaaugccgccguc

SEQ ID NO: 1834227 - RNA, 19 nt, Salmonella typhimurium LT2
ucgccaugucuucgcgcgu

SEQ ID NO: 1834228 - RNA, 20 nt, Salmonella typhimurium LT2
ucgccauucggauaauccag

SEQ ID NO: 1834229 - RNA, 12 nt, Salmonella typhimurium LT2
ugauaacaauau

SEQ ID NO: 1834230 - RNA, 14 nt, Salmonella typhimurium LT2
ugauaacccaacuc

SEQ ID NO: 1834231 - RNA, 15 nt, Salmonella typhimurium LT2
ugauaaccgccgcca

SEQ ID NO: 1834232 - RNA, 13 nt, Salmonella typhimurium LT2
ugauaagagaaaa

SEQ ID NO: 1834233 - RNA, 21 nt, Salmonella typhimurium LT2
ugauaagcguagcgccaucag

SEQ ID NO: 1834234 - RNA, 21 nt, Salmonella typhimurium LT2
ugauaagcauagcgccaucag

SEQ ID NO: 1834235 - RNA, 13 nt, Salmonella typhimurium LT2
ugauaagcgcagc

SEQ ID NO: 1834236 - RNA, 12 nt, Salmonella typhimurium LT2
ugauaauacugc

SEQ ID NO: 1834237 - RNA, 22 nt, Salmonella typhimurium LT2
ugauacagaaaaccggcaaaua

SEQ ID NO: 1834238 - RNA, 16 nt, Salmonella typhimurium LT2
ugauacaggaauaacc

SEQ ID NO: 1834239 - RNA, 18 nt, Salmonella typhimurium LT2
ugauaaucagcacgccac

SEQ ID NO: 1834240 - RNA, 19 nt, Salmonella typhimurium LT2
ugauaauuagagacauggu

SEQ ID NO: 1834241 - RNA, 14 nt, Salmonella typhimurium LT2
ugauaccggaggag

SEQ ID NO: 1834242 - RNA, 14 nt, Salmonella typhimurium LT2
ugauacccugaauc

SEQ ID NO: 1834243 - RNA, 19 nt, Salmonella typhimurium LT2
ugauacgcggcugaugcag

SEQ ID NO: 1834244 - RNA, 19 nt, Salmonella typhimurium LT2
ugauacgggaagucauuag

SEQ ID NO: 1834245 - RNA, 16 nt, Salmonella typhimurium LT2
ugauaccuaaacgcgu

SEQ ID NO: 1834246 - RNA, 19 nt, Salmonella typhimurium LT2
ugagcauaaacgacaucaa

SEQ ID NO: 1834247 - RNA, 22 nt, Salmonella typhimurium LT2
ugagccacugcauuacucgccu

SEQ ID NO: 1834248 - RNA, 17 nt, Salmonella typhimurium LT2
ugagucgggccugcugc

SEQ ID NO: 1834249 - RNA, 13 nt, Salmonella typhimurium LT2
ugaguuauguauu

SEQ ID NO: 1834250 - RNA, 16 nt, Salmonella typhimurium LT2
ugaguuugucauccag

SEQ ID NO: 1834251 - RNA, 16 nt, Salmonella typhimurium LT2
ugaguuggccuaccau

SEQ ID NO: 1834252 - RNA, 18 nt, Salmonella typhimurium LT2
ugauaaaucgucggcagg

SEQ ID NO: 1834253 - RNA, 13 nt, Salmonella typhimurium LT2
ugauaaaaaugcg

SEQ ID NO: 1834254 - RNA, 20 nt, Salmonella typhimurium LT2
ugaucaggaaaucuuccagu

SEQ ID NO: 1834255 - RNA, 12 nt, Salmonella typhimurium LT2
ugaucaaucaac

SEQ ID NO: 1834256 - RNA, 19 nt, Salmonella typhimurium LT2
ugauaugcucgacaauaaa

SEQ ID NO: 1834257 - RNA, 20 nt, Salmonella typhimurium LT2
ugauaucuaugguaauuuaa

SEQ ID NO: 1834258 - RNA, 14 nt, Salmonella typhimurium LT2
ugauaggccgcuau

SEQ ID NO: 1834259 - RNA, 15 nt, Salmonella typhimurium LT2
ugauagggaaggcuu

SEQ ID NO: 1834260 - RNA, 13 nt, Salmonella typhimurium LT2
ugauaguccauca

SEQ ID NO: 1834261 - RNA, 22 nt, Salmonella typhimurium LT2
ugauagugcguucgaaucagcu

SEQ ID NO: 1834262 - RNA, 18 nt, Salmonella typhimurium LT2
ugauagccguucuccagc

SEQ ID NO: 1834263 - RNA, 21 nt, Salmonella typhimurium LT2
ugauagcccguuaugccaucu

SEQ ID NO: 1834264 - RNA, 18 nt, Salmonella typhimurium LT2
ugauagcgaggcagcagg

SEQ ID NO: 1834265 - RNA, 16 nt, Salmonella typhimurium LT2
ugauagacguaaugau

SEQ ID NO: 1834266 - RNA, 23 nt, Salmonella typhimurium LT2
ugauagagguuaccgggcuaaac

SEQ ID NO: 1834267 - RNA, 18 nt, Salmonella typhimurium LT2
ugaugagaugcaggccaa

SEQ ID NO: 1834268 - RNA, 17 nt, Salmonella typhimurium LT2
ugaugaacaggcguggg

SEQ ID NO: 1834269 - RNA, 20 nt, Salmonella typhimurium LT2
ugaucuugcucaauaauacg

SEQ ID NO: 1834270 - RNA, 13 nt, Salmonella typhimurium LT2
ugaugaugccagg

SEQ ID NO: 1834271 - RNA, 22 nt, Salmonella typhimurium LT2
ugaugccccagaacaacgggaa

SEQ ID NO: 1834272 - RNA, 14 nt, Salmonella typhimurium LT2
ugaucauacugccg

SEQ ID NO: 1834273 - RNA, 15 nt, Salmonella typhimurium LT2
ugaucaguuugccuu

SEQ ID NO: 1834274 - RNA, 23 nt, Salmonella typhimurium LT2
ugaucaguuugccuuuauucauu

SEQ ID NO: 1834275 - RNA, 15 nt, Salmonella typhimurium LT2
ugaucguuucauuuu

SEQ ID NO: 1834276 - RNA, 13 nt, Salmonella typhimurium LT2
ugaucuaaaaauu

SEQ ID NO: 1834277 - RNA, 22 nt, Salmonella typhimurium LT2
ugaucguuggaaagcugcugcu

SEQ ID NO: 1834278 - RNA, 19 nt, Salmonella typhimurium LT2
ugaucuggccaauuuuuca

SEQ ID NO: 1834279 - RNA, 22 nt, Salmonella typhimurium LT2
ugaucuccucgccguaaaauuc

SEQ ID NO: 1834280 - RNA, 15 nt, Salmonella typhimurium LT2
ugaucugaagcguau

SEQ ID NO: 1834281 - RNA, 16 nt, Salmonella typhimurium LT2
ugcaaaagacggcuuu

SEQ ID NO: 1834282 - RNA, 12 nt, Salmonella typhimurium LT2
ugcaaaaugaug

SEQ ID NO: 1834283 - RNA, 11 nt, Salmonella typhimurium LT2
ugcaaauacca

SEQ ID NO: 1834284 - RNA, 17 nt, Salmonella typhimurium LT2
ugcaaauaccacaucag

SEQ ID NO: 1834285 - RNA, 15 nt, Salmonella typhimurium LT2
ugcaaauacugcuuu

SEQ ID NO: 1834286 - RNA, 20 nt, Salmonella typhimurium LT2
ugcaaauacugcuuuuccgg

SEQ ID NO: 1834287 - RNA, 16 nt, Salmonella typhimurium LT2
ugauugcgacaggcug

SEQ ID NO: 1834288 - RNA, 13 nt, Salmonella typhimurium LT2
ugauugauuuugu

SEQ ID NO: 1834289 - RNA, 16 nt, Salmonella typhimurium LT2
ugauucacuuucuugc

SEQ ID NO: 1834290 - RNA, 16 nt, Salmonella typhimurium LT2
ugauucauacgcuuuc

SEQ ID NO: 1834291 - RNA, 19 nt, Salmonella typhimurium LT2
ugauucauucccauacugc

SEQ ID NO: 1834292 - RNA, 14 nt, Salmonella typhimurium LT2
ugauuaaucgucau

SEQ ID NO: 1834293 - RNA, 12 nt, Salmonella typhimurium LT2
ugauuacaaaau

SEQ ID NO: 1834294 - RNA, 18 nt, Salmonella typhimurium LT2
ugauuaaucagcucagca

SEQ ID NO: 1834295 - RNA, 21 nt, Salmonella typhimurium LT2
ugauuaaucagcucagcaaca

SEQ ID NO: 1834296 - RNA, 22 nt, Salmonella typhimurium LT2
ugauuaaucagcucagcaacaa

SEQ ID NO: 1834297 - RNA, 15 nt, Salmonella typhimurium LT2
ugaugccguuuucau

SEQ ID NO: 1834298 - RNA, 19 nt, Salmonella typhimurium LT2
ugauuaaguuuuuuuaaaa

SEQ ID NO: 1834299 - RNA, 15 nt, Salmonella typhimurium LT2
ugcacgccaggguaa

SEQ ID NO: 1834300 - RNA, 14 nt, Salmonella typhimurium LT2
ugcacgcauggcac

SEQ ID NO: 1834301 - RNA, 23 nt, Salmonella typhimurium LT2
ugcacgccgcgcucgcucaucac

SEQ ID NO: 1834302 - RNA, 17 nt, Salmonella typhimurium LT2
ugcaauuccggcgaaaa

SEQ ID NO: 1834303 - RNA, 19 nt, Salmonella typhimurium LT2
ugcaauuccggcgaaaaac

SEQ ID NO: 1834304 - RNA, 20 nt, Salmonella typhimurium LT2
ugcaauuccggcgaaaaacc

SEQ ID NO: 1834305 - RNA, 16 nt, Salmonella typhimurium LT2
ugcaauguucaauauc

SEQ ID NO: 1834306 - RNA, 21 nt, Salmonella typhimurium LT2
ugcaacgcuuuagugccgcca

SEQ ID NO: 1834307 - RNA, 19 nt, Salmonella typhimurium LT2
ugcaacuucaccuucggug

SEQ ID NO: 1834308 - RNA, 18 nt, Salmonella typhimurium LT2
ugcaauaucccucgaagu

SEQ ID NO: 1834309 - RNA, 21 nt, Salmonella typhimurium LT2
ugcaauguuuucagcaaauaa

SEQ ID NO: 1834310 - RNA, 15 nt, Salmonella typhimurium LT2
ugcaauguucaauau

SEQ ID NO: 1834311 - RNA, 12 nt, Salmonella typhimurium LT2
ugcaaucagauu

SEQ ID NO: 1834312 - RNA, 17 nt, Salmonella typhimurium LT2
ugcaaccgcucuuuugc

SEQ ID NO: 1834313 - RNA, 23 nt, Salmonella typhimurium LT2
ugcaaccuccgcaccuucaucau

SEQ ID NO: 1834314 - RNA, 21 nt, Salmonella typhimurium LT2
ugcaacgaucccuaauaaaau

SEQ ID NO: 1834315 - RNA, 23 nt, Salmonella typhimurium LT2
ugcaacgaucccuaauaaaauaa

SEQ ID NO: 1834316 - RNA, 21 nt, Salmonella typhimurium LT2
ugcaacagaagaguuaacuuc

SEQ ID NO: 1834317 - RNA, 15 nt, Salmonella typhimurium LT2
ugcaacagcaccagc

SEQ ID NO: 1834318 - RNA, 20 nt, Salmonella typhimurium LT2
ugacgggggcgaucagcagg

SEQ ID NO: 1834319 - RNA, 20 nt, Salmonella typhimurium LT2
ugacguaaaucugaaauaaa

SEQ ID NO: 1834320 - RNA, 15 nt, Salmonella typhimurium LT2
ugacguaaauucuga

SEQ ID NO: 1834321 - RNA, 13 nt, Salmonella typhimurium LT2
ugacguaauugcc

SEQ ID NO: 1834322 - RNA, 15 nt, Salmonella typhimurium LT2
ugacuaaaagacgcc

SEQ ID NO: 1834323 - RNA, 22 nt, Salmonella typhimurium LT2
ugacguucaucauuuucccacu

SEQ ID NO: 1834324 - RNA, 19 nt, Salmonella typhimurium LT2
ugacguguuucauaauaug

SEQ ID NO: 1834325 - RNA, 14 nt, Salmonella typhimurium LT2
ugacgugagagaaa

SEQ ID NO: 1834326 - RNA, 16 nt, Salmonella typhimurium LT2
ugacugaauuaucagg

SEQ ID NO: 1834327 - RNA, 17 nt, Salmonella typhimurium LT2
ugacugaauuuucagcc

SEQ ID NO: 1834328 - RNA, 14 nt, Salmonella typhimurium LT2
ugacuuacaggcug

SEQ ID NO: 1834329 - RNA, 15 nt, Salmonella typhimurium LT2
ugacuaaaucagcau

SEQ ID NO: 1834330 - RNA, 13 nt, Salmonella typhimurium LT2
ugacuaaaucagc

SEQ ID NO: 1834331 - RNA, 14 nt, Salmonella typhimurium LT2
ugacuaucuuuaug

SEQ ID NO: 1834332 - RNA, 14 nt, Salmonella typhimurium LT2
ugacuaguccugau

SEQ ID NO: 1834333 - RNA, 17 nt, Salmonella typhimurium LT2
ugacuuacgcacuguug

SEQ ID NO: 1834334 - RNA, 19 nt, Salmonella typhimurium LT2
ugagacccaaaggaggaaa

SEQ ID NO: 1834335 - RNA, 18 nt, Salmonella typhimurium LT2
ugagaauuuccaguucaa

SEQ ID NO: 1834336 - RNA, 19 nt, Salmonella typhimurium LT2
ugagagcacguaggccuga

SEQ ID NO: 1834337 - RNA, 18 nt, Salmonella typhimurium LT2
ugagacgcagccucucuu

SEQ ID NO: 1834338 - RNA, 13 nt, Salmonella typhimurium LT2
ugagcaaaggcag

SEQ ID NO: 1834339 - RNA, 18 nt, Salmonella typhimurium LT2
ugagcaaugcagaaguuu

SEQ ID NO: 1834340 - RNA, 15 nt, Salmonella typhimurium LT2
ugagcaaugggaagg

SEQ ID NO: 1834341 - RNA, 18 nt, Salmonella typhimurium LT2
ugagcaaugggaaggaaa

SEQ ID NO: 1834342 - RNA, 22 nt, Salmonella typhimurium LT2
ugagcaaugggaaggaaaauag

SEQ ID NO: 1834343 - RNA, 16 nt, Salmonella typhimurium LT2
ugaccgcacagcagac

SEQ ID NO: 1834344 - RNA, 14 nt, Salmonella typhimurium LT2
ugacccucccugcg

SEQ ID NO: 1834345 - RNA, 19 nt, Salmonella typhimurium LT2
ugaccagguugccagcggg

SEQ ID NO: 1834346 - RNA, 12 nt, Salmonella typhimurium LT2
ugaccaaacugc

SEQ ID NO: 1834347 - RNA, 18 nt, Salmonella typhimurium LT2
ugacauuccuuuuaauuu

SEQ ID NO: 1834348 - RNA, 17 nt, Salmonella typhimurium LT2
ugacauuaauucagucc

SEQ ID NO: 1834349 - RNA, 21 nt, Salmonella typhimurium LT2
ugacauuaauucaguccuucc

SEQ ID NO: 1834350 - RNA, 16 nt, Salmonella typhimurium LT2
ugacaauacugaacgc

SEQ ID NO: 1834351 - RNA, 11 nt, Salmonella typhimurium LT2
ugacaucaucc

SEQ ID NO: 1834352 - RNA, 15 nt, Salmonella typhimurium LT2
ugacgacccgcuucc

SEQ ID NO: 1834353 - RNA, 23 nt, Salmonella typhimurium LT2
ugaccgccgucauagcaggagau

SEQ ID NO: 1834354 - RNA, 17 nt, Salmonella typhimurium LT2
ugaccgccgucauagca

SEQ ID NO: 1834355 - RNA, 15 nt, Salmonella typhimurium LT2
ugaccugcccauccu

SEQ ID NO: 1834356 - RNA, 17 nt, Salmonella typhimurium LT2
ugaccugggcgccagag

SEQ ID NO: 1834357 - RNA, 18 nt, Salmonella typhimurium LT2
ugacgauguucgucccug

SEQ ID NO: 1834358 - RNA, 15 nt, Salmonella typhimurium LT2
ugacgcaccguggaa

SEQ ID NO: 1834359 - RNA, 19 nt, Salmonella typhimurium LT2
ugacgauuuuuaagcugcg

SEQ ID NO: 1834360 - RNA, 13 nt, Salmonella typhimurium LT2
ugacgcagcagcu

SEQ ID NO: 1834361 - RNA, 22 nt, Salmonella typhimurium LT2
ugacgcagacgucaacaccucc

SEQ ID NO: 1834362 - RNA, 12 nt, Salmonella typhimurium LT2
ugacgccaggca

SEQ ID NO: 1834363 - RNA, 18 nt, Salmonella typhimurium LT2
ugacgcgcauacucauua

SEQ ID NO: 1834364 - RNA, 20 nt, Salmonella typhimurium LT2
ugacgccgcagccugauggc

SEQ ID NO: 1834365 - RNA, 16 nt, Salmonella typhimurium LT2
ugacgcuccugaaucg

SEQ ID NO: 1834366 - RNA, 22 nt, Salmonella typhimurium LT2
ugacgcguuaauauccuucagc

SEQ ID NO: 1834367 - RNA, 19 nt, Salmonella typhimurium LT2
ugaacuauaggaaaauaau

SEQ ID NO: 1834368 - RNA, 21 nt, Salmonella typhimurium LT2
ugaacucgacgccuucuucgu

SEQ ID NO: 1834369 - RNA, 15 nt, Salmonella typhimurium LT2
ugaacugcccggagc

SEQ ID NO: 1834370 - RNA, 21 nt, Salmonella typhimurium LT2
ugaacguuuuagcauguaagc

SEQ ID NO: 1834371 - RNA, 22 nt, Salmonella typhimurium LT2
ugaacggggaucaaaauuaagc

SEQ ID NO: 1834372 - RNA, 18 nt, Salmonella typhimurium LT2
ugaacggcucaaaauaau

SEQ ID NO: 1834373 - RNA, 14 nt, Salmonella typhimurium LT2
ugaacgccggaacc

SEQ ID NO: 1834374 - RNA, 17 nt, Salmonella typhimurium LT2
ugaagaguuugaucaug

SEQ ID NO: 1834375 - RNA, 18 nt, Salmonella typhimurium LT2
ugaagaccuuaucucgcu

SEQ ID NO: 1834376 - RNA, 20 nt, Salmonella typhimurium LT2
ugaacuuuuuguaggagcuc

SEQ ID NO: 1834377 - RNA, 19 nt, Salmonella typhimurium LT2
ugaagaaaauacugauuaa

SEQ ID NO: 1834378 - RNA, 18 nt, Salmonella typhimurium LT2
ugaagcugccgucccagc

SEQ ID NO: 1834379 - RNA, 15 nt, Salmonella typhimurium LT2
ugaagguuuuucccg

SEQ ID NO: 1834380 - RNA, 21 nt, Salmonella typhimurium LT2
ugaaguaauagguugcgccaa

SEQ ID NO: 1834381 - RNA, 18 nt, Salmonella typhimurium LT2
ugaagggggccagagcag

SEQ ID NO: 1834382 - RNA, 22 nt, Salmonella typhimurium LT2
ugaagcgauuuauccaccgcca

SEQ ID NO: 1834383 - RNA, 16 nt, Salmonella typhimurium LT2
ugaagcgaccggcguc

SEQ ID NO: 1834384 - RNA, 20 nt, Salmonella typhimurium LT2
ugaagccauccucacgcaac

SEQ ID NO: 1834385 - RNA, 20 nt, Salmonella typhimurium LT2
ugaagcauccgggauauaaa

SEQ ID NO: 1834386 - RNA, 13 nt, Salmonella typhimurium LT2
ugaagcauaaaaa

SEQ ID NO: 1834387 - RNA, 16 nt, Salmonella typhimurium LT2
ugaagcauaaaaagac

SEQ ID NO: 1834388 - RNA, 19 nt, Salmonella typhimurium LT2
ugaagcauaaaaagacuau

SEQ ID NO: 1834389 - RNA, 18 nt, Salmonella typhimurium LT2
ugaagaugguaauauuaa

SEQ ID NO: 1834390 - RNA, 20 nt, Salmonella typhimurium LT2
ugaagauuuuuauucccgcc

SEQ ID NO: 1834391 - RNA, 17 nt, Salmonella typhimurium LT2
ugaagauuuuuauuccc

SEQ ID NO: 1834392 - RNA, 22 nt, Salmonella typhimurium LT2
ugaaugccccagcgcugcugua

SEQ ID NO: 1834393 - RNA, 18 nt, Salmonella typhimurium LT2
ugaauggcggagaucucc

SEQ ID NO: 1834394 - RNA, 21 nt, Salmonella typhimurium LT2
ugaaucagauacggcuccagc

SEQ ID NO: 1834395 - RNA, 20 nt, Salmonella typhimurium LT2
ugaaucagaugcgcuucagc

SEQ ID NO: 1834396 - RNA, 17 nt, Salmonella typhimurium LT2
ugaaucccccugccaca

SEQ ID NO: 1834397 - RNA, 21 nt, Salmonella typhimurium LT2
ugaaucccgccaucguccagc

SEQ ID NO: 1834398 - RNA, 21 nt, Salmonella typhimurium LT2
ugaauccccagaauuucuuug

SEQ ID NO: 1834399 - RNA, 20 nt, Salmonella typhimurium LT2
ugaauccccagaauuucuuu

SEQ ID NO: 1834400 - RNA, 19 nt, Salmonella typhimurium LT2
ugaauccagcguacugagu

SEQ ID NO: 1834401 - RNA, 17 nt, Salmonella typhimurium LT2
ugacaaucagcacacua

SEQ ID NO: 1834402 - RNA, 20 nt, Salmonella typhimurium LT2
ugaauuugcugcauuucuug

SEQ ID NO: 1834403 - RNA, 19 nt, Salmonella typhimurium LT2
ugaauuaauggucagaucu

SEQ ID NO: 1834404 - RNA, 23 nt, Salmonella typhimurium LT2
ugaauuagguuacguugucacaa

SEQ ID NO: 1834405 - RNA, 22 nt, Salmonella typhimurium LT2
ugaauuacagcucauaaacgcg

SEQ ID NO: 1834406 - RNA, 16 nt, Salmonella typhimurium LT2
ugaauaaccauacuga

SEQ ID NO: 1834407 - RNA, 14 nt, Salmonella typhimurium LT2
ugaauaaaggguuu

SEQ ID NO: 1834408 - RNA, 19 nt, Salmonella typhimurium LT2
ugaauauuuuagccgcccc

SEQ ID NO: 1834409 - RNA, 17 nt, Salmonella typhimurium LT2
ugaauauucggcuccag

SEQ ID NO: 1834410 - RNA, 15 nt, Salmonella typhimurium LT2
ugaauauaauucaua

SEQ ID NO: 1834411 - RNA, 15 nt, Salmonella typhimurium LT2
ugaauagccagcccc

SEQ ID NO: 1834412 - RNA, 13 nt, Salmonella typhimurium LT2
ugaauagcgcaga

SEQ ID NO: 1834413 - RNA, 12 nt, Salmonella typhimurium LT2
ugaauagccagc

SEQ ID NO: 1834414 - RNA, 15 nt, Salmonella typhimurium LT2
ugaauaguagcugag

SEQ ID NO: 1834415 - RNA, 12 nt, Salmonella typhimurium LT2
ugcugacgcuga

SEQ ID NO: 1834416 - RNA, 16 nt, Salmonella typhimurium LT2
ugcugaagauaaaauu

SEQ ID NO: 1834417 - RNA, 21 nt, Salmonella typhimurium LT2
ugcugaacacaaugaauccuc

SEQ ID NO: 1834418 - RNA, 20 nt, Salmonella typhimurium LT2
ugcugaagcagauacugcgc

SEQ ID NO: 1834419 - RNA, 20 nt, Salmonella typhimurium LT2
ugcugaaaugauaagugaua

SEQ ID NO: 1834420 - RNA, 12 nt, Salmonella typhimurium LT2
ugcucuuuuguc

SEQ ID NO: 1834421 - RNA, 14 nt, Salmonella typhimurium LT2
ugcugcaaauauuc

SEQ ID NO: 1834422 - RNA, 14 nt, Salmonella typhimurium LT2
ugcugcaccgcauc

SEQ ID NO: 1834423 - RNA, 12 nt, Salmonella typhimurium LT2
ugcugcaccaau

SEQ ID NO: 1834424 - RNA, 15 nt, Salmonella typhimurium LT2
ugcugauaauacugc

SEQ ID NO: 1834425 - RNA, 22 nt, Salmonella typhimurium LT2
ugcugauaacuaauggcauuuc

SEQ ID NO: 1834426 - RNA, 16 nt, Salmonella typhimurium LT2
ugcugcacgccgcgcu

SEQ ID NO: 1834427 - RNA, 22 nt, Salmonella typhimurium LT2
ugcugcagacugccggcaaaac

SEQ ID NO: 1834428 - RNA, 16 nt, Salmonella typhimurium LT2
ugcugccagucugccc

SEQ ID NO: 1834429 - RNA, 16 nt, Salmonella typhimurium LT2
ugcugccacgucacgc

SEQ ID NO: 1834430 - RNA, 13 nt, Salmonella typhimurium LT2
ugcucaauauuau

SEQ ID NO: 1834431 - RNA, 12 nt, Salmonella typhimurium LT2
ugcucaauaagc

SEQ ID NO: 1834432 - RNA, 20 nt, Salmonella typhimurium LT2
ugcguuggcucgcugccaaa

SEQ ID NO: 1834433 - RNA, 19 nt, Salmonella typhimurium LT2
ugcguuguuccugagucac

SEQ ID NO: 1834434 - RNA, 14 nt, Salmonella typhimurium LT2
ugcucauaacccuc

SEQ ID NO: 1834435 - RNA, 19 nt, Salmonella typhimurium LT2
ugcucauaacccuccugcc

SEQ ID NO: 1834436 - RNA, 21 nt, Salmonella typhimurium LT2
ugcucaugacaucgcccuggg

SEQ ID NO: 1834437 - RNA, 14 nt, Salmonella typhimurium LT2
ugcucauugccuuu

SEQ ID NO: 1834438 - RNA, 21 nt, Salmonella typhimurium LT2
ugcucauugccuuucaauacu

SEQ ID NO: 1834439 - RNA, 11 nt, Salmonella typhimurium LT2
ugcucaaugau

SEQ ID NO: 1834440 - RNA, 16 nt, Salmonella typhimurium LT2
ugcucaaucgcaugac

SEQ ID NO: 1834441 - RNA, 14 nt, Salmonella typhimurium LT2
ugcucaaucgccug

SEQ ID NO: 1834442 - RNA, 23 nt, Salmonella typhimurium LT2
ugcucagguaggugauaagcagg

SEQ ID NO: 1834443 - RNA, 23 nt, Salmonella typhimurium LT2
ugcuccggcuuaaugcccggccc

SEQ ID NO: 1834444 - RNA, 22 nt, Salmonella typhimurium LT2
ugcuccggcuuaaugcccggcc

SEQ ID NO: 1834445 - RNA, 15 nt, Salmonella typhimurium LT2
ugcuccgguuugagc

SEQ ID NO: 1834446 - RNA, 20 nt, Salmonella typhimurium LT2
ugcuccguaucgugcugcug

SEQ ID NO: 1834447 - RNA, 21 nt, Salmonella typhimurium LT2
ugcucgauaccuuccgggccg

SEQ ID NO: 1834448 - RNA, 19 nt, Salmonella typhimurium LT2
ugcucguagcguuuaaaga

SEQ ID NO: 1834449 - RNA, 15 nt, Salmonella typhimurium LT2
ugcucgcccuguugc

SEQ ID NO: 1834450 - RNA, 21 nt, Salmonella typhimurium LT2
ugcuggcgcgucacaacagcc

SEQ ID NO: 1834451 - RNA, 20 nt, Salmonella typhimurium LT2
ugcuggcgcgucacaacagc

SEQ ID NO: 1834452 - RNA, 19 nt, Salmonella typhimurium LT2
ugcuggcgcuacguuuguc

SEQ ID NO: 1834453 - RNA, 20 nt, Salmonella typhimurium LT2
ugcuggcgcuacguuuguca

SEQ ID NO: 1834454 - RNA, 14 nt, Salmonella typhimurium LT2
ugcuggcuuugcug

SEQ ID NO: 1834455 - RNA, 17 nt, Salmonella typhimurium LT2
ugcugcuucgcugacga

SEQ ID NO: 1834456 - RNA, 14 nt, Salmonella typhimurium LT2
ugcugccucaucaa

SEQ ID NO: 1834457 - RNA, 19 nt, Salmonella typhimurium LT2
ugcugcucuugcggcugca

SEQ ID NO: 1834458 - RNA, 15 nt, Salmonella typhimurium LT2
ugcugcucccucacg

SEQ ID NO: 1834459 - RNA, 13 nt, Salmonella typhimurium LT2
ugcugcuguuacc

SEQ ID NO: 1834460 - RNA, 19 nt, Salmonella typhimurium LT2
ugcuguagcgucucaucaa

SEQ ID NO: 1834461 - RNA, 18 nt, Salmonella typhimurium LT2
ugcuguagcucagguucg

SEQ ID NO: 1834462 - RNA, 13 nt, Salmonella typhimurium LT2
ugcuguagcacau

SEQ ID NO: 1834463 - RNA, 22 nt, Salmonella typhimurium LT2
ugcuguagcugcccggauaacc

SEQ ID NO: 1834464 - RNA, 18 nt, Salmonella typhimurium LT2
ugcuguugcggaauacac

SEQ ID NO: 1834465 - RNA, 19 nt, Salmonella typhimurium LT2
ugcuucaccgcuuucaaaa

SEQ ID NO: 1834466 - RNA, 15 nt, Salmonella typhimurium LT2
ugcuugagcaggcag

SEQ ID NO: 1834467 - RNA, 20 nt, Salmonella typhimurium LT2
ugcuucaccucagcaaaauc

SEQ ID NO: 1834468 - RNA, 16 nt, Salmonella typhimurium LT2
ugcuuaucgccaaacc

SEQ ID NO: 1834469 - RNA, 19 nt, Salmonella typhimurium LT2
ugcuuaucgccaaaccaga

SEQ ID NO: 1834470 - RNA, 22 nt, Salmonella typhimurium LT2
ugcuuaucgccaaaccagaccc

SEQ ID NO: 1834471 - RNA, 22 nt, Salmonella typhimurium LT2
ugcuuagcuggccaaucagcgg

SEQ ID NO: 1834472 - RNA, 21 nt, Salmonella typhimurium LT2
ugcuuuggccgguucggccag

SEQ ID NO: 1834473 - RNA, 13 nt, Salmonella typhimurium LT2
ugcuuuauaaaaa

SEQ ID NO: 1834474 - RNA, 15 nt, Salmonella typhimurium LT2
ugcuuucaauaagca

SEQ ID NO: 1834475 - RNA, 14 nt, Salmonella typhimurium LT2
ugcuuuaaaugccu

SEQ ID NO: 1834476 - RNA, 17 nt, Salmonella typhimurium LT2
ugcgccaggcagcaccu

SEQ ID NO: 1834477 - RNA, 22 nt, Salmonella typhimurium LT2
ugcgccagccggauacugcgcu

SEQ ID NO: 1834478 - RNA, 13 nt, Salmonella typhimurium LT2
ugcgccagcagcg

SEQ ID NO: 1834479 - RNA, 15 nt, Salmonella typhimurium LT2
ugcgccagcauggcg

SEQ ID NO: 1834480 - RNA, 23 nt, Salmonella typhimurium LT2
ugcgccaccuuaaucgacuucau

SEQ ID NO: 1834481 - RNA, 20 nt, Salmonella typhimurium LT2
ugcgccaccagcgcaguaaa

SEQ ID NO: 1834482 - RNA, 17 nt, Salmonella typhimurium LT2
ugcgccaccagcgcagu

SEQ ID NO: 1834483 - RNA, 23 nt, Salmonella typhimurium LT2
ugccuuccgggcggcugucccag

SEQ ID NO: 1834484 - RNA, 14 nt, Salmonella typhimurium LT2
ugccuucgccgccg

SEQ ID NO: 1834485 - RNA, 17 nt, Salmonella typhimurium LT2
ugccuucgaagaauucc

SEQ ID NO: 1834486 - RNA, 22 nt, Salmonella typhimurium LT2
ugccuucgaagaauuccaccuu

SEQ ID NO: 1834487 - RNA, 11 nt, Salmonella typhimurium LT2
ugccuuccuga

SEQ ID NO: 1834488 - RNA, 17 nt, Salmonella typhimurium LT2
ugcgcccuuccgucagc

SEQ ID NO: 1834489 - RNA, 15 nt, Salmonella typhimurium LT2
ugcgccgcacuucac

SEQ ID NO: 1834490 - RNA, 16 nt, Salmonella typhimurium LT2
ugcgccgcagcgccug

SEQ ID NO: 1834491 - RNA, 23 nt, Salmonella typhimurium LT2
ugcgccgacaucgccaccgcaug

SEQ ID NO: 1834492 - RNA, 23 nt, Salmonella typhimurium LT2
ugcgccgccauccggcgauggug

SEQ ID NO: 1834493 - RNA, 12 nt, Salmonella typhimurium LT2
ugcgccgcgccg

SEQ ID NO: 1834494 - RNA, 15 nt, Salmonella typhimurium LT2
ugcgccgcgccgccc

SEQ ID NO: 1834495 - RNA, 20 nt, Salmonella typhimurium LT2
ugcgcccgcgaucgcuucca

SEQ ID NO: 1834496 - RNA, 19 nt, Salmonella typhimurium LT2
ugcgccauuucaauaauau

SEQ ID NO: 1834497 - RNA, 14 nt, Salmonella typhimurium LT2
ugcgccauuuccag

SEQ ID NO: 1834498 - RNA, 22 nt, Salmonella typhimurium LT2
ugcgccauccaccaggcaugca

SEQ ID NO: 1834499 - RNA, 20 nt, Salmonella typhimurium LT2
ugcgccaucuaaauuucagu

SEQ ID NO: 1834500 - RNA, 22 nt, Salmonella typhimurium LT2
ugcgccauauaggcauguuccu

SEQ ID NO: 1834501 - RNA, 17 nt, Salmonella typhimurium LT2
ugcgccaguucauccag

SEQ ID NO: 1834502 - RNA, 13 nt, Salmonella typhimurium LT2
ugcgccuuccagu

SEQ ID NO: 1834503 - RNA, 12 nt, Salmonella typhimurium LT2
ugcgccuggcag

SEQ ID NO: 1834504 - RNA, 22 nt, Salmonella typhimurium LT2
ugcgccuguuagggcgcggcug

SEQ ID NO: 1834505 - RNA, 20 nt, Salmonella typhimurium LT2
ugcgccuuaaaaagaacaag

SEQ ID NO: 1834506 - RNA, 17 nt, Salmonella typhimurium LT2
ugcgccuuacccggccu

SEQ ID NO: 1834507 - RNA, 21 nt, Salmonella typhimurium LT2
ugcgccuguuagggcgcggcu

SEQ ID NO: 1834508 - RNA, 19 nt, Salmonella typhimurium LT2
ugcgcgacgcccaccaguc

SEQ ID NO: 1834509 - RNA, 22 nt, Salmonella typhimurium LT2
ugcgccuugacgauaugcugcc

SEQ ID NO: 1834510 - RNA, 18 nt, Salmonella typhimurium LT2
ugcgcgaccacgccagcc

SEQ ID NO: 1834511 - RNA, 21 nt, Salmonella typhimurium LT2
ugcgcgaccacgccagccagc

SEQ ID NO: 1834512 - RNA, 22 nt, Salmonella typhimurium LT2
ugcgcgaccacgccagccagcc

SEQ ID NO: 1834513 - RNA, 18 nt, Salmonella typhimurium LT2
ugcgcgacugcgcgcggu

SEQ ID NO: 1834514 - RNA, 13 nt, Salmonella typhimurium LT2
ugcgccucagcca

SEQ ID NO: 1834515 - RNA, 14 nt, Salmonella typhimurium LT2
ugcgcggcugcgga

SEQ ID NO: 1834516 - RNA, 23 nt, Salmonella typhimurium LT2
ugcgcggcacacuuucaucagcc

SEQ ID NO: 1834517 - RNA, 20 nt, Salmonella typhimurium LT2
ugcgcgggcguauagccagg

SEQ ID NO: 1834518 - RNA, 20 nt, Salmonella typhimurium LT2
ugcgcguagcccacagguag

SEQ ID NO: 1834519 - RNA, 22 nt, Salmonella typhimurium LT2
ugcgcgcgugaccccaggcaua

SEQ ID NO: 1834520 - RNA, 12 nt, Salmonella typhimurium LT2
ugcgcgcuauuc

SEQ ID NO: 1834521 - RNA, 16 nt, Salmonella typhimurium LT2
ugcgcgcaucgggccg

SEQ ID NO: 1834522 - RNA, 18 nt, Salmonella typhimurium LT2
ugcgcgccacgcccagcg

SEQ ID NO: 1834523 - RNA, 15 nt, Salmonella typhimurium LT2
ugcggucuccugaac

SEQ ID NO: 1834524 - RNA, 19 nt, Salmonella typhimurium LT2
ugcggggagcgaaaaggcc

SEQ ID NO: 1834525 - RNA, 22 nt, Salmonella typhimurium LT2
ugcgggccguaaaguucccagc

SEQ ID NO: 1834526 - RNA, 17 nt, Salmonella typhimurium LT2
ugcggcgcgcccggcaa

SEQ ID NO: 1834527 - RNA, 18 nt, Salmonella typhimurium LT2
ugcgguuacguccggcau

SEQ ID NO: 1834528 - RNA, 21 nt, Salmonella typhimurium LT2
ugcguaauacggagcaaaaaa

SEQ ID NO: 1834529 - RNA, 14 nt, Salmonella typhimurium LT2
ugcguaaauaaaug

SEQ ID NO: 1834530 - RNA, 12 nt, Salmonella typhimurium LT2
ugcguucuucca

SEQ ID NO: 1834531 - RNA, 21 nt, Salmonella typhimurium LT2
ugcguucuuccacuucagcag

SEQ ID NO: 1834532 - RNA, 16 nt, Salmonella typhimurium LT2
ugcgugcuggcggccg

SEQ ID NO: 1834533 - RNA, 13 nt, Salmonella typhimurium LT2
ugcguugaauaaa

SEQ ID NO: 1834534 - RNA, 16 nt, Salmonella typhimurium LT2
ugcguugcaaauauuc

SEQ ID NO: 1834535 - RNA, 19 nt, Salmonella typhimurium LT2
ugcguugccgccuugcugc

SEQ ID NO: 1834536 - RNA, 23 nt, Salmonella typhimurium LT2
ugcguuggaaauacguuaacccg

SEQ ID NO: 1834537 - RNA, 19 nt, Salmonella typhimurium LT2
ugcgugagcaggggccgga

SEQ ID NO: 1834538 - RNA, 18 nt, Salmonella typhimurium LT2
ugcggcagggcggucugg

SEQ ID NO: 1834539 - RNA, 13 nt, Salmonella typhimurium LT2
ugcggauagucau

SEQ ID NO: 1834540 - RNA, 19 nt, Salmonella typhimurium LT2
ugcggagaagacgccgccg

SEQ ID NO: 1834541 - RNA, 17 nt, Salmonella typhimurium LT2
ugcggaauacacgaaca

SEQ ID NO: 1834542 - RNA, 16 nt, Salmonella typhimurium LT2
ugcgcucagggucaga

SEQ ID NO: 1834543 - RNA, 22 nt, Salmonella typhimurium LT2
ugcgcucacgcuuauccggccu

SEQ ID NO: 1834544 - RNA, 16 nt, Salmonella typhimurium LT2
ugcgcuuuacuguucc

SEQ ID NO: 1834545 - RNA, 14 nt, Salmonella typhimurium LT2
ugcgcucaggguca

SEQ ID NO: 1834546 - RNA, 23 nt, Salmonella typhimurium LT2
ugcgcucacccggcuggaggcgg

SEQ ID NO: 1834547 - RNA, 17 nt, Salmonella typhimurium LT2
ugcgcuuuuucaucauc

SEQ ID NO: 1834548 - RNA, 17 nt, Salmonella typhimurium LT2
ugcgcgucccucuccag

SEQ ID NO: 1834549 - RNA, 18 nt, Salmonella typhimurium LT2
ugcgcguuuagcgccagc

SEQ ID NO: 1834550 - RNA, 23 nt, Salmonella typhimurium LT2
ugcgcuaagcguuacggaaaaaa

SEQ ID NO: 1834551 - RNA, 21 nt, Salmonella typhimurium LT2
ugcgcuacggcuuccggcguc

SEQ ID NO: 1834552 - RNA, 21 nt, Salmonella typhimurium LT2
ugcgcuacgggcacccgguca

SEQ ID NO: 1834553 - RNA, 17 nt, Salmonella typhimurium LT2
ugcaucucguaaaucaa

SEQ ID NO: 1834554 - RNA, 18 nt, Salmonella typhimurium LT2
ugcaucucguaaaucaau

SEQ ID NO: 1834555 - RNA, 17 nt, Salmonella typhimurium LT2
ugcaucgcggucagcgg

SEQ ID NO: 1834556 - RNA, 18 nt, Salmonella typhimurium LT2
ugcauccgcgcuuucugg

SEQ ID NO: 1834557 - RNA, 20 nt, Salmonella typhimurium LT2
ugcauccaacuuaugaaaac

SEQ ID NO: 1834558 - RNA, 22 nt, Salmonella typhimurium LT2
ugcauccaacuuaugaaaaccu

SEQ ID NO: 1834559 - RNA, 22 nt, Salmonella typhimurium LT2
ugcaugggauacgccagcagac

SEQ ID NO: 1834560 - RNA, 17 nt, Salmonella typhimurium LT2
ugcaugauuaggcuggg

SEQ ID NO: 1834561 - RNA, 18 nt, Salmonella typhimurium LT2
ugcaugauagucguuaua

SEQ ID NO: 1834562 - RNA, 23 nt, Salmonella typhimurium LT2
ugcaugauagucguuauaauccu

SEQ ID NO: 1834563 - RNA, 15 nt, Salmonella typhimurium LT2
ugcagugcacugccu

SEQ ID NO: 1834564 - RNA, 17 nt, Salmonella typhimurium LT2
ugcagugcacugccuga

SEQ ID NO: 1834565 - RNA, 13 nt, Salmonella typhimurium LT2
ugcacugccugau

SEQ ID NO: 1834566 - RNA, 17 nt, Salmonella typhimurium LT2
ugcacugccugauggcg

SEQ ID NO: 1834567 - RNA, 23 nt, Salmonella typhimurium LT2
ugcaguuccgcaauccuggcuuc

SEQ ID NO: 1834568 - RNA, 20 nt, Salmonella typhimurium LT2
ugcauaaagauugguaucug

SEQ ID NO: 1834569 - RNA, 13 nt, Salmonella typhimurium LT2
ugcauaaaaaaac

SEQ ID NO: 1834570 - RNA, 12 nt, Salmonella typhimurium LT2
ugcauaauggug

SEQ ID NO: 1834571 - RNA, 22 nt, Salmonella typhimurium LT2
ugcauacucacauucauaaaag

SEQ ID NO: 1834572 - RNA, 19 nt, Salmonella typhimurium LT2
ugcauacucacauucauaa

SEQ ID NO: 1834573 - RNA, 19 nt, Salmonella typhimurium LT2
ugcauacguuucaccagca

SEQ ID NO: 1834574 - RNA, 16 nt, Salmonella typhimurium LT2
ugcauauaacuuucaa

SEQ ID NO: 1834575 - RNA, 22 nt, Salmonella typhimurium LT2
ugcauauucauaucgaagccca

SEQ ID NO: 1834576 - RNA, 17 nt, Salmonella typhimurium LT2
ugcauuuucaccuggau

SEQ ID NO: 1834577 - RNA, 17 nt, Salmonella typhimurium LT2
ugcauuucuuguugacg

SEQ ID NO: 1834578 - RNA, 13 nt, Salmonella typhimurium LT2
ugccaaaaaauca

SEQ ID NO: 1834579 - RNA, 16 nt, Salmonella typhimurium LT2
ugccaaaaaaucagca

SEQ ID NO: 1834580 - RNA, 21 nt, Salmonella typhimurium LT2
ugccaaacaucgcucgcgcca

SEQ ID NO: 1834581 - RNA, 12 nt, Salmonella typhimurium LT2
ugccaaaccacu

SEQ ID NO: 1834582 - RNA, 20 nt, Salmonella typhimurium LT2
ugccaaagcgggcaauauaa

SEQ ID NO: 1834583 - RNA, 13 nt, Salmonella typhimurium LT2
ugcauuggccagc

SEQ ID NO: 1834584 - RNA, 13 nt, Salmonella typhimurium LT2
ugcauucgcuccu

SEQ ID NO: 1834585 - RNA, 14 nt, Salmonella typhimurium LT2
ugccacaaccgccc

SEQ ID NO: 1834586 - RNA, 19 nt, Salmonella typhimurium LT2
ugccaaaucaugagcgcaa

SEQ ID NO: 1834587 - RNA, 22 nt, Salmonella typhimurium LT2
ugccacgucacgcaacaggccg

SEQ ID NO: 1834588 - RNA, 14 nt, Salmonella typhimurium LT2
ugccaucagcaccu

SEQ ID NO: 1834589 - RNA, 19 nt, Salmonella typhimurium LT2
ugccaguacggugaauauu

SEQ ID NO: 1834590 - RNA, 14 nt, Salmonella typhimurium LT2
ugccagguuauuuc

SEQ ID NO: 1834591 - RNA, 13 nt, Salmonella typhimurium LT2
ugccaucauccag

SEQ ID NO: 1834592 - RNA, 20 nt, Salmonella typhimurium LT2
ugccaucgcuucuacagcca

SEQ ID NO: 1834593 - RNA, 14 nt, Salmonella typhimurium LT2
ugccagcggccagg

SEQ ID NO: 1834594 - RNA, 18 nt, Salmonella typhimurium LT2
ugccagcggccagggcgu

SEQ ID NO: 1834595 - RNA, 22 nt, Salmonella typhimurium LT2
ugccagaccauuaacgccgccg

SEQ ID NO: 1834596 - RNA, 14 nt, Salmonella typhimurium LT2
ugccgccgcaccac

SEQ ID NO: 1834597 - RNA, 21 nt, Salmonella typhimurium LT2
ugccgccgacaaccagcgaaa

SEQ ID NO: 1834598 - RNA, 23 nt, Salmonella typhimurium LT2
ugccgccgucaucugcgccgaca

SEQ ID NO: 1834599 - RNA, 17 nt, Salmonella typhimurium LT2
ugccgccugccgcgccg

SEQ ID NO: 1834600 - RNA, 19 nt, Salmonella typhimurium LT2
ugccgcccaucgccacagc

SEQ ID NO: 1834601 - RNA, 18 nt, Salmonella typhimurium LT2
ugccgauagucuccgcca

SEQ ID NO: 1834602 - RNA, 14 nt, Salmonella typhimurium LT2
ugccgcacucccca

SEQ ID NO: 1834603 - RNA, 13 nt, Salmonella typhimurium LT2
ugccgaugaaaua

SEQ ID NO: 1834604 - RNA, 15 nt, Salmonella typhimurium LT2
ugcccucuuuaucaa

SEQ ID NO: 1834605 - RNA, 23 nt, Salmonella typhimurium LT2
ugcccugcuugucgaucaucaga

SEQ ID NO: 1834606 - RNA, 17 nt, Salmonella typhimurium LT2
ugcccgacgccgcggcg

SEQ ID NO: 1834607 - RNA, 13 nt, Salmonella typhimurium LT2
ugcccguuccagg

SEQ ID NO: 1834608 - RNA, 21 nt, Salmonella typhimurium LT2
ugcccuaacagggcgugcgcu

SEQ ID NO: 1834609 - RNA, 16 nt, Salmonella typhimurium LT2
ugcccgcguucugcug

SEQ ID NO: 1834610 - RNA, 21 nt, Salmonella typhimurium LT2
ugcccggcaugucgccagcca

SEQ ID NO: 1834611 - RNA, 19 nt, Salmonella typhimurium LT2
ugccaugucgccucgcuaa

SEQ ID NO: 1834612 - RNA, 15 nt, Salmonella typhimurium LT2
ugcccccgagccaga

SEQ ID NO: 1834613 - RNA, 19 nt, Salmonella typhimurium LT2
ugcccccgaucacggcgaa

SEQ ID NO: 1834614 - RNA, 19 nt, Salmonella typhimurium LT2
ugcccgaacgcaauacugu

SEQ ID NO: 1834615 - RNA, 20 nt, Salmonella typhimurium LT2
ugcccgaacgcaauacugua

SEQ ID NO: 1834616 - RNA, 15 nt, Salmonella typhimurium LT2
ugccccauuguucuu

SEQ ID NO: 1834617 - RNA, 18 nt, Salmonella typhimurium LT2
ugccguuguugucaauau

SEQ ID NO: 1834618 - RNA, 18 nt, Salmonella typhimurium LT2
ugccgugcauguccagac

SEQ ID NO: 1834619 - RNA, 22 nt, Salmonella typhimurium LT2
ugccgguaaagaaaccggcguc

SEQ ID NO: 1834620 - RNA, 17 nt, Salmonella typhimurium LT2
ugccggugcgagaaaaa

SEQ ID NO: 1834621 - RNA, 18 nt, Salmonella typhimurium LT2
ugccggugaauaccgaac

SEQ ID NO: 1834622 - RNA, 14 nt, Salmonella typhimurium LT2
ugccgguuggccgg

SEQ ID NO: 1834623 - RNA, 20 nt, Salmonella typhimurium LT2
ugccuaaaguggcgccuugc

SEQ ID NO: 1834624 - RNA, 17 nt, Salmonella typhimurium LT2
ugccucguuucccucau

SEQ ID NO: 1834625 - RNA, 19 nt, Salmonella typhimurium LT2
ugccucguuucccucauau

SEQ ID NO: 1834626 - RNA, 15 nt, Salmonella typhimurium LT2
ugccuggcucauucu

SEQ ID NO: 1834627 - RNA, 19 nt, Salmonella typhimurium LT2
ugccucuggccaguuucaa

SEQ ID NO: 1834628 - RNA, 15 nt, Salmonella typhimurium LT2
ugccugcgucauccc

SEQ ID NO: 1834629 - RNA, 14 nt, Salmonella typhimurium LT2
ugccugaaaagggg

SEQ ID NO: 1834630 - RNA, 15 nt, Salmonella typhimurium LT2
ugccgcugcugccuu

SEQ ID NO: 1834631 - RNA, 23 nt, Salmonella typhimurium LT2
ugccgcgcuggugggacuguuca

SEQ ID NO: 1834632 - RNA, 18 nt, Salmonella typhimurium LT2
ugccgcgccugccauagc

SEQ ID NO: 1834633 - RNA, 21 nt, Salmonella typhimurium LT2
ugccgcggcuucaucaccauc

SEQ ID NO: 1834634 - RNA, 15 nt, Salmonella typhimurium LT2
ugccgggccuggcau

SEQ ID NO: 1834635 - RNA, 13 nt, Salmonella typhimurium LT2
ugccggaagggau

SEQ ID NO: 1834636 - RNA, 14 nt, Salmonella typhimurium LT2
ugccggaaaaugcg

SEQ ID NO: 1834637 - RNA, 12 nt, Salmonella typhimurium LT2
uuaccaaaagca

SEQ ID NO: 1834638 - RNA, 11 nt, Salmonella typhimurium LT2
uuacaucuuuc

SEQ ID NO: 1834639 - RNA, 15 nt, Salmonella typhimurium LT2
uuacaugacccagcg

SEQ ID NO: 1834640 - RNA, 19 nt, Salmonella typhimurium LT2
uuacauccagcuauagacg

SEQ ID NO: 1834641 - RNA, 20 nt, Salmonella typhimurium LT2
uuacauuucaggcaaaaaaa

SEQ ID NO: 1834642 - RNA, 15 nt, Salmonella typhimurium LT2
uuacaucaauaaaca

SEQ ID NO: 1834643 - RNA, 13 nt, Salmonella typhimurium LT2
uuacaucagauaa

SEQ ID NO: 1834644 - RNA, 22 nt, Salmonella typhimurium LT2
uuacaccucgccacauucaauu

SEQ ID NO: 1834645 - RNA, 16 nt, Salmonella typhimurium LT2
uuacacgaucauuuca

SEQ ID NO: 1834646 - RNA, 19 nt, Salmonella typhimurium LT2
uuacacugauaccccagcg

SEQ ID NO: 1834647 - RNA, 19 nt, Salmonella typhimurium LT2
uuacaaaugaccucaagaa

SEQ ID NO: 1834648 - RNA, 19 nt, Salmonella typhimurium LT2
uuaauuguaccgauuguuu

SEQ ID NO: 1834649 - RNA, 19 nt, Salmonella typhimurium LT2
uuaauuuaauaauaaauuu

SEQ ID NO: 1834650 - RNA, 12 nt, Salmonella typhimurium LT2
uuaauuuaauug

SEQ ID NO: 1834651 - RNA, 16 nt, Salmonella typhimurium LT2
uuaaugcucuccagca

SEQ ID NO: 1834652 - RNA, 19 nt, Salmonella typhimurium LT2
uuaaugcgccccugcaggc

SEQ ID NO: 1834653 - RNA, 22 nt, Salmonella typhimurium LT2
uuaauggcgcuuuacaugccgc

SEQ ID NO: 1834654 - RNA, 23 nt, Salmonella typhimurium LT2
uuaauggucuuaaaugccgccgg

SEQ ID NO: 1834655 - RNA, 22 nt, Salmonella typhimurium LT2
uuaauggucagaucugcgccca

SEQ ID NO: 1834656 - RNA, 18 nt, Salmonella typhimurium LT2
uuaauggcagaauaaaac

SEQ ID NO: 1834657 - RNA, 17 nt, Salmonella typhimurium LT2
uuaaugucacaaugccu

SEQ ID NO: 1834658 - RNA, 13 nt, Salmonella typhimurium LT2
uuaauguauuauu

SEQ ID NO: 1834659 - RNA, 16 nt, Salmonella typhimurium LT2
uuaaugacuuuuuaua

SEQ ID NO: 1834660 - RNA, 15 nt, Salmonella typhimurium LT2
uuaaugaccugccgc

SEQ ID NO: 1834661 - RNA, 23 nt, Salmonella typhimurium LT2
uuaaugcauggcagauaaaccac

SEQ ID NO: 1834662 - RNA, 24 nt, Salmonella typhimurium LT2
uuaauaccgugcaggacagacaga

SEQ ID NO: 1834663 - RNA, 15 nt, Salmonella typhimurium LT2
uuacucucauguuca

SEQ ID NO: 1834664 - RNA, 15 nt, Salmonella typhimurium LT2
uuacugacaauaagu

SEQ ID NO: 1834665 - RNA, 12 nt, Salmonella typhimurium LT2
uuacucuuccac

SEQ ID NO: 1834666 - RNA, 23 nt, Salmonella typhimurium LT2
uuacugcuuugaucacccacacc

SEQ ID NO: 1834667 - RNA, 23 nt, Salmonella typhimurium LT2
uuacugacuaucuuuaugucagu

SEQ ID NO: 1834668 - RNA, 12 nt, Salmonella typhimurium LT2
uuacuauuuuuc

SEQ ID NO: 1834669 - RNA, 13 nt, Salmonella typhimurium LT2
uuacuaucuucaa

SEQ ID NO: 1834670 - RNA, 13 nt, Salmonella typhimurium LT2
uuacuuucauucc

SEQ ID NO: 1834671 - RNA, 23 nt, Salmonella typhimurium LT2
uuacuguagcgccgcuuccaggc

SEQ ID NO: 1834672 - RNA, 22 nt, Salmonella typhimurium LT2
uuagaauagcaucaauuucucu

SEQ ID NO: 1834673 - RNA, 21 nt, Salmonella typhimurium LT2
uuagaauagccgggguaauau

SEQ ID NO: 1834674 - RNA, 13 nt, Salmonella typhimurium LT2
uuacccagccuga

SEQ ID NO: 1834675 - RNA, 13 nt, Salmonella typhimurium LT2
uuacccaccagcc

SEQ ID NO: 1834676 - RNA, 21 nt, Salmonella typhimurium LT2
uuacccaccagccgcauaaua

SEQ ID NO: 1834677 - RNA, 17 nt, Salmonella typhimurium LT2
uuacccauaaaaaagcc

SEQ ID NO: 1834678 - RNA, 19 nt, Salmonella typhimurium LT2
uuacccauaaaaaagcccu

SEQ ID NO: 1834679 - RNA, 22 nt, Salmonella typhimurium LT2
uuacccaguaccauaccggugc

SEQ ID NO: 1834680 - RNA, 12 nt, Salmonella typhimurium LT2
uuacccccuucg

SEQ ID NO: 1834681 - RNA, 17 nt, Salmonella typhimurium LT2
uuacgcacgccagauaa

SEQ ID NO: 1834682 - RNA, 18 nt, Salmonella typhimurium LT2
uuacgcacgccagauaaa

SEQ ID NO: 1834683 - RNA, 16 nt, Salmonella typhimurium LT2
uuacgcagccggucag

SEQ ID NO: 1834684 - RNA, 19 nt, Salmonella typhimurium LT2
uuacgaucguuugcccauu

SEQ ID NO: 1834685 - RNA, 13 nt, Salmonella typhimurium LT2
uuacgcaggcuug

SEQ ID NO: 1834686 - RNA, 18 nt, Salmonella typhimurium LT2
uuacgccaucagggacga

SEQ ID NO: 1834687 - RNA, 20 nt, Salmonella typhimurium LT2
uuacgcccgguaaacgcuuu

SEQ ID NO: 1834688 - RNA, 17 nt, Salmonella typhimurium LT2
uuacuaaaaguaaauaa

SEQ ID NO: 1834689 - RNA, 12 nt, Salmonella typhimurium LT2
uuacguaacugc

SEQ ID NO: 1834690 - RNA, 11 nt, Salmonella typhimurium LT2
uuacgcugccg

SEQ ID NO: 1834691 - RNA, 19 nt, Salmonella typhimurium LT2
uuacgcugguuugugugca

SEQ ID NO: 1834692 - RNA, 11 nt, Salmonella typhimurium LT2
uuacgccgcca

SEQ ID NO: 1834693 - RNA, 19 nt, Salmonella typhimurium LT2
uuacgcguuacgcccugug

SEQ ID NO: 1834694 - RNA, 20 nt, Salmonella typhimurium LT2
uuacgcggucuuuuaaaaga

SEQ ID NO: 1834695 - RNA, 15 nt, Salmonella typhimurium LT2
uuacggacagaaaaa

SEQ ID NO: 1834696 - RNA, 16 nt, Salmonella typhimurium LT2
uuacggacagaaaaaa

SEQ ID NO: 1834697 - RNA, 19 nt, Salmonella typhimurium LT2
uuacggacgauacaccuuc

SEQ ID NO: 1834698 - RNA, 16 nt, Salmonella typhimurium LT2
uuacggacgugggggu

SEQ ID NO: 1834699 - RNA, 15 nt, Salmonella typhimurium LT2
uuacggaaaaaauac

SEQ ID NO: 1834700 - RNA, 22 nt, Salmonella typhimurium LT2
uuacggaaaaaauacugauaaa

SEQ ID NO: 1834701 - RNA, 12 nt, Salmonella typhimurium LT2
uuaaacacaucc

SEQ ID NO: 1834702 - RNA, 12 nt, Salmonella typhimurium LT2
uuaaacauauaa

SEQ ID NO: 1834703 - RNA, 13 nt, Salmonella typhimurium LT2
uuaaaccgcccau

SEQ ID NO: 1834704 - RNA, 13 nt, Salmonella typhimurium LT2
uuaaaccacaccu

SEQ ID NO: 1834705 - RNA, 23 nt, Salmonella typhimurium LT2
uuaaaccacuuaacguuaccuuu

SEQ ID NO: 1834706 - RNA, 23 nt, Salmonella typhimurium LT2
uguugccgcccguuuuuuccagu

SEQ ID NO: 1834707 - RNA, 14 nt, Salmonella typhimurium LT2
uguugcuaaaucca

SEQ ID NO: 1834708 - RNA, 19 nt, Salmonella typhimurium LT2
uuaaacgccggauuccaga

SEQ ID NO: 1834709 - RNA, 15 nt, Salmonella typhimurium LT2
uuaaauuuuuaauaa

SEQ ID NO: 1834710 - RNA, 22 nt, Salmonella typhimurium LT2
uuaaauucccagcguacaucuu

SEQ ID NO: 1834711 - RNA, 12 nt, Salmonella typhimurium LT2
uuaaauugaaaa

SEQ ID NO: 1834712 - RNA, 15 nt, Salmonella typhimurium LT2
uuaaauugaaaacca

SEQ ID NO: 1834713 - RNA, 17 nt, Salmonella typhimurium LT2
uuaaauugaaaaccaua

SEQ ID NO: 1834714 - RNA, 20 nt, Salmonella typhimurium LT2
uuaaaugcccgauggcgcuu

SEQ ID NO: 1834715 - RNA, 20 nt, Salmonella typhimurium LT2
uuaaaugccuguuuauauuc

SEQ ID NO: 1834716 - RNA, 17 nt, Salmonella typhimurium LT2
uuaaauaugaaagagaa

SEQ ID NO: 1834717 - RNA, 12 nt, Salmonella typhimurium LT2
uuaaauauuaag

SEQ ID NO: 1834718 - RNA, 18 nt, Salmonella typhimurium LT2
uuaagcgggucccagaag

SEQ ID NO: 1834719 - RNA, 20 nt, Salmonella typhimurium LT2
uuaagccuuuuuaaauauua

SEQ ID NO: 1834720 - RNA, 20 nt, Salmonella typhimurium LT2
uuaauaauaaauuuucauua

SEQ ID NO: 1834721 - RNA, 20 nt, Salmonella typhimurium LT2
uuaauaccagcgccaaucac

SEQ ID NO: 1834722 - RNA, 21 nt, Salmonella typhimurium LT2
uuaauaccagcgccaaucacu

SEQ ID NO: 1834723 - RNA, 18 nt, Salmonella typhimurium LT2
uuaacuucugcagggaaa

SEQ ID NO: 1834724 - RNA, 15 nt, Salmonella typhimurium LT2
uuaacucaucacagc

SEQ ID NO: 1834725 - RNA, 14 nt, Salmonella typhimurium LT2
uuaacuuaaauaaa

SEQ ID NO: 1834726 - RNA, 15 nt, Salmonella typhimurium LT2
uuaacuuaaauaaaa

SEQ ID NO: 1834727 - RNA, 20 nt, Salmonella typhimurium LT2
uuaagcaacugcuaguggau

SEQ ID NO: 1834728 - RNA, 23 nt, Salmonella typhimurium LT2
uuaagauccugacucaccagcac

SEQ ID NO: 1834729 - RNA, 18 nt, Salmonella typhimurium LT2
uuaagaaacugagugugu

SEQ ID NO: 1834730 - RNA, 18 nt, Salmonella typhimurium LT2
uuaaccugguucaaaaug

SEQ ID NO: 1834731 - RNA, 16 nt, Salmonella typhimurium LT2
uuaaccguucuuccug

SEQ ID NO: 1834732 - RNA, 19 nt, Salmonella typhimurium LT2
uuaaccccucgcagacuga

SEQ ID NO: 1834733 - RNA, 14 nt, Salmonella typhimurium LT2
uuaacguuuguaga

SEQ ID NO: 1834734 - RNA, 17 nt, Salmonella typhimurium LT2
uuaacgcgccaucuuuc

SEQ ID NO: 1834735 - RNA, 19 nt, Salmonella typhimurium LT2
uuaacgccgugcucaucca

SEQ ID NO: 1834736 - RNA, 20 nt, Salmonella typhimurium LT2
uuaacagcgcgaccaggaaa

SEQ ID NO: 1834737 - RNA, 12 nt, Salmonella typhimurium LT2
uuaacagaauug

SEQ ID NO: 1834738 - RNA, 15 nt, Salmonella typhimurium LT2
uuaacaucagaaaaa

SEQ ID NO: 1834739 - RNA, 15 nt, Salmonella typhimurium LT2
uuaacacccggauau

SEQ ID NO: 1834740 - RNA, 17 nt, Salmonella typhimurium LT2
uuaacaccggcaaauag

SEQ ID NO: 1834741 - RNA, 22 nt, Salmonella typhimurium LT2
uuauuucgucagcacuucccac

SEQ ID NO: 1834742 - RNA, 16 nt, Salmonella typhimurium LT2
uuauuuuacgagaacc

SEQ ID NO: 1834743 - RNA, 11 nt, Salmonella typhimurium LT2
uuauuuuaaau

SEQ ID NO: 1834744 - RNA, 19 nt, Salmonella typhimurium LT2
uuauuuguaugacaaauaa

SEQ ID NO: 1834745 - RNA, 22 nt, Salmonella typhimurium LT2
uuauuggcacacgucuacccag

SEQ ID NO: 1834746 - RNA, 17 nt, Salmonella typhimurium LT2
uuauuuaauaaccaauu

SEQ ID NO: 1834747 - RNA, 12 nt, Salmonella typhimurium LT2
uuauuuaauaca

SEQ ID NO: 1834748 - RNA, 15 nt, Salmonella typhimurium LT2
uuauuuaauacauca

SEQ ID NO: 1834749 - RNA, 20 nt, Salmonella typhimurium LT2
uuauuacgcaagaucacaua

SEQ ID NO: 1834750 - RNA, 23 nt, Salmonella typhimurium LT2
uuauucuuugucugucggacuca

SEQ ID NO: 1834751 - RNA, 23 nt, Salmonella typhimurium LT2
uuauucgccuuucacgcguucaa

SEQ ID NO: 1834752 - RNA, 17 nt, Salmonella typhimurium LT2
uuauucggcuuuuacau

SEQ ID NO: 1834753 - RNA, 15 nt, Salmonella typhimurium LT2
uuauuccgaauacgg

SEQ ID NO: 1834754 - RNA, 21 nt, Salmonella typhimurium LT2
uuauuccuuuuuaggcuauaa

SEQ ID NO: 1834755 - RNA, 12 nt, Salmonella typhimurium LT2
uuauuauuuuuu

SEQ ID NO: 1834756 - RNA, 12 nt, Salmonella typhimurium LT2
uucaaaaaagag

SEQ ID NO: 1834757 - RNA, 17 nt, Salmonella typhimurium LT2
uucaaaaaugauguguu

SEQ ID NO: 1834758 - RNA, 13 nt, Salmonella typhimurium LT2
uuauuuuuaauug

SEQ ID NO: 1834759 - RNA, 15 nt, Salmonella typhimurium LT2
uuauuuugauaauca

SEQ ID NO: 1834760 - RNA, 20 nt, Salmonella typhimurium LT2
uuauuuuucgccagaucgau

SEQ ID NO: 1834761 - RNA, 17 nt, Salmonella typhimurium LT2
uuauuuuucuggcuucu

SEQ ID NO: 1834762 - RNA, 23 nt, Salmonella typhimurium LT2
uucaaagccgccauccggccugu

SEQ ID NO: 1834763 - RNA, 14 nt, Salmonella typhimurium LT2
uucaaaaucaaaca

SEQ ID NO: 1834764 - RNA, 15 nt, Salmonella typhimurium LT2
uucaaaagagagcug

SEQ ID NO: 1834765 - RNA, 23 nt, Salmonella typhimurium LT2
uucaaaagccuguuuaccaagca

SEQ ID NO: 1834766 - RNA, 17 nt, Salmonella typhimurium LT2
uucaaaccuucaagaau

SEQ ID NO: 1834767 - RNA, 21 nt, Salmonella typhimurium LT2
uucaaaugauuuuuauaaaau

SEQ ID NO: 1834768 - RNA, 16 nt, Salmonella typhimurium LT2
uucaacagcucgccau

SEQ ID NO: 1834769 - RNA, 19 nt, Salmonella typhimurium LT2
uucaacagcucgccaugca

SEQ ID NO: 1834770 - RNA, 23 nt, Salmonella typhimurium LT2
uucaaccagccgaucagcgccau

SEQ ID NO: 1834771 - RNA, 21 nt, Salmonella typhimurium LT2
uucaacguuuuauuacgcuuc

SEQ ID NO: 1834772 - RNA, 15 nt, Salmonella typhimurium LT2
uucaaccuccugcaa

SEQ ID NO: 1834773 - RNA, 23 nt, Salmonella typhimurium LT2
uucaaccgagccaaacucaucua

SEQ ID NO: 1834774 - RNA, 14 nt, Salmonella typhimurium LT2
uucaacggcaucaa

SEQ ID NO: 1834775 - RNA, 12 nt, Salmonella typhimurium LT2
uucaagcaauaa

SEQ ID NO: 1834776 - RNA, 15 nt, Salmonella typhimurium LT2
uuaucgccaaagaua

SEQ ID NO: 1834777 - RNA, 16 nt, Salmonella typhimurium LT2
uuauccugcaaauagc

SEQ ID NO: 1834778 - RNA, 22 nt, Salmonella typhimurium LT2
uuauccuccgaacaggcguuug

SEQ ID NO: 1834779 - RNA, 18 nt, Salmonella typhimurium LT2
uuaucguccgucagaucc

SEQ ID NO: 1834780 - RNA, 14 nt, Salmonella typhimurium LT2
uuaucgggccuaca

SEQ ID NO: 1834781 - RNA, 13 nt, Salmonella typhimurium LT2
uuaucgccugggg

SEQ ID NO: 1834782 - RNA, 16 nt, Salmonella typhimurium LT2
uuaucgccccaggcga

SEQ ID NO: 1834783 - RNA, 18 nt, Salmonella typhimurium LT2
uuaucgccccaggcgaua

SEQ ID NO: 1834784 - RNA, 16 nt, Salmonella typhimurium LT2
uuaucucuuuugcuuc

SEQ ID NO: 1834785 - RNA, 12 nt, Salmonella typhimurium LT2
uuaucuguugau

SEQ ID NO: 1834786 - RNA, 20 nt, Salmonella typhimurium LT2
uuaucuuccacgguaaaaca

SEQ ID NO: 1834787 - RNA, 20 nt, Salmonella typhimurium LT2
uuaucuugagucaaaagauu

SEQ ID NO: 1834788 - RNA, 13 nt, Salmonella typhimurium LT2
uuaucuuccggca

SEQ ID NO: 1834789 - RNA, 21 nt, Salmonella typhimurium LT2
uuaugcgucaaaguugcauca

SEQ ID NO: 1834790 - RNA, 17 nt, Salmonella typhimurium LT2
uuaugccuuuuucaaca

SEQ ID NO: 1834791 - RNA, 21 nt, Salmonella typhimurium LT2
uuaugccuuuuucaacagcac

SEQ ID NO: 1834792 - RNA, 22 nt, Salmonella typhimurium LT2
uuaugcgucaaaguugcaucaa

SEQ ID NO: 1834793 - RNA, 15 nt, Salmonella typhimurium LT2
uuauguauuuaauuu

SEQ ID NO: 1834794 - RNA, 15 nt, Salmonella typhimurium LT2
uuauuaaaauuaucc

SEQ ID NO: 1834795 - RNA, 14 nt, Salmonella typhimurium LT2
uuaugaaugacagu

SEQ ID NO: 1834796 - RNA, 16 nt, Salmonella typhimurium LT2
uuaugacgggaaacag

SEQ ID NO: 1834797 - RNA, 17 nt, Salmonella typhimurium LT2
uuaugacgggaaacagu

SEQ ID NO: 1834798 - RNA, 16 nt, Salmonella typhimurium LT2
uuaugaauaaccaucg

SEQ ID NO: 1834799 - RNA, 23 nt, Salmonella typhimurium LT2
uuaugagaaaaguuggcauaaug

SEQ ID NO: 1834800 - RNA, 15 nt, Salmonella typhimurium LT2
uuaugcagucauucu

SEQ ID NO: 1834801 - RNA, 21 nt, Salmonella typhimurium LT2
uuauccagcagccacagaaug

SEQ ID NO: 1834802 - RNA, 17 nt, Salmonella typhimurium LT2
uuauccaggcgggcauc

SEQ ID NO: 1834803 - RNA, 22 nt, Salmonella typhimurium LT2
uuauccggcuuacggcuauucu

SEQ ID NO: 1834804 - RNA, 18 nt, Salmonella typhimurium LT2
uuauccggccuacgcguc

SEQ ID NO: 1834805 - RNA, 22 nt, Salmonella typhimurium LT2
uuauccggccuacgguaaacug

SEQ ID NO: 1834806 - RNA, 17 nt, Salmonella typhimurium LT2
uuaucccgcccgaucuc

SEQ ID NO: 1834807 - RNA, 17 nt, Salmonella typhimurium LT2
uuaucaucguaaaauca

SEQ ID NO: 1834808 - RNA, 20 nt, Salmonella typhimurium LT2
uuaucaaauuugcccagcac

SEQ ID NO: 1834809 - RNA, 23 nt, Salmonella typhimurium LT2
uuaucaauccugccaaauaaucc

SEQ ID NO: 1834810 - RNA, 19 nt, Salmonella typhimurium LT2
uuaucaacaaauuccggca

SEQ ID NO: 1834811 - RNA, 16 nt, Salmonella typhimurium LT2
uuauacagcaccugcu

SEQ ID NO: 1834812 - RNA, 21 nt, Salmonella typhimurium LT2
uuauagacgccggucaugcca

SEQ ID NO: 1834813 - RNA, 20 nt, Salmonella typhimurium LT2
uuauagcuggcuuuauauaa

SEQ ID NO: 1834814 - RNA, 18 nt, Salmonella typhimurium LT2
uuauagcucagcgcggca

SEQ ID NO: 1834815 - RNA, 18 nt, Salmonella typhimurium LT2
uuauacaccgggaaaagc

SEQ ID NO: 1834816 - RNA, 12 nt, Salmonella typhimurium LT2
uuauacaaaaug

SEQ ID NO: 1834817 - RNA, 13 nt, Salmonella typhimurium LT2
uuagagccaauau

SEQ ID NO: 1834818 - RNA, 22 nt, Salmonella typhimurium LT2
uuauaaggccugccguccugau

SEQ ID NO: 1834819 - RNA, 13 nt, Salmonella typhimurium LT2
uuauaagcgccaa

SEQ ID NO: 1834820 - RNA, 18 nt, Salmonella typhimurium LT2
uuauaaaacuucgauaau

SEQ ID NO: 1834821 - RNA, 20 nt, Salmonella typhimurium LT2
uguauuggucuaucgcuucu

SEQ ID NO: 1834822 - RNA, 19 nt, Salmonella typhimurium LT2
ugucaacgaccucaaaaua

SEQ ID NO: 1834823 - RNA, 19 nt, Salmonella typhimurium LT2
ugucaagguggugcucuaa

SEQ ID NO: 1834824 - RNA, 23 nt, Salmonella typhimurium LT2
ugucaagguggugcucuaaccaa

SEQ ID NO: 1834825 - RNA, 21 nt, Salmonella typhimurium LT2
ugucaguaucgguacgcgcgu

SEQ ID NO: 1834826 - RNA, 15 nt, Salmonella typhimurium LT2
ugucagggcggaaca

SEQ ID NO: 1834827 - RNA, 17 nt, Salmonella typhimurium LT2
ugucacaaaggugagac

SEQ ID NO: 1834828 - RNA, 15 nt, Salmonella typhimurium LT2
ugucagugcuacagg

SEQ ID NO: 1834829 - RNA, 14 nt, Salmonella typhimurium LT2
ugucauagcaauaa

SEQ ID NO: 1834830 - RNA, 17 nt, Salmonella typhimurium LT2
uguaugcguuacaggac

SEQ ID NO: 1834831 - RNA, 19 nt, Salmonella typhimurium LT2
uguacagcaauaaaaggaa

SEQ ID NO: 1834832 - RNA, 19 nt, Salmonella typhimurium LT2
ugucaucaguaugagcgaa

SEQ ID NO: 1834833 - RNA, 17 nt, Salmonella typhimurium LT2
ugucaucaagauuuugu

SEQ ID NO: 1834834 - RNA, 22 nt, Salmonella typhimurium LT2
ugucauagucggcgccaaaguu

SEQ ID NO: 1834835 - RNA, 23 nt, Salmonella typhimurium LT2
ugucauagucggcgccaaaguua

SEQ ID NO: 1834836 - RNA, 13 nt, Salmonella typhimurium LT2
ugucaucggcuuu

SEQ ID NO: 1834837 - RNA, 16 nt, Salmonella typhimurium LT2
ugucaugaagcucaac

SEQ ID NO: 1834838 - RNA, 16 nt, Salmonella typhimurium LT2
ugucaugcuaaaacag

SEQ ID NO: 1834839 - RNA, 22 nt, Salmonella typhimurium LT2
uguccaggucaucaccuccagc

SEQ ID NO: 1834840 - RNA, 20 nt, Salmonella typhimurium LT2
uguccaucagauucaacagg

SEQ ID NO: 1834841 - RNA, 13 nt, Salmonella typhimurium LT2
uguccauaaaaug

SEQ ID NO: 1834842 - RNA, 16 nt, Salmonella typhimurium LT2
uguccagcagugucug

SEQ ID NO: 1834843 - RNA, 12 nt, Salmonella typhimurium LT2
uguccacccucc

SEQ ID NO: 1834844 - RNA, 14 nt, Salmonella typhimurium LT2
uguccacccuccca

SEQ ID NO: 1834845 - RNA, 23 nt, Salmonella typhimurium LT2
uguccauguuuuauacucaaaaa

SEQ ID NO: 1834846 - RNA, 15 nt, Salmonella typhimurium LT2
uguccauuuuccucc

SEQ ID NO: 1834847 - RNA, 17 nt, Salmonella typhimurium LT2
uguccauuuuccuccca

SEQ ID NO: 1834848 - RNA, 12 nt, Salmonella typhimurium LT2
ugucccaggcca

SEQ ID NO: 1834849 - RNA, 20 nt, Salmonella typhimurium LT2
ugucccagcgucaacugcgc

SEQ ID NO: 1834850 - RNA, 20 nt, Salmonella typhimurium LT2
ugucccaucguaacgccguc

SEQ ID NO: 1834851 - RNA, 16 nt, Salmonella typhimurium LT2
uguccggcgacuccag

SEQ ID NO: 1834852 - RNA, 19 nt, Salmonella typhimurium LT2
uguccggcgacuccagaau

SEQ ID NO: 1834853 - RNA, 16 nt, Salmonella typhimurium LT2
uguccgguguccauca

SEQ ID NO: 1834854 - RNA, 16 nt, Salmonella typhimurium LT2
uguccgucagcgcaug

SEQ ID NO: 1834855 - RNA, 20 nt, Salmonella typhimurium LT2
uguccgggcguuucagcuuc

SEQ ID NO: 1834856 - RNA, 20 nt, Salmonella typhimurium LT2
uguccgccaauuccugccag

SEQ ID NO: 1834857 - RNA, 16 nt, Salmonella typhimurium LT2
uguccguuuucucaaa

SEQ ID NO: 1834858 - RNA, 21 nt, Salmonella typhimurium LT2
uguccuuuaucugcccuuucu

SEQ ID NO: 1834859 - RNA, 15 nt, Salmonella typhimurium LT2
ugucgagguuauaaa

SEQ ID NO: 1834860 - RNA, 17 nt, Salmonella typhimurium LT2
ugucgaccgcuccacuc

SEQ ID NO: 1834861 - RNA, 20 nt, Salmonella typhimurium LT2
ugucgauuuccgguuccagc

SEQ ID NO: 1834862 - RNA, 16 nt, Salmonella typhimurium LT2
ugucgcaaaccaccgg

SEQ ID NO: 1834863 - RNA, 23 nt, Salmonella typhimurium LT2
ugucgcaaccgacacauucaggc

SEQ ID NO: 1834864 - RNA, 17 nt, Salmonella typhimurium LT2
ugucgcgagcuuccagu

SEQ ID NO: 1834865 - RNA, 14 nt, Salmonella typhimurium LT2
ugucgugaauaguu

SEQ ID NO: 1834866 - RNA, 19 nt, Salmonella typhimurium LT2
ugucgggcaaaaugcgucg

SEQ ID NO: 1834867 - RNA, 22 nt, Salmonella typhimurium LT2
ugucgcugaguacgcaccagcc

SEQ ID NO: 1834868 - RNA, 16 nt, Salmonella typhimurium LT2
ugucgcggauaugcag

SEQ ID NO: 1834869 - RNA, 21 nt, Salmonella typhimurium LT2
ugucgcuacuggcguauuauc

SEQ ID NO: 1834870 - RNA, 13 nt, Salmonella typhimurium LT2
ugucuccaccgcc

SEQ ID NO: 1834871 - RNA, 14 nt, Salmonella typhimurium LT2
ugucugaaugaguc

SEQ ID NO: 1834872 - RNA, 15 nt, Salmonella typhimurium LT2
ugucugacgcuuauc

SEQ ID NO: 1834873 - RNA, 21 nt, Salmonella typhimurium LT2
ugucuacacuuugcgccgcca

SEQ ID NO: 1834874 - RNA, 15 nt, Salmonella typhimurium LT2
ugucuugcuaucaaa

SEQ ID NO: 1834875 - RNA, 22 nt, Salmonella typhimurium LT2
ugucuucuuucgguucgccgca

SEQ ID NO: 1834876 - RNA, 14 nt, Salmonella typhimurium LT2
ugucuucugccagc

SEQ ID NO: 1834877 - RNA, 14 nt, Salmonella typhimurium LT2
ugucuuuacugaau

SEQ ID NO: 1834878 - RNA, 13 nt, Salmonella typhimurium LT2
ugucuuugaauaa

SEQ ID NO: 1834879 - RNA, 22 nt, Salmonella typhimurium LT2
ugugaagacauuugauuccagc

SEQ ID NO: 1834880 - RNA, 18 nt, Salmonella typhimurium LT2
ugugaauauauuggcagg

SEQ ID NO: 1834881 - RNA, 16 nt, Salmonella typhimurium LT2
ugugaauccaggccag

SEQ ID NO: 1834882 - RNA, 15 nt, Salmonella typhimurium LT2
ugugaguaaagagau

SEQ ID NO: 1834883 - RNA, 14 nt, Salmonella typhimurium LT2
ugugauaaaugcga

SEQ ID NO: 1834884 - RNA, 21 nt, Salmonella typhimurium LT2
ugugauaugacccgggcguga

SEQ ID NO: 1834885 - RNA, 22 nt, Salmonella typhimurium LT2
ugugauugcagauaauuuugca

SEQ ID NO: 1834886 - RNA, 17 nt, Salmonella typhimurium LT2
ugugccaguaaucccgg

SEQ ID NO: 1834887 - RNA, 20 nt, Salmonella typhimurium LT2
ugugccaguaccgccgccgg

SEQ ID NO: 1834888 - RNA, 16 nt, Salmonella typhimurium LT2
ugugcucguuuuuaua

SEQ ID NO: 1834889 - RNA, 11 nt, Salmonella typhimurium LT2
ugugcuuuagc

SEQ ID NO: 1834890 - RNA, 12 nt, Salmonella typhimurium LT2
ugugcuuccagc

SEQ ID NO: 1834891 - RNA, 17 nt, Salmonella typhimurium LT2
uguggaaacuccagcgg

SEQ ID NO: 1834892 - RNA, 22 nt, Salmonella typhimurium LT2
uguggaacuuuaucgcacggcg

SEQ ID NO: 1834893 - RNA, 21 nt, Salmonella typhimurium LT2
ugugcuuuuuauuuuucuggc

SEQ ID NO: 1834894 - RNA, 18 nt, Salmonella typhimurium LT2
uguguggagguuucuuca

SEQ ID NO: 1834895 - RNA, 18 nt, Salmonella typhimurium LT2
uguguacgccaagcugca

SEQ ID NO: 1834896 - RNA, 13 nt, Salmonella typhimurium LT2
uguggugcggcuu

SEQ ID NO: 1834897 - RNA, 18 nt, Salmonella typhimurium LT2
ugugguugugguaaucaa

SEQ ID NO: 1834898 - RNA, 12 nt, Salmonella typhimurium LT2
uguuacccagcc

SEQ ID NO: 1834899 - RNA, 16 nt, Salmonella typhimurium LT2
uguuaaugguaccaau

SEQ ID NO: 1834900 - RNA, 13 nt, Salmonella typhimurium LT2
uguuaaugucagc

SEQ ID NO: 1834901 - RNA, 23 nt, Salmonella typhimurium LT2
uguuaauccagagcggauaaaua

SEQ ID NO: 1834902 - RNA, 11 nt, Salmonella typhimurium LT2
uguuaauccag

SEQ ID NO: 1834903 - RNA, 18 nt, Salmonella typhimurium LT2
uguuaguuucuauuaaau

SEQ ID NO: 1834904 - RNA, 15 nt, Salmonella typhimurium LT2
uguuaguguccuuac

SEQ ID NO: 1834905 - RNA, 16 nt, Salmonella typhimurium LT2
uguucaagcaauaaug

SEQ ID NO: 1834906 - RNA, 13 nt, Salmonella typhimurium LT2
uguucaauauuca

SEQ ID NO: 1834907 - RNA, 22 nt, Salmonella typhimurium LT2
uguucaguaagacaaaaaugga

SEQ ID NO: 1834908 - RNA, 17 nt, Salmonella typhimurium LT2
uguucuucuuucaucau

SEQ ID NO: 1834909 - RNA, 17 nt, Salmonella typhimurium LT2
uguugaaagccccggcu

SEQ ID NO: 1834910 - RNA, 13 nt, Salmonella typhimurium LT2
uguugaaguccuc

SEQ ID NO: 1834911 - RNA, 15 nt, Salmonella typhimurium LT2
uguugacgcuaaccu

SEQ ID NO: 1834912 - RNA, 13 nt, Salmonella typhimurium LT2
uguugaccagguu

SEQ ID NO: 1834913 - RNA, 15 nt, Salmonella typhimurium LT2
uguugaggaaauucu

SEQ ID NO: 1834914 - RNA, 13 nt, Salmonella typhimurium LT2
uguugauacagaa

SEQ ID NO: 1834915 - RNA, 20 nt, Salmonella typhimurium LT2
uguucgagggcgauuuugac

SEQ ID NO: 1834916 - RNA, 23 nt, Salmonella typhimurium LT2
uguucgcaaccuaaccaaacaga

SEQ ID NO: 1834917 - RNA, 14 nt, Salmonella typhimurium LT2
uguucgccacccgc

SEQ ID NO: 1834918 - RNA, 16 nt, Salmonella typhimurium LT2
uguucaucagguagua

SEQ ID NO: 1834919 - RNA, 19 nt, Salmonella typhimurium LT2
uguucauaccggauauggc

SEQ ID NO: 1834920 - RNA, 15 nt, Salmonella typhimurium LT2
uguucgcuucuucua

SEQ ID NO: 1834921 - RNA, 20 nt, Salmonella typhimurium LT2
uguucgcuuauuccuccgcc

SEQ ID NO: 1834922 - RNA, 19 nt, Salmonella typhimurium LT2
uguucuguccauguuuuau

SEQ ID NO: 1834923 - RNA, 15 nt, Salmonella typhimurium LT2
uggucgcgccgcgcg

SEQ ID NO: 1834924 - RNA, 21 nt, Salmonella typhimurium LT2
uggugcguucaauuggacucg

SEQ ID NO: 1834925 - RNA, 17 nt, Salmonella typhimurium LT2
uggugcagugcacugcc

SEQ ID NO: 1834926 - RNA, 23 nt, Salmonella typhimurium LT2
uggugcagugcacugccugaugg

SEQ ID NO: 1834927 - RNA, 15 nt, Salmonella typhimurium LT2
ugguagcccucgcaa

SEQ ID NO: 1834928 - RNA, 22 nt, Salmonella typhimurium LT2
ugguaggccugauaagcgcagc

SEQ ID NO: 1834929 - RNA, 23 nt, Salmonella typhimurium LT2
uggucaccaugacgcagugcaau

SEQ ID NO: 1834930 - RNA, 17 nt, Salmonella typhimurium LT2
uggucaucaucaggaac

SEQ ID NO: 1834931 - RNA, 20 nt, Salmonella typhimurium LT2
uggucaugauaucgccugcu

SEQ ID NO: 1834932 - RNA, 17 nt, Salmonella typhimurium LT2
ugguaagagagccuuau

SEQ ID NO: 1834933 - RNA, 22 nt, Salmonella typhimurium LT2
ugguaauuuaaaguaaggcuga

SEQ ID NO: 1834934 - RNA, 15 nt, Salmonella typhimurium LT2
ugguaaucauacgcg

SEQ ID NO: 1834935 - RNA, 19 nt, Salmonella typhimurium LT2
ugguaauccacgccaauaa

SEQ ID NO: 1834936 - RNA, 21 nt, Salmonella typhimurium LT2
ugguaauccacgccaauaauc

SEQ ID NO: 1834937 - RNA, 20 nt, Salmonella typhimurium LT2
ugguagacgcgcuagcuuca

SEQ ID NO: 1834938 - RNA, 15 nt, Salmonella typhimurium LT2
ugguagacccggcau

SEQ ID NO: 1834939 - RNA, 19 nt, Salmonella typhimurium LT2
ugguagacaaacagcgcgc

SEQ ID NO: 1834940 - RNA, 19 nt, Salmonella typhimurium LT2
uggguaaauaccaggcacu

SEQ ID NO: 1834941 - RNA, 17 nt, Salmonella typhimurium LT2
uggguaaauaccaggca

SEQ ID NO: 1834942 - RNA, 15 nt, Salmonella typhimurium LT2
uggggugagcgacaa

SEQ ID NO: 1834943 - RNA, 22 nt, Salmonella typhimurium LT2
uguaauucucacagaaucauca

SEQ ID NO: 1834944 - RNA, 20 nt, Salmonella typhimurium LT2
uguacacaauugccaugguu

SEQ ID NO: 1834945 - RNA, 22 nt, Salmonella typhimurium LT2
uguaauugaggauugccgccuu

SEQ ID NO: 1834946 - RNA, 15 nt, Salmonella typhimurium LT2
uguaauggugggaca

SEQ ID NO: 1834947 - RNA, 22 nt, Salmonella typhimurium LT2
uguaauggugggacacugccgg

SEQ ID NO: 1834948 - RNA, 14 nt, Salmonella typhimurium LT2
uguaaguucauuua

SEQ ID NO: 1834949 - RNA, 19 nt, Salmonella typhimurium LT2
uguaaguuacuaaaaguaa

SEQ ID NO: 1834950 - RNA, 16 nt, Salmonella typhimurium LT2
uguaaaaaaauaaaaa

SEQ ID NO: 1834951 - RNA, 23 nt, Salmonella typhimurium LT2
ugguuuuuaucuuuucucccggc

SEQ ID NO: 1834952 - RNA, 20 nt, Salmonella typhimurium LT2
uguaaauugcuuucuagcau

SEQ ID NO: 1834953 - RNA, 20 nt, Salmonella typhimurium LT2
uguaaauuuguuuaaucaua

SEQ ID NO: 1834954 - RNA, 23 nt, Salmonella typhimurium LT2
uguaaauuuguuuaaucauaaaa

SEQ ID NO: 1834955 - RNA, 16 nt, Salmonella typhimurium LT2
uguaacauauuuuuau

SEQ ID NO: 1834956 - RNA, 18 nt, Salmonella typhimurium LT2
uguaagagguauccugaa

SEQ ID NO: 1834957 - RNA, 13 nt, Salmonella typhimurium LT2
ugguuucccugcc

SEQ ID NO: 1834958 - RNA, 16 nt, Salmonella typhimurium LT2
ugguuucccugccuca

SEQ ID NO: 1834959 - RNA, 17 nt, Salmonella typhimurium LT2
ugguuucccugccucaa

SEQ ID NO: 1834960 - RNA, 18 nt, Salmonella typhimurium LT2
ugguuuaaacucugaaaa

SEQ ID NO: 1834961 - RNA, 20 nt, Salmonella typhimurium LT2
ugguuuaaacucugaaaacg

SEQ ID NO: 1834962 - RNA, 21 nt, Salmonella typhimurium LT2
ugguugcgaaccgcacagauu

SEQ ID NO: 1834963 - RNA, 18 nt, Salmonella typhimurium LT2
ugguugaaccgacggugc

SEQ ID NO: 1834964 - RNA, 16 nt, Salmonella typhimurium LT2
ugguucgcauaauauc

SEQ ID NO: 1834965 - RNA, 16 nt, Salmonella typhimurium LT2
ugguuacuauuuuuca

SEQ ID NO: 1834966 - RNA, 22 nt, Salmonella typhimurium LT2
ugguuacuggcuaguauauuaa

SEQ ID NO: 1834967 - RNA, 16 nt, Salmonella typhimurium LT2
ugguuaauuaaauguu

SEQ ID NO: 1834968 - RNA, 20 nt, Salmonella typhimurium LT2
ugguuaaauuaaauaacaaa

SEQ ID NO: 1834969 - RNA, 17 nt, Salmonella typhimurium LT2
uggcgcuuuaagugcau

SEQ ID NO: 1834970 - RNA, 16 nt, Salmonella typhimurium LT2
uggcggcgauacuccg

SEQ ID NO: 1834971 - RNA, 16 nt, Salmonella typhimurium LT2
uggcggcggcguuaca

SEQ ID NO: 1834972 - RNA, 17 nt, Salmonella typhimurium LT2
uggcgguauaacugccu

SEQ ID NO: 1834973 - RNA, 16 nt, Salmonella typhimurium LT2
uggcgguccaaugugg

SEQ ID NO: 1834974 - RNA, 15 nt, Salmonella typhimurium LT2
uggcggugacgucaa

SEQ ID NO: 1834975 - RNA, 16 nt, Salmonella typhimurium LT2
uggcgguugccacugc

SEQ ID NO: 1834976 - RNA, 20 nt, Salmonella typhimurium LT2
uggcguaauuaaccgcgccg

SEQ ID NO: 1834977 - RNA, 17 nt, Salmonella typhimurium LT2
uggcguaaauauucguu

SEQ ID NO: 1834978 - RNA, 23 nt, Salmonella typhimurium LT2
uggcguacgcauccgcguuaccc

SEQ ID NO: 1834979 - RNA, 17 nt, Salmonella typhimurium LT2
uggcguagaagcuuacc

SEQ ID NO: 1834980 - RNA, 20 nt, Salmonella typhimurium LT2
uggcguauuccauacagaaa

SEQ ID NO: 1834981 - RNA, 21 nt, Salmonella typhimurium LT2
uggaaaaucagcgacugguca

SEQ ID NO: 1834982 - RNA, 15 nt, Salmonella typhimurium LT2
uggcgcgccacuucu

SEQ ID NO: 1834983 - RNA, 23 nt, Salmonella typhimurium LT2
uggcgcgcuaucaagauaaaaag

SEQ ID NO: 1834984 - RNA, 19 nt, Salmonella typhimurium LT2
uggcgcggaaagccuucau

SEQ ID NO: 1834985 - RNA, 22 nt, Salmonella typhimurium LT2
uggcgcggaaagccuucaucau

SEQ ID NO: 1834986 - RNA, 13 nt, Salmonella typhimurium LT2
uggaaaagaaaac

SEQ ID NO: 1834987 - RNA, 21 nt, Salmonella typhimurium LT2
uggaaaacagcauaauaaagc

SEQ ID NO: 1834988 - RNA, 22 nt, Salmonella typhimurium LT2
uggaaaaccccaucccggcaac

SEQ ID NO: 1834989 - RNA, 15 nt, Salmonella typhimurium LT2
uggcgcgcgccgccu

SEQ ID NO: 1834990 - RNA, 20 nt, Salmonella typhimurium LT2
uggcgcgccugcuccaccag

SEQ ID NO: 1834991 - RNA, 17 nt, Salmonella typhimurium LT2
uggcgcugucgcuuacc

SEQ ID NO: 1834992 - RNA, 16 nt, Salmonella typhimurium LT2
uggcgcugcgcuuacc

SEQ ID NO: 1834993 - RNA, 17 nt, Salmonella typhimurium LT2
uggcucaauccaggugg

SEQ ID NO: 1834994 - RNA, 23 nt, Salmonella typhimurium LT2
uggcucuuagcagcauaaacauc

SEQ ID NO: 1834995 - RNA, 16 nt, Salmonella typhimurium LT2
uggcucggcgucaucc

SEQ ID NO: 1834996 - RNA, 12 nt, Salmonella typhimurium LT2
uggcucucggca

SEQ ID NO: 1834997 - RNA, 16 nt, Salmonella typhimurium LT2
uggcucucggcaacaa

SEQ ID NO: 1834998 - RNA, 15 nt, Salmonella typhimurium LT2
uggcucccgcagcca

SEQ ID NO: 1834999 - RNA, 20 nt, Salmonella typhimurium LT2
uggcguuaccggcaggcugg

SEQ ID NO: 1835000 - RNA, 17 nt, Salmonella typhimurium LT2
uggcguggauagccauc

SEQ ID NO: 1835001 - RNA, 19 nt, Salmonella typhimurium LT2
uggcguuccacccaguuca

SEQ ID NO: 1835002 - RNA, 22 nt, Salmonella typhimurium LT2
uggcgucgauaauugcgcgcgu

SEQ ID NO: 1835003 - RNA, 21 nt, Salmonella typhimurium LT2
uggcgucgccaaagcagcugc

SEQ ID NO: 1835004 - RNA, 15 nt, Salmonella typhimurium LT2
uggcgucuuuuaguc

SEQ ID NO: 1835005 - RNA, 18 nt, Salmonella typhimurium LT2
uggggaaaaaccccuggu

SEQ ID NO: 1835006 - RNA, 13 nt, Salmonella typhimurium LT2
ugggcuuugcaag

SEQ ID NO: 1835007 - RNA, 21 nt, Salmonella typhimurium LT2
uggggacgcgcaaacgcuggc

SEQ ID NO: 1835008 - RNA, 22 nt, Salmonella typhimurium LT2
ugggcgucuuaaugcucuccag

SEQ ID NO: 1835009 - RNA, 23 nt, Salmonella typhimurium LT2
ugggcgcgaucaguucuugcagg

SEQ ID NO: 1835010 - RNA, 14 nt, Salmonella typhimurium LT2
ugggcgcacaagcc

SEQ ID NO: 1835011 - RNA, 17 nt, Salmonella typhimurium LT2
ugggcgcacaagccugc

SEQ ID NO: 1835012 - RNA, 18 nt, Salmonella typhimurium LT2
ugggacauaauugcugcc

SEQ ID NO: 1835013 - RNA, 16 nt, Salmonella typhimurium LT2
uggcuuaccugcucug

SEQ ID NO: 1835014 - RNA, 18 nt, Salmonella typhimurium LT2
uggcuuccguccccagcc

SEQ ID NO: 1835015 - RNA, 15 nt, Salmonella typhimurium LT2
uggcuuccuacccuc

SEQ ID NO: 1835016 - RNA, 17 nt, Salmonella typhimurium LT2
uggcuuccuacccucac

SEQ ID NO: 1835017 - RNA, 21 nt, Salmonella typhimurium LT2
uggcuucuuaaaauagccagc

SEQ ID NO: 1835018 - RNA, 16 nt, Salmonella typhimurium LT2
ugggaacuagcgaauc

SEQ ID NO: 1835019 - RNA, 14 nt, Salmonella typhimurium LT2
uggcuuucauccaa

SEQ ID NO: 1835020 - RNA, 17 nt, Salmonella typhimurium LT2
uggcuuuauauaaaaaa

SEQ ID NO: 1835021 - RNA, 14 nt, Salmonella typhimurium LT2
uggcuggccugcug

SEQ ID NO: 1835022 - RNA, 14 nt, Salmonella typhimurium LT2
uggcuuaacucacc

SEQ ID NO: 1835023 - RNA, 17 nt, Salmonella typhimurium LT2
uggcugucggcagaacc

SEQ ID NO: 1835024 - RNA, 21 nt, Salmonella typhimurium LT2
uggcugcgcgucccucuccag

SEQ ID NO: 1835025 - RNA, 14 nt, Salmonella typhimurium LT2
uggcugccaguucg

SEQ ID NO: 1835026 - RNA, 13 nt, Salmonella typhimurium LT2
uggcugagaaaaa

SEQ ID NO: 1835027 - RNA, 14 nt, Salmonella typhimurium LT2
uucaguaagacaaa

SEQ ID NO: 1835028 - RNA, 19 nt, Salmonella typhimurium LT2
uucagucauaauccuuccu

SEQ ID NO: 1835029 - RNA, 20 nt, Salmonella typhimurium LT2
uucaguauuacuauacccgc

SEQ ID NO: 1835030 - RNA, 20 nt, Salmonella typhimurium LT2
uucaguaaaucaacuuuuuu

SEQ ID NO: 1835031 - RNA, 18 nt, Salmonella typhimurium LT2
uucaggcggcaaaaaacg

SEQ ID NO: 1835032 - RNA, 23 nt, Salmonella typhimurium LT2
uucaggccaugcuuuugcaggua

SEQ ID NO: 1835033 - RNA, 15 nt, Salmonella typhimurium LT2
uucaggcaaaaaaaa

SEQ ID NO: 1835034 - RNA, 17 nt, Salmonella typhimurium LT2
uucaggcaaaaaaaacc

SEQ ID NO: 1835035 - RNA, 21 nt, Salmonella typhimurium LT2
uucaggacgacgguuuucucg

SEQ ID NO: 1835036 - RNA, 23 nt, Salmonella typhimurium LT2
uucaggacgacgguuuucucguc

SEQ ID NO: 1835037 - RNA, 18 nt, Salmonella typhimurium LT2
uucagcgccagauaguca

SEQ ID NO: 1835038 - RNA, 16 nt, Salmonella typhimurium LT2
uucagcguacagaagg

SEQ ID NO: 1835039 - RNA, 22 nt, Salmonella typhimurium LT2
uucagccagaguuuuaaaacca

SEQ ID NO: 1835040 - RNA, 17 nt, Salmonella typhimurium LT2
uucagcgacaggcuguc

SEQ ID NO: 1835041 - RNA, 15 nt, Salmonella typhimurium LT2
uucagccugaagcca

SEQ ID NO: 1835042 - RNA, 18 nt, Salmonella typhimurium LT2
uucaggaaggagcaaaca

SEQ ID NO: 1835043 - RNA, 20 nt, Salmonella typhimurium LT2
uucagcugauugggauaaac

SEQ ID NO: 1835044 - RNA, 23 nt, Salmonella typhimurium LT2
uucagcuucagucauaauccuuc

SEQ ID NO: 1835045 - RNA, 20 nt, Salmonella typhimurium LT2
uucagcuuguggaaauaguc

SEQ ID NO: 1835046 - RNA, 16 nt, Salmonella typhimurium LT2
uucagcguugcagcca

SEQ ID NO: 1835047 - RNA, 22 nt, Salmonella typhimurium LT2
uucagcucgcaggccauaaaac

SEQ ID NO: 1835048 - RNA, 16 nt, Salmonella typhimurium LT2
uucauagcagcaagua

SEQ ID NO: 1835049 - RNA, 20 nt, Salmonella typhimurium LT2
uucauaugcgccaacugcau

SEQ ID NO: 1835050 - RNA, 16 nt, Salmonella typhimurium LT2
uucaucaaagaaauac

SEQ ID NO: 1835051 - RNA, 21 nt, Salmonella typhimurium LT2
uucagucuacuacacacuuac

SEQ ID NO: 1835052 - RNA, 21 nt, Salmonella typhimurium LT2
uucaguucaucuuccacacua

SEQ ID NO: 1835053 - RNA, 15 nt, Salmonella typhimurium LT2
uucauaagucaucca

SEQ ID NO: 1835054 - RNA, 21 nt, Salmonella typhimurium LT2
uucauaaagugccagggcgga

SEQ ID NO: 1835055 - RNA, 12 nt, Salmonella typhimurium LT2
uucaguuucuuc

SEQ ID NO: 1835056 - RNA, 13 nt, Salmonella typhimurium LT2
uucauaaaagauc

SEQ ID NO: 1835057 - RNA, 16 nt, Salmonella typhimurium LT2
uucaugaaucaucaca

SEQ ID NO: 1835058 - RNA, 22 nt, Salmonella typhimurium LT2
uucaucuucaccuuuccaguca

SEQ ID NO: 1835059 - RNA, 23 nt, Salmonella typhimurium LT2
uucaucggucagagcauaaaaau

SEQ ID NO: 1835060 - RNA, 20 nt, Salmonella typhimurium LT2
uucaucgcgccuccccugcc

SEQ ID NO: 1835061 - RNA, 20 nt, Salmonella typhimurium LT2
uucaucguuacgcagauagg

SEQ ID NO: 1835062 - RNA, 14 nt, Salmonella typhimurium LT2
uucaucucaucaau

SEQ ID NO: 1835063 - RNA, 18 nt, Salmonella typhimurium LT2
uucaucaggcaauaaaca

SEQ ID NO: 1835064 - RNA, 15 nt, Salmonella typhimurium LT2
uucauccagaccuga

SEQ ID NO: 1835065 - RNA, 15 nt, Salmonella typhimurium LT2
uucauccagcagcag

SEQ ID NO: 1835066 - RNA, 13 nt, Salmonella typhimurium LT2
uucauccaugcca

SEQ ID NO: 1835067 - RNA, 23 nt, Salmonella typhimurium LT2
uucauccauugcuuccuugauau

SEQ ID NO: 1835068 - RNA, 18 nt, Salmonella typhimurium LT2
uucauccagcgcgcggca

SEQ ID NO: 1835069 - RNA, 16 nt, Salmonella typhimurium LT2
uucaucauaucuuccc

SEQ ID NO: 1835070 - RNA, 20 nt, Salmonella typhimurium LT2
uucaucgccacaugcggcag

SEQ ID NO: 1835071 - RNA, 21 nt, Salmonella typhimurium LT2
uucauccuuaacgucaucauc

SEQ ID NO: 1835072 - RNA, 19 nt, Salmonella typhimurium LT2
uucaucccacucaaucauu

SEQ ID NO: 1835073 - RNA, 23 nt, Salmonella typhimurium LT2
uucaucccagcuaaaaagcuguc

SEQ ID NO: 1835074 - RNA, 17 nt, Salmonella typhimurium LT2
uucauccggauaaagcc

SEQ ID NO: 1835075 - RNA, 14 nt, Salmonella typhimurium LT2
uucauccucaacca

SEQ ID NO: 1835076 - RNA, 16 nt, Salmonella typhimurium LT2
uucauccugauaaucc

SEQ ID NO: 1835077 - RNA, 19 nt, Salmonella typhimurium LT2
uucauucgccaccaggcuc

SEQ ID NO: 1835078 - RNA, 18 nt, Salmonella typhimurium LT2
uucauuuuauagucccuc

SEQ ID NO: 1835079 - RNA, 13 nt, Salmonella typhimurium LT2
uucauuugcaaug

SEQ ID NO: 1835080 - RNA, 19 nt, Salmonella typhimurium LT2
uucauuucaggcaaaggaa

SEQ ID NO: 1835081 - RNA, 13 nt, Salmonella typhimurium LT2
uucauuacgcuuc

SEQ ID NO: 1835082 - RNA, 13 nt, Salmonella typhimurium LT2
uucauuauaaaac

SEQ ID NO: 1835083 - RNA, 15 nt, Salmonella typhimurium LT2
uucauuauaaaacau

SEQ ID NO: 1835084 - RNA, 14 nt, Salmonella typhimurium LT2
uucauuauaaaacu

SEQ ID NO: 1835085 - RNA, 20 nt, Salmonella typhimurium LT2
uucauggcgcgacauggcga

SEQ ID NO: 1835086 - RNA, 21 nt, Salmonella typhimurium LT2
uucauggucaucgcaaauucu

SEQ ID NO: 1835087 - RNA, 19 nt, Salmonella typhimurium LT2
uucaugguacucaacauca

SEQ ID NO: 1835088 - RNA, 13 nt, Salmonella typhimurium LT2
uucaugcgcggcg

SEQ ID NO: 1835089 - RNA, 23 nt, Salmonella typhimurium LT2
uucaugcaucauugaagcgaugu

SEQ ID NO: 1835090 - RNA, 22 nt, Salmonella typhimurium LT2
uucaaguccccccccucgcacc

SEQ ID NO: 1835091 - RNA, 15 nt, Salmonella typhimurium LT2
uucaauacgaaaacc

SEQ ID NO: 1835092 - RNA, 21 nt, Salmonella typhimurium LT2
uucaauaauggcgcgaaaaca

SEQ ID NO: 1835093 - RNA, 14 nt, Salmonella typhimurium LT2
uucaauaauaaaac

SEQ ID NO: 1835094 - RNA, 20 nt, Salmonella typhimurium LT2
uucaauaauauugucauaau

SEQ ID NO: 1835095 - RNA, 24 nt, Salmonella typhimurium LT2
uucaauaauauugucauaaugucc

SEQ ID NO: 1835096 - RNA, 20 nt, Salmonella typhimurium LT2
uucaauaagcgguaauaauu

SEQ ID NO: 1835097 - RNA, 21 nt, Salmonella typhimurium LT2
uucaauaaauugaaauucuau

SEQ ID NO: 1835098 - RNA, 19 nt, Salmonella typhimurium LT2
uucaaucuggugacgauga

SEQ ID NO: 1835099 - RNA, 18 nt, Salmonella typhimurium LT2
uucaaucgcacccgccau

SEQ ID NO: 1835100 - RNA, 18 nt, Salmonella typhimurium LT2
uucaaugcauacugccgg

SEQ ID NO: 1835101 - RNA, 22 nt, Salmonella typhimurium LT2
uucaauaucauuguucuguccg

SEQ ID NO: 1835102 - RNA, 20 nt, Salmonella typhimurium LT2
uucaauccccccuuuaccca

SEQ ID NO: 1835103 - RNA, 13 nt, Salmonella typhimurium LT2
uucaaucaucaua

SEQ ID NO: 1835104 - RNA, 17 nt, Salmonella typhimurium LT2
uucaaucaucauauccc

SEQ ID NO: 1835105 - RNA, 22 nt, Salmonella typhimurium LT2
uucacaccaaugucauauuugu

SEQ ID NO: 1835106 - RNA, 21 nt, Salmonella typhimurium LT2
uucacaccuuuauauuuuucc

SEQ ID NO: 1835107 - RNA, 16 nt, Salmonella typhimurium LT2
uucacaaucaucgcau

SEQ ID NO: 1835108 - RNA, 13 nt, Salmonella typhimurium LT2
uucacaaaaagua

SEQ ID NO: 1835109 - RNA, 15 nt, Salmonella typhimurium LT2
uucaauuuucgcuuu

SEQ ID NO: 1835110 - RNA, 20 nt, Salmonella typhimurium LT2
uucaauuugugagacaaaaa

SEQ ID NO: 1835111 - RNA, 16 nt, Salmonella typhimurium LT2
uucaccaaauccucac

SEQ ID NO: 1835112 - RNA, 16 nt, Salmonella typhimurium LT2
uucaccagacgcuggc

SEQ ID NO: 1835113 - RNA, 12 nt, Salmonella typhimurium LT2
uucaccagcgcg

SEQ ID NO: 1835114 - RNA, 15 nt, Salmonella typhimurium LT2
uucagcaagaagcag

SEQ ID NO: 1835115 - RNA, 21 nt, Salmonella typhimurium LT2
uucagcagcgguacgcaagcg

SEQ ID NO: 1835116 - RNA, 23 nt, Salmonella typhimurium LT2
uucagcaauuacccgguguuuuu

SEQ ID NO: 1835117 - RNA, 12 nt, Salmonella typhimurium LT2
uucagacgucau

SEQ ID NO: 1835118 - RNA, 22 nt, Salmonella typhimurium LT2
uucagagcgucuacgccaucau

SEQ ID NO: 1835119 - RNA, 16 nt, Salmonella typhimurium LT2
uucagaccauagucca

SEQ ID NO: 1835120 - RNA, 16 nt, Salmonella typhimurium LT2
uucacuucuucauaaa

SEQ ID NO: 1835121 - RNA, 19 nt, Salmonella typhimurium LT2
uucagaaaucauauaaaac

SEQ ID NO: 1835122 - RNA, 16 nt, Salmonella typhimurium LT2
uucagaaauguauucu

SEQ ID NO: 1835123 - RNA, 19 nt, Salmonella typhimurium LT2
uucagaaauguauucuccc

SEQ ID NO: 1835124 - RNA, 22 nt, Salmonella typhimurium LT2
uucacgccacaguugguucugc

SEQ ID NO: 1835125 - RNA, 20 nt, Salmonella typhimurium LT2
uucacgccuuuugacgcuuc

SEQ ID NO: 1835126 - RNA, 22 nt, Salmonella typhimurium LT2
uucacgcuauguuugcugagaa

SEQ ID NO: 1835127 - RNA, 20 nt, Salmonella typhimurium LT2
uucacgccgccauccggcaa

SEQ ID NO: 1835128 - RNA, 19 nt, Salmonella typhimurium LT2
uucacgagcggucaggcca

SEQ ID NO: 1835129 - RNA, 14 nt, Salmonella typhimurium LT2
uucaccuuuccagu

SEQ ID NO: 1835130 - RNA, 16 nt, Salmonella typhimurium LT2
uucaccugcauaccga

SEQ ID NO: 1835131 - RNA, 21 nt, Salmonella typhimurium LT2
uucaccugccguaccguugcc

SEQ ID NO: 1835132 - RNA, 15 nt, Salmonella typhimurium LT2
uucaccggcacccag

SEQ ID NO: 1835133 - RNA, 19 nt, Salmonella typhimurium LT2
uucaccggacgcaucgccg

SEQ ID NO: 1835134 - RNA, 13 nt, Salmonella typhimurium LT2
uucacccccaucg

SEQ ID NO: 1835135 - RNA, 23 nt, Salmonella typhimurium LT2
uucaccgcgucguuacgcucguc

SEQ ID NO: 1835136 - RNA, 17 nt, Salmonella typhimurium LT2
uucacgucgcgaagcug

SEQ ID NO: 1835137 - RNA, 20 nt, Salmonella typhimurium LT2
uucacuggcaucguauauac

SEQ ID NO: 1835138 - RNA, 18 nt, Salmonella typhimurium LT2
uucacuccuaagagaaaa

SEQ ID NO: 1835139 - RNA, 13 nt, Salmonella typhimurium LT2
uuccacagaccca

SEQ ID NO: 1835140 - RNA, 20 nt, Salmonella typhimurium LT2
uuccaccagauuucgcaaca

SEQ ID NO: 1835141 - RNA, 17 nt, Salmonella typhimurium LT2
uuccaccaccuccugcu

SEQ ID NO: 1835142 - RNA, 18 nt, Salmonella typhimurium LT2
uuccaccgucuugcugcg

SEQ ID NO: 1835143 - RNA, 14 nt, Salmonella typhimurium LT2
uuccacgguaaaac

SEQ ID NO: 1835144 - RNA, 23 nt, Salmonella typhimurium LT2
uuccacugcaucucuuccaggau

SEQ ID NO: 1835145 - RNA, 18 nt, Salmonella typhimurium LT2
uuccagaaauaaaauacg

SEQ ID NO: 1835146 - RNA, 19 nt, Salmonella typhimurium LT2
uuccauaacccggcugagc

SEQ ID NO: 1835147 - RNA, 17 nt, Salmonella typhimurium LT2
uuccaguugcggcauca

SEQ ID NO: 1835148 - RNA, 19 nt, Salmonella typhimurium LT2
uuccaucgcgacuucaauc

SEQ ID NO: 1835149 - RNA, 13 nt, Salmonella typhimurium LT2
uuccaucaaaagc

SEQ ID NO: 1835150 - RNA, 15 nt, Salmonella typhimurium LT2
uuccaucaauaaucc

SEQ ID NO: 1835151 - RNA, 14 nt, Salmonella typhimurium LT2
uuccauauccagcg

SEQ ID NO: 1835152 - RNA, 21 nt, Salmonella typhimurium LT2
uuccaguucauaagucaucca

SEQ ID NO: 1835153 - RNA, 17 nt, Salmonella typhimurium LT2
uuccagguugugacgaa

SEQ ID NO: 1835154 - RNA, 14 nt, Salmonella typhimurium LT2
uuccaguaauuuca

SEQ ID NO: 1835155 - RNA, 20 nt, Salmonella typhimurium LT2
uuccaguagucgcgccauuc

SEQ ID NO: 1835156 - RNA, 18 nt, Salmonella typhimurium LT2
uuccagggcuuccagaau

SEQ ID NO: 1835157 - RNA, 21 nt, Salmonella typhimurium LT2
uuccagaagcgcuuugccaau

SEQ ID NO: 1835158 - RNA, 15 nt, Salmonella typhimurium LT2
uuccagaugucagua

SEQ ID NO: 1835159 - RNA, 14 nt, Salmonella typhimurium LT2
uuccagcauuuccu

SEQ ID NO: 1835160 - RNA, 16 nt, Salmonella typhimurium LT2
uuccagcauuucuuca

SEQ ID NO: 1835161 - RNA, 17 nt, Salmonella typhimurium LT2
uuccagcauuucuucaa

SEQ ID NO: 1835162 - RNA, 23 nt, Salmonella typhimurium LT2
uuccagccgcccgcgauaaaaau

SEQ ID NO: 1835163 - RNA, 21 nt, Salmonella typhimurium LT2
uuccagcgcgccgucaucgcu

SEQ ID NO: 1835164 - RNA, 16 nt, Salmonella typhimurium LT2
uuccagcgccauaaga

SEQ ID NO: 1835165 - RNA, 19 nt, Salmonella typhimurium LT2
uuccagcgccauaagacua

SEQ ID NO: 1835166 - RNA, 11 nt, Salmonella typhimurium LT2
uuccagcgccg

SEQ ID NO: 1835167 - RNA, 14 nt, Salmonella typhimurium LT2
uucccacagucggc

SEQ ID NO: 1835168 - RNA, 16 nt, Salmonella typhimurium LT2
uucccacuccgcccag

SEQ ID NO: 1835169 - RNA, 11 nt, Salmonella typhimurium LT2
uuccauuuuua

SEQ ID NO: 1835170 - RNA, 21 nt, Salmonella typhimurium LT2
uuccauuuuucgaucuucucc

SEQ ID NO: 1835171 - RNA, 14 nt, Salmonella typhimurium LT2
uucccaauaguuua

SEQ ID NO: 1835172 - RNA, 13 nt, Salmonella typhimurium LT2
uuccauucccgcc

SEQ ID NO: 1835173 - RNA, 12 nt, Salmonella typhimurium LT2
uuccauugcugc

SEQ ID NO: 1835174 - RNA, 16 nt, Salmonella typhimurium LT2
uuccauuaugaugagu

SEQ ID NO: 1835175 - RNA, 15 nt, Salmonella typhimurium LT2
uuccaucucuuuaaa

SEQ ID NO: 1835176 - RNA, 14 nt, Salmonella typhimurium LT2
uuccccaucaaaac

SEQ ID NO: 1835177 - RNA, 16 nt, Salmonella typhimurium LT2
uucccaggucacgccc

SEQ ID NO: 1835178 - RNA, 22 nt, Salmonella typhimurium LT2
uucccagugcgcggucauaucu

SEQ ID NO: 1835179 - RNA, 15 nt, Salmonella typhimurium LT2
uucccccaaaaugcc

SEQ ID NO: 1835180 - RNA, 16 nt, Salmonella typhimurium LT2
uuccccggccagcgcg

SEQ ID NO: 1835181 - RNA, 16 nt, Salmonella typhimurium LT2
uuccccugaugcguau

SEQ ID NO: 1835182 - RNA, 11 nt, Salmonella typhimurium LT2
uucccgagcgg

SEQ ID NO: 1835183 - RNA, 21 nt, Salmonella typhimurium LT2
uucccgcaaacuggccacagc

SEQ ID NO: 1835184 - RNA, 13 nt, Salmonella typhimurium LT2
uucccgcaggccg

SEQ ID NO: 1835185 - RNA, 17 nt, Salmonella typhimurium LT2
uucccuuuuuaaaauga

SEQ ID NO: 1835186 - RNA, 20 nt, Salmonella typhimurium LT2
uucccucauauuuguaucug

SEQ ID NO: 1835187 - RNA, 20 nt, Salmonella typhimurium LT2
uucccgguaaaucauauuga

SEQ ID NO: 1835188 - RNA, 18 nt, Salmonella typhimurium LT2
uucccggcaauuaccgcc

SEQ ID NO: 1835189 - RNA, 19 nt, Salmonella typhimurium LT2
uucccgcccgucaggggcg

SEQ ID NO: 1835190 - RNA, 17 nt, Salmonella typhimurium LT2
uucccgcugguugccuu

SEQ ID NO: 1835191 - RNA, 15 nt, Salmonella typhimurium LT2
uucccggaucgcuaa

SEQ ID NO: 1835192 - RNA, 17 nt, Salmonella typhimurium LT2
uuccgcugucgccccuu

SEQ ID NO: 1835193 - RNA, 22 nt, Salmonella typhimurium LT2
uuccggaaugagaugcacgcag

SEQ ID NO: 1835194 - RNA, 20 nt, Salmonella typhimurium LT2
uuccggaguaaugaaaccga

SEQ ID NO: 1835195 - RNA, 16 nt, Salmonella typhimurium LT2
uuccgcgguguccugc

SEQ ID NO: 1835196 - RNA, 17 nt, Salmonella typhimurium LT2
uuccgcguuaucaagag

SEQ ID NO: 1835197 - RNA, 14 nt, Salmonella typhimurium LT2
uuccgcgcaaauac

SEQ ID NO: 1835198 - RNA, 17 nt, Salmonella typhimurium LT2
uuccgccugccgcgccg

SEQ ID NO: 1835199 - RNA, 19 nt, Salmonella typhimurium LT2
uuccgccaugaaaaaaacg

SEQ ID NO: 1835200 - RNA, 19 nt, Salmonella typhimurium LT2
uuccgccaccagauaguca

SEQ ID NO: 1835201 - RNA, 16 nt, Salmonella typhimurium LT2
uuccgccaccacgccc

SEQ ID NO: 1835202 - RNA, 23 nt, Salmonella typhimurium LT2
uuccgccaccagauagucaucac

SEQ ID NO: 1835203 - RNA, 14 nt, Salmonella typhimurium LT2
uuccgccagacuca

SEQ ID NO: 1835204 - RNA, 23 nt, Salmonella typhimurium LT2
uuccgacagugaacggcauaauc

SEQ ID NO: 1835205 - RNA, 15 nt, Salmonella typhimurium LT2
uuccgccaccacgcc

SEQ ID NO: 1835206 - RNA, 22 nt, Salmonella typhimurium LT2
uuccgcaauaugcgucagcgcg

SEQ ID NO: 1835207 - RNA, 23 nt, Salmonella typhimurium LT2
uuccgcaaagcccaucagcgcca

SEQ ID NO: 1835208 - RNA, 15 nt, Salmonella typhimurium LT2
uuccgcaauacagcc

SEQ ID NO: 1835209 - RNA, 22 nt, Salmonella typhimurium LT2
uucgccaaagcagugaaucccc

SEQ ID NO: 1835210 - RNA, 18 nt, Salmonella typhimurium LT2
uucgccaccagcaaaagu

SEQ ID NO: 1835211 - RNA, 20 nt, Salmonella typhimurium LT2
uucgccaccagcaaaaguug

SEQ ID NO: 1835212 - RNA, 16 nt, Salmonella typhimurium LT2
uucgcauauucugcga

SEQ ID NO: 1835213 - RNA, 20 nt, Salmonella typhimurium LT2
uucgcaugaauucaacgccc

SEQ ID NO: 1835214 - RNA, 19 nt, Salmonella typhimurium LT2
uucgcauguugacugcgcu

SEQ ID NO: 1835215 - RNA, 14 nt, Salmonella typhimurium LT2
uucgcccagucauc

SEQ ID NO: 1835216 - RNA, 22 nt, Salmonella typhimurium LT2
uucgcccguuguccgccagcgu

SEQ ID NO: 1835217 - RNA, 17 nt, Salmonella typhimurium LT2
uucgccucccucacccu

SEQ ID NO: 1835218 - RNA, 22 nt, Salmonella typhimurium LT2
uucgcuucgguaaaaacagcca

SEQ ID NO: 1835219 - RNA, 13 nt, Salmonella typhimurium LT2
uucgcugcaacuu

SEQ ID NO: 1835220 - RNA, 15 nt, Salmonella typhimurium LT2
uucgcguaaugcaau

SEQ ID NO: 1835221 - RNA, 21 nt, Salmonella typhimurium LT2
uucgcuaauccccccuuuuuu

SEQ ID NO: 1835222 - RNA, 22 nt, Salmonella typhimurium LT2
uucgcgcuaaaugacaaauaga

SEQ ID NO: 1835223 - RNA, 14 nt, Salmonella typhimurium LT2
uucgccugaacagg

SEQ ID NO: 1835224 - RNA, 23 nt, Salmonella typhimurium LT2
uucgccuggugcgggucaaaagc

SEQ ID NO: 1835225 - RNA, 13 nt, Salmonella typhimurium LT2
uucgcacccuguc

SEQ ID NO: 1835226 - RNA, 21 nt, Salmonella typhimurium LT2
uucgcaaccuaaccaaacaga

SEQ ID NO: 1835227 - RNA, 20 nt, Salmonella typhimurium LT2
uucgcaacaugaauuaacuu

SEQ ID NO: 1835228 - RNA, 14 nt, Salmonella typhimurium LT2
uucgauaauaaaau

SEQ ID NO: 1835229 - RNA, 18 nt, Salmonella typhimurium LT2
uucgauaaccaccagcgg

SEQ ID NO: 1835230 - RNA, 14 nt, Salmonella typhimurium LT2
uucgaugcgcucau

SEQ ID NO: 1835231 - RNA, 15 nt, Salmonella typhimurium LT2
uucgaugaaaaagag

SEQ ID NO: 1835232 - RNA, 14 nt, Salmonella typhimurium LT2
uucgagcagaacug

SEQ ID NO: 1835233 - RNA, 12 nt, Salmonella typhimurium LT2
uucgaacucuac

SEQ ID NO: 1835234 - RNA, 13 nt, Salmonella typhimurium LT2
uucgaauucugau

SEQ ID NO: 1835235 - RNA, 21 nt, Salmonella typhimurium LT2
uucgacaauauuuuucagcca

SEQ ID NO: 1835236 - RNA, 19 nt, Salmonella typhimurium LT2
uuccuuguuuuaacggaau

SEQ ID NO: 1835237 - RNA, 17 nt, Salmonella typhimurium LT2
uuccuugauauuuucca

SEQ ID NO: 1835238 - RNA, 14 nt, Salmonella typhimurium LT2
uuccuggugcgaca

SEQ ID NO: 1835239 - RNA, 14 nt, Salmonella typhimurium LT2
uuccuggcuugcca

SEQ ID NO: 1835240 - RNA, 16 nt, Salmonella typhimurium LT2
uuccuggggaacagaa

SEQ ID NO: 1835241 - RNA, 12 nt, Salmonella typhimurium LT2
uuccuuaucagc

SEQ ID NO: 1835242 - RNA, 17 nt, Salmonella typhimurium LT2
uuccugaguuuaugagg

SEQ ID NO: 1835243 - RNA, 16 nt, Salmonella typhimurium LT2
uuccugcugcgcuuug

SEQ ID NO: 1835244 - RNA, 15 nt, Salmonella typhimurium LT2
uuccugccagcacag

SEQ ID NO: 1835245 - RNA, 21 nt, Salmonella typhimurium LT2
uuccugcgcugucaccagcag

SEQ ID NO: 1835246 - RNA, 18 nt, Salmonella typhimurium LT2
uuccugccaggccggacu

SEQ ID NO: 1835247 - RNA, 23 nt, Salmonella typhimurium LT2
uuccguauugagcagcggcugga

SEQ ID NO: 1835248 - RNA, 18 nt, Salmonella typhimurium LT2
uuccgucucagagcuaug

SEQ ID NO: 1835249 - RNA, 18 nt, Salmonella typhimurium LT2
uuccguuuuguugccgcc

SEQ ID NO: 1835250 - RNA, 15 nt, Salmonella typhimurium LT2
uuccgguugcccauu

SEQ ID NO: 1835251 - RNA, 21 nt, Salmonella typhimurium LT2
uuccgggcgcaccaguucccc

SEQ ID NO: 1835252 - RNA, 22 nt, Salmonella typhimurium LT2
uuccggaucgccgaagcggcag

SEQ ID NO: 1835253 - RNA, 21 nt, Salmonella typhimurium LT2
uuccggcaccagaauccacuc

SEQ ID NO: 1835254 - RNA, 18 nt, Salmonella typhimurium LT2
uuccggcacucugcgcca

SEQ ID NO: 1835255 - RNA, 12 nt, Salmonella typhimurium LT2
uuccggcggcag

SEQ ID NO: 1835256 - RNA, 16 nt, Salmonella typhimurium LT2
uuccggcgaaaaacca

SEQ ID NO: 1835257 - RNA, 22 nt, Salmonella typhimurium LT2
uuccggcuucguuaagcgguuu

SEQ ID NO: 1835258 - RNA, 21 nt, Salmonella typhimurium LT2
uuccugacuguaauuucgcug

SEQ ID NO: 1835259 - RNA, 22 nt, Salmonella typhimurium LT2
uuccucucuuaaguauauauga

SEQ ID NO: 1835260 - RNA, 18 nt, Salmonella typhimurium LT2
uugcggaauaugagcaca

SEQ ID NO: 1835261 - RNA, 21 nt, Salmonella typhimurium LT2
uugcggaauaugagcacagcc

SEQ ID NO: 1835262 - RNA, 15 nt, Salmonella typhimurium LT2
uugcggcacacagcc

SEQ ID NO: 1835263 - RNA, 14 nt, Salmonella typhimurium LT2
uugcgccagcgcca

SEQ ID NO: 1835264 - RNA, 18 nt, Salmonella typhimurium LT2
uugcgccacggauggccu

SEQ ID NO: 1835265 - RNA, 14 nt, Salmonella typhimurium LT2
uugcgccacugcca

SEQ ID NO: 1835266 - RNA, 16 nt, Salmonella typhimurium LT2
uugcgccagauaacca

SEQ ID NO: 1835267 - RNA, 20 nt, Salmonella typhimurium LT2
uugccugauggcgcugcgcu

SEQ ID NO: 1835268 - RNA, 23 nt, Salmonella typhimurium LT2
uugccugauggcgcuacgccuga

SEQ ID NO: 1835269 - RNA, 19 nt, Salmonella typhimurium LT2
uugccugauggcgcucgcu

SEQ ID NO: 1835270 - RNA, 19 nt, Salmonella typhimurium LT2
uugccuucgaagaauucca

SEQ ID NO: 1835271 - RNA, 19 nt, Salmonella typhimurium LT2
uugcgcaagcacugaaugc

SEQ ID NO: 1835272 - RNA, 18 nt, Salmonella typhimurium LT2
uugcucguaccaggcccc

SEQ ID NO: 1835273 - RNA, 11 nt, Salmonella typhimurium LT2
uugcucgcacu

SEQ ID NO: 1835274 - RNA, 18 nt, Salmonella typhimurium LT2
uugccguuaacugcugcu

SEQ ID NO: 1835275 - RNA, 20 nt, Salmonella typhimurium LT2
uugccgguuuuuuuugccug

SEQ ID NO: 1835276 - RNA, 17 nt, Salmonella typhimurium LT2
uugccagugaaaaaaag

SEQ ID NO: 1835277 - RNA, 19 nt, Salmonella typhimurium LT2
uugccagugaaaaaaagca

SEQ ID NO: 1835278 - RNA, 15 nt, Salmonella typhimurium LT2
uugccaugaaaacga

SEQ ID NO: 1835279 - RNA, 20 nt, Salmonella typhimurium LT2
uugccauuacgauaaaugcg

SEQ ID NO: 1835280 - RNA, 13 nt, Salmonella typhimurium LT2
uugcauaaagaac

SEQ ID NO: 1835281 - RNA, 13 nt, Salmonella typhimurium LT2
uugcauaaauaau

SEQ ID NO: 1835282 - RNA, 22 nt, Salmonella typhimurium LT2
uugcaguugcgcgucuaaaaau

SEQ ID NO: 1835283 - RNA, 19 nt, Salmonella typhimurium LT2
uugcaggaaaaacuguccc

SEQ ID NO: 1835284 - RNA, 20 nt, Salmonella typhimurium LT2
uugccacuacgcagcuccag

SEQ ID NO: 1835285 - RNA, 18 nt, Salmonella typhimurium LT2
uugccagacgggccaggc

SEQ ID NO: 1835286 - RNA, 17 nt, Salmonella typhimurium LT2
uuggauucauuaaacca

SEQ ID NO: 1835287 - RNA, 15 nt, Salmonella typhimurium LT2
uuggcaaucaaaucc

SEQ ID NO: 1835288 - RNA, 22 nt, Salmonella typhimurium LT2
uugcuugugagggcaaaguucc

SEQ ID NO: 1835289 - RNA, 21 nt, Salmonella typhimurium LT2
uuggaaacuaugcaaaacgua

SEQ ID NO: 1835290 - RNA, 18 nt, Salmonella typhimurium LT2
uuggaaagauucuacauu

SEQ ID NO: 1835291 - RNA, 22 nt, Salmonella typhimurium LT2
uugcugcuguuaccggacagca

SEQ ID NO: 1835292 - RNA, 21 nt, Salmonella typhimurium LT2
uugcugcugcggaucgucucu

SEQ ID NO: 1835293 - RNA, 18 nt, Salmonella typhimurium LT2
uugcuggcaagaaccgcu

SEQ ID NO: 1835294 - RNA, 20 nt, Salmonella typhimurium LT2
uugcuucaggcgggguuaac

SEQ ID NO: 1835295 - RNA, 18 nt, Salmonella typhimurium LT2
uugggaacuagcgaauca

SEQ ID NO: 1835296 - RNA, 20 nt, Salmonella typhimurium LT2
uuggccggcuucuccaccau

SEQ ID NO: 1835297 - RNA, 15 nt, Salmonella typhimurium LT2
uuggccgcuuuagua

SEQ ID NO: 1835298 - RNA, 20 nt, Salmonella typhimurium LT2
uuggugauuaacagcgccau

SEQ ID NO: 1835299 - RNA, 23 nt, Salmonella typhimurium LT2
uugguaauccacgccaauaauca

SEQ ID NO: 1835300 - RNA, 23 nt, Salmonella typhimurium LT2
uuuaaggaauaacgcgcuuuuuu

SEQ ID NO: 1835301 - RNA, 16 nt, Salmonella typhimurium LT2
uuuaagccgauugaau

SEQ ID NO: 1835302 - RNA, 22 nt, Salmonella typhimurium LT2
uuuaaugcccuccgcaucaaaa

SEQ ID NO: 1835303 - RNA, 20 nt, Salmonella typhimurium LT2
uuuaauauaugaaccaagau

SEQ ID NO: 1835304 - RNA, 21 nt, Salmonella typhimurium LT2
uuuaccaucuacuaucaucug

SEQ ID NO: 1835305 - RNA, 20 nt, Salmonella typhimurium LT2
uuuacccacuucuuccagcg

SEQ ID NO: 1835306 - RNA, 21 nt, Salmonella typhimurium LT2
uuuacaucggcguguuucauu

SEQ ID NO: 1835307 - RNA, 18 nt, Salmonella typhimurium LT2
uuguagcugcgccugaaa

SEQ ID NO: 1835308 - RNA, 18 nt, Salmonella typhimurium LT2
uuguagcggcaacagcac

SEQ ID NO: 1835309 - RNA, 22 nt, Salmonella typhimurium LT2
uuguccucaucauucgguuagg

SEQ ID NO: 1835310 - RNA, 18 nt, Salmonella typhimurium LT2
uuguccuuuaucugcccu

SEQ ID NO: 1835311 - RNA, 14 nt, Salmonella typhimurium LT2
uugucuucuuagua

SEQ ID NO: 1835312 - RNA, 15 nt, Salmonella typhimurium LT2
uugugaguucauaaa

SEQ ID NO: 1835313 - RNA, 20 nt, Salmonella typhimurium LT2
uuguggguugauaacccaac

SEQ ID NO: 1835314 - RNA, 23 nt, Salmonella typhimurium LT2
uuguugccgcccguuuuuuccag

SEQ ID NO: 1835315 - RNA, 17 nt, Salmonella typhimurium LT2
uuguuuauuccauucau

SEQ ID NO: 1835316 - RNA, 23 nt, Salmonella typhimurium LT2
uuguucaauagagcgcagcaaaa

SEQ ID NO: 1835317 - RNA, 19 nt, Salmonella typhimurium LT2
uuguucuuucaccauuaag

SEQ ID NO: 1835318 - RNA, 13 nt, Salmonella typhimurium LT2
uugaagaaaaacc

SEQ ID NO: 1835319 - RNA, 15 nt, Salmonella typhimurium LT2
uugaacucuuucaga

SEQ ID NO: 1835320 - RNA, 18 nt, Salmonella typhimurium LT2
uugaacucuuucagacca

SEQ ID NO: 1835321 - RNA, 18 nt, Salmonella typhimurium LT2
uugaacggggaucaaaau

SEQ ID NO: 1835322 - RNA, 22 nt, Salmonella typhimurium LT2
uugaacgguaaacacgacgcug

SEQ ID NO: 1835323 - RNA, 11 nt, Salmonella typhimurium LT2
uugaagacagc

SEQ ID NO: 1835324 - RNA, 15 nt, Salmonella typhimurium LT2
uugacgauaucaucu

SEQ ID NO: 1835325 - RNA, 14 nt, Salmonella typhimurium LT2
uugacgaaaagaua

SEQ ID NO: 1835326 - RNA, 16 nt, Salmonella typhimurium LT2
uugaccucaucaccua

SEQ ID NO: 1835327 - RNA, 14 nt, Salmonella typhimurium LT2
uugaccgucaucca

SEQ ID NO: 1835328 - RNA, 14 nt, Salmonella typhimurium LT2
uugaaagaccuaaa

SEQ ID NO: 1835329 - RNA, 20 nt, Salmonella typhimurium LT2
uucuuuuucgaucagcauau

SEQ ID NO: 1835330 - RNA, 13 nt, Salmonella typhimurium LT2
uucuuugguauug

SEQ ID NO: 1835331 - RNA, 13 nt, Salmonella typhimurium LT2
uucuuugucacca

SEQ ID NO: 1835332 - RNA, 17 nt, Salmonella typhimurium LT2
uucuugcgccgcaaacu

SEQ ID NO: 1835333 - RNA, 21 nt, Salmonella typhimurium LT2
uucuugcgccgcaaacucagg

SEQ ID NO: 1835334 - RNA, 13 nt, Salmonella typhimurium LT2
uugaucguccauc

SEQ ID NO: 1835335 - RNA, 14 nt, Salmonella typhimurium LT2
uugauaagagaaaa

SEQ ID NO: 1835336 - RNA, 16 nt, Salmonella typhimurium LT2
uugagucgcauccagu

SEQ ID NO: 1835337 - RNA, 19 nt, Salmonella typhimurium LT2
uugaguagcaaggcuauug

SEQ ID NO: 1835338 - RNA, 13 nt, Salmonella typhimurium LT2
uugagccauucca

SEQ ID NO: 1835339 - RNA, 18 nt, Salmonella typhimurium LT2
uugagcgcaaaacgcugc

SEQ ID NO: 1835340 - RNA, 18 nt, Salmonella typhimurium LT2
uugaugaugccaggacca

SEQ ID NO: 1835341 - RNA, 22 nt, Salmonella typhimurium LT2
uugaucugaagcguauuucugu

SEQ ID NO: 1835342 - RNA, 12 nt, Salmonella typhimurium LT2
uugcagcgcagc

SEQ ID NO: 1835343 - RNA, 14 nt, Salmonella typhimurium LT2
uugcagccagaacu

SEQ ID NO: 1835344 - RNA, 20 nt, Salmonella typhimurium LT2
uugcagccacguugcgcgcg

SEQ ID NO: 1835345 - RNA, 12 nt, Salmonella typhimurium LT2
uugauuuuucau

SEQ ID NO: 1835346 - RNA, 20 nt, Salmonella typhimurium LT2
uucugguuuucaaauuguuc

SEQ ID NO: 1835347 - RNA, 20 nt, Salmonella typhimurium LT2
uucuggcgcagauacgcguc

SEQ ID NO: 1835348 - RNA, 14 nt, Salmonella typhimurium LT2
uucuggcaauaagg

SEQ ID NO: 1835349 - RNA, 20 nt, Salmonella typhimurium LT2
uucuggccccugagcaauca

SEQ ID NO: 1835350 - RNA, 15 nt, Salmonella typhimurium LT2
uucuggcgcagauac

SEQ ID NO: 1835351 - RNA, 18 nt, Salmonella typhimurium LT2
uucugaccaguugcaggc

SEQ ID NO: 1835352 - RNA, 17 nt, Salmonella typhimurium LT2
uucugauaacgcaggcg

SEQ ID NO: 1835353 - RNA, 15 nt, Salmonella typhimurium LT2
uucugauaagcgcag

SEQ ID NO: 1835354 - RNA, 18 nt, Salmonella typhimurium LT2
uucugaauuucacgcuuc

SEQ ID NO: 1835355 - RNA, 20 nt, Salmonella typhimurium LT2
uucugacagaauauaggaga

SEQ ID NO: 1835356 - RNA, 18 nt, Salmonella typhimurium LT2
uucugaaucauauuuuau

SEQ ID NO: 1835357 - RNA, 21 nt, Salmonella typhimurium LT2
uucugaagcguaacagcgcua

SEQ ID NO: 1835358 - RNA, 19 nt, Salmonella typhimurium LT2
uucugaagcguaacagcgc

SEQ ID NO: 1835359 - RNA, 18 nt, Salmonella typhimurium LT2
uucugaauaaauugaauu

SEQ ID NO: 1835360 - RNA, 15 nt, Salmonella typhimurium LT2
uucuuccagcggcag

SEQ ID NO: 1835361 - RNA, 23 nt, Salmonella typhimurium LT2
uucuucaucaaagaaauacccuu

SEQ ID NO: 1835362 - RNA, 12 nt, Salmonella typhimurium LT2
uucuuccgugcc

SEQ ID NO: 1835363 - RNA, 14 nt, Salmonella typhimurium LT2
uucuuccauuccca

SEQ ID NO: 1835364 - RNA, 20 nt, Salmonella typhimurium LT2
uucuucaagcguuuccagag

SEQ ID NO: 1835365 - RNA, 12 nt, Salmonella typhimurium LT2
uucuucaaugaa

SEQ ID NO: 1835366 - RNA, 19 nt, Salmonella typhimurium LT2
uucuuacggacgugggggu

SEQ ID NO: 1835367 - RNA, 18 nt, Salmonella typhimurium LT2
uucuguaauuugaaauug

SEQ ID NO: 1835368 - RNA, 14 nt, Salmonella typhimurium LT2
uucuuaauuccuca

SEQ ID NO: 1835369 - RNA, 17 nt, Salmonella typhimurium LT2
uucuuaccugguauuau

SEQ ID NO: 1835370 - RNA, 17 nt, Salmonella typhimurium LT2
uucucgaaguucucaau

SEQ ID NO: 1835371 - RNA, 23 nt, Salmonella typhimurium LT2
uucuacuucaauuuuccagauag

SEQ ID NO: 1835372 - RNA, 22 nt, Salmonella typhimurium LT2
uucggcaaaacgccgcagaaaa

SEQ ID NO: 1835373 - RNA, 13 nt, Salmonella typhimurium LT2
uucggcaauccau

SEQ ID NO: 1835374 - RNA, 21 nt, Salmonella typhimurium LT2
uucggagcgcuuuuuuuaugc

SEQ ID NO: 1835375 - RNA, 21 nt, Salmonella typhimurium LT2
uucggcagcgcgaacaggcug

SEQ ID NO: 1835376 - RNA, 19 nt, Salmonella typhimurium LT2
uucgguguaaacaggcuuc

SEQ ID NO: 1835377 - RNA, 15 nt, Salmonella typhimurium LT2
uucguccagggugaa

SEQ ID NO: 1835378 - RNA, 22 nt, Salmonella typhimurium LT2
uucguaauagcgucuaaauuuc

SEQ ID NO: 1835379 - RNA, 18 nt, Salmonella typhimurium LT2
uucgucuuuauucaucau

SEQ ID NO: 1835380 - RNA, 18 nt, Salmonella typhimurium LT2
uucgugaaaaccuaaaua

SEQ ID NO: 1835381 - RNA, 15 nt, Salmonella typhimurium LT2
uucgucuucaucuuc

SEQ ID NO: 1835382 - RNA, 13 nt, Salmonella typhimurium LT2
uucgucuucaucu

SEQ ID NO: 1835383 - RNA, 15 nt, Salmonella typhimurium LT2
uucuaacaaaacaga

SEQ ID NO: 1835384 - RNA, 17 nt, Salmonella typhimurium LT2
uucguuauaaggccugc

SEQ ID NO: 1835385 - RNA, 15 nt, Salmonella typhimurium LT2
uucguguaaaugacg

SEQ ID NO: 1835386 - RNA, 14 nt, Salmonella typhimurium LT2
gaguccagcggcag

SEQ ID NO: 1835387 - RNA, 15 nt, Salmonella typhimurium LT2
gaguccagcggcagc

SEQ ID NO: 1835388 - RNA, 16 nt, Salmonella typhimurium LT2
gagucgcagcggcggu

SEQ ID NO: 1835389 - RNA, 14 nt, Salmonella typhimurium LT2
gaguccauuuccuc

SEQ ID NO: 1835390 - RNA, 17 nt, Salmonella typhimurium LT2
gaguggagcggucgaca

SEQ ID NO: 1835391 - RNA, 13 nt, Salmonella typhimurium LT2
gagugccagcccc

SEQ ID NO: 1835392 - RNA, 15 nt, Salmonella typhimurium LT2
gagugccagaaacau

SEQ ID NO: 1835393 - RNA, 21 nt, Salmonella typhimurium LT2
gaguaugcccgcgagagauua

SEQ ID NO: 1835394 - RNA, 17 nt, Salmonella typhimurium LT2
gagucagacaccagccc

SEQ ID NO: 1835395 - RNA, 16 nt, Salmonella typhimurium LT2
gagucaggcggucaga

SEQ ID NO: 1835396 - RNA, 13 nt, Salmonella typhimurium LT2
gagucaccagcac

SEQ ID NO: 1835397 - RNA, 14 nt, Salmonella typhimurium LT2
gagucaccagcacu

SEQ ID NO: 1835398 - RNA, 19 nt, Salmonella typhimurium LT2
gaauuucuucaucccagcu

SEQ ID NO: 1835399 - RNA, 14 nt, Salmonella typhimurium LT2
gaauuugccccaga

SEQ ID NO: 1835400 - RNA, 22 nt, Salmonella typhimurium LT2
gaauuugucccuguuccaucuc

SEQ ID NO: 1835401 - RNA, 17 nt, Salmonella typhimurium LT2
gaguuccugugcggcau

SEQ ID NO: 1835402 - RNA, 13 nt, Salmonella typhimurium LT2
gaguuaucuuuua

SEQ ID NO: 1835403 - RNA, 15 nt, Salmonella typhimurium LT2
gaguucgguuaacug

SEQ ID NO: 1835404 - RNA, 20 nt, Salmonella typhimurium LT2
gauaaaaacgcgucagcguu

SEQ ID NO: 1835405 - RNA, 19 nt, Salmonella typhimurium LT2
gaguugaagcgauguaaga

SEQ ID NO: 1835406 - RNA, 17 nt, Salmonella typhimurium LT2
gaguugaaaccgcgcuc

SEQ ID NO: 1835407 - RNA, 18 nt, Salmonella typhimurium LT2
gauaaaaagacagauaaa

SEQ ID NO: 1835408 - RNA, 22 nt, Salmonella typhimurium LT2
gauaaagcgcucaugccacgcc

SEQ ID NO: 1835409 - RNA, 20 nt, Salmonella typhimurium LT2
gauaaagcgaccgaucauca

SEQ ID NO: 1835410 - RNA, 17 nt, Salmonella typhimurium LT2
gauaaagcacagcccca

SEQ ID NO: 1835411 - RNA, 17 nt, Salmonella typhimurium LT2
gauaaaguacuuucucc

SEQ ID NO: 1835412 - RNA, 17 nt, Salmonella typhimurium LT2
gauaaagcugggucagg

SEQ ID NO: 1835413 - RNA, 18 nt, Salmonella typhimurium LT2
gauaaagguacuuucccc

SEQ ID NO: 1835414 - RNA, 17 nt, Salmonella typhimurium LT2
gauaaagcuuucaucuu

SEQ ID NO: 1835415 - RNA, 15 nt, Salmonella typhimurium LT2
gauaaagagcaggcc

SEQ ID NO: 1835416 - RNA, 22 nt, Salmonella typhimurium LT2
gauaaaggauugugguaagcaa

SEQ ID NO: 1835417 - RNA, 21 nt, Salmonella typhimurium LT2
gauacuggaagugaucuuuca

SEQ ID NO: 1835418 - RNA, 17 nt, Salmonella typhimurium LT2
gauacugcaacgccaga

SEQ ID NO: 1835419 - RNA, 21 nt, Salmonella typhimurium LT2
gauacugcaacgccagaugcg

SEQ ID NO: 1835420 - RNA, 16 nt, Salmonella typhimurium LT2
gauacggcccagaccc

SEQ ID NO: 1835421 - RNA, 15 nt, Salmonella typhimurium LT2
gauacggcgagacca

SEQ ID NO: 1835422 - RNA, 16 nt, Salmonella typhimurium LT2
gauacgcuggcacagg

SEQ ID NO: 1835423 - RNA, 20 nt, Salmonella typhimurium LT2
gauacgcuucggcuccagcg

SEQ ID NO: 1835424 - RNA, 22 nt, Salmonella typhimurium LT2
gauacgcuucggcuccagcgcc

SEQ ID NO: 1835425 - RNA, 14 nt, Salmonella typhimurium LT2
gauacgccagguua

SEQ ID NO: 1835426 - RNA, 14 nt, Salmonella typhimurium LT2
gauacgccuggaua

SEQ ID NO: 1835427 - RNA, 15 nt, Salmonella typhimurium LT2
gauacgccagcagac

SEQ ID NO: 1835428 - RNA, 14 nt, Salmonella typhimurium LT2
gauacgcagaaccg

SEQ ID NO: 1835429 - RNA, 14 nt, Salmonella typhimurium LT2
gauacgccagcaga

SEQ ID NO: 1835430 - RNA, 12 nt, Salmonella typhimurium LT2
gauacugugucg

SEQ ID NO: 1835431 - RNA, 20 nt, Salmonella typhimurium LT2
gauagagcgcggucagguuc

SEQ ID NO: 1835432 - RNA, 16 nt, Salmonella typhimurium LT2
gauagaggguugauaa

SEQ ID NO: 1835433 - RNA, 15 nt, Salmonella typhimurium LT2
gauacaccuucacau

SEQ ID NO: 1835434 - RNA, 18 nt, Salmonella typhimurium LT2
gauacaagguauccgcca

SEQ ID NO: 1835435 - RNA, 20 nt, Salmonella typhimurium LT2
gauacaggacugacugcugu

SEQ ID NO: 1835436 - RNA, 21 nt, Salmonella typhimurium LT2
gauacaggacugacugcuguc

SEQ ID NO: 1835437 - RNA, 17 nt, Salmonella typhimurium LT2
gauacaggacugacugc

SEQ ID NO: 1835438 - RNA, 18 nt, Salmonella typhimurium LT2
gauacagaaaaccggcaa

SEQ ID NO: 1835439 - RNA, 23 nt, Salmonella typhimurium LT2
gauacauauuucgaucggccagu

SEQ ID NO: 1835440 - RNA, 20 nt, Salmonella typhimurium LT2
gauacccagcgucccggcgu

SEQ ID NO: 1835441 - RNA, 17 nt, Salmonella typhimurium LT2
gauacccgcccagauca

SEQ ID NO: 1835442 - RNA, 12 nt, Salmonella typhimurium LT2
gauaccagauua

SEQ ID NO: 1835443 - RNA, 19 nt, Salmonella typhimurium LT2
gauaccaauucccagaccc

SEQ ID NO: 1835444 - RNA, 13 nt, Salmonella typhimurium LT2
gauacauuuuuug

SEQ ID NO: 1835445 - RNA, 20 nt, Salmonella typhimurium LT2
gauaauggcgccgauaacac

SEQ ID NO: 1835446 - RNA, 16 nt, Salmonella typhimurium LT2
gauaaugcgcugcaca

SEQ ID NO: 1835447 - RNA, 18 nt, Salmonella typhimurium LT2
gauaaucgccgccagcuc

SEQ ID NO: 1835448 - RNA, 11 nt, Salmonella typhimurium LT2
gauaauccaga

SEQ ID NO: 1835449 - RNA, 15 nt, Salmonella typhimurium LT2
gauaauuggcgguga

SEQ ID NO: 1835450 - RNA, 17 nt, Salmonella typhimurium LT2
gauaauuuuucagacgu

SEQ ID NO: 1835451 - RNA, 23 nt, Salmonella typhimurium LT2
gauacaaagccgaccgccagguc

SEQ ID NO: 1835452 - RNA, 23 nt, Salmonella typhimurium LT2
gauaauuucacccguauucuuug

SEQ ID NO: 1835453 - RNA, 20 nt, Salmonella typhimurium LT2
gauaacggucguucccuacc

SEQ ID NO: 1835454 - RNA, 15 nt, Salmonella typhimurium LT2
gauaacggaaagagg

SEQ ID NO: 1835455 - RNA, 14 nt, Salmonella typhimurium LT2
gauaaauaaaaaau

SEQ ID NO: 1835456 - RNA, 14 nt, Salmonella typhimurium LT2
gauaaccgccgcca

SEQ ID NO: 1835457 - RNA, 18 nt, Salmonella typhimurium LT2
gauaaaguuaaacauacc

SEQ ID NO: 1835458 - RNA, 17 nt, Salmonella typhimurium LT2
gauaaccuauuuugcaa

SEQ ID NO: 1835459 - RNA, 23 nt, Salmonella typhimurium LT2
gauaaccuauuuugcaaaacuga

SEQ ID NO: 1835460 - RNA, 21 nt, Salmonella typhimurium LT2
gauaauaaaauauuauuuuuu

SEQ ID NO: 1835461 - RNA, 18 nt, Salmonella typhimurium LT2
gauaauaguuagccugau

SEQ ID NO: 1835462 - RNA, 17 nt, Salmonella typhimurium LT2
gauaauagccucauccc

SEQ ID NO: 1835463 - RNA, 17 nt, Salmonella typhimurium LT2
gauaauacauugccgca

SEQ ID NO: 1835464 - RNA, 14 nt, Salmonella typhimurium LT2
gauaaucagcagcg

SEQ ID NO: 1835465 - RNA, 22 nt, Salmonella typhimurium LT2
gauaaucaacggucuugccagc

SEQ ID NO: 1835466 - RNA, 19 nt, Salmonella typhimurium LT2
gaucaagcaauaccagaaa

SEQ ID NO: 1835467 - RNA, 16 nt, Salmonella typhimurium LT2
gaucagcggcugcaaa

SEQ ID NO: 1835468 - RNA, 19 nt, Salmonella typhimurium LT2
gaucagcggcugcaaagca

SEQ ID NO: 1835469 - RNA, 15 nt, Salmonella typhimurium LT2
gaucagcgccacgca

SEQ ID NO: 1835470 - RNA, 17 nt, Salmonella typhimurium LT2
gaucaggaaaucuucca

SEQ ID NO: 1835471 - RNA, 18 nt, Salmonella typhimurium LT2
gaucaggaaaucuuccag

SEQ ID NO: 1835472 - RNA, 11 nt, Salmonella typhimurium LT2
gaucaggcgac

SEQ ID NO: 1835473 - RNA, 20 nt, Salmonella typhimurium LT2
gaucaggcgcuugcgccgcc

SEQ ID NO: 1835474 - RNA, 20 nt, Salmonella typhimurium LT2
gaucaggccgcagacggaga

SEQ ID NO: 1835475 - RNA, 13 nt, Salmonella typhimurium LT2
gauauccacguuc

SEQ ID NO: 1835476 - RNA, 18 nt, Salmonella typhimurium LT2
gauauccgcgcucaacac

SEQ ID NO: 1835477 - RNA, 12 nt, Salmonella typhimurium LT2
gauaucuuccag

SEQ ID NO: 1835478 - RNA, 14 nt, Salmonella typhimurium LT2
gauaucgccccaga

SEQ ID NO: 1835479 - RNA, 23 nt, Salmonella typhimurium LT2
gauaucgccugcuuugaccuguu

SEQ ID NO: 1835480 - RNA, 23 nt, Salmonella typhimurium LT2
gauauggccguuuucaugcacga

SEQ ID NO: 1835481 - RNA, 18 nt, Salmonella typhimurium LT2
gauaugcuugccggaugc

SEQ ID NO: 1835482 - RNA, 20 nt, Salmonella typhimurium LT2
gauaugcaggggcaguaaau

SEQ ID NO: 1835483 - RNA, 14 nt, Salmonella typhimurium LT2
gauaugcagcagcc

SEQ ID NO: 1835484 - RNA, 20 nt, Salmonella typhimurium LT2
gauauugugcauacugauuu

SEQ ID NO: 1835485 - RNA, 16 nt, Salmonella typhimurium LT2
gauauugccuuauuca

SEQ ID NO: 1835486 - RNA, 17 nt, Salmonella typhimurium LT2
gauauugcauaggggca

SEQ ID NO: 1835487 - RNA, 17 nt, Salmonella typhimurium LT2
gaucgccauccugcacc

SEQ ID NO: 1835488 - RNA, 20 nt, Salmonella typhimurium LT2
gaucgccaucgacagcagcg

SEQ ID NO: 1835489 - RNA, 14 nt, Salmonella typhimurium LT2
gaucgcgcagcagg

SEQ ID NO: 1835490 - RNA, 21 nt, Salmonella typhimurium LT2
gaucgcgcucccggccaauca

SEQ ID NO: 1835491 - RNA, 20 nt, Salmonella typhimurium LT2
gaucgcauuuaaucgccugc

SEQ ID NO: 1835492 - RNA, 16 nt, Salmonella typhimurium LT2
gaucgaggcgcuggcg

SEQ ID NO: 1835493 - RNA, 22 nt, Salmonella typhimurium LT2
gaucgcuuucgcuuucucuucc

SEQ ID NO: 1835494 - RNA, 22 nt, Salmonella typhimurium LT2
gaucggagggggaggcaggcaa

SEQ ID NO: 1835495 - RNA, 14 nt, Salmonella typhimurium LT2
gaucggccagcaag

SEQ ID NO: 1835496 - RNA, 17 nt, Salmonella typhimurium LT2
gaucggcuuuaucuuua

SEQ ID NO: 1835497 - RNA, 19 nt, Salmonella typhimurium LT2
gaucccuaauaaaauaacu

SEQ ID NO: 1835498 - RNA, 12 nt, Salmonella typhimurium LT2
gauccagaaccg

SEQ ID NO: 1835499 - RNA, 15 nt, Salmonella typhimurium LT2
gauccacugcauccu

SEQ ID NO: 1835500 - RNA, 21 nt, Salmonella typhimurium LT2
gauccagccccagcgccagcu

SEQ ID NO: 1835501 - RNA, 22 nt, Salmonella typhimurium LT2
gauccagccgcaguugccaggc

SEQ ID NO: 1835502 - RNA, 22 nt, Salmonella typhimurium LT2
gauccuggcguguccccaccaa

SEQ ID NO: 1835503 - RNA, 23 nt, Salmonella typhimurium LT2
gauccuggcguguccccaccaac

SEQ ID NO: 1835504 - RNA, 19 nt, Salmonella typhimurium LT2
gauccuguucaaacaucag

SEQ ID NO: 1835505 - RNA, 20 nt, Salmonella typhimurium LT2
gauccuguuucaccguagca

SEQ ID NO: 1835506 - RNA, 15 nt, Salmonella typhimurium LT2
gauccuucauucaga

SEQ ID NO: 1835507 - RNA, 18 nt, Salmonella typhimurium LT2
gauccugcggcauuagca

SEQ ID NO: 1835508 - RNA, 16 nt, Salmonella typhimurium LT2
gauccugcaacagcac

SEQ ID NO: 1835509 - RNA, 19 nt, Salmonella typhimurium LT2
gaucgacaaaccacugcug

SEQ ID NO: 1835510 - RNA, 17 nt, Salmonella typhimurium LT2
gaucgacaaugaucaga

SEQ ID NO: 1835511 - RNA, 13 nt, Salmonella typhimurium LT2
gaucgacaaugau

SEQ ID NO: 1835512 - RNA, 15 nt, Salmonella typhimurium LT2
gaucgacaaugauca

SEQ ID NO: 1835513 - RNA, 22 nt, Salmonella typhimurium LT2
gaucgacgcugaugaaaaguau

SEQ ID NO: 1835514 - RNA, 14 nt, Salmonella typhimurium LT2
gauccguuucagaa

SEQ ID NO: 1835515 - RNA, 16 nt, Salmonella typhimurium LT2
gauccuccugcagacu

SEQ ID NO: 1835516 - RNA, 18 nt, Salmonella typhimurium LT2
gauccucauaaauagcca

SEQ ID NO: 1835517 - RNA, 15 nt, Salmonella typhimurium LT2
gauccugagaaauca

SEQ ID NO: 1835518 - RNA, 20 nt, Salmonella typhimurium LT2
gauccugagaaaucaacgug

SEQ ID NO: 1835519 - RNA, 18 nt, Salmonella typhimurium LT2
gauccggcuguuccagua

SEQ ID NO: 1835520 - RNA, 21 nt, Salmonella typhimurium LT2
gaucgucuccuguaacagggg

SEQ ID NO: 1835521 - RNA, 18 nt, Salmonella typhimurium LT2
gaucguaaaaugaaaaac

SEQ ID NO: 1835522 - RNA, 15 nt, Salmonella typhimurium LT2
gaucguaggcggcgg

SEQ ID NO: 1835523 - RNA, 15 nt, Salmonella typhimurium LT2
gaucguaugcgccug

SEQ ID NO: 1835524 - RNA, 22 nt, Salmonella typhimurium LT2
gaucguaaagcgcauccagcuc

SEQ ID NO: 1835525 - RNA, 14 nt, Salmonella typhimurium LT2
gaugacacuaucuc

SEQ ID NO: 1835526 - RNA, 15 nt, Salmonella typhimurium LT2
gaugaucuucagccc

SEQ ID NO: 1835527 - RNA, 21 nt, Salmonella typhimurium LT2
gaugagcgugacgaccggcac

SEQ ID NO: 1835528 - RNA, 16 nt, Salmonella typhimurium LT2
gaugcaucagaacaaa

SEQ ID NO: 1835529 - RNA, 18 nt, Salmonella typhimurium LT2
gaugcgccaguucagcgu

SEQ ID NO: 1835530 - RNA, 13 nt, Salmonella typhimurium LT2
gaugcgccaguac

SEQ ID NO: 1835531 - RNA, 19 nt, Salmonella typhimurium LT2
gaugcgggagaucggcugu

SEQ ID NO: 1835532 - RNA, 18 nt, Salmonella typhimurium LT2
gaugcgggccgacaaaaa

SEQ ID NO: 1835533 - RNA, 15 nt, Salmonella typhimurium LT2
gaugcgacucggugc

SEQ ID NO: 1835534 - RNA, 15 nt, Salmonella typhimurium LT2
gaugcccguaaagcu

SEQ ID NO: 1835535 - RNA, 13 nt, Salmonella typhimurium LT2
gaugccacaggcu

SEQ ID NO: 1835536 - RNA, 18 nt, Salmonella typhimurium LT2
gaugcguuggcucgcugc

SEQ ID NO: 1835537 - RNA, 17 nt, Salmonella typhimurium LT2
gaugcguauccagcgcg

SEQ ID NO: 1835538 - RNA, 16 nt, Salmonella typhimurium LT2
gaugcguugagcgugu

SEQ ID NO: 1835539 - RNA, 16 nt, Salmonella typhimurium LT2
gaugcuguaccgcccg

SEQ ID NO: 1835540 - RNA, 13 nt, Salmonella typhimurium LT2
gaugcuuauuauu

SEQ ID NO: 1835541 - RNA, 15 nt, Salmonella typhimurium LT2
gauggauaaccugcc

SEQ ID NO: 1835542 - RNA, 19 nt, Salmonella typhimurium LT2
gauggaaagaacacaggca

SEQ ID NO: 1835543 - RNA, 15 nt, Salmonella typhimurium LT2
gauggaacagacgcc

SEQ ID NO: 1835544 - RNA, 21 nt, Salmonella typhimurium LT2
gauggcgauucauaugcgcca

SEQ ID NO: 1835545 - RNA, 15 nt, Salmonella typhimurium LT2
gauggcgcugucgcu

SEQ ID NO: 1835546 - RNA, 18 nt, Salmonella typhimurium LT2
gauggcgcuaagccagcc

SEQ ID NO: 1835547 - RNA, 18 nt, Salmonella typhimurium LT2
gauggcggcgucgccugu

SEQ ID NO: 1835548 - RNA, 14 nt, Salmonella typhimurium LT2
gaugggcuucuuca

SEQ ID NO: 1835549 - RNA, 16 nt, Salmonella typhimurium LT2
gauggggcaugcuaua

SEQ ID NO: 1835550 - RNA, 14 nt, Salmonella typhimurium LT2
gauguaaucugaca

SEQ ID NO: 1835551 - RNA, 14 nt, Salmonella typhimurium LT2
gauguaaaaaugcu

SEQ ID NO: 1835552 - RNA, 23 nt, Salmonella typhimurium LT2
gaugguuaaauucauauuuaaau

SEQ ID NO: 1835553 - RNA, 17 nt, Salmonella typhimurium LT2
gauggucggcgcuggcg

SEQ ID NO: 1835554 - RNA, 20 nt, Salmonella typhimurium LT2
gauguccguuuuuucugucg

SEQ ID NO: 1835555 - RNA, 15 nt, Salmonella typhimurium LT2
gaugucauaaucgcc

SEQ ID NO: 1835556 - RNA, 21 nt, Salmonella typhimurium LT2
gaugucaucgccauccugcaa

SEQ ID NO: 1835557 - RNA, 19 nt, Salmonella typhimurium LT2
gauuaacaagcagauaccg

SEQ ID NO: 1835558 - RNA, 13 nt, Salmonella typhimurium LT2
gauuaaccagcag

SEQ ID NO: 1835559 - RNA, 23 nt, Salmonella typhimurium LT2
gauuaucagaaggcuugauacug

SEQ ID NO: 1835560 - RNA, 16 nt, Salmonella typhimurium LT2
gauuaucggccagcgc

SEQ ID NO: 1835561 - RNA, 17 nt, Salmonella typhimurium LT2
gauuaauaaccaauaau

SEQ ID NO: 1835562 - RNA, 19 nt, Salmonella typhimurium LT2
gauuacgacuuacgcagca

SEQ ID NO: 1835563 - RNA, 16 nt, Salmonella typhimurium LT2
gauuacucuucauuca

SEQ ID NO: 1835564 - RNA, 16 nt, Salmonella typhimurium LT2
gauuacugcgugcugg

SEQ ID NO: 1835565 - RNA, 18 nt, Salmonella typhimurium LT2
gauuacucccuugccagc

SEQ ID NO: 1835566 - RNA, 20 nt, Salmonella typhimurium LT2
gauuacucccuugccagcgc

SEQ ID NO: 1835567 - RNA, 13 nt, Salmonella typhimurium LT2
gauucuucugccu

SEQ ID NO: 1835568 - RNA, 16 nt, Salmonella typhimurium LT2
gauuuaagcuuaauuu

SEQ ID NO: 1835569 - RNA, 18 nt, Salmonella typhimurium LT2
gauuugcaaccgcucuuu

SEQ ID NO: 1835570 - RNA, 14 nt, Salmonella typhimurium LT2
gauuugcgccgccg

SEQ ID NO: 1835571 - RNA, 12 nt, Salmonella typhimurium LT2
gauuuuaaauug

SEQ ID NO: 1835572 - RNA, 19 nt, Salmonella typhimurium LT2
gauuuuagcgcaucgcucc

SEQ ID NO: 1835573 - RNA, 14 nt, Salmonella typhimurium LT2
gauuucuucuggcu

SEQ ID NO: 1835574 - RNA, 17 nt, Salmonella typhimurium LT2
gauuuuaucaagucgcg

SEQ ID NO: 1835575 - RNA, 22 nt, Salmonella typhimurium LT2
gauuuuucgcgucaaaacuuau

SEQ ID NO: 1835576 - RNA, 19 nt, Salmonella typhimurium LT2
gcaaaaacaccuaacccac

SEQ ID NO: 1835577 - RNA, 19 nt, Salmonella typhimurium LT2
gcaaaauggcaauugcgcc

SEQ ID NO: 1835578 - RNA, 14 nt, Salmonella typhimurium LT2
gcaaaaugcuucuu

SEQ ID NO: 1835579 - RNA, 19 nt, Salmonella typhimurium LT2
gcaaaaguuugaccagcaa

SEQ ID NO: 1835580 - RNA, 18 nt, Salmonella typhimurium LT2
gcaaaagcgguaauaacu

SEQ ID NO: 1835581 - RNA, 15 nt, Salmonella typhimurium LT2
gcaaaauucacacca

SEQ ID NO: 1835582 - RNA, 13 nt, Salmonella typhimurium LT2
gcaaaauuacuuc

SEQ ID NO: 1835583 - RNA, 14 nt, Salmonella typhimurium LT2
gcaaacaucugcuc

SEQ ID NO: 1835584 - RNA, 17 nt, Salmonella typhimurium LT2
gcaaacaguacgcccgc

SEQ ID NO: 1835585 - RNA, 16 nt, Salmonella typhimurium LT2
gcaaagauaaucugaa

SEQ ID NO: 1835586 - RNA, 15 nt, Salmonella typhimurium LT2
gcaaacugccaggca

SEQ ID NO: 1835587 - RNA, 23 nt, Salmonella typhimurium LT2
gcaaacgguaaacgugccacagu

SEQ ID NO: 1835588 - RNA, 18 nt, Salmonella typhimurium LT2
gcaaacgguuaauacuga

SEQ ID NO: 1835589 - RNA, 14 nt, Salmonella typhimurium LT2
gcaaacgccugcuc

SEQ ID NO: 1835590 - RNA, 18 nt, Salmonella typhimurium LT2
gcaaacucaccugauuac

SEQ ID NO: 1835591 - RNA, 19 nt, Salmonella typhimurium LT2
gcaaacggaauagcgccuu

SEQ ID NO: 1835592 - RNA, 15 nt, Salmonella typhimurium LT2
gcaaacgauaaaagc

SEQ ID NO: 1835593 - RNA, 15 nt, Salmonella typhimurium LT2
gcaaacgacacauaa

SEQ ID NO: 1835594 - RNA, 20 nt, Salmonella typhimurium LT2
gcaaaccggguaacagcauu

SEQ ID NO: 1835595 - RNA, 13 nt, Salmonella typhimurium LT2
gcaaaccucuccc

SEQ ID NO: 1835596 - RNA, 18 nt, Salmonella typhimurium LT2
gcaaaccggcaugaagac

SEQ ID NO: 1835597 - RNA, 13 nt, Salmonella typhimurium LT2
gcaaaucaccaca

SEQ ID NO: 1835598 - RNA, 16 nt, Salmonella typhimurium LT2
gcaaauacaucgccac

SEQ ID NO: 1835599 - RNA, 15 nt, Salmonella typhimurium LT2
gcaaauaccacauca

SEQ ID NO: 1835600 - RNA, 19 nt, Salmonella typhimurium LT2
gcaaauagguuuuaugcau

SEQ ID NO: 1835601 - RNA, 21 nt, Salmonella typhimurium LT2
gcaaaugauuaucuccaucuu

SEQ ID NO: 1835602 - RNA, 15 nt, Salmonella typhimurium LT2
gcaaauuaugauuca

SEQ ID NO: 1835603 - RNA, 14 nt, Salmonella typhimurium LT2
gcaaaguuccaggu

SEQ ID NO: 1835604 - RNA, 16 nt, Salmonella typhimurium LT2
gcaaagcgccauccgg

SEQ ID NO: 1835605 - RNA, 17 nt, Salmonella typhimurium LT2
gcagccgcucaggguaa

SEQ ID NO: 1835606 - RNA, 14 nt, Salmonella typhimurium LT2
gcagccgcucaaua

SEQ ID NO: 1835607 - RNA, 19 nt, Salmonella typhimurium LT2
gcagccgaauggcugccuu

SEQ ID NO: 1835608 - RNA, 19 nt, Salmonella typhimurium LT2
gcagccaccccggcauaug

SEQ ID NO: 1835609 - RNA, 22 nt, Salmonella typhimurium LT2
gcagcaugauggacguuuccug

SEQ ID NO: 1835610 - RNA, 15 nt, Salmonella typhimurium LT2
gcagcgccaucaggc

SEQ ID NO: 1835611 - RNA, 18 nt, Salmonella typhimurium LT2
gcagcgccaucaggcccc

SEQ ID NO: 1835612 - RNA, 13 nt, Salmonella typhimurium LT2
gcagcgcccagca

SEQ ID NO: 1835613 - RNA, 21 nt, Salmonella typhimurium LT2
gcagcgccaccgggcaacaca

SEQ ID NO: 1835614 - RNA, 21 nt, Salmonella typhimurium LT2
gcagcgcauucguaaugcgaa

SEQ ID NO: 1835615 - RNA, 15 nt, Salmonella typhimurium LT2
gcagcgauauuucuc

SEQ ID NO: 1835616 - RNA, 18 nt, Salmonella typhimurium LT2
gcagcgauauuucuccgc

SEQ ID NO: 1835617 - RNA, 18 nt, Salmonella typhimurium LT2
gcagcgauauagcgcaug

SEQ ID NO: 1835618 - RNA, 17 nt, Salmonella typhimurium LT2
gcagcagcagcagcaga

SEQ ID NO: 1835619 - RNA, 13 nt, Salmonella typhimurium LT2
gcagauugaggcu

SEQ ID NO: 1835620 - RNA, 17 nt, Salmonella typhimurium LT2
gcagauuacugagcagu

SEQ ID NO: 1835621 - RNA, 15 nt, Salmonella typhimurium LT2
gcagcaacaaaccga

SEQ ID NO: 1835622 - RNA, 14 nt, Salmonella typhimurium LT2
gcagcaacccugcc

SEQ ID NO: 1835623 - RNA, 15 nt, Salmonella typhimurium LT2
gcagcaacccugccg

SEQ ID NO: 1835624 - RNA, 14 nt, Salmonella typhimurium LT2
gcacuguggcggcu

SEQ ID NO: 1835625 - RNA, 21 nt, Salmonella typhimurium LT2
gcacuggcuuacucgcccugc

SEQ ID NO: 1835626 - RNA, 15 nt, Salmonella typhimurium LT2
gcagcggcugcgccu

SEQ ID NO: 1835627 - RNA, 19 nt, Salmonella typhimurium LT2
gcagcggcgaagcggugca

SEQ ID NO: 1835628 - RNA, 13 nt, Salmonella typhimurium LT2
gcagcgcggccug

SEQ ID NO: 1835629 - RNA, 14 nt, Salmonella typhimurium LT2
gcagcgcggccugc

SEQ ID NO: 1835630 - RNA, 15 nt, Salmonella typhimurium LT2
gcagcgcggcacaca

SEQ ID NO: 1835631 - RNA, 21 nt, Salmonella typhimurium LT2
gcagcgcggcgucgccgccgu

SEQ ID NO: 1835632 - RNA, 15 nt, Salmonella typhimurium LT2
gcagcgccuucgcuu

SEQ ID NO: 1835633 - RNA, 17 nt, Salmonella typhimurium LT2
gcagcgcgacauagagc

SEQ ID NO: 1835634 - RNA, 20 nt, Salmonella typhimurium LT2
gcagcugcuuaacuucugca

SEQ ID NO: 1835635 - RNA, 16 nt, Salmonella typhimurium LT2
gcagcucuccccacac

SEQ ID NO: 1835636 - RNA, 19 nt, Salmonella typhimurium LT2
gcagcgucagcccaagcug

SEQ ID NO: 1835637 - RNA, 22 nt, Salmonella typhimurium LT2
gcagcgucugcccuccugaaua

SEQ ID NO: 1835638 - RNA, 22 nt, Salmonella typhimurium LT2
gcaggcgauagccccaguaaau

SEQ ID NO: 1835639 - RNA, 16 nt, Salmonella typhimurium LT2
gcaggcggcuucgcau

SEQ ID NO: 1835640 - RNA, 20 nt, Salmonella typhimurium LT2
gcaggcgggugcgcagcccc

SEQ ID NO: 1835641 - RNA, 23 nt, Salmonella typhimurium LT2
gcaggcgggugcgcagccccagc

SEQ ID NO: 1835642 - RNA, 18 nt, Salmonella typhimurium LT2
gcaggcgucaaaacaggu

SEQ ID NO: 1835643 - RNA, 18 nt, Salmonella typhimurium LT2
gcaggcgaaggaggacgg

SEQ ID NO: 1835644 - RNA, 22 nt, Salmonella typhimurium LT2
gcaggcccgauaagcgccgcgc

SEQ ID NO: 1835645 - RNA, 16 nt, Salmonella typhimurium LT2
gcaggcaaaaaagugu

SEQ ID NO: 1835646 - RNA, 21 nt, Salmonella typhimurium LT2
gcaggcacuacggugugccug

SEQ ID NO: 1835647 - RNA, 17 nt, Salmonella typhimurium LT2
gcaggcaggucuccagc

SEQ ID NO: 1835648 - RNA, 16 nt, Salmonella typhimurium LT2
gcaggcauggccaaug

SEQ ID NO: 1835649 - RNA, 18 nt, Salmonella typhimurium LT2
gcaggcauuaaaaaaacg

SEQ ID NO: 1835650 - RNA, 17 nt, Salmonella typhimurium LT2
gcaggcaucgcgccgcc

SEQ ID NO: 1835651 - RNA, 16 nt, Salmonella typhimurium LT2
gcaggccaagcagcgc

SEQ ID NO: 1835652 - RNA, 22 nt, Salmonella typhimurium LT2
gcagcuugccuuguuucgucaa

SEQ ID NO: 1835653 - RNA, 18 nt, Salmonella typhimurium LT2
gcaguggcauguucccau

SEQ ID NO: 1835654 - RNA, 17 nt, Salmonella typhimurium LT2
gcaguuuaaagccaauc

SEQ ID NO: 1835655 - RNA, 22 nt, Salmonella typhimurium LT2
gcaguuuaaagccaauccagaa

SEQ ID NO: 1835656 - RNA, 16 nt, Salmonella typhimurium LT2
gcagugccgguugccu

SEQ ID NO: 1835657 - RNA, 22 nt, Salmonella typhimurium LT2
gcagugcaguauugcaccagga

SEQ ID NO: 1835658 - RNA, 14 nt, Salmonella typhimurium LT2
gcagugcacugccu

SEQ ID NO: 1835659 - RNA, 19 nt, Salmonella typhimurium LT2
gcauaaaaaagauugcugu

SEQ ID NO: 1835660 - RNA, 15 nt, Salmonella typhimurium LT2
gcauaaaaaaggcuc

SEQ ID NO: 1835661 - RNA, 14 nt, Salmonella typhimurium LT2
gcauaaaaaaugag

SEQ ID NO: 1835662 - RNA, 19 nt, Salmonella typhimurium LT2
gcaguuuuucugacucauu

SEQ ID NO: 1835663 - RNA, 17 nt, Salmonella typhimurium LT2
gcauaaaaaacaucaug

SEQ ID NO: 1835664 - RNA, 15 nt, Salmonella typhimurium LT2
gcauaaaaaaugaga

SEQ ID NO: 1835665 - RNA, 12 nt, Salmonella typhimurium LT2
gcauaagccuca

SEQ ID NO: 1835666 - RNA, 18 nt, Salmonella typhimurium LT2
gcauaagccagcccugcc

SEQ ID NO: 1835667 - RNA, 18 nt, Salmonella typhimurium LT2
gcauaauaaagcagcggc

SEQ ID NO: 1835668 - RNA, 10 nt, Salmonella typhimurium LT2
gcauaauaug

SEQ ID NO: 1835669 - RNA, 23 nt, Salmonella typhimurium LT2
gcauauccauugaaacggugccu

SEQ ID NO: 1835670 - RNA, 17 nt, Salmonella typhimurium LT2
gcauauagugcgugaca

SEQ ID NO: 1835671 - RNA, 16 nt, Salmonella typhimurium LT2
gcauauaagcuuuucc

SEQ ID NO: 1835672 - RNA, 17 nt, Salmonella typhimurium LT2
gcauaaugaaccacacu

SEQ ID NO: 1835673 - RNA, 19 nt, Salmonella typhimurium LT2
gcauaaugacguccaggcc

SEQ ID NO: 1835674 - RNA, 23 nt, Salmonella typhimurium LT2
gcauacgcuuucggaucaaucac

SEQ ID NO: 1835675 - RNA, 14 nt, Salmonella typhimurium LT2
gcauagaaaaagaa

SEQ ID NO: 1835676 - RNA, 18 nt, Salmonella typhimurium LT2
gcauacucuuggagagca

SEQ ID NO: 1835677 - RNA, 20 nt, Salmonella typhimurium LT2
gcauacucuccuccauaccu

SEQ ID NO: 1835678 - RNA, 19 nt, Salmonella typhimurium LT2
gcauacucacgaauaagaa

SEQ ID NO: 1835679 - RNA, 21 nt, Salmonella typhimurium LT2
gcagucacuuucagauuuuua

SEQ ID NO: 1835680 - RNA, 16 nt, Salmonella typhimurium LT2
gcaguccaacaaggau

SEQ ID NO: 1835681 - RNA, 13 nt, Salmonella typhimurium LT2
gcaguccaacaag

SEQ ID NO: 1835682 - RNA, 18 nt, Salmonella typhimurium LT2
gcagugauucguaguaag

SEQ ID NO: 1835683 - RNA, 13 nt, Salmonella typhimurium LT2
gcaguagccaugc

SEQ ID NO: 1835684 - RNA, 15 nt, Salmonella typhimurium LT2
gcaguagagaggggc

SEQ ID NO: 1835685 - RNA, 15 nt, Salmonella typhimurium LT2
gcaguaaaaagaaag

SEQ ID NO: 1835686 - RNA, 17 nt, Salmonella typhimurium LT2
gcaguauugcaccagga

SEQ ID NO: 1835687 - RNA, 22 nt, Salmonella typhimurium LT2
gcaguagcgcuuugacaucggg

SEQ ID NO: 1835688 - RNA, 21 nt, Salmonella typhimurium LT2
gcaguagugugguauucagcc

SEQ ID NO: 1835689 - RNA, 21 nt, Salmonella typhimurium LT2
gcagggauauacaaauauccc

SEQ ID NO: 1835690 - RNA, 15 nt, Salmonella typhimurium LT2
gcagggacuccugcg

SEQ ID NO: 1835691 - RNA, 22 nt, Salmonella typhimurium LT2
gcagggacuccugcgccggacg

SEQ ID NO: 1835692 - RNA, 14 nt, Salmonella typhimurium LT2
gcagggaacacccg

SEQ ID NO: 1835693 - RNA, 16 nt, Salmonella typhimurium LT2
gcagggcaggggccag

SEQ ID NO: 1835694 - RNA, 14 nt, Salmonella typhimurium LT2
gcaggucggcccga

SEQ ID NO: 1835695 - RNA, 10 nt, Salmonella typhimurium LT2
gcaggucggc

SEQ ID NO: 1835696 - RNA, 17 nt, Salmonella typhimurium LT2
gcaggugauggcggcuu

SEQ ID NO: 1835697 - RNA, 20 nt, Salmonella typhimurium LT2
gcagguugccgaugacuccc

SEQ ID NO: 1835698 - RNA, 16 nt, Salmonella typhimurium LT2
gcaucaaauaccuuuu

SEQ ID NO: 1835699 - RNA, 13 nt, Salmonella typhimurium LT2
gcaucaaauaccu

SEQ ID NO: 1835700 - RNA, 21 nt, Salmonella typhimurium LT2
gcaucaaacuuuuaaauugaa

SEQ ID NO: 1835701 - RNA, 13 nt, Salmonella typhimurium LT2
gcaucaaacuuuu

SEQ ID NO: 1835702 - RNA, 20 nt, Salmonella typhimurium LT2
gcaucaauggcgucaaacag

SEQ ID NO: 1835703 - RNA, 20 nt, Salmonella typhimurium LT2
gcaucaaugucgcgcucgcc

SEQ ID NO: 1835704 - RNA, 15 nt, Salmonella typhimurium LT2
gcauauuucuaauga

SEQ ID NO: 1835705 - RNA, 12 nt, Salmonella typhimurium LT2
gcauauuuuucu

SEQ ID NO: 1835706 - RNA, 13 nt, Salmonella typhimurium LT2
gcauauuuuucua

SEQ ID NO: 1835707 - RNA, 16 nt, Salmonella typhimurium LT2
gcauaugcacagcgcu

SEQ ID NO: 1835708 - RNA, 21 nt, Salmonella typhimurium LT2
gcaucaucgguguucacaauu

SEQ ID NO: 1835709 - RNA, 13 nt, Salmonella typhimurium LT2
gcaucauaaaagg

SEQ ID NO: 1835710 - RNA, 16 nt, Salmonella typhimurium LT2
gcaucauccccaccac

SEQ ID NO: 1835711 - RNA, 23 nt, Salmonella typhimurium LT2
gcaucagcgacucauucagcaac

SEQ ID NO: 1835712 - RNA, 16 nt, Salmonella typhimurium LT2
gcaucagaacaaacuu

SEQ ID NO: 1835713 - RNA, 15 nt, Salmonella typhimurium LT2
gcaucacgcgcuggc

SEQ ID NO: 1835714 - RNA, 16 nt, Salmonella typhimurium LT2
gcauccggcaauucaa

SEQ ID NO: 1835715 - RNA, 23 nt, Salmonella typhimurium LT2
gcauccugacuauugcugagcug

SEQ ID NO: 1835716 - RNA, 18 nt, Salmonella typhimurium LT2
gcauccgugaccugcuga

SEQ ID NO: 1835717 - RNA, 17 nt, Salmonella typhimurium LT2
gcauccuaacuggguca

SEQ ID NO: 1835718 - RNA, 15 nt, Salmonella typhimurium LT2
gcauccgugaccugc

SEQ ID NO: 1835719 - RNA, 20 nt, Salmonella typhimurium LT2
gcauccgguucaaggcagga

SEQ ID NO: 1835720 - RNA, 16 nt, Salmonella typhimurium LT2
gcauccggggcguggc

SEQ ID NO: 1835721 - RNA, 16 nt, Salmonella typhimurium LT2
gcauccggccagcgac

SEQ ID NO: 1835722 - RNA, 23 nt, Salmonella typhimurium LT2
gcauccuuaugggucacauccag

SEQ ID NO: 1835723 - RNA, 20 nt, Salmonella typhimurium LT2
gcaucgacauccgauuucau

SEQ ID NO: 1835724 - RNA, 13 nt, Salmonella typhimurium LT2
gcaucgacgccag

SEQ ID NO: 1835725 - RNA, 19 nt, Salmonella typhimurium LT2
gcaucgacguucagcauau

SEQ ID NO: 1835726 - RNA, 14 nt, Salmonella typhimurium LT2
gcauccgccgccgc

SEQ ID NO: 1835727 - RNA, 18 nt, Salmonella typhimurium LT2
gcauccgcaagacacgcu

SEQ ID NO: 1835728 - RNA, 14 nt, Salmonella typhimurium LT2
gcauccgcaagaca

SEQ ID NO: 1835729 - RNA, 23 nt, Salmonella typhimurium LT2
gcaucccggugucaaagcgccag

SEQ ID NO: 1835730 - RNA, 21 nt, Salmonella typhimurium LT2
gcaucccggugucaaagcgcc

SEQ ID NO: 1835731 - RNA, 14 nt, Salmonella typhimurium LT2
gcauccccugcagg

SEQ ID NO: 1835732 - RNA, 19 nt, Salmonella typhimurium LT2
gcaucccgcuggcgccacc

SEQ ID NO: 1835733 - RNA, 16 nt, Salmonella typhimurium LT2
gcaucauucugucagc

SEQ ID NO: 1835734 - RNA, 20 nt, Salmonella typhimurium LT2
gcauccagauguagcgcggu

SEQ ID NO: 1835735 - RNA, 15 nt, Salmonella typhimurium LT2
gcauccacguaaaua

SEQ ID NO: 1835736 - RNA, 21 nt, Salmonella typhimurium LT2
gcaauugguaauuaaaggcag

SEQ ID NO: 1835737 - RNA, 18 nt, Salmonella typhimurium LT2
gcaauugguaauuaaagg

SEQ ID NO: 1835738 - RNA, 13 nt, Salmonella typhimurium LT2
gcaauuagguuau

SEQ ID NO: 1835739 - RNA, 16 nt, Salmonella typhimurium LT2
gcaauuaacaaauaaa

SEQ ID NO: 1835740 - RNA, 19 nt, Salmonella typhimurium LT2
gcaauuaauauauuuauau

SEQ ID NO: 1835741 - RNA, 20 nt, Salmonella typhimurium LT2
gcaauguggacaaucaggcu

SEQ ID NO: 1835742 - RNA, 20 nt, Salmonella typhimurium LT2
gcaauguucaauaucaaauu

SEQ ID NO: 1835743 - RNA, 18 nt, Salmonella typhimurium LT2
gcaauguucaauaucaaa

SEQ ID NO: 1835744 - RNA, 14 nt, Salmonella typhimurium LT2
gcaauguuucaacc

SEQ ID NO: 1835745 - RNA, 19 nt, Salmonella typhimurium LT2
gcaaugucugcgucgggug

SEQ ID NO: 1835746 - RNA, 16 nt, Salmonella typhimurium LT2
gcaauguaagaauaac

SEQ ID NO: 1835747 - RNA, 23 nt, Salmonella typhimurium LT2
gcacaauagcgcuaaacagcgcc

SEQ ID NO: 1835748 - RNA, 20 nt, Salmonella typhimurium LT2
gcacaaucccggcaccgauc

SEQ ID NO: 1835749 - RNA, 18 nt, Salmonella typhimurium LT2
gcacaauggucagcgccg

SEQ ID NO: 1835750 - RNA, 12 nt, Salmonella typhimurium LT2
gcacaauaccaa

SEQ ID NO: 1835751 - RNA, 22 nt, Salmonella typhimurium LT2
gcacaauaacgaccccaauagc

SEQ ID NO: 1835752 - RNA, 20 nt, Salmonella typhimurium LT2
gcacaauaccaauaagaacu

SEQ ID NO: 1835753 - RNA, 14 nt, Salmonella typhimurium LT2
gcacaauaccaaua

SEQ ID NO: 1835754 - RNA, 11 nt, Salmonella typhimurium LT2
gcacaagccau

SEQ ID NO: 1835755 - RNA, 20 nt, Salmonella typhimurium LT2
gcacaaaaaguaguuccagc

SEQ ID NO: 1835756 - RNA, 17 nt, Salmonella typhimurium LT2
gcacaaaaaaaccgcuc

SEQ ID NO: 1835757 - RNA, 21 nt, Salmonella typhimurium LT2
gcaauuucucgcucgcccauc

SEQ ID NO: 1835758 - RNA, 11 nt, Salmonella typhimurium LT2
gcaauuucacu

SEQ ID NO: 1835759 - RNA, 14 nt, Salmonella typhimurium LT2
gcaauuuauaccgc

SEQ ID NO: 1835760 - RNA, 22 nt, Salmonella typhimurium LT2
gcaauuuacaucuuauuucacc

SEQ ID NO: 1835761 - RNA, 21 nt, Salmonella typhimurium LT2
gcaauuucacugucgccaggc

SEQ ID NO: 1835762 - RNA, 22 nt, Salmonella typhimurium LT2
gcacaucaugaugaucuucagc

SEQ ID NO: 1835763 - RNA, 22 nt, Salmonella typhimurium LT2
gcacauagcugagacucaguag

SEQ ID NO: 1835764 - RNA, 12 nt, Salmonella typhimurium LT2
gcacaguuuucc

SEQ ID NO: 1835765 - RNA, 21 nt, Salmonella typhimurium LT2
gcacacguauaaacgccgccg

SEQ ID NO: 1835766 - RNA, 22 nt, Salmonella typhimurium LT2
gcacacguauaaacgccgccgc

SEQ ID NO: 1835767 - RNA, 22 nt, Salmonella typhimurium LT2
gcacacgcggcgcuacggcgca

SEQ ID NO: 1835768 - RNA, 18 nt, Salmonella typhimurium LT2
gcacacucauuuugccgu

SEQ ID NO: 1835769 - RNA, 15 nt, Salmonella typhimurium LT2
gcacaccauuucaca

SEQ ID NO: 1835770 - RNA, 18 nt, Salmonella typhimurium LT2
gcacacgccaaaaucgcc

SEQ ID NO: 1835771 - RNA, 20 nt, Salmonella typhimurium LT2
gcacacgcccagggcacgcu

SEQ ID NO: 1835772 - RNA, 20 nt, Salmonella typhimurium LT2
gcacauuggcgagcaggaac

SEQ ID NO: 1835773 - RNA, 15 nt, Salmonella typhimurium LT2
gcaccaacgccgcuu

SEQ ID NO: 1835774 - RNA, 22 nt, Salmonella typhimurium LT2
gcaccaaaguuaaucagcgcug

SEQ ID NO: 1835775 - RNA, 19 nt, Salmonella typhimurium LT2
gcaaauucuuugugcuccg

SEQ ID NO: 1835776 - RNA, 17 nt, Salmonella typhimurium LT2
gcaacuucaccucaguc

SEQ ID NO: 1835777 - RNA, 22 nt, Salmonella typhimurium LT2
gcaacaaacauaagcaaauccu

SEQ ID NO: 1835778 - RNA, 14 nt, Salmonella typhimurium LT2
gcaagaaaaguuuc

SEQ ID NO: 1835779 - RNA, 22 nt, Salmonella typhimurium LT2
gcaagcaucugauauaucuuca

SEQ ID NO: 1835780 - RNA, 17 nt, Salmonella typhimurium LT2
gcaagcauaaaaaacau

SEQ ID NO: 1835781 - RNA, 19 nt, Salmonella typhimurium LT2
gcaagccaaacucuuccac

SEQ ID NO: 1835782 - RNA, 16 nt, Salmonella typhimurium LT2
gcaaggguaugaauaa

SEQ ID NO: 1835783 - RNA, 13 nt, Salmonella typhimurium LT2
gcaaguaugaaaa

SEQ ID NO: 1835784 - RNA, 20 nt, Salmonella typhimurium LT2
gcaaguaucgucagcagacu

SEQ ID NO: 1835785 - RNA, 17 nt, Salmonella typhimurium LT2
gcaauagccaauaacgu

SEQ ID NO: 1835786 - RNA, 17 nt, Salmonella typhimurium LT2
gcaauaggauaacuuuu

SEQ ID NO: 1835787 - RNA, 21 nt, Salmonella typhimurium LT2
gcaauaucccgccacuguccu

SEQ ID NO: 1835788 - RNA, 17 nt, Salmonella typhimurium LT2
gcaauaugaaaccgccc

SEQ ID NO: 1835789 - RNA, 17 nt, Salmonella typhimurium LT2
gcaaucacaagcuguuu

SEQ ID NO: 1835790 - RNA, 16 nt, Salmonella typhimurium LT2
gcaaucugaguauuua

SEQ ID NO: 1835791 - RNA, 19 nt, Salmonella typhimurium LT2
gcaaucugaguauuuacag

SEQ ID NO: 1835792 - RNA, 21 nt, Salmonella typhimurium LT2
gcaaucaauacagagauauua

SEQ ID NO: 1835793 - RNA, 15 nt, Salmonella typhimurium LT2
gcaaucuuugccgca

SEQ ID NO: 1835794 - RNA, 18 nt, Salmonella typhimurium LT2
gcacgauauccagcaccu

SEQ ID NO: 1835795 - RNA, 22 nt, Salmonella typhimurium LT2
gcacgccaucgccugauggcgc

SEQ ID NO: 1835796 - RNA, 18 nt, Salmonella typhimurium LT2
gcacgcccaucggcacac

SEQ ID NO: 1835797 - RNA, 22 nt, Salmonella typhimurium LT2
gcaccuucaacagcucgccaug

SEQ ID NO: 1835798 - RNA, 13 nt, Salmonella typhimurium LT2
gcaccuucaucau

SEQ ID NO: 1835799 - RNA, 14 nt, Salmonella typhimurium LT2
gcaccuucaucauu

SEQ ID NO: 1835800 - RNA, 17 nt, Salmonella typhimurium LT2
gcaccuucaucauucac

SEQ ID NO: 1835801 - RNA, 22 nt, Salmonella typhimurium LT2
gcacgacauucugcauggcgcu

SEQ ID NO: 1835802 - RNA, 15 nt, Salmonella typhimurium LT2
gcaccguaaacggcu

SEQ ID NO: 1835803 - RNA, 19 nt, Salmonella typhimurium LT2
gcaccguaucggcagucac

SEQ ID NO: 1835804 - RNA, 20 nt, Salmonella typhimurium LT2
gcaccagcucuacaucgccg

SEQ ID NO: 1835805 - RNA, 16 nt, Salmonella typhimurium LT2
gcaccagcaacacauc

SEQ ID NO: 1835806 - RNA, 16 nt, Salmonella typhimurium LT2
gcaccagaaucauuaa

SEQ ID NO: 1835807 - RNA, 21 nt, Salmonella typhimurium LT2
gcaccagauagcguauuauaa

SEQ ID NO: 1835808 - RNA, 23 nt, Salmonella typhimurium LT2
gcacccggcuuacaacauuguua

SEQ ID NO: 1835809 - RNA, 23 nt, Salmonella typhimurium LT2
gcacgucgguaaagcgcaccagc

SEQ ID NO: 1835810 - RNA, 23 nt, Salmonella typhimurium LT2
gcacguaggccugauaagcgcag

SEQ ID NO: 1835811 - RNA, 17 nt, Salmonella typhimurium LT2
gcacgcuuuggcaggcc

SEQ ID NO: 1835812 - RNA, 15 nt, Salmonella typhimurium LT2
gcacgcuggcaucaa

SEQ ID NO: 1835813 - RNA, 12 nt, Salmonella typhimurium LT2
gcacgcugcgca

SEQ ID NO: 1835814 - RNA, 18 nt, Salmonella typhimurium LT2
gcacgccgcgcucgcuca

SEQ ID NO: 1835815 - RNA, 15 nt, Salmonella typhimurium LT2
gcacgccggccccgc

SEQ ID NO: 1835816 - RNA, 22 nt, Salmonella typhimurium LT2
gcacgcuauauuccagccagga

SEQ ID NO: 1835817 - RNA, 17 nt, Salmonella typhimurium LT2
gcacuacggugugccug

SEQ ID NO: 1835818 - RNA, 17 nt, Salmonella typhimurium LT2
gcacucagaaaauuauu

SEQ ID NO: 1835819 - RNA, 22 nt, Salmonella typhimurium LT2
gcacucagaaaauuauuuuaaa

SEQ ID NO: 1835820 - RNA, 13 nt, Salmonella typhimurium LT2
gcacucaccucuu

SEQ ID NO: 1835821 - RNA, 23 nt, Salmonella typhimurium LT2
gcacguuaaagccgaccaucgcg

SEQ ID NO: 1835822 - RNA, 16 nt, Salmonella typhimurium LT2
gcacuaacagcagcaa

SEQ ID NO: 1835823 - RNA, 22 nt, Salmonella typhimurium LT2
gcacuaacagcagcaacaaacc

SEQ ID NO: 1835824 - RNA, 17 nt, Salmonella typhimurium LT2
gcacugauagccgccag

SEQ ID NO: 1835825 - RNA, 14 nt, Salmonella typhimurium LT2
gcacugacuuacag

SEQ ID NO: 1835826 - RNA, 21 nt, Salmonella typhimurium LT2
gcacugacgucaacucgcggc

SEQ ID NO: 1835827 - RNA, 22 nt, Salmonella typhimurium LT2
gcacugacgucaacucgcggcc

SEQ ID NO: 1835828 - RNA, 20 nt, Salmonella typhimurium LT2
gcacucucaaacuauuuuua

SEQ ID NO: 1835829 - RNA, 18 nt, Salmonella typhimurium LT2
gcacuccccggcuugcgg

SEQ ID NO: 1835830 - RNA, 13 nt, Salmonella typhimurium LT2
gcccgccagcggg

SEQ ID NO: 1835831 - RNA, 13 nt, Salmonella typhimurium LT2
gcccgcaaaagcg

SEQ ID NO: 1835832 - RNA, 15 nt, Salmonella typhimurium LT2
gcccgccucaaacca

SEQ ID NO: 1835833 - RNA, 11 nt, Salmonella typhimurium LT2
gcccgcggcga

SEQ ID NO: 1835834 - RNA, 13 nt, Salmonella typhimurium LT2
gcccgcgcucugg

SEQ ID NO: 1835835 - RNA, 23 nt, Salmonella typhimurium LT2
gcccgcgcuucgcuauuccagag

SEQ ID NO: 1835836 - RNA, 19 nt, Salmonella typhimurium LT2
gcccggacgccguccaggc

SEQ ID NO: 1835837 - RNA, 18 nt, Salmonella typhimurium LT2
gcccggacgaaccuggcg

SEQ ID NO: 1835838 - RNA, 14 nt, Salmonella typhimurium LT2
gcccggcaaacggg

SEQ ID NO: 1835839 - RNA, 22 nt, Salmonella typhimurium LT2
gcccggauaaccgcccgcggcg

SEQ ID NO: 1835840 - RNA, 14 nt, Salmonella typhimurium LT2
gcccggaucgccau

SEQ ID NO: 1835841 - RNA, 20 nt, Salmonella typhimurium LT2
gccccucaauuauguauuuc

SEQ ID NO: 1835842 - RNA, 20 nt, Salmonella typhimurium LT2
gccccucgcuaaugcccggc

SEQ ID NO: 1835843 - RNA, 16 nt, Salmonella typhimurium LT2
gccccggugagcgccg

SEQ ID NO: 1835844 - RNA, 17 nt, Salmonella typhimurium LT2
gccccggugagcgccgc

SEQ ID NO: 1835845 - RNA, 23 nt, Salmonella typhimurium LT2
gccccgucagucgccagaaggca

SEQ ID NO: 1835846 - RNA, 14 nt, Salmonella typhimurium LT2
gccccuaaggcagc

SEQ ID NO: 1835847 - RNA, 17 nt, Salmonella typhimurium LT2
gccccuaaggcagcgag

SEQ ID NO: 1835848 - RNA, 20 nt, Salmonella typhimurium LT2
gccccggucaacgcgccgcc

SEQ ID NO: 1835849 - RNA, 22 nt, Salmonella typhimurium LT2
gccccucuuuuuauuuuauaaa

SEQ ID NO: 1835850 - RNA, 19 nt, Salmonella typhimurium LT2
gcccgauaagcaaagcgcc

SEQ ID NO: 1835851 - RNA, 14 nt, Salmonella typhimurium LT2
gcccgauaagcgcc

SEQ ID NO: 1835852 - RNA, 21 nt, Salmonella typhimurium LT2
gcccgauaagcgcuggcuugc

SEQ ID NO: 1835853 - RNA, 20 nt, Salmonella typhimurium LT2
gcccgguucgaacgacagaa

SEQ ID NO: 1835854 - RNA, 15 nt, Salmonella typhimurium LT2
gcccgguggcgcugc

SEQ ID NO: 1835855 - RNA, 17 nt, Salmonella typhimurium LT2
gcccgguggcgcugcgc

SEQ ID NO: 1835856 - RNA, 16 nt, Salmonella typhimurium LT2
gcccggugugccgcuu

SEQ ID NO: 1835857 - RNA, 16 nt, Salmonella typhimurium LT2
gcccgugacgccaggc

SEQ ID NO: 1835858 - RNA, 14 nt, Salmonella typhimurium LT2
gcccgugacgccag

SEQ ID NO: 1835859 - RNA, 19 nt, Salmonella typhimurium LT2
gcccgugaucggagaaaua

SEQ ID NO: 1835860 - RNA, 23 nt, Salmonella typhimurium LT2
gcccgguagcgcaaacuaccggg

SEQ ID NO: 1835861 - RNA, 15 nt, Salmonella typhimurium LT2
gcccggugauggugc

SEQ ID NO: 1835862 - RNA, 19 nt, Salmonella typhimurium LT2
gcccggugauggugcagcc

SEQ ID NO: 1835863 - RNA, 14 nt, Salmonella typhimurium LT2
gcccgguggcgcug

SEQ ID NO: 1835864 - RNA, 13 nt, Salmonella typhimurium LT2
gcccggcgcggca

SEQ ID NO: 1835865 - RNA, 23 nt, Salmonella typhimurium LT2
gcccggcuccgucauauuuucag

SEQ ID NO: 1835866 - RNA, 14 nt, Salmonella typhimurium LT2
gcccggcuucccau

SEQ ID NO: 1835867 - RNA, 13 nt, Salmonella typhimurium LT2
gcccggcuggcga

SEQ ID NO: 1835868 - RNA, 11 nt, Salmonella typhimurium LT2
gcccggcuggc

SEQ ID NO: 1835869 - RNA, 15 nt, Salmonella typhimurium LT2
gcccggcuuucuguu

SEQ ID NO: 1835870 - RNA, 14 nt, Salmonella typhimurium LT2
gcccggcgccagcu

SEQ ID NO: 1835871 - RNA, 21 nt, Salmonella typhimurium LT2
gcccggcgcacacccugcaga

SEQ ID NO: 1835872 - RNA, 17 nt, Salmonella typhimurium LT2
gcccggcgccauccggc

SEQ ID NO: 1835873 - RNA, 19 nt, Salmonella typhimurium LT2
gcccggcgccauccggcag

SEQ ID NO: 1835874 - RNA, 21 nt, Salmonella typhimurium LT2
gcccggcaggcaucgcgccgc

SEQ ID NO: 1835875 - RNA, 17 nt, Salmonella typhimurium LT2
gcccggccacagcgcca

SEQ ID NO: 1835876 - RNA, 15 nt, Salmonella typhimurium LT2
gcccucgcaaagcug

SEQ ID NO: 1835877 - RNA, 16 nt, Salmonella typhimurium LT2
gcccugcuguuccagu

SEQ ID NO: 1835878 - RNA, 15 nt, Salmonella typhimurium LT2
gcccugccaccagcg

SEQ ID NO: 1835879 - RNA, 13 nt, Salmonella typhimurium LT2
gcccugcaggcgg

SEQ ID NO: 1835880 - RNA, 16 nt, Salmonella typhimurium LT2
gcccugaucccacagc

SEQ ID NO: 1835881 - RNA, 13 nt, Salmonella typhimurium LT2
gcccugcaaaagu

SEQ ID NO: 1835882 - RNA, 23 nt, Salmonella typhimurium LT2
gcccugcaaaaguuugaccagca

SEQ ID NO: 1835883 - RNA, 14 nt, Salmonella typhimurium LT2
gcccuguccuccau

SEQ ID NO: 1835884 - RNA, 19 nt, Salmonella typhimurium LT2
gccgaccaauugcaggcag

SEQ ID NO: 1835885 - RNA, 15 nt, Salmonella typhimurium LT2
gccgacauucccugc

SEQ ID NO: 1835886 - RNA, 18 nt, Salmonella typhimurium LT2
gccgacaucgccaccgca

SEQ ID NO: 1835887 - RNA, 17 nt, Salmonella typhimurium LT2
gccgaccaccauccggc

SEQ ID NO: 1835888 - RNA, 15 nt, Salmonella typhimurium LT2
gccgaccaccagcuu

SEQ ID NO: 1835889 - RNA, 22 nt, Salmonella typhimurium LT2
gccgaccaguaagagaacaaua

SEQ ID NO: 1835890 - RNA, 16 nt, Salmonella typhimurium LT2
gccgaagacuccccug

SEQ ID NO: 1835891 - RNA, 21 nt, Salmonella typhimurium LT2
gccgaacuuacgcaguugauu

SEQ ID NO: 1835892 - RNA, 18 nt, Salmonella typhimurium LT2
gccgaacgcggcuuaucc

SEQ ID NO: 1835893 - RNA, 23 nt, Salmonella typhimurium LT2
gccgaauuuacugugauccacca

SEQ ID NO: 1835894 - RNA, 16 nt, Salmonella typhimurium LT2
gccgaaugacgggccu

SEQ ID NO: 1835895 - RNA, 14 nt, Salmonella typhimurium LT2
gccgacaaccagcg

SEQ ID NO: 1835896 - RNA, 20 nt, Salmonella typhimurium LT2
gcccuguuuuuucgccgcgc

SEQ ID NO: 1835897 - RNA, 21 nt, Salmonella typhimurium LT2
gcccuuacaaaaaucaugcca

SEQ ID NO: 1835898 - RNA, 18 nt, Salmonella typhimurium LT2
gcccugugccgcuggugc

SEQ ID NO: 1835899 - RNA, 24 nt, Salmonella typhimurium LT2
gcccuucguuuuauuugaugccug

SEQ ID NO: 1835900 - RNA, 14 nt, Salmonella typhimurium LT2
gcccuuucaguuca

SEQ ID NO: 1835901 - RNA, 22 nt, Salmonella typhimurium LT2
gcccuuucauuucugccugcuu

SEQ ID NO: 1835902 - RNA, 17 nt, Salmonella typhimurium LT2
gcccuuuaguaaaguua

SEQ ID NO: 1835903 - RNA, 12 nt, Salmonella typhimurium LT2
gccgaacagacg

SEQ ID NO: 1835904 - RNA, 22 nt, Salmonella typhimurium LT2
gccgcaaccaaagccggcgcca

SEQ ID NO: 1835905 - RNA, 21 nt, Salmonella typhimurium LT2
gccgauaaccagcgcgccgcc

SEQ ID NO: 1835906 - RNA, 17 nt, Salmonella typhimurium LT2
gccgauaaccagcgcgc

SEQ ID NO: 1835907 - RNA, 22 nt, Salmonella typhimurium LT2
gccgauaaccagcgcgccgcca

SEQ ID NO: 1835908 - RNA, 16 nt, Salmonella typhimurium LT2
gccgaucaggccgcag

SEQ ID NO: 1835909 - RNA, 17 nt, Salmonella typhimurium LT2
gccgaucaggccgcaga

SEQ ID NO: 1835910 - RNA, 19 nt, Salmonella typhimurium LT2
gccgagggcauugaugguu

SEQ ID NO: 1835911 - RNA, 21 nt, Salmonella typhimurium LT2
gccgaggugguaauuggccug

SEQ ID NO: 1835912 - RNA, 16 nt, Salmonella typhimurium LT2
gccgaggcauucagcc

SEQ ID NO: 1835913 - RNA, 16 nt, Salmonella typhimurium LT2
gccgagcccgaggcga

SEQ ID NO: 1835914 - RNA, 12 nt, Salmonella typhimurium LT2
gccgagcaucgc

SEQ ID NO: 1835915 - RNA, 19 nt, Salmonella typhimurium LT2
gccgacguuaucgccgaca

SEQ ID NO: 1835916 - RNA, 18 nt, Salmonella typhimurium LT2
gccgacgcauuucuccug

SEQ ID NO: 1835917 - RNA, 13 nt, Salmonella typhimurium LT2
gccgccuugcugc

SEQ ID NO: 1835918 - RNA, 23 nt, Salmonella typhimurium LT2
gccgccuuuuugaccgucaucca

SEQ ID NO: 1835919 - RNA, 23 nt, Salmonella typhimurium LT2
gccgcgauacauugucgcagcgc

SEQ ID NO: 1835920 - RNA, 14 nt, Salmonella typhimurium LT2
gccgcgaucgcggc

SEQ ID NO: 1835921 - RNA, 24 nt, Salmonella typhimurium LT2
gccgcgauacauugucgcagcgcu

SEQ ID NO: 1835922 - RNA, 18 nt, Salmonella typhimurium LT2
gccgccggugucuccguc

SEQ ID NO: 1835923 - RNA, 13 nt, Salmonella typhimurium LT2
gccgccuggccug

SEQ ID NO: 1835924 - RNA, 17 nt, Salmonella typhimurium LT2
gccgcgccgacauagcu

SEQ ID NO: 1835925 - RNA, 21 nt, Salmonella typhimurium LT2
gccgcgccggacuccagcaac

SEQ ID NO: 1835926 - RNA, 17 nt, Salmonella typhimurium LT2
gccgcgccggacuccag

SEQ ID NO: 1835927 - RNA, 18 nt, Salmonella typhimurium LT2
gccgcgccgggagcguua

SEQ ID NO: 1835928 - RNA, 14 nt, Salmonella typhimurium LT2
gccgcgcgccgccu

SEQ ID NO: 1835929 - RNA, 15 nt, Salmonella typhimurium LT2
gccgcgcgccgccuc

SEQ ID NO: 1835930 - RNA, 13 nt, Salmonella typhimurium LT2
gccgcgcgccgcc

SEQ ID NO: 1835931 - RNA, 18 nt, Salmonella typhimurium LT2
gccgcgcgccgccucuuc

SEQ ID NO: 1835932 - RNA, 14 nt, Salmonella typhimurium LT2
gccgccgacgccga

SEQ ID NO: 1835933 - RNA, 16 nt, Salmonella typhimurium LT2
gccgccgacaaccagc

SEQ ID NO: 1835934 - RNA, 15 nt, Salmonella typhimurium LT2
gccgccgacaggaug

SEQ ID NO: 1835935 - RNA, 14 nt, Salmonella typhimurium LT2
gccgccgccugcca

SEQ ID NO: 1835936 - RNA, 18 nt, Salmonella typhimurium LT2
gccgccgggucaccgggg

SEQ ID NO: 1835937 - RNA, 16 nt, Salmonella typhimurium LT2
gccggaacucuuguua

SEQ ID NO: 1835938 - RNA, 16 nt, Salmonella typhimurium LT2
gccggaauagcaggca

SEQ ID NO: 1835939 - RNA, 17 nt, Salmonella typhimurium LT2
gccggaugugagcgcau

SEQ ID NO: 1835940 - RNA, 22 nt, Salmonella typhimurium LT2
gccggaugugagcgcauccggc

SEQ ID NO: 1835941 - RNA, 13 nt, Salmonella typhimurium LT2
gccggcagccugc

SEQ ID NO: 1835942 - RNA, 18 nt, Salmonella typhimurium LT2
gccggagaccugucgccg

SEQ ID NO: 1835943 - RNA, 12 nt, Salmonella typhimurium LT2
gccggagaccuu

SEQ ID NO: 1835944 - RNA, 14 nt, Salmonella typhimurium LT2
gccggagaccuuuu

SEQ ID NO: 1835945 - RNA, 13 nt, Salmonella typhimurium LT2
gccggaugguggu

SEQ ID NO: 1835946 - RNA, 13 nt, Salmonella typhimurium LT2
gccggauggcggc

SEQ ID NO: 1835947 - RNA, 18 nt, Salmonella typhimurium LT2
gccggauggggcaucagc

SEQ ID NO: 1835948 - RNA, 12 nt, Salmonella typhimurium LT2
gccggauggcgc

SEQ ID NO: 1835949 - RNA, 13 nt, Salmonella typhimurium LT2
gccggauggcggu

SEQ ID NO: 1835950 - RNA, 22 nt, Salmonella typhimurium LT2
gccggauggcgguacagcgagc

SEQ ID NO: 1835951 - RNA, 23 nt, Salmonella typhimurium LT2
gccggauggcgguacagcgagcu

SEQ ID NO: 1835952 - RNA, 14 nt, Salmonella typhimurium LT2
gccgcgcugguugg

SEQ ID NO: 1835953 - RNA, 18 nt, Salmonella typhimurium LT2
gccgcucgaaucgccaug

SEQ ID NO: 1835954 - RNA, 19 nt, Salmonella typhimurium LT2
gccgcucaggguaaucacc

SEQ ID NO: 1835955 - RNA, 20 nt, Salmonella typhimurium LT2
gccgcuaucugcuccgccag

SEQ ID NO: 1835956 - RNA, 19 nt, Salmonella typhimurium LT2
gccgcuaugcaauuguucc

SEQ ID NO: 1835957 - RNA, 13 nt, Salmonella typhimurium LT2
gccgcgugcucgc

SEQ ID NO: 1835958 - RNA, 16 nt, Salmonella typhimurium LT2
gccgcgugcucgcggc

SEQ ID NO: 1835959 - RNA, 16 nt, Salmonella typhimurium LT2
gccggucgccagcaua

SEQ ID NO: 1835960 - RNA, 13 nt, Salmonella typhimurium LT2
gccggugccgcaa

SEQ ID NO: 1835961 - RNA, 23 nt, Salmonella typhimurium LT2
gccggugcgagaaaaagcaauaa

SEQ ID NO: 1835962 - RNA, 20 nt, Salmonella typhimurium LT2
gccgggcgucacccgccggc

SEQ ID NO: 1835963 - RNA, 20 nt, Salmonella typhimurium LT2
gccgggcggcuguguccgcc

SEQ ID NO: 1835964 - RNA, 18 nt, Salmonella typhimurium LT2
gccgguagcuucagcggc

SEQ ID NO: 1835965 - RNA, 19 nt, Salmonella typhimurium LT2
gccgguacuggagaccggc

SEQ ID NO: 1835966 - RNA, 15 nt, Salmonella typhimurium LT2
gccgguacgcagcag

SEQ ID NO: 1835967 - RNA, 18 nt, Salmonella typhimurium LT2
gccgggaacugacagcag

SEQ ID NO: 1835968 - RNA, 23 nt, Salmonella typhimurium LT2
gccggcuaucuucuuccggcgcg

SEQ ID NO: 1835969 - RNA, 15 nt, Salmonella typhimurium LT2
gccgucgacaaagcc

SEQ ID NO: 1835970 - RNA, 20 nt, Salmonella typhimurium LT2
gccgucgaugauggcggcua

SEQ ID NO: 1835971 - RNA, 15 nt, Salmonella typhimurium LT2
gccgucgcaggcggc

SEQ ID NO: 1835972 - RNA, 15 nt, Salmonella typhimurium LT2
gccguuaauuuucac

SEQ ID NO: 1835973 - RNA, 22 nt, Salmonella typhimurium LT2
gccguucauucgccccagcaua

SEQ ID NO: 1835974 - RNA, 15 nt, Salmonella typhimurium LT2
gccguucauuugcaa

SEQ ID NO: 1835975 - RNA, 22 nt, Salmonella typhimurium LT2
gccguuacugcucguagcguuu

SEQ ID NO: 1835976 - RNA, 15 nt, Salmonella typhimurium LT2
gccgugaacgccaaa

SEQ ID NO: 1835977 - RNA, 13 nt, Salmonella typhimurium LT2
gccgucuucuucu

SEQ ID NO: 1835978 - RNA, 20 nt, Salmonella typhimurium LT2
gccgucuggggaaaccugaa

SEQ ID NO: 1835979 - RNA, 19 nt, Salmonella typhimurium LT2
gccgugcgccgacaucgcc

SEQ ID NO: 1835980 - RNA, 16 nt, Salmonella typhimurium LT2
gccgugcucauccaac

SEQ ID NO: 1835981 - RNA, 22 nt, Salmonella typhimurium LT2
gccgugcucauccaacugcgcc

SEQ ID NO: 1835982 - RNA, 17 nt, Salmonella typhimurium LT2
gccguaaacaggcaggc

SEQ ID NO: 1835983 - RNA, 17 nt, Salmonella typhimurium LT2
gccguaaauugagugga

SEQ ID NO: 1835984 - RNA, 24 nt, Salmonella typhimurium LT2
gccguaacgugcuccagcgccugc

SEQ ID NO: 1835985 - RNA, 21 nt, Salmonella typhimurium LT2
gccgguucggccagucgcaga

SEQ ID NO: 1835986 - RNA, 16 nt, Salmonella typhimurium LT2
gccgguugcgcugguu

SEQ ID NO: 1835987 - RNA, 20 nt, Salmonella typhimurium LT2
gccgguuccggcauaaauaa

SEQ ID NO: 1835988 - RNA, 17 nt, Salmonella typhimurium LT2
gccgguuagcgccgcgu

SEQ ID NO: 1835989 - RNA, 18 nt, Salmonella typhimurium LT2
gccgguuauaccgccauc

SEQ ID NO: 1835990 - RNA, 19 nt, Salmonella typhimurium LT2
gccguagcgcgcuuccugc

SEQ ID NO: 1835991 - RNA, 13 nt, Salmonella typhimurium LT2
gccguaggagaua

SEQ ID NO: 1835992 - RNA, 22 nt, Salmonella typhimurium LT2
gccguauuucacuuuugccggu

SEQ ID NO: 1835993 - RNA, 23 nt, Salmonella typhimurium LT2
gccguauaccagcgucagcgggc

SEQ ID NO: 1835994 - RNA, 17 nt, Salmonella typhimurium LT2
gccgucagugagcccuc

SEQ ID NO: 1835995 - RNA, 16 nt, Salmonella typhimurium LT2
gccgucauccagcagc

SEQ ID NO: 1835996 - RNA, 22 nt, Salmonella typhimurium LT2
gcaucgguagaaugaauguagc

SEQ ID NO: 1835997 - RNA, 18 nt, Salmonella typhimurium LT2
gcaucgcgccgccgggcu

SEQ ID NO: 1835998 - RNA, 19 nt, Salmonella typhimurium LT2
gcaucgccgggaacagaau

SEQ ID NO: 1835999 - RNA, 22 nt, Salmonella typhimurium LT2
gcaucuaauuaaaaagagaaaa

SEQ ID NO: 1836000 - RNA, 14 nt, Salmonella typhimurium LT2
gcaucguagucagg

SEQ ID NO: 1836001 - RNA, 17 nt, Salmonella typhimurium LT2
gcaucguagucaggcag

SEQ ID NO: 1836002 - RNA, 15 nt, Salmonella typhimurium LT2
gcaucgugagcgcgu

SEQ ID NO: 1836003 - RNA, 15 nt, Salmonella typhimurium LT2
gcaucugccggcacg

SEQ ID NO: 1836004 - RNA, 12 nt, Salmonella typhimurium LT2
gcaucugucauc

SEQ ID NO: 1836005 - RNA, 16 nt, Salmonella typhimurium LT2
gcaucucguaaaucaa

SEQ ID NO: 1836006 - RNA, 22 nt, Salmonella typhimurium LT2
gcaucugaaaaaccuccggcua

SEQ ID NO: 1836007 - RNA, 13 nt, Salmonella typhimurium LT2
gcaucugaccuac

SEQ ID NO: 1836008 - RNA, 12 nt, Salmonella typhimurium LT2
gcaugccgcagg

SEQ ID NO: 1836009 - RNA, 22 nt, Salmonella typhimurium LT2
gcaugccccucgacaggaguau

SEQ ID NO: 1836010 - RNA, 22 nt, Salmonella typhimurium LT2
gcaugcgccccguuuccgcgac

SEQ ID NO: 1836011 - RNA, 13 nt, Salmonella typhimurium LT2
gcaugauuacaga

SEQ ID NO: 1836012 - RNA, 12 nt, Salmonella typhimurium LT2
gcaugauuaaua

SEQ ID NO: 1836013 - RNA, 18 nt, Salmonella typhimurium LT2
gcaugagguuaguaaugc

SEQ ID NO: 1836014 - RNA, 17 nt, Salmonella typhimurium LT2
gcaugaucuauccaaua

SEQ ID NO: 1836015 - RNA, 22 nt, Salmonella typhimurium LT2
gcaugaucauacugccgccgug

SEQ ID NO: 1836016 - RNA, 13 nt, Salmonella typhimurium LT2
gcaucuucagaca

SEQ ID NO: 1836017 - RNA, 17 nt, Salmonella typhimurium LT2
gcaucuuaagaaaauuc

SEQ ID NO: 1836018 - RNA, 18 nt, Salmonella typhimurium LT2
gcaucuuccucugugccg

SEQ ID NO: 1836019 - RNA, 19 nt, Salmonella typhimurium LT2
gcaucuuuggcuuuaugaa

SEQ ID NO: 1836020 - RNA, 13 nt, Salmonella typhimurium LT2
gcaucuuuugccg

SEQ ID NO: 1836021 - RNA, 20 nt, Salmonella typhimurium LT2
gcaugaauaauuucuucuuu

SEQ ID NO: 1836022 - RNA, 13 nt, Salmonella typhimurium LT2
gcaugaauaucaa

SEQ ID NO: 1836023 - RNA, 16 nt, Salmonella typhimurium LT2
gcaugaacguucgccu

SEQ ID NO: 1836024 - RNA, 16 nt, Salmonella typhimurium LT2
gcaugaagcagcaggc

SEQ ID NO: 1836025 - RNA, 15 nt, Salmonella typhimurium LT2
gcaugaauucaacgc

SEQ ID NO: 1836026 - RNA, 14 nt, Salmonella typhimurium LT2
gcaugaccauccac

SEQ ID NO: 1836027 - RNA, 14 nt, Salmonella typhimurium LT2
gcaugacccaggca

SEQ ID NO: 1836028 - RNA, 23 nt, Salmonella typhimurium LT2
gcaugguuacgcgacgugcugug

SEQ ID NO: 1836029 - RNA, 16 nt, Salmonella typhimurium LT2
gcauguccggcgacuc

SEQ ID NO: 1836030 - RNA, 19 nt, Salmonella typhimurium LT2
gcauguccggcgacuccag

SEQ ID NO: 1836031 - RNA, 18 nt, Salmonella typhimurium LT2
gcaugucguauccccagu

SEQ ID NO: 1836032 - RNA, 12 nt, Salmonella typhimurium LT2
gcaugugaguau

SEQ ID NO: 1836033 - RNA, 15 nt, Salmonella typhimurium LT2
gcauuaacguccaua

SEQ ID NO: 1836034 - RNA, 17 nt, Salmonella typhimurium LT2
gcauuaacguccauacc

SEQ ID NO: 1836035 - RNA, 15 nt, Salmonella typhimurium LT2
gcauuaauuucuugc

SEQ ID NO: 1836036 - RNA, 13 nt, Salmonella typhimurium LT2
gcauuaauuucuu

SEQ ID NO: 1836037 - RNA, 22 nt, Salmonella typhimurium LT2
gcauuaauaugcgcaaucaccc

SEQ ID NO: 1836038 - RNA, 14 nt, Salmonella typhimurium LT2
gcauuaggcuuuuc

SEQ ID NO: 1836039 - RNA, 15 nt, Salmonella typhimurium LT2
gcauuacccccgcca

SEQ ID NO: 1836040 - RNA, 23 nt, Salmonella typhimurium LT2
gcauggugacuccccacaauccc

SEQ ID NO: 1836041 - RNA, 18 nt, Salmonella typhimurium LT2
gcaugguguucagauggc

SEQ ID NO: 1836042 - RNA, 14 nt, Salmonella typhimurium LT2
gcauggggagaccc

SEQ ID NO: 1836043 - RNA, 17 nt, Salmonella typhimurium LT2
gcauggcggucagcuuu

SEQ ID NO: 1836044 - RNA, 23 nt, Salmonella typhimurium LT2
gcauggcgucucagcggagugcu

SEQ ID NO: 1836045 - RNA, 21 nt, Salmonella typhimurium LT2
gcaugggauacgccagcagac

SEQ ID NO: 1836046 - RNA, 23 nt, Salmonella typhimurium LT2
gcauggcagccccggcauccagu

SEQ ID NO: 1836047 - RNA, 23 nt, Salmonella typhimurium LT2
gcauggcagauaaaccacgccgu

SEQ ID NO: 1836048 - RNA, 20 nt, Salmonella typhimurium LT2
gcauuauacgccuauuuucu

SEQ ID NO: 1836049 - RNA, 12 nt, Salmonella typhimurium LT2
gcauucacgccg

SEQ ID NO: 1836050 - RNA, 18 nt, Salmonella typhimurium LT2
gcauuauucggcuuuuac

SEQ ID NO: 1836051 - RNA, 16 nt, Salmonella typhimurium LT2
gcauuccccaucgcga

SEQ ID NO: 1836052 - RNA, 14 nt, Salmonella typhimurium LT2
gcauucagccagcu

SEQ ID NO: 1836053 - RNA, 16 nt, Salmonella typhimurium LT2
gcauucaguuugcaac

SEQ ID NO: 1836054 - RNA, 20 nt, Salmonella typhimurium LT2
gcauucuuugcuuuguaaag

SEQ ID NO: 1836055 - RNA, 23 nt, Salmonella typhimurium LT2
gcauucuuugcuuuguaaagcgc

SEQ ID NO: 1836056 - RNA, 12 nt, Salmonella typhimurium LT2
gcauucuuuuag

SEQ ID NO: 1836057 - RNA, 14 nt, Salmonella typhimurium LT2
gcauucgcuccuca

SEQ ID NO: 1836058 - RNA, 14 nt, Salmonella typhimurium LT2
gcauucgcuugccc

SEQ ID NO: 1836059 - RNA, 20 nt, Salmonella typhimurium LT2
gcauuuaucuuuaaacuuuu

SEQ ID NO: 1836060 - RNA, 19 nt, Salmonella typhimurium LT2
gcauuucaaagcguucuga

SEQ ID NO: 1836061 - RNA, 16 nt, Salmonella typhimurium LT2
gcauugccggaaacca

SEQ ID NO: 1836062 - RNA, 20 nt, Salmonella typhimurium LT2
gcauugcccuguaaggggca

SEQ ID NO: 1836063 - RNA, 18 nt, Salmonella typhimurium LT2
gcauugggauggauaaau

SEQ ID NO: 1836064 - RNA, 15 nt, Salmonella typhimurium LT2
gcauugguaaauccg

SEQ ID NO: 1836065 - RNA, 18 nt, Salmonella typhimurium LT2
gccaaaucuguucugucc

SEQ ID NO: 1836066 - RNA, 13 nt, Salmonella typhimurium LT2
gccaaauccggcu

SEQ ID NO: 1836067 - RNA, 13 nt, Salmonella typhimurium LT2
gccaaccagaccg

SEQ ID NO: 1836068 - RNA, 16 nt, Salmonella typhimurium LT2
gccaagcgcggcagca

SEQ ID NO: 1836069 - RNA, 19 nt, Salmonella typhimurium LT2
gccaagcggcaucucgcca

SEQ ID NO: 1836070 - RNA, 12 nt, Salmonella typhimurium LT2
gccaagcgcggc

SEQ ID NO: 1836071 - RNA, 14 nt, Salmonella typhimurium LT2
gccaagcgccucgc

SEQ ID NO: 1836072 - RNA, 17 nt, Salmonella typhimurium LT2
gccaagcgcggacagca

SEQ ID NO: 1836073 - RNA, 17 nt, Salmonella typhimurium LT2
gccaagcagcgccacgc

SEQ ID NO: 1836074 - RNA, 16 nt, Salmonella typhimurium LT2
gccaagcaccuagguu

SEQ ID NO: 1836075 - RNA, 14 nt, Salmonella typhimurium LT2
gccaacuuuuucuu

SEQ ID NO: 1836076 - RNA, 20 nt, Salmonella typhimurium LT2
gccaagaccgccuaacagcg

SEQ ID NO: 1836077 - RNA, 17 nt, Salmonella typhimurium LT2
gccaacgcguuugcccu

SEQ ID NO: 1836078 - RNA, 21 nt, Salmonella typhimurium LT2
gccaacggcccaaucaacgca

SEQ ID NO: 1836079 - RNA, 14 nt, Salmonella typhimurium LT2
gccaacguugaaaa

SEQ ID NO: 1836080 - RNA, 20 nt, Salmonella typhimurium LT2
gccaaaacccagaaucagca

SEQ ID NO: 1836081 - RNA, 14 nt, Salmonella typhimurium LT2
gccaaaccacugau

SEQ ID NO: 1836082 - RNA, 15 nt, Salmonella typhimurium LT2
gccaaaccagacccg

SEQ ID NO: 1836083 - RNA, 14 nt, Salmonella typhimurium LT2
gccaaacacccagc

SEQ ID NO: 1836084 - RNA, 17 nt, Salmonella typhimurium LT2
gccaaacuccaccugau

SEQ ID NO: 1836085 - RNA, 17 nt, Salmonella typhimurium LT2
gccaaacccgccacagg

SEQ ID NO: 1836086 - RNA, 19 nt, Salmonella typhimurium LT2
gccaaacccgccacaggcc

SEQ ID NO: 1836087 - RNA, 16 nt, Salmonella typhimurium LT2
gccaaacgccgcaacc

SEQ ID NO: 1836088 - RNA, 17 nt, Salmonella typhimurium LT2
gccaaagggagcagacu

SEQ ID NO: 1836089 - RNA, 20 nt, Salmonella typhimurium LT2
gccaaauacgucgcacggau

SEQ ID NO: 1836090 - RNA, 15 nt, Salmonella typhimurium LT2
gccaaaucagcagga

SEQ ID NO: 1836091 - RNA, 20 nt, Salmonella typhimurium LT2
gccaaagaaacgcugaucua

SEQ ID NO: 1836092 - RNA, 15 nt, Salmonella typhimurium LT2
gcauuuuuucuucag

SEQ ID NO: 1836093 - RNA, 21 nt, Salmonella typhimurium LT2
gcauuuuuaucagaccugccu

SEQ ID NO: 1836094 - RNA, 16 nt, Salmonella typhimurium LT2
gcauuuuuaagcuggc

SEQ ID NO: 1836095 - RNA, 17 nt, Salmonella typhimurium LT2
gcauuuuuacucagcac

SEQ ID NO: 1836096 - RNA, 16 nt, Salmonella typhimurium LT2
gcauuucuaccggcag

SEQ ID NO: 1836097 - RNA, 17 nt, Salmonella typhimurium LT2
gcauuucgccaguucca

SEQ ID NO: 1836098 - RNA, 20 nt, Salmonella typhimurium LT2
gcauuugcguccauaucaga

SEQ ID NO: 1836099 - RNA, 18 nt, Salmonella typhimurium LT2
gcauuugcuuucaucaau

SEQ ID NO: 1836100 - RNA, 16 nt, Salmonella typhimurium LT2
gccacacucucuccag

SEQ ID NO: 1836101 - RNA, 21 nt, Salmonella typhimurium LT2
gccacagauuguacugcgcca

SEQ ID NO: 1836102 - RNA, 23 nt, Salmonella typhimurium LT2
gccaccaaaaacgcccccagaua

SEQ ID NO: 1836103 - RNA, 13 nt, Salmonella typhimurium LT2
gccaccacaaagc

SEQ ID NO: 1836104 - RNA, 12 nt, Salmonella typhimurium LT2
gccaccaaaaac

SEQ ID NO: 1836105 - RNA, 20 nt, Salmonella typhimurium LT2
gccacagcgccagacacugg

SEQ ID NO: 1836106 - RNA, 12 nt, Salmonella typhimurium LT2
gccacagccgca

SEQ ID NO: 1836107 - RNA, 18 nt, Salmonella typhimurium LT2
gccacagccaggccgcgc

SEQ ID NO: 1836108 - RNA, 18 nt, Salmonella typhimurium LT2
gccaccaucuuuuuugcg

SEQ ID NO: 1836109 - RNA, 17 nt, Salmonella typhimurium LT2
gccaccaugaucaccug

SEQ ID NO: 1836110 - RNA, 21 nt, Salmonella typhimurium LT2
gccaccaugaucaccugaagc

SEQ ID NO: 1836111 - RNA, 16 nt, Salmonella typhimurium LT2
gccaccaucgucgcca

SEQ ID NO: 1836112 - RNA, 14 nt, Salmonella typhimurium LT2
gccaaucgccgccg

SEQ ID NO: 1836113 - RNA, 13 nt, Salmonella typhimurium LT2
gccaaucacugcg

SEQ ID NO: 1836114 - RNA, 15 nt, Salmonella typhimurium LT2
gccaaucaaccgcau

SEQ ID NO: 1836115 - RNA, 16 nt, Salmonella typhimurium LT2
gccaaucaaccgcauc

SEQ ID NO: 1836116 - RNA, 17 nt, Salmonella typhimurium LT2
gccaaucaacgccgcca

SEQ ID NO: 1836117 - RNA, 14 nt, Salmonella typhimurium LT2
gccaauagcaauga

SEQ ID NO: 1836118 - RNA, 20 nt, Salmonella typhimurium LT2
gccaaucaccgccagcaacg

SEQ ID NO: 1836119 - RNA, 17 nt, Salmonella typhimurium LT2
gccaauauagccgaugg

SEQ ID NO: 1836120 - RNA, 21 nt, Salmonella typhimurium LT2
gccacaaaggaucauuggcca

SEQ ID NO: 1836121 - RNA, 13 nt, Salmonella typhimurium LT2
gccacaaaggccu

SEQ ID NO: 1836122 - RNA, 14 nt, Salmonella typhimurium LT2
gccacaauugccag

SEQ ID NO: 1836123 - RNA, 16 nt, Salmonella typhimurium LT2
gccacaauugccagca

SEQ ID NO: 1836124 - RNA, 18 nt, Salmonella typhimurium LT2
gccacaauugccagcagg

SEQ ID NO: 1836125 - RNA, 21 nt, Salmonella typhimurium LT2
gccacaaugggggcauaauac

SEQ ID NO: 1836126 - RNA, 17 nt, Salmonella typhimurium LT2
gccacaauggcaggcag

SEQ ID NO: 1836127 - RNA, 18 nt, Salmonella typhimurium LT2
gccaaugccugacgccac

SEQ ID NO: 1836128 - RNA, 19 nt, Salmonella typhimurium LT2
gccaaugccugacgccacc

SEQ ID NO: 1836129 - RNA, 22 nt, Salmonella typhimurium LT2
gccaauggcucaacuccgccgg

SEQ ID NO: 1836130 - RNA, 15 nt, Salmonella typhimurium LT2
gccaauuccgccaua

SEQ ID NO: 1836131 - RNA, 22 nt, Salmonella typhimurium LT2
gccacuucacuggcggcaagcu

SEQ ID NO: 1836132 - RNA, 12 nt, Salmonella typhimurium LT2
gccacuuccuga

SEQ ID NO: 1836133 - RNA, 18 nt, Salmonella typhimurium LT2
gccacuucuuccagcggc

SEQ ID NO: 1836134 - RNA, 14 nt, Salmonella typhimurium LT2
gccagaaaagaacc

SEQ ID NO: 1836135 - RNA, 21 nt, Salmonella typhimurium LT2
gccaccggcagcgucguccag

SEQ ID NO: 1836136 - RNA, 13 nt, Salmonella typhimurium LT2
gccacugcgccau

SEQ ID NO: 1836137 - RNA, 17 nt, Salmonella typhimurium LT2
gccaccggcacauccag

SEQ ID NO: 1836138 - RNA, 18 nt, Salmonella typhimurium LT2
gccacuuccagcgcgccg

SEQ ID NO: 1836139 - RNA, 11 nt, Salmonella typhimurium LT2
gccacuguucg

SEQ ID NO: 1836140 - RNA, 12 nt, Salmonella typhimurium LT2
gccacuguccug

SEQ ID NO: 1836141 - RNA, 13 nt, Salmonella typhimurium LT2
gccacuguccuga

SEQ ID NO: 1836142 - RNA, 16 nt, Salmonella typhimurium LT2
gccagcaacccaccug

SEQ ID NO: 1836143 - RNA, 14 nt, Salmonella typhimurium LT2
gccagaggaaaucc

SEQ ID NO: 1836144 - RNA, 16 nt, Salmonella typhimurium LT2
gccagagcgcgcuggc

SEQ ID NO: 1836145 - RNA, 10 nt, Salmonella typhimurium LT2
gccagagaaa

SEQ ID NO: 1836146 - RNA, 14 nt, Salmonella typhimurium LT2
gccagacucagcca

SEQ ID NO: 1836147 - RNA, 21 nt, Salmonella typhimurium LT2
gccagacucagccaggucuga

SEQ ID NO: 1836148 - RNA, 20 nt, Salmonella typhimurium LT2
gccagacgccgcgccgcggc

SEQ ID NO: 1836149 - RNA, 18 nt, Salmonella typhimurium LT2
gccagccaaaacgucgug

SEQ ID NO: 1836150 - RNA, 14 nt, Salmonella typhimurium LT2
gccagccaaagcug

SEQ ID NO: 1836151 - RNA, 13 nt, Salmonella typhimurium LT2
gccagccagccgu

SEQ ID NO: 1836152 - RNA, 22 nt, Salmonella typhimurium LT2
gccagcccagcgcaaccugcgc

SEQ ID NO: 1836153 - RNA, 14 nt, Salmonella typhimurium LT2
gccagccccagccc

SEQ ID NO: 1836154 - RNA, 22 nt, Salmonella typhimurium LT2
gccagcccgaucaucuccugua

SEQ ID NO: 1836155 - RNA, 22 nt, Salmonella typhimurium LT2
gccagccgacgcucuuccucaa

SEQ ID NO: 1836156 - RNA, 12 nt, Salmonella typhimurium LT2
gccagccgcagc

SEQ ID NO: 1836157 - RNA, 23 nt, Salmonella typhimurium LT2
gccagcccgugaucggagaaaua

SEQ ID NO: 1836158 - RNA, 15 nt, Salmonella typhimurium LT2
gccagcccuuccagc

SEQ ID NO: 1836159 - RNA, 18 nt, Salmonella typhimurium LT2
gccagcagcgcaucaucc

SEQ ID NO: 1836160 - RNA, 15 nt, Salmonella typhimurium LT2
gccagcaugauaaug

SEQ ID NO: 1836161 - RNA, 16 nt, Salmonella typhimurium LT2
gccagcaugguuaaaa

SEQ ID NO: 1836162 - RNA, 11 nt, Salmonella typhimurium LT2
gccagcaguug

SEQ ID NO: 1836163 - RNA, 23 nt, Salmonella typhimurium LT2
gccagcaguuuuucaaucuuagc

SEQ ID NO: 1836164 - RNA, 17 nt, Salmonella typhimurium LT2
gccagcauacaaagcag

SEQ ID NO: 1836165 - RNA, 15 nt, Salmonella typhimurium LT2
gccagcauacagcuu

SEQ ID NO: 1836166 - RNA, 17 nt, Salmonella typhimurium LT2
gccaggcuaagaucgcc

SEQ ID NO: 1836167 - RNA, 21 nt, Salmonella typhimurium LT2
gccagggcgggauccccugcu

SEQ ID NO: 1836168 - RNA, 14 nt, Salmonella typhimurium LT2
gccaggcgcggcgc

SEQ ID NO: 1836169 - RNA, 16 nt, Salmonella typhimurium LT2
gccaggcgcggcgcgc

SEQ ID NO: 1836170 - RNA, 16 nt, Salmonella typhimurium LT2
gccaggcaaucagcag

SEQ ID NO: 1836171 - RNA, 17 nt, Salmonella typhimurium LT2
gccaggcaaccugucag

SEQ ID NO: 1836172 - RNA, 12 nt, Salmonella typhimurium LT2
gccagccuuccc

SEQ ID NO: 1836173 - RNA, 14 nt, Salmonella typhimurium LT2
gccagcgagaaguc

SEQ ID NO: 1836174 - RNA, 17 nt, Salmonella typhimurium LT2
gccagcgacaucccaga

SEQ ID NO: 1836175 - RNA, 23 nt, Salmonella typhimurium LT2
gccagcgagacuuuugccggaga

SEQ ID NO: 1836176 - RNA, 20 nt, Salmonella typhimurium LT2
gccagcgccggcgaaucacc

SEQ ID NO: 1836177 - RNA, 16 nt, Salmonella typhimurium LT2
gccagcucaaaucgcg

SEQ ID NO: 1836178 - RNA, 21 nt, Salmonella typhimurium LT2
gccagcucaaaucgcggcgcu

SEQ ID NO: 1836179 - RNA, 16 nt, Salmonella typhimurium LT2
gccagcguugaccagc

SEQ ID NO: 1836180 - RNA, 15 nt, Salmonella typhimurium LT2
gccagcguugcccau

SEQ ID NO: 1836181 - RNA, 16 nt, Salmonella typhimurium LT2
gccagcucuuuucugg

SEQ ID NO: 1836182 - RNA, 21 nt, Salmonella typhimurium LT2
gccagcggccacagccaggcc

SEQ ID NO: 1836183 - RNA, 18 nt, Salmonella typhimurium LT2
gccagcgucucagcaggc

SEQ ID NO: 1836184 - RNA, 16 nt, Salmonella typhimurium LT2
gccagcgugacccaga

SEQ ID NO: 1836185 - RNA, 18 nt, Salmonella typhimurium LT2
gccagcgugacccagaca

SEQ ID NO: 1836186 - RNA, 22 nt, Salmonella typhimurium LT2
gccagcgcguuuuccauuuuac

SEQ ID NO: 1836187 - RNA, 19 nt, Salmonella typhimurium LT2
gccagcgcguuuuccauuu

SEQ ID NO: 1836188 - RNA, 14 nt, Salmonella typhimurium LT2
gccaugucuucacu

SEQ ID NO: 1836189 - RNA, 16 nt, Salmonella typhimurium LT2
gccaugucuucacucu

SEQ ID NO: 1836190 - RNA, 20 nt, Salmonella typhimurium LT2
gccauguuaauaccagcgcc

SEQ ID NO: 1836191 - RNA, 19 nt, Salmonella typhimurium LT2
gccauguugcguaaauaaa

SEQ ID NO: 1836192 - RNA, 14 nt, Salmonella typhimurium LT2
gccauuaucaccau

SEQ ID NO: 1836193 - RNA, 20 nt, Salmonella typhimurium LT2
gccauuaaugcaggcagcac

SEQ ID NO: 1836194 - RNA, 19 nt, Salmonella typhimurium LT2
gccauuaaugcaggcagca

SEQ ID NO: 1836195 - RNA, 13 nt, Salmonella typhimurium LT2
gccauuaaccaga

SEQ ID NO: 1836196 - RNA, 17 nt, Salmonella typhimurium LT2
gccauuccgcagaagcc

SEQ ID NO: 1836197 - RNA, 15 nt, Salmonella typhimurium LT2
gccauucgcuuccgc

SEQ ID NO: 1836198 - RNA, 15 nt, Salmonella typhimurium LT2
gccauucgaauucug

SEQ ID NO: 1836199 - RNA, 15 nt, Salmonella typhimurium LT2
gccauuccagccggu

SEQ ID NO: 1836200 - RNA, 12 nt, Salmonella typhimurium LT2
gccauuccagcg

SEQ ID NO: 1836201 - RNA, 12 nt, Salmonella typhimurium LT2
gccauuccagcu

SEQ ID NO: 1836202 - RNA, 13 nt, Salmonella typhimurium LT2
gccauggccgcag

SEQ ID NO: 1836203 - RNA, 16 nt, Salmonella typhimurium LT2
gccaugaucgccgcca

SEQ ID NO: 1836204 - RNA, 16 nt, Salmonella typhimurium LT2
gccaucuucacgcagc

SEQ ID NO: 1836205 - RNA, 22 nt, Salmonella typhimurium LT2
gccaugaccauucgcacuccag

SEQ ID NO: 1836206 - RNA, 20 nt, Salmonella typhimurium LT2
gccaugagacgcguaaauca

SEQ ID NO: 1836207 - RNA, 15 nt, Salmonella typhimurium LT2
gccaucuuuuuucac

SEQ ID NO: 1836208 - RNA, 14 nt, Salmonella typhimurium LT2
gccaugaaaaaaac

SEQ ID NO: 1836209 - RNA, 14 nt, Salmonella typhimurium LT2
gccaucagcaccuu

SEQ ID NO: 1836210 - RNA, 13 nt, Salmonella typhimurium LT2
gccaucaggcacu

SEQ ID NO: 1836211 - RNA, 19 nt, Salmonella typhimurium LT2
gccaucaggcaugccaaac

SEQ ID NO: 1836212 - RNA, 16 nt, Salmonella typhimurium LT2
gccaucaugcaggccg

SEQ ID NO: 1836213 - RNA, 21 nt, Salmonella typhimurium LT2
gccaucaugcccacaggcagg

SEQ ID NO: 1836214 - RNA, 23 nt, Salmonella typhimurium LT2
gccaucaggcgguuuauccggcg

SEQ ID NO: 1836215 - RNA, 15 nt, Salmonella typhimurium LT2
gccaucgacagcgcc

SEQ ID NO: 1836216 - RNA, 14 nt, Salmonella typhimurium LT2
gccauccucacgca

SEQ ID NO: 1836217 - RNA, 22 nt, Salmonella typhimurium LT2
gccauccuguucaagcaauaau

SEQ ID NO: 1836218 - RNA, 13 nt, Salmonella typhimurium LT2
gccaucuccugcg

SEQ ID NO: 1836219 - RNA, 14 nt, Salmonella typhimurium LT2
gccaucucauucgc

SEQ ID NO: 1836220 - RNA, 17 nt, Salmonella typhimurium LT2
gccaucucauucgccag

SEQ ID NO: 1836221 - RNA, 15 nt, Salmonella typhimurium LT2
gccaucguccagcca

SEQ ID NO: 1836222 - RNA, 23 nt, Salmonella typhimurium LT2
gccagguuuuacucugaucgaga

SEQ ID NO: 1836223 - RNA, 22 nt, Salmonella typhimurium LT2
gccagguugcgcccggcgcauc

SEQ ID NO: 1836224 - RNA, 18 nt, Salmonella typhimurium LT2
gccagguugcgcccggcg

SEQ ID NO: 1836225 - RNA, 13 nt, Salmonella typhimurium LT2
gccaguccagguu

SEQ ID NO: 1836226 - RNA, 13 nt, Salmonella typhimurium LT2
gccagucaucgcc

SEQ ID NO: 1836227 - RNA, 14 nt, Salmonella typhimurium LT2
gccagucaucgccg

SEQ ID NO: 1836228 - RNA, 18 nt, Salmonella typhimurium LT2
gccagucaccagcagcac

SEQ ID NO: 1836229 - RNA, 23 nt, Salmonella typhimurium LT2
gccagucaauaagcuugcuuucc

SEQ ID NO: 1836230 - RNA, 13 nt, Salmonella typhimurium LT2
gccaucacgcugc

SEQ ID NO: 1836231 - RNA, 20 nt, Salmonella typhimurium LT2
gccaucaccaucguugccag

SEQ ID NO: 1836232 - RNA, 19 nt, Salmonella typhimurium LT2
gcccacaaugacagaaaug

SEQ ID NO: 1836233 - RNA, 14 nt, Salmonella typhimurium LT2
gcccacaggcaggg

SEQ ID NO: 1836234 - RNA, 13 nt, Salmonella typhimurium LT2
gcccaaccagugg

SEQ ID NO: 1836235 - RNA, 19 nt, Salmonella typhimurium LT2
gcccaaauaguccagcagc

SEQ ID NO: 1836236 - RNA, 14 nt, Salmonella typhimurium LT2
gcccaaaucaauua

SEQ ID NO: 1836237 - RNA, 16 nt, Salmonella typhimurium LT2
gcccaaauaguccagc

SEQ ID NO: 1836238 - RNA, 15 nt, Salmonella typhimurium LT2
gcccaaaaugcggca

SEQ ID NO: 1836239 - RNA, 18 nt, Salmonella typhimurium LT2
gcccaaaacgcgccaggu

SEQ ID NO: 1836240 - RNA, 20 nt, Salmonella typhimurium LT2
gccauuucgccuauuuucuc

SEQ ID NO: 1836241 - RNA, 16 nt, Salmonella typhimurium LT2
gccauuucugccugau

SEQ ID NO: 1836242 - RNA, 13 nt, Salmonella typhimurium LT2
gccauuuccagcc

SEQ ID NO: 1836243 - RNA, 12 nt, Salmonella typhimurium LT2
gccauugccgcg

SEQ ID NO: 1836244 - RNA, 22 nt, Salmonella typhimurium LT2
gccauuggcuauuuuuugcugg

SEQ ID NO: 1836245 - RNA, 16 nt, Salmonella typhimurium LT2
gcccacgcuucccagc

SEQ ID NO: 1836246 - RNA, 16 nt, Salmonella typhimurium LT2
gcccaccugcagcagc

SEQ ID NO: 1836247 - RNA, 13 nt, Salmonella typhimurium LT2
gcccacgcccaga

SEQ ID NO: 1836248 - RNA, 23 nt, Salmonella typhimurium LT2
gcccaccggagcggcguccgcca

SEQ ID NO: 1836249 - RNA, 15 nt, Salmonella typhimurium LT2
gcccaccaucagacc

SEQ ID NO: 1836250 - RNA, 17 nt, Salmonella typhimurium LT2
gcccaccgacagauagc

SEQ ID NO: 1836251 - RNA, 18 nt, Salmonella typhimurium LT2
gcccagcgccuucuucac

SEQ ID NO: 1836252 - RNA, 13 nt, Salmonella typhimurium LT2
gcccagcgccgga

SEQ ID NO: 1836253 - RNA, 22 nt, Salmonella typhimurium LT2
gcccagcgcaaccugcgcccgc

SEQ ID NO: 1836254 - RNA, 15 nt, Salmonella typhimurium LT2
gcguuucacuucuga

SEQ ID NO: 1836255 - RNA, 17 nt, Salmonella typhimurium LT2
gcguuucagcuuccagu

SEQ ID NO: 1836256 - RNA, 18 nt, Salmonella typhimurium LT2
gcuauaggccaucacugg

SEQ ID NO: 1836257 - RNA, 19 nt, Salmonella typhimurium LT2
gcuauaaucacagggguca

SEQ ID NO: 1836258 - RNA, 14 nt, Salmonella typhimurium LT2
gcuauacgccauac

SEQ ID NO: 1836259 - RNA, 14 nt, Salmonella typhimurium LT2
gcuaucgagaaugg

SEQ ID NO: 1836260 - RNA, 15 nt, Salmonella typhimurium LT2
gcuaucgucgcgcaa

SEQ ID NO: 1836261 - RNA, 22 nt, Salmonella typhimurium LT2
gcuaucucuuccagcgucucca

SEQ ID NO: 1836262 - RNA, 16 nt, Salmonella typhimurium LT2
gcuaucugacagccaa

SEQ ID NO: 1836263 - RNA, 22 nt, Salmonella typhimurium LT2
gcuaucugacagccaaacugcu

SEQ ID NO: 1836264 - RNA, 16 nt, Salmonella typhimurium LT2
gcuaucugcuccgcca

SEQ ID NO: 1836265 - RNA, 19 nt, Salmonella typhimurium LT2
gcuauccucaacuugucug

SEQ ID NO: 1836266 - RNA, 19 nt, Salmonella typhimurium LT2
gcuauccggcaacaugaca

SEQ ID NO: 1836267 - RNA, 20 nt, Salmonella typhimurium LT2
gcuaucccaggcggagaaau

SEQ ID NO: 1836268 - RNA, 12 nt, Salmonella typhimurium LT2
gcuauccccauu

SEQ ID NO: 1836269 - RNA, 23 nt, Salmonella typhimurium LT2
gcuaucccgaugcucagggcauc

SEQ ID NO: 1836270 - RNA, 17 nt, Salmonella typhimurium LT2
gcuauccagcaguaaau

SEQ ID NO: 1836271 - RNA, 14 nt, Salmonella typhimurium LT2
gcuaucccaggcgg

SEQ ID NO: 1836272 - RNA, 15 nt, Salmonella typhimurium LT2
gcuaucaccucugcg

SEQ ID NO: 1836273 - RNA, 16 nt, Salmonella typhimurium LT2
gcuaucagccgccagu

SEQ ID NO: 1836274 - RNA, 20 nt, Salmonella typhimurium LT2
gcuaucaggaagaacacgcc

SEQ ID NO: 1836275 - RNA, 15 nt, Salmonella typhimurium LT2
gcuaucaggcaauac

SEQ ID NO: 1836276 - RNA, 20 nt, Salmonella typhimurium LT2
gcuaucaauaccgcuaauac

SEQ ID NO: 1836277 - RNA, 20 nt, Salmonella typhimurium LT2
gcuaucaagauaaaaagaca

SEQ ID NO: 1836278 - RNA, 11 nt, Salmonella typhimurium LT2
gcuaucaagcu

SEQ ID NO: 1836279 - RNA, 22 nt, Salmonella typhimurium LT2
gcuaucaacgccuccaggcuac

SEQ ID NO: 1836280 - RNA, 14 nt, Salmonella typhimurium LT2
gcuauauugcugcg

SEQ ID NO: 1836281 - RNA, 19 nt, Salmonella typhimurium LT2
gcuauaugaaccuuguaac

SEQ ID NO: 1836282 - RNA, 15 nt, Salmonella typhimurium LT2
gcucaaaaaagagua

SEQ ID NO: 1836283 - RNA, 16 nt, Salmonella typhimurium LT2
gcuauucugcuguucc

SEQ ID NO: 1836284 - RNA, 14 nt, Salmonella typhimurium LT2
gcuaugcucccccc

SEQ ID NO: 1836285 - RNA, 13 nt, Salmonella typhimurium LT2
gcuaugcugauca

SEQ ID NO: 1836286 - RNA, 13 nt, Salmonella typhimurium LT2
gcuaugcgccagu

SEQ ID NO: 1836287 - RNA, 15 nt, Salmonella typhimurium LT2
gcuaucuuugcugcc

SEQ ID NO: 1836288 - RNA, 17 nt, Salmonella typhimurium LT2
gcuauguaagagcguuu

SEQ ID NO: 1836289 - RNA, 21 nt, Salmonella typhimurium LT2
gcuauguagcgcugaagcccg

SEQ ID NO: 1836290 - RNA, 18 nt, Salmonella typhimurium LT2
gcucaagaguaggccgga

SEQ ID NO: 1836291 - RNA, 16 nt, Salmonella typhimurium LT2
gcucaccugcucgccc

SEQ ID NO: 1836292 - RNA, 20 nt, Salmonella typhimurium LT2
gcucaaauaugauaugugua

SEQ ID NO: 1836293 - RNA, 13 nt, Salmonella typhimurium LT2
gcucaaauaugau

SEQ ID NO: 1836294 - RNA, 22 nt, Salmonella typhimurium LT2
gcucaaaaaagaguaaaguuau

SEQ ID NO: 1836295 - RNA, 14 nt, Salmonella typhimurium LT2
gcucaacuggauga

SEQ ID NO: 1836296 - RNA, 22 nt, Salmonella typhimurium LT2
gcucaaccgcgcggcguucugc

SEQ ID NO: 1836297 - RNA, 15 nt, Salmonella typhimurium LT2
gcucaaccgcgcggc

SEQ ID NO: 1836298 - RNA, 14 nt, Salmonella typhimurium LT2
gcuccgccccgccu

SEQ ID NO: 1836299 - RNA, 15 nt, Salmonella typhimurium LT2
gcuccgccccgccuu

SEQ ID NO: 1836300 - RNA, 18 nt, Salmonella typhimurium LT2
gcucccgcagccacuccc

SEQ ID NO: 1836301 - RNA, 15 nt, Salmonella typhimurium LT2
gcuccccgccgcggc

SEQ ID NO: 1836302 - RNA, 17 nt, Salmonella typhimurium LT2
gcuccccauaaaaaugg

SEQ ID NO: 1836303 - RNA, 20 nt, Salmonella typhimurium LT2
gcucccgcagccacucccga

SEQ ID NO: 1836304 - RNA, 20 nt, Salmonella typhimurium LT2
gcucccgcauggacaaggau

SEQ ID NO: 1836305 - RNA, 17 nt, Salmonella typhimurium LT2
gcucccggcguuuuugu

SEQ ID NO: 1836306 - RNA, 14 nt, Salmonella typhimurium LT2
gcucgcccgcagca

SEQ ID NO: 1836307 - RNA, 17 nt, Salmonella typhimurium LT2
gcucgcccgcagcaaaa

SEQ ID NO: 1836308 - RNA, 22 nt, Salmonella typhimurium LT2
gcucgccaguaucggcaggacu

SEQ ID NO: 1836309 - RNA, 16 nt, Salmonella typhimurium LT2
gcuccuugagcgccug

SEQ ID NO: 1836310 - RNA, 22 nt, Salmonella typhimurium LT2
gcucagcuggauagagcaucaa

SEQ ID NO: 1836311 - RNA, 16 nt, Salmonella typhimurium LT2
gcucagcgcggcagcc

SEQ ID NO: 1836312 - RNA, 23 nt, Salmonella typhimurium LT2
gcucacgguuucuacuuccacca

SEQ ID NO: 1836313 - RNA, 19 nt, Salmonella typhimurium LT2
gcucaugugcagcauccag

SEQ ID NO: 1836314 - RNA, 22 nt, Salmonella typhimurium LT2
gcucaugcgcgucccggcagug

SEQ ID NO: 1836315 - RNA, 17 nt, Salmonella typhimurium LT2
gcucaugugcagcaucc

SEQ ID NO: 1836316 - RNA, 15 nt, Salmonella typhimurium LT2
gcucaugacaucgcc

SEQ ID NO: 1836317 - RNA, 13 nt, Salmonella typhimurium LT2
gcucaucggcggc

SEQ ID NO: 1836318 - RNA, 19 nt, Salmonella typhimurium LT2
gcuccagaccaccagcgac

SEQ ID NO: 1836319 - RNA, 20 nt, Salmonella typhimurium LT2
gcuccagaccaccagcgaca

SEQ ID NO: 1836320 - RNA, 21 nt, Salmonella typhimurium LT2
gcuccagaagcacuucuccac

SEQ ID NO: 1836321 - RNA, 20 nt, Salmonella typhimurium LT2
gcuccacuggcccccuguuc

SEQ ID NO: 1836322 - RNA, 21 nt, Salmonella typhimurium LT2
gcuccacuggcccccuguucc

SEQ ID NO: 1836323 - RNA, 15 nt, Salmonella typhimurium LT2
gcuccaccagcccgc

SEQ ID NO: 1836324 - RNA, 21 nt, Salmonella typhimurium LT2
gcucccagauuaaaucauccu

SEQ ID NO: 1836325 - RNA, 16 nt, Salmonella typhimurium LT2
gcucccacucuuccag

SEQ ID NO: 1836326 - RNA, 17 nt, Salmonella typhimurium LT2
gcugacugguuuguugc

SEQ ID NO: 1836327 - RNA, 14 nt, Salmonella typhimurium LT2
gcugacucgcgcaa

SEQ ID NO: 1836328 - RNA, 23 nt, Salmonella typhimurium LT2
gcugagaauugacgauaucaucu

SEQ ID NO: 1836329 - RNA, 13 nt, Salmonella typhimurium LT2
gcugaggccgcuc

SEQ ID NO: 1836330 - RNA, 16 nt, Salmonella typhimurium LT2
gcugauguccgcagcc

SEQ ID NO: 1836331 - RNA, 17 nt, Salmonella typhimurium LT2
gcugaugugcuccauca

SEQ ID NO: 1836332 - RNA, 18 nt, Salmonella typhimurium LT2
gcugaugucugcgcucuu

SEQ ID NO: 1836333 - RNA, 12 nt, Salmonella typhimurium LT2
gcugaugguuuc

SEQ ID NO: 1836334 - RNA, 23 nt, Salmonella typhimurium LT2
gcugaugcgcuauaaaaaucgca

SEQ ID NO: 1836335 - RNA, 16 nt, Salmonella typhimurium LT2
gcugauauuuucaccu

SEQ ID NO: 1836336 - RNA, 13 nt, Salmonella typhimurium LT2
gcugauaauacug

SEQ ID NO: 1836337 - RNA, 13 nt, Salmonella typhimurium LT2
gcugauaacaaua

SEQ ID NO: 1836338 - RNA, 20 nt, Salmonella typhimurium LT2
gcugauaaagagcaggccaa

SEQ ID NO: 1836339 - RNA, 16 nt, Salmonella typhimurium LT2
gcugacgcccaucagc

SEQ ID NO: 1836340 - RNA, 14 nt, Salmonella typhimurium LT2
gcugacgcagcagc

SEQ ID NO: 1836341 - RNA, 16 nt, Salmonella typhimurium LT2
gcugacgccagccagc

SEQ ID NO: 1836342 - RNA, 16 nt, Salmonella typhimurium LT2
gcugacgcgaucgccg

SEQ ID NO: 1836343 - RNA, 22 nt, Salmonella typhimurium LT2
gcugacgauacucagccccagg

SEQ ID NO: 1836344 - RNA, 21 nt, Salmonella typhimurium LT2
gcugacgacauucagcacaug

SEQ ID NO: 1836345 - RNA, 16 nt, Salmonella typhimurium LT2
gcugacaaucagcaca

SEQ ID NO: 1836346 - RNA, 15 nt, Salmonella typhimurium LT2
gcugaagugcggaua

SEQ ID NO: 1836347 - RNA, 17 nt, Salmonella typhimurium LT2
gcugaauaccugcccca

SEQ ID NO: 1836348 - RNA, 17 nt, Salmonella typhimurium LT2
gcugaauagccagcccc

SEQ ID NO: 1836349 - RNA, 11 nt, Salmonella typhimurium LT2
gcugaaccacc

SEQ ID NO: 1836350 - RNA, 22 nt, Salmonella typhimurium LT2
gcugaaccacccugaaaaguua

SEQ ID NO: 1836351 - RNA, 15 nt, Salmonella typhimurium LT2
gcugaaauagccccg

SEQ ID NO: 1836352 - RNA, 14 nt, Salmonella typhimurium LT2
gcugaagcccgcga

SEQ ID NO: 1836353 - RNA, 16 nt, Salmonella typhimurium LT2
gcugaagacuggcaag

SEQ ID NO: 1836354 - RNA, 22 nt, Salmonella typhimurium LT2
gcucuccuccaaagguauggag

SEQ ID NO: 1836355 - RNA, 19 nt, Salmonella typhimurium LT2
gcucucccagcugagcuaa

SEQ ID NO: 1836356 - RNA, 23 nt, Salmonella typhimurium LT2
gcucuccccacacugaauuacug

SEQ ID NO: 1836357 - RNA, 13 nt, Salmonella typhimurium LT2
gcucucccagcug

SEQ ID NO: 1836358 - RNA, 21 nt, Salmonella typhimurium LT2
gcucucgccacgcuccaucau

SEQ ID NO: 1836359 - RNA, 19 nt, Salmonella typhimurium LT2
gcucucuuucaccagcgcc

SEQ ID NO: 1836360 - RNA, 20 nt, Salmonella typhimurium LT2
gcucuaucaccgcccgccgg

SEQ ID NO: 1836361 - RNA, 17 nt, Salmonella typhimurium LT2
gcucguaggccagcgcu

SEQ ID NO: 1836362 - RNA, 22 nt, Salmonella typhimurium LT2
gcucgucgaagcuuuucaccaa

SEQ ID NO: 1836363 - RNA, 14 nt, Salmonella typhimurium LT2
gcucuaaaaaggaa

SEQ ID NO: 1836364 - RNA, 13 nt, Salmonella typhimurium LT2
gcucuaaccaacu

SEQ ID NO: 1836365 - RNA, 18 nt, Salmonella typhimurium LT2
gcucguuaaauccuccca

SEQ ID NO: 1836366 - RNA, 18 nt, Salmonella typhimurium LT2
gcucuguccgcaaagaca

SEQ ID NO: 1836367 - RNA, 19 nt, Salmonella typhimurium LT2
gcucugccaguagcugcuc

SEQ ID NO: 1836368 - RNA, 22 nt, Salmonella typhimurium LT2
gcucucuuuuggcgacagacgc

SEQ ID NO: 1836369 - RNA, 16 nt, Salmonella typhimurium LT2
gcucuuuacauaaugu

SEQ ID NO: 1836370 - RNA, 22 nt, Salmonella typhimurium LT2
gcugaaacagaauaaacggcag

SEQ ID NO: 1836371 - RNA, 18 nt, Salmonella typhimurium LT2
gcucuuuuucuugucucc

SEQ ID NO: 1836372 - RNA, 21 nt, Salmonella typhimurium LT2
gcucuucgccgguaaaaaucc

SEQ ID NO: 1836373 - RNA, 12 nt, Salmonella typhimurium LT2
gcucuucgcucc

SEQ ID NO: 1836374 - RNA, 16 nt, Salmonella typhimurium LT2
gcucuucgcuccaguc

SEQ ID NO: 1836375 - RNA, 18 nt, Salmonella typhimurium LT2
gcgucgcggcaauagcga

SEQ ID NO: 1836376 - RNA, 22 nt, Salmonella typhimurium LT2
gcgucgcgcuuucaaucgucag

SEQ ID NO: 1836377 - RNA, 14 nt, Salmonella typhimurium LT2
gcgucgcgcauggc

SEQ ID NO: 1836378 - RNA, 12 nt, Salmonella typhimurium LT2
gcgucgccgccg

SEQ ID NO: 1836379 - RNA, 14 nt, Salmonella typhimurium LT2
gcgucgggccgcgc

SEQ ID NO: 1836380 - RNA, 19 nt, Salmonella typhimurium LT2
gcgucgucgguaaacgggc

SEQ ID NO: 1836381 - RNA, 22 nt, Salmonella typhimurium LT2
gcgucggcgcggggaacacaau

SEQ ID NO: 1836382 - RNA, 18 nt, Salmonella typhimurium LT2
gcgugauaaaggccggca

SEQ ID NO: 1836383 - RNA, 21 nt, Salmonella typhimurium LT2
gcgugaugcgauccagcgggc

SEQ ID NO: 1836384 - RNA, 19 nt, Salmonella typhimurium LT2
gcgugccgauucccgccug

SEQ ID NO: 1836385 - RNA, 16 nt, Salmonella typhimurium LT2
gcgugccugccgcaga

SEQ ID NO: 1836386 - RNA, 15 nt, Salmonella typhimurium LT2
gcgucucaagcuuuu

SEQ ID NO: 1836387 - RNA, 14 nt, Salmonella typhimurium LT2
gcgucuaaauuucg

SEQ ID NO: 1836388 - RNA, 17 nt, Salmonella typhimurium LT2
gcgucucaucaaaaagg

SEQ ID NO: 1836389 - RNA, 17 nt, Salmonella typhimurium LT2
gcgucucagcaggcggc

SEQ ID NO: 1836390 - RNA, 16 nt, Salmonella typhimurium LT2
gcgucucauccggcag

SEQ ID NO: 1836391 - RNA, 18 nt, Salmonella typhimurium LT2
gcgucucaucaaaaaggc

SEQ ID NO: 1836392 - RNA, 13 nt, Salmonella typhimurium LT2
gcgugacccagac

SEQ ID NO: 1836393 - RNA, 17 nt, Salmonella typhimurium LT2
gcguggcguaucggcag

SEQ ID NO: 1836394 - RNA, 18 nt, Salmonella typhimurium LT2
gcgugcgaauuucggcaa

SEQ ID NO: 1836395 - RNA, 21 nt, Salmonella typhimurium LT2
gcguggcaucuuaucaggccu

SEQ ID NO: 1836396 - RNA, 14 nt, Salmonella typhimurium LT2
gcgugcgcuacggc

SEQ ID NO: 1836397 - RNA, 20 nt, Salmonella typhimurium LT2
gcguguuucaucucaucaau

SEQ ID NO: 1836398 - RNA, 23 nt, Salmonella typhimurium LT2
gcguguuguacagcaauaaaagg

SEQ ID NO: 1836399 - RNA, 21 nt, Salmonella typhimurium LT2
gcguuguuuuuucagaauuag

SEQ ID NO: 1836400 - RNA, 12 nt, Salmonella typhimurium LT2
gcguuggcggcu

SEQ ID NO: 1836401 - RNA, 23 nt, Salmonella typhimurium LT2
gcguucauggcgcgacauggcga

SEQ ID NO: 1836402 - RNA, 15 nt, Salmonella typhimurium LT2
gcguucacgccgcca

SEQ ID NO: 1836403 - RNA, 15 nt, Salmonella typhimurium LT2
gcguucccaguuccg

SEQ ID NO: 1836404 - RNA, 20 nt, Salmonella typhimurium LT2
gcguugccaucgcacucucc

SEQ ID NO: 1836405 - RNA, 20 nt, Salmonella typhimurium LT2
gcgucaucggcgcgcuggcg

SEQ ID NO: 1836406 - RNA, 20 nt, Salmonella typhimurium LT2
gcgucauuaauggccuguac

SEQ ID NO: 1836407 - RNA, 21 nt, Salmonella typhimurium LT2
gcgucaugcgaaacgcuugug

SEQ ID NO: 1836408 - RNA, 18 nt, Salmonella typhimurium LT2
gcguccaacuggcuuuca

SEQ ID NO: 1836409 - RNA, 20 nt, Salmonella typhimurium LT2
gcgucccucuccagggcaac

SEQ ID NO: 1836410 - RNA, 15 nt, Salmonella typhimurium LT2
gcgucccgucccacc

SEQ ID NO: 1836411 - RNA, 17 nt, Salmonella typhimurium LT2
gcgucccgucccaccac

SEQ ID NO: 1836412 - RNA, 16 nt, Salmonella typhimurium LT2
gcguccgauggacucc

SEQ ID NO: 1836413 - RNA, 15 nt, Salmonella typhimurium LT2
gcguccuucuuccgc

SEQ ID NO: 1836414 - RNA, 16 nt, Salmonella typhimurium LT2
gcgucgaaugacgcgc

SEQ ID NO: 1836415 - RNA, 21 nt, Salmonella typhimurium LT2
gcgucgccaaagcagcugcug

SEQ ID NO: 1836416 - RNA, 19 nt, Salmonella typhimurium LT2
gcgucgccauaaagcugua

SEQ ID NO: 1836417 - RNA, 12 nt, Salmonella typhimurium LT2
gcgucgagcgcc

SEQ ID NO: 1836418 - RNA, 13 nt, Salmonella typhimurium LT2
gcgucgagcgccg

SEQ ID NO: 1836419 - RNA, 17 nt, Salmonella typhimurium LT2
gcgucgaccagacgaau

SEQ ID NO: 1836420 - RNA, 21 nt, Salmonella typhimurium LT2
gcguaugcuuucagcauguuu

SEQ ID NO: 1836421 - RNA, 14 nt, Salmonella typhimurium LT2
gcguagcccagcgc

SEQ ID NO: 1836422 - RNA, 19 nt, Salmonella typhimurium LT2
gcguagcguguauuccagu

SEQ ID NO: 1836423 - RNA, 20 nt, Salmonella typhimurium LT2
gcguagcuggucgccagcgc

SEQ ID NO: 1836424 - RNA, 17 nt, Salmonella typhimurium LT2
gcggugauccuccugca

SEQ ID NO: 1836425 - RNA, 18 nt, Salmonella typhimurium LT2
gcgucaacgugaaaaauc

SEQ ID NO: 1836426 - RNA, 20 nt, Salmonella typhimurium LT2
gcgucaauuccgcgccgccc

SEQ ID NO: 1836427 - RNA, 21 nt, Salmonella typhimurium LT2
gcgucacaauaucgagaugac

SEQ ID NO: 1836428 - RNA, 14 nt, Salmonella typhimurium LT2
gcgucacccgccgg

SEQ ID NO: 1836429 - RNA, 14 nt, Salmonella typhimurium LT2
gcgucagcccuucu

SEQ ID NO: 1836430 - RNA, 15 nt, Salmonella typhimurium LT2
gcgucagcauggugu

SEQ ID NO: 1836431 - RNA, 18 nt, Salmonella typhimurium LT2
gcgucauagccgcgcguc

SEQ ID NO: 1836432 - RNA, 20 nt, Salmonella typhimurium LT2
gcgucaucauugcgccaaga

SEQ ID NO: 1836433 - RNA, 18 nt, Salmonella typhimurium LT2
gcgucaggaacgcggcgc

SEQ ID NO: 1836434 - RNA, 13 nt, Salmonella typhimurium LT2
gcgucagcgcggc

SEQ ID NO: 1836435 - RNA, 18 nt, Salmonella typhimurium LT2
gcggcggucugcgccugc

SEQ ID NO: 1836436 - RNA, 17 nt, Salmonella typhimurium LT2
gcggcggucugcgccug

SEQ ID NO: 1836437 - RNA, 18 nt, Salmonella typhimurium LT2
gcggcguaccgcgcgccc

SEQ ID NO: 1836438 - RNA, 22 nt, Salmonella typhimurium LT2
gcggcguaaaccccuucaccac

SEQ ID NO: 1836439 - RNA, 15 nt, Salmonella typhimurium LT2
gcggcgguucauccu

SEQ ID NO: 1836440 - RNA, 16 nt, Salmonella typhimurium LT2
gcggcgccaucaccau

SEQ ID NO: 1836441 - RNA, 14 nt, Salmonella typhimurium LT2
gcggcgccaguacu

SEQ ID NO: 1836442 - RNA, 22 nt, Salmonella typhimurium LT2
gcggcgcauucuugcgccgcaa

SEQ ID NO: 1836443 - RNA, 13 nt, Salmonella typhimurium LT2
gcggcgcagggcg

SEQ ID NO: 1836444 - RNA, 12 nt, Salmonella typhimurium LT2
gcggcgccgcaa

SEQ ID NO: 1836445 - RNA, 20 nt, Salmonella typhimurium LT2
gcggcacgagcacuguggcg

SEQ ID NO: 1836446 - RNA, 17 nt, Salmonella typhimurium LT2
gcggcguucccgcaggc

SEQ ID NO: 1836447 - RNA, 20 nt, Salmonella typhimurium LT2
gcggcguggaaccgccggag

SEQ ID NO: 1836448 - RNA, 14 nt, Salmonella typhimurium LT2
gcggcguucaaaac

SEQ ID NO: 1836449 - RNA, 13 nt, Salmonella typhimurium LT2
gcggcguggcgca

SEQ ID NO: 1836450 - RNA, 15 nt, Salmonella typhimurium LT2
gcggcguagcguuca

SEQ ID NO: 1836451 - RNA, 16 nt, Salmonella typhimurium LT2
gcggcgugaccgccuu

SEQ ID NO: 1836452 - RNA, 13 nt, Salmonella typhimurium LT2
gcggcuuuuucac

SEQ ID NO: 1836453 - RNA, 22 nt, Salmonella typhimurium LT2
gcggcuggcgcgaugacggcgc

SEQ ID NO: 1836454 - RNA, 15 nt, Salmonella typhimurium LT2
gcggcucaccagcug

SEQ ID NO: 1836455 - RNA, 21 nt, Salmonella typhimurium LT2
gcggcuauugccugauggcgc

SEQ ID NO: 1836456 - RNA, 20 nt, Salmonella typhimurium LT2
gcgguagaaaguacaucauu

SEQ ID NO: 1836457 - RNA, 20 nt, Salmonella typhimurium LT2
gcgguacgccuugagcaaaa

SEQ ID NO: 1836458 - RNA, 14 nt, Salmonella typhimurium LT2
gcgguacaggcugu

SEQ ID NO: 1836459 - RNA, 15 nt, Salmonella typhimurium LT2
gcgguaacguaacug

SEQ ID NO: 1836460 - RNA, 18 nt, Salmonella typhimurium LT2
gcgguaacaggcaccagc

SEQ ID NO: 1836461 - RNA, 19 nt, Salmonella typhimurium LT2
gcgggugcgcagccccagc

SEQ ID NO: 1836462 - RNA, 14 nt, Salmonella typhimurium LT2
gcgggugcuccagc

SEQ ID NO: 1836463 - RNA, 19 nt, Salmonella typhimurium LT2
gcgggugagcgcuaucagg

SEQ ID NO: 1836464 - RNA, 13 nt, Salmonella typhimurium LT2
gcggguaaacaga

SEQ ID NO: 1836465 - RNA, 22 nt, Salmonella typhimurium LT2
gcgguaucaaugcgacagcggc

SEQ ID NO: 1836466 - RNA, 15 nt, Salmonella typhimurium LT2
gcggugaaacuguuu

SEQ ID NO: 1836467 - RNA, 16 nt, Salmonella typhimurium LT2
gcgggagaucggcugu

SEQ ID NO: 1836468 - RNA, 13 nt, Salmonella typhimurium LT2
gcgggccgcggcg

SEQ ID NO: 1836469 - RNA, 11 nt, Salmonella typhimurium LT2
gcgggagcugu

SEQ ID NO: 1836470 - RNA, 23 nt, Salmonella typhimurium LT2
gcgggcguugcugcacgccgcgc

SEQ ID NO: 1836471 - RNA, 19 nt, Salmonella typhimurium LT2
gcgggcguauagccaggca

SEQ ID NO: 1836472 - RNA, 23 nt, Salmonella typhimurium LT2
gcgggcggccaaucagauauccc

SEQ ID NO: 1836473 - RNA, 16 nt, Salmonella typhimurium LT2
gcgggcuauaggccau

SEQ ID NO: 1836474 - RNA, 23 nt, Salmonella typhimurium LT2
gcgccgcuggcgaccagccugcc

SEQ ID NO: 1836475 - RNA, 17 nt, Salmonella typhimurium LT2
gcgccgcugagaaaaag

SEQ ID NO: 1836476 - RNA, 15 nt, Salmonella typhimurium LT2
gcgccggaacaggcu

SEQ ID NO: 1836477 - RNA, 15 nt, Salmonella typhimurium LT2
gcgccggacagcagc

SEQ ID NO: 1836478 - RNA, 24 nt, Salmonella typhimurium LT2
gcgccggggaagcgacgacacggc

SEQ ID NO: 1836479 - RNA, 23 nt, Salmonella typhimurium LT2
gcgccgccgaacagacggcggcu

SEQ ID NO: 1836480 - RNA, 21 nt, Salmonella typhimurium LT2
gcgccgccucgcgauccgcca

SEQ ID NO: 1836481 - RNA, 18 nt, Salmonella typhimurium LT2
gcgccgccugcuccgggc

SEQ ID NO: 1836482 - RNA, 13 nt, Salmonella typhimurium LT2
gcgccgcgccacc

SEQ ID NO: 1836483 - RNA, 23 nt, Salmonella typhimurium LT2
gcgccgccgggaucagcggcugc

SEQ ID NO: 1836484 - RNA, 15 nt, Salmonella typhimurium LT2
gcgccugcugccugc

SEQ ID NO: 1836485 - RNA, 18 nt, Salmonella typhimurium LT2
gcgccugcggcaggcaau

SEQ ID NO: 1836486 - RNA, 14 nt, Salmonella typhimurium LT2
gcgccugccauagc

SEQ ID NO: 1836487 - RNA, 23 nt, Salmonella typhimurium LT2
gcgccuuacccggccuacacauc

SEQ ID NO: 1836488 - RNA, 18 nt, Salmonella typhimurium LT2
gcgccuuaccguaugcaa

SEQ ID NO: 1836489 - RNA, 20 nt, Salmonella typhimurium LT2
gcgccugucgggccuacaga

SEQ ID NO: 1836490 - RNA, 13 nt, Salmonella typhimurium LT2
gcgccuuccagca

SEQ ID NO: 1836491 - RNA, 15 nt, Salmonella typhimurium LT2
gcgccuuccagcaau

SEQ ID NO: 1836492 - RNA, 20 nt, Salmonella typhimurium LT2
gcgccuugucugaccgggcg

SEQ ID NO: 1836493 - RNA, 21 nt, Salmonella typhimurium LT2
gcgccuccgcguagcccagcg

SEQ ID NO: 1836494 - RNA, 19 nt, Salmonella typhimurium LT2
gcgccuccacaaagcgcga

SEQ ID NO: 1836495 - RNA, 19 nt, Salmonella typhimurium LT2
gcgccuauguuaugcacaa

SEQ ID NO: 1836496 - RNA, 23 nt, Salmonella typhimurium LT2
gcgccuccgcguagcccagcgcc

SEQ ID NO: 1836497 - RNA, 14 nt, Salmonella typhimurium LT2
gcgccucgcgcggc

SEQ ID NO: 1836498 - RNA, 17 nt, Salmonella typhimurium LT2
gcgccucgcugacgcca

SEQ ID NO: 1836499 - RNA, 18 nt, Salmonella typhimurium LT2
gcgccucgcugacgccag

SEQ ID NO: 1836500 - RNA, 19 nt, Salmonella typhimurium LT2
gcgccucgcugacgccagc

SEQ ID NO: 1836501 - RNA, 23 nt, Salmonella typhimurium LT2
gcgccucgcugacgccagccagc

SEQ ID NO: 1836502 - RNA, 16 nt, Salmonella typhimurium LT2
gcgccugacgcggacg

SEQ ID NO: 1836503 - RNA, 17 nt, Salmonella typhimurium LT2
gcgccugaugccgccgu

SEQ ID NO: 1836504 - RNA, 19 nt, Salmonella typhimurium LT2
gcgccugaagauacgccag

SEQ ID NO: 1836505 - RNA, 14 nt, Salmonella typhimurium LT2
gcgcggcguucugc

SEQ ID NO: 1836506 - RNA, 14 nt, Salmonella typhimurium LT2
gcgcggcgucgccg

SEQ ID NO: 1836507 - RNA, 21 nt, Salmonella typhimurium LT2
gcgcggccucauggcggugcu

SEQ ID NO: 1836508 - RNA, 13 nt, Salmonella typhimurium LT2
gcgcgcggcugcg

SEQ ID NO: 1836509 - RNA, 17 nt, Salmonella typhimurium LT2
gcgccuuucgcgcugca

SEQ ID NO: 1836510 - RNA, 16 nt, Salmonella typhimurium LT2
gcgcgaaaagaaacug

SEQ ID NO: 1836511 - RNA, 20 nt, Salmonella typhimurium LT2
gcgcgaugccugccgggccu

SEQ ID NO: 1836512 - RNA, 13 nt, Salmonella typhimurium LT2
gcgcgauuuuuuc

SEQ ID NO: 1836513 - RNA, 18 nt, Salmonella typhimurium LT2
gcgcgcccgccaccagca

SEQ ID NO: 1836514 - RNA, 14 nt, Salmonella typhimurium LT2
gcgcgcccgcuucc

SEQ ID NO: 1836515 - RNA, 14 nt, Salmonella typhimurium LT2
gcgcgcccagcagg

SEQ ID NO: 1836516 - RNA, 13 nt, Salmonella typhimurium LT2
gcgcgcgccgccu

SEQ ID NO: 1836517 - RNA, 17 nt, Salmonella typhimurium LT2
gcgcgccuuccagcaau

SEQ ID NO: 1836518 - RNA, 17 nt, Salmonella typhimurium LT2
gcgcgcgaauauguucu

SEQ ID NO: 1836519 - RNA, 20 nt, Salmonella typhimurium LT2
gcgcguaaauaccuuccggc

SEQ ID NO: 1836520 - RNA, 19 nt, Salmonella typhimurium LT2
gcgcguccagccagcguuu

SEQ ID NO: 1836521 - RNA, 16 nt, Salmonella typhimurium LT2
gcgcguccacggcggg

SEQ ID NO: 1836522 - RNA, 22 nt, Salmonella typhimurium LT2
gcgcgucacaauaucgagauga

SEQ ID NO: 1836523 - RNA, 19 nt, Salmonella typhimurium LT2
gcgcgucaacggcgcggcg

SEQ ID NO: 1836524 - RNA, 15 nt, Salmonella typhimurium LT2
gcgcucggcagcagc

SEQ ID NO: 1836525 - RNA, 16 nt, Salmonella typhimurium LT2
gcgcucuuccgccagc

SEQ ID NO: 1836526 - RNA, 15 nt, Salmonella typhimurium LT2
gcgcucgcccuucgg

SEQ ID NO: 1836527 - RNA, 19 nt, Salmonella typhimurium LT2
gcgcuggcaagcgccagca

SEQ ID NO: 1836528 - RNA, 21 nt, Salmonella typhimurium LT2
gcgcugcuggagaccaccggc

SEQ ID NO: 1836529 - RNA, 20 nt, Salmonella typhimurium LT2
gcggaaauacccuuaugaua

SEQ ID NO: 1836530 - RNA, 13 nt, Salmonella typhimurium LT2
gcgcuuugugcuc

SEQ ID NO: 1836531 - RNA, 16 nt, Salmonella typhimurium LT2
gcgcuuuggcugccag

SEQ ID NO: 1836532 - RNA, 17 nt, Salmonella typhimurium LT2
gcgcuuuggcugccagu

SEQ ID NO: 1836533 - RNA, 18 nt, Salmonella typhimurium LT2
gcgcuuuccaggccagcg

SEQ ID NO: 1836534 - RNA, 12 nt, Salmonella typhimurium LT2
gcgcuuuguuuc

SEQ ID NO: 1836535 - RNA, 16 nt, Salmonella typhimurium LT2
gcgcuuuuaaaauaaa

SEQ ID NO: 1836536 - RNA, 14 nt, Salmonella typhimurium LT2
gcgcuuuugccgcg

SEQ ID NO: 1836537 - RNA, 12 nt, Salmonella typhimurium LT2
gcgcuuuuucac

SEQ ID NO: 1836538 - RNA, 22 nt, Salmonella typhimurium LT2
gcggaaggcgccucgcgcggcg

SEQ ID NO: 1836539 - RNA, 14 nt, Salmonella typhimurium LT2
gcggaaggcgccuc

SEQ ID NO: 1836540 - RNA, 22 nt, Salmonella typhimurium LT2
gcgcuugcauggcagccccggc

SEQ ID NO: 1836541 - RNA, 14 nt, Salmonella typhimurium LT2
gcgcuuuaaacaua

SEQ ID NO: 1836542 - RNA, 21 nt, Salmonella typhimurium LT2
gcgcuuauccggccuacagcu

SEQ ID NO: 1836543 - RNA, 13 nt, Salmonella typhimurium LT2
gcgcuuaucccag

SEQ ID NO: 1836544 - RNA, 14 nt, Salmonella typhimurium LT2
gcgcuuauccggcc

SEQ ID NO: 1836545 - RNA, 13 nt, Salmonella typhimurium LT2
gcgcuucgccugc

SEQ ID NO: 1836546 - RNA, 14 nt, Salmonella typhimurium LT2
gcgcuuccagcaug

SEQ ID NO: 1836547 - RNA, 20 nt, Salmonella typhimurium LT2
gcggcaaagauaaucugaau

SEQ ID NO: 1836548 - RNA, 17 nt, Salmonella typhimurium LT2
gcggauugauuuuucug

SEQ ID NO: 1836549 - RNA, 23 nt, Salmonella typhimurium LT2
gcggcaacccuuuggccaccagc

SEQ ID NO: 1836550 - RNA, 17 nt, Salmonella typhimurium LT2
gcggcaacacauccggc

SEQ ID NO: 1836551 - RNA, 20 nt, Salmonella typhimurium LT2
gcggcaacaaauguugauaa

SEQ ID NO: 1836552 - RNA, 14 nt, Salmonella typhimurium LT2
gcggcaauggccgc

SEQ ID NO: 1836553 - RNA, 16 nt, Salmonella typhimurium LT2
gcggcaaugccgccgu

SEQ ID NO: 1836554 - RNA, 17 nt, Salmonella typhimurium LT2
gcggcaauggccgcagc

SEQ ID NO: 1836555 - RNA, 23 nt, Salmonella typhimurium LT2
gcggcaauauccugugucggcag

SEQ ID NO: 1836556 - RNA, 18 nt, Salmonella typhimurium LT2
gcggcaauuuguagcugc

SEQ ID NO: 1836557 - RNA, 14 nt, Salmonella typhimurium LT2
gcggcacauaagcg

SEQ ID NO: 1836558 - RNA, 21 nt, Salmonella typhimurium LT2
gcggaugcgccauccaccagg

SEQ ID NO: 1836559 - RNA, 22 nt, Salmonella typhimurium LT2
gcggaugcgccauccaccaggc

SEQ ID NO: 1836560 - RNA, 18 nt, Salmonella typhimurium LT2
gcggauguuaaugaauaa

SEQ ID NO: 1836561 - RNA, 20 nt, Salmonella typhimurium LT2
gcggauguuaaugaauaauc

SEQ ID NO: 1836562 - RNA, 19 nt, Salmonella typhimurium LT2
gcggaugguggcguaaaua

SEQ ID NO: 1836563 - RNA, 19 nt, Salmonella typhimurium LT2
gcggaauugguagacgcgc

SEQ ID NO: 1836564 - RNA, 18 nt, Salmonella typhimurium LT2
gcggaauuuuauccuggg

SEQ ID NO: 1836565 - RNA, 19 nt, Salmonella typhimurium LT2
gcggaauuuuauccugggu

SEQ ID NO: 1836566 - RNA, 19 nt, Salmonella typhimurium LT2
gcggaaucgcuuccugggu

SEQ ID NO: 1836567 - RNA, 19 nt, Salmonella typhimurium LT2
gcggaaucacgcauauccc

SEQ ID NO: 1836568 - RNA, 16 nt, Salmonella typhimurium LT2
gcggacacccgcagcc

SEQ ID NO: 1836569 - RNA, 13 nt, Salmonella typhimurium LT2
gcggacgcagcuc

SEQ ID NO: 1836570 - RNA, 17 nt, Salmonella typhimurium LT2
gcggagaucgcucccgc

SEQ ID NO: 1836571 - RNA, 15 nt, Salmonella typhimurium LT2
gcggagaguugaaac

SEQ ID NO: 1836572 - RNA, 21 nt, Salmonella typhimurium LT2
gcggauaaauagugacgccgc

SEQ ID NO: 1836573 - RNA, 19 nt, Salmonella typhimurium LT2
gcggauacagcggcgcgcc

SEQ ID NO: 1836574 - RNA, 17 nt, Salmonella typhimurium LT2
gcggauaugcagcagcc

SEQ ID NO: 1836575 - RNA, 16 nt, Salmonella typhimurium LT2
gcggauaugcagcagc

SEQ ID NO: 1836576 - RNA, 13 nt, Salmonella typhimurium LT2
gcggaggggagga

SEQ ID NO: 1836577 - RNA, 12 nt, Salmonella typhimurium LT2
gcgaaaauaaag

SEQ ID NO: 1836578 - RNA, 22 nt, Salmonella typhimurium LT2
gcgaaaauaaaggugccgccgc

SEQ ID NO: 1836579 - RNA, 22 nt, Salmonella typhimurium LT2
gcgaaaauaccccagcgcgccg

SEQ ID NO: 1836580 - RNA, 14 nt, Salmonella typhimurium LT2
gcgaaaauccagua

SEQ ID NO: 1836581 - RNA, 12 nt, Salmonella typhimurium LT2
gcgaaagaaaau

SEQ ID NO: 1836582 - RNA, 13 nt, Salmonella typhimurium LT2
gccguuccgcaac

SEQ ID NO: 1836583 - RNA, 15 nt, Salmonella typhimurium LT2
gcgaaaaggccuggc

SEQ ID NO: 1836584 - RNA, 19 nt, Salmonella typhimurium LT2
gccguuuuagguucuucaa

SEQ ID NO: 1836585 - RNA, 14 nt, Salmonella typhimurium LT2
gcgaauaaucgccg

SEQ ID NO: 1836586 - RNA, 16 nt, Salmonella typhimurium LT2
gcgaauaacaucaucc

SEQ ID NO: 1836587 - RNA, 18 nt, Salmonella typhimurium LT2
gcgaaucauguuuuucuc

SEQ ID NO: 1836588 - RNA, 17 nt, Salmonella typhimurium LT2
gcgaauagucgccgcgg

SEQ ID NO: 1836589 - RNA, 15 nt, Salmonella typhimurium LT2
gcgaauagccagaca

SEQ ID NO: 1836590 - RNA, 20 nt, Salmonella typhimurium LT2
gcgaacaguguaaacgccag

SEQ ID NO: 1836591 - RNA, 21 nt, Salmonella typhimurium LT2
gcgaaccaucauuaauauaau

SEQ ID NO: 1836592 - RNA, 22 nt, Salmonella typhimurium LT2
gcgaagaucguuauccagcagc

SEQ ID NO: 1836593 - RNA, 13 nt, Salmonella typhimurium LT2
gcgaaccggacca

SEQ ID NO: 1836594 - RNA, 15 nt, Salmonella typhimurium LT2
gcgaauccggcggcu

SEQ ID NO: 1836595 - RNA, 23 nt, Salmonella typhimurium LT2
gcgaaucuggauagucaggcgau

SEQ ID NO: 1836596 - RNA, 21 nt, Salmonella typhimurium LT2
gcgaauuucggcaaugacggu

SEQ ID NO: 1836597 - RNA, 18 nt, Salmonella typhimurium LT2
gcgaauugcgaguaaccu

SEQ ID NO: 1836598 - RNA, 14 nt, Salmonella typhimurium LT2
gcgacaucccagac

SEQ ID NO: 1836599 - RNA, 16 nt, Salmonella typhimurium LT2
gcgaccaacagcauca

SEQ ID NO: 1836600 - RNA, 17 nt, Salmonella typhimurium LT2
gcgaccaauauccgcag

SEQ ID NO: 1836601 - RNA, 14 nt, Salmonella typhimurium LT2
gcgacaucagccag

SEQ ID NO: 1836602 - RNA, 16 nt, Salmonella typhimurium LT2
gcgacaucagccagcc

SEQ ID NO: 1836603 - RNA, 21 nt, Salmonella typhimurium LT2
gcgaccacuagcgccgccagc

SEQ ID NO: 1836604 - RNA, 18 nt, Salmonella typhimurium LT2
gcgaccaccgucccagua

SEQ ID NO: 1836605 - RNA, 18 nt, Salmonella typhimurium LT2
gcgaccacgccagccagc

SEQ ID NO: 1836606 - RNA, 19 nt, Salmonella typhimurium LT2
gcgaccacgccagccagcc

SEQ ID NO: 1836607 - RNA, 23 nt, Salmonella typhimurium LT2
gcgaccggcucgcuguucgccag

SEQ ID NO: 1836608 - RNA, 14 nt, Salmonella typhimurium LT2
gcgacgccgccauc

SEQ ID NO: 1836609 - RNA, 21 nt, Salmonella typhimurium LT2
gcgacgccucguuugcugagc

SEQ ID NO: 1836610 - RNA, 13 nt, Salmonella typhimurium LT2
gcgacgcgcaccc

SEQ ID NO: 1836611 - RNA, 14 nt, Salmonella typhimurium LT2
gcgagaaucgccag

SEQ ID NO: 1836612 - RNA, 15 nt, Salmonella typhimurium LT2
gcgagaaucgccagg

SEQ ID NO: 1836613 - RNA, 17 nt, Salmonella typhimurium LT2
gcgagaaugucgccaug

SEQ ID NO: 1836614 - RNA, 23 nt, Salmonella typhimurium LT2
gcgacucgccguuuuaucgcccg

SEQ ID NO: 1836615 - RNA, 16 nt, Salmonella typhimurium LT2
gcgacuaucgccgccc

SEQ ID NO: 1836616 - RNA, 18 nt, Salmonella typhimurium LT2
gcgagcaguucagcagca

SEQ ID NO: 1836617 - RNA, 16 nt, Salmonella typhimurium LT2
gcgacggaccggcagc

SEQ ID NO: 1836618 - RNA, 16 nt, Salmonella typhimurium LT2
gcgacggcaucggcau

SEQ ID NO: 1836619 - RNA, 15 nt, Salmonella typhimurium LT2
gcgacgcucuuugga

SEQ ID NO: 1836620 - RNA, 18 nt, Salmonella typhimurium LT2
gcgacguccgccaacagc

SEQ ID NO: 1836621 - RNA, 17 nt, Salmonella typhimurium LT2
gcgacguuaacgccgcc

SEQ ID NO: 1836622 - RNA, 21 nt, Salmonella typhimurium LT2
gcgacguuuucaauaucggcg

SEQ ID NO: 1836623 - RNA, 14 nt, Salmonella typhimurium LT2
gcgaugccugccgg

SEQ ID NO: 1836624 - RNA, 19 nt, Salmonella typhimurium LT2
gcgaugccgacgcccgcuu

SEQ ID NO: 1836625 - RNA, 13 nt, Salmonella typhimurium LT2
gcgaucgcuucca

SEQ ID NO: 1836626 - RNA, 17 nt, Salmonella typhimurium LT2
gcgaucagcgccaccac

SEQ ID NO: 1836627 - RNA, 19 nt, Salmonella typhimurium LT2
gcgaucagacgcugguugu

SEQ ID NO: 1836628 - RNA, 15 nt, Salmonella typhimurium LT2
gcgaucagcgccacc

SEQ ID NO: 1836629 - RNA, 13 nt, Salmonella typhimurium LT2
gcgaucagcaggu

SEQ ID NO: 1836630 - RNA, 19 nt, Salmonella typhimurium LT2
gcgauauccagcgccagga

SEQ ID NO: 1836631 - RNA, 12 nt, Salmonella typhimurium LT2
gcgaucaccacg

SEQ ID NO: 1836632 - RNA, 20 nt, Salmonella typhimurium LT2
gcgaucaccagcaccgccag

SEQ ID NO: 1836633 - RNA, 24 nt, Salmonella typhimurium LT2
gcgaucaccagcaccgccagcgca

SEQ ID NO: 1836634 - RNA, 21 nt, Salmonella typhimurium LT2
gcgauaaaaauauccgccauc

SEQ ID NO: 1836635 - RNA, 14 nt, Salmonella typhimurium LT2
gcgauaaacgccag

SEQ ID NO: 1836636 - RNA, 17 nt, Salmonella typhimurium LT2
gcgagguucccgccgcc

SEQ ID NO: 1836637 - RNA, 19 nt, Salmonella typhimurium LT2
gcgagcguuuugaugucca

SEQ ID NO: 1836638 - RNA, 19 nt, Salmonella typhimurium LT2
gcgcauccugcaaaaggaa

SEQ ID NO: 1836639 - RNA, 15 nt, Salmonella typhimurium LT2
gcgcauguaaccaaa

SEQ ID NO: 1836640 - RNA, 12 nt, Salmonella typhimurium LT2
gcgcauggaaga

SEQ ID NO: 1836641 - RNA, 19 nt, Salmonella typhimurium LT2
gcgcauugccugaaccggu

SEQ ID NO: 1836642 - RNA, 14 nt, Salmonella typhimurium LT2
gcgcauugcccuuc

SEQ ID NO: 1836643 - RNA, 17 nt, Salmonella typhimurium LT2
gcgccaaugcgaaaaua

SEQ ID NO: 1836644 - RNA, 21 nt, Salmonella typhimurium LT2
gcgccaaucaccgccagcaac

SEQ ID NO: 1836645 - RNA, 19 nt, Salmonella typhimurium LT2
gcgccaacggccucccagc

SEQ ID NO: 1836646 - RNA, 13 nt, Salmonella typhimurium LT2
gcgccaagcaccu

SEQ ID NO: 1836647 - RNA, 19 nt, Salmonella typhimurium LT2
gcgccaaaagaggcagcaa

SEQ ID NO: 1836648 - RNA, 17 nt, Salmonella typhimurium LT2
gcgccaaaagaggcagc

SEQ ID NO: 1836649 - RNA, 18 nt, Salmonella typhimurium LT2
gcgccaaaagaggcagca

SEQ ID NO: 1836650 - RNA, 20 nt, Salmonella typhimurium LT2
gcgccaaagcaaucgccagc

SEQ ID NO: 1836651 - RNA, 18 nt, Salmonella typhimurium LT2
gcgccaaacgggcaagcc

SEQ ID NO: 1836652 - RNA, 17 nt, Salmonella typhimurium LT2
gcgcauuuucggcagcg

SEQ ID NO: 1836653 - RNA, 15 nt, Salmonella typhimurium LT2
gcgccacgcccagcg

SEQ ID NO: 1836654 - RNA, 22 nt, Salmonella typhimurium LT2
gcgccaccgggcaacacacgcu

SEQ ID NO: 1836655 - RNA, 13 nt, Salmonella typhimurium LT2
gcgccacgcgcuc

SEQ ID NO: 1836656 - RNA, 15 nt, Salmonella typhimurium LT2
gcgccagcccugcga

SEQ ID NO: 1836657 - RNA, 12 nt, Salmonella typhimurium LT2
gcgccagcccug

SEQ ID NO: 1836658 - RNA, 17 nt, Salmonella typhimurium LT2
gcgccagccgcgccauc

SEQ ID NO: 1836659 - RNA, 18 nt, Salmonella typhimurium LT2
gcgccagccagucgccag

SEQ ID NO: 1836660 - RNA, 12 nt, Salmonella typhimurium LT2
gcgccagcaggu

SEQ ID NO: 1836661 - RNA, 21 nt, Salmonella typhimurium LT2
gcgccagcaggucgcacuccu

SEQ ID NO: 1836662 - RNA, 14 nt, Salmonella typhimurium LT2
gcgccagcaccaug

SEQ ID NO: 1836663 - RNA, 11 nt, Salmonella typhimurium LT2
gcgccaucggc

SEQ ID NO: 1836664 - RNA, 20 nt, Salmonella typhimurium LT2
gcgccaucgggcaauggcag

SEQ ID NO: 1836665 - RNA, 14 nt, Salmonella typhimurium LT2
gcgccaugauccag

SEQ ID NO: 1836666 - RNA, 16 nt, Salmonella typhimurium LT2
gcgccauauccgcaga

SEQ ID NO: 1836667 - RNA, 19 nt, Salmonella typhimurium LT2
gcgccauacuuacugcugu

SEQ ID NO: 1836668 - RNA, 18 nt, Salmonella typhimurium LT2
gcgccauauuaacaaugc

SEQ ID NO: 1836669 - RNA, 21 nt, Salmonella typhimurium LT2
gcgccauauugcuguauuuua

SEQ ID NO: 1836670 - RNA, 20 nt, Salmonella typhimurium LT2
gcgccauccaccaggcaugc

SEQ ID NO: 1836671 - RNA, 14 nt, Salmonella typhimurium LT2
gcgccaucaugcag

SEQ ID NO: 1836672 - RNA, 18 nt, Salmonella typhimurium LT2
gcgccauccaccaggcau

SEQ ID NO: 1836673 - RNA, 19 nt, Salmonella typhimurium LT2
gcgccaucaggcauggcag

SEQ ID NO: 1836674 - RNA, 16 nt, Salmonella typhimurium LT2
gcgccaucaggcacaa

SEQ ID NO: 1836675 - RNA, 23 nt, Salmonella typhimurium LT2
gcgccaguuggcguaccaucagc

SEQ ID NO: 1836676 - RNA, 14 nt, Salmonella typhimurium LT2
gcgccaguuuuucc

SEQ ID NO: 1836677 - RNA, 20 nt, Salmonella typhimurium LT2
gcgccaguucauccagcagc

SEQ ID NO: 1836678 - RNA, 21 nt, Salmonella typhimurium LT2
gcgccaguucauccagcagca

SEQ ID NO: 1836679 - RNA, 13 nt, Salmonella typhimurium LT2
gcgcacaugcagc

SEQ ID NO: 1836680 - RNA, 22 nt, Salmonella typhimurium LT2
gcgcaccagccggugcucgccg

SEQ ID NO: 1836681 - RNA, 14 nt, Salmonella typhimurium LT2
gcgcacacgcccag

SEQ ID NO: 1836682 - RNA, 19 nt, Salmonella typhimurium LT2
gcgcagaauucugagguga

SEQ ID NO: 1836683 - RNA, 22 nt, Salmonella typhimurium LT2
gcgcagcgaaacugcgcgccgg

SEQ ID NO: 1836684 - RNA, 20 nt, Salmonella typhimurium LT2
gcgcagcgccaucaggcaau

SEQ ID NO: 1836685 - RNA, 18 nt, Salmonella typhimurium LT2
gcgcagcgccaucaggcc

SEQ ID NO: 1836686 - RNA, 18 nt, Salmonella typhimurium LT2
gcgcagcgccauccggca

SEQ ID NO: 1836687 - RNA, 14 nt, Salmonella typhimurium LT2
gcgcagcgcccagc

SEQ ID NO: 1836688 - RNA, 17 nt, Salmonella typhimurium LT2
gcgcagcgcccagcagc

SEQ ID NO: 1836689 - RNA, 14 nt, Salmonella typhimurium LT2
gcgcagucacagau

SEQ ID NO: 1836690 - RNA, 20 nt, Salmonella typhimurium LT2
gcgcaguaaacuccucuucc

SEQ ID NO: 1836691 - RNA, 23 nt, Salmonella typhimurium LT2
gcgcagguuuugcagauccgcga

SEQ ID NO: 1836692 - RNA, 16 nt, Salmonella typhimurium LT2
gcgcagucagugaaaa

SEQ ID NO: 1836693 - RNA, 19 nt, Salmonella typhimurium LT2
gcgcagucagugaaaaacc

SEQ ID NO: 1836694 - RNA, 13 nt, Salmonella typhimurium LT2
gcgcaguggcggc

SEQ ID NO: 1836695 - RNA, 14 nt, Salmonella typhimurium LT2
gcgcaguggcggcu

SEQ ID NO: 1836696 - RNA, 17 nt, Salmonella typhimurium LT2
gcgcauaggcuuugcug

SEQ ID NO: 1836697 - RNA, 23 nt, Salmonella typhimurium LT2
gcgcauacucauuaccggcugcc

SEQ ID NO: 1836698 - RNA, 23 nt, Salmonella typhimurium LT2
gcgcauacgcuguccagucaaaa

SEQ ID NO: 1836699 - RNA, 11 nt, Salmonella typhimurium LT2
gcgcauccagc

SEQ ID NO: 1836700 - RNA, 12 nt, Salmonella typhimurium LT2
gcgcaucaguac

SEQ ID NO: 1836701 - RNA, 19 nt, Salmonella typhimurium LT2
gcgcaucaaugucgcgcuc

SEQ ID NO: 1836702 - RNA, 21 nt, Salmonella typhimurium LT2
gcugccgccauuugcgcggcu

SEQ ID NO: 1836703 - RNA, 13 nt, Salmonella typhimurium LT2
gcugcgacaacaa

SEQ ID NO: 1836704 - RNA, 15 nt, Salmonella typhimurium LT2
gcugccgcccuuucc

SEQ ID NO: 1836705 - RNA, 19 nt, Salmonella typhimurium LT2
gcugccgcaacggucgguc

SEQ ID NO: 1836706 - RNA, 19 nt, Salmonella typhimurium LT2
gcugccgauacuccauugu

SEQ ID NO: 1836707 - RNA, 22 nt, Salmonella typhimurium LT2
gcugccgauagcaucgcugaug

SEQ ID NO: 1836708 - RNA, 19 nt, Salmonella typhimurium LT2
gcugccgaugaucccggcg

SEQ ID NO: 1836709 - RNA, 22 nt, Salmonella typhimurium LT2
gcugccgacuacgccuccugcc

SEQ ID NO: 1836710 - RNA, 22 nt, Salmonella typhimurium LT2
gcugccgacaaagagcucccca

SEQ ID NO: 1836711 - RNA, 17 nt, Salmonella typhimurium LT2
gcugccauuaucaccau

SEQ ID NO: 1836712 - RNA, 17 nt, Salmonella typhimurium LT2
gcugcacgccaucggcu

SEQ ID NO: 1836713 - RNA, 20 nt, Salmonella typhimurium LT2
gcugcacccggagagaaaca

SEQ ID NO: 1836714 - RNA, 15 nt, Salmonella typhimurium LT2
gcugcaacucuccca

SEQ ID NO: 1836715 - RNA, 18 nt, Salmonella typhimurium LT2
gcugcaaagcaucugccg

SEQ ID NO: 1836716 - RNA, 19 nt, Salmonella typhimurium LT2
gcugauuccggcgcaucca

SEQ ID NO: 1836717 - RNA, 20 nt, Salmonella typhimurium LT2
gcugauuuguuaucuacagu

SEQ ID NO: 1836718 - RNA, 21 nt, Salmonella typhimurium LT2
gcugcagcuuaggauucgcca

SEQ ID NO: 1836719 - RNA, 14 nt, Salmonella typhimurium LT2
gcugcauaaaacug

SEQ ID NO: 1836720 - RNA, 13 nt, Salmonella typhimurium LT2
gcugccagccgcc

SEQ ID NO: 1836721 - RNA, 14 nt, Salmonella typhimurium LT2
gcugccacacucuc

SEQ ID NO: 1836722 - RNA, 19 nt, Salmonella typhimurium LT2
gcugccacacucucuccag

SEQ ID NO: 1836723 - RNA, 21 nt, Salmonella typhimurium LT2
gcugcaucuuacugaccggcc

SEQ ID NO: 1836724 - RNA, 14 nt, Salmonella typhimurium LT2
gcugcuggacagga

SEQ ID NO: 1836725 - RNA, 16 nt, Salmonella typhimurium LT2
gcugcugcgcggccag

SEQ ID NO: 1836726 - RNA, 14 nt, Salmonella typhimurium LT2
gcugcuggcgcguc

SEQ ID NO: 1836727 - RNA, 14 nt, Salmonella typhimurium LT2
gcugcuguaacaga

SEQ ID NO: 1836728 - RNA, 14 nt, Salmonella typhimurium LT2
gcuggaaauguucu

SEQ ID NO: 1836729 - RNA, 19 nt, Salmonella typhimurium LT2
gcuggaaccugaguucccg

SEQ ID NO: 1836730 - RNA, 23 nt, Salmonella typhimurium LT2
gcugcuuuuggcggcaacaaaug

SEQ ID NO: 1836731 - RNA, 22 nt, Salmonella typhimurium LT2
gcuggaaagcucuucaugcagc

SEQ ID NO: 1836732 - RNA, 21 nt, Salmonella typhimurium LT2
gcuggaaaaauaagagggcgc

SEQ ID NO: 1836733 - RNA, 22 nt, Salmonella typhimurium LT2
gcugcuugcuuuucaucaccau

SEQ ID NO: 1836734 - RNA, 14 nt, Salmonella typhimurium LT2
gcuggcacuggcag

SEQ ID NO: 1836735 - RNA, 13 nt, Salmonella typhimurium LT2
gcuggcaaagcag

SEQ ID NO: 1836736 - RNA, 16 nt, Salmonella typhimurium LT2
gcuggcaaaacgcauc

SEQ ID NO: 1836737 - RNA, 18 nt, Salmonella typhimurium LT2
gcuggcaaaacgcaucca

SEQ ID NO: 1836738 - RNA, 16 nt, Salmonella typhimurium LT2
gcugcggauguuaaug

SEQ ID NO: 1836739 - RNA, 17 nt, Salmonella typhimurium LT2
gcugcgcuuuccaggcc

SEQ ID NO: 1836740 - RNA, 23 nt, Salmonella typhimurium LT2
gcugcggcgucccccaauguuca

SEQ ID NO: 1836741 - RNA, 15 nt, Salmonella typhimurium LT2
gcugcggccuccgca

SEQ ID NO: 1836742 - RNA, 11 nt, Salmonella typhimurium LT2
gcugcggccug

SEQ ID NO: 1836743 - RNA, 14 nt, Salmonella typhimurium LT2
gcugcgccagcagc

SEQ ID NO: 1836744 - RNA, 21 nt, Salmonella typhimurium LT2
gcugcgccaucaggcauggca

SEQ ID NO: 1836745 - RNA, 22 nt, Salmonella typhimurium LT2
gcugcgccugaaaggcacgcuc

SEQ ID NO: 1836746 - RNA, 12 nt, Salmonella typhimurium LT2
gcugcgccgcgc

SEQ ID NO: 1836747 - RNA, 14 nt, Salmonella typhimurium LT2
gcugcgcggccaga

SEQ ID NO: 1836748 - RNA, 12 nt, Salmonella typhimurium LT2
gcugcucccuca

SEQ ID NO: 1836749 - RNA, 14 nt, Salmonella typhimurium LT2
gcugcucuucuugc

SEQ ID NO: 1836750 - RNA, 16 nt, Salmonella typhimurium LT2
gcugcguugccgccuu

SEQ ID NO: 1836751 - RNA, 17 nt, Salmonella typhimurium LT2
gcugcuauuuugcgcuu

SEQ ID NO: 1836752 - RNA, 21 nt, Salmonella typhimurium LT2
gcugcgucgcuuccuguucac

SEQ ID NO: 1836753 - RNA, 23 nt, Salmonella typhimurium LT2
gcugcgguauuaacccgcagccg

SEQ ID NO: 1836754 - RNA, 22 nt, Salmonella typhimurium LT2
gcuguaggcacuuuccagacca

SEQ ID NO: 1836755 - RNA, 12 nt, Salmonella typhimurium LT2
gcuguagcguuu

SEQ ID NO: 1836756 - RNA, 21 nt, Salmonella typhimurium LT2
gcuguagcguuucgcgcgcgc

SEQ ID NO: 1836757 - RNA, 13 nt, Salmonella typhimurium LT2
gcuguagcugccc

SEQ ID NO: 1836758 - RNA, 15 nt, Salmonella typhimurium LT2
gcuguagccagccug

SEQ ID NO: 1836759 - RNA, 15 nt, Salmonella typhimurium LT2
gcugucaccagcagc

SEQ ID NO: 1836760 - RNA, 21 nt, Salmonella typhimurium LT2
gcugucagcacaauccauagg

SEQ ID NO: 1836761 - RNA, 21 nt, Salmonella typhimurium LT2
gcuguccauaccggacuccag

SEQ ID NO: 1836762 - RNA, 12 nt, Salmonella typhimurium LT2
gcugucccagag

SEQ ID NO: 1836763 - RNA, 14 nt, Salmonella typhimurium LT2
gcugucccagaguu

SEQ ID NO: 1836764 - RNA, 14 nt, Salmonella typhimurium LT2
gcuguccgcccaac

SEQ ID NO: 1836765 - RNA, 20 nt, Salmonella typhimurium LT2
gcuguccgcccaacaccagc

SEQ ID NO: 1836766 - RNA, 16 nt, Salmonella typhimurium LT2
gcugucgccgcuguuu

SEQ ID NO: 1836767 - RNA, 17 nt, Salmonella typhimurium LT2
gcugucgccaccuugua

SEQ ID NO: 1836768 - RNA, 16 nt, Salmonella typhimurium LT2
gcuguacauauccagu

SEQ ID NO: 1836769 - RNA, 23 nt, Salmonella typhimurium LT2
gcuguaaauguuguuccagagug

SEQ ID NO: 1836770 - RNA, 18 nt, Salmonella typhimurium LT2
gcuguaauagauaugaaa

SEQ ID NO: 1836771 - RNA, 18 nt, Salmonella typhimurium LT2
gcuguaaaucgcgcccga

SEQ ID NO: 1836772 - RNA, 18 nt, Salmonella typhimurium LT2
gcuguaaaucugauaauc

SEQ ID NO: 1836773 - RNA, 16 nt, Salmonella typhimurium LT2
gcugguugccuuccug

SEQ ID NO: 1836774 - RNA, 16 nt, Salmonella typhimurium LT2
gcugguuggcgcgcuc

SEQ ID NO: 1836775 - RNA, 21 nt, Salmonella typhimurium LT2
gcuguuuugcuucuucagccu

SEQ ID NO: 1836776 - RNA, 23 nt, Salmonella typhimurium LT2
gcuguuuuucaucaucauccaga

SEQ ID NO: 1836777 - RNA, 21 nt, Salmonella typhimurium LT2
gcuguuuuucaucaucaucca

SEQ ID NO: 1836778 - RNA, 16 nt, Salmonella typhimurium LT2
gcuguuaccguaagcg

SEQ ID NO: 1836779 - RNA, 19 nt, Salmonella typhimurium LT2
gcuguuaauuucauaaaug

SEQ ID NO: 1836780 - RNA, 13 nt, Salmonella typhimurium LT2
gcuguuccucggg

SEQ ID NO: 1836781 - RNA, 15 nt, Salmonella typhimurium LT2
gcuguguccgccaug

SEQ ID NO: 1836782 - RNA, 15 nt, Salmonella typhimurium LT2
gcugucgguuaacac

SEQ ID NO: 1836783 - RNA, 15 nt, Salmonella typhimurium LT2
gcuggcuuaacucac

SEQ ID NO: 1836784 - RNA, 18 nt, Salmonella typhimurium LT2
gcuggcuggcgcaauguu

SEQ ID NO: 1836785 - RNA, 14 nt, Salmonella typhimurium LT2
gcuggcuuaacuca

SEQ ID NO: 1836786 - RNA, 17 nt, Salmonella typhimurium LT2
gcuggcugaaccccugu

SEQ ID NO: 1836787 - RNA, 22 nt, Salmonella typhimurium LT2
gcugggcuuuauccugaccgcu

SEQ ID NO: 1836788 - RNA, 20 nt, Salmonella typhimurium LT2
gcuggguugauaccggagga

SEQ ID NO: 1836789 - RNA, 23 nt, Salmonella typhimurium LT2
gcugguaaauaacgggcgcgcgc

SEQ ID NO: 1836790 - RNA, 15 nt, Salmonella typhimurium LT2
gcugggucagugguc

SEQ ID NO: 1836791 - RNA, 16 nt, Salmonella typhimurium LT2
gcuggggcuggcggcg

SEQ ID NO: 1836792 - RNA, 16 nt, Salmonella typhimurium LT2
gcuggucgccagcgcc

SEQ ID NO: 1836793 - RNA, 15 nt, Salmonella typhimurium LT2
gcuggugaagacgcu

SEQ ID NO: 1836794 - RNA, 13 nt, Salmonella typhimurium LT2
gcuggucgagaua

SEQ ID NO: 1836795 - RNA, 15 nt, Salmonella typhimurium LT2
gcuggucgccagcgc

SEQ ID NO: 1836796 - RNA, 21 nt, Salmonella typhimurium LT2
gcuggucagcgcaaucugcuc

SEQ ID NO: 1836797 - RNA, 20 nt, Salmonella typhimurium LT2
gcuggucagcagaaacuggc

SEQ ID NO: 1836798 - RNA, 18 nt, Salmonella typhimurium LT2
gcugguagacaaacagcg

SEQ ID NO: 1836799 - RNA, 19 nt, Salmonella typhimurium LT2
gcuggcgauaaugccguga

SEQ ID NO: 1836800 - RNA, 18 nt, Salmonella typhimurium LT2
gcuggcgagcagaaaaag

SEQ ID NO: 1836801 - RNA, 20 nt, Salmonella typhimurium LT2
gcuggcgcggggaacacaau

SEQ ID NO: 1836802 - RNA, 19 nt, Salmonella typhimurium LT2
gcuggcgcggggaacacua

SEQ ID NO: 1836803 - RNA, 16 nt, Salmonella typhimurium LT2
gcuggcgcagccgcuu

SEQ ID NO: 1836804 - RNA, 14 nt, Salmonella typhimurium LT2
gcuggcggccccuc

SEQ ID NO: 1836805 - RNA, 19 nt, Salmonella typhimurium LT2
gcuggcgucgccaaagcag

SEQ ID NO: 1836806 - RNA, 14 nt, Salmonella typhimurium LT2
gcuggcggucggga

SEQ ID NO: 1836807 - RNA, 21 nt, Salmonella typhimurium LT2
gcuggcgguggauggcuuccg

SEQ ID NO: 1836808 - RNA, 19 nt, Salmonella typhimurium LT2
gcuggcgggguucgggcag

SEQ ID NO: 1836809 - RNA, 17 nt, Salmonella typhimurium LT2
gcuggcgaaccaccagc

SEQ ID NO: 1836810 - RNA, 16 nt, Salmonella typhimurium LT2
gcuggccuuuauacca

SEQ ID NO: 1836811 - RNA, 22 nt, Salmonella typhimurium LT2
gcuggccuagaugaaugacugu

SEQ ID NO: 1836812 - RNA, 14 nt, Salmonella typhimurium LT2
gcuggccgcgugcu

SEQ ID NO: 1836813 - RNA, 14 nt, Salmonella typhimurium LT2
gcuggcaggcgcga

SEQ ID NO: 1836814 - RNA, 16 nt, Salmonella typhimurium LT2
gcuggcauaaccgcag

SEQ ID NO: 1836815 - RNA, 17 nt, Salmonella typhimurium LT2
gcuuacgcggcgcgcuc

SEQ ID NO: 1836816 - RNA, 17 nt, Salmonella typhimurium LT2
gcuuagcucaucagccu

SEQ ID NO: 1836817 - RNA, 16 nt, Salmonella typhimurium LT2
gcuuauuauuuuuucu

SEQ ID NO: 1836818 - RNA, 17 nt, Salmonella typhimurium LT2
gcuuauuauuuuuucuu

SEQ ID NO: 1836819 - RNA, 17 nt, Salmonella typhimurium LT2
gcuuaucgggcaacuga

SEQ ID NO: 1836820 - RNA, 16 nt, Salmonella typhimurium LT2
gcuuaucgggccuaca

SEQ ID NO: 1836821 - RNA, 23 nt, Salmonella typhimurium LT2
gcuuaucgauaucugccugcaga

SEQ ID NO: 1836822 - RNA, 15 nt, Salmonella typhimurium LT2
gcuuauccagccacu

SEQ ID NO: 1836823 - RNA, 16 nt, Salmonella typhimurium LT2
gcuuaucgccaaagau

SEQ ID NO: 1836824 - RNA, 16 nt, Salmonella typhimurium LT2
gcuuaucaggccuaca

SEQ ID NO: 1836825 - RNA, 21 nt, Salmonella typhimurium LT2
gcuuaucaggccuacgugcuc

SEQ ID NO: 1836826 - RNA, 19 nt, Salmonella typhimurium LT2
gcuuaccgcggucaccuuc

SEQ ID NO: 1836827 - RNA, 23 nt, Salmonella typhimurium LT2
gcuuaccuuguucuuccauugcu

SEQ ID NO: 1836828 - RNA, 14 nt, Salmonella typhimurium LT2
gcuuacauuucagg

SEQ ID NO: 1836829 - RNA, 23 nt, Salmonella typhimurium LT2
gcuuacauuucaggcaaaaaaaa

SEQ ID NO: 1836830 - RNA, 13 nt, Salmonella typhimurium LT2
gcuuaccagaccg

SEQ ID NO: 1836831 - RNA, 17 nt, Salmonella typhimurium LT2
gcuuacaguuuaucugc

SEQ ID NO: 1836832 - RNA, 18 nt, Salmonella typhimurium LT2
gcuuaacagaauugcgcc

SEQ ID NO: 1836833 - RNA, 13 nt, Salmonella typhimurium LT2
gcuuaaaaaaucc

SEQ ID NO: 1836834 - RNA, 15 nt, Salmonella typhimurium LT2
gcuuaaaaaauccug

SEQ ID NO: 1836835 - RNA, 16 nt, Salmonella typhimurium LT2
gcuuaaucgagagcgg

SEQ ID NO: 1836836 - RNA, 18 nt, Salmonella typhimurium LT2
gcuuaauggcgucaauca

SEQ ID NO: 1836837 - RNA, 16 nt, Salmonella typhimurium LT2
gcuuaaugcucugcug

SEQ ID NO: 1836838 - RNA, 15 nt, Salmonella typhimurium LT2
gcuucaucugguuuu

SEQ ID NO: 1836839 - RNA, 19 nt, Salmonella typhimurium LT2
gcuucauugguuaauucaa

SEQ ID NO: 1836840 - RNA, 12 nt, Salmonella typhimurium LT2
gcuucagcgaca

SEQ ID NO: 1836841 - RNA, 21 nt, Salmonella typhimurium LT2
gcuucagucauaauccuuccu

SEQ ID NO: 1836842 - RNA, 20 nt, Salmonella typhimurium LT2
gcuucaccggcgugcgcuua

SEQ ID NO: 1836843 - RNA, 18 nt, Salmonella typhimurium LT2
gcuucaccgauuuaaaau

SEQ ID NO: 1836844 - RNA, 16 nt, Salmonella typhimurium LT2
gcuucacgaagucugg

SEQ ID NO: 1836845 - RNA, 23 nt, Salmonella typhimurium LT2
gcuucacgagcggucaggccagc

SEQ ID NO: 1836846 - RNA, 22 nt, Salmonella typhimurium LT2
gcuucacgcgcuguaacuucac

SEQ ID NO: 1836847 - RNA, 21 nt, Salmonella typhimurium LT2
gcuucagaaagcagguuuuga

SEQ ID NO: 1836848 - RNA, 19 nt, Salmonella typhimurium LT2
gcuucaaccguuucuuuuu

SEQ ID NO: 1836849 - RNA, 17 nt, Salmonella typhimurium LT2
gcuucaacagcggcggc

SEQ ID NO: 1836850 - RNA, 14 nt, Salmonella typhimurium LT2
gcuuauugcccagg

SEQ ID NO: 1836851 - RNA, 18 nt, Salmonella typhimurium LT2
gcuucuuauuauccaggc

SEQ ID NO: 1836852 - RNA, 22 nt, Salmonella typhimurium LT2
gcuucuucaacguuuucaccug

SEQ ID NO: 1836853 - RNA, 18 nt, Salmonella typhimurium LT2
gcuucuucuuuagauaau

SEQ ID NO: 1836854 - RNA, 13 nt, Salmonella typhimurium LT2
gcuucuucuacca

SEQ ID NO: 1836855 - RNA, 17 nt, Salmonella typhimurium LT2
gcuucuuccggccccgg

SEQ ID NO: 1836856 - RNA, 21 nt, Salmonella typhimurium LT2
gcuucuuugaagcguuccagu

SEQ ID NO: 1836857 - RNA, 21 nt, Salmonella typhimurium LT2
gcuucguggcaaucagcaauu

SEQ ID NO: 1836858 - RNA, 15 nt, Salmonella typhimurium LT2
gcuucgugagaagua

SEQ ID NO: 1836859 - RNA, 17 nt, Salmonella typhimurium LT2
gcuucugauacugcucc

SEQ ID NO: 1836860 - RNA, 15 nt, Salmonella typhimurium LT2
gcuucuggcggcggc

SEQ ID NO: 1836861 - RNA, 21 nt, Salmonella typhimurium LT2
gcuucugcgccuuuggcagga

SEQ ID NO: 1836862 - RNA, 14 nt, Salmonella typhimurium LT2
gcuucucuuuccag

SEQ ID NO: 1836863 - RNA, 16 nt, Salmonella typhimurium LT2
gcuucugauacugcuc

SEQ ID NO: 1836864 - RNA, 19 nt, Salmonella typhimurium LT2
gcuucucuucaaacucgcu

SEQ ID NO: 1836865 - RNA, 11 nt, Salmonella typhimurium LT2
gcuucucccaa

SEQ ID NO: 1836866 - RNA, 19 nt, Salmonella typhimurium LT2
gcuucucccagccgucaug

SEQ ID NO: 1836867 - RNA, 15 nt, Salmonella typhimurium LT2
gcuucucgccuucag

SEQ ID NO: 1836868 - RNA, 14 nt, Salmonella typhimurium LT2
gcuucgucagcucc

SEQ ID NO: 1836869 - RNA, 15 nt, Salmonella typhimurium LT2
gcuucguccagaucc

SEQ ID NO: 1836870 - RNA, 17 nt, Salmonella typhimurium LT2
gcuucgcucucgugcca

SEQ ID NO: 1836871 - RNA, 19 nt, Salmonella typhimurium LT2
gcuucgcucuccgccgcgg

SEQ ID NO: 1836872 - RNA, 14 nt, Salmonella typhimurium LT2
gcuucgcuuaccag

SEQ ID NO: 1836873 - RNA, 13 nt, Salmonella typhimurium LT2
gcuucgccaauaa

SEQ ID NO: 1836874 - RNA, 18 nt, Salmonella typhimurium LT2
gcuucgacaaacagcugu

SEQ ID NO: 1836875 - RNA, 15 nt, Salmonella typhimurium LT2
gcuuccuguuuauga

SEQ ID NO: 1836876 - RNA, 19 nt, Salmonella typhimurium LT2
gcuuccugcgcugucacca

SEQ ID NO: 1836877 - RNA, 15 nt, Salmonella typhimurium LT2
gcuuccguccccagc

SEQ ID NO: 1836878 - RNA, 23 nt, Salmonella typhimurium LT2
gcuuccguuuuguugccgcccgu

SEQ ID NO: 1836879 - RNA, 15 nt, Salmonella typhimurium LT2
gcuuccgccaugguu

SEQ ID NO: 1836880 - RNA, 14 nt, Salmonella typhimurium LT2
gcuuccgccgggaa

SEQ ID NO: 1836881 - RNA, 16 nt, Salmonella typhimurium LT2
gcuucccgaugccagc

SEQ ID NO: 1836882 - RNA, 15 nt, Salmonella typhimurium LT2
gcuucccccggcgcc

SEQ ID NO: 1836883 - RNA, 13 nt, Salmonella typhimurium LT2
gcuuccagcucca

SEQ ID NO: 1836884 - RNA, 21 nt, Salmonella typhimurium LT2
gcuuccagcgcgucggccggc

SEQ ID NO: 1836885 - RNA, 17 nt, Salmonella typhimurium LT2
gcuuccagcuccaucca

SEQ ID NO: 1836886 - RNA, 22 nt, Salmonella typhimurium LT2
gcuuccaguugaaaaccacaau

SEQ ID NO: 1836887 - RNA, 14 nt, Salmonella typhimurium LT2
gcuucccaaaagga

SEQ ID NO: 1836888 - RNA, 16 nt, Salmonella typhimurium LT2
gcuucccaaaaggaag

SEQ ID NO: 1836889 - RNA, 17 nt, Salmonella typhimurium LT2
gcuucccaaaaggaagc

SEQ ID NO: 1836890 - RNA, 15 nt, Salmonella typhimurium LT2
gcuugacucugaagc

SEQ ID NO: 1836891 - RNA, 14 nt, Salmonella typhimurium LT2
gcuugacucugaag

SEQ ID NO: 1836892 - RNA, 16 nt, Salmonella typhimurium LT2
gcuugagccagugagc

SEQ ID NO: 1836893 - RNA, 20 nt, Salmonella typhimurium LT2
gcuugaucucucccuggcag

SEQ ID NO: 1836894 - RNA, 19 nt, Salmonella typhimurium LT2
gcuugaguuuuccgccauu

SEQ ID NO: 1836895 - RNA, 16 nt, Salmonella typhimurium LT2
gcuugcccagcauauu

SEQ ID NO: 1836896 - RNA, 16 nt, Salmonella typhimurium LT2
gcuugccccucuuuuu

SEQ ID NO: 1836897 - RNA, 20 nt, Salmonella typhimurium LT2
gcuugccacuacgcagcucc

SEQ ID NO: 1836898 - RNA, 19 nt, Salmonella typhimurium LT2
gcuugcauugcuuuuaguu

SEQ ID NO: 1836899 - RNA, 18 nt, Salmonella typhimurium LT2
gcuugccaaagcgggcaa

SEQ ID NO: 1836900 - RNA, 15 nt, Salmonella typhimurium LT2
gcuugcaccauggcg

SEQ ID NO: 1836901 - RNA, 21 nt, Salmonella typhimurium LT2
gcuugcccggccuacauucau

SEQ ID NO: 1836902 - RNA, 20 nt, Salmonella typhimurium LT2
gcuugccaguacgccaggcu

SEQ ID NO: 1836903 - RNA, 22 nt, Salmonella typhimurium LT2
gcuugccgucgcaggcggccag

SEQ ID NO: 1836904 - RNA, 21 nt, Salmonella typhimurium LT2
gcuugccgucgucauaagcaa

SEQ ID NO: 1836905 - RNA, 18 nt, Salmonella typhimurium LT2
gcuugccgguucgcgacu

SEQ ID NO: 1836906 - RNA, 15 nt, Salmonella typhimurium LT2
gcuugcgcuauccgc

SEQ ID NO: 1836907 - RNA, 14 nt, Salmonella typhimurium LT2
gcuugcggcugcca

SEQ ID NO: 1836908 - RNA, 20 nt, Salmonella typhimurium LT2
gcuuggccaguggggcugcu

SEQ ID NO: 1836909 - RNA, 19 nt, Salmonella typhimurium LT2
gcuugcucguaccaggccc

SEQ ID NO: 1836910 - RNA, 20 nt, Salmonella typhimurium LT2
gcuugucacgaaguuccagu

SEQ ID NO: 1836911 - RNA, 21 nt, Salmonella typhimurium LT2
gcuuguguaggccggauaaga

SEQ ID NO: 1836912 - RNA, 14 nt, Salmonella typhimurium LT2
gcuugugggagaag

SEQ ID NO: 1836913 - RNA, 19 nt, Salmonella typhimurium LT2
gcuuguuguuuauccugca

SEQ ID NO: 1836914 - RNA, 17 nt, Salmonella typhimurium LT2
gcuuuaauaccgguggc

SEQ ID NO: 1836915 - RNA, 13 nt, Salmonella typhimurium LT2
gcuuuaaguuuuu

SEQ ID NO: 1836916 - RNA, 22 nt, Salmonella typhimurium LT2
gcuuuacccgggccaucuuuuu

SEQ ID NO: 1836917 - RNA, 22 nt, Salmonella typhimurium LT2
gcuuuaccgggccuauguuucu

SEQ ID NO: 1836918 - RNA, 20 nt, Salmonella typhimurium LT2
gcuuuacccggcgcaaacag

SEQ ID NO: 1836919 - RNA, 20 nt, Salmonella typhimurium LT2
gcuuuacccgggccaucuuu

SEQ ID NO: 1836920 - RNA, 23 nt, Salmonella typhimurium LT2
gcuuuaaucacccgcgccagcag

SEQ ID NO: 1836921 - RNA, 16 nt, Salmonella typhimurium LT2
gcuuuagcuuuacucu

SEQ ID NO: 1836922 - RNA, 13 nt, Salmonella typhimurium LT2
gcuuuuucaucau

SEQ ID NO: 1836923 - RNA, 17 nt, Salmonella typhimurium LT2
gcuuuuucggcaaucug

SEQ ID NO: 1836924 - RNA, 19 nt, Salmonella typhimurium LT2
gcuuuuccguuagcuggcu

SEQ ID NO: 1836925 - RNA, 14 nt, Salmonella typhimurium LT2
gcuuuuccuuccag

SEQ ID NO: 1836926 - RNA, 21 nt, Salmonella typhimurium LT2
gcuuuuaguuguacaaacugu

SEQ ID NO: 1836927 - RNA, 20 nt, Salmonella typhimurium LT2
gcuuuuauguuacccagccu

SEQ ID NO: 1836928 - RNA, 15 nt, Salmonella typhimurium LT2
gcuuuucagcccagg

SEQ ID NO: 1836929 - RNA, 23 nt, Salmonella typhimurium LT2
gcuuuucagcccaggcuuuaguu

SEQ ID NO: 1836930 - RNA, 17 nt, Salmonella typhimurium LT2
gcuuuuacagggcggca

SEQ ID NO: 1836931 - RNA, 18 nt, Salmonella typhimurium LT2
gcuuuuacgccauuggca

SEQ ID NO: 1836932 - RNA, 18 nt, Salmonella typhimurium LT2
gcuuuguuuugacgcugg

SEQ ID NO: 1836933 - RNA, 15 nt, Salmonella typhimurium LT2
gcuuugcgccacuuc

SEQ ID NO: 1836934 - RNA, 17 nt, Salmonella typhimurium LT2
gcuuugcuuauccggcc

SEQ ID NO: 1836935 - RNA, 13 nt, Salmonella typhimurium LT2
gcuuuggcaggcc

SEQ ID NO: 1836936 - RNA, 19 nt, Salmonella typhimurium LT2
gcuuuauuuuuaauugcug

SEQ ID NO: 1836937 - RNA, 21 nt, Salmonella typhimurium LT2
gcuuuauauaaaaaaugguuu

SEQ ID NO: 1836938 - RNA, 22 nt, Salmonella typhimurium LT2
gcuuuauucugucgccaccacu

SEQ ID NO: 1836939 - RNA, 13 nt, Salmonella typhimurium LT2
gcuuuaugcacgc

SEQ ID NO: 1836940 - RNA, 20 nt, Salmonella typhimurium LT2
gcuuuccgccaugaaaaaaa

SEQ ID NO: 1836941 - RNA, 13 nt, Salmonella typhimurium LT2
gcuuuccgccaug

SEQ ID NO: 1836942 - RNA, 16 nt, Salmonella typhimurium LT2
gcuuuccgccaugaaa

SEQ ID NO: 1836943 - RNA, 19 nt, Salmonella typhimurium LT2
gcuuuccguuaccucaaaa

SEQ ID NO: 1836944 - RNA, 21 nt, Salmonella typhimurium LT2
gcuuucagcuuuuuggaaaug

SEQ ID NO: 1836945 - RNA, 21 nt, Salmonella typhimurium LT2
gcuuucaucguauaaauuuuu

SEQ ID NO: 1836946 - RNA, 22 nt, Salmonella typhimurium LT2
gcuuucaucguauaaauuuuua

SEQ ID NO: 1836947 - RNA, 17 nt, Salmonella typhimurium LT2
gcuuuccagccaugcca

SEQ ID NO: 1836948 - RNA, 20 nt, Salmonella typhimurium LT2
gcuuucauuacgcuuccugc

SEQ ID NO: 1836949 - RNA, 18 nt, Salmonella typhimurium LT2
gcuuuccaggccagcgac

SEQ ID NO: 1836950 - RNA, 17 nt, Salmonella typhimurium LT2
gcuuucgcaacauccga

SEQ ID NO: 1836951 - RNA, 18 nt, Salmonella typhimurium LT2
gcuuucgccagccgcagc

SEQ ID NO: 1836952 - RNA, 13 nt, Salmonella typhimurium LT2
gcuuucuucuuca

SEQ ID NO: 1836953 - RNA, 10 nt, Salmonella typhimurium LT2
gcuuucuucu

SEQ ID NO: 1836954 - RNA, 17 nt, Salmonella typhimurium LT2
gcuuugcaagcaugaua

SEQ ID NO: 1836955 - RNA, 14 nt, Salmonella typhimurium LT2
gcuuucuucuucac

SEQ ID NO: 1836956 - RNA, 17 nt, Salmonella typhimurium LT2
gcuuugagcagcgccau

SEQ ID NO: 1836957 - RNA, 23 nt, Salmonella typhimurium LT2
ggaaaccuuucuucucuucuuca

SEQ ID NO: 1836958 - RNA, 21 nt, Salmonella typhimurium LT2
ggaaacggcucgguuuauccc

SEQ ID NO: 1836959 - RNA, 16 nt, Salmonella typhimurium LT2
ggaaacccgcucgccc

SEQ ID NO: 1836960 - RNA, 22 nt, Salmonella typhimurium LT2
ggaaacccgcucgcccgcagca

SEQ ID NO: 1836961 - RNA, 20 nt, Salmonella typhimurium LT2
ggaaaccgcucgaaagguua

SEQ ID NO: 1836962 - RNA, 22 nt, Salmonella typhimurium LT2
ggaaagccccuaccgaggcagg

SEQ ID NO: 1836963 - RNA, 23 nt, Salmonella typhimurium LT2
ggaaagccuucaucaucauagug

SEQ ID NO: 1836964 - RNA, 14 nt, Salmonella typhimurium LT2
ggaaagccccuacc

SEQ ID NO: 1836965 - RNA, 23 nt, Salmonella typhimurium LT2
ggaaagcucuucaugcagcgcgg

SEQ ID NO: 1836966 - RNA, 21 nt, Salmonella typhimurium LT2
ggaaagguguggaucagauca

SEQ ID NO: 1836967 - RNA, 13 nt, Salmonella typhimurium LT2
ggaaaggcagaga

SEQ ID NO: 1836968 - RNA, 13 nt, Salmonella typhimurium LT2
ggaaagcggcagg

SEQ ID NO: 1836969 - RNA, 14 nt, Salmonella typhimurium LT2
ggaaacuuaucauu

SEQ ID NO: 1836970 - RNA, 17 nt, Salmonella typhimurium LT2
ggaaagaacacaggcag

SEQ ID NO: 1836971 - RNA, 13 nt, Salmonella typhimurium LT2
ggaaaacgcuucu

SEQ ID NO: 1836972 - RNA, 23 nt, Salmonella typhimurium LT2
ggaaaacggccagugaaauaaau

SEQ ID NO: 1836973 - RNA, 17 nt, Salmonella typhimurium LT2
ggaaaagcgaccauucu

SEQ ID NO: 1836974 - RNA, 13 nt, Salmonella typhimurium LT2
ggaaaacagcgcc

SEQ ID NO: 1836975 - RNA, 19 nt, Salmonella typhimurium LT2
ggaaaaauuccgcagagcu

SEQ ID NO: 1836976 - RNA, 20 nt, Salmonella typhimurium LT2
ggaaaaaauacugauaaaaa

SEQ ID NO: 1836977 - RNA, 23 nt, Salmonella typhimurium LT2
ggaaaaaagcgcccagcgccgga

SEQ ID NO: 1836978 - RNA, 22 nt, Salmonella typhimurium LT2
ggaaaaaauuacugccugaacu

SEQ ID NO: 1836979 - RNA, 22 nt, Salmonella typhimurium LT2
gcuuuuuucucugcuuucggug

SEQ ID NO: 1836980 - RNA, 16 nt, Salmonella typhimurium LT2
ggaaccaaaugcccag

SEQ ID NO: 1836981 - RNA, 18 nt, Salmonella typhimurium LT2
ggaaccaaaugcccagcu

SEQ ID NO: 1836982 - RNA, 12 nt, Salmonella typhimurium LT2
ggaacagauaaa

SEQ ID NO: 1836983 - RNA, 13 nt, Salmonella typhimurium LT2
ggaacagaagcgc

SEQ ID NO: 1836984 - RNA, 14 nt, Salmonella typhimurium LT2
ggaacgagccgaua

SEQ ID NO: 1836985 - RNA, 19 nt, Salmonella typhimurium LT2
ggaaccaugauaucgccaa

SEQ ID NO: 1836986 - RNA, 16 nt, Salmonella typhimurium LT2
ggaaauacccuuauga

SEQ ID NO: 1836987 - RNA, 22 nt, Salmonella typhimurium LT2
ggaaauucuggcgcagcuucug

SEQ ID NO: 1836988 - RNA, 23 nt, Salmonella typhimurium LT2
ggaacaaaccgacuuucaaaucg

SEQ ID NO: 1836989 - RNA, 13 nt, Salmonella typhimurium LT2
ggaacaaaacgga

SEQ ID NO: 1836990 - RNA, 15 nt, Salmonella typhimurium LT2
ggaaggaaauaacgu

SEQ ID NO: 1836991 - RNA, 15 nt, Salmonella typhimurium LT2
ggaagaccguuuaaa

SEQ ID NO: 1836992 - RNA, 21 nt, Salmonella typhimurium LT2
ggaagaguuguugaccaacaa

SEQ ID NO: 1836993 - RNA, 22 nt, Salmonella typhimurium LT2
ggaacgccccucgguuuauccc

SEQ ID NO: 1836994 - RNA, 14 nt, Salmonella typhimurium LT2
ggaacucaucauca

SEQ ID NO: 1836995 - RNA, 20 nt, Salmonella typhimurium LT2
ggaacucaucggaaaaauag

SEQ ID NO: 1836996 - RNA, 12 nt, Salmonella typhimurium LT2
ggaacuccagca

SEQ ID NO: 1836997 - RNA, 16 nt, Salmonella typhimurium LT2
ggaacuggugaaacag

SEQ ID NO: 1836998 - RNA, 17 nt, Salmonella typhimurium LT2
ggaacuggcuccagcug

SEQ ID NO: 1836999 - RNA, 21 nt, Salmonella typhimurium LT2
ggaacuggcuccagcugguau

SEQ ID NO: 1837000 - RNA, 14 nt, Salmonella typhimurium LT2
ggaacugcggccag

SEQ ID NO: 1837001 - RNA, 18 nt, Salmonella typhimurium LT2
ggaacucugcuuuuauuu

SEQ ID NO: 1837002 - RNA, 15 nt, Salmonella typhimurium LT2
ggaacuccagcaggg

SEQ ID NO: 1837003 - RNA, 13 nt, Salmonella typhimurium LT2
ggaauccccgccg

SEQ ID NO: 1837004 - RNA, 20 nt, Salmonella typhimurium LT2
ggaaugccccagguuauaga

SEQ ID NO: 1837005 - RNA, 22 nt, Salmonella typhimurium LT2
ggaaugccgugauaggagagca

SEQ ID NO: 1837006 - RNA, 18 nt, Salmonella typhimurium LT2
ggaaugguauaugggcaa

SEQ ID NO: 1837007 - RNA, 17 nt, Salmonella typhimurium LT2
ggaauauugagaauaaa

SEQ ID NO: 1837008 - RNA, 16 nt, Salmonella typhimurium LT2
ggaauaugagcacagc

SEQ ID NO: 1837009 - RNA, 23 nt, Salmonella typhimurium LT2
ggaaggucgcauccgcguuagca

SEQ ID NO: 1837010 - RNA, 20 nt, Salmonella typhimurium LT2
ggaaggguaugccagcaggc

SEQ ID NO: 1837011 - RNA, 16 nt, Salmonella typhimurium LT2
ggaaggggaaaagggu

SEQ ID NO: 1837012 - RNA, 18 nt, Salmonella typhimurium LT2
ggaauuuaucaacaaauu

SEQ ID NO: 1837013 - RNA, 13 nt, Salmonella typhimurium LT2
ggaauguucuccu

SEQ ID NO: 1837014 - RNA, 16 nt, Salmonella typhimurium LT2
ggacacauuucuuuug

SEQ ID NO: 1837015 - RNA, 19 nt, Salmonella typhimurium LT2
ggaauuuuauccuggguuu

SEQ ID NO: 1837016 - RNA, 12 nt, Salmonella typhimurium LT2
ggacguugaaaa

SEQ ID NO: 1837017 - RNA, 15 nt, Salmonella typhimurium LT2
ggacggcggccagca

SEQ ID NO: 1837018 - RNA, 23 nt, Salmonella typhimurium LT2
ggacggcauaagccagcccugcc

SEQ ID NO: 1837019 - RNA, 18 nt, Salmonella typhimurium LT2
ggacgcugacgccaggcc

SEQ ID NO: 1837020 - RNA, 17 nt, Salmonella typhimurium LT2
ggacuaugcuccaguug

SEQ ID NO: 1837021 - RNA, 23 nt, Salmonella typhimurium LT2
ggacguugagcguuacgggaaca

SEQ ID NO: 1837022 - RNA, 12 nt, Salmonella typhimurium LT2
ggacaucgccau

SEQ ID NO: 1837023 - RNA, 15 nt, Salmonella typhimurium LT2
ggacauccauccggg

SEQ ID NO: 1837024 - RNA, 14 nt, Salmonella typhimurium LT2
ggacaucaaaggca

SEQ ID NO: 1837025 - RNA, 14 nt, Salmonella typhimurium LT2
ggagacgggcggag

SEQ ID NO: 1837026 - RNA, 15 nt, Salmonella typhimurium LT2
ggagaacgccgggcc

SEQ ID NO: 1837027 - RNA, 15 nt, Salmonella typhimurium LT2
ggacucccaggugug

SEQ ID NO: 1837028 - RNA, 14 nt, Salmonella typhimurium LT2
ggacuccaggcaac

SEQ ID NO: 1837029 - RNA, 16 nt, Salmonella typhimurium LT2
ggagaagacgccgccg

SEQ ID NO: 1837030 - RNA, 23 nt, Salmonella typhimurium LT2
ggagagaggacacguuaauuauu

SEQ ID NO: 1837031 - RNA, 17 nt, Salmonella typhimurium LT2
ggagagacguucauuuc

SEQ ID NO: 1837032 - RNA, 20 nt, Salmonella typhimurium LT2
ggagcaaacagcgugggaag

SEQ ID NO: 1837033 - RNA, 21 nt, Salmonella typhimurium LT2
ggagcaaacagcgugggaagc

SEQ ID NO: 1837034 - RNA, 17 nt, Salmonella typhimurium LT2
ggagagcggcuggaaga

SEQ ID NO: 1837035 - RNA, 19 nt, Salmonella typhimurium LT2
ggagccucuucuggcuccc

SEQ ID NO: 1837036 - RNA, 22 nt, Salmonella typhimurium LT2
ggagcgugcucauuugcggcgu

SEQ ID NO: 1837037 - RNA, 13 nt, Salmonella typhimurium LT2
ggagcuguucuua

SEQ ID NO: 1837038 - RNA, 16 nt, Salmonella typhimurium LT2
ggagccagccugagga

SEQ ID NO: 1837039 - RNA, 17 nt, Salmonella typhimurium LT2
ggagcaugaucggccag

SEQ ID NO: 1837040 - RNA, 20 nt, Salmonella typhimurium LT2
ggagguauaaucagcaucac

SEQ ID NO: 1837041 - RNA, 15 nt, Salmonella typhimurium LT2
ggaggucauuauuca

SEQ ID NO: 1837042 - RNA, 14 nt, Salmonella typhimurium LT2
ggaggugcucuccc

SEQ ID NO: 1837043 - RNA, 23 nt, Salmonella typhimurium LT2
ggaggcgugagcgaacaggucgc

SEQ ID NO: 1837044 - RNA, 17 nt, Salmonella typhimurium LT2
ggaggaaaguccgggcu

SEQ ID NO: 1837045 - RNA, 19 nt, Salmonella typhimurium LT2
ggagggguuuucgccagca

SEQ ID NO: 1837046 - RNA, 14 nt, Salmonella typhimurium LT2
ggauaaacgccccu

SEQ ID NO: 1837047 - RNA, 15 nt, Salmonella typhimurium LT2
ggauaaaacagaaac

SEQ ID NO: 1837048 - RNA, 18 nt, Salmonella typhimurium LT2
ggauaagcaaagcgccau

SEQ ID NO: 1837049 - RNA, 23 nt, Salmonella typhimurium LT2
ggauaacgcucuuaccgcuaaaa

SEQ ID NO: 1837050 - RNA, 15 nt, Salmonella typhimurium LT2
ggauaaaggccggga

SEQ ID NO: 1837051 - RNA, 17 nt, Salmonella typhimurium LT2
ggauaaauuaaaugugc

SEQ ID NO: 1837052 - RNA, 20 nt, Salmonella typhimurium LT2
ggaucagccugagcgccagc

SEQ ID NO: 1837053 - RNA, 13 nt, Salmonella typhimurium LT2
ggaucagcggcug

SEQ ID NO: 1837054 - RNA, 18 nt, Salmonella typhimurium LT2
ggauauugccgaagacca

SEQ ID NO: 1837055 - RNA, 23 nt, Salmonella typhimurium LT2
ggauauucguccaccuaaagagg

SEQ ID NO: 1837056 - RNA, 19 nt, Salmonella typhimurium LT2
ggauaugcgacgaaagcgg

SEQ ID NO: 1837057 - RNA, 12 nt, Salmonella typhimurium LT2
ggauagucuuca

SEQ ID NO: 1837058 - RNA, 16 nt, Salmonella typhimurium LT2
ggauauacuucaucag

SEQ ID NO: 1837059 - RNA, 16 nt, Salmonella typhimurium LT2
ggaucaugguugaaaa

SEQ ID NO: 1837060 - RNA, 13 nt, Salmonella typhimurium LT2
ggaucaucuuuua

SEQ ID NO: 1837061 - RNA, 13 nt, Salmonella typhimurium LT2
ggaucccccuggc

SEQ ID NO: 1837062 - RNA, 13 nt, Salmonella typhimurium LT2
ggaucgacgcuga

SEQ ID NO: 1837063 - RNA, 15 nt, Salmonella typhimurium LT2
ggaugcgauguaaaa

SEQ ID NO: 1837064 - RNA, 22 nt, Salmonella typhimurium LT2
ggaugcguaauccggccuggcg

SEQ ID NO: 1837065 - RNA, 23 nt, Salmonella typhimurium LT2
ggaugacggcgaacggggagaca

SEQ ID NO: 1837066 - RNA, 22 nt, Salmonella typhimurium LT2
ggaugaggaucgcgugcauuaa

SEQ ID NO: 1837067 - RNA, 21 nt, Salmonella typhimurium LT2
ggaucggucugacgcauaaug

SEQ ID NO: 1837068 - RNA, 11 nt, Salmonella typhimurium LT2
ggauggugguc

SEQ ID NO: 1837069 - RNA, 20 nt, Salmonella typhimurium LT2
ggauguacucauccauuucc

SEQ ID NO: 1837070 - RNA, 19 nt, Salmonella typhimurium LT2
ggauucgacggccagcgcg

SEQ ID NO: 1837071 - RNA, 19 nt, Salmonella typhimurium LT2
ggauucgccagcgugcuua

SEQ ID NO: 1837072 - RNA, 21 nt, Salmonella typhimurium LT2
ggauucucuaacgucagcgcc

SEQ ID NO: 1837073 - RNA, 18 nt, Salmonella typhimurium LT2
ggccagaugaucagcaua

SEQ ID NO: 1837074 - RNA, 14 nt, Salmonella typhimurium LT2
ggccacggcuguaa

SEQ ID NO: 1837075 - RNA, 21 nt, Salmonella typhimurium LT2
ggccacggauuuaauccacca

SEQ ID NO: 1837076 - RNA, 15 nt, Salmonella typhimurium LT2
ggccagaugcggcga

SEQ ID NO: 1837077 - RNA, 17 nt, Salmonella typhimurium LT2
ggccaccaggccugagc

SEQ ID NO: 1837078 - RNA, 12 nt, Salmonella typhimurium LT2
ggccaccagcac

SEQ ID NO: 1837079 - RNA, 12 nt, Salmonella typhimurium LT2
ggccaucaacuu

SEQ ID NO: 1837080 - RNA, 21 nt, Salmonella typhimurium LT2
ggccaucaacuucucgcaggc

SEQ ID NO: 1837081 - RNA, 17 nt, Salmonella typhimurium LT2
ggccaguuguucuuuca

SEQ ID NO: 1837082 - RNA, 18 nt, Salmonella typhimurium LT2
ggccaguuguucuuucac

SEQ ID NO: 1837083 - RNA, 20 nt, Salmonella typhimurium LT2
ggccaggucguccguugcca

SEQ ID NO: 1837084 - RNA, 17 nt, Salmonella typhimurium LT2
ggccauugaagucccuu

SEQ ID NO: 1837085 - RNA, 19 nt, Salmonella typhimurium LT2
ggccauuaagcuucgugag

SEQ ID NO: 1837086 - RNA, 15 nt, Salmonella typhimurium LT2
ggccaugcuuuugca

SEQ ID NO: 1837087 - RNA, 13 nt, Salmonella typhimurium LT2
ggccagcgccggc

SEQ ID NO: 1837088 - RNA, 17 nt, Salmonella typhimurium LT2
ggccgacaggcggcagc

SEQ ID NO: 1837089 - RNA, 21 nt, Salmonella typhimurium LT2
ggccgauauugcggccuuccu

SEQ ID NO: 1837090 - RNA, 17 nt, Salmonella typhimurium LT2
ggccgcaaaugcggccc

SEQ ID NO: 1837091 - RNA, 13 nt, Salmonella typhimurium LT2
ggccgaugcgccc

SEQ ID NO: 1837092 - RNA, 17 nt, Salmonella typhimurium LT2
ggcccugacgggcucgu

SEQ ID NO: 1837093 - RNA, 12 nt, Salmonella typhimurium LT2
ggcaaaccagca

SEQ ID NO: 1837094 - RNA, 18 nt, Salmonella typhimurium LT2
ggcaaaccauguacccuc

SEQ ID NO: 1837095 - RNA, 17 nt, Salmonella typhimurium LT2
ggcaaacggcgccagcu

SEQ ID NO: 1837096 - RNA, 16 nt, Salmonella typhimurium LT2
ggcacacuacgcagcg

SEQ ID NO: 1837097 - RNA, 20 nt, Salmonella typhimurium LT2
ggcacagcgugggcaaauca

SEQ ID NO: 1837098 - RNA, 21 nt, Salmonella typhimurium LT2
ggcacauauuccggcgcuggc

SEQ ID NO: 1837099 - RNA, 14 nt, Salmonella typhimurium LT2
ggcagagcgcgcuc

SEQ ID NO: 1837100 - RNA, 12 nt, Salmonella typhimurium LT2
ggcagagcgcgc

SEQ ID NO: 1837101 - RNA, 16 nt, Salmonella typhimurium LT2
ggcagaguccagcggc

SEQ ID NO: 1837102 - RNA, 20 nt, Salmonella typhimurium LT2
ggcagaguccagcggcagcu

SEQ ID NO: 1837103 - RNA, 16 nt, Salmonella typhimurium LT2
ggcagaucgcgcuccc

SEQ ID NO: 1837104 - RNA, 20 nt, Salmonella typhimurium LT2
ggcagcaauacgcccgcccg

SEQ ID NO: 1837105 - RNA, 16 nt, Salmonella typhimurium LT2
ggcagcaauacgcccg

SEQ ID NO: 1837106 - RNA, 23 nt, Salmonella typhimurium LT2
ggcagauuauuuaaaucccacua

SEQ ID NO: 1837107 - RNA, 13 nt, Salmonella typhimurium LT2
ggcagauucuucu

SEQ ID NO: 1837108 - RNA, 18 nt, Salmonella typhimurium LT2
ggcacuacgguccaguug

SEQ ID NO: 1837109 - RNA, 19 nt, Salmonella typhimurium LT2
ggcagcacaaucagcgcgg

SEQ ID NO: 1837110 - RNA, 12 nt, Salmonella typhimurium LT2
ggcagcagaccg

SEQ ID NO: 1837111 - RNA, 21 nt, Salmonella typhimurium LT2
ggcaggcaacaugaccagcgc

SEQ ID NO: 1837112 - RNA, 14 nt, Salmonella typhimurium LT2
ggcaggaugaauga

SEQ ID NO: 1837113 - RNA, 15 nt, Salmonella typhimurium LT2
ggcaggccggcagcc

SEQ ID NO: 1837114 - RNA, 20 nt, Salmonella typhimurium LT2
ggcagcuuacugugccgccg

SEQ ID NO: 1837115 - RNA, 16 nt, Salmonella typhimurium LT2
ggcagcguggcgagcu

SEQ ID NO: 1837116 - RNA, 20 nt, Salmonella typhimurium LT2
ggcagcgucggcuucaucac

SEQ ID NO: 1837117 - RNA, 15 nt, Salmonella typhimurium LT2
ggcagcgucguccag

SEQ ID NO: 1837118 - RNA, 24 nt, Salmonella typhimurium LT2
ggcagcggcuucaauaccgcccca

SEQ ID NO: 1837119 - RNA, 15 nt, Salmonella typhimurium LT2
ggcagcgccagcggu

SEQ ID NO: 1837120 - RNA, 17 nt, Salmonella typhimurium LT2
ggcauacucuccuccau

SEQ ID NO: 1837121 - RNA, 13 nt, Salmonella typhimurium LT2
ggcauagaaaaag

SEQ ID NO: 1837122 - RNA, 17 nt, Salmonella typhimurium LT2
ggcauagaaaaagaacu

SEQ ID NO: 1837123 - RNA, 18 nt, Salmonella typhimurium LT2
ggcauauucuggcggcgg

SEQ ID NO: 1837124 - RNA, 15 nt, Salmonella typhimurium LT2
ggcaguccggcggca

SEQ ID NO: 1837125 - RNA, 14 nt, Salmonella typhimurium LT2
ggcauaacccgccg

SEQ ID NO: 1837126 - RNA, 15 nt, Salmonella typhimurium LT2
ggcauaacccgccgc

SEQ ID NO: 1837127 - RNA, 21 nt, Salmonella typhimurium LT2
ggcauaaauaauaccguccgc

SEQ ID NO: 1837128 - RNA, 22 nt, Salmonella typhimurium LT2
ggcagucccaaugcggaaacca

SEQ ID NO: 1837129 - RNA, 20 nt, Salmonella typhimurium LT2
ggcaguccuugcagccagaa

SEQ ID NO: 1837130 - RNA, 14 nt, Salmonella typhimurium LT2
ggcaguaagccagc

SEQ ID NO: 1837131 - RNA, 19 nt, Salmonella typhimurium LT2
ggcaguaagccagcgggcg

SEQ ID NO: 1837132 - RNA, 15 nt, Salmonella typhimurium LT2
ggcauggcagcaggg

SEQ ID NO: 1837133 - RNA, 18 nt, Salmonella typhimurium LT2
ggcauggcguuauggcaa

SEQ ID NO: 1837134 - RNA, 14 nt, Salmonella typhimurium LT2
ggcaugccacuggg

SEQ ID NO: 1837135 - RNA, 22 nt, Salmonella typhimurium LT2
ggcauggggucaggugggacca

SEQ ID NO: 1837136 - RNA, 15 nt, Salmonella typhimurium LT2
ggcauggucagcaua

SEQ ID NO: 1837137 - RNA, 18 nt, Salmonella typhimurium LT2
ggcaucgcccguuuuacc

SEQ ID NO: 1837138 - RNA, 18 nt, Salmonella typhimurium LT2
ggcaucggaaccggggcg

SEQ ID NO: 1837139 - RNA, 22 nt, Salmonella typhimurium LT2
ggcaucguagucaggcagcagg

SEQ ID NO: 1837140 - RNA, 21 nt, Salmonella typhimurium LT2
uaaucgagacuguuugacacu

SEQ ID NO: 1837141 - RNA, 17 nt, Salmonella typhimurium LT2
uaaucgaaucgccucaa

SEQ ID NO: 1837142 - RNA, 14 nt, Salmonella typhimurium LT2
uaaucgaaucgccu

SEQ ID NO: 1837143 - RNA, 13 nt, Salmonella typhimurium LT2
uaaugaaccacac

SEQ ID NO: 1837144 - RNA, 19 nt, Salmonella typhimurium LT2
uaaugaagacguugaauau

SEQ ID NO: 1837145 - RNA, 21 nt, Salmonella typhimurium LT2
uaaugagaccagcgucgccug

SEQ ID NO: 1837146 - RNA, 22 nt, Salmonella typhimurium LT2
uaaugcccggcccgucaucuuc

SEQ ID NO: 1837147 - RNA, 17 nt, Salmonella typhimurium LT2
uaaugcccaccgauuuc

SEQ ID NO: 1837148 - RNA, 16 nt, Salmonella typhimurium LT2
uaaugccuucugaaaa

SEQ ID NO: 1837149 - RNA, 14 nt, Salmonella typhimurium LT2
uaaugccuggcagu

SEQ ID NO: 1837150 - RNA, 20 nt, Salmonella typhimurium LT2
uaaugcgaaaauaaaggugc

SEQ ID NO: 1837151 - RNA, 22 nt, Salmonella typhimurium LT2
uaaugcgaaaaacgggagauug

SEQ ID NO: 1837152 - RNA, 15 nt, Salmonella typhimurium LT2
uaaugcauggcagau

SEQ ID NO: 1837153 - RNA, 19 nt, Salmonella typhimurium LT2
uaaugcaggcagcacugcu

SEQ ID NO: 1837154 - RNA, 20 nt, Salmonella typhimurium LT2
uaaugauguuggggagaauu

SEQ ID NO: 1837155 - RNA, 20 nt, Salmonella typhimurium LT2
uaaugguugugccaguaauc

SEQ ID NO: 1837156 - RNA, 19 nt, Salmonella typhimurium LT2
uaaugguggaaugccccag

SEQ ID NO: 1837157 - RNA, 21 nt, Salmonella typhimurium LT2
uaauggucagaucugcgccca

SEQ ID NO: 1837158 - RNA, 17 nt, Salmonella typhimurium LT2
uaauggcgccgauaaca

SEQ ID NO: 1837159 - RNA, 17 nt, Salmonella typhimurium LT2
uaauggcgcgaaaacag

SEQ ID NO: 1837160 - RNA, 19 nt, Salmonella typhimurium LT2
uaauggcagaauaaaacag

SEQ ID NO: 1837161 - RNA, 12 nt, Salmonella typhimurium LT2
uaauggcccagc

SEQ ID NO: 1837162 - RNA, 15 nt, Salmonella typhimurium LT2
uaauuaaaaagagaa

SEQ ID NO: 1837163 - RNA, 20 nt, Salmonella typhimurium LT2
uaauuaaaaagagaaaaaau

SEQ ID NO: 1837164 - RNA, 23 nt, Salmonella typhimurium LT2
uaauuaaaaagagaaaaaauuca

SEQ ID NO: 1837165 - RNA, 15 nt, Salmonella typhimurium LT2
uaauucacaacugaa

SEQ ID NO: 1837166 - RNA, 16 nt, Salmonella typhimurium LT2
uaauucauaacaccaa

SEQ ID NO: 1837167 - RNA, 18 nt, Salmonella typhimurium LT2
uaauucauaacaccaaua

SEQ ID NO: 1837168 - RNA, 17 nt, Salmonella typhimurium LT2
uaauauaaccaauuuaa

SEQ ID NO: 1837169 - RNA, 20 nt, Salmonella typhimurium LT2
uaauauaaccaauuuaaaau

SEQ ID NO: 1837170 - RNA, 20 nt, Salmonella typhimurium LT2
uaauaucgcgcucuuccgcc

SEQ ID NO: 1837171 - RNA, 13 nt, Salmonella typhimurium LT2
uaauauccagcac

SEQ ID NO: 1837172 - RNA, 14 nt, Salmonella typhimurium LT2
uaauaucaauucca

SEQ ID NO: 1837173 - RNA, 15 nt, Salmonella typhimurium LT2
uaacgucgucauuca

SEQ ID NO: 1837174 - RNA, 17 nt, Salmonella typhimurium LT2
uaacguccggcguccug

SEQ ID NO: 1837175 - RNA, 20 nt, Salmonella typhimurium LT2
uaacguccugggcugccagg

SEQ ID NO: 1837176 - RNA, 13 nt, Salmonella typhimurium LT2
uaacgucaucauc

SEQ ID NO: 1837177 - RNA, 22 nt, Salmonella typhimurium LT2
uaacgucgcgguuacagucuuu

SEQ ID NO: 1837178 - RNA, 19 nt, Salmonella typhimurium LT2
uaaucaucacgcuauggcc

SEQ ID NO: 1837179 - RNA, 11 nt, Salmonella typhimurium LT2
uaaucaucaua

SEQ ID NO: 1837180 - RNA, 19 nt, Salmonella typhimurium LT2
uaaucacuaacuagccaua

SEQ ID NO: 1837181 - RNA, 16 nt, Salmonella typhimurium LT2
uaaucacgucauuaaa

SEQ ID NO: 1837182 - RNA, 15 nt, Salmonella typhimurium LT2
uaaucaccauggcgc

SEQ ID NO: 1837183 - RNA, 12 nt, Salmonella typhimurium LT2
uaaucaccagcc

SEQ ID NO: 1837184 - RNA, 14 nt, Salmonella typhimurium LT2
uaaucaccagcccg

SEQ ID NO: 1837185 - RNA, 12 nt, Salmonella typhimurium LT2
uaauccggcaau

SEQ ID NO: 1837186 - RNA, 17 nt, Salmonella typhimurium LT2
uaauccggucauccagc

SEQ ID NO: 1837187 - RNA, 18 nt, Salmonella typhimurium LT2
uaaucccuucuuuuacug

SEQ ID NO: 1837188 - RNA, 16 nt, Salmonella typhimurium LT2
uaaucccgcauauuuu

SEQ ID NO: 1837189 - RNA, 23 nt, Salmonella typhimurium LT2
uaaucccgcggcggacagcggca

SEQ ID NO: 1837190 - RNA, 23 nt, Salmonella typhimurium LT2
uacaaguucagcaggcuacggua

SEQ ID NO: 1837191 - RNA, 23 nt, Salmonella typhimurium LT2
uacaagcguugaauuccaucggc

SEQ ID NO: 1837192 - RNA, 16 nt, Salmonella typhimurium LT2
uacaagauuugcaaua

SEQ ID NO: 1837193 - RNA, 21 nt, Salmonella typhimurium LT2
uacacaguccgaugguuaaau

SEQ ID NO: 1837194 - RNA, 17 nt, Salmonella typhimurium LT2
uacacauggagaacaga

SEQ ID NO: 1837195 - RNA, 20 nt, Salmonella typhimurium LT2
uacacauucaggcuggcaaa

SEQ ID NO: 1837196 - RNA, 15 nt, Salmonella typhimurium LT2
uacaccguuucugau

SEQ ID NO: 1837197 - RNA, 20 nt, Salmonella typhimurium LT2
uacaccugacggcagccacg

SEQ ID NO: 1837198 - RNA, 13 nt, Salmonella typhimurium LT2
uacagccaccaug

SEQ ID NO: 1837199 - RNA, 18 nt, Salmonella typhimurium LT2
uacagccaaaucagcagg

SEQ ID NO: 1837200 - RNA, 15 nt, Salmonella typhimurium LT2
uacagcacuucccgc

SEQ ID NO: 1837201 - RNA, 17 nt, Salmonella typhimurium LT2
uacacuucagccagacg

SEQ ID NO: 1837202 - RNA, 14 nt, Salmonella typhimurium LT2
uacacgucgguaua

SEQ ID NO: 1837203 - RNA, 16 nt, Salmonella typhimurium LT2
uacacugauaccccag

SEQ ID NO: 1837204 - RNA, 18 nt, Salmonella typhimurium LT2
uacaccuucacauuggca

SEQ ID NO: 1837205 - RNA, 22 nt, Salmonella typhimurium LT2
uacaccuuauccggccugcgaa

SEQ ID NO: 1837206 - RNA, 21 nt, Salmonella typhimurium LT2
uacacgcgacaaugccauaaa

SEQ ID NO: 1837207 - RNA, 14 nt, Salmonella typhimurium LT2
uacagccagcacaa

SEQ ID NO: 1837208 - RNA, 14 nt, Salmonella typhimurium LT2
uacagccaaaaaua

SEQ ID NO: 1837209 - RNA, 22 nt, Salmonella typhimurium LT2
uacagguugugcaucuccugac

SEQ ID NO: 1837210 - RNA, 21 nt, Salmonella typhimurium LT2
uacaggauauacuucaucagg

SEQ ID NO: 1837211 - RNA, 12 nt, Salmonella typhimurium LT2
uacaggugcagg

SEQ ID NO: 1837212 - RNA, 19 nt, Salmonella typhimurium LT2
uacaguguaaaaauuuuug

SEQ ID NO: 1837213 - RNA, 16 nt, Salmonella typhimurium LT2
uacaguuugucaucag

SEQ ID NO: 1837214 - RNA, 18 nt, Salmonella typhimurium LT2
uaauucucacagaaucau

SEQ ID NO: 1837215 - RNA, 20 nt, Salmonella typhimurium LT2
uaauucucacagaaucauca

SEQ ID NO: 1837216 - RNA, 20 nt, Salmonella typhimurium LT2
uaauucgccaguaagggaau

SEQ ID NO: 1837217 - RNA, 15 nt, Salmonella typhimurium LT2
uaauuuauagccauu

SEQ ID NO: 1837218 - RNA, 22 nt, Salmonella typhimurium LT2
uaauuuaugauuuuaacaucac

SEQ ID NO: 1837219 - RNA, 14 nt, Salmonella typhimurium LT2
uaauuuaauaauaa

SEQ ID NO: 1837220 - RNA, 14 nt, Salmonella typhimurium LT2
uaauuucagugaau

SEQ ID NO: 1837221 - RNA, 14 nt, Salmonella typhimurium LT2
uaauuucgcuacuc

SEQ ID NO: 1837222 - RNA, 23 nt, Salmonella typhimurium LT2
uaauuucgcuggcggccccucuu

SEQ ID NO: 1837223 - RNA, 13 nt, Salmonella typhimurium LT2
uacaaacaaauaa

SEQ ID NO: 1837224 - RNA, 12 nt, Salmonella typhimurium LT2
uacaaaaugacg

SEQ ID NO: 1837225 - RNA, 23 nt, Salmonella typhimurium LT2
uacaaaaaaugugagccauaaca

SEQ ID NO: 1837226 - RNA, 11 nt, Salmonella typhimurium LT2
uaauuuuuccu

SEQ ID NO: 1837227 - RNA, 12 nt, Salmonella typhimurium LT2
uaauuuuuccuu

SEQ ID NO: 1837228 - RNA, 15 nt, Salmonella typhimurium LT2
uaauuuucuuuuauu

SEQ ID NO: 1837229 - RNA, 16 nt, Salmonella typhimurium LT2
uaauuuuacuuucauu

SEQ ID NO: 1837230 - RNA, 17 nt, Salmonella typhimurium LT2
uaauuuuacuuucauuc

SEQ ID NO: 1837231 - RNA, 18 nt, Salmonella typhimurium LT2
uaauuuuacuuucauucc

SEQ ID NO: 1837232 - RNA, 17 nt, Salmonella typhimurium LT2
uaauuuucaccuccggg

SEQ ID NO: 1837233 - RNA, 13 nt, Salmonella typhimurium LT2
uaauuuucaccuc

SEQ ID NO: 1837234 - RNA, 20 nt, Salmonella typhimurium LT2
uaauuuucccaguucaucca

SEQ ID NO: 1837235 - RNA, 19 nt, Salmonella typhimurium LT2
uaauuuucccaguucaucc

SEQ ID NO: 1837236 - RNA, 19 nt, Salmonella typhimurium LT2
uacgagugcguucuuccac

SEQ ID NO: 1837237 - RNA, 11 nt, Salmonella typhimurium LT2
uacgaacugcg

SEQ ID NO: 1837238 - RNA, 17 nt, Salmonella typhimurium LT2
uacgaucgccaccgcau

SEQ ID NO: 1837239 - RNA, 21 nt, Salmonella typhimurium LT2
uacgaucgcgcacaugcugug

SEQ ID NO: 1837240 - RNA, 13 nt, Salmonella typhimurium LT2
uaccuuuacgcag

SEQ ID NO: 1837241 - RNA, 18 nt, Salmonella typhimurium LT2
uaccuacgcgauaaaaaa

SEQ ID NO: 1837242 - RNA, 15 nt, Salmonella typhimurium LT2
uaccuaccagcgcgc

SEQ ID NO: 1837243 - RNA, 18 nt, Salmonella typhimurium LT2
uaccuaucggaagaaaac

SEQ ID NO: 1837244 - RNA, 15 nt, Salmonella typhimurium LT2
uaccuuguucuucca

SEQ ID NO: 1837245 - RNA, 19 nt, Salmonella typhimurium LT2
uaccuuuaaacuguuucca

SEQ ID NO: 1837246 - RNA, 16 nt, Salmonella typhimurium LT2
uaccuuauucagccca

SEQ ID NO: 1837247 - RNA, 21 nt, Salmonella typhimurium LT2
uaccuucgcguuuaucaccaa

SEQ ID NO: 1837248 - RNA, 19 nt, Salmonella typhimurium LT2
uaccuucccgcgauaaaaa

SEQ ID NO: 1837249 - RNA, 22 nt, Salmonella typhimurium LT2
uaccuuccggcgucccuuuccc

SEQ ID NO: 1837250 - RNA, 23 nt, Salmonella typhimurium LT2
uacgcggccaaaacccaccagca

SEQ ID NO: 1837251 - RNA, 17 nt, Salmonella typhimurium LT2
uacgcgcugaccuucag

SEQ ID NO: 1837252 - RNA, 20 nt, Salmonella typhimurium LT2
uacgcgggcucguugcgucg

SEQ ID NO: 1837253 - RNA, 17 nt, Salmonella typhimurium LT2
uacgcgucaaagcacau

SEQ ID NO: 1837254 - RNA, 17 nt, Salmonella typhimurium LT2
uacgcggucuuuuaaaa

SEQ ID NO: 1837255 - RNA, 22 nt, Salmonella typhimurium LT2
uacgcggucuuuuaaaagaccu

SEQ ID NO: 1837256 - RNA, 20 nt, Salmonella typhimurium LT2
uacgcggugcgccguaaaca

SEQ ID NO: 1837257 - RNA, 16 nt, Salmonella typhimurium LT2
uacggacagaaaaaau

SEQ ID NO: 1837258 - RNA, 19 nt, Salmonella typhimurium LT2
uacggacgauacaccuuca

SEQ ID NO: 1837259 - RNA, 12 nt, Salmonella typhimurium LT2
uacggaaaaaug

SEQ ID NO: 1837260 - RNA, 14 nt, Salmonella typhimurium LT2
uacggaaaaaauac

SEQ ID NO: 1837261 - RNA, 15 nt, Salmonella typhimurium LT2
uacgcgucaauuacc

SEQ ID NO: 1837262 - RNA, 16 nt, Salmonella typhimurium LT2
uacgcuauuuaaaaac

SEQ ID NO: 1837263 - RNA, 15 nt, Salmonella typhimurium LT2
uacgcuauuuaaaaa

SEQ ID NO: 1837264 - RNA, 14 nt, Salmonella typhimurium LT2
uacgcagcaggcag

SEQ ID NO: 1837265 - RNA, 18 nt, Salmonella typhimurium LT2
uacgcagcacuuucgcuu

SEQ ID NO: 1837266 - RNA, 23 nt, Salmonella typhimurium LT2
uacgcagauaacuuccuuugccu

SEQ ID NO: 1837267 - RNA, 22 nt, Salmonella typhimurium LT2
uacgauguaucacguuuuuuac

SEQ ID NO: 1837268 - RNA, 16 nt, Salmonella typhimurium LT2
uacgcagccccauuug

SEQ ID NO: 1837269 - RNA, 18 nt, Salmonella typhimurium LT2
uacgcagcgccuucgcuu

SEQ ID NO: 1837270 - RNA, 19 nt, Salmonella typhimurium LT2
uacgcaguuuaaagccaau

SEQ ID NO: 1837271 - RNA, 14 nt, Salmonella typhimurium LT2
uacgcaucaccagg

SEQ ID NO: 1837272 - RNA, 16 nt, Salmonella typhimurium LT2
uacggcgcgccaccau

SEQ ID NO: 1837273 - RNA, 16 nt, Salmonella typhimurium LT2
uacggcuccagcacau

SEQ ID NO: 1837274 - RNA, 12 nt, Salmonella typhimurium LT2
uacggagaaauu

SEQ ID NO: 1837275 - RNA, 16 nt, Salmonella typhimurium LT2
uacggagcaaaaaacg

SEQ ID NO: 1837276 - RNA, 13 nt, Salmonella typhimurium LT2
uacggcaaaaaua

SEQ ID NO: 1837277 - RNA, 14 nt, Salmonella typhimurium LT2
uacggcaucggaac

SEQ ID NO: 1837278 - RNA, 15 nt, Salmonella typhimurium LT2
uacgggcagcggcuu

SEQ ID NO: 1837279 - RNA, 21 nt, Salmonella typhimurium LT2
uacgggaauuccaguccuuuc

SEQ ID NO: 1837280 - RNA, 16 nt, Salmonella typhimurium LT2
uacguacugaaauaac

SEQ ID NO: 1837281 - RNA, 22 nt, Salmonella typhimurium LT2
uacgucaaaaacagaucgcagg

SEQ ID NO: 1837282 - RNA, 22 nt, Salmonella typhimurium LT2
uacgucgccgucuggggaaacc

SEQ ID NO: 1837283 - RNA, 12 nt, Salmonella typhimurium LT2
uacguccauccg

SEQ ID NO: 1837284 - RNA, 17 nt, Salmonella typhimurium LT2
uacgucauaucauccag

SEQ ID NO: 1837285 - RNA, 14 nt, Salmonella typhimurium LT2
uacccaacagcaga

SEQ ID NO: 1837286 - RNA, 21 nt, Salmonella typhimurium LT2
uacccaacagcagacagccga

SEQ ID NO: 1837287 - RNA, 13 nt, Salmonella typhimurium LT2
uacccaaaauaau

SEQ ID NO: 1837288 - RNA, 14 nt, Salmonella typhimurium LT2
uacccaaaauaauu

SEQ ID NO: 1837289 - RNA, 10 nt, Salmonella typhimurium LT2
uaccaggcac

SEQ ID NO: 1837290 - RNA, 14 nt, Salmonella typhimurium LT2
uaccaggcggucug

SEQ ID NO: 1837291 - RNA, 22 nt, Salmonella typhimurium LT2
uaccaggcauaauggaacugcc

SEQ ID NO: 1837292 - RNA, 16 nt, Salmonella typhimurium LT2
uaccagcgaaaugcga

SEQ ID NO: 1837293 - RNA, 23 nt, Salmonella typhimurium LT2
uaccagcgcgaacauuacauccu

SEQ ID NO: 1837294 - RNA, 15 nt, Salmonella typhimurium LT2
uaccagcgcggcgcc

SEQ ID NO: 1837295 - RNA, 20 nt, Salmonella typhimurium LT2
uaccagccaacaguauagaa

SEQ ID NO: 1837296 - RNA, 15 nt, Salmonella typhimurium LT2
uaccagcaacugacc

SEQ ID NO: 1837297 - RNA, 19 nt, Salmonella typhimurium LT2
uacauagcaggccauaaug

SEQ ID NO: 1837298 - RNA, 16 nt, Salmonella typhimurium LT2
uacauaccacgcagcg

SEQ ID NO: 1837299 - RNA, 16 nt, Salmonella typhimurium LT2
uaccgggcuaaaccac

SEQ ID NO: 1837300 - RNA, 22 nt, Salmonella typhimurium LT2
uaccgcgcaguucaauauucac

SEQ ID NO: 1837301 - RNA, 14 nt, Salmonella typhimurium LT2
uaccgcgccaggcg

SEQ ID NO: 1837302 - RNA, 17 nt, Salmonella typhimurium LT2
uaccgccuucagcgcgc

SEQ ID NO: 1837303 - RNA, 19 nt, Salmonella typhimurium LT2
uaccgcgaugugcugggga

SEQ ID NO: 1837304 - RNA, 23 nt, Salmonella typhimurium LT2
uaccgauuguuuggugcugaaau

SEQ ID NO: 1837305 - RNA, 13 nt, Salmonella typhimurium LT2
uaccgcacaucac

SEQ ID NO: 1837306 - RNA, 20 nt, Salmonella typhimurium LT2
uacccuauuuacagagcaau

SEQ ID NO: 1837307 - RNA, 19 nt, Salmonella typhimurium LT2
uacccguguggcugugcga

SEQ ID NO: 1837308 - RNA, 19 nt, Salmonella typhimurium LT2
uacccgauaccgccagccc

SEQ ID NO: 1837309 - RNA, 20 nt, Salmonella typhimurium LT2
uaccccaucauugacuucaa

SEQ ID NO: 1837310 - RNA, 13 nt, Salmonella typhimurium LT2
uaccccagcgcgc

SEQ ID NO: 1837311 - RNA, 20 nt, Salmonella typhimurium LT2
uacccaccggaccgccgagc

SEQ ID NO: 1837312 - RNA, 16 nt, Salmonella typhimurium LT2
uacccaacgcaaugcg

SEQ ID NO: 1837313 - RNA, 22 nt, Salmonella typhimurium LT2
uaccccgcagcgaaaauccagu

SEQ ID NO: 1837314 - RNA, 15 nt, Salmonella typhimurium LT2
uaccccgccagcagg

SEQ ID NO: 1837315 - RNA, 14 nt, Salmonella typhimurium LT2
uaccccucuuucac

SEQ ID NO: 1837316 - RNA, 20 nt, Salmonella typhimurium LT2
uacucacgacuuucaccaga

SEQ ID NO: 1837317 - RNA, 18 nt, Salmonella typhimurium LT2
uacucagaucggcagaca

SEQ ID NO: 1837318 - RNA, 16 nt, Salmonella typhimurium LT2
uacucagcgucaucac

SEQ ID NO: 1837319 - RNA, 16 nt, Salmonella typhimurium LT2
uacucacauucauaaa

SEQ ID NO: 1837320 - RNA, 20 nt, Salmonella typhimurium LT2
uacucacauucauaaaagau

SEQ ID NO: 1837321 - RNA, 13 nt, Salmonella typhimurium LT2
uacuauuuuucac

SEQ ID NO: 1837322 - RNA, 21 nt, Salmonella typhimurium LT2
uacguuuauccccgucauacu

SEQ ID NO: 1837323 - RNA, 16 nt, Salmonella typhimurium LT2
uacguuuauucuuuuc

SEQ ID NO: 1837324 - RNA, 16 nt, Salmonella typhimurium LT2
uacguuuuaauaauuu

SEQ ID NO: 1837325 - RNA, 20 nt, Salmonella typhimurium LT2
uacucgacgcacuccagaug

SEQ ID NO: 1837326 - RNA, 16 nt, Salmonella typhimurium LT2
uacuccugcaacagaa

SEQ ID NO: 1837327 - RNA, 18 nt, Salmonella typhimurium LT2
uacuccugcaucguuuug

SEQ ID NO: 1837328 - RNA, 17 nt, Salmonella typhimurium LT2
uacuccgcuauaaaaau

SEQ ID NO: 1837329 - RNA, 22 nt, Salmonella typhimurium LT2
uacucgccaauauccccagccc

SEQ ID NO: 1837330 - RNA, 18 nt, Salmonella typhimurium LT2
uacuccauucccagcucu

SEQ ID NO: 1837331 - RNA, 12 nt, Salmonella typhimurium LT2
uacuccagccca

SEQ ID NO: 1837332 - RNA, 21 nt, Salmonella typhimurium LT2
uacuccagcccaucagucccc

SEQ ID NO: 1837333 - RNA, 21 nt, Salmonella typhimurium LT2
uacugcggguguccguuccug

SEQ ID NO: 1837334 - RNA, 20 nt, Salmonella typhimurium LT2
uacugcuuagcucaucagcc

SEQ ID NO: 1837335 - RNA, 22 nt, Salmonella typhimurium LT2
uacugccgcccaucgccacagc

SEQ ID NO: 1837336 - RNA, 20 nt, Salmonella typhimurium LT2
uacugcgcccgcaagcugca

SEQ ID NO: 1837337 - RNA, 19 nt, Salmonella typhimurium LT2
uacugccaaccaucaacuc

SEQ ID NO: 1837338 - RNA, 14 nt, Salmonella typhimurium LT2
uacugcaacgcgca

SEQ ID NO: 1837339 - RNA, 13 nt, Salmonella typhimurium LT2
uacugauuccugc

SEQ ID NO: 1837340 - RNA, 13 nt, Salmonella typhimurium LT2
uacucuucacccu

SEQ ID NO: 1837341 - RNA, 13 nt, Salmonella typhimurium LT2
uacucuuccacca

SEQ ID NO: 1837342 - RNA, 21 nt, Salmonella typhimurium LT2
uacucuuggagagcaucaucu

SEQ ID NO: 1837343 - RNA, 16 nt, Salmonella typhimurium LT2
uacucugcggagcaag

SEQ ID NO: 1837344 - RNA, 19 nt, Salmonella typhimurium LT2
uacugaauaacagcaccau

SEQ ID NO: 1837345 - RNA, 19 nt, Salmonella typhimurium LT2
uacugaauauuccuuucuu

SEQ ID NO: 1837346 - RNA, 18 nt, Salmonella typhimurium LT2
uacugaacuauaggaaaa

SEQ ID NO: 1837347 - RNA, 21 nt, Salmonella typhimurium LT2
uacugaacuauaggaaaauaa

SEQ ID NO: 1837348 - RNA, 22 nt, Salmonella typhimurium LT2
uacugaacuauaggaaaauaau

SEQ ID NO: 1837349 - RNA, 15 nt, Salmonella typhimurium LT2
uacuuucaaaauacu

SEQ ID NO: 1837350 - RNA, 17 nt, Salmonella typhimurium LT2
uacuuucaaaauacugg

SEQ ID NO: 1837351 - RNA, 23 nt, Salmonella typhimurium LT2
uacuucuucaguuccgccagacu

SEQ ID NO: 1837352 - RNA, 17 nt, Salmonella typhimurium LT2
uacuugcgccgccaucc

SEQ ID NO: 1837353 - RNA, 23 nt, Salmonella typhimurium LT2
uacuugcgccgccauccggcgau

SEQ ID NO: 1837354 - RNA, 20 nt, Salmonella typhimurium LT2
uacuuucuccaugccagaag

SEQ ID NO: 1837355 - RNA, 23 nt, Salmonella typhimurium LT2
uacuuucuacaaauguugucgug

SEQ ID NO: 1837356 - RNA, 15 nt, Salmonella typhimurium LT2
uacuucauauuccga

SEQ ID NO: 1837357 - RNA, 22 nt, Salmonella typhimurium LT2
uacuucacaauaagaaauuuag

SEQ ID NO: 1837358 - RNA, 19 nt, Salmonella typhimurium LT2
uacuggauaaccgcuucga

SEQ ID NO: 1837359 - RNA, 23 nt, Salmonella typhimurium LT2
uacugggucgcguuuaccgccgc

SEQ ID NO: 1837360 - RNA, 20 nt, Salmonella typhimurium LT2
uaugaucgacaaugaucaga

SEQ ID NO: 1837361 - RNA, 15 nt, Salmonella typhimurium LT2
uaugcaacaugucga

SEQ ID NO: 1837362 - RNA, 13 nt, Salmonella typhimurium LT2
uaugcaugguguu

SEQ ID NO: 1837363 - RNA, 23 nt, Salmonella typhimurium LT2
uaugauagccguucuccagcguu

SEQ ID NO: 1837364 - RNA, 18 nt, Salmonella typhimurium LT2
uaugacugcgaauuuccu

SEQ ID NO: 1837365 - RNA, 12 nt, Salmonella typhimurium LT2
uaucugcugcug

SEQ ID NO: 1837366 - RNA, 20 nt, Salmonella typhimurium LT2
uaucuucugcugcucccuca

SEQ ID NO: 1837367 - RNA, 12 nt, Salmonella typhimurium LT2
uaucugcccuuu

SEQ ID NO: 1837368 - RNA, 18 nt, Salmonella typhimurium LT2
uaucugcccuuucuuaug

SEQ ID NO: 1837369 - RNA, 15 nt, Salmonella typhimurium LT2
uaucugcccuuucuu

SEQ ID NO: 1837370 - RNA, 22 nt, Salmonella typhimurium LT2
uaucuuuauuaaaaagcagcca

SEQ ID NO: 1837371 - RNA, 23 nt, Salmonella typhimurium LT2
uaucuuugccuuuugacagcaca

SEQ ID NO: 1837372 - RNA, 13 nt, Salmonella typhimurium LT2
uaucuugauauca

SEQ ID NO: 1837373 - RNA, 19 nt, Salmonella typhimurium LT2
uaugaaggcucaaauuugg

SEQ ID NO: 1837374 - RNA, 14 nt, Salmonella typhimurium LT2
uaugguaauuuaaa

SEQ ID NO: 1837375 - RNA, 22 nt, Salmonella typhimurium LT2
uauguaggccugauaagguaaa

SEQ ID NO: 1837376 - RNA, 20 nt, Salmonella typhimurium LT2
uauguagcaacagacuaucc

SEQ ID NO: 1837377 - RNA, 22 nt, Salmonella typhimurium LT2
uauguagcgcugaagcccgcga

SEQ ID NO: 1837378 - RNA, 16 nt, Salmonella typhimurium LT2
uauguaacugaaccca

SEQ ID NO: 1837379 - RNA, 14 nt, Salmonella typhimurium LT2
uauguaaauuaucc

SEQ ID NO: 1837380 - RNA, 17 nt, Salmonella typhimurium LT2
uauguauugcauuuuau

SEQ ID NO: 1837381 - RNA, 13 nt, Salmonella typhimurium LT2
uauguauuuaauu

SEQ ID NO: 1837382 - RNA, 22 nt, Salmonella typhimurium LT2
uauguuaccuguuaaauugugg

SEQ ID NO: 1837383 - RNA, 19 nt, Salmonella typhimurium LT2
uaugugcaucggcacagcg

SEQ ID NO: 1837384 - RNA, 22 nt, Salmonella typhimurium LT2
uauggcggcauaaucaggaaaa

SEQ ID NO: 1837385 - RNA, 15 nt, Salmonella typhimurium LT2
uauggaaugguauau

SEQ ID NO: 1837386 - RNA, 22 nt, Salmonella typhimurium LT2
uauggauaagcgucgccagcgu

SEQ ID NO: 1837387 - RNA, 20 nt, Salmonella typhimurium LT2
uaugcucccggggauuucuu

SEQ ID NO: 1837388 - RNA, 21 nt, Salmonella typhimurium LT2
uaugcuccaguuguuccagca

SEQ ID NO: 1837389 - RNA, 18 nt, Salmonella typhimurium LT2
uaugcucauugccuuuca

SEQ ID NO: 1837390 - RNA, 20 nt, Salmonella typhimurium LT2
uaugcuacacgccccuuucu

SEQ ID NO: 1837391 - RNA, 17 nt, Salmonella typhimurium LT2
uaugcucaacuuccaga

SEQ ID NO: 1837392 - RNA, 16 nt, Salmonella typhimurium LT2
uaugcgcuuuuuucag

SEQ ID NO: 1837393 - RNA, 18 nt, Salmonella typhimurium LT2
uaugcgcuuccagcauga

SEQ ID NO: 1837394 - RNA, 21 nt, Salmonella typhimurium LT2
uaugcggggguguugcaauaa

SEQ ID NO: 1837395 - RNA, 14 nt, Salmonella typhimurium LT2
uaugcgcuuccagc

SEQ ID NO: 1837396 - RNA, 21 nt, Salmonella typhimurium LT2
uaugcgacugaaaaucaaaaa

SEQ ID NO: 1837397 - RNA, 18 nt, Salmonella typhimurium LT2
uaugcgacgguaaaaaua

SEQ ID NO: 1837398 - RNA, 13 nt, Salmonella typhimurium LT2
uaugccuuccaga

SEQ ID NO: 1837399 - RNA, 21 nt, Salmonella typhimurium LT2
uaugccuuccagaaauaaaau

SEQ ID NO: 1837400 - RNA, 18 nt, Salmonella typhimurium LT2
uaugccagcucaaaucgc

SEQ ID NO: 1837401 - RNA, 16 nt, Salmonella typhimurium LT2
uaugccgcauaaaauu

SEQ ID NO: 1837402 - RNA, 18 nt, Salmonella typhimurium LT2
uaugccccgacaucagau

SEQ ID NO: 1837403 - RNA, 20 nt, Salmonella typhimurium LT2
uaugcccgccgcuggcgggc

SEQ ID NO: 1837404 - RNA, 22 nt, Salmonella typhimurium LT2
uaugcccccuccagccagcgcc

SEQ ID NO: 1837405 - RNA, 16 nt, Salmonella typhimurium LT2
uauaaucacagggguc

SEQ ID NO: 1837406 - RNA, 19 nt, Salmonella typhimurium LT2
uauaguccacuuucuguaa

SEQ ID NO: 1837407 - RNA, 22 nt, Salmonella typhimurium LT2
uauaguucgcauagaauuucag

SEQ ID NO: 1837408 - RNA, 16 nt, Salmonella typhimurium LT2
uauaguggauggccca

SEQ ID NO: 1837409 - RNA, 17 nt, Salmonella typhimurium LT2
uauauaauuuauagcca

SEQ ID NO: 1837410 - RNA, 17 nt, Salmonella typhimurium LT2
uauauacccaaaauaau

SEQ ID NO: 1837411 - RNA, 12 nt, Salmonella typhimurium LT2
uauauaaaaaua

SEQ ID NO: 1837412 - RNA, 19 nt, Salmonella typhimurium LT2
uauaguuuuuaccauauuu

SEQ ID NO: 1837413 - RNA, 20 nt, Salmonella typhimurium LT2
uaucaccaucuuuuugcuca

SEQ ID NO: 1837414 - RNA, 19 nt, Salmonella typhimurium LT2
uaucaacgucuugccauga

SEQ ID NO: 1837415 - RNA, 22 nt, Salmonella typhimurium LT2
uaucaaacugaaaaucaaauaa

SEQ ID NO: 1837416 - RNA, 20 nt, Salmonella typhimurium LT2
uaucaaacagguuguugaug

SEQ ID NO: 1837417 - RNA, 17 nt, Salmonella typhimurium LT2
uaucaaauuugcccagc

SEQ ID NO: 1837418 - RNA, 23 nt, Salmonella typhimurium LT2
uaucaagauaaaaagacagauaa

SEQ ID NO: 1837419 - RNA, 19 nt, Salmonella typhimurium LT2
uaucaagaaaacugccagg

SEQ ID NO: 1837420 - RNA, 20 nt, Salmonella typhimurium LT2
uaucaagaaaacugccagga

SEQ ID NO: 1837421 - RNA, 15 nt, Salmonella typhimurium LT2
uaucaacgggaacuu

SEQ ID NO: 1837422 - RNA, 18 nt, Salmonella typhimurium LT2
uaucaaaccaguuuuuca

SEQ ID NO: 1837423 - RNA, 20 nt, Salmonella typhimurium LT2
uaucaaaccaguuuuucauu

SEQ ID NO: 1837424 - RNA, 15 nt, Salmonella typhimurium LT2
uauauuuauauauag

SEQ ID NO: 1837425 - RNA, 16 nt, Salmonella typhimurium LT2
uauauuuaucugucac

SEQ ID NO: 1837426 - RNA, 18 nt, Salmonella typhimurium LT2
uauaugcaggcauaaaaa

SEQ ID NO: 1837427 - RNA, 19 nt, Salmonella typhimurium LT2
uauaugcaggcauaaaaaa

SEQ ID NO: 1837428 - RNA, 21 nt, Salmonella typhimurium LT2
uauccgccaucgacagcgcca

SEQ ID NO: 1837429 - RNA, 21 nt, Salmonella typhimurium LT2
uauccggcacgguaaaccucu

SEQ ID NO: 1837430 - RNA, 18 nt, Salmonella typhimurium LT2
uauccgcuauuaccagua

SEQ ID NO: 1837431 - RNA, 19 nt, Salmonella typhimurium LT2
uauccggccugcaggcaac

SEQ ID NO: 1837432 - RNA, 17 nt, Salmonella typhimurium LT2
uauccggcggcaaaggc

SEQ ID NO: 1837433 - RNA, 15 nt, Salmonella typhimurium LT2
uauccuaaaucugcc

SEQ ID NO: 1837434 - RNA, 14 nt, Salmonella typhimurium LT2
uauccuaaugccac

SEQ ID NO: 1837435 - RNA, 15 nt, Salmonella typhimurium LT2
uauccuauuggcgca

SEQ ID NO: 1837436 - RNA, 21 nt, Salmonella typhimurium LT2
uauccgugcgcaauuccagca

SEQ ID NO: 1837437 - RNA, 23 nt, Salmonella typhimurium LT2
uaucccaaacgucguaaaaccug

SEQ ID NO: 1837438 - RNA, 16 nt, Salmonella typhimurium LT2
uauccauugaaacggu

SEQ ID NO: 1837439 - RNA, 15 nt, Salmonella typhimurium LT2
uauccauuucaucag

SEQ ID NO: 1837440 - RNA, 14 nt, Salmonella typhimurium LT2
uaucauuuuuucua

SEQ ID NO: 1837441 - RNA, 15 nt, Salmonella typhimurium LT2
uaucauuuuuucuaa

SEQ ID NO: 1837442 - RNA, 22 nt, Salmonella typhimurium LT2
uaucauuuuuucuaagaugacu

SEQ ID NO: 1837443 - RNA, 13 nt, Salmonella typhimurium LT2
uauccaauaauaa

SEQ ID NO: 1837444 - RNA, 18 nt, Salmonella typhimurium LT2
uauccaauaauaagaauu

SEQ ID NO: 1837445 - RNA, 13 nt, Salmonella typhimurium LT2
uaucauuauguca

SEQ ID NO: 1837446 - RNA, 16 nt, Salmonella typhimurium LT2
uaucagaccugccuga

SEQ ID NO: 1837447 - RNA, 17 nt, Salmonella typhimurium LT2
uaucugcauaggcuuua

SEQ ID NO: 1837448 - RNA, 18 nt, Salmonella typhimurium LT2
uaucucccgguugauaau

SEQ ID NO: 1837449 - RNA, 17 nt, Salmonella typhimurium LT2
uaucggcucaauacccu

SEQ ID NO: 1837450 - RNA, 20 nt, Salmonella typhimurium LT2
uaucgggcccguugccuggc

SEQ ID NO: 1837451 - RNA, 19 nt, Salmonella typhimurium LT2
uaucguaagccacugccca

SEQ ID NO: 1837452 - RNA, 24 nt, Salmonella typhimurium LT2
uaucguggcgggcgucaauuuccu

SEQ ID NO: 1837453 - RNA, 20 nt, Salmonella typhimurium LT2
uaucgccgaaagcgaucaca

SEQ ID NO: 1837454 - RNA, 14 nt, Salmonella typhimurium LT2
uaucgccaaaccag

SEQ ID NO: 1837455 - RNA, 20 nt, Salmonella typhimurium LT2
uauccugcggacgcagcuca

SEQ ID NO: 1837456 - RNA, 15 nt, Salmonella typhimurium LT2
uauccugaaggacaa

SEQ ID NO: 1837457 - RNA, 23 nt, Salmonella typhimurium LT2
uaucgcgccgccaauauccauuu

SEQ ID NO: 1837458 - RNA, 20 nt, Salmonella typhimurium LT2
uaucgcggaugacuucuucu

SEQ ID NO: 1837459 - RNA, 19 nt, Salmonella typhimurium LT2
uaucgccguaaccgccugc

SEQ ID NO: 1837460 - RNA, 14 nt, Salmonella typhimurium LT2
uaucgccgaucaca

SEQ ID NO: 1837461 - RNA, 24 nt, Salmonella typhimurium LT2
uaucgccggcagacgauagcgggu

SEQ ID NO: 1837462 - RNA, 14 nt, Salmonella typhimurium LT2
uaucggccagcucu

SEQ ID NO: 1837463 - RNA, 18 nt, Salmonella typhimurium LT2
uaucggccggaugccagu

SEQ ID NO: 1837464 - RNA, 22 nt, Salmonella typhimurium LT2
uaucggcacaucaugccagccg

SEQ ID NO: 1837465 - RNA, 22 nt, Salmonella typhimurium LT2
uagugcagaaaggcgugcagcg

SEQ ID NO: 1837466 - RNA, 15 nt, Salmonella typhimurium LT2
uaguuuauucuucuc

SEQ ID NO: 1837467 - RNA, 21 nt, Salmonella typhimurium LT2
uauaacgacagccuauuaauc

SEQ ID NO: 1837468 - RNA, 21 nt, Salmonella typhimurium LT2
uauaaccguagauuuucauca

SEQ ID NO: 1837469 - RNA, 15 nt, Salmonella typhimurium LT2
uauaacuuucaauau

SEQ ID NO: 1837470 - RNA, 16 nt, Salmonella typhimurium LT2
uaguaguuauaaaucc

SEQ ID NO: 1837471 - RNA, 13 nt, Salmonella typhimurium LT2
uaguauuucccuu

SEQ ID NO: 1837472 - RNA, 12 nt, Salmonella typhimurium LT2
uaguaucauauu

SEQ ID NO: 1837473 - RNA, 17 nt, Salmonella typhimurium LT2
uaguaucauauuuucuu

SEQ ID NO: 1837474 - RNA, 21 nt, Salmonella typhimurium LT2
uaguaucauauuuucuugcua

SEQ ID NO: 1837475 - RNA, 22 nt, Salmonella typhimurium LT2
uaguauccccggcaaccuuaaa

SEQ ID NO: 1837476 - RNA, 20 nt, Salmonella typhimurium LT2
uaguauggagcaggaaaaga

SEQ ID NO: 1837477 - RNA, 14 nt, Salmonella typhimurium LT2
uaguccagcagcca

SEQ ID NO: 1837478 - RNA, 11 nt, Salmonella typhimurium LT2
uaguccagcag

SEQ ID NO: 1837479 - RNA, 22 nt, Salmonella typhimurium LT2
uagucaggaggauauucgucca

SEQ ID NO: 1837480 - RNA, 17 nt, Salmonella typhimurium LT2
uagucaggcacaaaaaa

SEQ ID NO: 1837481 - RNA, 21 nt, Salmonella typhimurium LT2
uagucaggcacaaaaaacaaa

SEQ ID NO: 1837482 - RNA, 19 nt, Salmonella typhimurium LT2
uaguccguuuaaagacauc

SEQ ID NO: 1837483 - RNA, 18 nt, Salmonella typhimurium LT2
uagugauaccagccaaca

SEQ ID NO: 1837484 - RNA, 19 nt, Salmonella typhimurium LT2
uagugauuucgaacucuac

SEQ ID NO: 1837485 - RNA, 18 nt, Salmonella typhimurium LT2
uagguucugcgaggugau

SEQ ID NO: 1837486 - RNA, 22 nt, Salmonella typhimurium LT2
uagguucgguaugccuuccaga

SEQ ID NO: 1837487 - RNA, 12 nt, Salmonella typhimurium LT2
uaggcugaauac

SEQ ID NO: 1837488 - RNA, 21 nt, Salmonella typhimurium LT2
uaggcugaauacguauuggaa

SEQ ID NO: 1837489 - RNA, 20 nt, Salmonella typhimurium LT2
uaggcucaauaugccaggca

SEQ ID NO: 1837490 - RNA, 22 nt, Salmonella typhimurium LT2
uaguaaacggcgcugaaaggca

SEQ ID NO: 1837491 - RNA, 19 nt, Salmonella typhimurium LT2
uaguaccgaacagccaggc

SEQ ID NO: 1837492 - RNA, 13 nt, Salmonella typhimurium LT2
uagcggcagcacg

SEQ ID NO: 1837493 - RNA, 15 nt, Salmonella typhimurium LT2
uagcgcuuuuuccag

SEQ ID NO: 1837494 - RNA, 16 nt, Salmonella typhimurium LT2
uagcggguaaacagau

SEQ ID NO: 1837495 - RNA, 16 nt, Salmonella typhimurium LT2
uagcgggcaaugccac

SEQ ID NO: 1837496 - RNA, 20 nt, Salmonella typhimurium LT2
uagcggcuaaucaccaccuc

SEQ ID NO: 1837497 - RNA, 18 nt, Salmonella typhimurium LT2
uagcgucaacgcuuuuau

SEQ ID NO: 1837498 - RNA, 14 nt, Salmonella typhimurium LT2
uagcgguuugacga

SEQ ID NO: 1837499 - RNA, 17 nt, Salmonella typhimurium LT2
uagcgucuuauccggcc

SEQ ID NO: 1837500 - RNA, 19 nt, Salmonella typhimurium LT2
uagcccugaucccacagcg

SEQ ID NO: 1837501 - RNA, 20 nt, Salmonella typhimurium LT2
uagcgcaggggggaaaugag

SEQ ID NO: 1837502 - RNA, 18 nt, Salmonella typhimurium LT2
uagcgcaaauauccuacc

SEQ ID NO: 1837503 - RNA, 14 nt, Salmonella typhimurium LT2
uagcgccgcuucca

SEQ ID NO: 1837504 - RNA, 22 nt, Salmonella typhimurium LT2
uagcgccagacagauaacacca

SEQ ID NO: 1837505 - RNA, 14 nt, Salmonella typhimurium LT2
uagcgccagcagca

SEQ ID NO: 1837506 - RNA, 16 nt, Salmonella typhimurium LT2
uagcgccagcagcaua

SEQ ID NO: 1837507 - RNA, 21 nt, Salmonella typhimurium LT2
uagcgcauggcggccagaugg

SEQ ID NO: 1837508 - RNA, 12 nt, Salmonella typhimurium LT2
uagcgccugcuc

SEQ ID NO: 1837509 - RNA, 12 nt, Salmonella typhimurium LT2
uagcgcgcugcu

SEQ ID NO: 1837510 - RNA, 21 nt, Salmonella typhimurium LT2
uagcgcgcgcuaauuuucagg

SEQ ID NO: 1837511 - RNA, 16 nt, Salmonella typhimurium LT2
uagcgcggcagcgcgc

SEQ ID NO: 1837512 - RNA, 20 nt, Salmonella typhimurium LT2
uagcgcguuaccgcucaaac

SEQ ID NO: 1837513 - RNA, 18 nt, Salmonella typhimurium LT2
uaggccaucacuggcauu

SEQ ID NO: 1837514 - RNA, 20 nt, Salmonella typhimurium LT2
uaggccagccgacgcucuuc

SEQ ID NO: 1837515 - RNA, 15 nt, Salmonella typhimurium LT2
uaggcaggaaaucca

SEQ ID NO: 1837516 - RNA, 17 nt, Salmonella typhimurium LT2
uaggcaacaauuucuac

SEQ ID NO: 1837517 - RNA, 16 nt, Salmonella typhimurium LT2
uagcuuacuuucagau

SEQ ID NO: 1837518 - RNA, 19 nt, Salmonella typhimurium LT2
uagcuuaaaaaauccugca

SEQ ID NO: 1837519 - RNA, 21 nt, Salmonella typhimurium LT2
uagcuguaccagaucgccugc

SEQ ID NO: 1837520 - RNA, 11 nt, Salmonella typhimurium LT2
uagcuuccagc

SEQ ID NO: 1837521 - RNA, 20 nt, Salmonella typhimurium LT2
uagcuuaucgccaaagauau

SEQ ID NO: 1837522 - RNA, 14 nt, Salmonella typhimurium LT2
uagcuucagcggcg

SEQ ID NO: 1837523 - RNA, 20 nt, Salmonella typhimurium LT2
uagcaggagaucuuuccauu

SEQ ID NO: 1837524 - RNA, 19 nt, Salmonella typhimurium LT2
uagcagcgaugacagcagg

SEQ ID NO: 1837525 - RNA, 13 nt, Salmonella typhimurium LT2
uagcagcaauaau

SEQ ID NO: 1837526 - RNA, 18 nt, Salmonella typhimurium LT2
uagcaaaucuucauuuca

SEQ ID NO: 1837527 - RNA, 12 nt, Salmonella typhimurium LT2
uagcaaaacaua

SEQ ID NO: 1837528 - RNA, 20 nt, Salmonella typhimurium LT2
uagcaaccucggcuugcuuc

SEQ ID NO: 1837529 - RNA, 18 nt, Salmonella typhimurium LT2
uagcaacgcgaagcagcu

SEQ ID NO: 1837530 - RNA, 18 nt, Salmonella typhimurium LT2
uagcaacagacuauccag

SEQ ID NO: 1837531 - RNA, 13 nt, Salmonella typhimurium LT2
uagcaggccauaa

SEQ ID NO: 1837532 - RNA, 14 nt, Salmonella typhimurium LT2
uagcauccagaccc

SEQ ID NO: 1837533 - RNA, 23 nt, Salmonella typhimurium LT2
uagcccgcuuuaccgaaaucggu

SEQ ID NO: 1837534 - RNA, 14 nt, Salmonella typhimurium LT2
uagaugaaugacug

SEQ ID NO: 1837535 - RNA, 21 nt, Salmonella typhimurium LT2
uagaugcugauguccgcagcc

SEQ ID NO: 1837536 - RNA, 17 nt, Salmonella typhimurium LT2
ucagcauaaagccucuc

SEQ ID NO: 1837537 - RNA, 12 nt, Salmonella typhimurium LT2
ucagcaguucau

SEQ ID NO: 1837538 - RNA, 15 nt, Salmonella typhimurium LT2
ucagcauacugcguu

SEQ ID NO: 1837539 - RNA, 20 nt, Salmonella typhimurium LT2
ucagcauagcgccuucaggc

SEQ ID NO: 1837540 - RNA, 15 nt, Salmonella typhimurium LT2
ucagcacuucccacu

SEQ ID NO: 1837541 - RNA, 14 nt, Salmonella typhimurium LT2
ucagcagcaccacu

SEQ ID NO: 1837542 - RNA, 21 nt, Salmonella typhimurium LT2
ucagcagcagcguaauggcca

SEQ ID NO: 1837543 - RNA, 21 nt, Salmonella typhimurium LT2
ucagcagcaccgguuuuuccg

SEQ ID NO: 1837544 - RNA, 20 nt, Salmonella typhimurium LT2
ucagcaauaauuuuaccauu

SEQ ID NO: 1837545 - RNA, 17 nt, Salmonella typhimurium LT2
ucagcaauuaacaaaua

SEQ ID NO: 1837546 - RNA, 18 nt, Salmonella typhimurium LT2
ucagcaauuaacaaauaa

SEQ ID NO: 1837547 - RNA, 15 nt, Salmonella typhimurium LT2
ucagcaauugccuga

SEQ ID NO: 1837548 - RNA, 15 nt, Salmonella typhimurium LT2
ucagcaauauuuugu

SEQ ID NO: 1837549 - RNA, 18 nt, Salmonella typhimurium LT2
ucagcaacccuuuuucaa

SEQ ID NO: 1837550 - RNA, 13 nt, Salmonella typhimurium LT2
ucagcaaauaauc

SEQ ID NO: 1837551 - RNA, 20 nt, Salmonella typhimurium LT2
ucagcaccucaucgcuaccu

SEQ ID NO: 1837552 - RNA, 21 nt, Salmonella typhimurium LT2
ucagcacgcuuuggcaggccu

SEQ ID NO: 1837553 - RNA, 16 nt, Salmonella typhimurium LT2
ucagcacaaaauccca

SEQ ID NO: 1837554 - RNA, 21 nt, Salmonella typhimurium LT2
ucagcacaaaaucccacaucc

SEQ ID NO: 1837555 - RNA, 20 nt, Salmonella typhimurium LT2
ucagcaauuuuguuaaaucc

SEQ ID NO: 1837556 - RNA, 16 nt, Salmonella typhimurium LT2
ucagcacacuacacag

SEQ ID NO: 1837557 - RNA, 23 nt, Salmonella typhimurium LT2
ucagcccuugucgacugcggaac

SEQ ID NO: 1837558 - RNA, 18 nt, Salmonella typhimurium LT2
ucagccgcgcauagcugg

SEQ ID NO: 1837559 - RNA, 19 nt, Salmonella typhimurium LT2
ucagccgccaucaggcaug

SEQ ID NO: 1837560 - RNA, 22 nt, Salmonella typhimurium LT2
ucagccgcgcuaucaaaaugca

SEQ ID NO: 1837561 - RNA, 16 nt, Salmonella typhimurium LT2
ucagccuuuucauaug

SEQ ID NO: 1837562 - RNA, 20 nt, Salmonella typhimurium LT2
ucagcgaccgucguguuacc

SEQ ID NO: 1837563 - RNA, 16 nt, Salmonella typhimurium LT2
ucagccuuaaucaacu

SEQ ID NO: 1837564 - RNA, 16 nt, Salmonella typhimurium LT2
ucagccgggcgggaac

SEQ ID NO: 1837565 - RNA, 19 nt, Salmonella typhimurium LT2
ucagcauccgcaagacacg

SEQ ID NO: 1837566 - RNA, 13 nt, Salmonella typhimurium LT2
ucagcauuaauac

SEQ ID NO: 1837567 - RNA, 16 nt, Salmonella typhimurium LT2
ucagccacuucuucca

SEQ ID NO: 1837568 - RNA, 16 nt, Salmonella typhimurium LT2
ucagccagcagcucaa

SEQ ID NO: 1837569 - RNA, 15 nt, Salmonella typhimurium LT2
ucagccagcgaucag

SEQ ID NO: 1837570 - RNA, 13 nt, Salmonella typhimurium LT2
ucagccagcugcu

SEQ ID NO: 1837571 - RNA, 12 nt, Salmonella typhimurium LT2
ucagaucaauac

SEQ ID NO: 1837572 - RNA, 15 nt, Salmonella typhimurium LT2
ucagaucggcaagca

SEQ ID NO: 1837573 - RNA, 19 nt, Salmonella typhimurium LT2
ucagauuaaucaggcguuc

SEQ ID NO: 1837574 - RNA, 17 nt, Salmonella typhimurium LT2
ucagauuacccccuucg

SEQ ID NO: 1837575 - RNA, 14 nt, Salmonella typhimurium LT2
ucagcaaaaacauu

SEQ ID NO: 1837576 - RNA, 11 nt, Salmonella typhimurium LT2
ucagcaaaaac

SEQ ID NO: 1837577 - RNA, 17 nt, Salmonella typhimurium LT2
ucagauugccacaggac

SEQ ID NO: 1837578 - RNA, 23 nt, Salmonella typhimurium LT2
ucagauaggcgcgaaaugucccg

SEQ ID NO: 1837579 - RNA, 18 nt, Salmonella typhimurium LT2
ucagauaguauuucccuu

SEQ ID NO: 1837580 - RNA, 19 nt, Salmonella typhimurium LT2
ucagauagagaaggcugga

SEQ ID NO: 1837581 - RNA, 20 nt, Salmonella typhimurium LT2
ucagauagagaaggcuggaa

SEQ ID NO: 1837582 - RNA, 22 nt, Salmonella typhimurium LT2
ucagauagcgaaccaucauuaa

SEQ ID NO: 1837583 - RNA, 21 nt, Salmonella typhimurium LT2
ucagauaaacagguaaaacaa

SEQ ID NO: 1837584 - RNA, 21 nt, Salmonella typhimurium LT2
ucagaggccuuuugcagcagc

SEQ ID NO: 1837585 - RNA, 22 nt, Salmonella typhimurium LT2
ucagaggccuuuugcagcagcg

SEQ ID NO: 1837586 - RNA, 16 nt, Salmonella typhimurium LT2
ucagacggacaucaga

SEQ ID NO: 1837587 - RNA, 17 nt, Salmonella typhimurium LT2
ucagacggacaucagag

SEQ ID NO: 1837588 - RNA, 14 nt, Salmonella typhimurium LT2
ucagacgaggcgca

SEQ ID NO: 1837589 - RNA, 13 nt, Salmonella typhimurium LT2
ucagacgcugguu

SEQ ID NO: 1837590 - RNA, 15 nt, Salmonella typhimurium LT2
ucagacgcugguugu

SEQ ID NO: 1837591 - RNA, 19 nt, Salmonella typhimurium LT2
ucagacaccagcccuggcu

SEQ ID NO: 1837592 - RNA, 17 nt, Salmonella typhimurium LT2
ucagacaccagcccugg

SEQ ID NO: 1837593 - RNA, 14 nt, Salmonella typhimurium LT2
ucagaauuucccca

SEQ ID NO: 1837594 - RNA, 16 nt, Salmonella typhimurium LT2
ucagaauuuccccagu

SEQ ID NO: 1837595 - RNA, 18 nt, Salmonella typhimurium LT2
ucagaccgauaaauaccg

SEQ ID NO: 1837596 - RNA, 12 nt, Salmonella typhimurium LT2
ucagacaguagc

SEQ ID NO: 1837597 - RNA, 17 nt, Salmonella typhimurium LT2
ucagacauuguugcguu

SEQ ID NO: 1837598 - RNA, 20 nt, Salmonella typhimurium LT2
ucagaauaccgcguccuucu

SEQ ID NO: 1837599 - RNA, 13 nt, Salmonella typhimurium LT2
ucagaauauguuu

SEQ ID NO: 1837600 - RNA, 17 nt, Salmonella typhimurium LT2
ucacgcgccgccugcac

SEQ ID NO: 1837601 - RNA, 12 nt, Salmonella typhimurium LT2
ucacgcggcgcg

SEQ ID NO: 1837602 - RNA, 16 nt, Salmonella typhimurium LT2
ucacgcugcaguuuau

SEQ ID NO: 1837603 - RNA, 17 nt, Salmonella typhimurium LT2
ucacggagaaaagcgaa

SEQ ID NO: 1837604 - RNA, 22 nt, Salmonella typhimurium LT2
ucacggagaaaagcgaaaauaa

SEQ ID NO: 1837605 - RNA, 19 nt, Salmonella typhimurium LT2
ucacgcuggugcgcggaag

SEQ ID NO: 1837606 - RNA, 17 nt, Salmonella typhimurium LT2
ucacggcgaaucgccug

SEQ ID NO: 1837607 - RNA, 18 nt, Salmonella typhimurium LT2
ucacggcguuaccuucau

SEQ ID NO: 1837608 - RNA, 18 nt, Salmonella typhimurium LT2
ucacggcacgcccuucgu

SEQ ID NO: 1837609 - RNA, 18 nt, Salmonella typhimurium LT2
ucacgguagaccaaaugg

SEQ ID NO: 1837610 - RNA, 18 nt, Salmonella typhimurium LT2
ucacgguauucguuacca

SEQ ID NO: 1837611 - RNA, 20 nt, Salmonella typhimurium LT2
ucacgccaucgacaaaggca

SEQ ID NO: 1837612 - RNA, 18 nt, Salmonella typhimurium LT2
ucacgccauuccagcugg

SEQ ID NO: 1837613 - RNA, 19 nt, Salmonella typhimurium LT2
ucacgcagcgccuuaucca

SEQ ID NO: 1837614 - RNA, 17 nt, Salmonella typhimurium LT2
ucacgcaaaugcagcgg

SEQ ID NO: 1837615 - RNA, 14 nt, Salmonella typhimurium LT2
ucacgcaacaacag

SEQ ID NO: 1837616 - RNA, 23 nt, Salmonella typhimurium LT2
ucacgcaacaacaggccagaaua

SEQ ID NO: 1837617 - RNA, 18 nt, Salmonella typhimurium LT2
ucaccuccgccaccagcg

SEQ ID NO: 1837618 - RNA, 12 nt, Salmonella typhimurium LT2
ucaccuccagca

SEQ ID NO: 1837619 - RNA, 18 nt, Salmonella typhimurium LT2
ucaccucacuccagaccu

SEQ ID NO: 1837620 - RNA, 16 nt, Salmonella typhimurium LT2
ucaccucuuccccggu

SEQ ID NO: 1837621 - RNA, 19 nt, Salmonella typhimurium LT2
ucaccucuaccggggcgcu

SEQ ID NO: 1837622 - RNA, 18 nt, Salmonella typhimurium LT2
ucaccugauuaccuacca

SEQ ID NO: 1837623 - RNA, 15 nt, Salmonella typhimurium LT2
ucaccucuuuuucaa

SEQ ID NO: 1837624 - RNA, 16 nt, Salmonella typhimurium LT2
ucaccuggaugcugcc

SEQ ID NO: 1837625 - RNA, 21 nt, Salmonella typhimurium LT2
ucaccuucggugaaaucacga

SEQ ID NO: 1837626 - RNA, 20 nt, Salmonella typhimurium LT2
ucaccuucggugaaaucacg

SEQ ID NO: 1837627 - RNA, 15 nt, Salmonella typhimurium LT2
ucaccuuucauuuua

SEQ ID NO: 1837628 - RNA, 16 nt, Salmonella typhimurium LT2
ucacgauaaugaaccu

SEQ ID NO: 1837629 - RNA, 14 nt, Salmonella typhimurium LT2
ucacgauaaggccu

SEQ ID NO: 1837630 - RNA, 17 nt, Salmonella typhimurium LT2
ucacgaccagccaacag

SEQ ID NO: 1837631 - RNA, 21 nt, Salmonella typhimurium LT2
ucacgacccggcguuuucaga

SEQ ID NO: 1837632 - RNA, 22 nt, Salmonella typhimurium LT2
ucacuaaaccagcuauccagcu

SEQ ID NO: 1837633 - RNA, 22 nt, Salmonella typhimurium LT2
ucacguuuuuuacgucagcaau

SEQ ID NO: 1837634 - RNA, 23 nt, Salmonella typhimurium LT2
ucacguuuuuuacgucagcaaua

SEQ ID NO: 1837635 - RNA, 20 nt, Salmonella typhimurium LT2
ucacuaaacuaaugccuggc

SEQ ID NO: 1837636 - RNA, 23 nt, Salmonella typhimurium LT2
ucacuaaacuaaugccuggcagu

SEQ ID NO: 1837637 - RNA, 15 nt, Salmonella typhimurium LT2
ucacuaacuagccau

SEQ ID NO: 1837638 - RNA, 21 nt, Salmonella typhimurium LT2
ucacuaacuccagcaucauuu

SEQ ID NO: 1837639 - RNA, 22 nt, Salmonella typhimurium LT2
ucacuaacuccagcaucauuuu

SEQ ID NO: 1837640 - RNA, 14 nt, Salmonella typhimurium LT2
ucacguuuuuacuc

SEQ ID NO: 1837641 - RNA, 22 nt, Salmonella typhimurium LT2
ucacgucgcgaagcugugcguu

SEQ ID NO: 1837642 - RNA, 18 nt, Salmonella typhimurium LT2
ucacgucgcgcgccgccu

SEQ ID NO: 1837643 - RNA, 23 nt, Salmonella typhimurium LT2
ucacgucggugaaaaugaaaaau

SEQ ID NO: 1837644 - RNA, 17 nt, Salmonella typhimurium LT2
ucacgucgcccaccgca

SEQ ID NO: 1837645 - RNA, 15 nt, Salmonella typhimurium LT2
ucacuaccgccgcga

SEQ ID NO: 1837646 - RNA, 15 nt, Salmonella typhimurium LT2
ucacuaucacacuga

SEQ ID NO: 1837647 - RNA, 13 nt, Salmonella typhimurium LT2
ucacucugaaaaa

SEQ ID NO: 1837648 - RNA, 22 nt, Salmonella typhimurium LT2
ucacuucuuugaaguucaucac

SEQ ID NO: 1837649 - RNA, 19 nt, Salmonella typhimurium LT2
ucacuucuucauaaaaccc

SEQ ID NO: 1837650 - RNA, 23 nt, Salmonella typhimurium LT2
ucacuucugaguucggcaugggg

SEQ ID NO: 1837651 - RNA, 14 nt, Salmonella typhimurium LT2
ucacuucaucauca

SEQ ID NO: 1837652 - RNA, 14 nt, Salmonella typhimurium LT2
ucacuuauguacaa

SEQ ID NO: 1837653 - RNA, 15 nt, Salmonella typhimurium LT2
ucacuucaauguuag

SEQ ID NO: 1837654 - RNA, 12 nt, Salmonella typhimurium LT2
ucacuuauaaau

SEQ ID NO: 1837655 - RNA, 17 nt, Salmonella typhimurium LT2
ucacuuaaguaaagauu

SEQ ID NO: 1837656 - RNA, 19 nt, Salmonella typhimurium LT2
ucacuggcggcaagcugcu

SEQ ID NO: 1837657 - RNA, 17 nt, Salmonella typhimurium LT2
ucacuggcggcaagcug

SEQ ID NO: 1837658 - RNA, 20 nt, Salmonella typhimurium LT2
ucacuggcgaguugccggag

SEQ ID NO: 1837659 - RNA, 14 nt, Salmonella typhimurium LT2
ucacuguaaaaggg

SEQ ID NO: 1837660 - RNA, 15 nt, Salmonella typhimurium LT2
ucacugucguaaggc

SEQ ID NO: 1837661 - RNA, 13 nt, Salmonella typhimurium LT2
ucaaucaacucuu

SEQ ID NO: 1837662 - RNA, 20 nt, Salmonella typhimurium LT2
ucaauauucaauggguuaug

SEQ ID NO: 1837663 - RNA, 13 nt, Salmonella typhimurium LT2
ucaauaucauugu

SEQ ID NO: 1837664 - RNA, 22 nt, Salmonella typhimurium LT2
ucaauauacucccgaauggcuu

SEQ ID NO: 1837665 - RNA, 15 nt, Salmonella typhimurium LT2
ucaauaucauagugc

SEQ ID NO: 1837666 - RNA, 21 nt, Salmonella typhimurium LT2
ucaauaauggcgcgaaaacag

SEQ ID NO: 1837667 - RNA, 16 nt, Salmonella typhimurium LT2
ucaauaccagccccac

SEQ ID NO: 1837668 - RNA, 18 nt, Salmonella typhimurium LT2
ucaauacagagauauuaa

SEQ ID NO: 1837669 - RNA, 17 nt, Salmonella typhimurium LT2
ucaauaccuuaguaaaa

SEQ ID NO: 1837670 - RNA, 12 nt, Salmonella typhimurium LT2
ucaauaauaucc

SEQ ID NO: 1837671 - RNA, 14 nt, Salmonella typhimurium LT2
ucaauaauauccug

SEQ ID NO: 1837672 - RNA, 15 nt, Salmonella typhimurium LT2
ucaauaaguaccauu

SEQ ID NO: 1837673 - RNA, 13 nt, Salmonella typhimurium LT2
ucaagcuguugga

SEQ ID NO: 1837674 - RNA, 20 nt, Salmonella typhimurium LT2
ucaagcuuugcguaaaaaaa

SEQ ID NO: 1837675 - RNA, 21 nt, Salmonella typhimurium LT2
ucaagcuuugcguaaaaaaac

SEQ ID NO: 1837676 - RNA, 22 nt, Salmonella typhimurium LT2
ucaagcugauugauuuuguaau

SEQ ID NO: 1837677 - RNA, 20 nt, Salmonella typhimurium LT2
ucaagcugauugauuuugua

SEQ ID NO: 1837678 - RNA, 21 nt, Salmonella typhimurium LT2
ucaagcuggacgguaaccauu

SEQ ID NO: 1837679 - RNA, 23 nt, Salmonella typhimurium LT2
ucaagcgccgccgcauuuugcuu

SEQ ID NO: 1837680 - RNA, 16 nt, Salmonella typhimurium LT2
ucaagcggcaccacau

SEQ ID NO: 1837681 - RNA, 18 nt, Salmonella typhimurium LT2
ucaagccguuuuggcagc

SEQ ID NO: 1837682 - RNA, 13 nt, Salmonella typhimurium LT2
ucaaggcaauaga

SEQ ID NO: 1837683 - RNA, 23 nt, Salmonella typhimurium LT2
ucaaggauggagauaucaccauc

SEQ ID NO: 1837684 - RNA, 14 nt, Salmonella typhimurium LT2
ucaagucccccccc

SEQ ID NO: 1837685 - RNA, 16 nt, Salmonella typhimurium LT2
ucaaguccccccccuc

SEQ ID NO: 1837686 - RNA, 22 nt, Salmonella typhimurium LT2
ucaagugucgauaaccuggaug

SEQ ID NO: 1837687 - RNA, 19 nt, Salmonella typhimurium LT2
ucaauaaagccgcauuuuu

SEQ ID NO: 1837688 - RNA, 23 nt, Salmonella typhimurium LT2
ucaauaaaucgggacggauacug

SEQ ID NO: 1837689 - RNA, 16 nt, Salmonella typhimurium LT2
ucaaugguuaauuaaa

SEQ ID NO: 1837690 - RNA, 19 nt, Salmonella typhimurium LT2
ucaauguuagcauuauuuu

SEQ ID NO: 1837691 - RNA, 20 nt, Salmonella typhimurium LT2
ucaaugcgccccgucugcgu

SEQ ID NO: 1837692 - RNA, 23 nt, Salmonella typhimurium LT2
ucaaugccgucggcaauuaacau

SEQ ID NO: 1837693 - RNA, 17 nt, Salmonella typhimurium LT2
ucaauccugccaaauaa

SEQ ID NO: 1837694 - RNA, 17 nt, Salmonella typhimurium LT2
ucaaucaucauaucccg

SEQ ID NO: 1837695 - RNA, 12 nt, Salmonella typhimurium LT2
ucaaucaucaua

SEQ ID NO: 1837696 - RNA, 15 nt, Salmonella typhimurium LT2
ucaaucacuuaucaa

SEQ ID NO: 1837697 - RNA, 10 nt, Salmonella typhimurium LT2
ucaaucagcg

SEQ ID NO: 1837698 - RNA, 14 nt, Salmonella typhimurium LT2
ucacaaauuaaaaa

SEQ ID NO: 1837699 - RNA, 14 nt, Salmonella typhimurium LT2
ucacaaacaccacc

SEQ ID NO: 1837700 - RNA, 17 nt, Salmonella typhimurium LT2
ucacaaaaacacccgca

SEQ ID NO: 1837701 - RNA, 13 nt, Salmonella typhimurium LT2
ucacaaaaucauu

SEQ ID NO: 1837702 - RNA, 18 nt, Salmonella typhimurium LT2
ucaauuucucuuuuauua

SEQ ID NO: 1837703 - RNA, 17 nt, Salmonella typhimurium LT2
ucaauuuuaauuuaaua

SEQ ID NO: 1837704 - RNA, 21 nt, Salmonella typhimurium LT2
ucaauuuuaauuuaauaauaa

SEQ ID NO: 1837705 - RNA, 17 nt, Salmonella typhimurium LT2
ucaauugccgucagcuc

SEQ ID NO: 1837706 - RNA, 14 nt, Salmonella typhimurium LT2
ucaauucuuuaauu

SEQ ID NO: 1837707 - RNA, 14 nt, Salmonella typhimurium LT2
ucaauuccacaggc

SEQ ID NO: 1837708 - RNA, 13 nt, Salmonella typhimurium LT2
ucaauuauguauu

SEQ ID NO: 1837709 - RNA, 19 nt, Salmonella typhimurium LT2
ucaccccagguugaugcaa

SEQ ID NO: 1837710 - RNA, 22 nt, Salmonella typhimurium LT2
ucaccccagguugaugcaaaug

SEQ ID NO: 1837711 - RNA, 14 nt, Salmonella typhimurium LT2
ucacccccagcuga

SEQ ID NO: 1837712 - RNA, 16 nt, Salmonella typhimurium LT2
ucacccccagcugacu

SEQ ID NO: 1837713 - RNA, 21 nt, Salmonella typhimurium LT2
ucacccccagcugacuggcag

SEQ ID NO: 1837714 - RNA, 17 nt, Salmonella typhimurium LT2
ucacccgcgccagcagg

SEQ ID NO: 1837715 - RNA, 22 nt, Salmonella typhimurium LT2
ucacccgcguaucauugcgcuc

SEQ ID NO: 1837716 - RNA, 18 nt, Salmonella typhimurium LT2
ucacccggauacgcggca

SEQ ID NO: 1837717 - RNA, 19 nt, Salmonella typhimurium LT2
ucaccgcaaauucgucgcc

SEQ ID NO: 1837718 - RNA, 13 nt, Salmonella typhimurium LT2
ucaccgccagagc

SEQ ID NO: 1837719 - RNA, 14 nt, Salmonella typhimurium LT2
ucaccgccaguccc

SEQ ID NO: 1837720 - RNA, 15 nt, Salmonella typhimurium LT2
ucaccggcgugcgcu

SEQ ID NO: 1837721 - RNA, 18 nt, Salmonella typhimurium LT2
ucaccguaauauaaucua

SEQ ID NO: 1837722 - RNA, 22 nt, Salmonella typhimurium LT2
ucaccgggcaggauacggcgcu

SEQ ID NO: 1837723 - RNA, 17 nt, Salmonella typhimurium LT2
ucaccguagcaucauca

SEQ ID NO: 1837724 - RNA, 18 nt, Salmonella typhimurium LT2
ucaccguuuaaaaacauc

SEQ ID NO: 1837725 - RNA, 21 nt, Salmonella typhimurium LT2
ucaccguuuaaaaacaucauu

SEQ ID NO: 1837726 - RNA, 20 nt, Salmonella typhimurium LT2
ucaccauaauuaccggcaca

SEQ ID NO: 1837727 - RNA, 16 nt, Salmonella typhimurium LT2
ucaccaucccaugaug

SEQ ID NO: 1837728 - RNA, 15 nt, Salmonella typhimurium LT2
ucaccaucccaugau

SEQ ID NO: 1837729 - RNA, 17 nt, Salmonella typhimurium LT2
ucaccauuaacaucaga

SEQ ID NO: 1837730 - RNA, 15 nt, Salmonella typhimurium LT2
ucaccauuaacauca

SEQ ID NO: 1837731 - RNA, 22 nt, Salmonella typhimurium LT2
ucaccaucugcgcacguuuauu

SEQ ID NO: 1837732 - RNA, 18 nt, Salmonella typhimurium LT2
ucacccaacauuuuuagc

SEQ ID NO: 1837733 - RNA, 17 nt, Salmonella typhimurium LT2
ucacccaaaaugccaua

SEQ ID NO: 1837734 - RNA, 14 nt, Salmonella typhimurium LT2
ucacccacaucagc

SEQ ID NO: 1837735 - RNA, 14 nt, Salmonella typhimurium LT2
ucaccauucccagc

SEQ ID NO: 1837736 - RNA, 22 nt, Salmonella typhimurium LT2
ucacccagaugcgaaucuucau

SEQ ID NO: 1837737 - RNA, 16 nt, Salmonella typhimurium LT2
ucaccaccgcaggcag

SEQ ID NO: 1837738 - RNA, 22 nt, Salmonella typhimurium LT2
ucaccacgccauagcgcuaugc

SEQ ID NO: 1837739 - RNA, 20 nt, Salmonella typhimurium LT2
ucaccacgcgcacgcccauc

SEQ ID NO: 1837740 - RNA, 22 nt, Salmonella typhimurium LT2
ucaccacgcggauaccuaacag

SEQ ID NO: 1837741 - RNA, 15 nt, Salmonella typhimurium LT2
ucaccacuguauucc

SEQ ID NO: 1837742 - RNA, 17 nt, Salmonella typhimurium LT2
ucaccacuucaaacggu

SEQ ID NO: 1837743 - RNA, 19 nt, Salmonella typhimurium LT2
ucaccagaaugagcggaac

SEQ ID NO: 1837744 - RNA, 13 nt, Salmonella typhimurium LT2
ucaccagcagcau

SEQ ID NO: 1837745 - RNA, 12 nt, Salmonella typhimurium LT2
ucaccaggaugc

SEQ ID NO: 1837746 - RNA, 12 nt, Salmonella typhimurium LT2
ucaccagcgcgc

SEQ ID NO: 1837747 - RNA, 21 nt, Salmonella typhimurium LT2
ucaccaguugaccaaacagca

SEQ ID NO: 1837748 - RNA, 14 nt, Salmonella typhimurium LT2
ucaccacaaaggcg

SEQ ID NO: 1837749 - RNA, 21 nt, Salmonella typhimurium LT2
ucacauuggcaaaccccugcu

SEQ ID NO: 1837750 - RNA, 12 nt, Salmonella typhimurium LT2
ucacauucugac

SEQ ID NO: 1837751 - RNA, 23 nt, Salmonella typhimurium LT2
ucacauuuugacugguaagcugc

SEQ ID NO: 1837752 - RNA, 14 nt, Salmonella typhimurium LT2
ucacaugugcgcua

SEQ ID NO: 1837753 - RNA, 19 nt, Salmonella typhimurium LT2
ucacauucauaaaagauca

SEQ ID NO: 1837754 - RNA, 15 nt, Salmonella typhimurium LT2
ucacaucgcgcagca

SEQ ID NO: 1837755 - RNA, 19 nt, Salmonella typhimurium LT2
ucacaucgccggagaucag

SEQ ID NO: 1837756 - RNA, 22 nt, Salmonella typhimurium LT2
ucacaucgccggagaucagcag

SEQ ID NO: 1837757 - RNA, 17 nt, Salmonella typhimurium LT2
ucacaucguaaaucagc

SEQ ID NO: 1837758 - RNA, 15 nt, Salmonella typhimurium LT2
ucacaucgcccugau

SEQ ID NO: 1837759 - RNA, 13 nt, Salmonella typhimurium LT2
ucacauccagccc

SEQ ID NO: 1837760 - RNA, 21 nt, Salmonella typhimurium LT2
ucacauacaaagagaaaauga

SEQ ID NO: 1837761 - RNA, 17 nt, Salmonella typhimurium LT2
ucacaucaaagccccau

SEQ ID NO: 1837762 - RNA, 15 nt, Salmonella typhimurium LT2
ucacauauucaauaa

SEQ ID NO: 1837763 - RNA, 17 nt, Salmonella typhimurium LT2
ucacauauucaauaaua

SEQ ID NO: 1837764 - RNA, 15 nt, Salmonella typhimurium LT2
ucacaggcuucgaca

SEQ ID NO: 1837765 - RNA, 14 nt, Salmonella typhimurium LT2
ucacaggcuuauac

SEQ ID NO: 1837766 - RNA, 22 nt, Salmonella typhimurium LT2
ucacagacaucggagauuucau

SEQ ID NO: 1837767 - RNA, 14 nt, Salmonella typhimurium LT2
ucacagacaucggu

SEQ ID NO: 1837768 - RNA, 16 nt, Salmonella typhimurium LT2
ucacacugacaauaaa

SEQ ID NO: 1837769 - RNA, 20 nt, Salmonella typhimurium LT2
ucacacugcgccgccagcga

SEQ ID NO: 1837770 - RNA, 12 nt, Salmonella typhimurium LT2
ucacacccagcg

SEQ ID NO: 1837771 - RNA, 16 nt, Salmonella typhimurium LT2
ucacaacugaagcaua

SEQ ID NO: 1837772 - RNA, 18 nt, Salmonella typhimurium LT2
ucacacaagucaccguuu

SEQ ID NO: 1837773 - RNA, 20 nt, Salmonella typhimurium LT2
ucacacaagucaccguuuuu

SEQ ID NO: 1837774 - RNA, 12 nt, Salmonella typhimurium LT2
ucacaaugccgc

SEQ ID NO: 1837775 - RNA, 16 nt, Salmonella typhimurium LT2
ucacaaugccuucaac

SEQ ID NO: 1837776 - RNA, 17 nt, Salmonella typhimurium LT2
ucacaauaucgagauga

SEQ ID NO: 1837777 - RNA, 12 nt, Salmonella typhimurium LT2
ucacaaugucau

SEQ ID NO: 1837778 - RNA, 15 nt, Salmonella typhimurium LT2
ucacaaugucaucaa

SEQ ID NO: 1837779 - RNA, 20 nt, Salmonella typhimurium LT2
uauucauaucguaaauuacu

SEQ ID NO: 1837780 - RNA, 22 nt, Salmonella typhimurium LT2
uauucauaucguaaauuacuca

SEQ ID NO: 1837781 - RNA, 21 nt, Salmonella typhimurium LT2
uauuccagccaggaauggcua

SEQ ID NO: 1837782 - RNA, 16 nt, Salmonella typhimurium LT2
uauucauuuccagcac

SEQ ID NO: 1837783 - RNA, 20 nt, Salmonella typhimurium LT2
uauuccagagaguuuucccc

SEQ ID NO: 1837784 - RNA, 15 nt, Salmonella typhimurium LT2
uauuccauacagaaa

SEQ ID NO: 1837785 - RNA, 16 nt, Salmonella typhimurium LT2
uauuccggcgcuggcg

SEQ ID NO: 1837786 - RNA, 16 nt, Salmonella typhimurium LT2
uauucccaggcaaaug

SEQ ID NO: 1837787 - RNA, 16 nt, Salmonella typhimurium LT2
uauucccguuccagcu

SEQ ID NO: 1837788 - RNA, 17 nt, Salmonella typhimurium LT2
uauucaaucaauuuuaa

SEQ ID NO: 1837789 - RNA, 18 nt, Salmonella typhimurium LT2
uauucagaauaugccagg

SEQ ID NO: 1837790 - RNA, 18 nt, Salmonella typhimurium LT2
uauucagcaguucauucg

SEQ ID NO: 1837791 - RNA, 13 nt, Salmonella typhimurium LT2
uauucaggccucc

SEQ ID NO: 1837792 - RNA, 15 nt, Salmonella typhimurium LT2
uauucaggccuccug

SEQ ID NO: 1837793 - RNA, 15 nt, Salmonella typhimurium LT2
uauuauuuuuucuuu

SEQ ID NO: 1837794 - RNA, 12 nt, Salmonella typhimurium LT2
uauucaauaaua

SEQ ID NO: 1837795 - RNA, 15 nt, Salmonella typhimurium LT2
uauucaagcuguugg

SEQ ID NO: 1837796 - RNA, 13 nt, Salmonella typhimurium LT2
uauucaauaauau

SEQ ID NO: 1837797 - RNA, 13 nt, Salmonella typhimurium LT2
uauucuuaucauu

SEQ ID NO: 1837798 - RNA, 11 nt, Salmonella typhimurium LT2
uauucuucucc

SEQ ID NO: 1837799 - RNA, 23 nt, Salmonella typhimurium LT2
uauucugcacgcacgacggugcu

SEQ ID NO: 1837800 - RNA, 21 nt, Salmonella typhimurium LT2
uauucugggcuuacuuuccaa

SEQ ID NO: 1837801 - RNA, 15 nt, Salmonella typhimurium LT2
uauucuguuuuuuca

SEQ ID NO: 1837802 - RNA, 17 nt, Salmonella typhimurium LT2
uauugaacauuuuuuca

SEQ ID NO: 1837803 - RNA, 21 nt, Salmonella typhimurium LT2
uauugacaacaaauccaaucu

SEQ ID NO: 1837804 - RNA, 15 nt, Salmonella typhimurium LT2
uauucggcuccagau

SEQ ID NO: 1837805 - RNA, 18 nt, Salmonella typhimurium LT2
uauucggucagauaaaua

SEQ ID NO: 1837806 - RNA, 20 nt, Salmonella typhimurium LT2
uauucucaaccagccgauca

SEQ ID NO: 1837807 - RNA, 16 nt, Salmonella typhimurium LT2
uauuaccaauauuaau

SEQ ID NO: 1837808 - RNA, 19 nt, Salmonella typhimurium LT2
uauuaccaauauuaaugua

SEQ ID NO: 1837809 - RNA, 22 nt, Salmonella typhimurium LT2
uauuacgcaagaucacauacaa

SEQ ID NO: 1837810 - RNA, 15 nt, Salmonella typhimurium LT2
uauuaccuccugcau

SEQ ID NO: 1837811 - RNA, 16 nt, Salmonella typhimurium LT2
uauuacgauugcgcca

SEQ ID NO: 1837812 - RNA, 20 nt, Salmonella typhimurium LT2
uauuaauccaaugacaguga

SEQ ID NO: 1837813 - RNA, 21 nt, Salmonella typhimurium LT2
uauuaagccuuuuuaaauauu

SEQ ID NO: 1837814 - RNA, 22 nt, Salmonella typhimurium LT2
uauuaagccuuuuuaaauauua

SEQ ID NO: 1837815 - RNA, 18 nt, Salmonella typhimurium LT2
uauuaacagcuucuucuu

SEQ ID NO: 1837816 - RNA, 15 nt, Salmonella typhimurium LT2
uauuaacaucagccg

SEQ ID NO: 1837817 - RNA, 15 nt, Salmonella typhimurium LT2
uauuaaaauaaauua

SEQ ID NO: 1837818 - RNA, 16 nt, Salmonella typhimurium LT2
uauuaaaauaaauuaa

SEQ ID NO: 1837819 - RNA, 13 nt, Salmonella typhimurium LT2
uauuauguagcaa

SEQ ID NO: 1837820 - RNA, 13 nt, Salmonella typhimurium LT2
uauuaucaauccu

SEQ ID NO: 1837821 - RNA, 15 nt, Salmonella typhimurium LT2
uauuaucaauccugc

SEQ ID NO: 1837822 - RNA, 16 nt, Salmonella typhimurium LT2
uauuagcguuuuuacc

SEQ ID NO: 1837823 - RNA, 15 nt, Salmonella typhimurium LT2
uauuagccaaagcgg

SEQ ID NO: 1837824 - RNA, 20 nt, Salmonella typhimurium LT2
uauuagaauucccuauguaa

SEQ ID NO: 1837825 - RNA, 13 nt, Salmonella typhimurium LT2
uauuauaaaauaa

SEQ ID NO: 1837826 - RNA, 11 nt, Salmonella typhimurium LT2
uauuauaaaau

SEQ ID NO: 1837827 - RNA, 12 nt, Salmonella typhimurium LT2
uauuauacuuau

SEQ ID NO: 1837828 - RNA, 16 nt, Salmonella typhimurium LT2
uauuuauugauuauuu

SEQ ID NO: 1837829 - RNA, 18 nt, Salmonella typhimurium LT2
uauuucgacuuucuucgg

SEQ ID NO: 1837830 - RNA, 19 nt, Salmonella typhimurium LT2
uauuuccuuccgaaucaau

SEQ ID NO: 1837831 - RNA, 17 nt, Salmonella typhimurium LT2
uauuucccuucccagcc

SEQ ID NO: 1837832 - RNA, 17 nt, Salmonella typhimurium LT2
uauuucaucuauuauuu

SEQ ID NO: 1837833 - RNA, 13 nt, Salmonella typhimurium LT2
uauuucaguacag

SEQ ID NO: 1837834 - RNA, 20 nt, Salmonella typhimurium LT2
uauuucacuucgauaacauc

SEQ ID NO: 1837835 - RNA, 17 nt, Salmonella typhimurium LT2
uauuuguguauuuuuuu

SEQ ID NO: 1837836 - RNA, 15 nt, Salmonella typhimurium LT2
uauuuguguauuuuu

SEQ ID NO: 1837837 - RNA, 15 nt, Salmonella typhimurium LT2
uauuuguuccggcaa

SEQ ID NO: 1837838 - RNA, 11 nt, Salmonella typhimurium LT2
uauuuguuccu

SEQ ID NO: 1837839 - RNA, 14 nt, Salmonella typhimurium LT2
uauuuguuccggca

SEQ ID NO: 1837840 - RNA, 22 nt, Salmonella typhimurium LT2
uauuuguuugccgcgauagaaa

SEQ ID NO: 1837841 - RNA, 16 nt, Salmonella typhimurium LT2
uauuuuagcuucuuca

SEQ ID NO: 1837842 - RNA, 13 nt, Salmonella typhimurium LT2
uauuugcccuguu

SEQ ID NO: 1837843 - RNA, 13 nt, Salmonella typhimurium LT2
uauuugcauuuuc

SEQ ID NO: 1837844 - RNA, 18 nt, Salmonella typhimurium LT2
uauuugaugccuggcagu

SEQ ID NO: 1837845 - RNA, 15 nt, Salmonella typhimurium LT2
uauuucugucagcgu

SEQ ID NO: 1837846 - RNA, 19 nt, Salmonella typhimurium LT2
uauuuagccguucaugcac

SEQ ID NO: 1837847 - RNA, 16 nt, Salmonella typhimurium LT2
uauuuaagcucuucuu

SEQ ID NO: 1837848 - RNA, 22 nt, Salmonella typhimurium LT2
uauugugccgcggcuucaucac

SEQ ID NO: 1837849 - RNA, 16 nt, Salmonella typhimurium LT2
uauuuaacuuaaauaa

SEQ ID NO: 1837850 - RNA, 17 nt, Salmonella typhimurium LT2
uauuuaacuuaaauaaa

SEQ ID NO: 1837851 - RNA, 21 nt, Salmonella typhimurium LT2
uauuguuuaacguuucaugga

SEQ ID NO: 1837852 - RNA, 17 nt, Salmonella typhimurium LT2
uauuguuuagacagaca

SEQ ID NO: 1837853 - RNA, 23 nt, Salmonella typhimurium LT2
uauuggaguuaaggauauauacu

SEQ ID NO: 1837854 - RNA, 22 nt, Salmonella typhimurium LT2
uauuggaaagauucuacauucc

SEQ ID NO: 1837855 - RNA, 22 nt, Salmonella typhimurium LT2
uauuggcgcagccuuuuucucg

SEQ ID NO: 1837856 - RNA, 21 nt, Salmonella typhimurium LT2
uauugcgaauaaaacugccau

SEQ ID NO: 1837857 - RNA, 19 nt, Salmonella typhimurium LT2
uauugccuaaaguggcgcc

SEQ ID NO: 1837858 - RNA, 15 nt, Salmonella typhimurium LT2
uauugccgucucaac

SEQ ID NO: 1837859 - RNA, 17 nt, Salmonella typhimurium LT2
uauugccacaauaucau

SEQ ID NO: 1837860 - RNA, 14 nt, Salmonella typhimurium LT2
uauugagaauaaac

SEQ ID NO: 1837861 - RNA, 17 nt, Salmonella typhimurium LT2
uauugacgaaaagauaa

SEQ ID NO: 1837862 - RNA, 13 nt, Salmonella typhimurium LT2
uauugagaauaaa

SEQ ID NO: 1837863 - RNA, 16 nt, Salmonella typhimurium LT2
ucaagacgguuguuuu

SEQ ID NO: 1837864 - RNA, 17 nt, Salmonella typhimurium LT2
ucaacuuuuuuaccauu

SEQ ID NO: 1837865 - RNA, 15 nt, Salmonella typhimurium LT2
ucaagaaccaauaaa

SEQ ID NO: 1837866 - RNA, 20 nt, Salmonella typhimurium LT2
ucaacuuauccauuagcgcc

SEQ ID NO: 1837867 - RNA, 16 nt, Salmonella typhimurium LT2
ucaagcaguuccagca

SEQ ID NO: 1837868 - RNA, 14 nt, Salmonella typhimurium LT2
ucaagcccagcuca

SEQ ID NO: 1837869 - RNA, 20 nt, Salmonella typhimurium LT2
ucaagccagccguccuccag

SEQ ID NO: 1837870 - RNA, 19 nt, Salmonella typhimurium LT2
ucaagauuuugugaccgcc

SEQ ID NO: 1837871 - RNA, 14 nt, Salmonella typhimurium LT2
ucaacgcgccgcca

SEQ ID NO: 1837872 - RNA, 23 nt, Salmonella typhimurium LT2
ucaacgcgaucuucauagucgcu

SEQ ID NO: 1837873 - RNA, 17 nt, Salmonella typhimurium LT2
ucaacgccuccaggcua

SEQ ID NO: 1837874 - RNA, 14 nt, Salmonella typhimurium LT2
ucaacgccauaauc

SEQ ID NO: 1837875 - RNA, 21 nt, Salmonella typhimurium LT2
ucaacgcccgcuuucaccauc

SEQ ID NO: 1837876 - RNA, 23 nt, Salmonella typhimurium LT2
ucaacgccgaacaggccaugacc

SEQ ID NO: 1837877 - RNA, 18 nt, Salmonella typhimurium LT2
ucaacgaggugaauaaau

SEQ ID NO: 1837878 - RNA, 18 nt, Salmonella typhimurium LT2
ucaacgaaugccugcaua

SEQ ID NO: 1837879 - RNA, 18 nt, Salmonella typhimurium LT2
ucaacgaccucaaaauag

SEQ ID NO: 1837880 - RNA, 22 nt, Salmonella typhimurium LT2
ucaaccggguuaagcugaauac

SEQ ID NO: 1837881 - RNA, 14 nt, Salmonella typhimurium LT2
ucaacgugaaaaau

SEQ ID NO: 1837882 - RNA, 16 nt, Salmonella typhimurium LT2
ucaacguccaccagcg

SEQ ID NO: 1837883 - RNA, 15 nt, Salmonella typhimurium LT2
ucaacggucaaaaua

SEQ ID NO: 1837884 - RNA, 19 nt, Salmonella typhimurium LT2
ucaacgguucgacggagau

SEQ ID NO: 1837885 - RNA, 23 nt, Salmonella typhimurium LT2
ucaacuguaccugauccagcucu

SEQ ID NO: 1837886 - RNA, 16 nt, Salmonella typhimurium LT2
ucaacugucgaucggu

SEQ ID NO: 1837887 - RNA, 21 nt, Salmonella typhimurium LT2
ucaacuguaccugauccagcu

SEQ ID NO: 1837888 - RNA, 21 nt, Salmonella typhimurium LT2
ucaacuggaugacugaauuau

SEQ ID NO: 1837889 - RNA, 14 nt, Salmonella typhimurium LT2
ucaacucuccuuuc

SEQ ID NO: 1837890 - RNA, 15 nt, Salmonella typhimurium LT2
ucaaaugaacacaaa

SEQ ID NO: 1837891 - RNA, 14 nt, Salmonella typhimurium LT2
ucaaaugagaauag

SEQ ID NO: 1837892 - RNA, 19 nt, Salmonella typhimurium LT2
ucaaaugauuuuuauaaaa

SEQ ID NO: 1837893 - RNA, 20 nt, Salmonella typhimurium LT2
ucaaaugauuuuuauaaaau

SEQ ID NO: 1837894 - RNA, 18 nt, Salmonella typhimurium LT2
ucaaauguuguuugaaaa

SEQ ID NO: 1837895 - RNA, 20 nt, Salmonella typhimurium LT2
ucaaauguuguuugaaaagu

SEQ ID NO: 1837896 - RNA, 22 nt, Salmonella typhimurium LT2
ucaaaucagacgcuucauuggu

SEQ ID NO: 1837897 - RNA, 12 nt, Salmonella typhimurium LT2
ucaaauccugga

SEQ ID NO: 1837898 - RNA, 21 nt, Salmonella typhimurium LT2
ucaaauccuggaagacuucac

SEQ ID NO: 1837899 - RNA, 13 nt, Salmonella typhimurium LT2
ucaacaaaguuaa

SEQ ID NO: 1837900 - RNA, 13 nt, Salmonella typhimurium LT2
ucaaauuugccca

SEQ ID NO: 1837901 - RNA, 15 nt, Salmonella typhimurium LT2
ucaacagcaggcauc

SEQ ID NO: 1837902 - RNA, 22 nt, Salmonella typhimurium LT2
ucaacagcggcggcaguagucg

SEQ ID NO: 1837903 - RNA, 19 nt, Salmonella typhimurium LT2
ucaacagagccaucaccgu

SEQ ID NO: 1837904 - RNA, 17 nt, Salmonella typhimurium LT2
ucaacaaugcuuucacc

SEQ ID NO: 1837905 - RNA, 14 nt, Salmonella typhimurium LT2
ucaacaaugucgcc

SEQ ID NO: 1837906 - RNA, 15 nt, Salmonella typhimurium LT2
ucaacaccagcagcg

SEQ ID NO: 1837907 - RNA, 21 nt, Salmonella typhimurium LT2
ucaacacuuagaacgcggaag

SEQ ID NO: 1837908 - RNA, 16 nt, Salmonella typhimurium LT2
ucaacacgcagaccca

SEQ ID NO: 1837909 - RNA, 20 nt, Salmonella typhimurium LT2
ucaacaccgacauccgccau

SEQ ID NO: 1837910 - RNA, 11 nt, Salmonella typhimurium LT2
ucaacccuccc

SEQ ID NO: 1837911 - RNA, 19 nt, Salmonella typhimurium LT2
ucaacccucccugcauuau

SEQ ID NO: 1837912 - RNA, 20 nt, Salmonella typhimurium LT2
ucaaccaccaccgauaaacg

SEQ ID NO: 1837913 - RNA, 21 nt, Salmonella typhimurium LT2
ucaaccagccgaucaucacga

SEQ ID NO: 1837914 - RNA, 18 nt, Salmonella typhimurium LT2
ucaaccacgauaaccaga

SEQ ID NO: 1837915 - RNA, 15 nt, Salmonella typhimurium LT2
ucaaccaacggcgcu

SEQ ID NO: 1837916 - RNA, 21 nt, Salmonella typhimurium LT2
ucaacauauuuuucacacaua

SEQ ID NO: 1837917 - RNA, 14 nt, Salmonella typhimurium LT2
ucaacaucaucgga

SEQ ID NO: 1837918 - RNA, 15 nt, Salmonella typhimurium LT2
ucaaagaucucggug

SEQ ID NO: 1837919 - RNA, 18 nt, Salmonella typhimurium LT2
ucaaagcguaccgucugg

SEQ ID NO: 1837920 - RNA, 15 nt, Salmonella typhimurium LT2
ucaaacuuuuaaauu

SEQ ID NO: 1837921 - RNA, 20 nt, Salmonella typhimurium LT2
ucaaacuuuuaaauugaaga

SEQ ID NO: 1837922 - RNA, 18 nt, Salmonella typhimurium LT2
ucaaacuuuuaaauugaa

SEQ ID NO: 1837923 - RNA, 19 nt, Salmonella typhimurium LT2
ucaaacuuguguucccacu

SEQ ID NO: 1837924 - RNA, 22 nt, Salmonella typhimurium LT2
ucaaagaacagggggcgcauca

SEQ ID NO: 1837925 - RNA, 13 nt, Salmonella typhimurium LT2
ucaaacuuuuaua

SEQ ID NO: 1837926 - RNA, 21 nt, Salmonella typhimurium LT2
ucaaagaagcggaaaccccag

SEQ ID NO: 1837927 - RNA, 23 nt, Salmonella typhimurium LT2
ucaaacucgcugccgacuuggcu

SEQ ID NO: 1837928 - RNA, 19 nt, Salmonella typhimurium LT2
ucaaacucuuccgggcuga

SEQ ID NO: 1837929 - RNA, 20 nt, Salmonella typhimurium LT2
ucaaacucgcccagcgccuu

SEQ ID NO: 1837930 - RNA, 15 nt, Salmonella typhimurium LT2
ucaaacccuuccgca

SEQ ID NO: 1837931 - RNA, 22 nt, Salmonella typhimurium LT2
ucaaacgccugcaucaacaggc

SEQ ID NO: 1837932 - RNA, 14 nt, Salmonella typhimurium LT2
ucaaacgcgccgcu

SEQ ID NO: 1837933 - RNA, 19 nt, Salmonella typhimurium LT2
ucaaacggccugcgcugga

SEQ ID NO: 1837934 - RNA, 22 nt, Salmonella typhimurium LT2
ucaaacagcuggcggaagacac

SEQ ID NO: 1837935 - RNA, 17 nt, Salmonella typhimurium LT2
ucaaaccaguuuuucau

SEQ ID NO: 1837936 - RNA, 19 nt, Salmonella typhimurium LT2
ucaaacaaaucaucagcau

SEQ ID NO: 1837937 - RNA, 15 nt, Salmonella typhimurium LT2
ucaaaauuaaucgcc

SEQ ID NO: 1837938 - RNA, 22 nt, Salmonella typhimurium LT2
ucaaaauuaaucgccagcagcg

SEQ ID NO: 1837939 - RNA, 22 nt, Salmonella typhimurium LT2
ucaaaauuaccuuuacaugaaa

SEQ ID NO: 1837940 - RNA, 15 nt, Salmonella typhimurium LT2
ucaaaaucgcgcccc

SEQ ID NO: 1837941 - RNA, 22 nt, Salmonella typhimurium LT2
ucaaaaugauguccacacugac

SEQ ID NO: 1837942 - RNA, 17 nt, Salmonella typhimurium LT2
ucaaaauauaacuucuu

SEQ ID NO: 1837943 - RNA, 14 nt, Salmonella typhimurium LT2
uauuuuccaguagu

SEQ ID NO: 1837944 - RNA, 12 nt, Salmonella typhimurium LT2
uauuuuauuuuu

SEQ ID NO: 1837945 - RNA, 23 nt, Salmonella typhimurium LT2
uauuuucagaaaucauauaaaac

SEQ ID NO: 1837946 - RNA, 18 nt, Salmonella typhimurium LT2
uauuuucuugcuacauau

SEQ ID NO: 1837947 - RNA, 13 nt, Salmonella typhimurium LT2
uauuuuuucgcac

SEQ ID NO: 1837948 - RNA, 20 nt, Salmonella typhimurium LT2
uauuuuucuaaugucagcuc

SEQ ID NO: 1837949 - RNA, 19 nt, Salmonella typhimurium LT2
uauuuuucuauuccgcuca

SEQ ID NO: 1837950 - RNA, 14 nt, Salmonella typhimurium LT2
uauuuuuagcccuu

SEQ ID NO: 1837951 - RNA, 20 nt, Salmonella typhimurium LT2
uauuuuggugugacagcaac

SEQ ID NO: 1837952 - RNA, 24 nt, Salmonella typhimurium LT2
uauuuuggcauuucgcauugucau

SEQ ID NO: 1837953 - RNA, 23 nt, Salmonella typhimurium LT2
ucaaaacccagcccaauacgcca

SEQ ID NO: 1837954 - RNA, 13 nt, Salmonella typhimurium LT2
ucaaaacuggaaa

SEQ ID NO: 1837955 - RNA, 22 nt, Salmonella typhimurium LT2
ucaaaagcguguagcaggagau

SEQ ID NO: 1837956 - RNA, 14 nt, Salmonella typhimurium LT2
ucaaaauaaaauua

SEQ ID NO: 1837957 - RNA, 16 nt, Salmonella typhimurium LT2
ucaaaaggugagaaaa

SEQ ID NO: 1837958 - RNA, 14 nt, Salmonella typhimurium LT2
ucaaaaguaucaac

SEQ ID NO: 1837959 - RNA, 15 nt, Salmonella typhimurium LT2
ucaaaaaaaaccaga

SEQ ID NO: 1837960 - RNA, 14 nt, Salmonella typhimurium LT2
ucaaaaauaaaaaa

SEQ ID NO: 1837961 - RNA, 19 nt, Salmonella typhimurium LT2
ucaaaaagaggaaagcgua

SEQ ID NO: 1837962 - RNA, 22 nt, Salmonella typhimurium LT2
guuucaggacggcauaagccag

SEQ ID NO: 1837963 - RNA, 15 nt, Salmonella typhimurium LT2
guuucaggccagacu

SEQ ID NO: 1837964 - RNA, 20 nt, Salmonella typhimurium LT2
guuucaggucaucggccugc

SEQ ID NO: 1837965 - RNA, 17 nt, Salmonella typhimurium LT2
guuucagcuuccaguua

SEQ ID NO: 1837966 - RNA, 17 nt, Salmonella typhimurium LT2
guuucacguccugguua

SEQ ID NO: 1837967 - RNA, 17 nt, Salmonella typhimurium LT2
guuucagauagagaagg

SEQ ID NO: 1837968 - RNA, 18 nt, Salmonella typhimurium LT2
guuucguuuagcgccugc

SEQ ID NO: 1837969 - RNA, 20 nt, Salmonella typhimurium LT2
guuuccacugaguuucaccg

SEQ ID NO: 1837970 - RNA, 22 nt, Salmonella typhimurium LT2
guuuccacugaguuucaccgcc

SEQ ID NO: 1837971 - RNA, 19 nt, Salmonella typhimurium LT2
guuucaaugcccaggcgcc

SEQ ID NO: 1837972 - RNA, 15 nt, Salmonella typhimurium LT2
guuucaauccaugua

SEQ ID NO: 1837973 - RNA, 17 nt, Salmonella typhimurium LT2
guuucaccuucacaggu

SEQ ID NO: 1837974 - RNA, 22 nt, Salmonella typhimurium LT2
guuucaccuucacaggugguua

SEQ ID NO: 1837975 - RNA, 14 nt, Salmonella typhimurium LT2
guuucaccgccaga

SEQ ID NO: 1837976 - RNA, 17 nt, Salmonella typhimurium LT2
guuucaccgccagagca

SEQ ID NO: 1837977 - RNA, 19 nt, Salmonella typhimurium LT2
guuucaccguuuucgucaa

SEQ ID NO: 1837978 - RNA, 23 nt, Salmonella typhimurium LT2
guuucaacccccucagcaaugau

SEQ ID NO: 1837979 - RNA, 20 nt, Salmonella typhimurium LT2
guuuauugagauaauuuaug

SEQ ID NO: 1837980 - RNA, 14 nt, Salmonella typhimurium LT2
guuuauucuucucc

SEQ ID NO: 1837981 - RNA, 13 nt, Salmonella typhimurium LT2
guuuaagcggaua

SEQ ID NO: 1837982 - RNA, 17 nt, Salmonella typhimurium LT2
guugugcauuccaggug

SEQ ID NO: 1837983 - RNA, 16 nt, Salmonella typhimurium LT2
guugugguuaaacaca

SEQ ID NO: 1837984 - RNA, 20 nt, Salmonella typhimurium LT2
guuuacuccauucccagcuc

SEQ ID NO: 1837985 - RNA, 21 nt, Salmonella typhimurium LT2
guuuacgccgccauccggcac

SEQ ID NO: 1837986 - RNA, 19 nt, Salmonella typhimurium LT2
guuuaauucuuugagcauc

SEQ ID NO: 1837987 - RNA, 19 nt, Salmonella typhimurium LT2
guuuaaugcuuucaauacu

SEQ ID NO: 1837988 - RNA, 22 nt, Salmonella typhimurium LT2
guucugcugauaauacugccgc

SEQ ID NO: 1837989 - RNA, 15 nt, Salmonella typhimurium LT2
guucuggcugcgcuu

SEQ ID NO: 1837990 - RNA, 17 nt, Salmonella typhimurium LT2
guugucggggcuuuaau

SEQ ID NO: 1837991 - RNA, 20 nt, Salmonella typhimurium LT2
guuguccauuuuccucccau

SEQ ID NO: 1837992 - RNA, 13 nt, Salmonella typhimurium LT2
guugucccaggcc

SEQ ID NO: 1837993 - RNA, 14 nt, Salmonella typhimurium LT2
guugucccaggcca

SEQ ID NO: 1837994 - RNA, 18 nt, Salmonella typhimurium LT2
guuugccagcaccagcag

SEQ ID NO: 1837995 - RNA, 23 nt, Salmonella typhimurium LT2
guuugcauaggccccgguggcgg

SEQ ID NO: 1837996 - RNA, 21 nt, Salmonella typhimurium LT2
guuugccgcauacaucgcaga

SEQ ID NO: 1837997 - RNA, 18 nt, Salmonella typhimurium LT2
guuugcugacaaucugcu

SEQ ID NO: 1837998 - RNA, 13 nt, Salmonella typhimurium LT2
guuugcugcacca

SEQ ID NO: 1837999 - RNA, 12 nt, Salmonella typhimurium LT2
guuugcgcgucg

SEQ ID NO: 1838000 - RNA, 18 nt, Salmonella typhimurium LT2
guuugcggauuggauaaa

SEQ ID NO: 1838001 - RNA, 23 nt, Salmonella typhimurium LT2
guuucugccgguucggcaucgcc

SEQ ID NO: 1838002 - RNA, 13 nt, Salmonella typhimurium LT2
guuucuguauuuu

SEQ ID NO: 1838003 - RNA, 14 nt, Salmonella typhimurium LT2
guuucuguauuuuc

SEQ ID NO: 1838004 - RNA, 13 nt, Salmonella typhimurium LT2
guuucuucaucaa

SEQ ID NO: 1838005 - RNA, 16 nt, Salmonella typhimurium LT2
guuucuuguuaacgca

SEQ ID NO: 1838006 - RNA, 14 nt, Salmonella typhimurium LT2
guuucuuucaucag

SEQ ID NO: 1838007 - RNA, 15 nt, Salmonella typhimurium LT2
guuuggcaaucaaau

SEQ ID NO: 1838008 - RNA, 22 nt, Salmonella typhimurium LT2
guuuggcaaggguaugaauaaa

SEQ ID NO: 1838009 - RNA, 23 nt, Salmonella typhimurium LT2
guuuguuguagccaggcgaugaa

SEQ ID NO: 1838010 - RNA, 13 nt, Salmonella typhimurium LT2
guuuuaaaaauaa

SEQ ID NO: 1838011 - RNA, 15 nt, Salmonella typhimurium LT2
guuuguaggccggau

SEQ ID NO: 1838012 - RNA, 17 nt, Salmonella typhimurium LT2
guuuguagaugaacucg

SEQ ID NO: 1838013 - RNA, 14 nt, Salmonella typhimurium LT2
guuugucauccaga

SEQ ID NO: 1838014 - RNA, 22 nt, Salmonella typhimurium LT2
guuuucaggccgcguaauuuuu

SEQ ID NO: 1838015 - RNA, 22 nt, Salmonella typhimurium LT2
guuuucaggaaggagcaaacag

SEQ ID NO: 1838016 - RNA, 17 nt, Salmonella typhimurium LT2
guuuucauuagccgcca

SEQ ID NO: 1838017 - RNA, 19 nt, Salmonella typhimurium LT2
guuuucaaagacgguuuca

SEQ ID NO: 1838018 - RNA, 17 nt, Salmonella typhimurium LT2
guuuuauccccuucagg

SEQ ID NO: 1838019 - RNA, 20 nt, Salmonella typhimurium LT2
uaaaaccuaacgccugcaua

SEQ ID NO: 1838020 - RNA, 18 nt, Salmonella typhimurium LT2
uaaaacauaaagauaaau

SEQ ID NO: 1838021 - RNA, 17 nt, Salmonella typhimurium LT2
uaaaacgauauugccuu

SEQ ID NO: 1838022 - RNA, 21 nt, Salmonella typhimurium LT2
uaaaacuucgauaauaaaaua

SEQ ID NO: 1838023 - RNA, 21 nt, Salmonella typhimurium LT2
uaaaaauauggcgggccugug

SEQ ID NO: 1838024 - RNA, 23 nt, Salmonella typhimurium LT2
uaaaaauaucugaauaaccauuc

SEQ ID NO: 1838025 - RNA, 17 nt, Salmonella typhimurium LT2
uaaaaauccuguuccau

SEQ ID NO: 1838026 - RNA, 17 nt, Salmonella typhimurium LT2
uaaaaguuagccccuua

SEQ ID NO: 1838027 - RNA, 23 nt, Salmonella typhimurium LT2
uaaaaguacaaugcaaagaaaaa

SEQ ID NO: 1838028 - RNA, 18 nt, Salmonella typhimurium LT2
uaaaaguaaauaagaaaa

SEQ ID NO: 1838029 - RNA, 19 nt, Salmonella typhimurium LT2
uaaaaguaaauaagaaaau

SEQ ID NO: 1838030 - RNA, 22 nt, Salmonella typhimurium LT2
uaaaagcccuuaucgccccagc

SEQ ID NO: 1838031 - RNA, 21 nt, Salmonella typhimurium LT2
uaaaagcgauaaagacagguu

SEQ ID NO: 1838032 - RNA, 21 nt, Salmonella typhimurium LT2
uaaaagcaauguaagaauaac

SEQ ID NO: 1838033 - RNA, 14 nt, Salmonella typhimurium LT2
uaaaauaaauuaau

SEQ ID NO: 1838034 - RNA, 21 nt, Salmonella typhimurium LT2
guuuuuuaaugagaaauuuua

SEQ ID NO: 1838035 - RNA, 14 nt, Salmonella typhimurium LT2
guuuuuucguucca

SEQ ID NO: 1838036 - RNA, 20 nt, Salmonella typhimurium LT2
uaaaaaaacaucauaauaau

SEQ ID NO: 1838037 - RNA, 19 nt, Salmonella typhimurium LT2
uaaaaaaauaaaaaaggca

SEQ ID NO: 1838038 - RNA, 12 nt, Salmonella typhimurium LT2
uaaaaaaauaaa

SEQ ID NO: 1838039 - RNA, 18 nt, Salmonella typhimurium LT2
uaaaaaagugauucacuu

SEQ ID NO: 1838040 - RNA, 15 nt, Salmonella typhimurium LT2
uaaaaaagaggaaug

SEQ ID NO: 1838041 - RNA, 17 nt, Salmonella typhimurium LT2
uaaaaaauccugcacuu

SEQ ID NO: 1838042 - RNA, 12 nt, Salmonella typhimurium LT2
uaaaaaaugaga

SEQ ID NO: 1838043 - RNA, 11 nt, Salmonella typhimurium LT2
uaaaaaacagg

SEQ ID NO: 1838044 - RNA, 18 nt, Salmonella typhimurium LT2
uaaaaaacaccugucugu

SEQ ID NO: 1838045 - RNA, 23 nt, Salmonella typhimurium LT2
uaaaaaacaacucuauuaaaaua

SEQ ID NO: 1838046 - RNA, 16 nt, Salmonella typhimurium LT2
uaaaaaacaagauuaa

SEQ ID NO: 1838047 - RNA, 16 nt, Salmonella typhimurium LT2
uaaaaaagccgaccug

SEQ ID NO: 1838048 - RNA, 22 nt, Salmonella typhimurium LT2
guuuugcaggaaaaacuguccc

SEQ ID NO: 1838049 - RNA, 15 nt, Salmonella typhimurium LT2
guuuugcuggaauuu

SEQ ID NO: 1838050 - RNA, 18 nt, Salmonella typhimurium LT2
guuuuggguaaauaccag

SEQ ID NO: 1838051 - RNA, 16 nt, Salmonella typhimurium LT2
guuuucucauccagcu

SEQ ID NO: 1838052 - RNA, 17 nt, Salmonella typhimurium LT2
guuuucucuuuccagcg

SEQ ID NO: 1838053 - RNA, 13 nt, Salmonella typhimurium LT2
guuuuucaucaag

SEQ ID NO: 1838054 - RNA, 19 nt, Salmonella typhimurium LT2
guuuuuaccauauuuaucu

SEQ ID NO: 1838055 - RNA, 16 nt, Salmonella typhimurium LT2
uaacccgauacccuga

SEQ ID NO: 1838056 - RNA, 14 nt, Salmonella typhimurium LT2
uaacccgcagccgg

SEQ ID NO: 1838057 - RNA, 15 nt, Salmonella typhimurium LT2
uaacccuucagcuua

SEQ ID NO: 1838058 - RNA, 20 nt, Salmonella typhimurium LT2
uaacccguccauauucaguu

SEQ ID NO: 1838059 - RNA, 23 nt, Salmonella typhimurium LT2
uaaccauaucaguuaugacagac

SEQ ID NO: 1838060 - RNA, 13 nt, Salmonella typhimurium LT2
uaaccaggccaga

SEQ ID NO: 1838061 - RNA, 19 nt, Salmonella typhimurium LT2
uaaccagguauuaaauaca

SEQ ID NO: 1838062 - RNA, 19 nt, Salmonella typhimurium LT2
uaacauugguuaucaaaaa

SEQ ID NO: 1838063 - RNA, 20 nt, Salmonella typhimurium LT2
uaacauguuuuguauuaauu

SEQ ID NO: 1838064 - RNA, 19 nt, Salmonella typhimurium LT2
uaacagccgcggaccuuuu

SEQ ID NO: 1838065 - RNA, 19 nt, Salmonella typhimurium LT2
uaacagcgcgaccagcgug

SEQ ID NO: 1838066 - RNA, 19 nt, Salmonella typhimurium LT2
uaacagcgcuaucaggaag

SEQ ID NO: 1838067 - RNA, 18 nt, Salmonella typhimurium LT2
uaacaucuuccaugccuu

SEQ ID NO: 1838068 - RNA, 23 nt, Salmonella typhimurium LT2
uaacaccacgaaggaaacgccag

SEQ ID NO: 1838069 - RNA, 16 nt, Salmonella typhimurium LT2
uaacagcauugaggcu

SEQ ID NO: 1838070 - RNA, 23 nt, Salmonella typhimurium LT2
uaacgcgugcucuuuuucgccuu

SEQ ID NO: 1838071 - RNA, 17 nt, Salmonella typhimurium LT2
uaacgcagcaucgccau

SEQ ID NO: 1838072 - RNA, 23 nt, Salmonella typhimurium LT2
uaacgcguccaacuggcuuucau

SEQ ID NO: 1838073 - RNA, 22 nt, Salmonella typhimurium LT2
uaacgcaacggaaggaaauaac

SEQ ID NO: 1838074 - RNA, 22 nt, Salmonella typhimurium LT2
uaacgcacuaccagaaacaaca

SEQ ID NO: 1838075 - RNA, 20 nt, Salmonella typhimurium LT2
uaacgauacccaccagcgug

SEQ ID NO: 1838076 - RNA, 16 nt, Salmonella typhimurium LT2
uaacgaaauguuuucu

SEQ ID NO: 1838077 - RNA, 17 nt, Salmonella typhimurium LT2
uaaccguggcggcagug

SEQ ID NO: 1838078 - RNA, 18 nt, Salmonella typhimurium LT2
uaaccguaacgcuccugg

SEQ ID NO: 1838079 - RNA, 17 nt, Salmonella typhimurium LT2
uaaccguagauuuucau

SEQ ID NO: 1838080 - RNA, 14 nt, Salmonella typhimurium LT2
uaaccuauuuugca

SEQ ID NO: 1838081 - RNA, 19 nt, Salmonella typhimurium LT2
uaaccgauaacgcggcccg

SEQ ID NO: 1838082 - RNA, 13 nt, Salmonella typhimurium LT2
uaacccuccugcc

SEQ ID NO: 1838083 - RNA, 22 nt, Salmonella typhimurium LT2
uaaccgaugugcguauucagcg

SEQ ID NO: 1838084 - RNA, 15 nt, Salmonella typhimurium LT2
uaaccgcccgcggcg

SEQ ID NO: 1838085 - RNA, 12 nt, Salmonella typhimurium LT2
uaaauugguuau

SEQ ID NO: 1838086 - RNA, 15 nt, Salmonella typhimurium LT2
uaaauugaguggaca

SEQ ID NO: 1838087 - RNA, 14 nt, Salmonella typhimurium LT2
uaaauuacuuauga

SEQ ID NO: 1838088 - RNA, 14 nt, Salmonella typhimurium LT2
uaaauucauauuua

SEQ ID NO: 1838089 - RNA, 21 nt, Salmonella typhimurium LT2
uaaauuauuuaagcucuucuu

SEQ ID NO: 1838090 - RNA, 21 nt, Salmonella typhimurium LT2
uaacaaugucgaaacaacaca

SEQ ID NO: 1838091 - RNA, 22 nt, Salmonella typhimurium LT2
uaacaaaaugagauugauaauc

SEQ ID NO: 1838092 - RNA, 20 nt, Salmonella typhimurium LT2
uaacaaaccgguaaucccuu

SEQ ID NO: 1838093 - RNA, 17 nt, Salmonella typhimurium LT2
uaacacacuuucugcuu

SEQ ID NO: 1838094 - RNA, 15 nt, Salmonella typhimurium LT2
uaacacaaaaucccu

SEQ ID NO: 1838095 - RNA, 21 nt, Salmonella typhimurium LT2
uaacacaauacuucaaaugau

SEQ ID NO: 1838096 - RNA, 21 nt, Salmonella typhimurium LT2
uaaauuuccucuugucaggca

SEQ ID NO: 1838097 - RNA, 14 nt, Salmonella typhimurium LT2
uaaauuuacucagu

SEQ ID NO: 1838098 - RNA, 13 nt, Salmonella typhimurium LT2
uaaauuuacucag

SEQ ID NO: 1838099 - RNA, 17 nt, Salmonella typhimurium LT2
uaaauuuucgcucaaca

SEQ ID NO: 1838100 - RNA, 21 nt, Salmonella typhimurium LT2
uaaauuuucauuauaaaacuu

SEQ ID NO: 1838101 - RNA, 11 nt, Salmonella typhimurium LT2
uaaauuuucau

SEQ ID NO: 1838102 - RNA, 15 nt, Salmonella typhimurium LT2
uaaacgaucuguuau

SEQ ID NO: 1838103 - RNA, 15 nt, Salmonella typhimurium LT2
uaaacguuauucauu

SEQ ID NO: 1838104 - RNA, 19 nt, Salmonella typhimurium LT2
uaaacuaaguaaggaggaa

SEQ ID NO: 1838105 - RNA, 15 nt, Salmonella typhimurium LT2
uaaacgugccacagu

SEQ ID NO: 1838106 - RNA, 10 nt, Salmonella typhimurium LT2
uaaaaugacc

SEQ ID NO: 1838107 - RNA, 15 nt, Salmonella typhimurium LT2
uaaaccgccagauga

SEQ ID NO: 1838108 - RNA, 18 nt, Salmonella typhimurium LT2
uaaaccgccguuuugauu

SEQ ID NO: 1838109 - RNA, 18 nt, Salmonella typhimurium LT2
uaaaccgcgauaaaccug

SEQ ID NO: 1838110 - RNA, 23 nt, Salmonella typhimurium LT2
uaaaccaccauacccaacagcag

SEQ ID NO: 1838111 - RNA, 19 nt, Salmonella typhimurium LT2
uaaagcccgguucaccguu

SEQ ID NO: 1838112 - RNA, 18 nt, Salmonella typhimurium LT2
uaaagcagaccaccccac

SEQ ID NO: 1838113 - RNA, 22 nt, Salmonella typhimurium LT2
uaaagcagaccaccccacagca

SEQ ID NO: 1838114 - RNA, 13 nt, Salmonella typhimurium LT2
uaaagcagugcag

SEQ ID NO: 1838115 - RNA, 21 nt, Salmonella typhimurium LT2
uaaagcgcgggccugccuguu

SEQ ID NO: 1838116 - RNA, 22 nt, Salmonella typhimurium LT2
uaaagcgcgggccugccuguuu

SEQ ID NO: 1838117 - RNA, 14 nt, Salmonella typhimurium LT2
uaaaggucaucaca

SEQ ID NO: 1838118 - RNA, 23 nt, Salmonella typhimurium LT2
uaaagcgaauuguuugaaaagga

SEQ ID NO: 1838119 - RNA, 13 nt, Salmonella typhimurium LT2
uaaagccuucaug

SEQ ID NO: 1838120 - RNA, 18 nt, Salmonella typhimurium LT2
uaaagccuucaugcuucu

SEQ ID NO: 1838121 - RNA, 21 nt, Salmonella typhimurium LT2
uaaagccgguuucauuggcua

SEQ ID NO: 1838122 - RNA, 20 nt, Salmonella typhimurium LT2
uaaagccucucguaagagag

SEQ ID NO: 1838123 - RNA, 22 nt, Salmonella typhimurium LT2
uaaacuucacgucacucacauu

SEQ ID NO: 1838124 - RNA, 15 nt, Salmonella typhimurium LT2
uaaagaccggcacaa

SEQ ID NO: 1838125 - RNA, 15 nt, Salmonella typhimurium LT2
uaaagacacagauuc

SEQ ID NO: 1838126 - RNA, 18 nt, Salmonella typhimurium LT2
uaaagaaugaaaaaaaau

SEQ ID NO: 1838127 - RNA, 23 nt, Salmonella typhimurium LT2
uaaaggugagagacugaaaauaa

SEQ ID NO: 1838128 - RNA, 14 nt, Salmonella typhimurium LT2
uaaauaaaaaccau

SEQ ID NO: 1838129 - RNA, 16 nt, Salmonella typhimurium LT2
uaaauaaaaaccauuu

SEQ ID NO: 1838130 - RNA, 14 nt, Salmonella typhimurium LT2
uaaauagccagcau

SEQ ID NO: 1838131 - RNA, 16 nt, Salmonella typhimurium LT2
uaaauagagaaaucaa

SEQ ID NO: 1838132 - RNA, 11 nt, Salmonella typhimurium LT2
uaaauaaaugc

SEQ ID NO: 1838133 - RNA, 19 nt, Salmonella typhimurium LT2
uaaaugcgcgcggcugccg

SEQ ID NO: 1838134 - RNA, 18 nt, Salmonella typhimurium LT2
uaaauaucgcguuaauuu

SEQ ID NO: 1838135 - RNA, 23 nt, Salmonella typhimurium LT2
uaaauaucgcguuaauuuuuagc

SEQ ID NO: 1838136 - RNA, 13 nt, Salmonella typhimurium LT2
uaaaucugaaaua

SEQ ID NO: 1838137 - RNA, 20 nt, Salmonella typhimurium LT2
gucugcccggcaaccugagc

SEQ ID NO: 1838138 - RNA, 18 nt, Salmonella typhimurium LT2
gucugcgucuucuuccac

SEQ ID NO: 1838139 - RNA, 14 nt, Salmonella typhimurium LT2
gucugcguugaaua

SEQ ID NO: 1838140 - RNA, 13 nt, Salmonella typhimurium LT2
gucugaccgccgc

SEQ ID NO: 1838141 - RNA, 13 nt, Salmonella typhimurium LT2
gucugaccgggcg

SEQ ID NO: 1838142 - RNA, 16 nt, Salmonella typhimurium LT2
gucugcaugccgcagg

SEQ ID NO: 1838143 - RNA, 22 nt, Salmonella typhimurium LT2
gucugauaagcgcagcgccauc

SEQ ID NO: 1838144 - RNA, 19 nt, Salmonella typhimurium LT2
gucucucgugcaggccgga

SEQ ID NO: 1838145 - RNA, 12 nt, Salmonella typhimurium LT2
gucucucccuca

SEQ ID NO: 1838146 - RNA, 13 nt, Salmonella typhimurium LT2
gucucucccucaa

SEQ ID NO: 1838147 - RNA, 20 nt, Salmonella typhimurium LT2
gucucuucaugcauaaccgc

SEQ ID NO: 1838148 - RNA, 18 nt, Salmonella typhimurium LT2
gucugaagaaguucuucu

SEQ ID NO: 1838149 - RNA, 14 nt, Salmonella typhimurium LT2
gucugaaagcgacu

SEQ ID NO: 1838150 - RNA, 17 nt, Salmonella typhimurium LT2
gucuccuguaacagggg

SEQ ID NO: 1838151 - RNA, 14 nt, Salmonella typhimurium LT2
gucucggccuggcc

SEQ ID NO: 1838152 - RNA, 23 nt, Salmonella typhimurium LT2
gucucgccgcggugauccuccug

SEQ ID NO: 1838153 - RNA, 13 nt, Salmonella typhimurium LT2
gucuggggaacaa

SEQ ID NO: 1838154 - RNA, 11 nt, Salmonella typhimurium LT2
gucuggucagc

SEQ ID NO: 1838155 - RNA, 19 nt, Salmonella typhimurium LT2
gucuggucagguaagcccu

SEQ ID NO: 1838156 - RNA, 19 nt, Salmonella typhimurium LT2
gucugguacggccaccagg

SEQ ID NO: 1838157 - RNA, 20 nt, Salmonella typhimurium LT2
gucugguacggccaccaggc

SEQ ID NO: 1838158 - RNA, 14 nt, Salmonella typhimurium LT2
gucugguaaacgca

SEQ ID NO: 1838159 - RNA, 20 nt, Salmonella typhimurium LT2
gucuggcagcggcaguaaau

SEQ ID NO: 1838160 - RNA, 16 nt, Salmonella typhimurium LT2
gucuggagccucugcg

SEQ ID NO: 1838161 - RNA, 15 nt, Salmonella typhimurium LT2
gucuggcgaggcgcc

SEQ ID NO: 1838162 - RNA, 23 nt, Salmonella typhimurium LT2
gucuucacucugggauuugcgaa

SEQ ID NO: 1838163 - RNA, 14 nt, Salmonella typhimurium LT2
gucuucaucccagu

SEQ ID NO: 1838164 - RNA, 11 nt, Salmonella typhimurium LT2
gucuuccagca

SEQ ID NO: 1838165 - RNA, 14 nt, Salmonella typhimurium LT2
gucuguuucaacac

SEQ ID NO: 1838166 - RNA, 21 nt, Salmonella typhimurium LT2
gucuguuucaacacauccagc

SEQ ID NO: 1838167 - RNA, 21 nt, Salmonella typhimurium LT2
gucuguucguagcccauagca

SEQ ID NO: 1838168 - RNA, 22 nt, Salmonella typhimurium LT2
gucuguuuuucguuccuucagc

SEQ ID NO: 1838169 - RNA, 16 nt, Salmonella typhimurium LT2
gucuuaacccauggcu

SEQ ID NO: 1838170 - RNA, 13 nt, Salmonella typhimurium LT2
gucuuaaauauga

SEQ ID NO: 1838171 - RNA, 13 nt, Salmonella typhimurium LT2
gucuuagugaaau

SEQ ID NO: 1838172 - RNA, 14 nt, Salmonella typhimurium LT2
gucuugucaggcuc

SEQ ID NO: 1838173 - RNA, 23 nt, Salmonella typhimurium LT2
gucuucuucuucgcgcauuucug

SEQ ID NO: 1838174 - RNA, 14 nt, Salmonella typhimurium LT2
gucuucgaugccau

SEQ ID NO: 1838175 - RNA, 16 nt, Salmonella typhimurium LT2
gucuucgaccgccaua

SEQ ID NO: 1838176 - RNA, 21 nt, Salmonella typhimurium LT2
gucuuuugaauaguaacuggc

SEQ ID NO: 1838177 - RNA, 17 nt, Salmonella typhimurium LT2
gugaaaccggcgcgccu

SEQ ID NO: 1838178 - RNA, 14 nt, Salmonella typhimurium LT2
gugaaacuguuuua

SEQ ID NO: 1838179 - RNA, 18 nt, Salmonella typhimurium LT2
gucuuuauucaucaucuu

SEQ ID NO: 1838180 - RNA, 12 nt, Salmonella typhimurium LT2
gucuuuuauccc

SEQ ID NO: 1838181 - RNA, 15 nt, Salmonella typhimurium LT2
gucuuuauccgccag

SEQ ID NO: 1838182 - RNA, 16 nt, Salmonella typhimurium LT2
gugaaccaaagcaaaa

SEQ ID NO: 1838183 - RNA, 18 nt, Salmonella typhimurium LT2
gugaaccaaagcaaaaaa

SEQ ID NO: 1838184 - RNA, 20 nt, Salmonella typhimurium LT2
gugaacauggguuucuugcu

SEQ ID NO: 1838185 - RNA, 16 nt, Salmonella typhimurium LT2
gugaaccgucgccucc

SEQ ID NO: 1838186 - RNA, 19 nt, Salmonella typhimurium LT2
gugaagaucagcagagcgg

SEQ ID NO: 1838187 - RNA, 21 nt, Salmonella typhimurium LT2
gugaagaugguaauauuaaaa

SEQ ID NO: 1838188 - RNA, 16 nt, Salmonella typhimurium LT2
gugaaagugauuucau

SEQ ID NO: 1838189 - RNA, 17 nt, Salmonella typhimurium LT2
gugaaaaccuaaauaaa

SEQ ID NO: 1838190 - RNA, 19 nt, Salmonella typhimurium LT2
gugaaaguaaguuuauggu

SEQ ID NO: 1838191 - RNA, 22 nt, Salmonella typhimurium LT2
gugaacaucacgcccuccuguu

SEQ ID NO: 1838192 - RNA, 21 nt, Salmonella typhimurium LT2
gugaaauuuccuccgccgaua

SEQ ID NO: 1838193 - RNA, 21 nt, Salmonella typhimurium LT2
gugaacacacccuucucaggg

SEQ ID NO: 1838194 - RNA, 20 nt, Salmonella typhimurium LT2
gugaauuaugaccaauguua

SEQ ID NO: 1838195 - RNA, 14 nt, Salmonella typhimurium LT2
gugaauguccugcg

SEQ ID NO: 1838196 - RNA, 19 nt, Salmonella typhimurium LT2
gugaaugcgcggcugcgga

SEQ ID NO: 1838197 - RNA, 22 nt, Salmonella typhimurium LT2
gugaauauuugcgcuaguuucu

SEQ ID NO: 1838198 - RNA, 19 nt, Salmonella typhimurium LT2
gugaaucgacggcaauauu

SEQ ID NO: 1838199 - RNA, 16 nt, Salmonella typhimurium LT2
gugaauaccaaagccc

SEQ ID NO: 1838200 - RNA, 13 nt, Salmonella typhimurium LT2
gugaauaaauccu

SEQ ID NO: 1838201 - RNA, 20 nt, Salmonella typhimurium LT2
gugaagcgacgaauaauccu

SEQ ID NO: 1838202 - RNA, 17 nt, Salmonella typhimurium LT2
gugaaggcaaaacacca

SEQ ID NO: 1838203 - RNA, 12 nt, Salmonella typhimurium LT2
gugaaggcaaaa

SEQ ID NO: 1838204 - RNA, 21 nt, Salmonella typhimurium LT2
gugaggcagauacgcgggcuc

SEQ ID NO: 1838205 - RNA, 21 nt, Salmonella typhimurium LT2
gugagggcaaaguuccagguu

SEQ ID NO: 1838206 - RNA, 14 nt, Salmonella typhimurium LT2
gugaguaaauaaaa

SEQ ID NO: 1838207 - RNA, 15 nt, Salmonella typhimurium LT2
gugagcccuccucca

SEQ ID NO: 1838208 - RNA, 22 nt, Salmonella typhimurium LT2
gugacugauaaaagcccuuauc

SEQ ID NO: 1838209 - RNA, 16 nt, Salmonella typhimurium LT2
gugauacuggcggcga

SEQ ID NO: 1838210 - RNA, 22 nt, Salmonella typhimurium LT2
gugauacuguagggguuccaag

SEQ ID NO: 1838211 - RNA, 17 nt, Salmonella typhimurium LT2
gugauccaccaccagca

SEQ ID NO: 1838212 - RNA, 23 nt, Salmonella typhimurium LT2
gugaucgaggcgcuggcgagcga

SEQ ID NO: 1838213 - RNA, 13 nt, Salmonella typhimurium LT2
gugauccuccugc

SEQ ID NO: 1838214 - RNA, 13 nt, Salmonella typhimurium LT2
gugagaaaaguaa

SEQ ID NO: 1838215 - RNA, 18 nt, Salmonella typhimurium LT2
gugacuaauagccaaaag

SEQ ID NO: 1838216 - RNA, 17 nt, Salmonella typhimurium LT2
gugacuaauagccaaaa

SEQ ID NO: 1838217 - RNA, 14 nt, Salmonella typhimurium LT2
gugacucauuucaa

SEQ ID NO: 1838218 - RNA, 15 nt, Salmonella typhimurium LT2
gugacucauuucaac

SEQ ID NO: 1838219 - RNA, 13 nt, Salmonella typhimurium LT2
gugacuucgcagc

SEQ ID NO: 1838220 - RNA, 19 nt, Salmonella typhimurium LT2
gugacgccgccauccggua

SEQ ID NO: 1838221 - RNA, 23 nt, Salmonella typhimurium LT2
gugacgucaagaucgcgcagcag

SEQ ID NO: 1838222 - RNA, 12 nt, Salmonella typhimurium LT2
gugaccugcuga

SEQ ID NO: 1838223 - RNA, 14 nt, Salmonella typhimurium LT2
gugaccgauaaaaa

SEQ ID NO: 1838224 - RNA, 14 nt, Salmonella typhimurium LT2
gugacacacuugau

SEQ ID NO: 1838225 - RNA, 15 nt, Salmonella typhimurium LT2
gugacagcaacaucu

SEQ ID NO: 1838226 - RNA, 14 nt, Salmonella typhimurium LT2
gugccugccgccuc

SEQ ID NO: 1838227 - RNA, 19 nt, Salmonella typhimurium LT2
gugccugacagcaaugagc

SEQ ID NO: 1838228 - RNA, 15 nt, Salmonella typhimurium LT2
gugccugacagcaau

SEQ ID NO: 1838229 - RNA, 14 nt, Salmonella typhimurium LT2
gugccugccgcaga

SEQ ID NO: 1838230 - RNA, 19 nt, Salmonella typhimurium LT2
gugccgguaaagggcggga

SEQ ID NO: 1838231 - RNA, 12 nt, Salmonella typhimurium LT2
gugccgguggga

SEQ ID NO: 1838232 - RNA, 11 nt, Salmonella typhimurium LT2
gugcauggugu

SEQ ID NO: 1838233 - RNA, 19 nt, Salmonella typhimurium LT2
gugccaguaacucaucgcc

SEQ ID NO: 1838234 - RNA, 20 nt, Salmonella typhimurium LT2
gugccaguaacucaucgcca

SEQ ID NO: 1838235 - RNA, 12 nt, Salmonella typhimurium LT2
gugccaguaauc

SEQ ID NO: 1838236 - RNA, 19 nt, Salmonella typhimurium LT2
gugccggaaagacggcagc

SEQ ID NO: 1838237 - RNA, 14 nt, Salmonella typhimurium LT2
gugccgcuugccag

SEQ ID NO: 1838238 - RNA, 14 nt, Salmonella typhimurium LT2
gugccgauaucaau

SEQ ID NO: 1838239 - RNA, 15 nt, Salmonella typhimurium LT2
gugcaggagcaguga

SEQ ID NO: 1838240 - RNA, 19 nt, Salmonella typhimurium LT2
gugcaguauugcaccagga

SEQ ID NO: 1838241 - RNA, 20 nt, Salmonella typhimurium LT2
gugcaucaggaaauccugga

SEQ ID NO: 1838242 - RNA, 17 nt, Salmonella typhimurium LT2
gugcagugacagaggaa

SEQ ID NO: 1838243 - RNA, 22 nt, Salmonella typhimurium LT2
gugcauaaagauugguaucugc

SEQ ID NO: 1838244 - RNA, 13 nt, Salmonella typhimurium LT2
gugcauaaagcgg

SEQ ID NO: 1838245 - RNA, 13 nt, Salmonella typhimurium LT2
gugaucuccucgc

SEQ ID NO: 1838246 - RNA, 14 nt, Salmonella typhimurium LT2
gugcagcgugccgg

SEQ ID NO: 1838247 - RNA, 18 nt, Salmonella typhimurium LT2
guuauuugccucuggcca

SEQ ID NO: 1838248 - RNA, 20 nt, Salmonella typhimurium LT2
guucaaccugcgcugacggc

SEQ ID NO: 1838249 - RNA, 18 nt, Salmonella typhimurium LT2
guucaacgaagaaaagcc

SEQ ID NO: 1838250 - RNA, 21 nt, Salmonella typhimurium LT2
guuaugccuuuuucaacagca

SEQ ID NO: 1838251 - RNA, 22 nt, Salmonella typhimurium LT2
guuaugccuuuuucaacagcac

SEQ ID NO: 1838252 - RNA, 12 nt, Salmonella typhimurium LT2
guuaugcaucug

SEQ ID NO: 1838253 - RNA, 15 nt, Salmonella typhimurium LT2
guuaucugaccuaca

SEQ ID NO: 1838254 - RNA, 17 nt, Salmonella typhimurium LT2
guuaucguagugccaca

SEQ ID NO: 1838255 - RNA, 14 nt, Salmonella typhimurium LT2
guuaucuuauaaau

SEQ ID NO: 1838256 - RNA, 16 nt, Salmonella typhimurium LT2
guuaucuuauaaauaa

SEQ ID NO: 1838257 - RNA, 16 nt, Salmonella typhimurium LT2
guuauucggucagaua

SEQ ID NO: 1838258 - RNA, 14 nt, Salmonella typhimurium LT2
guuauucgaugcgg

SEQ ID NO: 1838259 - RNA, 14 nt, Salmonella typhimurium LT2
guuauucgcuggcc

SEQ ID NO: 1838260 - RNA, 15 nt, Salmonella typhimurium LT2
guuauucagcaggag

SEQ ID NO: 1838261 - RNA, 21 nt, Salmonella typhimurium LT2
guuauugucaugcuaaaacag

SEQ ID NO: 1838262 - RNA, 22 nt, Salmonella typhimurium LT2
guuauugugguguuccauugcu

SEQ ID NO: 1838263 - RNA, 15 nt, Salmonella typhimurium LT2
guuauuaagcagacu

SEQ ID NO: 1838264 - RNA, 13 nt, Salmonella typhimurium LT2
guuauccagcagc

SEQ ID NO: 1838265 - RNA, 14 nt, Salmonella typhimurium LT2
guuauccagcagcc

SEQ ID NO: 1838266 - RNA, 19 nt, Salmonella typhimurium LT2
guuauccagcagccacaga

SEQ ID NO: 1838267 - RNA, 19 nt, Salmonella typhimurium LT2
guuauccagcagccaggua

SEQ ID NO: 1838268 - RNA, 18 nt, Salmonella typhimurium LT2
guuauaaauccccgccgc

SEQ ID NO: 1838269 - RNA, 23 nt, Salmonella typhimurium LT2
guuauagcggggacuguggaaga

SEQ ID NO: 1838270 - RNA, 23 nt, Salmonella typhimurium LT2
guuacccaugagcgaaacuccag

SEQ ID NO: 1838271 - RNA, 14 nt, Salmonella typhimurium LT2
guuaauuaaauguu

SEQ ID NO: 1838272 - RNA, 16 nt, Salmonella typhimurium LT2
guuagcauuauuuuua

SEQ ID NO: 1838273 - RNA, 21 nt, Salmonella typhimurium LT2
guuaccgccggcuucgucuuu

SEQ ID NO: 1838274 - RNA, 14 nt, Salmonella typhimurium LT2
guuacccgccaguc

SEQ ID NO: 1838275 - RNA, 23 nt, Salmonella typhimurium LT2
guuaccccuuuuucaauuuccag

SEQ ID NO: 1838276 - RNA, 16 nt, Salmonella typhimurium LT2
guuagcgcccauaaug

SEQ ID NO: 1838277 - RNA, 19 nt, Salmonella typhimurium LT2
guuagcgcucuucgcucca

SEQ ID NO: 1838278 - RNA, 16 nt, Salmonella typhimurium LT2
guuccgacaauaaaaa

SEQ ID NO: 1838279 - RNA, 18 nt, Salmonella typhimurium LT2
guuccauuccagaacgaa

SEQ ID NO: 1838280 - RNA, 14 nt, Salmonella typhimurium LT2
guuccgaaauaaau

SEQ ID NO: 1838281 - RNA, 16 nt, Salmonella typhimurium LT2
guuccagccgccaggc

SEQ ID NO: 1838282 - RNA, 17 nt, Salmonella typhimurium LT2
guuccagaggcauuauu

SEQ ID NO: 1838283 - RNA, 12 nt, Salmonella typhimurium LT2
guuccagcagcu

SEQ ID NO: 1838284 - RNA, 22 nt, Salmonella typhimurium LT2
guuccaggcgaaccauaauaaa

SEQ ID NO: 1838285 - RNA, 16 nt, Salmonella typhimurium LT2
guuccaguaaggucca

SEQ ID NO: 1838286 - RNA, 14 nt, Salmonella typhimurium LT2
guucauccagcgcg

SEQ ID NO: 1838287 - RNA, 17 nt, Salmonella typhimurium LT2
guucaucauccugcagg

SEQ ID NO: 1838288 - RNA, 17 nt, Salmonella typhimurium LT2
guucaucauuuucccac

SEQ ID NO: 1838289 - RNA, 21 nt, Salmonella typhimurium LT2
guucaucaggccugcaaaccu

SEQ ID NO: 1838290 - RNA, 16 nt, Salmonella typhimurium LT2
guucauccugcgccau

SEQ ID NO: 1838291 - RNA, 23 nt, Salmonella typhimurium LT2
guucaugcgaucgggcaauccau

SEQ ID NO: 1838292 - RNA, 21 nt, Salmonella typhimurium LT2
guucaccaccacccagugcca

SEQ ID NO: 1838293 - RNA, 22 nt, Salmonella typhimurium LT2
guucaccaccacccagugccac

SEQ ID NO: 1838294 - RNA, 21 nt, Salmonella typhimurium LT2
guucaccguuuaaaaacauca

SEQ ID NO: 1838295 - RNA, 22 nt, Salmonella typhimurium LT2
guucaucaggcaauaaacauca

SEQ ID NO: 1838296 - RNA, 19 nt, Salmonella typhimurium LT2
guucaucaggccugcaaac

SEQ ID NO: 1838297 - RNA, 14 nt, Salmonella typhimurium LT2
guucucuccaguuc

SEQ ID NO: 1838298 - RNA, 19 nt, Salmonella typhimurium LT2
guucugauacucguagcca

SEQ ID NO: 1838299 - RNA, 20 nt, Salmonella typhimurium LT2
guucugcgccauuuccagcc

SEQ ID NO: 1838300 - RNA, 18 nt, Salmonella typhimurium LT2
guucucccaccgcgcaca

SEQ ID NO: 1838301 - RNA, 20 nt, Salmonella typhimurium LT2
guucuccgucaacaccugca

SEQ ID NO: 1838302 - RNA, 18 nt, Salmonella typhimurium LT2
guucgguaucgcgccagg

SEQ ID NO: 1838303 - RNA, 17 nt, Salmonella typhimurium LT2
guucggguaaacgcugc

SEQ ID NO: 1838304 - RNA, 20 nt, Salmonella typhimurium LT2
guucgaauccagguacccca

SEQ ID NO: 1838305 - RNA, 24 nt, Salmonella typhimurium LT2
guucgaaucccgucguagccacca

SEQ ID NO: 1838306 - RNA, 15 nt, Salmonella typhimurium LT2
guucgaauccuuccc

SEQ ID NO: 1838307 - RNA, 11 nt, Salmonella typhimurium LT2
guguauuuuuu

SEQ ID NO: 1838308 - RNA, 16 nt, Salmonella typhimurium LT2
gugucagauccuucau

SEQ ID NO: 1838309 - RNA, 21 nt, Salmonella typhimurium LT2
gugucacucaucggccaccac

SEQ ID NO: 1838310 - RNA, 19 nt, Salmonella typhimurium LT2
gugucaucauuacaggcga

SEQ ID NO: 1838311 - RNA, 22 nt, Salmonella typhimurium LT2
guguccaugcaugacgcaggcg

SEQ ID NO: 1838312 - RNA, 19 nt, Salmonella typhimurium LT2
gugucauaacgaccaaaca

SEQ ID NO: 1838313 - RNA, 18 nt, Salmonella typhimurium LT2
guguaucgcccugccagc

SEQ ID NO: 1838314 - RNA, 15 nt, Salmonella typhimurium LT2
guguagccauaaucu

SEQ ID NO: 1838315 - RNA, 14 nt, Salmonella typhimurium LT2
guguccucugcugc

SEQ ID NO: 1838316 - RNA, 22 nt, Salmonella typhimurium LT2
guguccugaauuguccccaucu

SEQ ID NO: 1838317 - RNA, 18 nt, Salmonella typhimurium LT2
gugucgaaccccggucgg

SEQ ID NO: 1838318 - RNA, 15 nt, Salmonella typhimurium LT2
gugucgggccaggcu

SEQ ID NO: 1838319 - RNA, 20 nt, Salmonella typhimurium LT2
gugucgccggggcgcuggcg

SEQ ID NO: 1838320 - RNA, 15 nt, Salmonella typhimurium LT2
gugucgccauaaauc

SEQ ID NO: 1838321 - RNA, 21 nt, Salmonella typhimurium LT2
guguuaccgccaccuuucugc

SEQ ID NO: 1838322 - RNA, 15 nt, Salmonella typhimurium LT2
guuaaaaccggcugc

SEQ ID NO: 1838323 - RNA, 20 nt, Salmonella typhimurium LT2
guuaaaagguuauuguguua

SEQ ID NO: 1838324 - RNA, 15 nt, Salmonella typhimurium LT2
guuaacagaaugcug

SEQ ID NO: 1838325 - RNA, 17 nt, Salmonella typhimurium LT2
guuaacaauauugcgcu

SEQ ID NO: 1838326 - RNA, 22 nt, Salmonella typhimurium LT2
guuaacgacccaucaauaacga

SEQ ID NO: 1838327 - RNA, 13 nt, Salmonella typhimurium LT2
guuaacugcugcu

SEQ ID NO: 1838328 - RNA, 21 nt, Salmonella typhimurium LT2
guuaacuggauauuccaguua

SEQ ID NO: 1838329 - RNA, 21 nt, Salmonella typhimurium LT2
guuaacucuuuugcagcaaau

SEQ ID NO: 1838330 - RNA, 16 nt, Salmonella typhimurium LT2
guuaaucacuaccugc

SEQ ID NO: 1838331 - RNA, 16 nt, Salmonella typhimurium LT2
guuaaucagcgcuguc

SEQ ID NO: 1838332 - RNA, 21 nt, Salmonella typhimurium LT2
guuaagcgcccgcgcgccagc

SEQ ID NO: 1838333 - RNA, 14 nt, Salmonella typhimurium LT2
guuaagcauuucgc

SEQ ID NO: 1838334 - RNA, 16 nt, Salmonella typhimurium LT2
guuaagaagucuguga

SEQ ID NO: 1838335 - RNA, 22 nt, Salmonella typhimurium LT2
guuaauggccugaugacgcugc

SEQ ID NO: 1838336 - RNA, 20 nt, Salmonella typhimurium LT2
guuaaugauuccgucucaga

SEQ ID NO: 1838337 - RNA, 22 nt, Salmonella typhimurium LT2
guggagaggccaccagcgccag

SEQ ID NO: 1838338 - RNA, 15 nt, Salmonella typhimurium LT2
guggagacagaacag

SEQ ID NO: 1838339 - RNA, 22 nt, Salmonella typhimurium LT2
guggacaucgccauuccaagaa

SEQ ID NO: 1838340 - RNA, 12 nt, Salmonella typhimurium LT2
guggcagggcag

SEQ ID NO: 1838341 - RNA, 17 nt, Salmonella typhimurium LT2
guggaaacuccagcggc

SEQ ID NO: 1838342 - RNA, 14 nt, Salmonella typhimurium LT2
guggaaaacagcau

SEQ ID NO: 1838343 - RNA, 14 nt, Salmonella typhimurium LT2
gugcgcaagaaaag

SEQ ID NO: 1838344 - RNA, 22 nt, Salmonella typhimurium LT2
gugcgccagccuuaucccaucc

SEQ ID NO: 1838345 - RNA, 14 nt, Salmonella typhimurium LT2
gugcgccagcgcau

SEQ ID NO: 1838346 - RNA, 18 nt, Salmonella typhimurium LT2
gugcgcagccccagcgcc

SEQ ID NO: 1838347 - RNA, 19 nt, Salmonella typhimurium LT2
gugcgcagccccagcgcca

SEQ ID NO: 1838348 - RNA, 20 nt, Salmonella typhimurium LT2
gugggaucgacucauccagc

SEQ ID NO: 1838349 - RNA, 22 nt, Salmonella typhimurium LT2
guggucgacauauucaugguuc

SEQ ID NO: 1838350 - RNA, 22 nt, Salmonella typhimurium LT2
guggcaugaaaauaugaugcua

SEQ ID NO: 1838351 - RNA, 22 nt, Salmonella typhimurium LT2
guaaucacgucauuaaagcgcu

SEQ ID NO: 1838352 - RNA, 14 nt, Salmonella typhimurium LT2
guaauccagcuuca

SEQ ID NO: 1838353 - RNA, 22 nt, Salmonella typhimurium LT2
guaauacgcgucugucgaaacu

SEQ ID NO: 1838354 - RNA, 13 nt, Salmonella typhimurium LT2
guaauaauuuaaa

SEQ ID NO: 1838355 - RNA, 22 nt, Salmonella typhimurium LT2
guaaaacgccaagaaugaaaca

SEQ ID NO: 1838356 - RNA, 21 nt, Salmonella typhimurium LT2
guaauaaggcggguugcugau

SEQ ID NO: 1838357 - RNA, 22 nt, Salmonella typhimurium LT2
guaauucucacagaaucaucag

SEQ ID NO: 1838358 - RNA, 14 nt, Salmonella typhimurium LT2
guaauucucccaaa

SEQ ID NO: 1838359 - RNA, 19 nt, Salmonella typhimurium LT2
guaauugaggauugccgcc

SEQ ID NO: 1838360 - RNA, 16 nt, Salmonella typhimurium LT2
guaauucucacagaau

SEQ ID NO: 1838361 - RNA, 16 nt, Salmonella typhimurium LT2
guaaucuuuucauauu

SEQ ID NO: 1838362 - RNA, 23 nt, Salmonella typhimurium LT2
guacaaugcaaagaaaaacagga

SEQ ID NO: 1838363 - RNA, 18 nt, Salmonella typhimurium LT2
guacaagggccgccgcca

SEQ ID NO: 1838364 - RNA, 18 nt, Salmonella typhimurium LT2
guacacaauugccauggu

SEQ ID NO: 1838365 - RNA, 15 nt, Salmonella typhimurium LT2
guacaaacaaauaaa

SEQ ID NO: 1838366 - RNA, 13 nt, Salmonella typhimurium LT2
guacaaacaaaua

SEQ ID NO: 1838367 - RNA, 22 nt, Salmonella typhimurium LT2
guacaaacacgucuuugcugcc

SEQ ID NO: 1838368 - RNA, 19 nt, Salmonella typhimurium LT2
guaauuuugauauaaccgu

SEQ ID NO: 1838369 - RNA, 15 nt, Salmonella typhimurium LT2
guaauuucuugcgcc

SEQ ID NO: 1838370 - RNA, 10 nt, Salmonella typhimurium LT2
guaauuugcg

SEQ ID NO: 1838371 - RNA, 14 nt, Salmonella typhimurium LT2
guaauuuaaaccgc

SEQ ID NO: 1838372 - RNA, 18 nt, Salmonella typhimurium LT2
guaauuucgcuggcggcc

SEQ ID NO: 1838373 - RNA, 17 nt, Salmonella typhimurium LT2
guacagccgggcauaug

SEQ ID NO: 1838374 - RNA, 17 nt, Salmonella typhimurium LT2
guacauaacagcagcag

SEQ ID NO: 1838375 - RNA, 17 nt, Salmonella typhimurium LT2
guacauaacaucucacu

SEQ ID NO: 1838376 - RNA, 15 nt, Salmonella typhimurium LT2
guacaggcgcucaac

SEQ ID NO: 1838377 - RNA, 12 nt, Salmonella typhimurium LT2
guacagaugcug

SEQ ID NO: 1838378 - RNA, 19 nt, Salmonella typhimurium LT2
guacagccaaaaauaacgc

SEQ ID NO: 1838379 - RNA, 19 nt, Salmonella typhimurium LT2
guacaccugcaacuccugg

SEQ ID NO: 1838380 - RNA, 22 nt, Salmonella typhimurium LT2
guacgccaaaucuguucugucc

SEQ ID NO: 1838381 - RNA, 16 nt, Salmonella typhimurium LT2
guacgccaaguacgcc

SEQ ID NO: 1838382 - RNA, 12 nt, Salmonella typhimurium LT2
guacgcccagcc

SEQ ID NO: 1838383 - RNA, 21 nt, Salmonella typhimurium LT2
guacgcccgugacgccaggca

SEQ ID NO: 1838384 - RNA, 16 nt, Salmonella typhimurium LT2
guacgccugucgcaac

SEQ ID NO: 1838385 - RNA, 20 nt, Salmonella typhimurium LT2
guacgcgcaaccgcaucacg

SEQ ID NO: 1838386 - RNA, 14 nt, Salmonella typhimurium LT2
guacuccugcaucg

SEQ ID NO: 1838387 - RNA, 16 nt, Salmonella typhimurium LT2
guacucuuccagcugc

SEQ ID NO: 1838388 - RNA, 23 nt, Salmonella typhimurium LT2
guacucuuccagcugcucuucuu

SEQ ID NO: 1838389 - RNA, 14 nt, Salmonella typhimurium LT2
guacugaaauaacu

SEQ ID NO: 1838390 - RNA, 12 nt, Salmonella typhimurium LT2
guacuuuaaccg

SEQ ID NO: 1838391 - RNA, 21 nt, Salmonella typhimurium LT2
guacuuucuacaaauguuguc

SEQ ID NO: 1838392 - RNA, 12 nt, Salmonella typhimurium LT2
guacuuucucca

SEQ ID NO: 1838393 - RNA, 19 nt, Salmonella typhimurium LT2
guacuuucuccaugccaga

SEQ ID NO: 1838394 - RNA, 21 nt, Salmonella typhimurium LT2
guacuuuucauccacagcgcc

SEQ ID NO: 1838395 - RNA, 20 nt, Salmonella typhimurium LT2
guaccugcggcaauggcuca

SEQ ID NO: 1838396 - RNA, 16 nt, Salmonella typhimurium LT2
guaccugcguuaaacg

SEQ ID NO: 1838397 - RNA, 15 nt, Salmonella typhimurium LT2
guaccugauaaaacu

SEQ ID NO: 1838398 - RNA, 14 nt, Salmonella typhimurium LT2
guaccuggauaaau

SEQ ID NO: 1838399 - RNA, 20 nt, Salmonella typhimurium LT2
guaccuuuaucuugaccuga

SEQ ID NO: 1838400 - RNA, 11 nt, Salmonella typhimurium LT2
guacauaucca

SEQ ID NO: 1838401 - RNA, 17 nt, Salmonella typhimurium LT2
guaccagcagaacggua

SEQ ID NO: 1838402 - RNA, 16 nt, Salmonella typhimurium LT2
guacuuuugccaggcg

SEQ ID NO: 1838403 - RNA, 17 nt, Salmonella typhimurium LT2
guagaaauucugcaggc

SEQ ID NO: 1838404 - RNA, 18 nt, Salmonella typhimurium LT2
guagaacuuccaacuaaa

SEQ ID NO: 1838405 - RNA, 16 nt, Salmonella typhimurium LT2
guagacaaacagcgcg

SEQ ID NO: 1838406 - RNA, 13 nt, Salmonella typhimurium LT2
guagcagcgauga

SEQ ID NO: 1838407 - RNA, 15 nt, Salmonella typhimurium LT2
guagcagcgaugaca

SEQ ID NO: 1838408 - RNA, 23 nt, Salmonella typhimurium LT2
guagcaggagaucuuuccauuuc

SEQ ID NO: 1838409 - RNA, 17 nt, Salmonella typhimurium LT2
guagcaguggagaggcc

SEQ ID NO: 1838410 - RNA, 19 nt, Salmonella typhimurium LT2
guagccaaaagcgccacgc

SEQ ID NO: 1838411 - RNA, 19 nt, Salmonella typhimurium LT2
guagccacgcccgccgccu

SEQ ID NO: 1838412 - RNA, 20 nt, Salmonella typhimurium LT2
guagccagagcgcgcuggca

SEQ ID NO: 1838413 - RNA, 18 nt, Salmonella typhimurium LT2
guagccgcaaaugccauc

SEQ ID NO: 1838414 - RNA, 17 nt, Salmonella typhimurium LT2
guagccgcgcgccgccu

SEQ ID NO: 1838415 - RNA, 14 nt, Salmonella typhimurium LT2
guagccgcgccaga

SEQ ID NO: 1838416 - RNA, 16 nt, Salmonella typhimurium LT2
guagcguacaggcgga

SEQ ID NO: 1838417 - RNA, 14 nt, Salmonella typhimurium LT2
guagcggcgccggg

SEQ ID NO: 1838418 - RNA, 21 nt, Salmonella typhimurium LT2
guagcggcaacagcaccagaa

SEQ ID NO: 1838419 - RNA, 14 nt, Salmonella typhimurium LT2
guauaggccaggcu

SEQ ID NO: 1838420 - RNA, 14 nt, Salmonella typhimurium LT2
guauagccaggcag

SEQ ID NO: 1838421 - RNA, 16 nt, Salmonella typhimurium LT2
guagcuuuuccgcugg

SEQ ID NO: 1838422 - RNA, 16 nt, Salmonella typhimurium LT2
guauacucagacgacc

SEQ ID NO: 1838423 - RNA, 14 nt, Salmonella typhimurium LT2
guagcuucugucug

SEQ ID NO: 1838424 - RNA, 24 nt, Salmonella typhimurium LT2
guagcugcgcgccgcaaaacgcgu

SEQ ID NO: 1838425 - RNA, 20 nt, Salmonella typhimurium LT2
guagcgucaauacgccucgg

SEQ ID NO: 1838426 - RNA, 18 nt, Salmonella typhimurium LT2
guaucacugauauaaccc

SEQ ID NO: 1838427 - RNA, 20 nt, Salmonella typhimurium LT2
guaucaaugcgacagcggca

SEQ ID NO: 1838428 - RNA, 17 nt, Salmonella typhimurium LT2
guaucauuuugauucag

SEQ ID NO: 1838429 - RNA, 15 nt, Salmonella typhimurium LT2
guaucaucgauuuua

SEQ ID NO: 1838430 - RNA, 13 nt, Salmonella typhimurium LT2
guaucccgccagc

SEQ ID NO: 1838431 - RNA, 17 nt, Salmonella typhimurium LT2
guaucccgccagcggcg

SEQ ID NO: 1838432 - RNA, 15 nt, Salmonella typhimurium LT2
guauccguacuuucu

SEQ ID NO: 1838433 - RNA, 16 nt, Salmonella typhimurium LT2
guauccggucaauaca

SEQ ID NO: 1838434 - RNA, 12 nt, Salmonella typhimurium LT2
guauuaccaaua

SEQ ID NO: 1838435 - RNA, 12 nt, Salmonella typhimurium LT2
guauuaaauaca

SEQ ID NO: 1838436 - RNA, 18 nt, Salmonella typhimurium LT2
guauuaacagcuucuucu

SEQ ID NO: 1838437 - RNA, 20 nt, Salmonella typhimurium LT2
guauuaagccuuuuuaaaua

SEQ ID NO: 1838438 - RNA, 22 nt, Salmonella typhimurium LT2
guauuaagccuuuuuaaauauu

SEQ ID NO: 1838439 - RNA, 15 nt, Salmonella typhimurium LT2
guaugguggcggggu

SEQ ID NO: 1838440 - RNA, 19 nt, Salmonella typhimurium LT2
guauguauuuuauccagga

SEQ ID NO: 1838441 - RNA, 23 nt, Salmonella typhimurium LT2
guauguauuuuauccaggagagc

SEQ ID NO: 1838442 - RNA, 16 nt, Salmonella typhimurium LT2
guauguauugcauuuu

SEQ ID NO: 1838443 - RNA, 14 nt, Salmonella typhimurium LT2
guaugcagccaggc

SEQ ID NO: 1838444 - RNA, 17 nt, Salmonella typhimurium LT2
guaugcagccaggccau

SEQ ID NO: 1838445 - RNA, 19 nt, Salmonella typhimurium LT2
guaugccgcauaaaauuuu

SEQ ID NO: 1838446 - RNA, 23 nt, Salmonella typhimurium LT2
guaugcccccuccagccagcgcc

SEQ ID NO: 1838447 - RNA, 17 nt, Salmonella typhimurium LT2
guaugcguugcaaauau

SEQ ID NO: 1838448 - RNA, 13 nt, Salmonella typhimurium LT2
guaugcuccuucc

SEQ ID NO: 1838449 - RNA, 22 nt, Salmonella typhimurium LT2
guaucguuugcccaucauucaa

SEQ ID NO: 1838450 - RNA, 20 nt, Salmonella typhimurium LT2
guaucgcgcuuacacagacu

SEQ ID NO: 1838451 - RNA, 14 nt, Salmonella typhimurium LT2
guauccuuccagcc

SEQ ID NO: 1838452 - RNA, 13 nt, Salmonella typhimurium LT2
guaucgauaaguc

SEQ ID NO: 1838453 - RNA, 20 nt, Salmonella typhimurium LT2
guaucugcaauucggcggca

SEQ ID NO: 1838454 - RNA, 22 nt, Salmonella typhimurium LT2
guaucugguggaaaagaaaaca

SEQ ID NO: 1838455 - RNA, 11 nt, Salmonella typhimurium LT2
guaucuuuuau

SEQ ID NO: 1838456 - RNA, 21 nt, Salmonella typhimurium LT2
guaugacaaauaaaauaagca

SEQ ID NO: 1838457 - RNA, 18 nt, Salmonella typhimurium LT2
guaugacgcacacggcgu

SEQ ID NO: 1838458 - RNA, 23 nt, Salmonella typhimurium LT2
guaugacgcuugagcgccuuauc

SEQ ID NO: 1838459 - RNA, 17 nt, Salmonella typhimurium LT2
guaugacccgccccagg

SEQ ID NO: 1838460 - RNA, 22 nt, Salmonella typhimurium LT2
gucaaauuguacuuuuuggcca

SEQ ID NO: 1838461 - RNA, 16 nt, Salmonella typhimurium LT2
gucaaauuugcugcca

SEQ ID NO: 1838462 - RNA, 22 nt, Salmonella typhimurium LT2
gucaauaaccgccgauuuaucg

SEQ ID NO: 1838463 - RNA, 13 nt, Salmonella typhimurium LT2
gucaaaaugauca

SEQ ID NO: 1838464 - RNA, 18 nt, Salmonella typhimurium LT2
gucaaauccaccgccagc

SEQ ID NO: 1838465 - RNA, 12 nt, Salmonella typhimurium LT2
gucaaucaucag

SEQ ID NO: 1838466 - RNA, 13 nt, Salmonella typhimurium LT2
gucaccagcagca

SEQ ID NO: 1838467 - RNA, 11 nt, Salmonella typhimurium LT2
gucaccagcag

SEQ ID NO: 1838468 - RNA, 14 nt, Salmonella typhimurium LT2
gucacauccagaca

SEQ ID NO: 1838469 - RNA, 15 nt, Salmonella typhimurium LT2
gucacauacuucugu

SEQ ID NO: 1838470 - RNA, 23 nt, Salmonella typhimurium LT2
gucacgaucuggcaaaccaugua

SEQ ID NO: 1838471 - RNA, 16 nt, Salmonella typhimurium LT2
gucacgacguauuaaa

SEQ ID NO: 1838472 - RNA, 23 nt, Salmonella typhimurium LT2
gucaccauuaacaucagaaaaaa

SEQ ID NO: 1838473 - RNA, 13 nt, Salmonella typhimurium LT2
gucacgaaguucc

SEQ ID NO: 1838474 - RNA, 22 nt, Salmonella typhimurium LT2
gucacgacggcgaccagcaaaa

SEQ ID NO: 1838475 - RNA, 20 nt, Salmonella typhimurium LT2
guauucugcgccagccagcu

SEQ ID NO: 1838476 - RNA, 14 nt, Salmonella typhimurium LT2
guauugaagcgaua

SEQ ID NO: 1838477 - RNA, 15 nt, Salmonella typhimurium LT2
guauugacaacaaau

SEQ ID NO: 1838478 - RNA, 19 nt, Salmonella typhimurium LT2
guauugacaacaaauccaa

SEQ ID NO: 1838479 - RNA, 17 nt, Salmonella typhimurium LT2
guauugagcgaaacagg

SEQ ID NO: 1838480 - RNA, 15 nt, Salmonella typhimurium LT2
guauugcaccuggga

SEQ ID NO: 1838481 - RNA, 15 nt, Salmonella typhimurium LT2
guauuccaucaaaag

SEQ ID NO: 1838482 - RNA, 16 nt, Salmonella typhimurium LT2
guauugcuuucaauuu

SEQ ID NO: 1838483 - RNA, 22 nt, Salmonella typhimurium LT2
guauugcuuucaauuuccgcac

SEQ ID NO: 1838484 - RNA, 13 nt, Salmonella typhimurium LT2
guauuggcaagaa

SEQ ID NO: 1838485 - RNA, 13 nt, Salmonella typhimurium LT2
guauuuauccagc

SEQ ID NO: 1838486 - RNA, 17 nt, Salmonella typhimurium LT2
guauuucacuuuugccg

SEQ ID NO: 1838487 - RNA, 16 nt, Salmonella typhimurium LT2
guauuucccuucccag

SEQ ID NO: 1838488 - RNA, 11 nt, Salmonella typhimurium LT2
guauuuucuau

SEQ ID NO: 1838489 - RNA, 17 nt, Salmonella typhimurium LT2
gucaugcgggagcuugg

SEQ ID NO: 1838490 - RNA, 20 nt, Salmonella typhimurium LT2
gucaucggcacguaguaaug

SEQ ID NO: 1838491 - RNA, 23 nt, Salmonella typhimurium LT2
gucaucgcggaaagcaaugucgc

SEQ ID NO: 1838492 - RNA, 16 nt, Salmonella typhimurium LT2
gucaucgccuucaucc

SEQ ID NO: 1838493 - RNA, 23 nt, Salmonella typhimurium LT2
gucaucgcucaucucaagcccca

SEQ ID NO: 1838494 - RNA, 15 nt, Salmonella typhimurium LT2
gucaugcuaaaacag

SEQ ID NO: 1838495 - RNA, 17 nt, Salmonella typhimurium LT2
gucaugcuaaaacagau

SEQ ID NO: 1838496 - RNA, 17 nt, Salmonella typhimurium LT2
gucaugcucgcuuucca

SEQ ID NO: 1838497 - RNA, 18 nt, Salmonella typhimurium LT2
gucaugcuggcgaugagu

SEQ ID NO: 1838498 - RNA, 16 nt, Salmonella typhimurium LT2
gucaugcuggcuaaau

SEQ ID NO: 1838499 - RNA, 22 nt, Salmonella typhimurium LT2
gucaugcuucaccucagcaaaa

SEQ ID NO: 1838500 - RNA, 23 nt, Salmonella typhimurium LT2
guccaacaaggauauccgccagu

SEQ ID NO: 1838501 - RNA, 14 nt, Salmonella typhimurium LT2
guccaaagauaaac

SEQ ID NO: 1838502 - RNA, 14 nt, Salmonella typhimurium LT2
guccacaccuucca

SEQ ID NO: 1838503 - RNA, 21 nt, Salmonella typhimurium LT2
gucaucgaaggcaucuucaga

SEQ ID NO: 1838504 - RNA, 22 nt, Salmonella typhimurium LT2
gucaucccgguuucccgcguga

SEQ ID NO: 1838505 - RNA, 15 nt, Salmonella typhimurium LT2
gucaucauuacaggc

SEQ ID NO: 1838506 - RNA, 21 nt, Salmonella typhimurium LT2
gucaucauugucacuauucuu

SEQ ID NO: 1838507 - RNA, 12 nt, Salmonella typhimurium LT2
gucaucccgaac

SEQ ID NO: 1838508 - RNA, 17 nt, Salmonella typhimurium LT2
gucaucaacgcgaucuu

SEQ ID NO: 1838509 - RNA, 20 nt, Salmonella typhimurium LT2
gucaucaacgcgaucuucau

SEQ ID NO: 1838510 - RNA, 21 nt, Salmonella typhimurium LT2
gucauauagccgcgcaguuuc

SEQ ID NO: 1838511 - RNA, 20 nt, Salmonella typhimurium LT2
gucaucaaauuaucuguuga

SEQ ID NO: 1838512 - RNA, 21 nt, Salmonella typhimurium LT2
gucauauugccgccuuuguug

SEQ ID NO: 1838513 - RNA, 17 nt, Salmonella typhimurium LT2
guccacaucuaccaggu

SEQ ID NO: 1838514 - RNA, 23 nt, Salmonella typhimurium LT2
guccacuccggcgugaacgccuc

SEQ ID NO: 1838515 - RNA, 16 nt, Salmonella typhimurium LT2
guccacgcgagcugcc

SEQ ID NO: 1838516 - RNA, 15 nt, Salmonella typhimurium LT2
guccagaugcugggc

SEQ ID NO: 1838517 - RNA, 19 nt, Salmonella typhimurium LT2
guccagauagggccaggcg

SEQ ID NO: 1838518 - RNA, 14 nt, Salmonella typhimurium LT2
guccagauccacug

SEQ ID NO: 1838519 - RNA, 22 nt, Salmonella typhimurium LT2
guccagaggaucuggacgccaa

SEQ ID NO: 1838520 - RNA, 19 nt, Salmonella typhimurium LT2
guccagauaccggauugcu

SEQ ID NO: 1838521 - RNA, 14 nt, Salmonella typhimurium LT2
guccacugaccgga

SEQ ID NO: 1838522 - RNA, 19 nt, Salmonella typhimurium LT2
guccagggugaacaugggu

SEQ ID NO: 1838523 - RNA, 19 nt, Salmonella typhimurium LT2
guccagucgaacuuugcga

SEQ ID NO: 1838524 - RNA, 18 nt, Salmonella typhimurium LT2
guccaggguguucaccau

SEQ ID NO: 1838525 - RNA, 17 nt, Salmonella typhimurium LT2
guccagguuaaacguca

SEQ ID NO: 1838526 - RNA, 13 nt, Salmonella typhimurium LT2
guccagcgcguga

SEQ ID NO: 1838527 - RNA, 16 nt, Salmonella typhimurium LT2
gucgacgaccucggaa

SEQ ID NO: 1838528 - RNA, 13 nt, Salmonella typhimurium LT2
gucgacaccagcg

SEQ ID NO: 1838529 - RNA, 15 nt, Salmonella typhimurium LT2
gucgacguuuuucag

SEQ ID NO: 1838530 - RNA, 22 nt, Salmonella typhimurium LT2
gucgaacugaauggucggcugc

SEQ ID NO: 1838531 - RNA, 14 nt, Salmonella typhimurium LT2
gucgaagcuuuuca

SEQ ID NO: 1838532 - RNA, 22 nt, Salmonella typhimurium LT2
guccucggcaacauaccgggua

SEQ ID NO: 1838533 - RNA, 21 nt, Salmonella typhimurium LT2
guccuuuaucugcccuuucuu

SEQ ID NO: 1838534 - RNA, 18 nt, Salmonella typhimurium LT2
gucccggcagugcauaaa

SEQ ID NO: 1838535 - RNA, 14 nt, Salmonella typhimurium LT2
guccauuuuccuau

SEQ ID NO: 1838536 - RNA, 24 nt, Salmonella typhimurium LT2
guccauuuauugcagguauugagu

SEQ ID NO: 1838537 - RNA, 21 nt, Salmonella typhimurium LT2
guccauuacucucauguucaa

SEQ ID NO: 1838538 - RNA, 18 nt, Salmonella typhimurium LT2
guccauugcgagaaaaaa

SEQ ID NO: 1838539 - RNA, 18 nt, Salmonella typhimurium LT2
guccauuuauugcaggua

SEQ ID NO: 1838540 - RNA, 20 nt, Salmonella typhimurium LT2
guccauguuuuauacucaaa

SEQ ID NO: 1838541 - RNA, 14 nt, Salmonella typhimurium LT2
gucccgucccacca

SEQ ID NO: 1838542 - RNA, 21 nt, Salmonella typhimurium LT2
gucccuuucccuuccagcgac

SEQ ID NO: 1838543 - RNA, 11 nt, Salmonella typhimurium LT2
gucccugcugg

SEQ ID NO: 1838544 - RNA, 15 nt, Salmonella typhimurium LT2
gucccugcuucaccg

SEQ ID NO: 1838545 - RNA, 17 nt, Salmonella typhimurium LT2
guccgccuaccagcaca

SEQ ID NO: 1838546 - RNA, 18 nt, Salmonella typhimurium LT2
guccgcguuaacuccccu

SEQ ID NO: 1838547 - RNA, 14 nt, Salmonella typhimurium LT2
guccuccauggcuu

SEQ ID NO: 1838548 - RNA, 19 nt, Salmonella typhimurium LT2
guccgggcugcacgccauc

SEQ ID NO: 1838549 - RNA, 13 nt, Salmonella typhimurium LT2
gucgagcagcagg

SEQ ID NO: 1838550 - RNA, 16 nt, Salmonella typhimurium LT2
gucgcgcccuccucca

SEQ ID NO: 1838551 - RNA, 22 nt, Salmonella typhimurium LT2
gucgcgccaaaagaggcagcaa

SEQ ID NO: 1838552 - RNA, 20 nt, Salmonella typhimurium LT2
gucgcgcauggcagggcgau

SEQ ID NO: 1838553 - RNA, 18 nt, Salmonella typhimurium LT2
gucgcgacguccgccaac

SEQ ID NO: 1838554 - RNA, 23 nt, Salmonella typhimurium LT2
gucgcgauaucugaacgcgggcg

SEQ ID NO: 1838555 - RNA, 16 nt, Salmonella typhimurium LT2
gucggcagaaccuggc

SEQ ID NO: 1838556 - RNA, 21 nt, Salmonella typhimurium LT2
gucggcaaugccuaccggcgg

SEQ ID NO: 1838557 - RNA, 20 nt, Salmonella typhimurium LT2
gucggcaucgugaaacucac

SEQ ID NO: 1838558 - RNA, 18 nt, Salmonella typhimurium LT2
gucgcuccccauaaaaau

SEQ ID NO: 1838559 - RNA, 19 nt, Salmonella typhimurium LT2
gucgcguuuaccgccgccg

SEQ ID NO: 1838560 - RNA, 20 nt, Salmonella typhimurium LT2
gucgcguuuaccgccgccgu

SEQ ID NO: 1838561 - RNA, 17 nt, Salmonella typhimurium LT2
gucgggccugcugcggu

SEQ ID NO: 1838562 - RNA, 15 nt, Salmonella typhimurium LT2
gucgggaacgcuguc

SEQ ID NO: 1838563 - RNA, 12 nt, Salmonella typhimurium LT2
gucggcgccauc

SEQ ID NO: 1838564 - RNA, 17 nt, Salmonella typhimurium LT2
gucggccaggugccgag

SEQ ID NO: 1838565 - RNA, 19 nt, Salmonella typhimurium LT2
gucgucgauuuucugcuca

SEQ ID NO: 1838566 - RNA, 21 nt, Salmonella typhimurium LT2
gucgucgauuuucugcucaau

SEQ ID NO: 1838567 - RNA, 22 nt, Salmonella typhimurium LT2
gucguauccccagucuuccugc

SEQ ID NO: 1838568 - RNA, 16 nt, Salmonella typhimurium LT2
gucgucauaucgaugg

SEQ ID NO: 1838569 - RNA, 20 nt, Salmonella typhimurium LT2
gucgucauuugaaucugcag

SEQ ID NO: 1838570 - RNA, 17 nt, Salmonella typhimurium LT2
gucguagguuuuaucaa

SEQ ID NO: 1838571 - RNA, 22 nt, Salmonella typhimurium LT2
gucggugauauauucagcaaau

SEQ ID NO: 1838572 - RNA, 15 nt, Salmonella typhimurium LT2
gucuccgcagcaggc

SEQ ID NO: 1838573 - RNA, 19 nt, Salmonella typhimurium LT2
gucucccgauuguauaaau

SEQ ID NO: 1838574 - RNA, 20 nt, Salmonella typhimurium LT2
gucuccagcucauuuuuaca

SEQ ID NO: 1838575 - RNA, 14 nt, Salmonella typhimurium LT2
gucuaccagcucuc

SEQ ID NO: 1838576 - RNA, 18 nt, Salmonella typhimurium LT2
gucuacccaggucgccga

SEQ ID NO: 1838577 - RNA, 20 nt, Salmonella typhimurium LT2
gucuacccgguguaaaaaau

SEQ ID NO: 1838578 - RNA, 22 nt, Salmonella typhimurium LT2
gucuacacuuugcgccgccagu

SEQ ID NO: 1838579 - RNA, 15 nt, Salmonella typhimurium LT2
gggacacugccggcu

SEQ ID NO: 1838580 - RNA, 17 nt, Salmonella typhimurium LT2
gggacgcugcgcggcga

SEQ ID NO: 1838581 - RNA, 16 nt, Salmonella typhimurium LT2
ggcuuugcaacagggc

SEQ ID NO: 1838582 - RNA, 14 nt, Salmonella typhimurium LT2
ggcuuucuaccugc

SEQ ID NO: 1838583 - RNA, 18 nt, Salmonella typhimurium LT2
gggaagaugugccacucc

SEQ ID NO: 1838584 - RNA, 22 nt, Salmonella typhimurium LT2
gggaagaugugccacuccgcca

SEQ ID NO: 1838585 - RNA, 23 nt, Salmonella typhimurium LT2
gggaagagauuaacgaccaggua

SEQ ID NO: 1838586 - RNA, 15 nt, Salmonella typhimurium LT2
gggaaguaaggcaua

SEQ ID NO: 1838587 - RNA, 23 nt, Salmonella typhimurium LT2
gggaaggugauguccagaccaau

SEQ ID NO: 1838588 - RNA, 20 nt, Salmonella typhimurium LT2
gggaaucagggugccaggca

SEQ ID NO: 1838589 - RNA, 21 nt, Salmonella typhimurium LT2
ggcugucgauuuccggcggca

SEQ ID NO: 1838590 - RNA, 18 nt, Salmonella typhimurium LT2
ggcugugcgugacccaua

SEQ ID NO: 1838591 - RNA, 12 nt, Salmonella typhimurium LT2
ggccgccagggg

SEQ ID NO: 1838592 - RNA, 16 nt, Salmonella typhimurium LT2
ggcuucaaccuccugc

SEQ ID NO: 1838593 - RNA, 15 nt, Salmonella typhimurium LT2
ggcuucauaccgaga

SEQ ID NO: 1838594 - RNA, 23 nt, Salmonella typhimurium LT2
ggcuuccacccgggaagcccuuu

SEQ ID NO: 1838595 - RNA, 20 nt, Salmonella typhimurium LT2
ggcuugaguuuuucucgcaa

SEQ ID NO: 1838596 - RNA, 23 nt, Salmonella typhimurium LT2
ggcuugauguagucgcucagguu

SEQ ID NO: 1838597 - RNA, 23 nt, Salmonella typhimurium LT2
ggcuuuauccugaccgcuccagu

SEQ ID NO: 1838598 - RNA, 13 nt, Salmonella typhimurium LT2
ggcuuuauauaaa

SEQ ID NO: 1838599 - RNA, 24 nt, Salmonella typhimurium LT2
gggccaguuuccugacccgcucgu

SEQ ID NO: 1838600 - RNA, 17 nt, Salmonella typhimurium LT2
gggccagcucuuuucug

SEQ ID NO: 1838601 - RNA, 13 nt, Salmonella typhimurium LT2
gggccagcgccag

SEQ ID NO: 1838602 - RNA, 21 nt, Salmonella typhimurium LT2
gggccgccaucuccggcagcg

SEQ ID NO: 1838603 - RNA, 13 nt, Salmonella typhimurium LT2
gggccgacagacg

SEQ ID NO: 1838604 - RNA, 14 nt, Salmonella typhimurium LT2
gggccgacaggcgg

SEQ ID NO: 1838605 - RNA, 20 nt, Salmonella typhimurium LT2
gggcaacggccagcgcaggc

SEQ ID NO: 1838606 - RNA, 22 nt, Salmonella typhimurium LT2
gggcaaaaacggcgcuuuuaaa

SEQ ID NO: 1838607 - RNA, 23 nt, Salmonella typhimurium LT2
gggcacgcugaccacgccgccgc

SEQ ID NO: 1838608 - RNA, 14 nt, Salmonella typhimurium LT2
gggcaauccauuaa

SEQ ID NO: 1838609 - RNA, 16 nt, Salmonella typhimurium LT2
gggcaagggcaagggc

SEQ ID NO: 1838610 - RNA, 19 nt, Salmonella typhimurium LT2
gggcacuccggcucgcaca

SEQ ID NO: 1838611 - RNA, 20 nt, Salmonella typhimurium LT2
gggcagacauuugcgcacgg

SEQ ID NO: 1838612 - RNA, 20 nt, Salmonella typhimurium LT2
gggcagaaacguaccugaga

SEQ ID NO: 1838613 - RNA, 14 nt, Salmonella typhimurium LT2
gggcagacuuucug

SEQ ID NO: 1838614 - RNA, 13 nt, Salmonella typhimurium LT2
gggagcagacugu

SEQ ID NO: 1838615 - RNA, 19 nt, Salmonella typhimurium LT2
gggauguggugcggcuuau

SEQ ID NO: 1838616 - RNA, 17 nt, Salmonella typhimurium LT2
gggggcgaucagcaggu

SEQ ID NO: 1838617 - RNA, 23 nt, Salmonella typhimurium LT2
ggggguucaaguccccccccucg

SEQ ID NO: 1838618 - RNA, 12 nt, Salmonella typhimurium LT2
ggggugaaacag

SEQ ID NO: 1838619 - RNA, 19 nt, Salmonella typhimurium LT2
ggggucggcgcuaaugugg

SEQ ID NO: 1838620 - RNA, 21 nt, Salmonella typhimurium LT2
gggggaaaugagaaaaggaag

SEQ ID NO: 1838621 - RNA, 19 nt, Salmonella typhimurium LT2
gggggaaaugagaaaagga

SEQ ID NO: 1838622 - RNA, 17 nt, Salmonella typhimurium LT2
gggggaggcaggcaaca

SEQ ID NO: 1838623 - RNA, 17 nt, Salmonella typhimurium LT2
gggugcagcgucaggaa

SEQ ID NO: 1838624 - RNA, 12 nt, Salmonella typhimurium LT2
gggugccaggca

SEQ ID NO: 1838625 - RNA, 12 nt, Salmonella typhimurium LT2
gggucaggaacu

SEQ ID NO: 1838626 - RNA, 18 nt, Salmonella typhimurium LT2
gggucgccgcgcccagca

SEQ ID NO: 1838627 - RNA, 21 nt, Salmonella typhimurium LT2
ggguaaauagacuguugaaag

SEQ ID NO: 1838628 - RNA, 14 nt, Salmonella typhimurium LT2
gggucaagaaaauc

SEQ ID NO: 1838629 - RNA, 24 nt, Salmonella typhimurium LT2
gggucacauccagacagccgacgg

SEQ ID NO: 1838630 - RNA, 22 nt, Salmonella typhimurium LT2
gggucaccgggguucagaccag

SEQ ID NO: 1838631 - RNA, 21 nt, Salmonella typhimurium LT2
gggguuuuugccggaccugcg

SEQ ID NO: 1838632 - RNA, 22 nt, Salmonella typhimurium LT2
gggguuuucucuuuccagcgac

SEQ ID NO: 1838633 - RNA, 19 nt, Salmonella typhimurium LT2
ggguaaaaauauggcgggc

SEQ ID NO: 1838634 - RNA, 18 nt, Salmonella typhimurium LT2
gggguucccgagcggcca

SEQ ID NO: 1838635 - RNA, 19 nt, Salmonella typhimurium LT2
gggcuaaaugcccacggcg

SEQ ID NO: 1838636 - RNA, 22 nt, Salmonella typhimurium LT2
gggcucauuuuauccaacagcg

SEQ ID NO: 1838637 - RNA, 19 nt, Salmonella typhimurium LT2
gggcucguuuuuguuuaaa

SEQ ID NO: 1838638 - RNA, 23 nt, Salmonella typhimurium LT2
gggccuacagguacagaugcugu

SEQ ID NO: 1838639 - RNA, 13 nt, Salmonella typhimurium LT2
gggccugauaagc

SEQ ID NO: 1838640 - RNA, 18 nt, Salmonella typhimurium LT2
gggccugauaagcacagg

SEQ ID NO: 1838641 - RNA, 19 nt, Salmonella typhimurium LT2
gggccugauaagcacaggc

SEQ ID NO: 1838642 - RNA, 21 nt, Salmonella typhimurium LT2
gggcggaaaacauucgcccgu

SEQ ID NO: 1838643 - RNA, 11 nt, Salmonella typhimurium LT2
ggggauuucau

SEQ ID NO: 1838644 - RNA, 16 nt, Salmonella typhimurium LT2
ggggaucaagcccccg

SEQ ID NO: 1838645 - RNA, 20 nt, Salmonella typhimurium LT2
ggggaucaagcccccgcaac

SEQ ID NO: 1838646 - RNA, 18 nt, Salmonella typhimurium LT2
ggggaugauuuucaggca

SEQ ID NO: 1838647 - RNA, 14 nt, Salmonella typhimurium LT2
gggcuugagcccgg

SEQ ID NO: 1838648 - RNA, 13 nt, Salmonella typhimurium LT2
ggggccagcgcca

SEQ ID NO: 1838649 - RNA, 15 nt, Salmonella typhimurium LT2
ggggcaucagccgcc

SEQ ID NO: 1838650 - RNA, 13 nt, Salmonella typhimurium LT2
ggggcgaccggcu

SEQ ID NO: 1838651 - RNA, 14 nt, Salmonella typhimurium LT2
ggggcgacagcccc

SEQ ID NO: 1838652 - RNA, 23 nt, Salmonella typhimurium LT2
ggucaauaagugauacauagucu

SEQ ID NO: 1838653 - RNA, 21 nt, Salmonella typhimurium LT2
ggucaacuaacaaugucgaaa

SEQ ID NO: 1838654 - RNA, 14 nt, Salmonella typhimurium LT2
gguauccugaacca

SEQ ID NO: 1838655 - RNA, 13 nt, Salmonella typhimurium LT2
gguaucccaaacg

SEQ ID NO: 1838656 - RNA, 15 nt, Salmonella typhimurium LT2
gguauugcuuucaau

SEQ ID NO: 1838657 - RNA, 17 nt, Salmonella typhimurium LT2
gguauuuauccagcagg

SEQ ID NO: 1838658 - RNA, 14 nt, Salmonella typhimurium LT2
ggucaaaagcugca

SEQ ID NO: 1838659 - RNA, 21 nt, Salmonella typhimurium LT2
gguagcgcuuguuaucuggca

SEQ ID NO: 1838660 - RNA, 20 nt, Salmonella typhimurium LT2
gguagcggcacguacugcac

SEQ ID NO: 1838661 - RNA, 22 nt, Salmonella typhimurium LT2
gguagcgguggcgcuccagccg

SEQ ID NO: 1838662 - RNA, 13 nt, Salmonella typhimurium LT2
gguagccacagau

SEQ ID NO: 1838663 - RNA, 19 nt, Salmonella typhimurium LT2
ggucauucauugucuuuuu

SEQ ID NO: 1838664 - RNA, 17 nt, Salmonella typhimurium LT2
ggucauuggggacgcgc

SEQ ID NO: 1838665 - RNA, 23 nt, Salmonella typhimurium LT2
ggucagcaggcgaacuucaucca

SEQ ID NO: 1838666 - RNA, 21 nt, Salmonella typhimurium LT2
ggucaucgaaggcaucuucag

SEQ ID NO: 1838667 - RNA, 16 nt, Salmonella typhimurium LT2
ggucaucgcaaauucu

SEQ ID NO: 1838668 - RNA, 16 nt, Salmonella typhimurium LT2
ggucaucaccuccagc

SEQ ID NO: 1838669 - RNA, 19 nt, Salmonella typhimurium LT2
ggucaucaccuccagcacg

SEQ ID NO: 1838670 - RNA, 23 nt, Salmonella typhimurium LT2
ggugauuucgcccgcauucgcgg

SEQ ID NO: 1838671 - RNA, 24 nt, Salmonella typhimurium LT2
ggugcaugcggagauggcgaagga

SEQ ID NO: 1838672 - RNA, 22 nt, Salmonella typhimurium LT2
ggugaauaccagcggcaaacag

SEQ ID NO: 1838673 - RNA, 16 nt, Salmonella typhimurium LT2
ggugaauaccaaagcc

SEQ ID NO: 1838674 - RNA, 20 nt, Salmonella typhimurium LT2
ggucugcuucagccacuggc

SEQ ID NO: 1838675 - RNA, 19 nt, Salmonella typhimurium LT2
ggucugcaugccgcaggcc

SEQ ID NO: 1838676 - RNA, 12 nt, Salmonella typhimurium LT2
ggugagcucuuu

SEQ ID NO: 1838677 - RNA, 16 nt, Salmonella typhimurium LT2
ggugagcaaaggcagc

SEQ ID NO: 1838678 - RNA, 19 nt, Salmonella typhimurium LT2
ggugacaaucucaaugcca

SEQ ID NO: 1838679 - RNA, 19 nt, Salmonella typhimurium LT2
ggucuccagcaaaaaaugc

SEQ ID NO: 1838680 - RNA, 11 nt, Salmonella typhimurium LT2
ggucucaggcu

SEQ ID NO: 1838681 - RNA, 20 nt, Salmonella typhimurium LT2
ggucguacuaaagagcgccu

SEQ ID NO: 1838682 - RNA, 21 nt, Salmonella typhimurium LT2
ggucuccgccuggaacccagg

SEQ ID NO: 1838683 - RNA, 17 nt, Salmonella typhimurium LT2
ggucugaugagcgcagc

SEQ ID NO: 1838684 - RNA, 16 nt, Salmonella typhimurium LT2
ggucgggcaggcuucc

SEQ ID NO: 1838685 - RNA, 16 nt, Salmonella typhimurium LT2
ggucgcuauccagcag

SEQ ID NO: 1838686 - RNA, 21 nt, Salmonella typhimurium LT2
ggucgcguccggggccagcgc

SEQ ID NO: 1838687 - RNA, 22 nt, Salmonella typhimurium LT2
ggucgcgccaaaagaggcagca

SEQ ID NO: 1838688 - RNA, 21 nt, Salmonella typhimurium LT2
gguccggcgcuaaccagcgcu

SEQ ID NO: 1838689 - RNA, 18 nt, Salmonella typhimurium LT2
gguuuuaugcaucgcggu

SEQ ID NO: 1838690 - RNA, 16 nt, Salmonella typhimurium LT2
gguuuuauugcacguu

SEQ ID NO: 1838691 - RNA, 20 nt, Salmonella typhimurium LT2
gguuugugucguaguggcau

SEQ ID NO: 1838692 - RNA, 23 nt, Salmonella typhimurium LT2
gguuugacccauuuuaaaaguua

SEQ ID NO: 1838693 - RNA, 17 nt, Salmonella typhimurium LT2
gguuugccagcaccagc

SEQ ID NO: 1838694 - RNA, 11 nt, Salmonella typhimurium LT2
gguuucuuuuu

SEQ ID NO: 1838695 - RNA, 18 nt, Salmonella typhimurium LT2
gguuucgccuaagcccac

SEQ ID NO: 1838696 - RNA, 18 nt, Salmonella typhimurium LT2
gguuucuacuuccaccac

SEQ ID NO: 1838697 - RNA, 22 nt, Salmonella typhimurium LT2
gguuucaauauagccguggcug

SEQ ID NO: 1838698 - RNA, 20 nt, Salmonella typhimurium LT2
guaaaacacgccuccauaca

SEQ ID NO: 1838699 - RNA, 16 nt, Salmonella typhimurium LT2
guaaaaccgacuauca

SEQ ID NO: 1838700 - RNA, 23 nt, Salmonella typhimurium LT2
guaaaacgauauugccuuauuca

SEQ ID NO: 1838701 - RNA, 18 nt, Salmonella typhimurium LT2
guaaaaauuguuccugua

SEQ ID NO: 1838702 - RNA, 14 nt, Salmonella typhimurium LT2
guaaaaaugcuucc

SEQ ID NO: 1838703 - RNA, 22 nt, Salmonella typhimurium LT2
gguuuuuaucuuuucucccggc

SEQ ID NO: 1838704 - RNA, 15 nt, Salmonella typhimurium LT2
gguuuuuauggaagg

SEQ ID NO: 1838705 - RNA, 18 nt, Salmonella typhimurium LT2
gguuuuuggcuugccggu

SEQ ID NO: 1838706 - RNA, 14 nt, Salmonella typhimurium LT2
gguuuuaaaaauaa

SEQ ID NO: 1838707 - RNA, 23 nt, Salmonella typhimurium LT2
gguugcaugauuaggcuggguca

SEQ ID NO: 1838708 - RNA, 19 nt, Salmonella typhimurium LT2
gguucgcgaagugucuucc

SEQ ID NO: 1838709 - RNA, 12 nt, Salmonella typhimurium LT2
gguucugcucaa

SEQ ID NO: 1838710 - RNA, 20 nt, Salmonella typhimurium LT2
gguucuuguguugaaauacu

SEQ ID NO: 1838711 - RNA, 19 nt, Salmonella typhimurium LT2
gguucuuucuuuaacaccu

SEQ ID NO: 1838712 - RNA, 23 nt, Salmonella typhimurium LT2
gguugcggcggggauaaucagca

SEQ ID NO: 1838713 - RNA, 20 nt, Salmonella typhimurium LT2
gguuggaauaauuuucgcaa

SEQ ID NO: 1838714 - RNA, 16 nt, Salmonella typhimurium LT2
gguugcgaaccgcaca

SEQ ID NO: 1838715 - RNA, 17 nt, Salmonella typhimurium LT2
gguugcccgcaggcuuc

SEQ ID NO: 1838716 - RNA, 19 nt, Salmonella typhimurium LT2
gguucaacgcgcugcagcu

SEQ ID NO: 1838717 - RNA, 13 nt, Salmonella typhimurium LT2
gguucaagucccc

SEQ ID NO: 1838718 - RNA, 15 nt, Salmonella typhimurium LT2
gguucaagucccccc

SEQ ID NO: 1838719 - RNA, 19 nt, Salmonella typhimurium LT2
gguucaaguccccccccuc

SEQ ID NO: 1838720 - RNA, 18 nt, Salmonella typhimurium LT2
gguucccugcgccaggcc

SEQ ID NO: 1838721 - RNA, 20 nt, Salmonella typhimurium LT2
gguuccgacaauaaaaaugc

SEQ ID NO: 1838722 - RNA, 19 nt, Salmonella typhimurium LT2
gguucccgccgccaucgcc

SEQ ID NO: 1838723 - RNA, 23 nt, Salmonella typhimurium LT2
gguucccgagcggccaaagggag

SEQ ID NO: 1838724 - RNA, 22 nt, Salmonella typhimurium LT2
gguuccguucccaaugcuuucg

SEQ ID NO: 1838725 - RNA, 17 nt, Salmonella typhimurium LT2
gguuauucggucagaua

SEQ ID NO: 1838726 - RNA, 14 nt, Salmonella typhimurium LT2
gguuauccagcagg

SEQ ID NO: 1838727 - RNA, 22 nt, Salmonella typhimurium LT2
gguuauaaacccccuggccgga

SEQ ID NO: 1838728 - RNA, 13 nt, Salmonella typhimurium LT2
gguuaauggcagc

SEQ ID NO: 1838729 - RNA, 20 nt, Salmonella typhimurium LT2
gguuacaacugcgaggucac

SEQ ID NO: 1838730 - RNA, 15 nt, Salmonella typhimurium LT2
gguuacaacccgacc

SEQ ID NO: 1838731 - RNA, 18 nt, Salmonella typhimurium LT2
ggugcuuagcuggccaau

SEQ ID NO: 1838732 - RNA, 20 nt, Salmonella typhimurium LT2
ggugcuuccggcacugcgcc

SEQ ID NO: 1838733 - RNA, 14 nt, Salmonella typhimurium LT2
ggugcccgcgugga

SEQ ID NO: 1838734 - RNA, 19 nt, Salmonella typhimurium LT2
gguggggcuaagugagcau

SEQ ID NO: 1838735 - RNA, 22 nt, Salmonella typhimurium LT2
gguggggauaucuucgaugaga

SEQ ID NO: 1838736 - RNA, 16 nt, Salmonella typhimurium LT2
ggugguuucccugacc

SEQ ID NO: 1838737 - RNA, 20 nt, Salmonella typhimurium LT2
gguguaaaccaggcauuuuc

SEQ ID NO: 1838738 - RNA, 15 nt, Salmonella typhimurium LT2
ggugggugaugacgg

SEQ ID NO: 1838739 - RNA, 14 nt, Salmonella typhimurium LT2
gguguaccccgccu

SEQ ID NO: 1838740 - RNA, 16 nt, Salmonella typhimurium LT2
gguguagcucauaacu

SEQ ID NO: 1838741 - RNA, 13 nt, Salmonella typhimurium LT2
cuccaccaaccag

SEQ ID NO: 1838742 - RNA, 19 nt, Salmonella typhimurium LT2
cuccaccaaaucccccaac

SEQ ID NO: 1838743 - RNA, 14 nt, Salmonella typhimurium LT2
cuccacaguucaau

SEQ ID NO: 1838744 - RNA, 13 nt, Salmonella typhimurium LT2
cuccaauaaauau

SEQ ID NO: 1838745 - RNA, 15 nt, Salmonella typhimurium LT2
cuccacgccauagcg

SEQ ID NO: 1838746 - RNA, 16 nt, Salmonella typhimurium LT2
cuccagcacauccuca

SEQ ID NO: 1838747 - RNA, 14 nt, Salmonella typhimurium LT2
cuccagcaacgccg

SEQ ID NO: 1838748 - RNA, 13 nt, Salmonella typhimurium LT2
cuccagagcgccg

SEQ ID NO: 1838749 - RNA, 16 nt, Salmonella typhimurium LT2
cuccagcaaaucaauu

SEQ ID NO: 1838750 - RNA, 16 nt, Salmonella typhimurium LT2
cucauuuuauccaaca

SEQ ID NO: 1838751 - RNA, 23 nt, Salmonella typhimurium LT2
cucauuuuugaguuugucaucca

SEQ ID NO: 1838752 - RNA, 16 nt, Salmonella typhimurium LT2
cucauuucacuauaaa

SEQ ID NO: 1838753 - RNA, 22 nt, Salmonella typhimurium LT2
cucauuucucaaaaacaccauu

SEQ ID NO: 1838754 - RNA, 15 nt, Salmonella typhimurium LT2
cucauuucaacauau

SEQ ID NO: 1838755 - RNA, 23 nt, Salmonella typhimurium LT2
cucauuggguaugcgcaaaucaa

SEQ ID NO: 1838756 - RNA, 12 nt, Salmonella typhimurium LT2
cucaggcaguaa

SEQ ID NO: 1838757 - RNA, 21 nt, Salmonella typhimurium LT2
cucauucgggcacuccggcuc

SEQ ID NO: 1838758 - RNA, 15 nt, Salmonella typhimurium LT2
cucauucagcggcug

SEQ ID NO: 1838759 - RNA, 16 nt, Salmonella typhimurium LT2
cucauucagcaacugc

SEQ ID NO: 1838760 - RNA, 23 nt, Salmonella typhimurium LT2
cucauuaccggcugccgauagca

SEQ ID NO: 1838761 - RNA, 18 nt, Salmonella typhimurium LT2
cucauuaauaacccaggu

SEQ ID NO: 1838762 - RNA, 16 nt, Salmonella typhimurium LT2
cucauuauccagugcg

SEQ ID NO: 1838763 - RNA, 15 nt, Salmonella typhimurium LT2
cucccauacccaggu

SEQ ID NO: 1838764 - RNA, 16 nt, Salmonella typhimurium LT2
cucccauuugcgggug

SEQ ID NO: 1838765 - RNA, 15 nt, Salmonella typhimurium LT2
cuccauuaaauuacu

SEQ ID NO: 1838766 - RNA, 20 nt, Salmonella typhimurium LT2
cuccagcgaggccucuccuc

SEQ ID NO: 1838767 - RNA, 20 nt, Salmonella typhimurium LT2
cuccagcgcauugcccuucg

SEQ ID NO: 1838768 - RNA, 15 nt, Salmonella typhimurium LT2
cuccagccgcugccu

SEQ ID NO: 1838769 - RNA, 17 nt, Salmonella typhimurium LT2
cuccagcccgaaaggac

SEQ ID NO: 1838770 - RNA, 13 nt, Salmonella typhimurium LT2
cuccagccagcgc

SEQ ID NO: 1838771 - RNA, 15 nt, Salmonella typhimurium LT2
cuccagccagcgcca

SEQ ID NO: 1838772 - RNA, 13 nt, Salmonella typhimurium LT2
cuccccugccggc

SEQ ID NO: 1838773 - RNA, 13 nt, Salmonella typhimurium LT2
cucccucaaccag

SEQ ID NO: 1838774 - RNA, 17 nt, Salmonella typhimurium LT2
cucccgucgccuguuuc

SEQ ID NO: 1838775 - RNA, 16 nt, Salmonella typhimurium LT2
cucccgugacguuuug

SEQ ID NO: 1838776 - RNA, 16 nt, Salmonella typhimurium LT2
cucccgguucgccgcu

SEQ ID NO: 1838777 - RNA, 14 nt, Salmonella typhimurium LT2
cuccccgccgcggc

SEQ ID NO: 1838778 - RNA, 14 nt, Salmonella typhimurium LT2
cuccccgccccagc

SEQ ID NO: 1838779 - RNA, 18 nt, Salmonella typhimurium LT2
cucccccggcaccacgca

SEQ ID NO: 1838780 - RNA, 14 nt, Salmonella typhimurium LT2
cucccccggcacca

SEQ ID NO: 1838781 - RNA, 13 nt, Salmonella typhimurium LT2
cucccccccuucc

SEQ ID NO: 1838782 - RNA, 22 nt, Salmonella typhimurium LT2
cuccccaacaucauuacugcuu

SEQ ID NO: 1838783 - RNA, 18 nt, Salmonella typhimurium LT2
cuccccacgaaagucugu

SEQ ID NO: 1838784 - RNA, 21 nt, Salmonella typhimurium LT2
cuccccaggcgcuauucccag

SEQ ID NO: 1838785 - RNA, 21 nt, Salmonella typhimurium LT2
cuccgguaucgccggcagacg

SEQ ID NO: 1838786 - RNA, 14 nt, Salmonella typhimurium LT2
cuccguaggccccg

SEQ ID NO: 1838787 - RNA, 16 nt, Salmonella typhimurium LT2
cuccuaagagaaaacc

SEQ ID NO: 1838788 - RNA, 21 nt, Salmonella typhimurium LT2
cuccuacaccaccagcccggc

SEQ ID NO: 1838789 - RNA, 15 nt, Salmonella typhimurium LT2
cuccuaagagaaaac

SEQ ID NO: 1838790 - RNA, 19 nt, Salmonella typhimurium LT2
cuccgggauagcaaucucg

SEQ ID NO: 1838791 - RNA, 14 nt, Salmonella typhimurium LT2
cuccggcugaagcc

SEQ ID NO: 1838792 - RNA, 18 nt, Salmonella typhimurium LT2
cuccgcguagcccagcgc

SEQ ID NO: 1838793 - RNA, 13 nt, Salmonella typhimurium LT2
cuccgcuauaaaa

SEQ ID NO: 1838794 - RNA, 21 nt, Salmonella typhimurium LT2
cuccgcuauaaaaauuauaac

SEQ ID NO: 1838795 - RNA, 18 nt, Salmonella typhimurium LT2
cuccgagacucaaagaaa

SEQ ID NO: 1838796 - RNA, 18 nt, Salmonella typhimurium LT2
cuccgacaaacuucaucg

SEQ ID NO: 1838797 - RNA, 17 nt, Salmonella typhimurium LT2
cucgccugcgcuuugug

SEQ ID NO: 1838798 - RNA, 21 nt, Salmonella typhimurium LT2
cucgccgguuuuuuuacucug

SEQ ID NO: 1838799 - RNA, 18 nt, Salmonella typhimurium LT2
cucgccgguagccagcca

SEQ ID NO: 1838800 - RNA, 19 nt, Salmonella typhimurium LT2
cucgcgcagaaucagcgug

SEQ ID NO: 1838801 - RNA, 13 nt, Salmonella typhimurium LT2
cucgcgcugugua

SEQ ID NO: 1838802 - RNA, 14 nt, Salmonella typhimurium LT2
cucgcccgccagau

SEQ ID NO: 1838803 - RNA, 14 nt, Salmonella typhimurium LT2
cucgcccgcagcaa

SEQ ID NO: 1838804 - RNA, 22 nt, Salmonella typhimurium LT2
cucgcccuucgggccgccgcaa

SEQ ID NO: 1838805 - RNA, 18 nt, Salmonella typhimurium LT2
cucgccgcguuuaagccc

SEQ ID NO: 1838806 - RNA, 15 nt, Salmonella typhimurium LT2
cucgccgccuccccc

SEQ ID NO: 1838807 - RNA, 11 nt, Salmonella typhimurium LT2
cucgccgccgg

SEQ ID NO: 1838808 - RNA, 14 nt, Salmonella typhimurium LT2
cucgcccagcgccu

SEQ ID NO: 1838809 - RNA, 22 nt, Salmonella typhimurium LT2
cucgcccauuugcgagaaaaag

SEQ ID NO: 1838810 - RNA, 19 nt, Salmonella typhimurium LT2
cucgccaccggcacaucca

SEQ ID NO: 1838811 - RNA, 17 nt, Salmonella typhimurium LT2
cucgccaaugccgcaac

SEQ ID NO: 1838812 - RNA, 22 nt, Salmonella typhimurium LT2
cucgccagcauacgucugcgcu

SEQ ID NO: 1838813 - RNA, 20 nt, Salmonella typhimurium LT2
cucgccaaagcgcugcugcu

SEQ ID NO: 1838814 - RNA, 19 nt, Salmonella typhimurium LT2
cucgccaaaucaugcccaa

SEQ ID NO: 1838815 - RNA, 14 nt, Salmonella typhimurium LT2
cucgcauccuccau

SEQ ID NO: 1838816 - RNA, 17 nt, Salmonella typhimurium LT2
cucgcacucgccgccaa

SEQ ID NO: 1838817 - RNA, 14 nt, Salmonella typhimurium LT2
cucgcacaccagau

SEQ ID NO: 1838818 - RNA, 13 nt, Salmonella typhimurium LT2
cucgcaaaacaug

SEQ ID NO: 1838819 - RNA, 15 nt, Salmonella typhimurium LT2
cucgacgcacuccag

SEQ ID NO: 1838820 - RNA, 22 nt, Salmonella typhimurium LT2
cucgauuccugacgcacagugu

SEQ ID NO: 1838821 - RNA, 17 nt, Salmonella typhimurium LT2
cucgauuaccguguuua

SEQ ID NO: 1838822 - RNA, 22 nt, Salmonella typhimurium LT2
cucgauggcuuucuaccugcaa

SEQ ID NO: 1838823 - RNA, 12 nt, Salmonella typhimurium LT2
cucgaaccaacg

SEQ ID NO: 1838824 - RNA, 12 nt, Salmonella typhimurium LT2
cuccuccaucag

SEQ ID NO: 1838825 - RNA, 22 nt, Salmonella typhimurium LT2
cuccuccaucaguucggcgcgc

SEQ ID NO: 1838826 - RNA, 13 nt, Salmonella typhimurium LT2
cuccuccggcuuc

SEQ ID NO: 1838827 - RNA, 17 nt, Salmonella typhimurium LT2
cucgaccccuucgccuu

SEQ ID NO: 1838828 - RNA, 15 nt, Salmonella typhimurium LT2
cucggugccgcugcu

SEQ ID NO: 1838829 - RNA, 18 nt, Salmonella typhimurium LT2
cucgguauccagcucguc

SEQ ID NO: 1838830 - RNA, 15 nt, Salmonella typhimurium LT2
cucggguauggcggc

SEQ ID NO: 1838831 - RNA, 18 nt, Salmonella typhimurium LT2
cucggguacacucucggg

SEQ ID NO: 1838832 - RNA, 18 nt, Salmonella typhimurium LT2
cucgcgggcauacucucc

SEQ ID NO: 1838833 - RNA, 14 nt, Salmonella typhimurium LT2
cucgcugacgccag

SEQ ID NO: 1838834 - RNA, 19 nt, Salmonella typhimurium LT2
cucgcugcgcucgcccuuc

SEQ ID NO: 1838835 - RNA, 21 nt, Salmonella typhimurium LT2
cucuaaggcggugucaucuuc

SEQ ID NO: 1838836 - RNA, 24 nt, Salmonella typhimurium LT2
cucuaacgucagcgccacccauuu

SEQ ID NO: 1838837 - RNA, 22 nt, Salmonella typhimurium LT2
cucuaacgucagcgccacccau

SEQ ID NO: 1838838 - RNA, 12 nt, Salmonella typhimurium LT2
cucuaaccaacu

SEQ ID NO: 1838839 - RNA, 17 nt, Salmonella typhimurium LT2
cucuaaccaacugagcu

SEQ ID NO: 1838840 - RNA, 20 nt, Salmonella typhimurium LT2
cucgugaacagggugacuca

SEQ ID NO: 1838841 - RNA, 17 nt, Salmonella typhimurium LT2
cucgugaucgccaaagc

SEQ ID NO: 1838842 - RNA, 13 nt, Salmonella typhimurium LT2
cucgguuuauccc

SEQ ID NO: 1838843 - RNA, 13 nt, Salmonella typhimurium LT2
cuauuuucucuuc

SEQ ID NO: 1838844 - RNA, 19 nt, Salmonella typhimurium LT2
cuauuuucucuuccacaaa

SEQ ID NO: 1838845 - RNA, 23 nt, Salmonella typhimurium LT2
cuauuuucugcucgggccagcuc

SEQ ID NO: 1838846 - RNA, 19 nt, Salmonella typhimurium LT2
cuauuuuaaauucccagcg

SEQ ID NO: 1838847 - RNA, 21 nt, Salmonella typhimurium LT2
cuauuucuguauaauuauuug

SEQ ID NO: 1838848 - RNA, 13 nt, Salmonella typhimurium LT2
cuauuugcagauu

SEQ ID NO: 1838849 - RNA, 21 nt, Salmonella typhimurium LT2
cuauuugcgcaucauuuuuau

SEQ ID NO: 1838850 - RNA, 13 nt, Salmonella typhimurium LT2
cucaaaaagagga

SEQ ID NO: 1838851 - RNA, 15 nt, Salmonella typhimurium LT2
cucaaaaagaggaaa

SEQ ID NO: 1838852 - RNA, 13 nt, Salmonella typhimurium LT2
cuauuuuuucaau

SEQ ID NO: 1838853 - RNA, 22 nt, Salmonella typhimurium LT2
cuauuucaguacagccaaaaau

SEQ ID NO: 1838854 - RNA, 19 nt, Salmonella typhimurium LT2
cuauuuaaaaaccgccccc

SEQ ID NO: 1838855 - RNA, 15 nt, Salmonella typhimurium LT2
cuauucguucucuga

SEQ ID NO: 1838856 - RNA, 16 nt, Salmonella typhimurium LT2
cuauugccugauggcg

SEQ ID NO: 1838857 - RNA, 22 nt, Salmonella typhimurium LT2
cuauuggaguuaaggauauaua

SEQ ID NO: 1838858 - RNA, 15 nt, Salmonella typhimurium LT2
cuauagauauuaaac

SEQ ID NO: 1838859 - RNA, 23 nt, Salmonella typhimurium LT2
cuauagaggugagauauggcacu

SEQ ID NO: 1838860 - RNA, 12 nt, Salmonella typhimurium LT2
cuaucuuuuuaa

SEQ ID NO: 1838861 - RNA, 12 nt, Salmonella typhimurium LT2
cuaugacaaguc

SEQ ID NO: 1838862 - RNA, 18 nt, Salmonella typhimurium LT2
cuaugguaauuuaaagua

SEQ ID NO: 1838863 - RNA, 16 nt, Salmonella typhimurium LT2
cuauuccaguuuuuau

SEQ ID NO: 1838864 - RNA, 21 nt, Salmonella typhimurium LT2
cuauuccgcgguguccugcuu

SEQ ID NO: 1838865 - RNA, 15 nt, Salmonella typhimurium LT2
cuauucagcaguuca

SEQ ID NO: 1838866 - RNA, 21 nt, Salmonella typhimurium LT2
cuauucaugccgaccagggcg

SEQ ID NO: 1838867 - RNA, 14 nt, Salmonella typhimurium LT2
cuauuauuuuucua

SEQ ID NO: 1838868 - RNA, 18 nt, Salmonella typhimurium LT2
cucaaagcguuauuugca

SEQ ID NO: 1838869 - RNA, 16 nt, Salmonella typhimurium LT2
cuauuuuuugcuggcg

SEQ ID NO: 1838870 - RNA, 15 nt, Salmonella typhimurium LT2
cucaaucugaugaug

SEQ ID NO: 1838871 - RNA, 22 nt, Salmonella typhimurium LT2
cucaccagcacgcaggcauccg

SEQ ID NO: 1838872 - RNA, 13 nt, Salmonella typhimurium LT2
cucagccaggcgc

SEQ ID NO: 1838873 - RNA, 17 nt, Salmonella typhimurium LT2
cucagccagguauuuag

SEQ ID NO: 1838874 - RNA, 19 nt, Salmonella typhimurium LT2
cucagccaggucugaacca

SEQ ID NO: 1838875 - RNA, 14 nt, Salmonella typhimurium LT2
cucagcgccccagc

SEQ ID NO: 1838876 - RNA, 19 nt, Salmonella typhimurium LT2
cucagcuaaaaacagcgca

SEQ ID NO: 1838877 - RNA, 23 nt, Salmonella typhimurium LT2
cucacggagaaaagcgaaaauaa

SEQ ID NO: 1838878 - RNA, 15 nt, Salmonella typhimurium LT2
cucacgcucauagcc

SEQ ID NO: 1838879 - RNA, 14 nt, Salmonella typhimurium LT2
cucacggucuccug

SEQ ID NO: 1838880 - RNA, 13 nt, Salmonella typhimurium LT2
cucacuguugaua

SEQ ID NO: 1838881 - RNA, 20 nt, Salmonella typhimurium LT2
cucagaaaauuauuuuaaau

SEQ ID NO: 1838882 - RNA, 18 nt, Salmonella typhimurium LT2
cucacuuuucuuuccugc

SEQ ID NO: 1838883 - RNA, 13 nt, Salmonella typhimurium LT2
cuaguauauuaaa

SEQ ID NO: 1838884 - RNA, 18 nt, Salmonella typhimurium LT2
cuaguaugucuaugauuu

SEQ ID NO: 1838885 - RNA, 11 nt, Salmonella typhimurium LT2
cuauaaaaauc

SEQ ID NO: 1838886 - RNA, 15 nt, Salmonella typhimurium LT2
cuacgcucauaaaaa

SEQ ID NO: 1838887 - RNA, 19 nt, Salmonella typhimurium LT2
cuacgcgauaaaaaacgcc

SEQ ID NO: 1838888 - RNA, 13 nt, Salmonella typhimurium LT2
cuacgccuccugc

SEQ ID NO: 1838889 - RNA, 17 nt, Salmonella typhimurium LT2
cuacgcuuauccggcuu

SEQ ID NO: 1838890 - RNA, 18 nt, Salmonella typhimurium LT2
cuacgcuucguauuucuu

SEQ ID NO: 1838891 - RNA, 19 nt, Salmonella typhimurium LT2
cuacggauuaugucugcug

SEQ ID NO: 1838892 - RNA, 13 nt, Salmonella typhimurium LT2
cuacggcaaacac

SEQ ID NO: 1838893 - RNA, 15 nt, Salmonella typhimurium LT2
cuacgguaaacugga

SEQ ID NO: 1838894 - RNA, 22 nt, Salmonella typhimurium LT2
cuacgggucaugguaggccuga

SEQ ID NO: 1838895 - RNA, 14 nt, Salmonella typhimurium LT2
cuacguuccaugcg

SEQ ID NO: 1838896 - RNA, 22 nt, Salmonella typhimurium LT2
cuagccgccguguugugugccg

SEQ ID NO: 1838897 - RNA, 13 nt, Salmonella typhimurium LT2
cuagcauaagcac

SEQ ID NO: 1838898 - RNA, 22 nt, Salmonella typhimurium LT2
cuacagacgcauuaaaaugaug

SEQ ID NO: 1838899 - RNA, 19 nt, Salmonella typhimurium LT2
cuacaccguauccggccug

SEQ ID NO: 1838900 - RNA, 22 nt, Salmonella typhimurium LT2
cuacaccguauccggccugcag

SEQ ID NO: 1838901 - RNA, 13 nt, Salmonella typhimurium LT2
cuacacaucaucu

SEQ ID NO: 1838902 - RNA, 20 nt, Salmonella typhimurium LT2
cuacaauccaggacguccug

SEQ ID NO: 1838903 - RNA, 21 nt, Salmonella typhimurium LT2
cuacaggucgacgugaacugc

SEQ ID NO: 1838904 - RNA, 16 nt, Salmonella typhimurium LT2
cuacaugucuccucag

SEQ ID NO: 1838905 - RNA, 19 nt, Salmonella typhimurium LT2
cuacaucuccuuaacacaa

SEQ ID NO: 1838906 - RNA, 16 nt, Salmonella typhimurium LT2
cuacauuccaucaugu

SEQ ID NO: 1838907 - RNA, 18 nt, Salmonella typhimurium LT2
cuacauuaaugucaugaa

SEQ ID NO: 1838908 - RNA, 18 nt, Salmonella typhimurium LT2
cuacauagcuauauuuuu

SEQ ID NO: 1838909 - RNA, 12 nt, Salmonella typhimurium LT2
cuacauacugcu

SEQ ID NO: 1838910 - RNA, 22 nt, Salmonella typhimurium LT2
cuaccgucgacgucuuucuuaa

SEQ ID NO: 1838911 - RNA, 18 nt, Salmonella typhimurium LT2
cuaccguuucgaccguga

SEQ ID NO: 1838912 - RNA, 19 nt, Salmonella typhimurium LT2
cuaccgucgacgucuuucu

SEQ ID NO: 1838913 - RNA, 14 nt, Salmonella typhimurium LT2
cuaccggaaaacag

SEQ ID NO: 1838914 - RNA, 17 nt, Salmonella typhimurium LT2
cuaccgccacuuccgcu

SEQ ID NO: 1838915 - RNA, 13 nt, Salmonella typhimurium LT2
cuaccgccauacg

SEQ ID NO: 1838916 - RNA, 20 nt, Salmonella typhimurium LT2
cuaccgccguuucguugcca

SEQ ID NO: 1838917 - RNA, 16 nt, Salmonella typhimurium LT2
cuaccgcgaugugcug

SEQ ID NO: 1838918 - RNA, 14 nt, Salmonella typhimurium LT2
cuaccgaggcaggg

SEQ ID NO: 1838919 - RNA, 16 nt, Salmonella typhimurium LT2
cuacccuuucacccgc

SEQ ID NO: 1838920 - RNA, 16 nt, Salmonella typhimurium LT2
cuaccauuacccgaac

SEQ ID NO: 1838921 - RNA, 13 nt, Salmonella typhimurium LT2
cuaccauaaugau

SEQ ID NO: 1838922 - RNA, 20 nt, Salmonella typhimurium LT2
cuaccagcgcgccagcgcca

SEQ ID NO: 1838923 - RNA, 14 nt, Salmonella typhimurium LT2
cuaccaggcaaagc

SEQ ID NO: 1838924 - RNA, 18 nt, Salmonella typhimurium LT2
cuaccagguugcucaucu

SEQ ID NO: 1838925 - RNA, 16 nt, Salmonella typhimurium LT2
cuaccaacugagcuaa

SEQ ID NO: 1838926 - RNA, 13 nt, Salmonella typhimurium LT2
cguaccccaaucu

SEQ ID NO: 1838927 - RNA, 17 nt, Salmonella typhimurium LT2
cguaccggcgcucagcc

SEQ ID NO: 1838928 - RNA, 18 nt, Salmonella typhimurium LT2
cguaccguaaaccgcguu

SEQ ID NO: 1838929 - RNA, 16 nt, Salmonella typhimurium LT2
cguacgcauccgcguu

SEQ ID NO: 1838930 - RNA, 19 nt, Salmonella typhimurium LT2
cguacuaaagagcgccuga

SEQ ID NO: 1838931 - RNA, 19 nt, Salmonella typhimurium LT2
cguacucggauagcuacga

SEQ ID NO: 1838932 - RNA, 21 nt, Salmonella typhimurium LT2
cguacuccaggcgcugcuggc

SEQ ID NO: 1838933 - RNA, 22 nt, Salmonella typhimurium LT2
cguacuccaggcgcugcuggca

SEQ ID NO: 1838934 - RNA, 21 nt, Salmonella typhimurium LT2
cguacugaaauaacucuggau

SEQ ID NO: 1838935 - RNA, 19 nt, Salmonella typhimurium LT2
cguacugaguucgcucagu

SEQ ID NO: 1838936 - RNA, 13 nt, Salmonella typhimurium LT2
cguacuuucaaac

SEQ ID NO: 1838937 - RNA, 20 nt, Salmonella typhimurium LT2
cguacauguccagaucuuca

SEQ ID NO: 1838938 - RNA, 19 nt, Salmonella typhimurium LT2
cguaauucaugcaacuuca

SEQ ID NO: 1838939 - RNA, 18 nt, Salmonella typhimurium LT2
cguacauaacagcagcag

SEQ ID NO: 1838940 - RNA, 20 nt, Salmonella typhimurium LT2
cguaaugcgccccggcggcg

SEQ ID NO: 1838941 - RNA, 15 nt, Salmonella typhimurium LT2
cguaauugcgccugg

SEQ ID NO: 1838942 - RNA, 21 nt, Salmonella typhimurium LT2
cguacaaaggggccacaggcg

SEQ ID NO: 1838943 - RNA, 22 nt, Salmonella typhimurium LT2
cguaauuaaccgcgccgcuggc

SEQ ID NO: 1838944 - RNA, 13 nt, Salmonella typhimurium LT2
cguauccagcgcg

SEQ ID NO: 1838945 - RNA, 19 nt, Salmonella typhimurium LT2
cguauccccagucuuccug

SEQ ID NO: 1838946 - RNA, 19 nt, Salmonella typhimurium LT2
cguauauacccaaaauaau

SEQ ID NO: 1838947 - RNA, 22 nt, Salmonella typhimurium LT2
cguaggccugauaagcgcagcg

SEQ ID NO: 1838948 - RNA, 17 nt, Salmonella typhimurium LT2
cguaggcaacaauuucu

SEQ ID NO: 1838949 - RNA, 14 nt, Salmonella typhimurium LT2
cguagguuggcuga

SEQ ID NO: 1838950 - RNA, 19 nt, Salmonella typhimurium LT2
cguagacgaccagggaacu

SEQ ID NO: 1838951 - RNA, 15 nt, Salmonella typhimurium LT2
cguagaucuuuugcg

SEQ ID NO: 1838952 - RNA, 13 nt, Salmonella typhimurium LT2
cguagaucgccag

SEQ ID NO: 1838953 - RNA, 17 nt, Salmonella typhimurium LT2
cguagccgccgagcgcc

SEQ ID NO: 1838954 - RNA, 24 nt, Salmonella typhimurium LT2
cguagcaucucuucgacaucuuca

SEQ ID NO: 1838955 - RNA, 16 nt, Salmonella typhimurium LT2
cguagccaacacauca

SEQ ID NO: 1838956 - RNA, 18 nt, Salmonella typhimurium LT2
cguagauuuucaucauau

SEQ ID NO: 1838957 - RNA, 12 nt, Salmonella typhimurium LT2
cguagccgcgcg

SEQ ID NO: 1838958 - RNA, 15 nt, Salmonella typhimurium LT2
cguagccgcgccaga

SEQ ID NO: 1838959 - RNA, 14 nt, Salmonella typhimurium LT2
cguagccgcgcgcc

SEQ ID NO: 1838960 - RNA, 18 nt, Salmonella typhimurium LT2
cguccgcagccgacgcau

SEQ ID NO: 1838961 - RNA, 17 nt, Salmonella typhimurium LT2
cguccgccaggcccaug

SEQ ID NO: 1838962 - RNA, 13 nt, Salmonella typhimurium LT2
cgucccucgccgg

SEQ ID NO: 1838963 - RNA, 22 nt, Salmonella typhimurium LT2
cguccagccagcguuucuggaa

SEQ ID NO: 1838964 - RNA, 13 nt, Salmonella typhimurium LT2
cguccagcccggc

SEQ ID NO: 1838965 - RNA, 13 nt, Salmonella typhimurium LT2
cguccagauccac

SEQ ID NO: 1838966 - RNA, 14 nt, Salmonella typhimurium LT2
cguccagacucugc

SEQ ID NO: 1838967 - RNA, 17 nt, Salmonella typhimurium LT2
cgucccggucggcgcau

SEQ ID NO: 1838968 - RNA, 20 nt, Salmonella typhimurium LT2
cgucccggucggcgcauggc

SEQ ID NO: 1838969 - RNA, 13 nt, Salmonella typhimurium LT2
cguccacaccuuc

SEQ ID NO: 1838970 - RNA, 14 nt, Salmonella typhimurium LT2
cguccacaccuucc

SEQ ID NO: 1838971 - RNA, 15 nt, Salmonella typhimurium LT2
cguccacaccuucca

SEQ ID NO: 1838972 - RNA, 15 nt, Salmonella typhimurium LT2
cgucaugcucgcuuu

SEQ ID NO: 1838973 - RNA, 18 nt, Salmonella typhimurium LT2
cgucaugcucgcuuucca

SEQ ID NO: 1838974 - RNA, 15 nt, Salmonella typhimurium LT2
cgucaugucucagac

SEQ ID NO: 1838975 - RNA, 15 nt, Salmonella typhimurium LT2
cguccacauccccgc

SEQ ID NO: 1838976 - RNA, 15 nt, Salmonella typhimurium LT2
cguccaccagcacag

SEQ ID NO: 1838977 - RNA, 18 nt, Salmonella typhimurium LT2
cguccaccagcacaggcg

SEQ ID NO: 1838978 - RNA, 11 nt, Salmonella typhimurium LT2
cgucagauucu

SEQ ID NO: 1838979 - RNA, 15 nt, Salmonella typhimurium LT2
cgucagcaacaccac

SEQ ID NO: 1838980 - RNA, 22 nt, Salmonella typhimurium LT2
cgucagcaacaccaccgcccgc

SEQ ID NO: 1838981 - RNA, 18 nt, Salmonella typhimurium LT2
cgucagauuauggcuaca

SEQ ID NO: 1838982 - RNA, 22 nt, Salmonella typhimurium LT2
cgucacugucagcaucagugga

SEQ ID NO: 1838983 - RNA, 12 nt, Salmonella typhimurium LT2
cgucaucauugc

SEQ ID NO: 1838984 - RNA, 22 nt, Salmonella typhimurium LT2
cgucaucauuaccuuuuccggc

SEQ ID NO: 1838985 - RNA, 15 nt, Salmonella typhimurium LT2
cgucaggguuaucgu

SEQ ID NO: 1838986 - RNA, 13 nt, Salmonella typhimurium LT2
cgucauccugcaa

SEQ ID NO: 1838987 - RNA, 17 nt, Salmonella typhimurium LT2
cgucauccggcaaucaa

SEQ ID NO: 1838988 - RNA, 15 nt, Salmonella typhimurium LT2
cgucaucgacauuaa

SEQ ID NO: 1838989 - RNA, 17 nt, Salmonella typhimurium LT2
cguauucggaauaaugu

SEQ ID NO: 1838990 - RNA, 19 nt, Salmonella typhimurium LT2
cguauucucaaccagccga

SEQ ID NO: 1838991 - RNA, 17 nt, Salmonella typhimurium LT2
cguauuucacuuuugcc

SEQ ID NO: 1838992 - RNA, 17 nt, Salmonella typhimurium LT2
cguauugagcagcggcu

SEQ ID NO: 1838993 - RNA, 12 nt, Salmonella typhimurium LT2
cgucacucccug

SEQ ID NO: 1838994 - RNA, 17 nt, Salmonella typhimurium LT2
cgucacgcaacaggccg

SEQ ID NO: 1838995 - RNA, 14 nt, Salmonella typhimurium LT2
cgucacgaccggcg

SEQ ID NO: 1838996 - RNA, 15 nt, Salmonella typhimurium LT2
cgucaccgaauagcg

SEQ ID NO: 1838997 - RNA, 18 nt, Salmonella typhimurium LT2
cgucaccgggcugcagcc

SEQ ID NO: 1838998 - RNA, 23 nt, Salmonella typhimurium LT2
cgugcgagauaaccaucgcgcag

SEQ ID NO: 1838999 - RNA, 17 nt, Salmonella typhimurium LT2
cgugccugccgcagaag

SEQ ID NO: 1839000 - RNA, 15 nt, Salmonella typhimurium LT2
cgugcucauccaacu

SEQ ID NO: 1839001 - RNA, 19 nt, Salmonella typhimurium LT2
cgugaugcgacgcgcucac

SEQ ID NO: 1839002 - RNA, 14 nt, Salmonella typhimurium LT2
cgugauugagcaga

SEQ ID NO: 1839003 - RNA, 22 nt, Salmonella typhimurium LT2
cgugauugagcagaucagcacg

SEQ ID NO: 1839004 - RNA, 13 nt, Salmonella typhimurium LT2
cgugcagcgccgc

SEQ ID NO: 1839005 - RNA, 17 nt, Salmonella typhimurium LT2
cgugcaguuuugcuuca

SEQ ID NO: 1839006 - RNA, 15 nt, Salmonella typhimurium LT2
cgugaagaucagcag

SEQ ID NO: 1839007 - RNA, 20 nt, Salmonella typhimurium LT2
cgugaagaucagcagagcgg

SEQ ID NO: 1839008 - RNA, 22 nt, Salmonella typhimurium LT2
cgugagccacuauccagucagc

SEQ ID NO: 1839009 - RNA, 16 nt, Salmonella typhimurium LT2
cgugagcgaagcgccg

SEQ ID NO: 1839010 - RNA, 17 nt, Salmonella typhimurium LT2
cgugagcgcauccggca

SEQ ID NO: 1839011 - RNA, 13 nt, Salmonella typhimurium LT2
cgugagcgcgccg

SEQ ID NO: 1839012 - RNA, 14 nt, Salmonella typhimurium LT2
cgucucggccuggc

SEQ ID NO: 1839013 - RNA, 23 nt, Salmonella typhimurium LT2
cgucucgccgcggugauccuccu

SEQ ID NO: 1839014 - RNA, 20 nt, Salmonella typhimurium LT2
cgucugguaauaggccggag

SEQ ID NO: 1839015 - RNA, 19 nt, Salmonella typhimurium LT2
cgucugguacggccaccag

SEQ ID NO: 1839016 - RNA, 20 nt, Salmonella typhimurium LT2
cgucugguacggccaccagg

SEQ ID NO: 1839017 - RNA, 14 nt, Salmonella typhimurium LT2
cgucuuccuuccac

SEQ ID NO: 1839018 - RNA, 17 nt, Salmonella typhimurium LT2
cgucugcgucuucuucc

SEQ ID NO: 1839019 - RNA, 16 nt, Salmonella typhimurium LT2
cgucugcgcuuucagc

SEQ ID NO: 1839020 - RNA, 23 nt, Salmonella typhimurium LT2
cgucggugguuuuaacccccagc

SEQ ID NO: 1839021 - RNA, 18 nt, Salmonella typhimurium LT2
cgucgguucgucgagcag

SEQ ID NO: 1839022 - RNA, 21 nt, Salmonella typhimurium LT2
cgucgguucgucgagcagcag

SEQ ID NO: 1839023 - RNA, 23 nt, Salmonella typhimurium LT2
cgucgggccgcgcugcgccugcu

SEQ ID NO: 1839024 - RNA, 16 nt, Salmonella typhimurium LT2
cgucgggccauucccc

SEQ ID NO: 1839025 - RNA, 22 nt, Salmonella typhimurium LT2
cgucgguaaaaaugcaaugucu

SEQ ID NO: 1839026 - RNA, 19 nt, Salmonella typhimurium LT2
cgucgugcagcgccgccug

SEQ ID NO: 1839027 - RNA, 21 nt, Salmonella typhimurium LT2
cgucgugaguggcggcacgca

SEQ ID NO: 1839028 - RNA, 17 nt, Salmonella typhimurium LT2
cgucguuucguguuguc

SEQ ID NO: 1839029 - RNA, 14 nt, Salmonella typhimurium LT2
cgucgcgcgccgcc

SEQ ID NO: 1839030 - RNA, 16 nt, Salmonella typhimurium LT2
cgucgcgcgccgccuc

SEQ ID NO: 1839031 - RNA, 17 nt, Salmonella typhimurium LT2
cgucgccggaaugcgaa

SEQ ID NO: 1839032 - RNA, 22 nt, Salmonella typhimurium LT2
cgucgccauauccaagccccuc

SEQ ID NO: 1839033 - RNA, 21 nt, Salmonella typhimurium LT2
cgucgccauccaccaggacau

SEQ ID NO: 1839034 - RNA, 20 nt, Salmonella typhimurium LT2
cgucgccaaagcagcugcug

SEQ ID NO: 1839035 - RNA, 15 nt, Salmonella typhimurium LT2
cgucggccagcgccg

SEQ ID NO: 1839036 - RNA, 23 nt, Salmonella typhimurium LT2
cgucggcauggucagcauaauau

SEQ ID NO: 1839037 - RNA, 17 nt, Salmonella typhimurium LT2
cgucgcucccggcacca

SEQ ID NO: 1839038 - RNA, 16 nt, Salmonella typhimurium LT2
cgucgcuacgggcgcg

SEQ ID NO: 1839039 - RNA, 15 nt, Salmonella typhimurium LT2
cuaacgaggccacca

SEQ ID NO: 1839040 - RNA, 13 nt, Salmonella typhimurium LT2
cuaacgccugcau

SEQ ID NO: 1839041 - RNA, 17 nt, Salmonella typhimurium LT2
cuaacgcccucucuccg

SEQ ID NO: 1839042 - RNA, 18 nt, Salmonella typhimurium LT2
cuaacgugaaccuccugu

SEQ ID NO: 1839043 - RNA, 19 nt, Salmonella typhimurium LT2
cuaacgugaaccuccugug

SEQ ID NO: 1839044 - RNA, 20 nt, Salmonella typhimurium LT2
cuaacugcggcuuacccuga

SEQ ID NO: 1839045 - RNA, 21 nt, Salmonella typhimurium LT2
cuaacuggucaaacaaaucau

SEQ ID NO: 1839046 - RNA, 14 nt, Salmonella typhimurium LT2
cuaacuggaaaaag

SEQ ID NO: 1839047 - RNA, 14 nt, Salmonella typhimurium LT2
cuaaaccacggaau

SEQ ID NO: 1839048 - RNA, 21 nt, Salmonella typhimurium LT2
cuaaaccacaugaccagcgcc

SEQ ID NO: 1839049 - RNA, 18 nt, Salmonella typhimurium LT2
cuaauaaaauaacuauaa

SEQ ID NO: 1839050 - RNA, 19 nt, Salmonella typhimurium LT2
cuaaguuaaccgguaugaa

SEQ ID NO: 1839051 - RNA, 15 nt, Salmonella typhimurium LT2
cuaagugagcauuac

SEQ ID NO: 1839052 - RNA, 22 nt, Salmonella typhimurium LT2
cuaaguggauagaguuaaaagg

SEQ ID NO: 1839053 - RNA, 20 nt, Salmonella typhimurium LT2
cuaagguugaaagaccuaaa

SEQ ID NO: 1839054 - RNA, 16 nt, Salmonella typhimurium LT2
cuaagccggcaggcag

SEQ ID NO: 1839055 - RNA, 21 nt, Salmonella typhimurium LT2
cuaagagugacgguuuucacu

SEQ ID NO: 1839056 - RNA, 13 nt, Salmonella typhimurium LT2
cuaagagaaaacc

SEQ ID NO: 1839057 - RNA, 18 nt, Salmonella typhimurium LT2
cuaagaccagcaccaucu

SEQ ID NO: 1839058 - RNA, 14 nt, Salmonella typhimurium LT2
cuaagaauuuaauc

SEQ ID NO: 1839059 - RNA, 14 nt, Salmonella typhimurium LT2
cuaauuaauucuaa

SEQ ID NO: 1839060 - RNA, 17 nt, Salmonella typhimurium LT2
cuaauuaaaaagagaaa

SEQ ID NO: 1839061 - RNA, 21 nt, Salmonella typhimurium LT2
cuaauuaaaaagagaaaaaau

SEQ ID NO: 1839062 - RNA, 19 nt, Salmonella typhimurium LT2
cuaauugcccccuuuuuau

SEQ ID NO: 1839063 - RNA, 23 nt, Salmonella typhimurium LT2
cuaauugcccccuuuuuauucau

SEQ ID NO: 1839064 - RNA, 20 nt, Salmonella typhimurium LT2
cuaauuuauugccacgccau

SEQ ID NO: 1839065 - RNA, 17 nt, Salmonella typhimurium LT2
cuaauucucccugccag

SEQ ID NO: 1839066 - RNA, 15 nt, Salmonella typhimurium LT2
cuaauucuucguagg

SEQ ID NO: 1839067 - RNA, 13 nt, Salmonella typhimurium LT2
cuaauuuuacuuu

SEQ ID NO: 1839068 - RNA, 15 nt, Salmonella typhimurium LT2
cuaauuuucagggug

SEQ ID NO: 1839069 - RNA, 18 nt, Salmonella typhimurium LT2
cuacaaauuacacaauau

SEQ ID NO: 1839070 - RNA, 22 nt, Salmonella typhimurium LT2
cuacaaauuacacaauaucaau

SEQ ID NO: 1839071 - RNA, 20 nt, Salmonella typhimurium LT2
cuacaacucagcguaacugu

SEQ ID NO: 1839072 - RNA, 15 nt, Salmonella typhimurium LT2
cuaaugcaauaaacu

SEQ ID NO: 1839073 - RNA, 13 nt, Salmonella typhimurium LT2
cuaaugccuggca

SEQ ID NO: 1839074 - RNA, 21 nt, Salmonella typhimurium LT2
cuaaugauuaucuuuuuuagu

SEQ ID NO: 1839075 - RNA, 21 nt, Salmonella typhimurium LT2
cuaaugaacggaggucaugga

SEQ ID NO: 1839076 - RNA, 20 nt, Salmonella typhimurium LT2
cuaaucucgccgguuuauuu

SEQ ID NO: 1839077 - RNA, 19 nt, Salmonella typhimurium LT2
cuaauccggccugucagga

SEQ ID NO: 1839078 - RNA, 16 nt, Salmonella typhimurium LT2
cuaauccccauuuuuu

SEQ ID NO: 1839079 - RNA, 20 nt, Salmonella typhimurium LT2
cuaauccccauuuuuuucag

SEQ ID NO: 1839080 - RNA, 23 nt, Salmonella typhimurium LT2
cuaaucgcgacgacgcugguucc

SEQ ID NO: 1839081 - RNA, 17 nt, Salmonella typhimurium LT2
cguuguguccagggugu

SEQ ID NO: 1839082 - RNA, 19 nt, Salmonella typhimurium LT2
cguugccauagcgggcagc

SEQ ID NO: 1839083 - RNA, 13 nt, Salmonella typhimurium LT2
cguuucuacaaua

SEQ ID NO: 1839084 - RNA, 20 nt, Salmonella typhimurium LT2
cguuucgggcgcaugcugcc

SEQ ID NO: 1839085 - RNA, 16 nt, Salmonella typhimurium LT2
cguuucguguaaauga

SEQ ID NO: 1839086 - RNA, 19 nt, Salmonella typhimurium LT2
cguuucguuuagcgccugc

SEQ ID NO: 1839087 - RNA, 21 nt, Salmonella typhimurium LT2
cguuuguaacagcaggacccg

SEQ ID NO: 1839088 - RNA, 14 nt, Salmonella typhimurium LT2
cguuuuacaccagc

SEQ ID NO: 1839089 - RNA, 18 nt, Salmonella typhimurium LT2
cguuucgauaaccaccag

SEQ ID NO: 1839090 - RNA, 20 nt, Salmonella typhimurium LT2
cguugugcgcuuuggcugcc

SEQ ID NO: 1839091 - RNA, 15 nt, Salmonella typhimurium LT2
cguuuuuguuuaaaa

SEQ ID NO: 1839092 - RNA, 19 nt, Salmonella typhimurium LT2
cguuuuuuuguuuuaccug

SEQ ID NO: 1839093 - RNA, 17 nt, Salmonella typhimurium LT2
cguuuuucagccgcgca

SEQ ID NO: 1839094 - RNA, 24 nt, Salmonella typhimurium LT2
cguuuuucaucaagagauauccca

SEQ ID NO: 1839095 - RNA, 22 nt, Salmonella typhimurium LT2
cguuuuucugaagcguaacagc

SEQ ID NO: 1839096 - RNA, 19 nt, Salmonella typhimurium LT2
cguuuuggguaaauaccag

SEQ ID NO: 1839097 - RNA, 18 nt, Salmonella typhimurium LT2
cguuuuguugccgcccgu

SEQ ID NO: 1839098 - RNA, 18 nt, Salmonella typhimurium LT2
cguuuuagguucuucaau

SEQ ID NO: 1839099 - RNA, 19 nt, Salmonella typhimurium LT2
cguuuucauuagccgccag

SEQ ID NO: 1839100 - RNA, 15 nt, Salmonella typhimurium LT2
cguuuucaugcacga

SEQ ID NO: 1839101 - RNA, 13 nt, Salmonella typhimurium LT2
cguuuucaauaau

SEQ ID NO: 1839102 - RNA, 17 nt, Salmonella typhimurium LT2
cguuuugcugccacguc

SEQ ID NO: 1839103 - RNA, 17 nt, Salmonella typhimurium LT2
cguuuugcgacuucaga

SEQ ID NO: 1839104 - RNA, 16 nt, Salmonella typhimurium LT2
cguuuucgucaacaua

SEQ ID NO: 1839105 - RNA, 14 nt, Salmonella typhimurium LT2
cuaaaaaccagaac

SEQ ID NO: 1839106 - RNA, 16 nt, Salmonella typhimurium LT2
cuaaacagcaaaucgg

SEQ ID NO: 1839107 - RNA, 12 nt, Salmonella typhimurium LT2
cguuaccagcau

SEQ ID NO: 1839108 - RNA, 23 nt, Salmonella typhimurium LT2
cguuacauuuuuggugacguguu

SEQ ID NO: 1839109 - RNA, 23 nt, Salmonella typhimurium LT2
cguuacaucuccuggucuggcuc

SEQ ID NO: 1839110 - RNA, 21 nt, Salmonella typhimurium LT2
cguuaauuuuuagcuaacucu

SEQ ID NO: 1839111 - RNA, 20 nt, Salmonella typhimurium LT2
cguuacccgauaccgccagc

SEQ ID NO: 1839112 - RNA, 17 nt, Salmonella typhimurium LT2
cguuaccccuuuuucaa

SEQ ID NO: 1839113 - RNA, 23 nt, Salmonella typhimurium LT2
cguuaccccgcagcgaaaaucca

SEQ ID NO: 1839114 - RNA, 18 nt, Salmonella typhimurium LT2
cguuaccagcaucaauag

SEQ ID NO: 1839115 - RNA, 15 nt, Salmonella typhimurium LT2
cguuaauaccgugca

SEQ ID NO: 1839116 - RNA, 13 nt, Salmonella typhimurium LT2
cguuaaucggcac

SEQ ID NO: 1839117 - RNA, 15 nt, Salmonella typhimurium LT2
cgugcuguggaaaau

SEQ ID NO: 1839118 - RNA, 21 nt, Salmonella typhimurium LT2
cguggcauucgcuugcccggc

SEQ ID NO: 1839119 - RNA, 15 nt, Salmonella typhimurium LT2
cguuacgcgcugcaa

SEQ ID NO: 1839120 - RNA, 20 nt, Salmonella typhimurium LT2
cguuacggcugaagcugccg

SEQ ID NO: 1839121 - RNA, 14 nt, Salmonella typhimurium LT2
cguuacgcaucugc

SEQ ID NO: 1839122 - RNA, 16 nt, Salmonella typhimurium LT2
cguuaccguucaggca

SEQ ID NO: 1839123 - RNA, 15 nt, Salmonella typhimurium LT2
cguuaccggcaggcu

SEQ ID NO: 1839124 - RNA, 16 nt, Salmonella typhimurium LT2
cguuaccgggcaaaca

SEQ ID NO: 1839125 - RNA, 15 nt, Salmonella typhimurium LT2
cguuaggccacuuca

SEQ ID NO: 1839126 - RNA, 18 nt, Salmonella typhimurium LT2
cguuauccagcagccaca

SEQ ID NO: 1839127 - RNA, 14 nt, Salmonella typhimurium LT2
cguuauucgcuggc

SEQ ID NO: 1839128 - RNA, 16 nt, Salmonella typhimurium LT2
cguuaucuguaauuga

SEQ ID NO: 1839129 - RNA, 17 nt, Salmonella typhimurium LT2
cguuaucugaccuacag

SEQ ID NO: 1839130 - RNA, 21 nt, Salmonella typhimurium LT2
cguuaucgggaugccagaucu

SEQ ID NO: 1839131 - RNA, 20 nt, Salmonella typhimurium LT2
cguuauugaccaucgccagc

SEQ ID NO: 1839132 - RNA, 16 nt, Salmonella typhimurium LT2
cguuauucuccaggcu

SEQ ID NO: 1839133 - RNA, 22 nt, Salmonella typhimurium LT2
cguucaaaaucaaacagaauau

SEQ ID NO: 1839134 - RNA, 15 nt, Salmonella typhimurium LT2
cguucacgccgccau

SEQ ID NO: 1839135 - RNA, 21 nt, Salmonella typhimurium LT2
cguucacgcugccacccggca

SEQ ID NO: 1839136 - RNA, 17 nt, Salmonella typhimurium LT2
cguucaccgcacugacg

SEQ ID NO: 1839137 - RNA, 14 nt, Salmonella typhimurium LT2
cguucaucaggcaa

SEQ ID NO: 1839138 - RNA, 19 nt, Salmonella typhimurium LT2
cguucauaguuugcauaac

SEQ ID NO: 1839139 - RNA, 16 nt, Salmonella typhimurium LT2
cguucaucggcauaca

SEQ ID NO: 1839140 - RNA, 20 nt, Salmonella typhimurium LT2
cguucagggauaccacgcca

SEQ ID NO: 1839141 - RNA, 23 nt, Salmonella typhimurium LT2
cguugauaucuucaagcggacgu

SEQ ID NO: 1839142 - RNA, 23 nt, Salmonella typhimurium LT2
cugacaggccggauuagcgacag

SEQ ID NO: 1839143 - RNA, 18 nt, Salmonella typhimurium LT2
cugacagccaaacugcug

SEQ ID NO: 1839144 - RNA, 16 nt, Salmonella typhimurium LT2
cugacauaaucaugaa

SEQ ID NO: 1839145 - RNA, 13 nt, Salmonella typhimurium LT2
cugacauaaucau

SEQ ID NO: 1839146 - RNA, 16 nt, Salmonella typhimurium LT2
cugacagccaaacugc

SEQ ID NO: 1839147 - RNA, 21 nt, Salmonella typhimurium LT2
cugacagaauauaggagagcg

SEQ ID NO: 1839148 - RNA, 14 nt, Salmonella typhimurium LT2
cugaauuucacgcu

SEQ ID NO: 1839149 - RNA, 17 nt, Salmonella typhimurium LT2
cugacauuccuuuuaau

SEQ ID NO: 1839150 - RNA, 20 nt, Salmonella typhimurium LT2
cugaccgcgaucgcuggacg

SEQ ID NO: 1839151 - RNA, 13 nt, Salmonella typhimurium LT2
cugaccgcuccag

SEQ ID NO: 1839152 - RNA, 16 nt, Salmonella typhimurium LT2
cugacguaaauucuga

SEQ ID NO: 1839153 - RNA, 14 nt, Salmonella typhimurium LT2
cugacugcugucau

SEQ ID NO: 1839154 - RNA, 13 nt, Salmonella typhimurium LT2
cugacuguaauuu

SEQ ID NO: 1839155 - RNA, 13 nt, Salmonella typhimurium LT2
cugacgccagcca

SEQ ID NO: 1839156 - RNA, 21 nt, Salmonella typhimurium LT2
cugacgggcauuguuaaucca

SEQ ID NO: 1839157 - RNA, 14 nt, Salmonella typhimurium LT2
cugacgcagcagcu

SEQ ID NO: 1839158 - RNA, 15 nt, Salmonella typhimurium LT2
cugacgaucaaccgg

SEQ ID NO: 1839159 - RNA, 17 nt, Salmonella typhimurium LT2
cugacgaucaaccgguu

SEQ ID NO: 1839160 - RNA, 16 nt, Salmonella typhimurium LT2
cugacgaccauugcca

SEQ ID NO: 1839161 - RNA, 21 nt, Salmonella typhimurium LT2
cugacgaccauugccaaugcc

SEQ ID NO: 1839162 - RNA, 16 nt, Salmonella typhimurium LT2
cugaauuaucaggguu

SEQ ID NO: 1839163 - RNA, 17 nt, Salmonella typhimurium LT2
cugaauucgccaccagc

SEQ ID NO: 1839164 - RNA, 19 nt, Salmonella typhimurium LT2
cugaaucugcggcugcgug

SEQ ID NO: 1839165 - RNA, 23 nt, Salmonella typhimurium LT2
cugaaucagauacggcuccagca

SEQ ID NO: 1839166 - RNA, 18 nt, Salmonella typhimurium LT2
cugaaucaauagcugggu

SEQ ID NO: 1839167 - RNA, 15 nt, Salmonella typhimurium LT2
cucuaccggauaaau

SEQ ID NO: 1839168 - RNA, 20 nt, Salmonella typhimurium LT2
cugaaguaauguucaggguu

SEQ ID NO: 1839169 - RNA, 17 nt, Salmonella typhimurium LT2
cugaaguaucgacgcag

SEQ ID NO: 1839170 - RNA, 11 nt, Salmonella typhimurium LT2
cugaauaaucg

SEQ ID NO: 1839171 - RNA, 15 nt, Salmonella typhimurium LT2
cugaauaaugaccuc

SEQ ID NO: 1839172 - RNA, 18 nt, Salmonella typhimurium LT2
cugaauaacccgcagccc

SEQ ID NO: 1839173 - RNA, 18 nt, Salmonella typhimurium LT2
cugaauaccuucacaaaa

SEQ ID NO: 1839174 - RNA, 18 nt, Salmonella typhimurium LT2
cugaauacggguaaugca

SEQ ID NO: 1839175 - RNA, 13 nt, Salmonella typhimurium LT2
cugaauagccagc

SEQ ID NO: 1839176 - RNA, 18 nt, Salmonella typhimurium LT2
cugaauaguagcugagag

SEQ ID NO: 1839177 - RNA, 22 nt, Salmonella typhimurium LT2
cugauuauucaguaccgccuuc

SEQ ID NO: 1839178 - RNA, 15 nt, Salmonella typhimurium LT2
cugauucaggucaug

SEQ ID NO: 1839179 - RNA, 15 nt, Salmonella typhimurium LT2
cugauuccagagcga

SEQ ID NO: 1839180 - RNA, 22 nt, Salmonella typhimurium LT2
cugauuaaucagcucagcaaca

SEQ ID NO: 1839181 - RNA, 19 nt, Salmonella typhimurium LT2
cugauuaaguuuuuuuaaa

SEQ ID NO: 1839182 - RNA, 20 nt, Salmonella typhimurium LT2
cugaugugacguuuucaggu

SEQ ID NO: 1839183 - RNA, 16 nt, Salmonella typhimurium LT2
cugaugugacauuuuc

SEQ ID NO: 1839184 - RNA, 17 nt, Salmonella typhimurium LT2
cugaugcugcgcaucug

SEQ ID NO: 1839185 - RNA, 18 nt, Salmonella typhimurium LT2
cugauggcgcuacguuua

SEQ ID NO: 1839186 - RNA, 17 nt, Salmonella typhimurium LT2
cugaugaccgccgucau

SEQ ID NO: 1839187 - RNA, 16 nt, Salmonella typhimurium LT2
cugaugacaaagccgg

SEQ ID NO: 1839188 - RNA, 21 nt, Salmonella typhimurium LT2
cugaugaacguagucguugua

SEQ ID NO: 1839189 - RNA, 18 nt, Salmonella typhimurium LT2
cugauauacgaagcgcca

SEQ ID NO: 1839190 - RNA, 22 nt, Salmonella typhimurium LT2
cugauaucggcugcuguaacag

SEQ ID NO: 1839191 - RNA, 19 nt, Salmonella typhimurium LT2
cugagaaaaauacgccaga

SEQ ID NO: 1839192 - RNA, 13 nt, Salmonella typhimurium LT2
cugagaaaaauac

SEQ ID NO: 1839193 - RNA, 15 nt, Salmonella typhimurium LT2
cugagaaaaagcgaa

SEQ ID NO: 1839194 - RNA, 16 nt, Salmonella typhimurium LT2
cugagcggcucaucca

SEQ ID NO: 1839195 - RNA, 20 nt, Salmonella typhimurium LT2
cugaggaguauuauccauug

SEQ ID NO: 1839196 - RNA, 17 nt, Salmonella typhimurium LT2
cugaggcguugcuccag

SEQ ID NO: 1839197 - RNA, 16 nt, Salmonella typhimurium LT2
cugagcucacuuuuug

SEQ ID NO: 1839198 - RNA, 14 nt, Salmonella typhimurium LT2
cugagcuaacgacc

SEQ ID NO: 1839199 - RNA, 13 nt, Salmonella typhimurium LT2
cugauaaaaacuc

SEQ ID NO: 1839200 - RNA, 18 nt, Salmonella typhimurium LT2
cugaguauacagacagca

SEQ ID NO: 1839201 - RNA, 20 nt, Salmonella typhimurium LT2
cugagucacagaauacccuc

SEQ ID NO: 1839202 - RNA, 20 nt, Salmonella typhimurium LT2
cugauaaagcuuucaucuuu

SEQ ID NO: 1839203 - RNA, 20 nt, Salmonella typhimurium LT2
cugauaaauaugccggccgc

SEQ ID NO: 1839204 - RNA, 14 nt, Salmonella typhimurium LT2
cugauaaagagcag

SEQ ID NO: 1839205 - RNA, 18 nt, Salmonella typhimurium LT2
cugauaacgauaagugaa

SEQ ID NO: 1839206 - RNA, 17 nt, Salmonella typhimurium LT2
cugauaagcgcagcgcc

SEQ ID NO: 1839207 - RNA, 14 nt, Salmonella typhimurium LT2
cugauacugcuccg

SEQ ID NO: 1839208 - RNA, 18 nt, Salmonella typhimurium LT2
cugauaagcgcagcgcca

SEQ ID NO: 1839209 - RNA, 19 nt, Salmonella typhimurium LT2
cugauagcccauccagcac

SEQ ID NO: 1839210 - RNA, 18 nt, Salmonella typhimurium LT2
cugauagccguaaauaau

SEQ ID NO: 1839211 - RNA, 20 nt, Salmonella typhimurium LT2
cugauagggacacauuucuu

SEQ ID NO: 1839212 - RNA, 19 nt, Salmonella typhimurium LT2
cugauagcuaaccagcgag

SEQ ID NO: 1839213 - RNA, 19 nt, Salmonella typhimurium LT2
cugauagggacacauuucu

SEQ ID NO: 1839214 - RNA, 17 nt, Salmonella typhimurium LT2
cugcacgaaauguagag

SEQ ID NO: 1839215 - RNA, 18 nt, Salmonella typhimurium LT2
cugcacgccaauaauuuc

SEQ ID NO: 1839216 - RNA, 17 nt, Salmonella typhimurium LT2
cugcacggcgucaucca

SEQ ID NO: 1839217 - RNA, 16 nt, Salmonella typhimurium LT2
cugcacguaccugcuc

SEQ ID NO: 1839218 - RNA, 24 nt, Salmonella typhimurium LT2
cugcaccuuuuuuuccagcgucug

SEQ ID NO: 1839219 - RNA, 15 nt, Salmonella typhimurium LT2
cugcacccaucuuua

SEQ ID NO: 1839220 - RNA, 18 nt, Salmonella typhimurium LT2
cugcaacagcaccagcag

SEQ ID NO: 1839221 - RNA, 14 nt, Salmonella typhimurium LT2
cugcaacagcacca

SEQ ID NO: 1839222 - RNA, 14 nt, Salmonella typhimurium LT2
cugcaacagaagag

SEQ ID NO: 1839223 - RNA, 20 nt, Salmonella typhimurium LT2
cugcaacagaagaguuaacu

SEQ ID NO: 1839224 - RNA, 23 nt, Salmonella typhimurium LT2
cugcaccaggagcaaaccgaccc

SEQ ID NO: 1839225 - RNA, 12 nt, Salmonella typhimurium LT2
cugcaccaauca

SEQ ID NO: 1839226 - RNA, 22 nt, Salmonella typhimurium LT2
cugcaccaaauccuccagcggc

SEQ ID NO: 1839227 - RNA, 12 nt, Salmonella typhimurium LT2
cugcaaccgacg

SEQ ID NO: 1839228 - RNA, 19 nt, Salmonella typhimurium LT2
cugcacuuuaagcggcagc

SEQ ID NO: 1839229 - RNA, 22 nt, Salmonella typhimurium LT2
cugcagauuuugcucccuggug

SEQ ID NO: 1839230 - RNA, 17 nt, Salmonella typhimurium LT2
cugcagaauaagcuccg

SEQ ID NO: 1839231 - RNA, 23 nt, Salmonella typhimurium LT2
cugcacuucaaugucguuaucgc

SEQ ID NO: 1839232 - RNA, 21 nt, Salmonella typhimurium LT2
cugcagaaucccgauaaucaa

SEQ ID NO: 1839233 - RNA, 11 nt, Salmonella typhimurium LT2
cugcaggccaa

SEQ ID NO: 1839234 - RNA, 15 nt, Salmonella typhimurium LT2
cugcauauuuuucau

SEQ ID NO: 1839235 - RNA, 14 nt, Salmonella typhimurium LT2
cugcauacucacau

SEQ ID NO: 1839236 - RNA, 20 nt, Salmonella typhimurium LT2
cugcaggcggugcgcagcca

SEQ ID NO: 1839237 - RNA, 21 nt, Salmonella typhimurium LT2
cugccguaaacaggcaggccc

SEQ ID NO: 1839238 - RNA, 15 nt, Salmonella typhimurium LT2
cugccggcaaaacca

SEQ ID NO: 1839239 - RNA, 14 nt, Salmonella typhimurium LT2
cugccggacugcuc

SEQ ID NO: 1839240 - RNA, 12 nt, Salmonella typhimurium LT2
cugccguccuga

SEQ ID NO: 1839241 - RNA, 16 nt, Salmonella typhimurium LT2
cugccguccugaucaa

SEQ ID NO: 1839242 - RNA, 14 nt, Salmonella typhimurium LT2
cugccgucgcggcu

SEQ ID NO: 1839243 - RNA, 18 nt, Salmonella typhimurium LT2
cugccguagcgcauuauu

SEQ ID NO: 1839244 - RNA, 14 nt, Salmonella typhimurium LT2
cugccgucccagcg

SEQ ID NO: 1839245 - RNA, 21 nt, Salmonella typhimurium LT2
cugccuuuaauugccugacga

SEQ ID NO: 1839246 - RNA, 19 nt, Salmonella typhimurium LT2
cugccuuuguacagcuugc

SEQ ID NO: 1839247 - RNA, 17 nt, Salmonella typhimurium LT2
cugccgcgccugauuca

SEQ ID NO: 1839248 - RNA, 16 nt, Salmonella typhimurium LT2
cugccgcgccuuuacc

SEQ ID NO: 1839249 - RNA, 18 nt, Salmonella typhimurium LT2
cugcccuuucagagcguc

SEQ ID NO: 1839250 - RNA, 13 nt, Salmonella typhimurium LT2
cugcccuuuuagc

SEQ ID NO: 1839251 - RNA, 14 nt, Salmonella typhimurium LT2
cugccgacaggcag

SEQ ID NO: 1839252 - RNA, 17 nt, Salmonella typhimurium LT2
cugccgacuacgccucc

SEQ ID NO: 1839253 - RNA, 18 nt, Salmonella typhimurium LT2
cugccccgccacagccgc

SEQ ID NO: 1839254 - RNA, 20 nt, Salmonella typhimurium LT2
cugccccgccacagccgcau

SEQ ID NO: 1839255 - RNA, 15 nt, Salmonella typhimurium LT2
cugcccccggcgccu

SEQ ID NO: 1839256 - RNA, 16 nt, Salmonella typhimurium LT2
cugcccacccgggccg

SEQ ID NO: 1839257 - RNA, 13 nt, Salmonella typhimurium LT2
cugcccacccggg

SEQ ID NO: 1839258 - RNA, 20 nt, Salmonella typhimurium LT2
cugccaccacgcggccuccg

SEQ ID NO: 1839259 - RNA, 16 nt, Salmonella typhimurium LT2
cugccaccgucgcggc

SEQ ID NO: 1839260 - RNA, 20 nt, Salmonella typhimurium LT2
cugccacgcuuuuccuucca

SEQ ID NO: 1839261 - RNA, 14 nt, Salmonella typhimurium LT2
cugcgcuuuccagg

SEQ ID NO: 1839262 - RNA, 15 nt, Salmonella typhimurium LT2
cugcgcuuuccaggc

SEQ ID NO: 1839263 - RNA, 11 nt, Salmonella typhimurium LT2
cugcgcuuuga

SEQ ID NO: 1839264 - RNA, 12 nt, Salmonella typhimurium LT2
cugcggaacgcc

SEQ ID NO: 1839265 - RNA, 16 nt, Salmonella typhimurium LT2
cugcggaacgccccuc

SEQ ID NO: 1839266 - RNA, 17 nt, Salmonella typhimurium LT2
cugcgcuuugugcucca

SEQ ID NO: 1839267 - RNA, 13 nt, Salmonella typhimurium LT2
cugcgcuuuuuca

SEQ ID NO: 1839268 - RNA, 21 nt, Salmonella typhimurium LT2
cugcgcuuuuucaucaucugu

SEQ ID NO: 1839269 - RNA, 14 nt, Salmonella typhimurium LT2
cugcggacacggcg

SEQ ID NO: 1839270 - RNA, 14 nt, Salmonella typhimurium LT2
cugcggacauuuuc

SEQ ID NO: 1839271 - RNA, 15 nt, Salmonella typhimurium LT2
cugcgaacagcgcuc

SEQ ID NO: 1839272 - RNA, 21 nt, Salmonella typhimurium LT2
cugcggccaugaucgccgcca

SEQ ID NO: 1839273 - RNA, 22 nt, Salmonella typhimurium LT2
cugcggcauacuuucgcgcggc

SEQ ID NO: 1839274 - RNA, 21 nt, Salmonella typhimurium LT2
cugcggcauuacgcgccucuu

SEQ ID NO: 1839275 - RNA, 14 nt, Salmonella typhimurium LT2
cugcggccugccca

SEQ ID NO: 1839276 - RNA, 14 nt, Salmonella typhimurium LT2
cugcguccugcuua

SEQ ID NO: 1839277 - RNA, 23 nt, Salmonella typhimurium LT2
cugcggucuccugaacgcccggc

SEQ ID NO: 1839278 - RNA, 16 nt, Salmonella typhimurium LT2
cugcggucaggaauga

SEQ ID NO: 1839279 - RNA, 19 nt, Salmonella typhimurium LT2
cugcgguauuaacccgcag

SEQ ID NO: 1839280 - RNA, 15 nt, Salmonella typhimurium LT2
cugcgugaagacaca

SEQ ID NO: 1839281 - RNA, 18 nt, Salmonella typhimurium LT2
cugcgugaugcaucagaa

SEQ ID NO: 1839282 - RNA, 18 nt, Salmonella typhimurium LT2
cugcucauuucagcgagu

SEQ ID NO: 1839283 - RNA, 19 nt, Salmonella typhimurium LT2
cugcucauaacccuccugc

SEQ ID NO: 1839284 - RNA, 22 nt, Salmonella typhimurium LT2
cugcucauaacccuccugccuu

SEQ ID NO: 1839285 - RNA, 24 nt, Salmonella typhimurium LT2
cugcuaguggauaaacauuacguu

SEQ ID NO: 1839286 - RNA, 17 nt, Salmonella typhimurium LT2
cugcgugcgcgccaccg

SEQ ID NO: 1839287 - RNA, 16 nt, Salmonella typhimurium LT2
cugcugagugacgggc

SEQ ID NO: 1839288 - RNA, 11 nt, Salmonella typhimurium LT2
cugcugauaac

SEQ ID NO: 1839289 - RNA, 22 nt, Salmonella typhimurium LT2
cugcugauaguccaguacccgc

SEQ ID NO: 1839290 - RNA, 15 nt, Salmonella typhimurium LT2
cugcugauaauacug

SEQ ID NO: 1839291 - RNA, 18 nt, Salmonella typhimurium LT2
cugcugaccuuaauccag

SEQ ID NO: 1839292 - RNA, 20 nt, Salmonella typhimurium LT2
cugcugaccuuaauccagcc

SEQ ID NO: 1839293 - RNA, 15 nt, Salmonella typhimurium LT2
aaacuauccuggccu

SEQ ID NO: 1839294 - RNA, 15 nt, Salmonella typhimurium LT2
cugcugaacacaaug

SEQ ID NO: 1839295 - RNA, 22 nt, Salmonella typhimurium LT2
cugcucgggccagcucuuuucu

SEQ ID NO: 1839296 - RNA, 16 nt, Salmonella typhimurium LT2
cugcuguaccucuugc

SEQ ID NO: 1839297 - RNA, 16 nt, Salmonella typhimurium LT2
cugcuguaacagacgc

SEQ ID NO: 1839298 - RNA, 15 nt, Salmonella typhimurium LT2
cugcuguagcugucc

SEQ ID NO: 1839299 - RNA, 22 nt, Salmonella typhimurium LT2
cugcuguaacagacgcaggccg

SEQ ID NO: 1839300 - RNA, 18 nt, Salmonella typhimurium LT2
cugcuucggaaugacaaa

SEQ ID NO: 1839301 - RNA, 22 nt, Salmonella typhimurium LT2
cugcuguguccaggucaucacc

SEQ ID NO: 1839302 - RNA, 16 nt, Salmonella typhimurium LT2
cugcuguccgccagca

SEQ ID NO: 1839303 - RNA, 17 nt, Salmonella typhimurium LT2
cugcuguguccagguca

SEQ ID NO: 1839304 - RNA, 15 nt, Salmonella typhimurium LT2
cugcugguagagcau

SEQ ID NO: 1839305 - RNA, 18 nt, Salmonella typhimurium LT2
cugcugggucugcugggc

SEQ ID NO: 1839306 - RNA, 20 nt, Salmonella typhimurium LT2
cugcugcaacgucgcgcccu

SEQ ID NO: 1839307 - RNA, 14 nt, Salmonella typhimurium LT2
cugcuggcgcguca

SEQ ID NO: 1839308 - RNA, 22 nt, Salmonella typhimurium LT2
cuggaacgcgucggcgcgggga

SEQ ID NO: 1839309 - RNA, 21 nt, Salmonella typhimurium LT2
cuggaacugaucguggccaca

SEQ ID NO: 1839310 - RNA, 22 nt, Salmonella typhimurium LT2
cuggaacugaucguggccacac

SEQ ID NO: 1839311 - RNA, 20 nt, Salmonella typhimurium LT2
cuggaacaggugcgagaggu

SEQ ID NO: 1839312 - RNA, 23 nt, Salmonella typhimurium LT2
cugcuugucacgaaguuccagua

SEQ ID NO: 1839313 - RNA, 12 nt, Salmonella typhimurium LT2
cugcuuggccug

SEQ ID NO: 1839314 - RNA, 20 nt, Salmonella typhimurium LT2
cuggauagagcaucaaccuc

SEQ ID NO: 1839315 - RNA, 23 nt, Salmonella typhimurium LT2
cuggauagagcaucaaccuccua

SEQ ID NO: 1839316 - RNA, 14 nt, Salmonella typhimurium LT2
cuggauaaaagguc

SEQ ID NO: 1839317 - RNA, 21 nt, Salmonella typhimurium LT2
cuggaguuuaaacacucucca

SEQ ID NO: 1839318 - RNA, 12 nt, Salmonella typhimurium LT2
cuggaugauaaa

SEQ ID NO: 1839319 - RNA, 22 nt, Salmonella typhimurium LT2
cuggauagccucguugauuugu

SEQ ID NO: 1839320 - RNA, 16 nt, Salmonella typhimurium LT2
cuggaugcuuaaaauc

SEQ ID NO: 1839321 - RNA, 22 nt, Salmonella typhimurium LT2
cuggauuagucugccauuuccu

SEQ ID NO: 1839322 - RNA, 14 nt, Salmonella typhimurium LT2
cuggauuaucaaua

SEQ ID NO: 1839323 - RNA, 16 nt, Salmonella typhimurium LT2
cuggauugcagagaag

SEQ ID NO: 1839324 - RNA, 22 nt, Salmonella typhimurium LT2
cuggaauaaccggugccaaagu

SEQ ID NO: 1839325 - RNA, 21 nt, Salmonella typhimurium LT2
cuggagcgcauuuuacugccg

SEQ ID NO: 1839326 - RNA, 15 nt, Salmonella typhimurium LT2
cuggagaucagcaug

SEQ ID NO: 1839327 - RNA, 15 nt, Salmonella typhimurium LT2
cuggagaccaccggc

SEQ ID NO: 1839328 - RNA, 17 nt, Salmonella typhimurium LT2
cuggagaccaccggcaa

SEQ ID NO: 1839329 - RNA, 16 nt, Salmonella typhimurium LT2
cuggcggucaauacgu

SEQ ID NO: 1839330 - RNA, 22 nt, Salmonella typhimurium LT2
cuggcgguaugaaagccaucgc

SEQ ID NO: 1839331 - RNA, 20 nt, Salmonella typhimurium LT2
cuggcgguaaauacgcggca

SEQ ID NO: 1839332 - RNA, 19 nt, Salmonella typhimurium LT2
cuggcgugacguguggcgc

SEQ ID NO: 1839333 - RNA, 22 nt, Salmonella typhimurium LT2
cuggcguaguaugacccgcccc

SEQ ID NO: 1839334 - RNA, 13 nt, Salmonella typhimurium LT2
aaacuccagcacg

SEQ ID NO: 1839335 - RNA, 22 nt, Salmonella typhimurium LT2
aaacucccgcacgcuggcauca

SEQ ID NO: 1839336 - RNA, 13 nt, Salmonella typhimurium LT2
aaacucaucuuua

SEQ ID NO: 1839337 - RNA, 13 nt, Salmonella typhimurium LT2
cuggcggcucagg

SEQ ID NO: 1839338 - RNA, 13 nt, Salmonella typhimurium LT2
cuggcucagacca

SEQ ID NO: 1839339 - RNA, 12 nt, Salmonella typhimurium LT2
cuggcucauucu

SEQ ID NO: 1839340 - RNA, 17 nt, Salmonella typhimurium LT2
cuggcucccgcagccac

SEQ ID NO: 1839341 - RNA, 21 nt, Salmonella typhimurium LT2
cuggcugacagaagccccgcu

SEQ ID NO: 1839342 - RNA, 14 nt, Salmonella typhimurium LT2
cuggcugagaaaaa

SEQ ID NO: 1839343 - RNA, 11 nt, Salmonella typhimurium LT2
cuggcucagac

SEQ ID NO: 1839344 - RNA, 15 nt, Salmonella typhimurium LT2
cuggcucaauccagg

SEQ ID NO: 1839345 - RNA, 18 nt, Salmonella typhimurium LT2
cuggcucaauccaggugg

SEQ ID NO: 1839346 - RNA, 15 nt, Salmonella typhimurium LT2
cuggcuacguacaca

SEQ ID NO: 1839347 - RNA, 20 nt, Salmonella typhimurium LT2
cuggcgugaaaagugccgcu

SEQ ID NO: 1839348 - RNA, 20 nt, Salmonella typhimurium LT2
cuggcuuugcuggcacugcg

SEQ ID NO: 1839349 - RNA, 11 nt, Salmonella typhimurium LT2
cuggcuuuaua

SEQ ID NO: 1839350 - RNA, 17 nt, Salmonella typhimurium LT2
cuggcuuuauauaaaaa

SEQ ID NO: 1839351 - RNA, 15 nt, Salmonella typhimurium LT2
cuggcuuaccugcuc

SEQ ID NO: 1839352 - RNA, 22 nt, Salmonella typhimurium LT2
cuggcuucaaccuccugcaauc

SEQ ID NO: 1839353 - RNA, 21 nt, Salmonella typhimurium LT2
cuggcuugcgcuauccgcgcu

SEQ ID NO: 1839354 - RNA, 16 nt, Salmonella typhimurium LT2
cugggccucgccccuu

SEQ ID NO: 1839355 - RNA, 20 nt, Salmonella typhimurium LT2
cugggccgccacgaccugca

SEQ ID NO: 1839356 - RNA, 21 nt, Salmonella typhimurium LT2
cugggauucggcaacacccac

SEQ ID NO: 1839357 - RNA, 22 nt, Salmonella typhimurium LT2
cuggcgaauaaaauucagcgca

SEQ ID NO: 1839358 - RNA, 18 nt, Salmonella typhimurium LT2
cuggcgacggcaucggca

SEQ ID NO: 1839359 - RNA, 22 nt, Salmonella typhimurium LT2
cuggccugauaagcgcagcgcc

SEQ ID NO: 1839360 - RNA, 23 nt, Salmonella typhimurium LT2
cuggccugucguacuccaggcgc

SEQ ID NO: 1839361 - RNA, 17 nt, Salmonella typhimurium LT2
cuggcgaaccaccagcc

SEQ ID NO: 1839362 - RNA, 17 nt, Salmonella typhimurium LT2
cuggccucccaguuccc

SEQ ID NO: 1839363 - RNA, 16 nt, Salmonella typhimurium LT2
cuggccucccaguucc

SEQ ID NO: 1839364 - RNA, 16 nt, Salmonella typhimurium LT2
cuggccuccagcacuu

SEQ ID NO: 1839365 - RNA, 19 nt, Salmonella typhimurium LT2
cuggccuagaugaaugacu

SEQ ID NO: 1839366 - RNA, 21 nt, Salmonella typhimurium LT2
cuggccgguuuuaaaaauaac

SEQ ID NO: 1839367 - RNA, 14 nt, Salmonella typhimurium LT2
cuggcacuggcagc

SEQ ID NO: 1839368 - RNA, 14 nt, Salmonella typhimurium LT2
cuggcacugcggac

SEQ ID NO: 1839369 - RNA, 15 nt, Salmonella typhimurium LT2
cuggcagaaggcaug

SEQ ID NO: 1839370 - RNA, 19 nt, Salmonella typhimurium LT2
cuggcagcgccugacggcg

SEQ ID NO: 1839371 - RNA, 13 nt, Salmonella typhimurium LT2
cuggcagccucgu

SEQ ID NO: 1839372 - RNA, 18 nt, Salmonella typhimurium LT2
cuggcagcgccugacggc

SEQ ID NO: 1839373 - RNA, 16 nt, Salmonella typhimurium LT2
cuggcagcggcaguaa

SEQ ID NO: 1839374 - RNA, 18 nt, Salmonella typhimurium LT2
cuggcgcuuuaagugcau

SEQ ID NO: 1839375 - RNA, 18 nt, Salmonella typhimurium LT2
cuggcgcuacguuuguca

SEQ ID NO: 1839376 - RNA, 17 nt, Salmonella typhimurium LT2
cuggcgcggggaacacg

SEQ ID NO: 1839377 - RNA, 19 nt, Salmonella typhimurium LT2
cuggcgcggggaacacaau

SEQ ID NO: 1839378 - RNA, 14 nt, Salmonella typhimurium LT2
cuggcggcaaaaac

SEQ ID NO: 1839379 - RNA, 22 nt, Salmonella typhimurium LT2
cuggcggauaccgaagacggcg

SEQ ID NO: 1839380 - RNA, 13 nt, Salmonella typhimurium LT2
aaacucagagaga

SEQ ID NO: 1839381 - RNA, 22 nt, Salmonella typhimurium LT2
aaacucagagagauccugagaa

SEQ ID NO: 1839382 - RNA, 20 nt, Salmonella typhimurium LT2
aaacucagcgccagcgcuga

SEQ ID NO: 1839383 - RNA, 16 nt, Salmonella typhimurium LT2
cuggcgcacaggccug

SEQ ID NO: 1839384 - RNA, 14 nt, Salmonella typhimurium LT2
cuggcgcaaccggc

SEQ ID NO: 1839385 - RNA, 15 nt, Salmonella typhimurium LT2
cuggcgcaaaugggc

SEQ ID NO: 1839386 - RNA, 14 nt, Salmonella typhimurium LT2
cuggcgcagccgcu

SEQ ID NO: 1839387 - RNA, 15 nt, Salmonella typhimurium LT2
cuggcgcagccgcuu

SEQ ID NO: 1839388 - RNA, 13 nt, Salmonella typhimurium LT2
cuggcgcagcuuc

SEQ ID NO: 1839389 - RNA, 19 nt, Salmonella typhimurium LT2
cuggcgcagcgcuuuugcc

SEQ ID NO: 1839390 - RNA, 15 nt, Salmonella typhimurium LT2
cuggcgcgccugcuc

SEQ ID NO: 1839391 - RNA, 20 nt, Salmonella typhimurium LT2
cuggcgcgccugcuccacca

SEQ ID NO: 1839392 - RNA, 17 nt, Salmonella typhimurium LT2
cuggcgcgccagcucuu

SEQ ID NO: 1839393 - RNA, 13 nt, Salmonella typhimurium LT2
cuggcgccgcaag

SEQ ID NO: 1839394 - RNA, 18 nt, Salmonella typhimurium LT2
cuggcgccgccagccagg

SEQ ID NO: 1839395 - RNA, 14 nt, Salmonella typhimurium LT2
cuguuccaggcgaa

SEQ ID NO: 1839396 - RNA, 15 nt, Salmonella typhimurium LT2
cuguuccagcugcga

SEQ ID NO: 1839397 - RNA, 17 nt, Salmonella typhimurium LT2
cuguucaucaaagaaaa

SEQ ID NO: 1839398 - RNA, 14 nt, Salmonella typhimurium LT2
cuguucacauccag

SEQ ID NO: 1839399 - RNA, 16 nt, Salmonella typhimurium LT2
cuguuaauuucauaaa

SEQ ID NO: 1839400 - RNA, 14 nt, Salmonella typhimurium LT2
cuguuaauuucccg

SEQ ID NO: 1839401 - RNA, 11 nt, Salmonella typhimurium LT2
cuguucugucc

SEQ ID NO: 1839402 - RNA, 18 nt, Salmonella typhimurium LT2
cuguuccagguucaagcu

SEQ ID NO: 1839403 - RNA, 17 nt, Salmonella typhimurium LT2
cuguguugcucaaaaaa

SEQ ID NO: 1839404 - RNA, 18 nt, Salmonella typhimurium LT2
cugugucguccgggccug

SEQ ID NO: 1839405 - RNA, 16 nt, Salmonella typhimurium LT2
cugugugggcacucga

SEQ ID NO: 1839406 - RNA, 17 nt, Salmonella typhimurium LT2
cuguuaaaaccggcugc

SEQ ID NO: 1839407 - RNA, 21 nt, Salmonella typhimurium LT2
cuguguacacaauugccaugg

SEQ ID NO: 1839408 - RNA, 19 nt, Salmonella typhimurium LT2
cuguguacgccaagcugca

SEQ ID NO: 1839409 - RNA, 14 nt, Salmonella typhimurium LT2
cuguggguucaucg

SEQ ID NO: 1839410 - RNA, 19 nt, Salmonella typhimurium LT2
cuguggguugccauauuuu

SEQ ID NO: 1839411 - RNA, 19 nt, Salmonella typhimurium LT2
cuguuggaugcgcgacugc

SEQ ID NO: 1839412 - RNA, 14 nt, Salmonella typhimurium LT2
cuguugcugugcau

SEQ ID NO: 1839413 - RNA, 20 nt, Salmonella typhimurium LT2
cuguugaugauaaccgccgc

SEQ ID NO: 1839414 - RNA, 21 nt, Salmonella typhimurium LT2
cuguugaugauaaccgccgcc

SEQ ID NO: 1839415 - RNA, 20 nt, Salmonella typhimurium LT2
cuguugccuuugcgcgcgau

SEQ ID NO: 1839416 - RNA, 15 nt, Salmonella typhimurium LT2
cuguugccgcccguc

SEQ ID NO: 1839417 - RNA, 22 nt, Salmonella typhimurium LT2
cuguuugcugacaaucugcugg

SEQ ID NO: 1839418 - RNA, 20 nt, Salmonella typhimurium LT2
cuguuguagaaugaauuucu

SEQ ID NO: 1839419 - RNA, 18 nt, Salmonella typhimurium LT2
cuguuuugcuucuucagc

SEQ ID NO: 1839420 - RNA, 15 nt, Salmonella typhimurium LT2
cuuaaaauagccagc

SEQ ID NO: 1839421 - RNA, 22 nt, Salmonella typhimurium LT2
cuuacuuuccaaaauccaggga

SEQ ID NO: 1839422 - RNA, 22 nt, Salmonella typhimurium LT2
cuuagacaucaaaauuaccuuu

SEQ ID NO: 1839423 - RNA, 23 nt, Salmonella typhimurium LT2
cuuauaaaucagcuuugcggcca

SEQ ID NO: 1839424 - RNA, 14 nt, Salmonella typhimurium LT2
cuuauaaauaagaa

SEQ ID NO: 1839425 - RNA, 17 nt, Salmonella typhimurium LT2
cuuauacugauaucuau

SEQ ID NO: 1839426 - RNA, 22 nt, Salmonella typhimurium LT2
cuuaucaggccgacaaaugacg

SEQ ID NO: 1839427 - RNA, 13 nt, Salmonella typhimurium LT2
cuuaucaggccua

SEQ ID NO: 1839428 - RNA, 21 nt, Salmonella typhimurium LT2
cuuaucaggccuacaguuuca

SEQ ID NO: 1839429 - RNA, 19 nt, Salmonella typhimurium LT2
cuuaucaggccuaccagcc

SEQ ID NO: 1839430 - RNA, 14 nt, Salmonella typhimurium LT2
cuuauccacgcccu

SEQ ID NO: 1839431 - RNA, 13 nt, Salmonella typhimurium LT2
cuuauccagccac

SEQ ID NO: 1839432 - RNA, 14 nt, Salmonella typhimurium LT2
cuuauccagccacu

SEQ ID NO: 1839433 - RNA, 19 nt, Salmonella typhimurium LT2
cuuaucccacaacuguucu

SEQ ID NO: 1839434 - RNA, 17 nt, Salmonella typhimurium LT2
cuuauccaguacaagca

SEQ ID NO: 1839435 - RNA, 18 nt, Salmonella typhimurium LT2
cuuaucccugcggcuggu

SEQ ID NO: 1839436 - RNA, 14 nt, Salmonella typhimurium LT2
cuuaucugcugcug

SEQ ID NO: 1839437 - RNA, 15 nt, Salmonella typhimurium LT2
cuuaucugcaauaaa

SEQ ID NO: 1839438 - RNA, 14 nt, Salmonella typhimurium LT2
cuuauuauuuuuuc

SEQ ID NO: 1839439 - RNA, 22 nt, Salmonella typhimurium LT2
cuuauuauuuuuucuuuaauua

SEQ ID NO: 1839440 - RNA, 23 nt, Salmonella typhimurium LT2
cuuacgcaguugggcgcgcgacu

SEQ ID NO: 1839441 - RNA, 20 nt, Salmonella typhimurium LT2
cuuaauuugcagaaagauuu

SEQ ID NO: 1839442 - RNA, 11 nt, Salmonella typhimurium LT2
cuuacaaaaau

SEQ ID NO: 1839443 - RNA, 22 nt, Salmonella typhimurium LT2
cuuacgcggcgcgcucuuuuuc

SEQ ID NO: 1839444 - RNA, 20 nt, Salmonella typhimurium LT2
cuuacggaaaaaugucgcuu

SEQ ID NO: 1839445 - RNA, 21 nt, Salmonella typhimurium LT2
cuuacggacguggggguucaa

SEQ ID NO: 1839446 - RNA, 22 nt, Salmonella typhimurium LT2
cuuacguuucucacuaauuuga

SEQ ID NO: 1839447 - RNA, 14 nt, Salmonella typhimurium LT2
cuuacguaccggcg

SEQ ID NO: 1839448 - RNA, 18 nt, Salmonella typhimurium LT2
cuuacuuuccaaaaucca

SEQ ID NO: 1839449 - RNA, 22 nt, Salmonella typhimurium LT2
cuuacuuauguaagcucccggg

SEQ ID NO: 1839450 - RNA, 13 nt, Salmonella typhimurium LT2
cuuaauaacagcg

SEQ ID NO: 1839451 - RNA, 18 nt, Salmonella typhimurium LT2
cuuaauacccauuucuuc

SEQ ID NO: 1839452 - RNA, 17 nt, Salmonella typhimurium LT2
cuuaauacgcagaucuu

SEQ ID NO: 1839453 - RNA, 20 nt, Salmonella typhimurium LT2
cuucagccagaguuuuaaaa

SEQ ID NO: 1839454 - RNA, 14 nt, Salmonella typhimurium LT2
cuucagccagcugc

SEQ ID NO: 1839455 - RNA, 17 nt, Salmonella typhimurium LT2
cuucagccagcugcugg

SEQ ID NO: 1839456 - RNA, 23 nt, Salmonella typhimurium LT2
cuucagagagaugucgcaauaaa

SEQ ID NO: 1839457 - RNA, 18 nt, Salmonella typhimurium LT2
cuucagccugaaucagca

SEQ ID NO: 1839458 - RNA, 19 nt, Salmonella typhimurium LT2
cuucagaacggcucgggug

SEQ ID NO: 1839459 - RNA, 16 nt, Salmonella typhimurium LT2
cuucauagucgcuuuu

SEQ ID NO: 1839460 - RNA, 12 nt, Salmonella typhimurium LT2
cuucauaaauac

SEQ ID NO: 1839461 - RNA, 19 nt, Salmonella typhimurium LT2
cuucauaaaacccgcuucg

SEQ ID NO: 1839462 - RNA, 16 nt, Salmonella typhimurium LT2
cuucagcguugucccg

SEQ ID NO: 1839463 - RNA, 17 nt, Salmonella typhimurium LT2
cuucagcgacaucguca

SEQ ID NO: 1839464 - RNA, 19 nt, Salmonella typhimurium LT2
cuucaugugguaggcuuca

SEQ ID NO: 1839465 - RNA, 22 nt, Salmonella typhimurium LT2
cuucaugugguaggcuucaacc

SEQ ID NO: 1839466 - RNA, 14 nt, Salmonella typhimurium LT2
cuucaugcagcccg

SEQ ID NO: 1839467 - RNA, 14 nt, Salmonella typhimurium LT2
cuucaugcagcgcg

SEQ ID NO: 1839468 - RNA, 13 nt, Salmonella typhimurium LT2
cuucaugcacaaa

SEQ ID NO: 1839469 - RNA, 12 nt, Salmonella typhimurium LT2
cuucaugccucg

SEQ ID NO: 1839470 - RNA, 16 nt, Salmonella typhimurium LT2
cuucaucgccacgcca

SEQ ID NO: 1839471 - RNA, 23 nt, Salmonella typhimurium LT2
cuucauauuaaauuccggcucgc

SEQ ID NO: 1839472 - RNA, 15 nt, Salmonella typhimurium LT2
cuucauauuucaagc

SEQ ID NO: 1839473 - RNA, 19 nt, Salmonella typhimurium LT2
cuucaucaaagaaauaccc

SEQ ID NO: 1839474 - RNA, 17 nt, Salmonella typhimurium LT2
cuucauccgcucccgcu

SEQ ID NO: 1839475 - RNA, 14 nt, Salmonella typhimurium LT2
cuucaacagcggcg

SEQ ID NO: 1839476 - RNA, 22 nt, Salmonella typhimurium LT2
cuucaaaugauuuuuauaaaau

SEQ ID NO: 1839477 - RNA, 21 nt, Salmonella typhimurium LT2
cuuauucacagcguaagaauu

SEQ ID NO: 1839478 - RNA, 12 nt, Salmonella typhimurium LT2
cuuauucaggcg

SEQ ID NO: 1839479 - RNA, 16 nt, Salmonella typhimurium LT2
cuuauucgguuuaucc

SEQ ID NO: 1839480 - RNA, 17 nt, Salmonella typhimurium LT2
cuuauugaugacgcuua

SEQ ID NO: 1839481 - RNA, 19 nt, Salmonella typhimurium LT2
cuucaauuuuccagauagc

SEQ ID NO: 1839482 - RNA, 23 nt, Salmonella typhimurium LT2
cuucaauuugccggaacucagcu

SEQ ID NO: 1839483 - RNA, 17 nt, Salmonella typhimurium LT2
cuucacuucacaaacaa

SEQ ID NO: 1839484 - RNA, 21 nt, Salmonella typhimurium LT2
cuucacucugggauuugcgaa

SEQ ID NO: 1839485 - RNA, 14 nt, Salmonella typhimurium LT2
cuucacgcuaaucc

SEQ ID NO: 1839486 - RNA, 19 nt, Salmonella typhimurium LT2
cuucacgccauuccagcug

SEQ ID NO: 1839487 - RNA, 21 nt, Salmonella typhimurium LT2
cuucacgccauuccagcuggg

SEQ ID NO: 1839488 - RNA, 19 nt, Salmonella typhimurium LT2
cuucacgaagucuggcugc

SEQ ID NO: 1839489 - RNA, 21 nt, Salmonella typhimurium LT2
cuucacgagcggucaggccag

SEQ ID NO: 1839490 - RNA, 17 nt, Salmonella typhimurium LT2
cuucaccucagucgcuu

SEQ ID NO: 1839491 - RNA, 18 nt, Salmonella typhimurium LT2
cuuccacacggcauucac

SEQ ID NO: 1839492 - RNA, 14 nt, Salmonella typhimurium LT2
cuuccaccaccucc

SEQ ID NO: 1839493 - RNA, 21 nt, Salmonella typhimurium LT2
cuuccagauacauggcuauuc

SEQ ID NO: 1839494 - RNA, 18 nt, Salmonella typhimurium LT2
cuuccaccaccuccugcu

SEQ ID NO: 1839495 - RNA, 14 nt, Salmonella typhimurium LT2
cuuccagcaccgcg

SEQ ID NO: 1839496 - RNA, 12 nt, Salmonella typhimurium LT2
aaacuuaucauu

SEQ ID NO: 1839497 - RNA, 23 nt, Salmonella typhimurium LT2
aaacuuaucauuuuuucuaagau

SEQ ID NO: 1839498 - RNA, 12 nt, Salmonella typhimurium LT2
cuuccagcgcca

SEQ ID NO: 1839499 - RNA, 14 nt, Salmonella typhimurium LT2
cuuccagcgcgccg

SEQ ID NO: 1839500 - RNA, 17 nt, Salmonella typhimurium LT2
cuuccagcgacuccgga

SEQ ID NO: 1839501 - RNA, 20 nt, Salmonella typhimurium LT2
cuuccagcgcauggaagaaa

SEQ ID NO: 1839502 - RNA, 15 nt, Salmonella typhimurium LT2
cuuccaucagccagg

SEQ ID NO: 1839503 - RNA, 15 nt, Salmonella typhimurium LT2
cuucccccaccacca

SEQ ID NO: 1839504 - RNA, 16 nt, Salmonella typhimurium LT2
cuucccccaccaccau

SEQ ID NO: 1839505 - RNA, 22 nt, Salmonella typhimurium LT2
cuuccgaaucaauuccuacaau

SEQ ID NO: 1839506 - RNA, 18 nt, Salmonella typhimurium LT2
cuucccugaccagcgacg

SEQ ID NO: 1839507 - RNA, 17 nt, Salmonella typhimurium LT2
cuuccccggcagcccca

SEQ ID NO: 1839508 - RNA, 23 nt, Salmonella typhimurium LT2
cuucccauauuuuuucugccagu

SEQ ID NO: 1839509 - RNA, 17 nt, Salmonella typhimurium LT2
cuuccccaucaaaacug

SEQ ID NO: 1839510 - RNA, 17 nt, Salmonella typhimurium LT2
cuuccuuugccuuucuu

SEQ ID NO: 1839511 - RNA, 19 nt, Salmonella typhimurium LT2
cuuccgccauacccggcuc

SEQ ID NO: 1839512 - RNA, 23 nt, Salmonella typhimurium LT2
cuuccgccagcgccagcagcagu

SEQ ID NO: 1839513 - RNA, 19 nt, Salmonella typhimurium LT2
cuuccgcaccgccagucaa

SEQ ID NO: 1839514 - RNA, 20 nt, Salmonella typhimurium LT2
cuucgcccaucgccgccucc

SEQ ID NO: 1839515 - RNA, 20 nt, Salmonella typhimurium LT2
cuucgccaucuccaucauuu

SEQ ID NO: 1839516 - RNA, 21 nt, Salmonella typhimurium LT2
cuucgccaacuuuuugcgcaa

SEQ ID NO: 1839517 - RNA, 20 nt, Salmonella typhimurium LT2
cuucgcauuuuuaucggcua

SEQ ID NO: 1839518 - RNA, 19 nt, Salmonella typhimurium LT2
cuucgccaaacacccagcc

SEQ ID NO: 1839519 - RNA, 13 nt, Salmonella typhimurium LT2
cuucgcaaucucc

SEQ ID NO: 1839520 - RNA, 22 nt, Salmonella typhimurium LT2
cuucgcaauagggggugacauc

SEQ ID NO: 1839521 - RNA, 18 nt, Salmonella typhimurium LT2
cuucgcagaucgccugga

SEQ ID NO: 1839522 - RNA, 23 nt, Salmonella typhimurium LT2
cuucgcauauuguaccugccgcu

SEQ ID NO: 1839523 - RNA, 20 nt, Salmonella typhimurium LT2
cuucgauggccucaucauga

SEQ ID NO: 1839524 - RNA, 15 nt, Salmonella typhimurium LT2
cuucgauggauuuga

SEQ ID NO: 1839525 - RNA, 20 nt, Salmonella typhimurium LT2
cuucgauaauaaaauauuau

SEQ ID NO: 1839526 - RNA, 19 nt, Salmonella typhimurium LT2
cuucgaugagaugcgcggu

SEQ ID NO: 1839527 - RNA, 14 nt, Salmonella typhimurium LT2
cuucgaucgccugg

SEQ ID NO: 1839528 - RNA, 15 nt, Salmonella typhimurium LT2
cugguggucuacggc

SEQ ID NO: 1839529 - RNA, 16 nt, Salmonella typhimurium LT2
cuggugugaacaucac

SEQ ID NO: 1839530 - RNA, 23 nt, Salmonella typhimurium LT2
cuggugcagcaagcggcugucau

SEQ ID NO: 1839531 - RNA, 18 nt, Salmonella typhimurium LT2
cuggugccaaucuccagc

SEQ ID NO: 1839532 - RNA, 22 nt, Salmonella typhimurium LT2
cuggugcgacaccacgcaggcg

SEQ ID NO: 1839533 - RNA, 19 nt, Salmonella typhimurium LT2
cuggugcccgcaaaaccuu

SEQ ID NO: 1839534 - RNA, 18 nt, Salmonella typhimurium LT2
cuggugcucaaucagaau

SEQ ID NO: 1839535 - RNA, 13 nt, Salmonella typhimurium LT2
cugguggaacggc

SEQ ID NO: 1839536 - RNA, 18 nt, Salmonella typhimurium LT2
cugguuuugcguaaucca

SEQ ID NO: 1839537 - RNA, 16 nt, Salmonella typhimurium LT2
cugguuucccugccuc

SEQ ID NO: 1839538 - RNA, 15 nt, Salmonella typhimurium LT2
cugguugugguccaa

SEQ ID NO: 1839539 - RNA, 16 nt, Salmonella typhimurium LT2
cugguugcugaucagc

SEQ ID NO: 1839540 - RNA, 20 nt, Salmonella typhimurium LT2
cugguguuuuuuucaucuuu

SEQ ID NO: 1839541 - RNA, 21 nt, Salmonella typhimurium LT2
cugguuaacccgguuuauccc

SEQ ID NO: 1839542 - RNA, 24 nt, Salmonella typhimurium LT2
cugguuaaugccuucgccgccgcu

SEQ ID NO: 1839543 - RNA, 14 nt, Salmonella typhimurium LT2
cugguucgaaucca

SEQ ID NO: 1839544 - RNA, 21 nt, Salmonella typhimurium LT2
cuguaacggcgcgauuuuuuc

SEQ ID NO: 1839545 - RNA, 23 nt, Salmonella typhimurium LT2
cuguaaaucgcgcccgacauggc

SEQ ID NO: 1839546 - RNA, 13 nt, Salmonella typhimurium LT2
cuguaaauguucc

SEQ ID NO: 1839547 - RNA, 16 nt, Salmonella typhimurium LT2
cuguaaacagaugcuc

SEQ ID NO: 1839548 - RNA, 12 nt, Salmonella typhimurium LT2
cuguaaaaggga

SEQ ID NO: 1839549 - RNA, 18 nt, Salmonella typhimurium LT2
cuguacgcugaacaaccc

SEQ ID NO: 1839550 - RNA, 21 nt, Salmonella typhimurium LT2
cuguacgccacggcuuaaauc

SEQ ID NO: 1839551 - RNA, 14 nt, Salmonella typhimurium LT2
cuguacgcccagcc

SEQ ID NO: 1839552 - RNA, 15 nt, Salmonella typhimurium LT2
cuguacgccacggcu

SEQ ID NO: 1839553 - RNA, 16 nt, Salmonella typhimurium LT2
cuguacgcccagccgu

SEQ ID NO: 1839554 - RNA, 18 nt, Salmonella typhimurium LT2
cuguaccugauccagcuc

SEQ ID NO: 1839555 - RNA, 13 nt, Salmonella typhimurium LT2
cuguaaugaggca

SEQ ID NO: 1839556 - RNA, 17 nt, Salmonella typhimurium LT2
cuguaaugggcaauaaa

SEQ ID NO: 1839557 - RNA, 12 nt, Salmonella typhimurium LT2
cuguaccaccac

SEQ ID NO: 1839558 - RNA, 16 nt, Salmonella typhimurium LT2
cuguaauuucgcuggc

SEQ ID NO: 1839559 - RNA, 14 nt, Salmonella typhimurium LT2
cugggucaggaacu

SEQ ID NO: 1839560 - RNA, 16 nt, Salmonella typhimurium LT2
cuggguuugcugaauc

SEQ ID NO: 1839561 - RNA, 19 nt, Salmonella typhimurium LT2
cugguaaccguaacgcucc

SEQ ID NO: 1839562 - RNA, 23 nt, Salmonella typhimurium LT2
cugguaaccguaacgcuccugga

SEQ ID NO: 1839563 - RNA, 16 nt, Salmonella typhimurium LT2
cugguaacggcacugc

SEQ ID NO: 1839564 - RNA, 22 nt, Salmonella typhimurium LT2
cugguaacggcacugcuuuucg

SEQ ID NO: 1839565 - RNA, 14 nt, Salmonella typhimurium LT2
cuggguugcccaaa

SEQ ID NO: 1839566 - RNA, 21 nt, Salmonella typhimurium LT2
cugggcuuuauccugaccgcu

SEQ ID NO: 1839567 - RNA, 18 nt, Salmonella typhimurium LT2
cugggcugauacgccugg

SEQ ID NO: 1839568 - RNA, 17 nt, Salmonella typhimurium LT2
cugggcugacaaaaauu

SEQ ID NO: 1839569 - RNA, 16 nt, Salmonella typhimurium LT2
cuggggguaacacaaa

SEQ ID NO: 1839570 - RNA, 22 nt, Salmonella typhimurium LT2
cugggcgagggaggcaaucgca

SEQ ID NO: 1839571 - RNA, 13 nt, Salmonella typhimurium LT2
cuggucauccccg

SEQ ID NO: 1839572 - RNA, 15 nt, Salmonella typhimurium LT2
cuggucauccccguc

SEQ ID NO: 1839573 - RNA, 15 nt, Salmonella typhimurium LT2
cugguaggccugaua

SEQ ID NO: 1839574 - RNA, 18 nt, Salmonella typhimurium LT2
cugguauaggccaggcua

SEQ ID NO: 1839575 - RNA, 19 nt, Salmonella typhimurium LT2
cuggucaacacgcggucgu

SEQ ID NO: 1839576 - RNA, 17 nt, Salmonella typhimurium LT2
cugguaagagagccuua

SEQ ID NO: 1839577 - RNA, 22 nt, Salmonella typhimurium LT2
cugguaagagagccuuauaggc

SEQ ID NO: 1839578 - RNA, 20 nt, Salmonella typhimurium LT2
cugguaaguguuagcucuua

SEQ ID NO: 1839579 - RNA, 21 nt, Salmonella typhimurium LT2
cugguagcccucgcaaagcug

SEQ ID NO: 1839580 - RNA, 18 nt, Salmonella typhimurium LT2
cugguagagaucgacaaa

SEQ ID NO: 1839581 - RNA, 16 nt, Salmonella typhimurium LT2
cugguaggcauccaga

SEQ ID NO: 1839582 - RNA, 15 nt, Salmonella typhimurium LT2
cuggucgccagcgcc

SEQ ID NO: 1839583 - RNA, 21 nt, Salmonella typhimurium LT2
cuggucgagaacguaaaagac

SEQ ID NO: 1839584 - RNA, 21 nt, Salmonella typhimurium LT2
cuggugaaacguguuuauccc

SEQ ID NO: 1839585 - RNA, 17 nt, Salmonella typhimurium LT2
cuggugacgaugauaac

SEQ ID NO: 1839586 - RNA, 18 nt, Salmonella typhimurium LT2
cuggugacgaugauaaca

SEQ ID NO: 1839587 - RNA, 15 nt, Salmonella typhimurium LT2
cuggugauaaagcag

SEQ ID NO: 1839588 - RNA, 14 nt, Salmonella typhimurium LT2
cuggugaucuggcc

SEQ ID NO: 1839589 - RNA, 16 nt, Salmonella typhimurium LT2
cugugccguugagcac

SEQ ID NO: 1839590 - RNA, 22 nt, Salmonella typhimurium LT2
cugugcgagcgcccgccgcgag

SEQ ID NO: 1839591 - RNA, 22 nt, Salmonella typhimurium LT2
cugugcgguuugcgcuccggca

SEQ ID NO: 1839592 - RNA, 14 nt, Salmonella typhimurium LT2
cugugcgugaccca

SEQ ID NO: 1839593 - RNA, 15 nt, Salmonella typhimurium LT2
cuguggaaaaucugg

SEQ ID NO: 1839594 - RNA, 17 nt, Salmonella typhimurium LT2
cugugcuuucgccacca

SEQ ID NO: 1839595 - RNA, 17 nt, Salmonella typhimurium LT2
cugugcaaaauuacuuc

SEQ ID NO: 1839596 - RNA, 20 nt, Salmonella typhimurium LT2
cugugccagcucguuauuuc

SEQ ID NO: 1839597 - RNA, 19 nt, Salmonella typhimurium LT2
cugugccacauuuaugucg

SEQ ID NO: 1839598 - RNA, 19 nt, Salmonella typhimurium LT2
cugugccgccggugucucc

SEQ ID NO: 1839599 - RNA, 23 nt, Salmonella typhimurium LT2
cugucgcuaaagcacuccccggc

SEQ ID NO: 1839600 - RNA, 20 nt, Salmonella typhimurium LT2
cugucgccgcguaaauccac

SEQ ID NO: 1839601 - RNA, 17 nt, Salmonella typhimurium LT2
cugucgccgucaauguc

SEQ ID NO: 1839602 - RNA, 15 nt, Salmonella typhimurium LT2
cugucgccaccacuc

SEQ ID NO: 1839603 - RNA, 14 nt, Salmonella typhimurium LT2
cugucgccaccacu

SEQ ID NO: 1839604 - RNA, 21 nt, Salmonella typhimurium LT2
cugucgauaauauccagcacg

SEQ ID NO: 1839605 - RNA, 16 nt, Salmonella typhimurium LT2
cugucgggagccucuu

SEQ ID NO: 1839606 - RNA, 15 nt, Salmonella typhimurium LT2
cugucggcagaaccu

SEQ ID NO: 1839607 - RNA, 18 nt, Salmonella typhimurium LT2
cugucggagagcggcaug

SEQ ID NO: 1839608 - RNA, 21 nt, Salmonella typhimurium LT2
cugucgaucauccacccggcu

SEQ ID NO: 1839609 - RNA, 18 nt, Salmonella typhimurium LT2
cugucgauuuccggcggc

SEQ ID NO: 1839610 - RNA, 20 nt, Salmonella typhimurium LT2
cugucgauuuccggcggcag

SEQ ID NO: 1839611 - RNA, 18 nt, Salmonella typhimurium LT2
cugucgaccgcuccacuc

SEQ ID NO: 1839612 - RNA, 16 nt, Salmonella typhimurium LT2
cugucgauaaacucau

SEQ ID NO: 1839613 - RNA, 12 nt, Salmonella typhimurium LT2
cugucgacuggc

SEQ ID NO: 1839614 - RNA, 22 nt, Salmonella typhimurium LT2
cuguccgggcguuucagcuucc

SEQ ID NO: 1839615 - RNA, 22 nt, Salmonella typhimurium LT2
cugucucuauuaaccgggacuc

SEQ ID NO: 1839616 - RNA, 16 nt, Salmonella typhimurium LT2
cugucuuguuuuucug

SEQ ID NO: 1839617 - RNA, 17 nt, Salmonella typhimurium LT2
cugucguguccuugcca

SEQ ID NO: 1839618 - RNA, 16 nt, Salmonella typhimurium LT2
cugucgucaccagcag

SEQ ID NO: 1839619 - RNA, 15 nt, Salmonella typhimurium LT2
cuguccacgacagaa

SEQ ID NO: 1839620 - RNA, 20 nt, Salmonella typhimurium LT2
cuguccauaccggacuccag

SEQ ID NO: 1839621 - RNA, 19 nt, Salmonella typhimurium LT2
cugucauugggagcaaagc

SEQ ID NO: 1839622 - RNA, 20 nt, Salmonella typhimurium LT2
cugucauugggagcaaagcu

SEQ ID NO: 1839623 - RNA, 16 nt, Salmonella typhimurium LT2
cugucccccagggaug

SEQ ID NO: 1839624 - RNA, 23 nt, Salmonella typhimurium LT2
cuguccgcccaacaccagcacug

SEQ ID NO: 1839625 - RNA, 13 nt, Salmonella typhimurium LT2
aaacugccagggc

SEQ ID NO: 1839626 - RNA, 13 nt, Salmonella typhimurium LT2
cugucaccagcag

SEQ ID NO: 1839627 - RNA, 14 nt, Salmonella typhimurium LT2
aaacugagucguag

SEQ ID NO: 1839628 - RNA, 21 nt, Salmonella typhimurium LT2
aaacucuuuuucaauaaacgg

SEQ ID NO: 1839629 - RNA, 19 nt, Salmonella typhimurium LT2
cuguauuuucuaucuuuuu

SEQ ID NO: 1839630 - RNA, 22 nt, Salmonella typhimurium LT2
cuguauacauacauacauacca

SEQ ID NO: 1839631 - RNA, 16 nt, Salmonella typhimurium LT2
cuguauaaauaaaauu

SEQ ID NO: 1839632 - RNA, 17 nt, Salmonella typhimurium LT2
cuguagauaccuacuuu

SEQ ID NO: 1839633 - RNA, 18 nt, Salmonella typhimurium LT2
cuguagauaccuacuuua

SEQ ID NO: 1839634 - RNA, 13 nt, Salmonella typhimurium LT2
cuguagccagccu

SEQ ID NO: 1839635 - RNA, 14 nt, Salmonella typhimurium LT2
cuguagccagccug

SEQ ID NO: 1839636 - RNA, 20 nt, Salmonella typhimurium LT2
cuguagcgucucaucaaaaa

SEQ ID NO: 1839637 - RNA, 20 nt, Salmonella typhimurium LT2
cuguagcgccgcuuccaggc

SEQ ID NO: 1839638 - RNA, 18 nt, Salmonella typhimurium LT2
cuguaggaucaaccaccu

SEQ ID NO: 1839639 - RNA, 20 nt, Salmonella typhimurium LT2
cuguagugaggcugguugug

SEQ ID NO: 1839640 - RNA, 20 nt, Salmonella typhimurium LT2
gaagaaaaaggcaauaaagu

SEQ ID NO: 1839641 - RNA, 19 nt, Salmonella typhimurium LT2
gaagaaaccgcagaaaaag

SEQ ID NO: 1839642 - RNA, 21 nt, Salmonella typhimurium LT2
gaagaaaaaauuaaaauucau

SEQ ID NO: 1839643 - RNA, 12 nt, Salmonella typhimurium LT2
gaacuuauccac

SEQ ID NO: 1839644 - RNA, 17 nt, Salmonella typhimurium LT2
gaacuuccgccaccacc

SEQ ID NO: 1839645 - RNA, 22 nt, Salmonella typhimurium LT2
gaacugguuugucgauuugcug

SEQ ID NO: 1839646 - RNA, 17 nt, Salmonella typhimurium LT2
gaacuguucagccagca

SEQ ID NO: 1839647 - RNA, 22 nt, Salmonella typhimurium LT2
aaagagguugacgcuucaaggc

SEQ ID NO: 1839648 - RNA, 23 nt, Salmonella typhimurium LT2
aaagagggugaaccaaagcaaaa

SEQ ID NO: 1839649 - RNA, 14 nt, Salmonella typhimurium LT2
aaagauaaacgaca

SEQ ID NO: 1839650 - RNA, 18 nt, Salmonella typhimurium LT2
aaagagugccagaaacau

SEQ ID NO: 1839651 - RNA, 15 nt, Salmonella typhimurium LT2
gaagcacgacacaaa

SEQ ID NO: 1839652 - RNA, 17 nt, Salmonella typhimurium LT2
gaagcacgacacaaaag

SEQ ID NO: 1839653 - RNA, 19 nt, Salmonella typhimurium LT2
gaagaguuaacuucuccuc

SEQ ID NO: 1839654 - RNA, 21 nt, Salmonella typhimurium LT2
gaagaguuaacuucuccucca

SEQ ID NO: 1839655 - RNA, 20 nt, Salmonella typhimurium LT2
gaagauagcgggcaaugcca

SEQ ID NO: 1839656 - RNA, 23 nt, Salmonella typhimurium LT2
gaagcaauucuucgaaugucuca

SEQ ID NO: 1839657 - RNA, 15 nt, Salmonella typhimurium LT2
gaagcaagugcugga

SEQ ID NO: 1839658 - RNA, 17 nt, Salmonella typhimurium LT2
gaagcggcacugcucuu

SEQ ID NO: 1839659 - RNA, 18 nt, Salmonella typhimurium LT2
gaagcggguauuauacuu

SEQ ID NO: 1839660 - RNA, 19 nt, Salmonella typhimurium LT2
gaagcggcgccauccggca

SEQ ID NO: 1839661 - RNA, 20 nt, Salmonella typhimurium LT2
gaagcgcguuggcguuaccu

SEQ ID NO: 1839662 - RNA, 23 nt, Salmonella typhimurium LT2
gaagcccggccacagcgccagac

SEQ ID NO: 1839663 - RNA, 19 nt, Salmonella typhimurium LT2
gaagcgauuuauccaccgc

SEQ ID NO: 1839664 - RNA, 16 nt, Salmonella typhimurium LT2
gaagcgauguaagagg

SEQ ID NO: 1839665 - RNA, 14 nt, Salmonella typhimurium LT2
gaagguuuuucccg

SEQ ID NO: 1839666 - RNA, 17 nt, Salmonella typhimurium LT2
gaaguagcagagaaaag

SEQ ID NO: 1839667 - RNA, 21 nt, Salmonella typhimurium LT2
gaaguagcagagaaaagguug

SEQ ID NO: 1839668 - RNA, 14 nt, Salmonella typhimurium LT2
gaaggggauuuucc

SEQ ID NO: 1839669 - RNA, 15 nt, Salmonella typhimurium LT2
gaaggcgcuaugcug

SEQ ID NO: 1839670 - RNA, 19 nt, Salmonella typhimurium LT2
gaaggauuauuggcaucau

SEQ ID NO: 1839671 - RNA, 18 nt, Salmonella typhimurium LT2
gaaggaugaccggcuauc

SEQ ID NO: 1839672 - RNA, 14 nt, Salmonella typhimurium LT2
gaaggcaacugauc

SEQ ID NO: 1839673 - RNA, 21 nt, Salmonella typhimurium LT2
gaaggcaucuucagacaguuu

SEQ ID NO: 1839674 - RNA, 12 nt, Salmonella typhimurium LT2
gaaggacaagcu

SEQ ID NO: 1839675 - RNA, 17 nt, Salmonella typhimurium LT2
gaaggacaagcugcgcc

SEQ ID NO: 1839676 - RNA, 14 nt, Salmonella typhimurium LT2
gaauaaaaaacaag

SEQ ID NO: 1839677 - RNA, 17 nt, Salmonella typhimurium LT2
gaaguccucuauuuuuu

SEQ ID NO: 1839678 - RNA, 19 nt, Salmonella typhimurium LT2
gaaguagcaaaucaucgcc

SEQ ID NO: 1839679 - RNA, 14 nt, Salmonella typhimurium LT2
gaagucuaucugua

SEQ ID NO: 1839680 - RNA, 16 nt, Salmonella typhimurium LT2
gaauaccaaaucucaa

SEQ ID NO: 1839681 - RNA, 15 nt, Salmonella typhimurium LT2
gaauaaucccggcgc

SEQ ID NO: 1839682 - RNA, 15 nt, Salmonella typhimurium LT2
gaauacccagcucag

SEQ ID NO: 1839683 - RNA, 13 nt, Salmonella typhimurium LT2
gaauaccuucccg

SEQ ID NO: 1839684 - RNA, 13 nt, Salmonella typhimurium LT2
gaauaaacucccg

SEQ ID NO: 1839685 - RNA, 11 nt, Salmonella typhimurium LT2
gaauaaacaca

SEQ ID NO: 1839686 - RNA, 20 nt, Salmonella typhimurium LT2
gaauagccagcccccugcca

SEQ ID NO: 1839687 - RNA, 12 nt, Salmonella typhimurium LT2
gaauagcaggca

SEQ ID NO: 1839688 - RNA, 17 nt, Salmonella typhimurium LT2
gaauagaggcgcuggcg

SEQ ID NO: 1839689 - RNA, 15 nt, Salmonella typhimurium LT2
gaauagacuggcgcc

SEQ ID NO: 1839690 - RNA, 23 nt, Salmonella typhimurium LT2
gaauagccccucaauuauguauu

SEQ ID NO: 1839691 - RNA, 15 nt, Salmonella typhimurium LT2
gaauagcgcagaccc

SEQ ID NO: 1839692 - RNA, 19 nt, Salmonella typhimurium LT2
gaauagccugggcaaggcu

SEQ ID NO: 1839693 - RNA, 19 nt, Salmonella typhimurium LT2
gaauagcgccuacgggcau

SEQ ID NO: 1839694 - RNA, 16 nt, Salmonella typhimurium LT2
gaauagugauaccagc

SEQ ID NO: 1839695 - RNA, 22 nt, Salmonella typhimurium LT2
aaagauuauuuuaucaucagca

SEQ ID NO: 1839696 - RNA, 16 nt, Salmonella typhimurium LT2
gaauccccaucuccag

SEQ ID NO: 1839697 - RNA, 16 nt, Salmonella typhimurium LT2
gaauccagguacccca

SEQ ID NO: 1839698 - RNA, 11 nt, Salmonella typhimurium LT2
gaauccaggua

SEQ ID NO: 1839699 - RNA, 16 nt, Salmonella typhimurium LT2
gaauccaggccagaua

SEQ ID NO: 1839700 - RNA, 15 nt, Salmonella typhimurium LT2
gaaucacauccgcca

SEQ ID NO: 1839701 - RNA, 16 nt, Salmonella typhimurium LT2
gaaucaaugcaucuuc

SEQ ID NO: 1839702 - RNA, 14 nt, Salmonella typhimurium LT2
gaaugacaaaccgg

SEQ ID NO: 1839703 - RNA, 22 nt, Salmonella typhimurium LT2
gaaugaagccuuagcgggaggc

SEQ ID NO: 1839704 - RNA, 17 nt, Salmonella typhimurium LT2
gaaugaaggauuguacu

SEQ ID NO: 1839705 - RNA, 17 nt, Salmonella typhimurium LT2
gaaugaaaaaaaauuac

SEQ ID NO: 1839706 - RNA, 13 nt, Salmonella typhimurium LT2
gaaucgccaggcg

SEQ ID NO: 1839707 - RNA, 14 nt, Salmonella typhimurium LT2
gaaucgccaggcgc

SEQ ID NO: 1839708 - RNA, 15 nt, Salmonella typhimurium LT2
gaauguagcgaccuu

SEQ ID NO: 1839709 - RNA, 18 nt, Salmonella typhimurium LT2
gaauguccacuccggcgu

SEQ ID NO: 1839710 - RNA, 18 nt, Salmonella typhimurium LT2
gaaugccggauggcggcg

SEQ ID NO: 1839711 - RNA, 15 nt, Salmonella typhimurium LT2
gaaugccguugacca

SEQ ID NO: 1839712 - RNA, 14 nt, Salmonella typhimurium LT2
gaaugagcaucuac

SEQ ID NO: 1839713 - RNA, 15 nt, Salmonella typhimurium LT2
gaauuaucaggguua

SEQ ID NO: 1839714 - RNA, 13 nt, Salmonella typhimurium LT2
gaauuauuaccaa

SEQ ID NO: 1839715 - RNA, 16 nt, Salmonella typhimurium LT2
gaauugauaaagaucu

SEQ ID NO: 1839716 - RNA, 17 nt, Salmonella typhimurium LT2
gaauuuaaucucacaaa

SEQ ID NO: 1839717 - RNA, 17 nt, Salmonella typhimurium LT2
gaauuuagcacccagga

SEQ ID NO: 1839718 - RNA, 14 nt, Salmonella typhimurium LT2
gaauugguagacgc

SEQ ID NO: 1839719 - RNA, 21 nt, Salmonella typhimurium LT2
gaauuguccacccucccagaa

SEQ ID NO: 1839720 - RNA, 18 nt, Salmonella typhimurium LT2
gacaaaaauggauagagu

SEQ ID NO: 1839721 - RNA, 14 nt, Salmonella typhimurium LT2
gacaaaaaucugaa

SEQ ID NO: 1839722 - RNA, 14 nt, Salmonella typhimurium LT2
gacaaaaauaccac

SEQ ID NO: 1839723 - RNA, 13 nt, Salmonella typhimurium LT2
gaauuucaggaag

SEQ ID NO: 1839724 - RNA, 22 nt, Salmonella typhimurium LT2
gaauuucaggguagcauugccg

SEQ ID NO: 1839725 - RNA, 21 nt, Salmonella typhimurium LT2
gacaaaaucuuuccagcucca

SEQ ID NO: 1839726 - RNA, 21 nt, Salmonella typhimurium LT2
gacaaggcgaucucaagcgcc

SEQ ID NO: 1839727 - RNA, 18 nt, Salmonella typhimurium LT2
gacaaggcgauucaaaac

SEQ ID NO: 1839728 - RNA, 19 nt, Salmonella typhimurium LT2
gacaaggcgguacuccgcc

SEQ ID NO: 1839729 - RNA, 14 nt, Salmonella typhimurium LT2
gacaaccugcccuu

SEQ ID NO: 1839730 - RNA, 18 nt, Salmonella typhimurium LT2
gacaacgcuccagcaguu

SEQ ID NO: 1839731 - RNA, 17 nt, Salmonella typhimurium LT2
gacaacgccgccuggca

SEQ ID NO: 1839732 - RNA, 16 nt, Salmonella typhimurium LT2
gacaaugaauauuauu

SEQ ID NO: 1839733 - RNA, 23 nt, Salmonella typhimurium LT2
gacaaucuccuccggcuucagca

SEQ ID NO: 1839734 - RNA, 23 nt, Salmonella typhimurium LT2
gacaauuuugauaagagaaaaua

SEQ ID NO: 1839735 - RNA, 20 nt, Salmonella typhimurium LT2
gacuacucccgucgccuguu

SEQ ID NO: 1839736 - RNA, 18 nt, Salmonella typhimurium LT2
gacuauuccgcaaacgcc

SEQ ID NO: 1839737 - RNA, 14 nt, Salmonella typhimurium LT2
gacuaucgccgccc

SEQ ID NO: 1839738 - RNA, 16 nt, Salmonella typhimurium LT2
gacuaucguuacccua

SEQ ID NO: 1839739 - RNA, 17 nt, Salmonella typhimurium LT2
gacuaucagaaaaaauu

SEQ ID NO: 1839740 - RNA, 17 nt, Salmonella typhimurium LT2
gacguucaauucauaga

SEQ ID NO: 1839741 - RNA, 22 nt, Salmonella typhimurium LT2
gacguggggguucaaguccccc

SEQ ID NO: 1839742 - RNA, 12 nt, Salmonella typhimurium LT2
gacguggggguu

SEQ ID NO: 1839743 - RNA, 17 nt, Salmonella typhimurium LT2
gacguggggguucaagu

SEQ ID NO: 1839744 - RNA, 20 nt, Salmonella typhimurium LT2
gacgucacugucagcaucag

SEQ ID NO: 1839745 - RNA, 21 nt, Salmonella typhimurium LT2
gacgucaacaccuccaguuca

SEQ ID NO: 1839746 - RNA, 18 nt, Salmonella typhimurium LT2
gacgucaacgguaaaaug

SEQ ID NO: 1839747 - RNA, 15 nt, Salmonella typhimurium LT2
gacguucgacccgca

SEQ ID NO: 1839748 - RNA, 19 nt, Salmonella typhimurium LT2
gacguucagcauauccagc

SEQ ID NO: 1839749 - RNA, 16 nt, Salmonella typhimurium LT2
gacuaaaagacgccau

SEQ ID NO: 1839750 - RNA, 22 nt, Salmonella typhimurium LT2
gacuaaaaagcgcguccccggu

SEQ ID NO: 1839751 - RNA, 15 nt, Salmonella typhimurium LT2
gacuaaccuugauuc

SEQ ID NO: 1839752 - RNA, 18 nt, Salmonella typhimurium LT2
gacggccugucuccgcag

SEQ ID NO: 1839753 - RNA, 14 nt, Salmonella typhimurium LT2
gacggcggaccccu

SEQ ID NO: 1839754 - RNA, 15 nt, Salmonella typhimurium LT2
gacggcuaagcugau

SEQ ID NO: 1839755 - RNA, 16 nt, Salmonella typhimurium LT2
gacggcugaauguucu

SEQ ID NO: 1839756 - RNA, 23 nt, Salmonella typhimurium LT2
gacgccgucugguacggccacca

SEQ ID NO: 1839757 - RNA, 18 nt, Salmonella typhimurium LT2
gacgccgggaaauuuuuc

SEQ ID NO: 1839758 - RNA, 15 nt, Salmonella typhimurium LT2
gacggacccugacca

SEQ ID NO: 1839759 - RNA, 23 nt, Salmonella typhimurium LT2
gaccugcaguucguacuccugca

SEQ ID NO: 1839760 - RNA, 23 nt, Salmonella typhimurium LT2
gaccugcagcuccacaaauagca

SEQ ID NO: 1839761 - RNA, 22 nt, Salmonella typhimurium LT2
gaccugaauauucggcuccaga

SEQ ID NO: 1839762 - RNA, 18 nt, Salmonella typhimurium LT2
gaccggcgaacgcuggcu

SEQ ID NO: 1839763 - RNA, 20 nt, Salmonella typhimurium LT2
gaccggaacggggaaccagc

SEQ ID NO: 1839764 - RNA, 17 nt, Salmonella typhimurium LT2
gaccgcuuucgccuggu

SEQ ID NO: 1839765 - RNA, 15 nt, Salmonella typhimurium LT2
gacgaacggccugau

SEQ ID NO: 1839766 - RNA, 15 nt, Salmonella typhimurium LT2
gacgcagcucauacc

SEQ ID NO: 1839767 - RNA, 19 nt, Salmonella typhimurium LT2
gacgauacucaaaccugcg

SEQ ID NO: 1839768 - RNA, 20 nt, Salmonella typhimurium LT2
gacgauacggcccagacccc

SEQ ID NO: 1839769 - RNA, 17 nt, Salmonella typhimurium LT2
gacgauacgucauauca

SEQ ID NO: 1839770 - RNA, 19 nt, Salmonella typhimurium LT2
gacgauauucaagcuguug

SEQ ID NO: 1839771 - RNA, 15 nt, Salmonella typhimurium LT2
gacgaucagcgccac

SEQ ID NO: 1839772 - RNA, 22 nt, Salmonella typhimurium LT2
gacgauaaccggacgauuuaag

SEQ ID NO: 1839773 - RNA, 18 nt, Salmonella typhimurium LT2
gacgagguuuccggcggg

SEQ ID NO: 1839774 - RNA, 21 nt, Salmonella typhimurium LT2
gacgacguucgauacuauaac

SEQ ID NO: 1839775 - RNA, 17 nt, Salmonella typhimurium LT2
gacgacgccaggcgguc

SEQ ID NO: 1839776 - RNA, 16 nt, Salmonella typhimurium LT2
gacgacggcaggggcg

SEQ ID NO: 1839777 - RNA, 17 nt, Salmonella typhimurium LT2
gacgccgacauaagcug

SEQ ID NO: 1839778 - RNA, 16 nt, Salmonella typhimurium LT2
gacgccgauaaagccu

SEQ ID NO: 1839779 - RNA, 13 nt, Salmonella typhimurium LT2
gacgccagauaau

SEQ ID NO: 1839780 - RNA, 22 nt, Salmonella typhimurium LT2
gacgccagaugauagagcaccu

SEQ ID NO: 1839781 - RNA, 21 nt, Salmonella typhimurium LT2
gacgccaauuccuaucaguac

SEQ ID NO: 1839782 - RNA, 19 nt, Salmonella typhimurium LT2
gacgcauaaugacguccag

SEQ ID NO: 1839783 - RNA, 14 nt, Salmonella typhimurium LT2
gacgcccaucagca

SEQ ID NO: 1839784 - RNA, 17 nt, Salmonella typhimurium LT2
gacgcccaucagcaucc

SEQ ID NO: 1839785 - RNA, 15 nt, Salmonella typhimurium LT2
gacgccaugggguga

SEQ ID NO: 1839786 - RNA, 13 nt, Salmonella typhimurium LT2
gaccccgccaggc

SEQ ID NO: 1839787 - RNA, 18 nt, Salmonella typhimurium LT2
gaccccaguaauccggca

SEQ ID NO: 1839788 - RNA, 14 nt, Salmonella typhimurium LT2
gaccccaauagcga

SEQ ID NO: 1839789 - RNA, 14 nt, Salmonella typhimurium LT2
gaccccucuucuuu

SEQ ID NO: 1839790 - RNA, 21 nt, Salmonella typhimurium LT2
gaccccuggguagaguaaccc

SEQ ID NO: 1839791 - RNA, 23 nt, Salmonella typhimurium LT2
gaccccuggguagaguaacccuu

SEQ ID NO: 1839792 - RNA, 17 nt, Salmonella typhimurium LT2
gaccgagacccagcgcg

SEQ ID NO: 1839793 - RNA, 23 nt, Salmonella typhimurium LT2
gaccgccacaucguuggccgcca

SEQ ID NO: 1839794 - RNA, 19 nt, Salmonella typhimurium LT2
gaccgacaagccccccgca

SEQ ID NO: 1839795 - RNA, 13 nt, Salmonella typhimurium LT2
gaccgccagaggc

SEQ ID NO: 1839796 - RNA, 22 nt, Salmonella typhimurium LT2
gaccgccgucauagcaggagau

SEQ ID NO: 1839797 - RNA, 18 nt, Salmonella typhimurium LT2
gaccgccgauaaagaacu

SEQ ID NO: 1839798 - RNA, 18 nt, Salmonella typhimurium LT2
gaccauccagacaugcac

SEQ ID NO: 1839799 - RNA, 14 nt, Salmonella typhimurium LT2
gaccaucggccgcu

SEQ ID NO: 1839800 - RNA, 15 nt, Salmonella typhimurium LT2
gaccaucucuuccgc

SEQ ID NO: 1839801 - RNA, 12 nt, Salmonella typhimurium LT2
gaccauacuaau

SEQ ID NO: 1839802 - RNA, 15 nt, Salmonella typhimurium LT2
gaccaucaauccggg

SEQ ID NO: 1839803 - RNA, 14 nt, Salmonella typhimurium LT2
gaccauauucacgc

SEQ ID NO: 1839804 - RNA, 18 nt, Salmonella typhimurium LT2
gaccauaaauagccgacc

SEQ ID NO: 1839805 - RNA, 17 nt, Salmonella typhimurium LT2
gaccauugcguauuuca

SEQ ID NO: 1839806 - RNA, 11 nt, Salmonella typhimurium LT2
gacccagcgcg

SEQ ID NO: 1839807 - RNA, 23 nt, Salmonella typhimurium LT2
gacccauaguuucauauccgaca

SEQ ID NO: 1839808 - RNA, 16 nt, Salmonella typhimurium LT2
gacccaguacaaacaa

SEQ ID NO: 1839809 - RNA, 22 nt, Salmonella typhimurium LT2
gaccaugcauauaagagacgcc

SEQ ID NO: 1839810 - RNA, 16 nt, Salmonella typhimurium LT2
gaccaccauccggcaa

SEQ ID NO: 1839811 - RNA, 22 nt, Salmonella typhimurium LT2
gaccaccgaagaauuuaucaau

SEQ ID NO: 1839812 - RNA, 15 nt, Salmonella typhimurium LT2
gaccacgaaucagga

SEQ ID NO: 1839813 - RNA, 16 nt, Salmonella typhimurium LT2
gaccacgaaucaggau

SEQ ID NO: 1839814 - RNA, 20 nt, Salmonella typhimurium LT2
gaccagcguuggugccgcca

SEQ ID NO: 1839815 - RNA, 15 nt, Salmonella typhimurium LT2
gaccacgccaccgcc

SEQ ID NO: 1839816 - RNA, 19 nt, Salmonella typhimurium LT2
gaccacgccaucaacagcg

SEQ ID NO: 1839817 - RNA, 23 nt, Salmonella typhimurium LT2
gaccacgccaucaacagcggaga

SEQ ID NO: 1839818 - RNA, 14 nt, Salmonella typhimurium LT2
gaccacgccgccgc

SEQ ID NO: 1839819 - RNA, 13 nt, Salmonella typhimurium LT2
gaccagcgccgga

SEQ ID NO: 1839820 - RNA, 15 nt, Salmonella typhimurium LT2
gaccagcgccggagc

SEQ ID NO: 1839821 - RNA, 17 nt, Salmonella typhimurium LT2
gacagugaacggcauaa

SEQ ID NO: 1839822 - RNA, 17 nt, Salmonella typhimurium LT2
gacaucauccacggcau

SEQ ID NO: 1839823 - RNA, 17 nt, Salmonella typhimurium LT2
gacaucagccagccgcc

SEQ ID NO: 1839824 - RNA, 21 nt, Salmonella typhimurium LT2
gacauccaugauaaucagcac

SEQ ID NO: 1839825 - RNA, 11 nt, Salmonella typhimurium LT2
gacauccgcca

SEQ ID NO: 1839826 - RNA, 16 nt, Salmonella typhimurium LT2
gacaucccagacaaaa

SEQ ID NO: 1839827 - RNA, 19 nt, Salmonella typhimurium LT2
gacauggucgaacaucugc

SEQ ID NO: 1839828 - RNA, 13 nt, Salmonella typhimurium LT2
gacauccgccauc

SEQ ID NO: 1839829 - RNA, 23 nt, Salmonella typhimurium LT2
gacaucgccaacgccaaccggcu

SEQ ID NO: 1839830 - RNA, 15 nt, Salmonella typhimurium LT2
gacauccggauccag

SEQ ID NO: 1839831 - RNA, 13 nt, Salmonella typhimurium LT2
gaccacaacccac

SEQ ID NO: 1839832 - RNA, 14 nt, Salmonella typhimurium LT2
gaccacaaagagug

SEQ ID NO: 1839833 - RNA, 17 nt, Salmonella typhimurium LT2
gaccacaaagagugcca

SEQ ID NO: 1839834 - RNA, 23 nt, Salmonella typhimurium LT2
gaccacagauaaaacaaaaggcc

SEQ ID NO: 1839835 - RNA, 15 nt, Salmonella typhimurium LT2
gaccaccauccggca

SEQ ID NO: 1839836 - RNA, 12 nt, Salmonella typhimurium LT2
gacauuuuugcc

SEQ ID NO: 1839837 - RNA, 13 nt, Salmonella typhimurium LT2
gaccaaaccugcg

SEQ ID NO: 1839838 - RNA, 24 nt, Salmonella typhimurium LT2
gacauguucgaacaugccgacaga

SEQ ID NO: 1839839 - RNA, 24 nt, Salmonella typhimurium LT2
gacagaugcagguucccgcccugc

SEQ ID NO: 1839840 - RNA, 12 nt, Salmonella typhimurium LT2
gacagaguccac

SEQ ID NO: 1839841 - RNA, 16 nt, Salmonella typhimurium LT2
gacagauaacaccagc

SEQ ID NO: 1839842 - RNA, 19 nt, Salmonella typhimurium LT2
gacagacuucauuuuccac

SEQ ID NO: 1839843 - RNA, 19 nt, Salmonella typhimurium LT2
gacagauuggucagcagcc

SEQ ID NO: 1839844 - RNA, 15 nt, Salmonella typhimurium LT2
gacaccgcaaaccgu

SEQ ID NO: 1839845 - RNA, 23 nt, Salmonella typhimurium LT2
gacagccgcuaucacagcggcau

SEQ ID NO: 1839846 - RNA, 20 nt, Salmonella typhimurium LT2
gacaggguuugccagcacca

SEQ ID NO: 1839847 - RNA, 21 nt, Salmonella typhimurium LT2
gacagguacgcggagagauga

SEQ ID NO: 1839848 - RNA, 22 nt, Salmonella typhimurium LT2
gacagguacgcggagagaugaa

SEQ ID NO: 1839849 - RNA, 22 nt, Salmonella typhimurium LT2
gacagggcgugaaccagcaucc

SEQ ID NO: 1839850 - RNA, 20 nt, Salmonella typhimurium LT2
gacagggcgugaaccagcau

SEQ ID NO: 1839851 - RNA, 19 nt, Salmonella typhimurium LT2
gacaguaaaacccaauaac

SEQ ID NO: 1839852 - RNA, 16 nt, Salmonella typhimurium LT2
gaaagcguaauauacg

SEQ ID NO: 1839853 - RNA, 17 nt, Salmonella typhimurium LT2
gaaagcguaauaugcac

SEQ ID NO: 1839854 - RNA, 20 nt, Salmonella typhimurium LT2
gaaagguuaugcagcaagaa

SEQ ID NO: 1839855 - RNA, 18 nt, Salmonella typhimurium LT2
gaaauaacgcacuaccag

SEQ ID NO: 1839856 - RNA, 14 nt, Salmonella typhimurium LT2
gaaauaaucuguag

SEQ ID NO: 1839857 - RNA, 18 nt, Salmonella typhimurium LT2
gaaagucaaaauaaaauu

SEQ ID NO: 1839858 - RNA, 17 nt, Salmonella typhimurium LT2
gaaaucacgccacagua

SEQ ID NO: 1839859 - RNA, 19 nt, Salmonella typhimurium LT2
gaaaucacaaacaccacca

SEQ ID NO: 1839860 - RNA, 23 nt, Salmonella typhimurium LT2
gaaaucacaaacaccaccaguaa

SEQ ID NO: 1839861 - RNA, 19 nt, Salmonella typhimurium LT2
gaaauagacgagcgaaaaa

SEQ ID NO: 1839862 - RNA, 18 nt, Salmonella typhimurium LT2
gaaaaucgcugcgcccga

SEQ ID NO: 1839863 - RNA, 13 nt, Salmonella typhimurium LT2
gaaaaugaaaaau

SEQ ID NO: 1839864 - RNA, 18 nt, Salmonella typhimurium LT2
gaaaaugcgccaggaaac

SEQ ID NO: 1839865 - RNA, 22 nt, Salmonella typhimurium LT2
gaaacucgugaagaucagcaga

SEQ ID NO: 1839866 - RNA, 14 nt, Salmonella typhimurium LT2
gaaagcaaccagaa

SEQ ID NO: 1839867 - RNA, 14 nt, Salmonella typhimurium LT2
gaaagcagguuuug

SEQ ID NO: 1839868 - RNA, 13 nt, Salmonella typhimurium LT2
gaaauuugcagcg

SEQ ID NO: 1839869 - RNA, 17 nt, Salmonella typhimurium LT2
gaaauucucagaaacaa

SEQ ID NO: 1839870 - RNA, 17 nt, Salmonella typhimurium LT2
gaaauucugcaggccaa

SEQ ID NO: 1839871 - RNA, 22 nt, Salmonella typhimurium LT2
gaaauucuggcgcagcuucuga

SEQ ID NO: 1839872 - RNA, 22 nt, Salmonella typhimurium LT2
gaaaugagugcgccaaccugcu

SEQ ID NO: 1839873 - RNA, 18 nt, Salmonella typhimurium LT2
aaagagaaaagccagucg

SEQ ID NO: 1839874 - RNA, 18 nt, Salmonella typhimurium LT2
aaagagaaaaaauucaac

SEQ ID NO: 1839875 - RNA, 14 nt, Salmonella typhimurium LT2
aaagagaaaaagaa

SEQ ID NO: 1839876 - RNA, 22 nt, Salmonella typhimurium LT2
gaaaucgccgggcuauccggcu

SEQ ID NO: 1839877 - RNA, 15 nt, Salmonella typhimurium LT2
gaaaugagaaaagga

SEQ ID NO: 1839878 - RNA, 15 nt, Salmonella typhimurium LT2
gaaaugaauacgaua

SEQ ID NO: 1839879 - RNA, 18 nt, Salmonella typhimurium LT2
gaacaggccaaacccugc

SEQ ID NO: 1839880 - RNA, 16 nt, Salmonella typhimurium LT2
gaacaguuucgccagc

SEQ ID NO: 1839881 - RNA, 17 nt, Salmonella typhimurium LT2
gaacauaaaaacgcgcu

SEQ ID NO: 1839882 - RNA, 13 nt, Salmonella typhimurium LT2
gaacagccaggcu

SEQ ID NO: 1839883 - RNA, 21 nt, Salmonella typhimurium LT2
gaacaaguucuucgaagcacu

SEQ ID NO: 1839884 - RNA, 20 nt, Salmonella typhimurium LT2
gaacaaguucuucgaagcac

SEQ ID NO: 1839885 - RNA, 22 nt, Salmonella typhimurium LT2
gaacacgguguaguacacaauc

SEQ ID NO: 1839886 - RNA, 15 nt, Salmonella typhimurium LT2
gaacggcauaaucug

SEQ ID NO: 1839887 - RNA, 19 nt, Salmonella typhimurium LT2
gaacggaucaugguugaaa

SEQ ID NO: 1839888 - RNA, 22 nt, Salmonella typhimurium LT2
gaacggguaaaugcgcgcggcu

SEQ ID NO: 1839889 - RNA, 19 nt, Salmonella typhimurium LT2
gaacggcuuuccagcagcc

SEQ ID NO: 1839890 - RNA, 16 nt, Salmonella typhimurium LT2
gaacguucauggguua

SEQ ID NO: 1839891 - RNA, 16 nt, Salmonella typhimurium LT2
gaacgccuuauccggc

SEQ ID NO: 1839892 - RNA, 14 nt, Salmonella typhimurium LT2
gaacgcuaucaggu

SEQ ID NO: 1839893 - RNA, 22 nt, Salmonella typhimurium LT2
gaacgccgccugcgccagcgcc

SEQ ID NO: 1839894 - RNA, 17 nt, Salmonella typhimurium LT2
gaacgccggaacccgcg

SEQ ID NO: 1839895 - RNA, 14 nt, Salmonella typhimurium LT2
gaacgcaauacugu

SEQ ID NO: 1839896 - RNA, 15 nt, Salmonella typhimurium LT2
gaacgcaauacugua

SEQ ID NO: 1839897 - RNA, 18 nt, Salmonella typhimurium LT2
gaacuacugauuccugcc

SEQ ID NO: 1839898 - RNA, 19 nt, Salmonella typhimurium LT2
gaacuaugcugagcauaaa

SEQ ID NO: 1839899 - RNA, 21 nt, Salmonella typhimurium LT2
gaacucacauauucaauaaua

SEQ ID NO: 1839900 - RNA, 13 nt, Salmonella typhimurium LT2
gaacucaucauca

SEQ ID NO: 1839901 - RNA, 17 nt, Salmonella typhimurium LT2
gaacucaucaucaauac

SEQ ID NO: 1839902 - RNA, 19 nt, Salmonella typhimurium LT2
gaacucaucggaaaaauag

SEQ ID NO: 1839903 - RNA, 20 nt, Salmonella typhimurium LT2
gaacugauggcgcuaagcca

SEQ ID NO: 1839904 - RNA, 21 nt, Salmonella typhimurium LT2
gaacugcaaauaccacaucag

SEQ ID NO: 1839905 - RNA, 19 nt, Salmonella typhimurium LT2
gaacugcagcgcgucgacc

SEQ ID NO: 1839906 - RNA, 19 nt, Salmonella typhimurium LT2
gaacugcguaagcaucccc

SEQ ID NO: 1839907 - RNA, 16 nt, Salmonella typhimurium LT2
gaacucugcuuuuauu

SEQ ID NO: 1839908 - RNA, 15 nt, Salmonella typhimurium LT2
gaacucuuucagacc

SEQ ID NO: 1839909 - RNA, 18 nt, Salmonella typhimurium LT2
gaacaucagccagcagcu

SEQ ID NO: 1839910 - RNA, 17 nt, Salmonella typhimurium LT2
gaacaucaucuucuguc

SEQ ID NO: 1839911 - RNA, 18 nt, Salmonella typhimurium LT2
gaacauuggaauauccgc

SEQ ID NO: 1839912 - RNA, 16 nt, Salmonella typhimurium LT2
gaacauuucaucuauc

SEQ ID NO: 1839913 - RNA, 20 nt, Salmonella typhimurium LT2
gaacauugaagguauccagc

SEQ ID NO: 1839914 - RNA, 14 nt, Salmonella typhimurium LT2
gaacauuacauccu

SEQ ID NO: 1839915 - RNA, 21 nt, Salmonella typhimurium LT2
gaaccaaucgagaagccauca

SEQ ID NO: 1839916 - RNA, 18 nt, Salmonella typhimurium LT2
gaaccaacugccaaacca

SEQ ID NO: 1839917 - RNA, 21 nt, Salmonella typhimurium LT2
gaaccaauaguauggagcagg

SEQ ID NO: 1839918 - RNA, 18 nt, Salmonella typhimurium LT2
gaaccccagacacagaug

SEQ ID NO: 1839919 - RNA, 16 nt, Salmonella typhimurium LT2
gaaccauuuuccccag

SEQ ID NO: 1839920 - RNA, 18 nt, Salmonella typhimurium LT2
gaaccaucauuaauauaa

SEQ ID NO: 1839921 - RNA, 13 nt, Salmonella typhimurium LT2
gaaccaugauauc

SEQ ID NO: 1839922 - RNA, 22 nt, Salmonella typhimurium LT2
gaaccaucauuaauauaauccu

SEQ ID NO: 1839923 - RNA, 17 nt, Salmonella typhimurium LT2
gaaccaucgacccccac

SEQ ID NO: 1839924 - RNA, 18 nt, Salmonella typhimurium LT2
gaaccaucgacccccacc

SEQ ID NO: 1839925 - RNA, 19 nt, Salmonella typhimurium LT2
gaaccaucgacccccacca

SEQ ID NO: 1839926 - RNA, 13 nt, Salmonella typhimurium LT2
gaaccauaauaaa

SEQ ID NO: 1839927 - RNA, 15 nt, Salmonella typhimurium LT2
gaaccagguuuccag

SEQ ID NO: 1839928 - RNA, 18 nt, Salmonella typhimurium LT2
gaaccagucgguaucguu

SEQ ID NO: 1839929 - RNA, 13 nt, Salmonella typhimurium LT2
gaaccgagauaca

SEQ ID NO: 1839930 - RNA, 18 nt, Salmonella typhimurium LT2
gaacccggguaggcugcu

SEQ ID NO: 1839931 - RNA, 16 nt, Salmonella typhimurium LT2
gaacccgaccgucuuu

SEQ ID NO: 1839932 - RNA, 13 nt, Salmonella typhimurium LT2
gaaccgccgaccc

SEQ ID NO: 1839933 - RNA, 22 nt, Salmonella typhimurium LT2
gaaccgggugcacgaacugcug

SEQ ID NO: 1839934 - RNA, 18 nt, Salmonella typhimurium LT2
gaaccguaaacgccugca

SEQ ID NO: 1839935 - RNA, 22 nt, Salmonella typhimurium LT2
gaaccucaccguccgccaggcc

SEQ ID NO: 1839936 - RNA, 17 nt, Salmonella typhimurium LT2
gaaccucacggagaaaa

SEQ ID NO: 1839937 - RNA, 15 nt, Salmonella typhimurium LT2
gaacgagaggaggag

SEQ ID NO: 1839938 - RNA, 20 nt, Salmonella typhimurium LT2
gaacgacucacgcgcgcuuu

SEQ ID NO: 1839939 - RNA, 19 nt, Salmonella typhimurium LT2
gaaccuggcgguaaauacg

SEQ ID NO: 1839940 - RNA, 16 nt, Salmonella typhimurium LT2
cuuuugcgccuuccag

SEQ ID NO: 1839941 - RNA, 18 nt, Salmonella typhimurium LT2
cuuuugcagcaaauacag

SEQ ID NO: 1839942 - RNA, 22 nt, Salmonella typhimurium LT2
cuuuugcccgguggcgcugcgc

SEQ ID NO: 1839943 - RNA, 22 nt, Salmonella typhimurium LT2
cuuuugcuucaauagguuggcu

SEQ ID NO: 1839944 - RNA, 19 nt, Salmonella typhimurium LT2
cuuuugcgcguuccccaac

SEQ ID NO: 1839945 - RNA, 15 nt, Salmonella typhimurium LT2
cuuuucuuuccugca

SEQ ID NO: 1839946 - RNA, 22 nt, Salmonella typhimurium LT2
cuuuucucucuucgucauacuc

SEQ ID NO: 1839947 - RNA, 17 nt, Salmonella typhimurium LT2
cuuuucgcagcaauucu

SEQ ID NO: 1839948 - RNA, 17 nt, Salmonella typhimurium LT2
cuuuucggguguccacu

SEQ ID NO: 1839949 - RNA, 13 nt, Salmonella typhimurium LT2
aaagacgccaugg

SEQ ID NO: 1839950 - RNA, 21 nt, Salmonella typhimurium LT2
aaagacgcgcucggcagcagc

SEQ ID NO: 1839951 - RNA, 17 nt, Salmonella typhimurium LT2
aaagaccccgccaggcg

SEQ ID NO: 1839952 - RNA, 22 nt, Salmonella typhimurium LT2
cuuuucauccacagcgccagaa

SEQ ID NO: 1839953 - RNA, 21 nt, Salmonella typhimurium LT2
cuuuucacccaacauuuuuag

SEQ ID NO: 1839954 - RNA, 21 nt, Salmonella typhimurium LT2
cuuuuccgccucgcgcacccg

SEQ ID NO: 1839955 - RNA, 14 nt, Salmonella typhimurium LT2
cuuuuccagcgccu

SEQ ID NO: 1839956 - RNA, 19 nt, Salmonella typhimurium LT2
cuuuuagaacuaucugaaa

SEQ ID NO: 1839957 - RNA, 12 nt, Salmonella typhimurium LT2
cuuuuaugaagg

SEQ ID NO: 1839958 - RNA, 18 nt, Salmonella typhimurium LT2
cuuuuauuucaucuauua

SEQ ID NO: 1839959 - RNA, 23 nt, Salmonella typhimurium LT2
cuuuuacaggccggacaggcgac

SEQ ID NO: 1839960 - RNA, 16 nt, Salmonella typhimurium LT2
cuuuuacccuucaugu

SEQ ID NO: 1839961 - RNA, 23 nt, Salmonella typhimurium LT2
cuuuuaaacgugcggcggccucu

SEQ ID NO: 1839962 - RNA, 17 nt, Salmonella typhimurium LT2
gaaaaagugauaaauau

SEQ ID NO: 1839963 - RNA, 16 nt, Salmonella typhimurium LT2
gaaaaagggaauaaua

SEQ ID NO: 1839964 - RNA, 19 nt, Salmonella typhimurium LT2
gaaaaagccaaaaggcgcc

SEQ ID NO: 1839965 - RNA, 17 nt, Salmonella typhimurium LT2
gaaaaaacucaggaaau

SEQ ID NO: 1839966 - RNA, 16 nt, Salmonella typhimurium LT2
cuuuuuccugccauug

SEQ ID NO: 1839967 - RNA, 12 nt, Salmonella typhimurium LT2
gaaaagcagagg

SEQ ID NO: 1839968 - RNA, 14 nt, Salmonella typhimurium LT2
gaaaacuuuccaac

SEQ ID NO: 1839969 - RNA, 20 nt, Salmonella typhimurium LT2
gaaaacuuuccaaccuguua

SEQ ID NO: 1839970 - RNA, 16 nt, Salmonella typhimurium LT2
gaaaagaccaguggac

SEQ ID NO: 1839971 - RNA, 14 nt, Salmonella typhimurium LT2
gaaaauaaaugcuu

SEQ ID NO: 1839972 - RNA, 16 nt, Salmonella typhimurium LT2
gaaaauaaaugcuuug

SEQ ID NO: 1839973 - RNA, 17 nt, Salmonella typhimurium LT2
gaaaaucagcgacuggu

SEQ ID NO: 1839974 - RNA, 13 nt, Salmonella typhimurium LT2
gaaaauacucccg

SEQ ID NO: 1839975 - RNA, 22 nt, Salmonella typhimurium LT2
gaaaacggccagugaaauaaau

SEQ ID NO: 1839976 - RNA, 17 nt, Salmonella typhimurium LT2
gaaaacgugauugcuga

SEQ ID NO: 1839977 - RNA, 19 nt, Salmonella typhimurium LT2
gaaaacgugauugcugaca

SEQ ID NO: 1839978 - RNA, 20 nt, Salmonella typhimurium LT2
gaaaacggugaauagcuaug

SEQ ID NO: 1839979 - RNA, 18 nt, Salmonella typhimurium LT2
gaaaaccugcaaaaaaag

SEQ ID NO: 1839980 - RNA, 21 nt, Salmonella typhimurium LT2
gaaaacaccagggauuuugcu

SEQ ID NO: 1839981 - RNA, 19 nt, Salmonella typhimurium LT2
cuuuacccgggccaucuuu

SEQ ID NO: 1839982 - RNA, 17 nt, Salmonella typhimurium LT2
cuuuaccgucagccacu

SEQ ID NO: 1839983 - RNA, 17 nt, Salmonella typhimurium LT2
cuuuaccggcccuuccg

SEQ ID NO: 1839984 - RNA, 21 nt, Salmonella typhimurium LT2
cuuuacgcagauaacuuccuu

SEQ ID NO: 1839985 - RNA, 20 nt, Salmonella typhimurium LT2
cuuuagaaaaagaaaccucc

SEQ ID NO: 1839986 - RNA, 22 nt, Salmonella typhimurium LT2
cuuuaaugcaucucguaaauca

SEQ ID NO: 1839987 - RNA, 23 nt, Salmonella typhimurium LT2
cuuuaaugcaucucguaaaucaa

SEQ ID NO: 1839988 - RNA, 20 nt, Salmonella typhimurium LT2
cuuuaaucuuagacaucaaa

SEQ ID NO: 1839989 - RNA, 16 nt, Salmonella typhimurium LT2
cuucggcgaucgcuuu

SEQ ID NO: 1839990 - RNA, 15 nt, Salmonella typhimurium LT2
aaagaccaauacuga

SEQ ID NO: 1839991 - RNA, 18 nt, Salmonella typhimurium LT2
aaagaccaacagaaggcc

SEQ ID NO: 1839992 - RNA, 12 nt, Salmonella typhimurium LT2
aaagaccaauac

SEQ ID NO: 1839993 - RNA, 18 nt, Salmonella typhimurium LT2
cuucgcguuuaucaccaa

SEQ ID NO: 1839994 - RNA, 13 nt, Salmonella typhimurium LT2
cuucgcucucuuu

SEQ ID NO: 1839995 - RNA, 14 nt, Salmonella typhimurium LT2
cuuucacccauuga

SEQ ID NO: 1839996 - RNA, 20 nt, Salmonella typhimurium LT2
cuuucagccggcuaucuucu

SEQ ID NO: 1839997 - RNA, 22 nt, Salmonella typhimurium LT2
cuuucagccggcuaucuucuuc

SEQ ID NO: 1839998 - RNA, 13 nt, Salmonella typhimurium LT2
cuuucaccgccuc

SEQ ID NO: 1839999 - RNA, 18 nt, Salmonella typhimurium LT2
cuuucaccggucgcaaga

SEQ ID NO: 1840000 - RNA, 24 nt, Salmonella typhimurium LT2
cuuucaccagugaucggcuggaca

SEQ ID NO: 1840001 - RNA, 20 nt, Salmonella typhimurium LT2
cuuuaggcggcgccgcgccg

SEQ ID NO: 1840002 - RNA, 16 nt, Salmonella typhimurium LT2
cuuuauauaaaaaaug

SEQ ID NO: 1840003 - RNA, 17 nt, Salmonella typhimurium LT2
cuuuauauaaaaaaugg

SEQ ID NO: 1840004 - RNA, 13 nt, Salmonella typhimurium LT2
cuuuauauaaaaa

SEQ ID NO: 1840005 - RNA, 14 nt, Salmonella typhimurium LT2
cuuuauccugaagg

SEQ ID NO: 1840006 - RNA, 14 nt, Salmonella typhimurium LT2
cuuuauauaaaaaa

SEQ ID NO: 1840007 - RNA, 12 nt, Salmonella typhimurium LT2
cuuuaucaauag

SEQ ID NO: 1840008 - RNA, 22 nt, Salmonella typhimurium LT2
cuuuaucagaugugguauuuuc

SEQ ID NO: 1840009 - RNA, 23 nt, Salmonella typhimurium LT2
cuuuaucagaugugguauuuucu

SEQ ID NO: 1840010 - RNA, 13 nt, Salmonella typhimurium LT2
cuuuauucauuuc

SEQ ID NO: 1840011 - RNA, 13 nt, Salmonella typhimurium LT2
cuuuauucucuga

SEQ ID NO: 1840012 - RNA, 21 nt, Salmonella typhimurium LT2
cuuuauucugaaagaaaagau

SEQ ID NO: 1840013 - RNA, 23 nt, Salmonella typhimurium LT2
cuuuaucgcgcagcagauuaaca

SEQ ID NO: 1840014 - RNA, 20 nt, Salmonella typhimurium LT2
cuuugcacagucugcagacc

SEQ ID NO: 1840015 - RNA, 16 nt, Salmonella typhimurium LT2
cuuugcagaccuuucc

SEQ ID NO: 1840016 - RNA, 20 nt, Salmonella typhimurium LT2
cuuugcgccggcaguuuaag

SEQ ID NO: 1840017 - RNA, 17 nt, Salmonella typhimurium LT2
cuuugcgcgucucuccc

SEQ ID NO: 1840018 - RNA, 22 nt, Salmonella typhimurium LT2
cuuugcucuggcuuguucaucg

SEQ ID NO: 1840019 - RNA, 16 nt, Salmonella typhimurium LT2
cuuugcgcuccugcuc

SEQ ID NO: 1840020 - RNA, 18 nt, Salmonella typhimurium LT2
cuuugacgacccgcuucc

SEQ ID NO: 1840021 - RNA, 19 nt, Salmonella typhimurium LT2
cuuugacgaccgcggccuu

SEQ ID NO: 1840022 - RNA, 15 nt, Salmonella typhimurium LT2
cuuugaccagcgacg

SEQ ID NO: 1840023 - RNA, 20 nt, Salmonella typhimurium LT2
cuuugacgccgggaaauuuu

SEQ ID NO: 1840024 - RNA, 18 nt, Salmonella typhimurium LT2
cuuugaccagcaucgccg

SEQ ID NO: 1840025 - RNA, 14 nt, Salmonella typhimurium LT2
cuuugauggcuuua

SEQ ID NO: 1840026 - RNA, 16 nt, Salmonella typhimurium LT2
cuuugauggcuuuaaa

SEQ ID NO: 1840027 - RNA, 21 nt, Salmonella typhimurium LT2
cuuuguaucccuuucaaaaaa

SEQ ID NO: 1840028 - RNA, 21 nt, Salmonella typhimurium LT2
cuuugucagagggccaaagau

SEQ ID NO: 1840029 - RNA, 17 nt, Salmonella typhimurium LT2
cuuuguugaucucauug

SEQ ID NO: 1840030 - RNA, 16 nt, Salmonella typhimurium LT2
cuuuguuuaaaaauuu

SEQ ID NO: 1840031 - RNA, 19 nt, Salmonella typhimurium LT2
cuuugugcuccaccagccc

SEQ ID NO: 1840032 - RNA, 19 nt, Salmonella typhimurium LT2
cuuucucggcuuuccagcu

SEQ ID NO: 1840033 - RNA, 22 nt, Salmonella typhimurium LT2
cuuucucggcgaggacccgugg

SEQ ID NO: 1840034 - RNA, 21 nt, Salmonella typhimurium LT2
cuuucugaauuucacgcuuca

SEQ ID NO: 1840035 - RNA, 20 nt, Salmonella typhimurium LT2
cuuucuucccuccccugcgc

SEQ ID NO: 1840036 - RNA, 12 nt, Salmonella typhimurium LT2
cuuucuugccac

SEQ ID NO: 1840037 - RNA, 14 nt, Salmonella typhimurium LT2
cuuucauuccuuua

SEQ ID NO: 1840038 - RNA, 18 nt, Salmonella typhimurium LT2
cuuucauuacgcuuccug

SEQ ID NO: 1840039 - RNA, 13 nt, Salmonella typhimurium LT2
gauaugcagcagc

SEQ ID NO: 1840040 - RNA, 18 nt, Salmonella typhimurium LT2
gauaugcgacgaaagcgg

SEQ ID NO: 1840041 - RNA, 19 nt, Salmonella typhimurium LT2
gauaugcgacgaaagcggc

SEQ ID NO: 1840042 - RNA, 24 nt, Salmonella typhimurium LT2
gauaugacccgggcgugacagggg

SEQ ID NO: 1840043 - RNA, 14 nt, Salmonella typhimurium LT2
gauaugaauaauuu

SEQ ID NO: 1840044 - RNA, 23 nt, Salmonella typhimurium LT2
gauaugaauaauuucggcggcgc

SEQ ID NO: 1840045 - RNA, 23 nt, Salmonella typhimurium LT2
gauaucuguauaaauaaaauugu

SEQ ID NO: 1840046 - RNA, 13 nt, Salmonella typhimurium LT2
gauauaugcaaaa

SEQ ID NO: 1840047 - RNA, 23 nt, Salmonella typhimurium LT2
gauauaucuucaucguuucugcc

SEQ ID NO: 1840048 - RNA, 21 nt, Salmonella typhimurium LT2
gauauagcugcgauccagguc

SEQ ID NO: 1840049 - RNA, 19 nt, Salmonella typhimurium LT2
gauauagcggugcguuucc

SEQ ID NO: 1840050 - RNA, 19 nt, Salmonella typhimurium LT2
gauauaggguggucacgcc

SEQ ID NO: 1840051 - RNA, 22 nt, Salmonella typhimurium LT2
gauauaccaugccgccauuuua

SEQ ID NO: 1840052 - RNA, 21 nt, Salmonella typhimurium LT2
gauauagcaacguccgcagcc

SEQ ID NO: 1840053 - RNA, 21 nt, Salmonella typhimurium LT2
gauauagagcccucuauccac

SEQ ID NO: 1840054 - RNA, 18 nt, Salmonella typhimurium LT2
gauagucauugacagcaa

SEQ ID NO: 1840055 - RNA, 22 nt, Salmonella typhimurium LT2
gauaggcucaauaugccaggca

SEQ ID NO: 1840056 - RNA, 23 nt, Salmonella typhimurium LT2
gauaggcucaauaugccaggcau

SEQ ID NO: 1840057 - RNA, 22 nt, Salmonella typhimurium LT2
gauagagguuaccgggcuaaac

SEQ ID NO: 1840058 - RNA, 23 nt, Salmonella typhimurium LT2
gauagcuuguuguuuauccugca

SEQ ID NO: 1840059 - RNA, 15 nt, Salmonella typhimurium LT2
gauaagagaaaauac

SEQ ID NO: 1840060 - RNA, 21 nt, Salmonella typhimurium LT2
gauaagacugauauccaucgg

SEQ ID NO: 1840061 - RNA, 22 nt, Salmonella typhimurium LT2
gauaagcaggaaggaaaaucug

SEQ ID NO: 1840062 - RNA, 19 nt, Salmonella typhimurium LT2
gauaagcauaacguucuua

SEQ ID NO: 1840063 - RNA, 14 nt, Salmonella typhimurium LT2
gauaagcaccugca

SEQ ID NO: 1840064 - RNA, 17 nt, Salmonella typhimurium LT2
gauaagcaccugcauuu

SEQ ID NO: 1840065 - RNA, 21 nt, Salmonella typhimurium LT2
gauaagcaccugcauuuaucu

SEQ ID NO: 1840066 - RNA, 23 nt, Salmonella typhimurium LT2
gauaacugaagguuuuucccgga

SEQ ID NO: 1840067 - RNA, 19 nt, Salmonella typhimurium LT2
gauaagaaagauaaaauac

SEQ ID NO: 1840068 - RNA, 19 nt, Salmonella typhimurium LT2
gauaagaaguaaacagaau

SEQ ID NO: 1840069 - RNA, 21 nt, Salmonella typhimurium LT2
gauaagcgcagcgccaucagg

SEQ ID NO: 1840070 - RNA, 21 nt, Salmonella typhimurium LT2
gauaagcguagcgccaucagg

SEQ ID NO: 1840071 - RNA, 16 nt, Salmonella typhimurium LT2
gauaagcgucagcgcc

SEQ ID NO: 1840072 - RNA, 22 nt, Salmonella typhimurium LT2
gauaccuguugcacgcauggca

SEQ ID NO: 1840073 - RNA, 20 nt, Salmonella typhimurium LT2
gauaagcucugcgguaacaa

SEQ ID NO: 1840074 - RNA, 20 nt, Salmonella typhimurium LT2
gauacgcgucaaagcacaug

SEQ ID NO: 1840075 - RNA, 19 nt, Salmonella typhimurium LT2
gauacgcguugccaucgca

SEQ ID NO: 1840076 - RNA, 19 nt, Salmonella typhimurium LT2
gauagagaguuccuccugg

SEQ ID NO: 1840077 - RNA, 16 nt, Salmonella typhimurium LT2
gauagagguuaccggg

SEQ ID NO: 1840078 - RNA, 23 nt, Salmonella typhimurium LT2
gauagaccacgccaucaacagcg

SEQ ID NO: 1840079 - RNA, 13 nt, Salmonella typhimurium LT2
gauagaaaacaua

SEQ ID NO: 1840080 - RNA, 12 nt, Salmonella typhimurium LT2
gauacugcaacg

SEQ ID NO: 1840081 - RNA, 19 nt, Salmonella typhimurium LT2
gauacugacacgccaguuc

SEQ ID NO: 1840082 - RNA, 21 nt, Salmonella typhimurium LT2
gauacugcaaccgacgaacaa

SEQ ID NO: 1840083 - RNA, 21 nt, Salmonella typhimurium LT2
gauacugccgcccaucgccac

SEQ ID NO: 1840084 - RNA, 18 nt, Salmonella typhimurium LT2
gauacugcgaucgccggc

SEQ ID NO: 1840085 - RNA, 21 nt, Salmonella typhimurium LT2
gaucagcauagcgccuucagg

SEQ ID NO: 1840086 - RNA, 19 nt, Salmonella typhimurium LT2
gaucagacuuuggauaaag

SEQ ID NO: 1840087 - RNA, 21 nt, Salmonella typhimurium LT2
gaucagcaccacgcccggauc

SEQ ID NO: 1840088 - RNA, 14 nt, Salmonella typhimurium LT2
gaucacggugguga

SEQ ID NO: 1840089 - RNA, 19 nt, Salmonella typhimurium LT2
gaucacgccguccagcacc

SEQ ID NO: 1840090 - RNA, 15 nt, Salmonella typhimurium LT2
gaucaccucuuccag

SEQ ID NO: 1840091 - RNA, 19 nt, Salmonella typhimurium LT2
gaucaccucuuccagcguc

SEQ ID NO: 1840092 - RNA, 14 nt, Salmonella typhimurium LT2
gauauggcggcggc

SEQ ID NO: 1840093 - RNA, 24 nt, Salmonella typhimurium LT2
gauaugguuacuggcuaguauauu

SEQ ID NO: 1840094 - RNA, 23 nt, Salmonella typhimurium LT2
gaucaaccgguuugucauucgcc

SEQ ID NO: 1840095 - RNA, 18 nt, Salmonella typhimurium LT2
gaucacccacaucagcgg

SEQ ID NO: 1840096 - RNA, 17 nt, Salmonella typhimurium LT2
gaucacccacaccacag

SEQ ID NO: 1840097 - RNA, 16 nt, Salmonella typhimurium LT2
gaucacccacaucagc

SEQ ID NO: 1840098 - RNA, 14 nt, Salmonella typhimurium LT2
gaucaccagcccuu

SEQ ID NO: 1840099 - RNA, 21 nt, Salmonella typhimurium LT2
gaucaccagcaccgccagcgc

SEQ ID NO: 1840100 - RNA, 18 nt, Salmonella typhimurium LT2
gaucaauaaaauuaucca

SEQ ID NO: 1840101 - RNA, 21 nt, Salmonella typhimurium LT2
gaucaagcccccgcaacauug

SEQ ID NO: 1840102 - RNA, 18 nt, Salmonella typhimurium LT2
gaucaagcaauaccagaa

SEQ ID NO: 1840103 - RNA, 16 nt, Salmonella typhimurium LT2
gaucaggcgucagcgg

SEQ ID NO: 1840104 - RNA, 16 nt, Salmonella typhimurium LT2
gaucaguaacaggacg

SEQ ID NO: 1840105 - RNA, 18 nt, Salmonella typhimurium LT2
gaucagcgcgcuccagac

SEQ ID NO: 1840106 - RNA, 13 nt, Salmonella typhimurium LT2
gaucaucuucacu

SEQ ID NO: 1840107 - RNA, 19 nt, Salmonella typhimurium LT2
gaucauuaccugucgccca

SEQ ID NO: 1840108 - RNA, 20 nt, Salmonella typhimurium LT2
gaucaucuucacuucacaaa

SEQ ID NO: 1840109 - RNA, 14 nt, Salmonella typhimurium LT2
gaucauggcucaga

SEQ ID NO: 1840110 - RNA, 15 nt, Salmonella typhimurium LT2
gaucucauaaacgcc

SEQ ID NO: 1840111 - RNA, 21 nt, Salmonella typhimurium LT2
gaucuauuucauaauaagcgc

SEQ ID NO: 1840112 - RNA, 15 nt, Salmonella typhimurium LT2
gaucuaaaaauuaca

SEQ ID NO: 1840113 - RNA, 23 nt, Salmonella typhimurium LT2
gaucucauaaacgccuggaguga

SEQ ID NO: 1840114 - RNA, 14 nt, Salmonella typhimurium LT2
gaucugcgccgccg

SEQ ID NO: 1840115 - RNA, 15 nt, Salmonella typhimurium LT2
gaucugcgccgccgg

SEQ ID NO: 1840116 - RNA, 19 nt, Salmonella typhimurium LT2
gaucguuauuaaacagaca

SEQ ID NO: 1840117 - RNA, 19 nt, Salmonella typhimurium LT2
gaucguuuucggcuggagu

SEQ ID NO: 1840118 - RNA, 22 nt, Salmonella typhimurium LT2
gaucgucgcgaucgcgccagcc

SEQ ID NO: 1840119 - RNA, 23 nt, Salmonella typhimurium LT2
gaucguccaucgaauaaagacaa

SEQ ID NO: 1840120 - RNA, 20 nt, Salmonella typhimurium LT2
gaucgucauauguugcgcuu

SEQ ID NO: 1840121 - RNA, 21 nt, Salmonella typhimurium LT2
gaucguaugcagccaggccau

SEQ ID NO: 1840122 - RNA, 16 nt, Salmonella typhimurium LT2
gaucguaggcggcgga

SEQ ID NO: 1840123 - RNA, 17 nt, Salmonella typhimurium LT2
gaucguaaucacccgcu

SEQ ID NO: 1840124 - RNA, 13 nt, Salmonella typhimurium LT2
gaucggccagcaa

SEQ ID NO: 1840125 - RNA, 15 nt, Salmonella typhimurium LT2
gaucgggcaauccau

SEQ ID NO: 1840126 - RNA, 12 nt, Salmonella typhimurium LT2
gaucgcgggcaa

SEQ ID NO: 1840127 - RNA, 21 nt, Salmonella typhimurium LT2
gaucgcgugcauuaaaauaau

SEQ ID NO: 1840128 - RNA, 23 nt, Salmonella typhimurium LT2
gaucggagggggaggcaggcaac

SEQ ID NO: 1840129 - RNA, 23 nt, Salmonella typhimurium LT2
gaucgccgcugcgagcagcgaaa

SEQ ID NO: 1840130 - RNA, 10 nt, Salmonella typhimurium LT2
gaucgccugg

SEQ ID NO: 1840131 - RNA, 19 nt, Salmonella typhimurium LT2
gaucgcgaggcaacagaua

SEQ ID NO: 1840132 - RNA, 19 nt, Salmonella typhimurium LT2
gaucgccauucggauaauc

SEQ ID NO: 1840133 - RNA, 21 nt, Salmonella typhimurium LT2
gaucgccagcguuagcacauu

SEQ ID NO: 1840134 - RNA, 14 nt, Salmonella typhimurium LT2
aaagccccggcuca

SEQ ID NO: 1840135 - RNA, 20 nt, Salmonella typhimurium LT2
aaagccgccauccggcauuu

SEQ ID NO: 1840136 - RNA, 16 nt, Salmonella typhimurium LT2
aaagccaucaauccau

SEQ ID NO: 1840137 - RNA, 14 nt, Salmonella typhimurium LT2
gauccuccugcaga

SEQ ID NO: 1840138 - RNA, 20 nt, Salmonella typhimurium LT2
gaucgcaagauccugauauu

SEQ ID NO: 1840139 - RNA, 16 nt, Salmonella typhimurium LT2
gaucgaggucagcauu

SEQ ID NO: 1840140 - RNA, 20 nt, Salmonella typhimurium LT2
gaucgauagcgacggcgcgc

SEQ ID NO: 1840141 - RNA, 18 nt, Salmonella typhimurium LT2
gaucgacaaaccacugcu

SEQ ID NO: 1840142 - RNA, 13 nt, Salmonella typhimurium LT2
gaucauuggccag

SEQ ID NO: 1840143 - RNA, 14 nt, Salmonella typhimurium LT2
gaucauuggccaga

SEQ ID NO: 1840144 - RNA, 23 nt, Salmonella typhimurium LT2
gauccaacacaucgacaugcaga

SEQ ID NO: 1840145 - RNA, 14 nt, Salmonella typhimurium LT2
gauccacacuggcg

SEQ ID NO: 1840146 - RNA, 20 nt, Salmonella typhimurium LT2
gauccagaacugcgaaauca

SEQ ID NO: 1840147 - RNA, 16 nt, Salmonella typhimurium LT2
gauccagccccagcgc

SEQ ID NO: 1840148 - RNA, 20 nt, Salmonella typhimurium LT2
gauccaccaccagcaucacg

SEQ ID NO: 1840149 - RNA, 16 nt, Salmonella typhimurium LT2
gauccaccaccagcau

SEQ ID NO: 1840150 - RNA, 23 nt, Salmonella typhimurium LT2
gaucccagggcggcgucgccaga

SEQ ID NO: 1840151 - RNA, 20 nt, Salmonella typhimurium LT2
gauccaucgguucucugcca

SEQ ID NO: 1840152 - RNA, 21 nt, Salmonella typhimurium LT2
gauccaucgguucucugccau

SEQ ID NO: 1840153 - RNA, 11 nt, Salmonella typhimurium LT2
gaucccaccag

SEQ ID NO: 1840154 - RNA, 16 nt, Salmonella typhimurium LT2
gauccaggucuuccgc

SEQ ID NO: 1840155 - RNA, 13 nt, Salmonella typhimurium LT2
gauccagcucuuc

SEQ ID NO: 1840156 - RNA, 19 nt, Salmonella typhimurium LT2
gauccgacaugaugccaaa

SEQ ID NO: 1840157 - RNA, 21 nt, Salmonella typhimurium LT2
gauccgacaugaugccaaaua

SEQ ID NO: 1840158 - RNA, 20 nt, Salmonella typhimurium LT2
gauccgaugcgcuuuacugu

SEQ ID NO: 1840159 - RNA, 20 nt, Salmonella typhimurium LT2
gauccccucuuccaucagcc

SEQ ID NO: 1840160 - RNA, 16 nt, Salmonella typhimurium LT2
gaucccgaaaugguuc

SEQ ID NO: 1840161 - RNA, 14 nt, Salmonella typhimurium LT2
gaucccuaauaaaa

SEQ ID NO: 1840162 - RNA, 20 nt, Salmonella typhimurium LT2
gaucccgggcgauaaaccag

SEQ ID NO: 1840163 - RNA, 20 nt, Salmonella typhimurium LT2
gaucccggcgccgccgagga

SEQ ID NO: 1840164 - RNA, 18 nt, Salmonella typhimurium LT2
gaggccagauucaccacc

SEQ ID NO: 1840165 - RNA, 16 nt, Salmonella typhimurium LT2
gaggccggauggcggu

SEQ ID NO: 1840166 - RNA, 18 nt, Salmonella typhimurium LT2
gaggcauccagaaugcgu

SEQ ID NO: 1840167 - RNA, 15 nt, Salmonella typhimurium LT2
gaggccaccagcgcc

SEQ ID NO: 1840168 - RNA, 21 nt, Salmonella typhimurium LT2
gaggaaaaaccgccucaauug

SEQ ID NO: 1840169 - RNA, 18 nt, Salmonella typhimurium LT2
gaggaaaccuuucuucuc

SEQ ID NO: 1840170 - RNA, 17 nt, Salmonella typhimurium LT2
gaggaacuguucagcca

SEQ ID NO: 1840171 - RNA, 15 nt, Salmonella typhimurium LT2
gaggaacaucagcca

SEQ ID NO: 1840172 - RNA, 22 nt, Salmonella typhimurium LT2
gagcugcgcuuuuucaucaucu

SEQ ID NO: 1840173 - RNA, 18 nt, Salmonella typhimurium LT2
gaguaaugacaaaaauua

SEQ ID NO: 1840174 - RNA, 20 nt, Salmonella typhimurium LT2
gaguaauguucaguuuuucc

SEQ ID NO: 1840175 - RNA, 23 nt, Salmonella typhimurium LT2
gaguaauguucaguuuuuccagc

SEQ ID NO: 1840176 - RNA, 14 nt, Salmonella typhimurium LT2
gaguaaauaaauca

SEQ ID NO: 1840177 - RNA, 15 nt, Salmonella typhimurium LT2
gaguaaagccugccc

SEQ ID NO: 1840178 - RNA, 18 nt, Salmonella typhimurium LT2
gagguaaauuagcgcgaa

SEQ ID NO: 1840179 - RNA, 22 nt, Salmonella typhimurium LT2
gaggguguucaugcgacugccc

SEQ ID NO: 1840180 - RNA, 20 nt, Salmonella typhimurium LT2
gagggugaaccaaagcaaaa

SEQ ID NO: 1840181 - RNA, 23 nt, Salmonella typhimurium LT2
gaggggcacgcccgcauucauaa

SEQ ID NO: 1840182 - RNA, 14 nt, Salmonella typhimurium LT2
gaggccuuuugcag

SEQ ID NO: 1840183 - RNA, 23 nt, Salmonella typhimurium LT2
gaggccguuauugucaugcuaaa

SEQ ID NO: 1840184 - RNA, 23 nt, Salmonella typhimurium LT2
gaggcgcagccgccauccggcaa

SEQ ID NO: 1840185 - RNA, 19 nt, Salmonella typhimurium LT2
gauaaaauccgaaaugacc

SEQ ID NO: 1840186 - RNA, 13 nt, Salmonella typhimurium LT2
gauaaaauuguua

SEQ ID NO: 1840187 - RNA, 16 nt, Salmonella typhimurium LT2
gauaaaacgcaggcag

SEQ ID NO: 1840188 - RNA, 10 nt, Salmonella typhimurium LT2
gaguuuuaac

SEQ ID NO: 1840189 - RNA, 15 nt, Salmonella typhimurium LT2
gaguuguuucaacau

SEQ ID NO: 1840190 - RNA, 18 nt, Salmonella typhimurium LT2
gauaaacgacagcgccau

SEQ ID NO: 1840191 - RNA, 14 nt, Salmonella typhimurium LT2
gauaaacgccagcc

SEQ ID NO: 1840192 - RNA, 20 nt, Salmonella typhimurium LT2
gauaaacgccagcccuucca

SEQ ID NO: 1840193 - RNA, 19 nt, Salmonella typhimurium LT2
gauaaacgccccuucauca

SEQ ID NO: 1840194 - RNA, 23 nt, Salmonella typhimurium LT2
gauaaacgccccuucaucagcca

SEQ ID NO: 1840195 - RNA, 19 nt, Salmonella typhimurium LT2
gauaaacgcccgcaaaagc

SEQ ID NO: 1840196 - RNA, 22 nt, Salmonella typhimurium LT2
gauaaaccaacagccgccuguu

SEQ ID NO: 1840197 - RNA, 15 nt, Salmonella typhimurium LT2
gauaaaccaacagcc

SEQ ID NO: 1840198 - RNA, 16 nt, Salmonella typhimurium LT2
gauaaacaccggaauu

SEQ ID NO: 1840199 - RNA, 12 nt, Salmonella typhimurium LT2
gauaaacaccuu

SEQ ID NO: 1840200 - RNA, 16 nt, Salmonella typhimurium LT2
gauaaccgcccgcggc

SEQ ID NO: 1840201 - RNA, 18 nt, Salmonella typhimurium LT2
gauaaccaucgcgcagcc

SEQ ID NO: 1840202 - RNA, 12 nt, Salmonella typhimurium LT2
gauaaccagguc

SEQ ID NO: 1840203 - RNA, 17 nt, Salmonella typhimurium LT2
gauaaagagcaggccaa

SEQ ID NO: 1840204 - RNA, 21 nt, Salmonella typhimurium LT2
gauaaagagcaggccaaaaaa

SEQ ID NO: 1840205 - RNA, 22 nt, Salmonella typhimurium LT2
gauaaacggcuuuaguucagca

SEQ ID NO: 1840206 - RNA, 22 nt, Salmonella typhimurium LT2
gauaacgcgauggccaaauaac

SEQ ID NO: 1840207 - RNA, 18 nt, Salmonella typhimurium LT2
gauaacccugaagcugca

SEQ ID NO: 1840208 - RNA, 16 nt, Salmonella typhimurium LT2
gauaaccuucuucguu

SEQ ID NO: 1840209 - RNA, 15 nt, Salmonella typhimurium LT2
gauaacgcaacaaca

SEQ ID NO: 1840210 - RNA, 15 nt, Salmonella typhimurium LT2
gauaacgcaggcgau

SEQ ID NO: 1840211 - RNA, 18 nt, Salmonella typhimurium LT2
gagugacgguuuucacug

SEQ ID NO: 1840212 - RNA, 22 nt, Salmonella typhimurium LT2
gagugacgcagacgucaacacc

SEQ ID NO: 1840213 - RNA, 17 nt, Salmonella typhimurium LT2
gagucgguacuccccuu

SEQ ID NO: 1840214 - RNA, 22 nt, Salmonella typhimurium LT2
gagugugucuuuuacgccagga

SEQ ID NO: 1840215 - RNA, 12 nt, Salmonella typhimurium LT2
gaguuccuccug

SEQ ID NO: 1840216 - RNA, 17 nt, Salmonella typhimurium LT2
gaguggcgaaauuggua

SEQ ID NO: 1840217 - RNA, 18 nt, Salmonella typhimurium LT2
gagugguagaaacuggca

SEQ ID NO: 1840218 - RNA, 12 nt, Salmonella typhimurium LT2
gaguagauguag

SEQ ID NO: 1840219 - RNA, 23 nt, Salmonella typhimurium LT2
gaguacgccgauagcggcggcgc

SEQ ID NO: 1840220 - RNA, 16 nt, Salmonella typhimurium LT2
gaguacggaacaaaac

SEQ ID NO: 1840221 - RNA, 19 nt, Salmonella typhimurium LT2
gaguacggaacaaaacgga

SEQ ID NO: 1840222 - RNA, 18 nt, Salmonella typhimurium LT2
gaguaugaacaggcagcg

SEQ ID NO: 1840223 - RNA, 16 nt, Salmonella typhimurium LT2
gaguccugccggacug

SEQ ID NO: 1840224 - RNA, 17 nt, Salmonella typhimurium LT2
gagucagaaacggccag

SEQ ID NO: 1840225 - RNA, 18 nt, Salmonella typhimurium LT2
gagucagaaacggccagg

SEQ ID NO: 1840226 - RNA, 23 nt, Salmonella typhimurium LT2
gagucacagaauacccuccgcca

SEQ ID NO: 1840227 - RNA, 18 nt, Salmonella typhimurium LT2
gagucaaaagauugauuu

SEQ ID NO: 1840228 - RNA, 15 nt, Salmonella typhimurium LT2
gagccaauauccgga

SEQ ID NO: 1840229 - RNA, 22 nt, Salmonella typhimurium LT2
gagccacucacguucagcgcgg

SEQ ID NO: 1840230 - RNA, 23 nt, Salmonella typhimurium LT2
gagccacugcauuacucgccugc

SEQ ID NO: 1840231 - RNA, 17 nt, Salmonella typhimurium LT2
gagccgccauccggcag

SEQ ID NO: 1840232 - RNA, 21 nt, Salmonella typhimurium LT2
gagccuaaaacauuaaucgcc

SEQ ID NO: 1840233 - RNA, 22 nt, Salmonella typhimurium LT2
gagcgcauacgcuguccaguca

SEQ ID NO: 1840234 - RNA, 16 nt, Salmonella typhimurium LT2
gagcgacgcccugccc

SEQ ID NO: 1840235 - RNA, 13 nt, Salmonella typhimurium LT2
gagcgcaaacauc

SEQ ID NO: 1840236 - RNA, 15 nt, Salmonella typhimurium LT2
gagcgaugcugcuuc

SEQ ID NO: 1840237 - RNA, 17 nt, Salmonella typhimurium LT2
gagcgauagagaguucc

SEQ ID NO: 1840238 - RNA, 20 nt, Salmonella typhimurium LT2
gagcgcgcaaucgggccugc

SEQ ID NO: 1840239 - RNA, 15 nt, Salmonella typhimurium LT2
gagcgccggcaaagc

SEQ ID NO: 1840240 - RNA, 14 nt, Salmonella typhimurium LT2
gagcgccguggaaa

SEQ ID NO: 1840241 - RNA, 22 nt, Salmonella typhimurium LT2
gagcgccgcgccuaccagcgcu

SEQ ID NO: 1840242 - RNA, 17 nt, Salmonella typhimurium LT2
gagcgccagcaacagcg

SEQ ID NO: 1840243 - RNA, 15 nt, Salmonella typhimurium LT2
gagcggucaggccag

SEQ ID NO: 1840244 - RNA, 21 nt, Salmonella typhimurium LT2
gagcgguaagucaaccagccc

SEQ ID NO: 1840245 - RNA, 20 nt, Salmonella typhimurium LT2
gagcggcauguaaagcgcca

SEQ ID NO: 1840246 - RNA, 17 nt, Salmonella typhimurium LT2
gagcgcgcucugccuuu

SEQ ID NO: 1840247 - RNA, 12 nt, Salmonella typhimurium LT2
gagcgcgcuggc

SEQ ID NO: 1840248 - RNA, 17 nt, Salmonella typhimurium LT2
gagcgcggaggggcgau

SEQ ID NO: 1840249 - RNA, 13 nt, Salmonella typhimurium LT2
gagcgcuugcugc

SEQ ID NO: 1840250 - RNA, 19 nt, Salmonella typhimurium LT2
gagcgcuugauccaguucg

SEQ ID NO: 1840251 - RNA, 12 nt, Salmonella typhimurium LT2
gagcuaaauauc

SEQ ID NO: 1840252 - RNA, 18 nt, Salmonella typhimurium LT2
gagcgugaucucauugga

SEQ ID NO: 1840253 - RNA, 17 nt, Salmonella typhimurium LT2
gagcgugaucucauugg

SEQ ID NO: 1840254 - RNA, 19 nt, Salmonella typhimurium LT2
gagcgugaucgucuccugu

SEQ ID NO: 1840255 - RNA, 18 nt, Salmonella typhimurium LT2
gagcgucuuuuaucccca

SEQ ID NO: 1840256 - RNA, 21 nt, Salmonella typhimurium LT2
gagcguuacgggaacagaauu

SEQ ID NO: 1840257 - RNA, 10 nt, Salmonella typhimurium LT2
gagcguucaa

SEQ ID NO: 1840258 - RNA, 13 nt, Salmonella typhimurium LT2
gagcguucaaaau

SEQ ID NO: 1840259 - RNA, 20 nt, Salmonella typhimurium LT2
gagcguuacgggaacagaau

SEQ ID NO: 1840260 - RNA, 19 nt, Salmonella typhimurium LT2
gagcguggaaaacagcgcc

SEQ ID NO: 1840261 - RNA, 20 nt, Salmonella typhimurium LT2
gagcguguccucugcugcga

SEQ ID NO: 1840262 - RNA, 21 nt, Salmonella typhimurium LT2
gagcaggccaaaaaagccgcu

SEQ ID NO: 1840263 - RNA, 15 nt, Salmonella typhimurium LT2
gagcaguucagcagc

SEQ ID NO: 1840264 - RNA, 16 nt, Salmonella typhimurium LT2
gagcaguucagcagca

SEQ ID NO: 1840265 - RNA, 16 nt, Salmonella typhimurium LT2
gagcagcgccaucugc

SEQ ID NO: 1840266 - RNA, 11 nt, Salmonella typhimurium LT2
gagcagccugg

SEQ ID NO: 1840267 - RNA, 16 nt, Salmonella typhimurium LT2
gagcagccuggcggcu

SEQ ID NO: 1840268 - RNA, 18 nt, Salmonella typhimurium LT2
aaagcacagccccagcac

SEQ ID NO: 1840269 - RNA, 21 nt, Salmonella typhimurium LT2
aaagcacaucaggaaaugaac

SEQ ID NO: 1840270 - RNA, 16 nt, Salmonella typhimurium LT2
gagcauucuacaguuu

SEQ ID NO: 1840271 - RNA, 22 nt, Salmonella typhimurium LT2
gagcaaacucaaugacuuuaau

SEQ ID NO: 1840272 - RNA, 12 nt, Salmonella typhimurium LT2
gagcagcaggac

SEQ ID NO: 1840273 - RNA, 13 nt, Salmonella typhimurium LT2
gagaggaggagau

SEQ ID NO: 1840274 - RNA, 19 nt, Salmonella typhimurium LT2
gagaggccaccagcgccag

SEQ ID NO: 1840275 - RNA, 22 nt, Salmonella typhimurium LT2
gagaggcugaaggcgcuccccu

SEQ ID NO: 1840276 - RNA, 20 nt, Salmonella typhimurium LT2
gacucauucagcaacugcgu

SEQ ID NO: 1840277 - RNA, 20 nt, Salmonella typhimurium LT2
gacucaguucgcgacccaga

SEQ ID NO: 1840278 - RNA, 17 nt, Salmonella typhimurium LT2
gacucaucgccgcaaug

SEQ ID NO: 1840279 - RNA, 19 nt, Salmonella typhimurium LT2
gacucaucgccgcaaugac

SEQ ID NO: 1840280 - RNA, 16 nt, Salmonella typhimurium LT2
gacucauccacauacu

SEQ ID NO: 1840281 - RNA, 21 nt, Salmonella typhimurium LT2
gacucaccagcacgcaggcau

SEQ ID NO: 1840282 - RNA, 19 nt, Salmonella typhimurium LT2
gacucaaaaagaggaaagc

SEQ ID NO: 1840283 - RNA, 13 nt, Salmonella typhimurium LT2
gacucaaagaaaa

SEQ ID NO: 1840284 - RNA, 13 nt, Salmonella typhimurium LT2
gacucagccaggu

SEQ ID NO: 1840285 - RNA, 21 nt, Salmonella typhimurium LT2
gagaucguuauuaaacagaca

SEQ ID NO: 1840286 - RNA, 23 nt, Salmonella typhimurium LT2
gagauuacugcgugcuggcggcc

SEQ ID NO: 1840287 - RNA, 20 nt, Salmonella typhimurium LT2
gagaucgaacugacccgcca

SEQ ID NO: 1840288 - RNA, 17 nt, Salmonella typhimurium LT2
gagaucgguaauuucca

SEQ ID NO: 1840289 - RNA, 16 nt, Salmonella typhimurium LT2
gagaucgguaauuucc

SEQ ID NO: 1840290 - RNA, 16 nt, Salmonella typhimurium LT2
gagaucgcuuuccagc

SEQ ID NO: 1840291 - RNA, 20 nt, Salmonella typhimurium LT2
gagcaaaaccguagcuuugc

SEQ ID NO: 1840292 - RNA, 24 nt, Salmonella typhimurium LT2
gaugauagccguugucauggcgcc

SEQ ID NO: 1840293 - RNA, 17 nt, Salmonella typhimurium LT2
gaugaucgccucuucgg

SEQ ID NO: 1840294 - RNA, 13 nt, Salmonella typhimurium LT2
gaugauggcggcu

SEQ ID NO: 1840295 - RNA, 20 nt, Salmonella typhimurium LT2
gaugagcaaaccgcaaauaa

SEQ ID NO: 1840296 - RNA, 21 nt, Salmonella typhimurium LT2
gaugagcaaaccgcaaauaau

SEQ ID NO: 1840297 - RNA, 14 nt, Salmonella typhimurium LT2
gaugagcaaaguaa

SEQ ID NO: 1840298 - RNA, 15 nt, Salmonella typhimurium LT2
gaugagcaaaguaaa

SEQ ID NO: 1840299 - RNA, 19 nt, Salmonella typhimurium LT2
gaugaggcgcagccgccau

SEQ ID NO: 1840300 - RNA, 21 nt, Salmonella typhimurium LT2
gaugaggcgcagccgccaucc

SEQ ID NO: 1840301 - RNA, 17 nt, Salmonella typhimurium LT2
gaugagcgccagcaaca

SEQ ID NO: 1840302 - RNA, 21 nt, Salmonella typhimurium LT2
gaugacccccagauagcccuc

SEQ ID NO: 1840303 - RNA, 18 nt, Salmonella typhimurium LT2
gaugacccgcaauauuaa

SEQ ID NO: 1840304 - RNA, 17 nt, Salmonella typhimurium LT2
gaugacgcuccugaauc

SEQ ID NO: 1840305 - RNA, 19 nt, Salmonella typhimurium LT2
gaugacucccaguccggua

SEQ ID NO: 1840306 - RNA, 17 nt, Salmonella typhimurium LT2
gaugaccgcuuucgccu

SEQ ID NO: 1840307 - RNA, 21 nt, Salmonella typhimurium LT2
gaugaccggcuauccaugcgu

SEQ ID NO: 1840308 - RNA, 19 nt, Salmonella typhimurium LT2
gaucuugucacaauaacgc

SEQ ID NO: 1840309 - RNA, 12 nt, Salmonella typhimurium LT2
gaucuuuauaaa

SEQ ID NO: 1840310 - RNA, 21 nt, Salmonella typhimurium LT2
gaucuuuccuuuuucaggcac

SEQ ID NO: 1840311 - RNA, 15 nt, Salmonella typhimurium LT2
gaucuuuuucagcac

SEQ ID NO: 1840312 - RNA, 11 nt, Salmonella typhimurium LT2
gaugaaaaaga

SEQ ID NO: 1840313 - RNA, 22 nt, Salmonella typhimurium LT2
gaugaaacaguccggcgaaaaa

SEQ ID NO: 1840314 - RNA, 13 nt, Salmonella typhimurium LT2
gaugaaaaagagg

SEQ ID NO: 1840315 - RNA, 16 nt, Salmonella typhimurium LT2
gaucuucuuuaaccgc

SEQ ID NO: 1840316 - RNA, 19 nt, Salmonella typhimurium LT2
gaugacacaucaccuccag

SEQ ID NO: 1840317 - RNA, 17 nt, Salmonella typhimurium LT2
gaugacacuaucuccuu

SEQ ID NO: 1840318 - RNA, 22 nt, Salmonella typhimurium LT2
gaugaacgaugcugauuugcca

SEQ ID NO: 1840319 - RNA, 19 nt, Salmonella typhimurium LT2
gaugcugauguccgcagcc

SEQ ID NO: 1840320 - RNA, 17 nt, Salmonella typhimurium LT2
gaugcugaauagccagc

SEQ ID NO: 1840321 - RNA, 16 nt, Salmonella typhimurium LT2
gaugcuaacgcccucu

SEQ ID NO: 1840322 - RNA, 21 nt, Salmonella typhimurium LT2
gaugcuaacgcccucucuccg

SEQ ID NO: 1840323 - RNA, 14 nt, Salmonella typhimurium LT2
gaugcguucaaaga

SEQ ID NO: 1840324 - RNA, 22 nt, Salmonella typhimurium LT2
gaugcguucuagcuuaucgcca

SEQ ID NO: 1840325 - RNA, 22 nt, Salmonella typhimurium LT2
gaugcguuggcucgcugccaaa

SEQ ID NO: 1840326 - RNA, 16 nt, Salmonella typhimurium LT2
gaugcguaccgcgcug

SEQ ID NO: 1840327 - RNA, 23 nt, Salmonella typhimurium LT2
gaugcguaccgcgcugugcgugg

SEQ ID NO: 1840328 - RNA, 16 nt, Salmonella typhimurium LT2
gaugcgccgugcuugu

SEQ ID NO: 1840329 - RNA, 16 nt, Salmonella typhimurium LT2
gaugcgccauccacca

SEQ ID NO: 1840330 - RNA, 15 nt, Salmonella typhimurium LT2
gaugcgaaucuucau

SEQ ID NO: 1840331 - RNA, 19 nt, Salmonella typhimurium LT2
gaugcgacgcgcucaccuc

SEQ ID NO: 1840332 - RNA, 20 nt, Salmonella typhimurium LT2
gaugccguuuuaacgucauc

SEQ ID NO: 1840333 - RNA, 21 nt, Salmonella typhimurium LT2
gaugccguuuuaacgucauca

SEQ ID NO: 1840334 - RNA, 18 nt, Salmonella typhimurium LT2
gaugccgccgacaaccag

SEQ ID NO: 1840335 - RNA, 15 nt, Salmonella typhimurium LT2
gaugcauaaaaaaac

SEQ ID NO: 1840336 - RNA, 19 nt, Salmonella typhimurium LT2
gaugcccagguuagcagcc

SEQ ID NO: 1840337 - RNA, 20 nt, Salmonella typhimurium LT2
gaugcaggccaagcagcgcc

SEQ ID NO: 1840338 - RNA, 15 nt, Salmonella typhimurium LT2
aaagcgaaaauaaag

SEQ ID NO: 1840339 - RNA, 13 nt, Salmonella typhimurium LT2
aaagcgaauaauu

SEQ ID NO: 1840340 - RNA, 13 nt, Salmonella typhimurium LT2
aaagcgaagcggc

SEQ ID NO: 1840341 - RNA, 23 nt, Salmonella typhimurium LT2
aaagcgaccggcacucaccucuu

SEQ ID NO: 1840342 - RNA, 21 nt, Salmonella typhimurium LT2
gauggcguaauuaaccgcgcc

SEQ ID NO: 1840343 - RNA, 16 nt, Salmonella typhimurium LT2
gauggcggcugaugcc

SEQ ID NO: 1840344 - RNA, 20 nt, Salmonella typhimurium LT2
gauggcgcuucguuuccugu

SEQ ID NO: 1840345 - RNA, 15 nt, Salmonella typhimurium LT2
gauggcgcugcgcuu

SEQ ID NO: 1840346 - RNA, 17 nt, Salmonella typhimurium LT2
gauggcgcugcgcuuau

SEQ ID NO: 1840347 - RNA, 20 nt, Salmonella typhimurium LT2
gauggcgaaggaguucgguu

SEQ ID NO: 1840348 - RNA, 19 nt, Salmonella typhimurium LT2
gaugcugucuuagugaaau

SEQ ID NO: 1840349 - RNA, 22 nt, Salmonella typhimurium LT2
gaugcuugccauauugccgcac

SEQ ID NO: 1840350 - RNA, 13 nt, Salmonella typhimurium LT2
gauggcaaauaau

SEQ ID NO: 1840351 - RNA, 12 nt, Salmonella typhimurium LT2
gauggcaaauaa

SEQ ID NO: 1840352 - RNA, 19 nt, Salmonella typhimurium LT2
gauggacggauuggcgcuc

SEQ ID NO: 1840353 - RNA, 19 nt, Salmonella typhimurium LT2
gauggagauaagcugggcg

SEQ ID NO: 1840354 - RNA, 16 nt, Salmonella typhimurium LT2
gauggucaauaacagc

SEQ ID NO: 1840355 - RNA, 19 nt, Salmonella typhimurium LT2
gaugguaugcgaagguggc

SEQ ID NO: 1840356 - RNA, 16 nt, Salmonella typhimurium LT2
gaugguaauauuaaaa

SEQ ID NO: 1840357 - RNA, 22 nt, Salmonella typhimurium LT2
gauggugcagccccggcggcgu

SEQ ID NO: 1840358 - RNA, 20 nt, Salmonella typhimurium LT2
gauguccaggcgacaugaca

SEQ ID NO: 1840359 - RNA, 12 nt, Salmonella typhimurium LT2
gauggugcgagg

SEQ ID NO: 1840360 - RNA, 17 nt, Salmonella typhimurium LT2
gaugguggugcaagcac

SEQ ID NO: 1840361 - RNA, 13 nt, Salmonella typhimurium LT2
gauguaaaaaugc

SEQ ID NO: 1840362 - RNA, 16 nt, Salmonella typhimurium LT2
gauuaaucgucauccc

SEQ ID NO: 1840363 - RNA, 19 nt, Salmonella typhimurium LT2
gauuaaugcugcaccacac

SEQ ID NO: 1840364 - RNA, 16 nt, Salmonella typhimurium LT2
gauuaaucagcagaua

SEQ ID NO: 1840365 - RNA, 16 nt, Salmonella typhimurium LT2
gauuacgacccacaau

SEQ ID NO: 1840366 - RNA, 22 nt, Salmonella typhimurium LT2
gauuaccgggauuuccauauua

SEQ ID NO: 1840367 - RNA, 18 nt, Salmonella typhimurium LT2
gauuaccgggauuuccau

SEQ ID NO: 1840368 - RNA, 17 nt, Salmonella typhimurium LT2
gauuaccuaccagcgcg

SEQ ID NO: 1840369 - RNA, 19 nt, Salmonella typhimurium LT2
gauuaucgucuaucacaug

SEQ ID NO: 1840370 - RNA, 16 nt, Salmonella typhimurium LT2
gauuaucguucaagac

SEQ ID NO: 1840371 - RNA, 19 nt, Salmonella typhimurium LT2
gauuauuggucagcaggcg

SEQ ID NO: 1840372 - RNA, 20 nt, Salmonella typhimurium LT2
gauuauuuuaucaucagcac

SEQ ID NO: 1840373 - RNA, 14 nt, Salmonella typhimurium LT2
gaugucgccacgcc

SEQ ID NO: 1840374 - RNA, 17 nt, Salmonella typhimurium LT2
gauguguuugagcagcc

SEQ ID NO: 1840375 - RNA, 13 nt, Salmonella typhimurium LT2
gauguuaaagguc

SEQ ID NO: 1840376 - RNA, 19 nt, Salmonella typhimurium LT2
gaugugcuuuuuauuuuuc

SEQ ID NO: 1840377 - RNA, 18 nt, Salmonella typhimurium LT2
gaugugcuggggagcguu

SEQ ID NO: 1840378 - RNA, 20 nt, Salmonella typhimurium LT2
gauguuuuuaucaugcugac

SEQ ID NO: 1840379 - RNA, 23 nt, Salmonella typhimurium LT2
gauuaaggccggcauuuuauuca

SEQ ID NO: 1840380 - RNA, 17 nt, Salmonella typhimurium LT2
gauguuuucagcauuaa

SEQ ID NO: 1840381 - RNA, 20 nt, Salmonella typhimurium LT2
gauucucuaacgucagcgcc

SEQ ID NO: 1840382 - RNA, 22 nt, Salmonella typhimurium LT2
gauucuaucuguuuuaauuccu

SEQ ID NO: 1840383 - RNA, 15 nt, Salmonella typhimurium LT2
gauucuacucugcuc

SEQ ID NO: 1840384 - RNA, 12 nt, Salmonella typhimurium LT2
gauucuaucugu

SEQ ID NO: 1840385 - RNA, 15 nt, Salmonella typhimurium LT2
gauucugccaguuca

SEQ ID NO: 1840386 - RNA, 19 nt, Salmonella typhimurium LT2
gauucugaauaauauguaa

SEQ ID NO: 1840387 - RNA, 16 nt, Salmonella typhimurium LT2
gauugacgguuugucu

SEQ ID NO: 1840388 - RNA, 17 nt, Salmonella typhimurium LT2
gauugacagaauaaugc

SEQ ID NO: 1840389 - RNA, 13 nt, Salmonella typhimurium LT2
gauugaauaaugc

SEQ ID NO: 1840390 - RNA, 18 nt, Salmonella typhimurium LT2
gauugaaguucuucccac

SEQ ID NO: 1840391 - RNA, 14 nt, Salmonella typhimurium LT2
gauugcaagaauau

SEQ ID NO: 1840392 - RNA, 17 nt, Salmonella typhimurium LT2
gauugauuuuguaaucu

SEQ ID NO: 1840393 - RNA, 20 nt, Salmonella typhimurium LT2
gauugauuuauucacuggca

SEQ ID NO: 1840394 - RNA, 14 nt, Salmonella typhimurium LT2
gauucgcccacgga

SEQ ID NO: 1840395 - RNA, 14 nt, Salmonella typhimurium LT2
gauucgaaccugcg

SEQ ID NO: 1840396 - RNA, 22 nt, Salmonella typhimurium LT2
gauucguuucucuucggcggcc

SEQ ID NO: 1840397 - RNA, 17 nt, Salmonella typhimurium LT2
gauucaugaucuuuccu

SEQ ID NO: 1840398 - RNA, 15 nt, Salmonella typhimurium LT2
gauucaggucaugca

SEQ ID NO: 1840399 - RNA, 19 nt, Salmonella typhimurium LT2
gauucaguucaucuuccac

SEQ ID NO: 1840400 - RNA, 13 nt, Salmonella typhimurium LT2
gauuccagagcga

SEQ ID NO: 1840401 - RNA, 14 nt, Salmonella typhimurium LT2
gauucaccaccacc

SEQ ID NO: 1840402 - RNA, 22 nt, Salmonella typhimurium LT2
gauucaacgcgugauccacagc

SEQ ID NO: 1840403 - RNA, 17 nt, Salmonella typhimurium LT2
gauuuaaucgcuucaau

SEQ ID NO: 1840404 - RNA, 16 nt, Salmonella typhimurium LT2
gauuuccauauuaacg

SEQ ID NO: 1840405 - RNA, 15 nt, Salmonella typhimurium LT2
gauuuccggcggcag

SEQ ID NO: 1840406 - RNA, 19 nt, Salmonella typhimurium LT2
gauuuccggguucacauca

SEQ ID NO: 1840407 - RNA, 22 nt, Salmonella typhimurium LT2
gauuucaugcggugcaugaaua

SEQ ID NO: 1840408 - RNA, 12 nt, Salmonella typhimurium LT2
gauuucaucgcu

SEQ ID NO: 1840409 - RNA, 22 nt, Salmonella typhimurium LT2
gauuuccagaaucaauaaaucg

SEQ ID NO: 1840410 - RNA, 19 nt, Salmonella typhimurium LT2
gauuuccagcgaauaauga

SEQ ID NO: 1840411 - RNA, 16 nt, Salmonella typhimurium LT2
gauuuauucuuugucu

SEQ ID NO: 1840412 - RNA, 12 nt, Salmonella typhimurium LT2
gauuuaugaaua

SEQ ID NO: 1840413 - RNA, 23 nt, Salmonella typhimurium LT2
gauuuagcguuggcgucaucgac

SEQ ID NO: 1840414 - RNA, 19 nt, Salmonella typhimurium LT2
gauuugcgaaucauguuuu

SEQ ID NO: 1840415 - RNA, 16 nt, Salmonella typhimurium LT2
gauuugccgcgccuuc

SEQ ID NO: 1840416 - RNA, 17 nt, Salmonella typhimurium LT2
gauuugcugaaguucuc

SEQ ID NO: 1840417 - RNA, 16 nt, Salmonella typhimurium LT2
gauuugcggcagaaau

SEQ ID NO: 1840418 - RNA, 23 nt, Salmonella typhimurium LT2
gauuuguacguauuuacaaauga

SEQ ID NO: 1840419 - RNA, 16 nt, Salmonella typhimurium LT2
gauuucgcaacagcau

SEQ ID NO: 1840420 - RNA, 17 nt, Salmonella typhimurium LT2
gauuucgcuccacuggc

SEQ ID NO: 1840421 - RNA, 17 nt, Salmonella typhimurium LT2
gauuucguucuuucugc

SEQ ID NO: 1840422 - RNA, 16 nt, Salmonella typhimurium LT2
gauuuguuucaucgcc

SEQ ID NO: 1840423 - RNA, 21 nt, Salmonella typhimurium LT2
gauuuuaagcauccaggaagu

SEQ ID NO: 1840424 - RNA, 22 nt, Salmonella typhimurium LT2
gauuuucuaugugcgccagcgc

SEQ ID NO: 1840425 - RNA, 14 nt, Salmonella typhimurium LT2
gcaaaaaaggccag

SEQ ID NO: 1840426 - RNA, 21 nt, Salmonella typhimurium LT2
gcaaaaacggcgcuuuuaaaa

SEQ ID NO: 1840427 - RNA, 23 nt, Salmonella typhimurium LT2
gcaaaaacggcgcuuuuaaaaua

SEQ ID NO: 1840428 - RNA, 15 nt, Salmonella typhimurium LT2
gcaaacaacccggcu

SEQ ID NO: 1840429 - RNA, 21 nt, Salmonella typhimurium LT2
gcaaaaguuugaccagcaaua

SEQ ID NO: 1840430 - RNA, 15 nt, Salmonella typhimurium LT2
gcaaaauauauaauu

SEQ ID NO: 1840431 - RNA, 15 nt, Salmonella typhimurium LT2
gcaaaaccagacgcc

SEQ ID NO: 1840432 - RNA, 18 nt, Salmonella typhimurium LT2
gcaaaaccuucauaaaua

SEQ ID NO: 1840433 - RNA, 12 nt, Salmonella typhimurium LT2
gcaaaacauggc

SEQ ID NO: 1840434 - RNA, 16 nt, Salmonella typhimurium LT2
gcaaaacucugagcau

SEQ ID NO: 1840435 - RNA, 17 nt, Salmonella typhimurium LT2
gcaaaacucugagcaua

SEQ ID NO: 1840436 - RNA, 17 nt, Salmonella typhimurium LT2
gcaaaacgugguaaaaa

SEQ ID NO: 1840437 - RNA, 20 nt, Salmonella typhimurium LT2
gcaaaacuaaacccggccug

SEQ ID NO: 1840438 - RNA, 15 nt, Salmonella typhimurium LT2
gcaaaacgccgcaga

SEQ ID NO: 1840439 - RNA, 14 nt, Salmonella typhimurium LT2
gcaaacuuugcgcc

SEQ ID NO: 1840440 - RNA, 22 nt, Salmonella typhimurium LT2
gcaaacuuugcgccauuucaau

SEQ ID NO: 1840441 - RNA, 15 nt, Salmonella typhimurium LT2
gcaaagcaauaccac

SEQ ID NO: 1840442 - RNA, 17 nt, Salmonella typhimurium LT2
gcaaagcgacgcgcggu

SEQ ID NO: 1840443 - RNA, 19 nt, Salmonella typhimurium LT2
gcaaagcgucgcgucagca

SEQ ID NO: 1840444 - RNA, 15 nt, Salmonella typhimurium LT2
gcaaagcucaacgca

SEQ ID NO: 1840445 - RNA, 18 nt, Salmonella typhimurium LT2
gcaaagcucaacgcaggc

SEQ ID NO: 1840446 - RNA, 20 nt, Salmonella typhimurium LT2
gcaaagcucacucuaucaag

SEQ ID NO: 1840447 - RNA, 17 nt, Salmonella typhimurium LT2
gcaaaggaucgcaacca

SEQ ID NO: 1840448 - RNA, 21 nt, Salmonella typhimurium LT2
gcaaagccaauacucaggguc

SEQ ID NO: 1840449 - RNA, 19 nt, Salmonella typhimurium LT2
gcaaagcccacgcccugca

SEQ ID NO: 1840450 - RNA, 22 nt, Salmonella typhimurium LT2
gcaaagcccacgcccugcaaug

SEQ ID NO: 1840451 - RNA, 22 nt, Salmonella typhimurium LT2
gcaaagcccaucagcgccagcc

SEQ ID NO: 1840452 - RNA, 18 nt, Salmonella typhimurium LT2
gcaaacgccgaagccaac

SEQ ID NO: 1840453 - RNA, 16 nt, Salmonella typhimurium LT2
gcaaacggauauuuua

SEQ ID NO: 1840454 - RNA, 15 nt, Salmonella typhimurium LT2
gcaaaccggcaugaa

SEQ ID NO: 1840455 - RNA, 12 nt, Salmonella typhimurium LT2
gcaaacgacaca

SEQ ID NO: 1840456 - RNA, 18 nt, Salmonella typhimurium LT2
gcaaacgauaaaagcucu

SEQ ID NO: 1840457 - RNA, 16 nt, Salmonella typhimurium LT2
gcaaacgguuaauacu

SEQ ID NO: 1840458 - RNA, 20 nt, Salmonella typhimurium LT2
gcaaacuacuuucggaaaaa

SEQ ID NO: 1840459 - RNA, 20 nt, Salmonella typhimurium LT2
gcaaacaucugcuccagcgu

SEQ ID NO: 1840460 - RNA, 21 nt, Salmonella typhimurium LT2
gcaaaccgaauucguccacac

SEQ ID NO: 1840461 - RNA, 11 nt, Salmonella typhimurium LT2
gcaaaccgcaa

SEQ ID NO: 1840462 - RNA, 18 nt, Salmonella typhimurium LT2
gcaaacagagcgccggca

SEQ ID NO: 1840463 - RNA, 20 nt, Salmonella typhimurium LT2
gcaaacaaggcaucuaucag

SEQ ID NO: 1840464 - RNA, 21 nt, Salmonella typhimurium LT2
gcaaacacaaaaugcccuucu

SEQ ID NO: 1840465 - RNA, 13 nt, Salmonella typhimurium LT2
gcaaaucaaaagg

SEQ ID NO: 1840466 - RNA, 19 nt, Salmonella typhimurium LT2
gcaaauaccacaucagacc

SEQ ID NO: 1840467 - RNA, 19 nt, Salmonella typhimurium LT2
gcaaauaccggacagacuu

SEQ ID NO: 1840468 - RNA, 19 nt, Salmonella typhimurium LT2
gcaaauacugcuuuuccgg

SEQ ID NO: 1840469 - RNA, 14 nt, Salmonella typhimurium LT2
gcaaagugccaucc

SEQ ID NO: 1840470 - RNA, 14 nt, Salmonella typhimurium LT2
gcaaaguuguuuua

SEQ ID NO: 1840471 - RNA, 18 nt, Salmonella typhimurium LT2
gcaaaguuguuuuaacgu

SEQ ID NO: 1840472 - RNA, 14 nt, Salmonella typhimurium LT2
gcaaauaauaccac

SEQ ID NO: 1840473 - RNA, 19 nt, Salmonella typhimurium LT2
gcaaaguacgggugaagca

SEQ ID NO: 1840474 - RNA, 22 nt, Salmonella typhimurium LT2
gcaaagucgaacgacugaguau

SEQ ID NO: 1840475 - RNA, 20 nt, Salmonella typhimurium LT2
gcaaagucuucauggucgga

SEQ ID NO: 1840476 - RNA, 20 nt, Salmonella typhimurium LT2
gcaaaucgcccaucacaugu

SEQ ID NO: 1840477 - RNA, 20 nt, Salmonella typhimurium LT2
gcaaaucccugaucggccag

SEQ ID NO: 1840478 - RNA, 20 nt, Salmonella typhimurium LT2
gcaaaugaccagaucaacau

SEQ ID NO: 1840479 - RNA, 16 nt, Salmonella typhimurium LT2
gcaaaugccaucccau

SEQ ID NO: 1840480 - RNA, 23 nt, Salmonella typhimurium LT2
gcaaauucuguaucgcuuauuuu

SEQ ID NO: 1840481 - RNA, 12 nt, Salmonella typhimurium LT2
gcaacaaagccu

SEQ ID NO: 1840482 - RNA, 15 nt, Salmonella typhimurium LT2
gcaacaugacauuaa

SEQ ID NO: 1840483 - RNA, 17 nt, Salmonella typhimurium LT2
gcaacaugaccagcgca

SEQ ID NO: 1840484 - RNA, 13 nt, Salmonella typhimurium LT2
gcaacaugcccac

SEQ ID NO: 1840485 - RNA, 13 nt, Salmonella typhimurium LT2
gcaacauugcgcc

SEQ ID NO: 1840486 - RNA, 13 nt, Salmonella typhimurium LT2
gcaaccaggucac

SEQ ID NO: 1840487 - RNA, 17 nt, Salmonella typhimurium LT2
gcaaccagcuaaccugu

SEQ ID NO: 1840488 - RNA, 16 nt, Salmonella typhimurium LT2
gcaaccauuccacagg

SEQ ID NO: 1840489 - RNA, 18 nt, Salmonella typhimurium LT2
gcaaccauuaccgccaac

SEQ ID NO: 1840490 - RNA, 16 nt, Salmonella typhimurium LT2
gcaaccaacgcccaac

SEQ ID NO: 1840491 - RNA, 19 nt, Salmonella typhimurium LT2
gcaaccagaaugcccaggc

SEQ ID NO: 1840492 - RNA, 21 nt, Salmonella typhimurium LT2
gcaacccguaccuccagcgac

SEQ ID NO: 1840493 - RNA, 15 nt, Salmonella typhimurium LT2
gcaacccgcuccaga

SEQ ID NO: 1840494 - RNA, 18 nt, Salmonella typhimurium LT2
gcaacccgacugccacca

SEQ ID NO: 1840495 - RNA, 19 nt, Salmonella typhimurium LT2
gcaacccgacugccaccac

SEQ ID NO: 1840496 - RNA, 21 nt, Salmonella typhimurium LT2
gcaacccugccgucucaacca

SEQ ID NO: 1840497 - RNA, 14 nt, Salmonella typhimurium LT2
gcaaccccucaucg

SEQ ID NO: 1840498 - RNA, 23 nt, Salmonella typhimurium LT2
gcaacagcaccagcaggugguac

SEQ ID NO: 1840499 - RNA, 17 nt, Salmonella typhimurium LT2
gcaacagcaccagcagg

SEQ ID NO: 1840500 - RNA, 18 nt, Salmonella typhimurium LT2
gcaacagcaagucgcggg

SEQ ID NO: 1840501 - RNA, 22 nt, Salmonella typhimurium LT2
gcaacaggccgcgaaagcggcc

SEQ ID NO: 1840502 - RNA, 19 nt, Salmonella typhimurium LT2
gcaacagggcuuccgcauu

SEQ ID NO: 1840503 - RNA, 19 nt, Salmonella typhimurium LT2
gcaacagguuaaccaugcc

SEQ ID NO: 1840504 - RNA, 20 nt, Salmonella typhimurium LT2
gcaacagguuaaccaugccc

SEQ ID NO: 1840505 - RNA, 16 nt, Salmonella typhimurium LT2
gcaacagcaccagcag

SEQ ID NO: 1840506 - RNA, 12 nt, Salmonella typhimurium LT2
gcaacagcacca

SEQ ID NO: 1840507 - RNA, 15 nt, Salmonella typhimurium LT2
gcaacagcaccagaa

SEQ ID NO: 1840508 - RNA, 16 nt, Salmonella typhimurium LT2
gcaacagacuauccag

SEQ ID NO: 1840509 - RNA, 22 nt, Salmonella typhimurium LT2
gcaacaacaggccagaauaacg

SEQ ID NO: 1840510 - RNA, 21 nt, Salmonella typhimurium LT2
gcaacaauuucuacugauuua

SEQ ID NO: 1840511 - RNA, 13 nt, Salmonella typhimurium LT2
gcaacaccauccc

SEQ ID NO: 1840512 - RNA, 17 nt, Salmonella typhimurium LT2
gcaacaccaccgcccgc

SEQ ID NO: 1840513 - RNA, 22 nt, Salmonella typhimurium LT2
gcccgcuucauuggcgucugcu

SEQ ID NO: 1840514 - RNA, 21 nt, Salmonella typhimurium LT2
gcccgcuugcaccauggcggc

SEQ ID NO: 1840515 - RNA, 20 nt, Salmonella typhimurium LT2
gcccggacgaaccuggcggu

SEQ ID NO: 1840516 - RNA, 14 nt, Salmonella typhimurium LT2
gcccgcugcgccgc

SEQ ID NO: 1840517 - RNA, 19 nt, Salmonella typhimurium LT2
gcccgcguuuaccaccgga

SEQ ID NO: 1840518 - RNA, 20 nt, Salmonella typhimurium LT2
gcccgcguucugcugugccg

SEQ ID NO: 1840519 - RNA, 18 nt, Salmonella typhimurium LT2
gcccgcgucguugaugca

SEQ ID NO: 1840520 - RNA, 13 nt, Salmonella typhimurium LT2
gcccgcgcguuca

SEQ ID NO: 1840521 - RNA, 21 nt, Salmonella typhimurium LT2
gcccgggagaacgccgggccu

SEQ ID NO: 1840522 - RNA, 22 nt, Salmonella typhimurium LT2
gcccgggagaacgccgggccug

SEQ ID NO: 1840523 - RNA, 18 nt, Salmonella typhimurium LT2
gcccggcggcacggcgcu

SEQ ID NO: 1840524 - RNA, 21 nt, Salmonella typhimurium LT2
gcccggcggcgcgaugccugc

SEQ ID NO: 1840525 - RNA, 13 nt, Salmonella typhimurium LT2
gcccggcggcggc

SEQ ID NO: 1840526 - RNA, 21 nt, Salmonella typhimurium LT2
gcccggagggguuuucgccag

SEQ ID NO: 1840527 - RNA, 17 nt, Salmonella typhimurium LT2
gcccggaucgcggccuu

SEQ ID NO: 1840528 - RNA, 17 nt, Salmonella typhimurium LT2
gcccggcgcgacaccuu

SEQ ID NO: 1840529 - RNA, 18 nt, Salmonella typhimurium LT2
gcccgagcgacgcccugc

SEQ ID NO: 1840530 - RNA, 14 nt, Salmonella typhimurium LT2
gccccuuccgccac

SEQ ID NO: 1840531 - RNA, 17 nt, Salmonella typhimurium LT2
gccccuuccgccacggc

SEQ ID NO: 1840532 - RNA, 18 nt, Salmonella typhimurium LT2
gccccggucaacgcgccg

SEQ ID NO: 1840533 - RNA, 21 nt, Salmonella typhimurium LT2
gcccgacgcgccacuuccagc

SEQ ID NO: 1840534 - RNA, 14 nt, Salmonella typhimurium LT2
gcccgaaaggacau

SEQ ID NO: 1840535 - RNA, 12 nt, Salmonella typhimurium LT2
gccccggcggcg

SEQ ID NO: 1840536 - RNA, 15 nt, Salmonella typhimurium LT2
gccccgccauccggc

SEQ ID NO: 1840537 - RNA, 16 nt, Salmonella typhimurium LT2
gccccgccauccggca

SEQ ID NO: 1840538 - RNA, 21 nt, Salmonella typhimurium LT2
gcccauucuucgucgucauca

SEQ ID NO: 1840539 - RNA, 18 nt, Salmonella typhimurium LT2
gcccauuccgccaacggu

SEQ ID NO: 1840540 - RNA, 15 nt, Salmonella typhimurium LT2
gcccauucaacgggc

SEQ ID NO: 1840541 - RNA, 14 nt, Salmonella typhimurium LT2
gcccccgcgcaggc

SEQ ID NO: 1840542 - RNA, 20 nt, Salmonella typhimurium LT2
gcccccaaauugaccucaug

SEQ ID NO: 1840543 - RNA, 15 nt, Salmonella typhimurium LT2
gcccacgcccagagc

SEQ ID NO: 1840544 - RNA, 13 nt, Salmonella typhimurium LT2
gcccaccugcagc

SEQ ID NO: 1840545 - RNA, 17 nt, Salmonella typhimurium LT2
gcccaccugcagcagcu

SEQ ID NO: 1840546 - RNA, 23 nt, Salmonella typhimurium LT2
gcccacuaacaggauguaagaca

SEQ ID NO: 1840547 - RNA, 19 nt, Salmonella typhimurium LT2
gcccacuuguaccaacugc

SEQ ID NO: 1840548 - RNA, 21 nt, Salmonella typhimurium LT2
gcccacuuguaccaacugcug

SEQ ID NO: 1840549 - RNA, 17 nt, Salmonella typhimurium LT2
gcccacuguggcgccac

SEQ ID NO: 1840550 - RNA, 15 nt, Salmonella typhimurium LT2
gcccaccagucccug

SEQ ID NO: 1840551 - RNA, 22 nt, Salmonella typhimurium LT2
gcccaccggagcggcguccgcc

SEQ ID NO: 1840552 - RNA, 21 nt, Salmonella typhimurium LT2
gcccagcauauuaacagugag

SEQ ID NO: 1840553 - RNA, 14 nt, Salmonella typhimurium LT2
gcccagcccggaaa

SEQ ID NO: 1840554 - RNA, 18 nt, Salmonella typhimurium LT2
gcccagcgugccugccgc

SEQ ID NO: 1840555 - RNA, 19 nt, Salmonella typhimurium LT2
gcccagcgugccugccgca

SEQ ID NO: 1840556 - RNA, 18 nt, Salmonella typhimurium LT2
gcccaucagcgccagccc

SEQ ID NO: 1840557 - RNA, 14 nt, Salmonella typhimurium LT2
gcccaucagcgcca

SEQ ID NO: 1840558 - RNA, 15 nt, Salmonella typhimurium LT2
gcccauccagcacag

SEQ ID NO: 1840559 - RNA, 14 nt, Salmonella typhimurium LT2
gcccauccagagca

SEQ ID NO: 1840560 - RNA, 16 nt, Salmonella typhimurium LT2
gcccaucgcgccauga

SEQ ID NO: 1840561 - RNA, 15 nt, Salmonella typhimurium LT2
gcccaguuucuucag

SEQ ID NO: 1840562 - RNA, 16 nt, Salmonella typhimurium LT2
gcccagguuagcagcc

SEQ ID NO: 1840563 - RNA, 21 nt, Salmonella typhimurium LT2
gcccagguuagcagccacaca

SEQ ID NO: 1840564 - RNA, 22 nt, Salmonella typhimurium LT2
gcccaggucugaugagcgcagc

SEQ ID NO: 1840565 - RNA, 20 nt, Salmonella typhimurium LT2
gcccaucagcaucccaccgg

SEQ ID NO: 1840566 - RNA, 11 nt, Salmonella typhimurium LT2
gcccauaucca

SEQ ID NO: 1840567 - RNA, 19 nt, Salmonella typhimurium LT2
gcccauaccacaacagaau

SEQ ID NO: 1840568 - RNA, 15 nt, Salmonella typhimurium LT2
gcccauaccagcgcg

SEQ ID NO: 1840569 - RNA, 21 nt, Salmonella typhimurium LT2
gcccauacacaccagcaggaa

SEQ ID NO: 1840570 - RNA, 16 nt, Salmonella typhimurium LT2
gccauguuaauaccag

SEQ ID NO: 1840571 - RNA, 16 nt, Salmonella typhimurium LT2
gccaugucuuuuucag

SEQ ID NO: 1840572 - RNA, 20 nt, Salmonella typhimurium LT2
gccauuaauuucuuaccaaa

SEQ ID NO: 1840573 - RNA, 13 nt, Salmonella typhimurium LT2
gccauuauuuauu

SEQ ID NO: 1840574 - RNA, 22 nt, Salmonella typhimurium LT2
gccauuaucaccauucccagcg

SEQ ID NO: 1840575 - RNA, 14 nt, Salmonella typhimurium LT2
gccaugccagcagu

SEQ ID NO: 1840576 - RNA, 15 nt, Salmonella typhimurium LT2
gccaugcccggcggc

SEQ ID NO: 1840577 - RNA, 16 nt, Salmonella typhimurium LT2
gccaugcccggcggcg

SEQ ID NO: 1840578 - RNA, 18 nt, Salmonella typhimurium LT2
gccaugccugauggcgca

SEQ ID NO: 1840579 - RNA, 22 nt, Salmonella typhimurium LT2
gccaugcgcggcaucagccugc

SEQ ID NO: 1840580 - RNA, 23 nt, Salmonella typhimurium LT2
gccaugcgggugacgcuggcgga

SEQ ID NO: 1840581 - RNA, 16 nt, Salmonella typhimurium LT2
gcccaacaccagcacu

SEQ ID NO: 1840582 - RNA, 19 nt, Salmonella typhimurium LT2
gcccaacagcaauguuuca

SEQ ID NO: 1840583 - RNA, 19 nt, Salmonella typhimurium LT2
gcccaauguuuuaccggca

SEQ ID NO: 1840584 - RNA, 13 nt, Salmonella typhimurium LT2
gcccaauccggcu

SEQ ID NO: 1840585 - RNA, 15 nt, Salmonella typhimurium LT2
gccauuggcaaucag

SEQ ID NO: 1840586 - RNA, 19 nt, Salmonella typhimurium LT2
gccauugcugucgacaaua

SEQ ID NO: 1840587 - RNA, 20 nt, Salmonella typhimurium LT2
gccauuucaauaauauguuc

SEQ ID NO: 1840588 - RNA, 20 nt, Salmonella typhimurium LT2
gcccaaauaguccagcagcc

SEQ ID NO: 1840589 - RNA, 21 nt, Salmonella typhimurium LT2
gccaggcuaagaucgccuucg

SEQ ID NO: 1840590 - RNA, 19 nt, Salmonella typhimurium LT2
gccaggcgcuaucuucaau

SEQ ID NO: 1840591 - RNA, 13 nt, Salmonella typhimurium LT2
gccauauugcugu

SEQ ID NO: 1840592 - RNA, 18 nt, Salmonella typhimurium LT2
gccauauugccgcacaug

SEQ ID NO: 1840593 - RNA, 15 nt, Salmonella typhimurium LT2
gccauauguuccacc

SEQ ID NO: 1840594 - RNA, 15 nt, Salmonella typhimurium LT2
gccauauccaagccc

SEQ ID NO: 1840595 - RNA, 20 nt, Salmonella typhimurium LT2
gccauaucguucaguuucaa

SEQ ID NO: 1840596 - RNA, 14 nt, Salmonella typhimurium LT2
gccauauacgccac

SEQ ID NO: 1840597 - RNA, 15 nt, Salmonella typhimurium LT2
gccauauaugaaauc

SEQ ID NO: 1840598 - RNA, 14 nt, Salmonella typhimurium LT2
gccauccugcaccg

SEQ ID NO: 1840599 - RNA, 17 nt, Salmonella typhimurium LT2
gccaucaggcaaugucu

SEQ ID NO: 1840600 - RNA, 15 nt, Salmonella typhimurium LT2
gccaucaggaaauuc

SEQ ID NO: 1840601 - RNA, 19 nt, Salmonella typhimurium LT2
gccaucaggcaugaccugc

SEQ ID NO: 1840602 - RNA, 23 nt, Salmonella typhimurium LT2
gccaucaggccccccuuguuauc

SEQ ID NO: 1840603 - RNA, 19 nt, Salmonella typhimurium LT2
gccaucaggccccccuugu

SEQ ID NO: 1840604 - RNA, 19 nt, Salmonella typhimurium LT2
gccaucaggcgauggcgca

SEQ ID NO: 1840605 - RNA, 22 nt, Salmonella typhimurium LT2
gccaucaggcgggguuguuuua

SEQ ID NO: 1840606 - RNA, 15 nt, Salmonella typhimurium LT2
gccaucuccggcagc

SEQ ID NO: 1840607 - RNA, 14 nt, Salmonella typhimurium LT2
gccaucuuccaacu

SEQ ID NO: 1840608 - RNA, 14 nt, Salmonella typhimurium LT2
gccaucuuccagca

SEQ ID NO: 1840609 - RNA, 17 nt, Salmonella typhimurium LT2
gccaucuuccagcauca

SEQ ID NO: 1840610 - RNA, 18 nt, Salmonella typhimurium LT2
gccaucuuccagcaucag

SEQ ID NO: 1840611 - RNA, 22 nt, Salmonella typhimurium LT2
gccaucgacagcgccauauaaa

SEQ ID NO: 1840612 - RNA, 14 nt, Salmonella typhimurium LT2
gccaucgacagcgc

SEQ ID NO: 1840613 - RNA, 20 nt, Salmonella typhimurium LT2
gccgauaguggucgccacgc

SEQ ID NO: 1840614 - RNA, 13 nt, Salmonella typhimurium LT2
gccgauaucaaua

SEQ ID NO: 1840615 - RNA, 18 nt, Salmonella typhimurium LT2
gccgauagcaucgcugau

SEQ ID NO: 1840616 - RNA, 15 nt, Salmonella typhimurium LT2
gccgauagcggcggc

SEQ ID NO: 1840617 - RNA, 13 nt, Salmonella typhimurium LT2
gccgauacugccc

SEQ ID NO: 1840618 - RNA, 19 nt, Salmonella typhimurium LT2
gccgauaaccagcgcgccg

SEQ ID NO: 1840619 - RNA, 16 nt, Salmonella typhimurium LT2
gccgcacuccccagaa

SEQ ID NO: 1840620 - RNA, 11 nt, Salmonella typhimurium LT2
gccgcaacaga

SEQ ID NO: 1840621 - RNA, 16 nt, Salmonella typhimurium LT2
gccgcaaacgccugcu

SEQ ID NO: 1840622 - RNA, 18 nt, Salmonella typhimurium LT2
gccgcaaacgccugcucc

SEQ ID NO: 1840623 - RNA, 17 nt, Salmonella typhimurium LT2
gccgcaaacucaggagc

SEQ ID NO: 1840624 - RNA, 23 nt, Salmonella typhimurium LT2
gccgcaaaugaccagaucaacau

SEQ ID NO: 1840625 - RNA, 14 nt, Salmonella typhimurium LT2
gccgcaaacgccga

SEQ ID NO: 1840626 - RNA, 12 nt, Salmonella typhimurium LT2
gccgaugacgcu

SEQ ID NO: 1840627 - RNA, 14 nt, Salmonella typhimurium LT2
gccgauuuuucggc

SEQ ID NO: 1840628 - RNA, 12 nt, Salmonella typhimurium LT2
gccgccagaauc

SEQ ID NO: 1840629 - RNA, 18 nt, Salmonella typhimurium LT2
gccgccacgaccugcagu

SEQ ID NO: 1840630 - RNA, 12 nt, Salmonella typhimurium LT2
gccgcauaauag

SEQ ID NO: 1840631 - RNA, 19 nt, Salmonella typhimurium LT2
gccgcauaauagcgccaga

SEQ ID NO: 1840632 - RNA, 18 nt, Salmonella typhimurium LT2
gccgcagccgcucagggu

SEQ ID NO: 1840633 - RNA, 14 nt, Salmonella typhimurium LT2
gccgcagcccgccc

SEQ ID NO: 1840634 - RNA, 18 nt, Salmonella typhimurium LT2
gccgaaagcgaucacauu

SEQ ID NO: 1840635 - RNA, 13 nt, Salmonella typhimurium LT2
gccgaaacguaug

SEQ ID NO: 1840636 - RNA, 13 nt, Salmonella typhimurium LT2
gccgaaagugguu

SEQ ID NO: 1840637 - RNA, 13 nt, Salmonella typhimurium LT2
gcccugugccgcu

SEQ ID NO: 1840638 - RNA, 18 nt, Salmonella typhimurium LT2
gcccugccggaaaaugcg

SEQ ID NO: 1840639 - RNA, 14 nt, Salmonella typhimurium LT2
gcccugcccgccag

SEQ ID NO: 1840640 - RNA, 17 nt, Salmonella typhimurium LT2
gcccugcgccucaagcg

SEQ ID NO: 1840641 - RNA, 16 nt, Salmonella typhimurium LT2
gcccugcucccacagc

SEQ ID NO: 1840642 - RNA, 14 nt, Salmonella typhimurium LT2
gccgaccgccaggu

SEQ ID NO: 1840643 - RNA, 14 nt, Salmonella typhimurium LT2
gccgaccauccaga

SEQ ID NO: 1840644 - RNA, 19 nt, Salmonella typhimurium LT2
gccgacccccuccuuguaa

SEQ ID NO: 1840645 - RNA, 13 nt, Salmonella typhimurium LT2
gccgaccaccauc

SEQ ID NO: 1840646 - RNA, 14 nt, Salmonella typhimurium LT2
gccgaauggcggcu

SEQ ID NO: 1840647 - RNA, 21 nt, Salmonella typhimurium LT2
gccgaacgauugacccgccgc

SEQ ID NO: 1840648 - RNA, 23 nt, Salmonella typhimurium LT2
gccgaacgauugacccgccgcac

SEQ ID NO: 1840649 - RNA, 18 nt, Salmonella typhimurium LT2
gccgcugucgccagaaug

SEQ ID NO: 1840650 - RNA, 18 nt, Salmonella typhimurium LT2
gccgcugcgagcagcgaa

SEQ ID NO: 1840651 - RNA, 14 nt, Salmonella typhimurium LT2
gccgcugcuggcga

SEQ ID NO: 1840652 - RNA, 19 nt, Salmonella typhimurium LT2
gccgcugagaaaaagcgaa

SEQ ID NO: 1840653 - RNA, 16 nt, Salmonella typhimurium LT2
gccgcucccgcaugga

SEQ ID NO: 1840654 - RNA, 14 nt, Salmonella typhimurium LT2
gccgcucccgcaug

SEQ ID NO: 1840655 - RNA, 15 nt, Salmonella typhimurium LT2
gccgcuaucugcucc

SEQ ID NO: 1840656 - RNA, 22 nt, Salmonella typhimurium LT2
gccgcuaucgaccagcaccugc

SEQ ID NO: 1840657 - RNA, 16 nt, Salmonella typhimurium LT2
gccgcguuuugccgcu

SEQ ID NO: 1840658 - RNA, 19 nt, Salmonella typhimurium LT2
gccgcguuuuaaaccgcga

SEQ ID NO: 1840659 - RNA, 18 nt, Salmonella typhimurium LT2
gccgcguugcgcugaagu

SEQ ID NO: 1840660 - RNA, 17 nt, Salmonella typhimurium LT2
gccgcgugcucgcggcg

SEQ ID NO: 1840661 - RNA, 15 nt, Salmonella typhimurium LT2
gccgcgggcagcagc

SEQ ID NO: 1840662 - RNA, 17 nt, Salmonella typhimurium LT2
gccgccagauccuggcu

SEQ ID NO: 1840663 - RNA, 13 nt, Salmonella typhimurium LT2
gccgccagcaaua

SEQ ID NO: 1840664 - RNA, 13 nt, Salmonella typhimurium LT2
aaagcugcugcuu

SEQ ID NO: 1840665 - RNA, 15 nt, Salmonella typhimurium LT2
aaagcugcaccagga

SEQ ID NO: 1840666 - RNA, 19 nt, Salmonella typhimurium LT2
aaagcucgucuguuguucu

SEQ ID NO: 1840667 - RNA, 13 nt, Salmonella typhimurium LT2
aaagcucuucaug

SEQ ID NO: 1840668 - RNA, 16 nt, Salmonella typhimurium LT2
gccgccgcaggacagc

SEQ ID NO: 1840669 - RNA, 14 nt, Salmonella typhimurium LT2
gccgccgcaggaca

SEQ ID NO: 1840670 - RNA, 15 nt, Salmonella typhimurium LT2
gccgccgcgcucgcg

SEQ ID NO: 1840671 - RNA, 20 nt, Salmonella typhimurium LT2
gccgcgauguuugcucgcca

SEQ ID NO: 1840672 - RNA, 20 nt, Salmonella typhimurium LT2
gccgcgcacgccgcucgaau

SEQ ID NO: 1840673 - RNA, 13 nt, Salmonella typhimurium LT2
gccgcgcuggaua

SEQ ID NO: 1840674 - RNA, 13 nt, Salmonella typhimurium LT2
gccgcgccgcgca

SEQ ID NO: 1840675 - RNA, 14 nt, Salmonella typhimurium LT2
gccgcgccgcgcac

SEQ ID NO: 1840676 - RNA, 12 nt, Salmonella typhimurium LT2
gccgcgccgccg

SEQ ID NO: 1840677 - RNA, 17 nt, Salmonella typhimurium LT2
gccgcgacagucgcaga

SEQ ID NO: 1840678 - RNA, 18 nt, Salmonella typhimurium LT2
gccgccgggaucagcggc

SEQ ID NO: 1840679 - RNA, 16 nt, Salmonella typhimurium LT2
gccgccguuuuauuug

SEQ ID NO: 1840680 - RNA, 20 nt, Salmonella typhimurium LT2
gccgccgugguaaauacgcu

SEQ ID NO: 1840681 - RNA, 14 nt, Salmonella typhimurium LT2
gccagacgccgcgc

SEQ ID NO: 1840682 - RNA, 14 nt, Salmonella typhimurium LT2
gccagacgcgcagc

SEQ ID NO: 1840683 - RNA, 20 nt, Salmonella typhimurium LT2
gccagacggcgcccagccug

SEQ ID NO: 1840684 - RNA, 17 nt, Salmonella typhimurium LT2
gccagacgggccaggcg

SEQ ID NO: 1840685 - RNA, 13 nt, Salmonella typhimurium LT2
gccagagcgcgcu

SEQ ID NO: 1840686 - RNA, 11 nt, Salmonella typhimurium LT2
gccagagcagg

SEQ ID NO: 1840687 - RNA, 18 nt, Salmonella typhimurium LT2
gccagagauaauuuuccc

SEQ ID NO: 1840688 - RNA, 14 nt, Salmonella typhimurium LT2
gccagagagcguuu

SEQ ID NO: 1840689 - RNA, 17 nt, Salmonella typhimurium LT2
gccagaaugcccagcaa

SEQ ID NO: 1840690 - RNA, 13 nt, Salmonella typhimurium LT2
gccagacccgcgc

SEQ ID NO: 1840691 - RNA, 20 nt, Salmonella typhimurium LT2
gccagaccauuaacgccgcc

SEQ ID NO: 1840692 - RNA, 22 nt, Salmonella typhimurium LT2
gccagacagcccuauaacagcg

SEQ ID NO: 1840693 - RNA, 12 nt, Salmonella typhimurium LT2
gccagacaggcu

SEQ ID NO: 1840694 - RNA, 13 nt, Salmonella typhimurium LT2
gccagacaggcuu

SEQ ID NO: 1840695 - RNA, 18 nt, Salmonella typhimurium LT2
gccagaaaaaaaagcgcc

SEQ ID NO: 1840696 - RNA, 23 nt, Salmonella typhimurium LT2
gccagaagagaauggccagcaca

SEQ ID NO: 1840697 - RNA, 18 nt, Salmonella typhimurium LT2
gccagaagagaagcuuuu

SEQ ID NO: 1840698 - RNA, 20 nt, Salmonella typhimurium LT2
gccagaagagaagcuuuuuc

SEQ ID NO: 1840699 - RNA, 17 nt, Salmonella typhimurium LT2
gccacgcucgcuggugc

SEQ ID NO: 1840700 - RNA, 14 nt, Salmonella typhimurium LT2
gccacgcgccagcc

SEQ ID NO: 1840701 - RNA, 16 nt, Salmonella typhimurium LT2
gccacgcgccagccgu

SEQ ID NO: 1840702 - RNA, 23 nt, Salmonella typhimurium LT2
gccacuucuuccagcggcaggcc

SEQ ID NO: 1840703 - RNA, 22 nt, Salmonella typhimurium LT2
gccacggagagcggcuggaaga

SEQ ID NO: 1840704 - RNA, 19 nt, Salmonella typhimurium LT2
gccagcaccagcagcgcau

SEQ ID NO: 1840705 - RNA, 14 nt, Salmonella typhimurium LT2
gccagcaccagcag

SEQ ID NO: 1840706 - RNA, 15 nt, Salmonella typhimurium LT2
gccagcaccagcagc

SEQ ID NO: 1840707 - RNA, 18 nt, Salmonella typhimurium LT2
gccagcaacgcccagaua

SEQ ID NO: 1840708 - RNA, 17 nt, Salmonella typhimurium LT2
gccagcaauacccagaa

SEQ ID NO: 1840709 - RNA, 15 nt, Salmonella typhimurium LT2
gccagcaccagcagu

SEQ ID NO: 1840710 - RNA, 15 nt, Salmonella typhimurium LT2
gccagcaccauggcu

SEQ ID NO: 1840711 - RNA, 21 nt, Salmonella typhimurium LT2
gccagauggauaaccugccgg

SEQ ID NO: 1840712 - RNA, 14 nt, Salmonella typhimurium LT2
gccagauucaccac

SEQ ID NO: 1840713 - RNA, 19 nt, Salmonella typhimurium LT2
gccagauggauaaccugcc

SEQ ID NO: 1840714 - RNA, 18 nt, Salmonella typhimurium LT2
gccagauggauaaccugc

SEQ ID NO: 1840715 - RNA, 17 nt, Salmonella typhimurium LT2
gccagaucucacaagau

SEQ ID NO: 1840716 - RNA, 20 nt, Salmonella typhimurium LT2
gccagaucucacaagauuca

SEQ ID NO: 1840717 - RNA, 19 nt, Salmonella typhimurium LT2
gccagaugaucagcauagc

SEQ ID NO: 1840718 - RNA, 14 nt, Salmonella typhimurium LT2
gccagcaacagcgu

SEQ ID NO: 1840719 - RNA, 21 nt, Salmonella typhimurium LT2
gccagaggcuaaucaggaaga

SEQ ID NO: 1840720 - RNA, 20 nt, Salmonella typhimurium LT2
gccagaggcgguucugggca

SEQ ID NO: 1840721 - RNA, 19 nt, Salmonella typhimurium LT2
gccagauaaagcagcgaca

SEQ ID NO: 1840722 - RNA, 21 nt, Salmonella typhimurium LT2
gccagaucgaacagcggcaga

SEQ ID NO: 1840723 - RNA, 13 nt, Salmonella typhimurium LT2
gccagauccggcg

SEQ ID NO: 1840724 - RNA, 17 nt, Salmonella typhimurium LT2
gccaccaucgucgccag

SEQ ID NO: 1840725 - RNA, 15 nt, Salmonella typhimurium LT2
gccaccagcacaaug

SEQ ID NO: 1840726 - RNA, 14 nt, Salmonella typhimurium LT2
gccaccgccgccac

SEQ ID NO: 1840727 - RNA, 22 nt, Salmonella typhimurium LT2
gccaccaucgucgccagaccca

SEQ ID NO: 1840728 - RNA, 13 nt, Salmonella typhimurium LT2
gccaccgccgcca

SEQ ID NO: 1840729 - RNA, 17 nt, Salmonella typhimurium LT2
gccaccgcuccgcgcau

SEQ ID NO: 1840730 - RNA, 21 nt, Salmonella typhimurium LT2
gccacgcagauaucuuccagc

SEQ ID NO: 1840731 - RNA, 14 nt, Salmonella typhimurium LT2
gccacgcgacgcca

SEQ ID NO: 1840732 - RNA, 22 nt, Salmonella typhimurium LT2
gccacgccguagcugcgcgccg

SEQ ID NO: 1840733 - RNA, 23 nt, Salmonella typhimurium LT2
gccacgccguagcugcgcgccgc

SEQ ID NO: 1840734 - RNA, 20 nt, Salmonella typhimurium LT2
gccacgccccuaaggcagcg

SEQ ID NO: 1840735 - RNA, 12 nt, Salmonella typhimurium LT2
gccacgccgagg

SEQ ID NO: 1840736 - RNA, 14 nt, Salmonella typhimurium LT2
gccacgccauugcu

SEQ ID NO: 1840737 - RNA, 12 nt, Salmonella typhimurium LT2
gccaaagggagc

SEQ ID NO: 1840738 - RNA, 13 nt, Salmonella typhimurium LT2
gccaaagcgggca

SEQ ID NO: 1840739 - RNA, 16 nt, Salmonella typhimurium LT2
gccaaagggagcagac

SEQ ID NO: 1840740 - RNA, 18 nt, Salmonella typhimurium LT2
gccaaagucauugcugcc

SEQ ID NO: 1840741 - RNA, 19 nt, Salmonella typhimurium LT2
gccaaaucaugcccaacug

SEQ ID NO: 1840742 - RNA, 20 nt, Salmonella typhimurium LT2
gccaaaucuguucuguccau

SEQ ID NO: 1840743 - RNA, 14 nt, Salmonella typhimurium LT2
gccacaacgccuga

SEQ ID NO: 1840744 - RNA, 18 nt, Salmonella typhimurium LT2
gccacaccacaugcgagc

SEQ ID NO: 1840745 - RNA, 13 nt, Salmonella typhimurium LT2
gccaccacucggc

SEQ ID NO: 1840746 - RNA, 17 nt, Salmonella typhimurium LT2
gccaccacgccgagaaa

SEQ ID NO: 1840747 - RNA, 15 nt, Salmonella typhimurium LT2
gccaccacgcccaac

SEQ ID NO: 1840748 - RNA, 14 nt, Salmonella typhimurium LT2
gccaccacaaagcg

SEQ ID NO: 1840749 - RNA, 22 nt, Salmonella typhimurium LT2
gccacaugauguuguucgucuu

SEQ ID NO: 1840750 - RNA, 23 nt, Salmonella typhimurium LT2
gccacaucguuacccaucaccug

SEQ ID NO: 1840751 - RNA, 17 nt, Salmonella typhimurium LT2
gccacauagcauccaga

SEQ ID NO: 1840752 - RNA, 20 nt, Salmonella typhimurium LT2
gccagcccgaucaucuccug

SEQ ID NO: 1840753 - RNA, 19 nt, Salmonella typhimurium LT2
gccagccgcagcucauaac

SEQ ID NO: 1840754 - RNA, 13 nt, Salmonella typhimurium LT2
gccagccgccgcc

SEQ ID NO: 1840755 - RNA, 14 nt, Salmonella typhimurium LT2
gccagccgccgccg

SEQ ID NO: 1840756 - RNA, 18 nt, Salmonella typhimurium LT2
gccagccgccaaaaauau

SEQ ID NO: 1840757 - RNA, 20 nt, Salmonella typhimurium LT2
gccagccgcgccaucuccuc

SEQ ID NO: 1840758 - RNA, 19 nt, Salmonella typhimurium LT2
gccagccggauacugcgcu

SEQ ID NO: 1840759 - RNA, 16 nt, Salmonella typhimurium LT2
gccagccguuccgcua

SEQ ID NO: 1840760 - RNA, 18 nt, Salmonella typhimurium LT2
gccagccggagagcagua

SEQ ID NO: 1840761 - RNA, 21 nt, Salmonella typhimurium LT2
gccagccugaacaucuuccag

SEQ ID NO: 1840762 - RNA, 13 nt, Salmonella typhimurium LT2
gccagccugagga

SEQ ID NO: 1840763 - RNA, 14 nt, Salmonella typhimurium LT2
gccagcgccuuagg

SEQ ID NO: 1840764 - RNA, 18 nt, Salmonella typhimurium LT2
gccagcgccguuguccgu

SEQ ID NO: 1840765 - RNA, 14 nt, Salmonella typhimurium LT2
gccagcgccggcga

SEQ ID NO: 1840766 - RNA, 21 nt, Salmonella typhimurium LT2
gccagcgaccaccgucccagu

SEQ ID NO: 1840767 - RNA, 22 nt, Salmonella typhimurium LT2
gccagcgauccugcggcauuag

SEQ ID NO: 1840768 - RNA, 14 nt, Salmonella typhimurium LT2
gccagcgcauccac

SEQ ID NO: 1840769 - RNA, 15 nt, Salmonella typhimurium LT2
gccagcgccagcagc

SEQ ID NO: 1840770 - RNA, 16 nt, Salmonella typhimurium LT2
gccagcauuuuuccac

SEQ ID NO: 1840771 - RNA, 12 nt, Salmonella typhimurium LT2
gccagccaaagc

SEQ ID NO: 1840772 - RNA, 19 nt, Salmonella typhimurium LT2
gccagcauugauuuuucau

SEQ ID NO: 1840773 - RNA, 20 nt, Salmonella typhimurium LT2
gccagcaguuuuucaaucuu

SEQ ID NO: 1840774 - RNA, 21 nt, Salmonella typhimurium LT2
gccagcaucaugggcucauca

SEQ ID NO: 1840775 - RNA, 13 nt, Salmonella typhimurium LT2
gccagcauauaaa

SEQ ID NO: 1840776 - RNA, 16 nt, Salmonella typhimurium LT2
gccagcaucauggcau

SEQ ID NO: 1840777 - RNA, 23 nt, Salmonella typhimurium LT2
gccagccauggcccaaaagguag

SEQ ID NO: 1840778 - RNA, 19 nt, Salmonella typhimurium LT2
gccagccagucgccaggca

SEQ ID NO: 1840779 - RNA, 18 nt, Salmonella typhimurium LT2
gccagccaaauagcgcca

SEQ ID NO: 1840780 - RNA, 15 nt, Salmonella typhimurium LT2
gccagccagcgggcu

SEQ ID NO: 1840781 - RNA, 14 nt, Salmonella typhimurium LT2
gccagccagcgggc

SEQ ID NO: 1840782 - RNA, 20 nt, Salmonella typhimurium LT2
gccagcagcauaaaaccgcc

SEQ ID NO: 1840783 - RNA, 19 nt, Salmonella typhimurium LT2
gccagcagcucaacggcag

SEQ ID NO: 1840784 - RNA, 18 nt, Salmonella typhimurium LT2
gccagcuuaucgaccagc

SEQ ID NO: 1840785 - RNA, 23 nt, Salmonella typhimurium LT2
gccagcugaaacagaauaaacgg

SEQ ID NO: 1840786 - RNA, 18 nt, Salmonella typhimurium LT2
gccagcucgucggccagc

SEQ ID NO: 1840787 - RNA, 14 nt, Salmonella typhimurium LT2
gccagcucuuuucu

SEQ ID NO: 1840788 - RNA, 22 nt, Salmonella typhimurium LT2
gccaggccguugugucccugga

SEQ ID NO: 1840789 - RNA, 17 nt, Salmonella typhimurium LT2
gccaggccgcgccgcgc

SEQ ID NO: 1840790 - RNA, 16 nt, Salmonella typhimurium LT2
gccaggcccaugauca

SEQ ID NO: 1840791 - RNA, 15 nt, Salmonella typhimurium LT2
gccaggcacgccggc

SEQ ID NO: 1840792 - RNA, 24 nt, Salmonella typhimurium LT2
gccaggcauaccuccucucuuccu

SEQ ID NO: 1840793 - RNA, 15 nt, Salmonella typhimurium LT2
gccaggauaauaaug

SEQ ID NO: 1840794 - RNA, 17 nt, Salmonella typhimurium LT2
gccaggauaucuuccac

SEQ ID NO: 1840795 - RNA, 18 nt, Salmonella typhimurium LT2
gccaggauaucuuccacu

SEQ ID NO: 1840796 - RNA, 17 nt, Salmonella typhimurium LT2
gccaggaucgccgcugc

SEQ ID NO: 1840797 - RNA, 20 nt, Salmonella typhimurium LT2
gccagcgucucagcaggcgg

SEQ ID NO: 1840798 - RNA, 19 nt, Salmonella typhimurium LT2
gccagcguggaugaacuca

SEQ ID NO: 1840799 - RNA, 16 nt, Salmonella typhimurium LT2
gccagcgucgccaugc

SEQ ID NO: 1840800 - RNA, 22 nt, Salmonella typhimurium LT2
gccagcgguuucauauggguaa

SEQ ID NO: 1840801 - RNA, 21 nt, Salmonella typhimurium LT2
gccagcgggcuauaggccauc

SEQ ID NO: 1840802 - RNA, 14 nt, Salmonella typhimurium LT2
gccagcgggcugca

SEQ ID NO: 1840803 - RNA, 16 nt, Salmonella typhimurium LT2
gccagcuaauuuuacu

SEQ ID NO: 1840804 - RNA, 19 nt, Salmonella typhimurium LT2
gccagcguuagcacauugg

SEQ ID NO: 1840805 - RNA, 20 nt, Salmonella typhimurium LT2
gccagcucaaaucgcggcgc

SEQ ID NO: 1840806 - RNA, 15 nt, Salmonella typhimurium LT2
gccagcucaaaugac

SEQ ID NO: 1840807 - RNA, 18 nt, Salmonella typhimurium LT2
gccagcggaucgcgucca

SEQ ID NO: 1840808 - RNA, 21 nt, Salmonella typhimurium LT2
gccagcggcguuuuuuccugc

SEQ ID NO: 1840809 - RNA, 19 nt, Salmonella typhimurium LT2
gccagcgcugacaucaucc

SEQ ID NO: 1840810 - RNA, 14 nt, Salmonella typhimurium LT2
gccagcgcgggcga

SEQ ID NO: 1840811 - RNA, 16 nt, Salmonella typhimurium LT2
gcauuuucaaugucgc

SEQ ID NO: 1840812 - RNA, 15 nt, Salmonella typhimurium LT2
gcauuuucaaugucg

SEQ ID NO: 1840813 - RNA, 17 nt, Salmonella typhimurium LT2
gcauuuuaucuuuuguu

SEQ ID NO: 1840814 - RNA, 16 nt, Salmonella typhimurium LT2
gccaaacucuuccacc

SEQ ID NO: 1840815 - RNA, 21 nt, Salmonella typhimurium LT2
gccaaacucuuuuucaauaaa

SEQ ID NO: 1840816 - RNA, 14 nt, Salmonella typhimurium LT2
gcauuuaggucuug

SEQ ID NO: 1840817 - RNA, 19 nt, Salmonella typhimurium LT2
gcauuuaacggcuuacugc

SEQ ID NO: 1840818 - RNA, 16 nt, Salmonella typhimurium LT2
gcauuucaaucgccac

SEQ ID NO: 1840819 - RNA, 22 nt, Salmonella typhimurium LT2
gcauuucaaucgccaccacauu

SEQ ID NO: 1840820 - RNA, 12 nt, Salmonella typhimurium LT2
gcauuucuucaa

SEQ ID NO: 1840821 - RNA, 15 nt, Salmonella typhimurium LT2
gcauucaguuugcaa

SEQ ID NO: 1840822 - RNA, 22 nt, Salmonella typhimurium LT2
gcauucauaagcaaacaggggg

SEQ ID NO: 1840823 - RNA, 15 nt, Salmonella typhimurium LT2
gcauuaccagcaaua

SEQ ID NO: 1840824 - RNA, 20 nt, Salmonella typhimurium LT2
gcauuaccagcaauaacagg

SEQ ID NO: 1840825 - RNA, 14 nt, Salmonella typhimurium LT2
gcauuacgcuggcc

SEQ ID NO: 1840826 - RNA, 17 nt, Salmonella typhimurium LT2
gcauucgaauccuccug

SEQ ID NO: 1840827 - RNA, 16 nt, Salmonella typhimurium LT2
gcauucgcuccucagc

SEQ ID NO: 1840828 - RNA, 19 nt, Salmonella typhimurium LT2
gcauugaggcuacccagac

SEQ ID NO: 1840829 - RNA, 16 nt, Salmonella typhimurium LT2
gcauugcucaacugga

SEQ ID NO: 1840830 - RNA, 14 nt, Salmonella typhimurium LT2
gcauuggcaaugaa

SEQ ID NO: 1840831 - RNA, 15 nt, Salmonella typhimurium LT2
gcaugaucggcuggg

SEQ ID NO: 1840832 - RNA, 19 nt, Salmonella typhimurium LT2
gcaugauggcgaacagccc

SEQ ID NO: 1840833 - RNA, 15 nt, Salmonella typhimurium LT2
gcaucugggcugaca

SEQ ID NO: 1840834 - RNA, 20 nt, Salmonella typhimurium LT2
gcaucugggcugacaaaaau

SEQ ID NO: 1840835 - RNA, 21 nt, Salmonella typhimurium LT2
gcaucugggcugacaaaaauu

SEQ ID NO: 1840836 - RNA, 17 nt, Salmonella typhimurium LT2
gcaucuuacugaccggc

SEQ ID NO: 1840837 - RNA, 17 nt, Salmonella typhimurium LT2
gcaucuuuaaccgccug

SEQ ID NO: 1840838 - RNA, 21 nt, Salmonella typhimurium LT2
gcaugguuaacaauauugcgc

SEQ ID NO: 1840839 - RNA, 14 nt, Salmonella typhimurium LT2
gcauguaguaagcc

SEQ ID NO: 1840840 - RNA, 15 nt, Salmonella typhimurium LT2
gcauggagcaucagc

SEQ ID NO: 1840841 - RNA, 14 nt, Salmonella typhimurium LT2
gcauggaagaaaau

SEQ ID NO: 1840842 - RNA, 23 nt, Salmonella typhimurium LT2
gcauaauacggggccauuauuua

SEQ ID NO: 1840843 - RNA, 20 nt, Salmonella typhimurium LT2
gcauaauuguggaaauaaga

SEQ ID NO: 1840844 - RNA, 17 nt, Salmonella typhimurium LT2
gcauagaauuucagggu

SEQ ID NO: 1840845 - RNA, 16 nt, Salmonella typhimurium LT2
gcauagacgugcggca

SEQ ID NO: 1840846 - RNA, 16 nt, Salmonella typhimurium LT2
gcauagccccagcgca

SEQ ID NO: 1840847 - RNA, 19 nt, Salmonella typhimurium LT2
gcauagcgucaucaacaua

SEQ ID NO: 1840848 - RNA, 13 nt, Salmonella typhimurium LT2
gcauaucgcccug

SEQ ID NO: 1840849 - RNA, 14 nt, Salmonella typhimurium LT2
gcauaggccccggu

SEQ ID NO: 1840850 - RNA, 16 nt, Salmonella typhimurium LT2
gcaucaaacuuuuaaa

SEQ ID NO: 1840851 - RNA, 23 nt, Salmonella typhimurium LT2
gcauaucuggcgaggcuuugucc

SEQ ID NO: 1840852 - RNA, 23 nt, Salmonella typhimurium LT2
gcauaucuuacggaaaaaugucg

SEQ ID NO: 1840853 - RNA, 22 nt, Salmonella typhimurium LT2
gcauauucauaucgaagcccag

SEQ ID NO: 1840854 - RNA, 18 nt, Salmonella typhimurium LT2
gcauauucuggcggcggg

SEQ ID NO: 1840855 - RNA, 14 nt, Salmonella typhimurium LT2
gcaucauccccacc

SEQ ID NO: 1840856 - RNA, 13 nt, Salmonella typhimurium LT2
gcaucaacgccag

SEQ ID NO: 1840857 - RNA, 14 nt, Salmonella typhimurium LT2
gcaucgugagcgcg

SEQ ID NO: 1840858 - RNA, 17 nt, Salmonella typhimurium LT2
gcaucgcccgcccccaa

SEQ ID NO: 1840859 - RNA, 19 nt, Salmonella typhimurium LT2
gcaucgcccugccagugaa

SEQ ID NO: 1840860 - RNA, 22 nt, Salmonella typhimurium LT2
gcaucguuugcaguuccgcaau

SEQ ID NO: 1840861 - RNA, 21 nt, Salmonella typhimurium LT2
gcaucugaccuacaaucgucu

SEQ ID NO: 1840862 - RNA, 15 nt, Salmonella typhimurium LT2
gcaucuaauuaaaaa

SEQ ID NO: 1840863 - RNA, 13 nt, Salmonella typhimurium LT2
gcauccucuuucc

SEQ ID NO: 1840864 - RNA, 18 nt, Salmonella typhimurium LT2
gcauccuccauccaggua

SEQ ID NO: 1840865 - RNA, 21 nt, Salmonella typhimurium LT2
gcauccuuuacuauagauauu

SEQ ID NO: 1840866 - RNA, 23 nt, Salmonella typhimurium LT2
gcauccuguggguucaucgccac

SEQ ID NO: 1840867 - RNA, 20 nt, Salmonella typhimurium LT2
gcaucaucuaccuucacaca

SEQ ID NO: 1840868 - RNA, 17 nt, Salmonella typhimurium LT2
gcaucaucucccaggcc

SEQ ID NO: 1840869 - RNA, 15 nt, Salmonella typhimurium LT2
gcaucauucugcagg

SEQ ID NO: 1840870 - RNA, 15 nt, Salmonella typhimurium LT2
gcaucauucaucucg

SEQ ID NO: 1840871 - RNA, 22 nt, Salmonella typhimurium LT2
gcaucaugggcucaucaaacag

SEQ ID NO: 1840872 - RNA, 22 nt, Salmonella typhimurium LT2
gcaucauuuucuuucaucaaac

SEQ ID NO: 1840873 - RNA, 13 nt, Salmonella typhimurium LT2
gcauccagcucau

SEQ ID NO: 1840874 - RNA, 16 nt, Salmonella typhimurium LT2
gcauccaccgcggagu

SEQ ID NO: 1840875 - RNA, 23 nt, Salmonella typhimurium LT2
gcagcguuugacggauuuuuuuc

SEQ ID NO: 1840876 - RNA, 18 nt, Salmonella typhimurium LT2
gcagcuccacaaauagca

SEQ ID NO: 1840877 - RNA, 22 nt, Salmonella typhimurium LT2
gcagcugcuguaugauuucacc

SEQ ID NO: 1840878 - RNA, 19 nt, Salmonella typhimurium LT2
gcagcuccccgccgcggcg

SEQ ID NO: 1840879 - RNA, 16 nt, Salmonella typhimurium LT2
gcagcugccacaccac

SEQ ID NO: 1840880 - RNA, 19 nt, Salmonella typhimurium LT2
gcaaccgacgggcgcuggu

SEQ ID NO: 1840881 - RNA, 15 nt, Salmonella typhimurium LT2
gcaacccuuuuucaa

SEQ ID NO: 1840882 - RNA, 13 nt, Salmonella typhimurium LT2
gcagcgguccaaa

SEQ ID NO: 1840883 - RNA, 19 nt, Salmonella typhimurium LT2
gcagcguaauacaggcgau

SEQ ID NO: 1840884 - RNA, 19 nt, Salmonella typhimurium LT2
gcagcuucaggauccaggu

SEQ ID NO: 1840885 - RNA, 19 nt, Salmonella typhimurium LT2
gcaggaaauccagcagaau

SEQ ID NO: 1840886 - RNA, 18 nt, Salmonella typhimurium LT2
gcaggauccccaucccaa

SEQ ID NO: 1840887 - RNA, 20 nt, Salmonella typhimurium LT2
gcaggcgaaaucaaaaggcg

SEQ ID NO: 1840888 - RNA, 21 nt, Salmonella typhimurium LT2
gcaggcgauagccccaguaaa

SEQ ID NO: 1840889 - RNA, 18 nt, Salmonella typhimurium LT2
gcaggcgauagccccagu

SEQ ID NO: 1840890 - RNA, 19 nt, Salmonella typhimurium LT2
gcaggccuaacacaugcaa

SEQ ID NO: 1840891 - RNA, 13 nt, Salmonella typhimurium LT2
gcaggcguuucaa

SEQ ID NO: 1840892 - RNA, 20 nt, Salmonella typhimurium LT2
gcaggcuaacgcgccccagg

SEQ ID NO: 1840893 - RNA, 20 nt, Salmonella typhimurium LT2
gcaggcuaugcucccccccu

SEQ ID NO: 1840894 - RNA, 16 nt, Salmonella typhimurium LT2
gcaggcucuuuuucuc

SEQ ID NO: 1840895 - RNA, 22 nt, Salmonella typhimurium LT2
gcaggcgucauagccgcgcguc

SEQ ID NO: 1840896 - RNA, 12 nt, Salmonella typhimurium LT2
gcaggcgccgcc

SEQ ID NO: 1840897 - RNA, 14 nt, Salmonella typhimurium LT2
gcagggccacaacg

SEQ ID NO: 1840898 - RNA, 17 nt, Salmonella typhimurium LT2
gcagugccgguugccug

SEQ ID NO: 1840899 - RNA, 20 nt, Salmonella typhimurium LT2
gcaguggcauguucccaugu

SEQ ID NO: 1840900 - RNA, 13 nt, Salmonella typhimurium LT2
gcaguggcggcua

SEQ ID NO: 1840901 - RNA, 17 nt, Salmonella typhimurium LT2
gcaguguaucgaagauc

SEQ ID NO: 1840902 - RNA, 12 nt, Salmonella typhimurium LT2
gcaguucaauau

SEQ ID NO: 1840903 - RNA, 19 nt, Salmonella typhimurium LT2
gcagugugcuccuggcgca

SEQ ID NO: 1840904 - RNA, 17 nt, Salmonella typhimurium LT2
gcauaaauuggcucaga

SEQ ID NO: 1840905 - RNA, 13 nt, Salmonella typhimurium LT2
gcauaaauauccg

SEQ ID NO: 1840906 - RNA, 14 nt, Salmonella typhimurium LT2
gcauaaaaaagagg

SEQ ID NO: 1840907 - RNA, 19 nt, Salmonella typhimurium LT2
gcauaaaaaaugagaaagg

SEQ ID NO: 1840908 - RNA, 17 nt, Salmonella typhimurium LT2
gcauaaaaccgccgccc

SEQ ID NO: 1840909 - RNA, 23 nt, Salmonella typhimurium LT2
gcauaaacgccuuauccggccug

SEQ ID NO: 1840910 - RNA, 14 nt, Salmonella typhimurium LT2
gcaguuuaaagcca

SEQ ID NO: 1840911 - RNA, 22 nt, Salmonella typhimurium LT2
gcaguugaaaacauugucggug

SEQ ID NO: 1840912 - RNA, 17 nt, Salmonella typhimurium LT2
gcaguugauacauuuuu

SEQ ID NO: 1840913 - RNA, 17 nt, Salmonella typhimurium LT2
gcaguugccaggccgca

SEQ ID NO: 1840914 - RNA, 20 nt, Salmonella typhimurium LT2
gcaguauugcaccaggaaga

SEQ ID NO: 1840915 - RNA, 22 nt, Salmonella typhimurium LT2
gcagucaaaacgacauaaccgg

SEQ ID NO: 1840916 - RNA, 17 nt, Salmonella typhimurium LT2
gcaguaacgccccacga

SEQ ID NO: 1840917 - RNA, 17 nt, Salmonella typhimurium LT2
gcaguaaaaagaaagcu

SEQ ID NO: 1840918 - RNA, 20 nt, Salmonella typhimurium LT2
gcagguuuuacuucuucagg

SEQ ID NO: 1840919 - RNA, 20 nt, Salmonella typhimurium LT2
gcaggggcucuaaaaaggaa

SEQ ID NO: 1840920 - RNA, 12 nt, Salmonella typhimurium LT2
gcagggcugcug

SEQ ID NO: 1840921 - RNA, 17 nt, Salmonella typhimurium LT2
gcagucgcuacaaccag

SEQ ID NO: 1840922 - RNA, 21 nt, Salmonella typhimurium LT2
gcagucagccuugaccgccug

SEQ ID NO: 1840923 - RNA, 12 nt, Salmonella typhimurium LT2
gcagugauuuua

SEQ ID NO: 1840924 - RNA, 17 nt, Salmonella typhimurium LT2
gcagugagauugacaga

SEQ ID NO: 1840925 - RNA, 21 nt, Salmonella typhimurium LT2
gcagugagauugacagaauaa

SEQ ID NO: 1840926 - RNA, 16 nt, Salmonella typhimurium LT2
gcagugacauuuaucu

SEQ ID NO: 1840927 - RNA, 15 nt, Salmonella typhimurium LT2
gcagugacagaggaa

SEQ ID NO: 1840928 - RNA, 17 nt, Salmonella typhimurium LT2
gcgcuggaucagauucc

SEQ ID NO: 1840929 - RNA, 13 nt, Salmonella typhimurium LT2
gcgcugcgcucuu

SEQ ID NO: 1840930 - RNA, 22 nt, Salmonella typhimurium LT2
gcgcugcgguuuacgccaugca

SEQ ID NO: 1840931 - RNA, 21 nt, Salmonella typhimurium LT2
gcgcugauuuucuccagcaga

SEQ ID NO: 1840932 - RNA, 16 nt, Salmonella typhimurium LT2
gcgcugcaaaaugaug

SEQ ID NO: 1840933 - RNA, 23 nt, Salmonella typhimurium LT2
gcgcugccgucaaugccgggcag

SEQ ID NO: 1840934 - RNA, 14 nt, Salmonella typhimurium LT2
gcgcugcgccgcaa

SEQ ID NO: 1840935 - RNA, 24 nt, Salmonella typhimurium LT2
gcgcucgcucaucacaucgcgcag

SEQ ID NO: 1840936 - RNA, 16 nt, Salmonella typhimurium LT2
gcgcucggcagcagcg

SEQ ID NO: 1840937 - RNA, 10 nt, Salmonella typhimurium LT2
gcgcggcgga

SEQ ID NO: 1840938 - RNA, 15 nt, Salmonella typhimurium LT2
gcgcucgcauugcuc

SEQ ID NO: 1840939 - RNA, 14 nt, Salmonella typhimurium LT2
gcgcugaucgccac

SEQ ID NO: 1840940 - RNA, 17 nt, Salmonella typhimurium LT2
gcgcucuucgcuccagu

SEQ ID NO: 1840941 - RNA, 19 nt, Salmonella typhimurium LT2
gcgcucuaucaccgcccgc

SEQ ID NO: 1840942 - RNA, 17 nt, Salmonella typhimurium LT2
gcgcucguaggccagcg

SEQ ID NO: 1840943 - RNA, 23 nt, Salmonella typhimurium LT2
gcggaacgucuuuuuccagcagc

SEQ ID NO: 1840944 - RNA, 16 nt, Salmonella typhimurium LT2
gcggaacucaucauca

SEQ ID NO: 1840945 - RNA, 20 nt, Salmonella typhimurium LT2
gcggaaaggacguucuucuc

SEQ ID NO: 1840946 - RNA, 21 nt, Salmonella typhimurium LT2
gcggaaaggacguucuucucc

SEQ ID NO: 1840947 - RNA, 13 nt, Salmonella typhimurium LT2
gcggaaccauuuu

SEQ ID NO: 1840948 - RNA, 21 nt, Salmonella typhimurium LT2
gcggaacaucgcuuuuugcag

SEQ ID NO: 1840949 - RNA, 20 nt, Salmonella typhimurium LT2
gcgcuuaucgggcagacugu

SEQ ID NO: 1840950 - RNA, 15 nt, Salmonella typhimurium LT2
gcgcugugcggcgug

SEQ ID NO: 1840951 - RNA, 16 nt, Salmonella typhimurium LT2
gcgcugucgccacgca

SEQ ID NO: 1840952 - RNA, 19 nt, Salmonella typhimurium LT2
gcgcugucgccaucaccag

SEQ ID NO: 1840953 - RNA, 13 nt, Salmonella typhimurium LT2
gcgcuuacacaga

SEQ ID NO: 1840954 - RNA, 20 nt, Salmonella typhimurium LT2
gcgcuggggugcgccgcagc

SEQ ID NO: 1840955 - RNA, 15 nt, Salmonella typhimurium LT2
gcgcugucagcacaa

SEQ ID NO: 1840956 - RNA, 21 nt, Salmonella typhimurium LT2
gcgcuggugggacuguucagc

SEQ ID NO: 1840957 - RNA, 18 nt, Salmonella typhimurium LT2
gcgcuggugacaucgccg

SEQ ID NO: 1840958 - RNA, 14 nt, Salmonella typhimurium LT2
gcgcuggcgagcga

SEQ ID NO: 1840959 - RNA, 15 nt, Salmonella typhimurium LT2
gcgcuggcgcgccug

SEQ ID NO: 1840960 - RNA, 22 nt, Salmonella typhimurium LT2
gcgcuggcuguucguaggcugg

SEQ ID NO: 1840961 - RNA, 16 nt, Salmonella typhimurium LT2
gcggcaaagauaaucu

SEQ ID NO: 1840962 - RNA, 13 nt, Salmonella typhimurium LT2
gcggcaacacauc

SEQ ID NO: 1840963 - RNA, 15 nt, Salmonella typhimurium LT2
gcggcaggaucccca

SEQ ID NO: 1840964 - RNA, 15 nt, Salmonella typhimurium LT2
gcggaaguagagaac

SEQ ID NO: 1840965 - RNA, 19 nt, Salmonella typhimurium LT2
gcggacguagcggcgccgg

SEQ ID NO: 1840966 - RNA, 15 nt, Salmonella typhimurium LT2
gcggaucggcgcaga

SEQ ID NO: 1840967 - RNA, 22 nt, Salmonella typhimurium LT2
gcggaucgccaucgacagcagc

SEQ ID NO: 1840968 - RNA, 18 nt, Salmonella typhimurium LT2
gcggccaaagggagcaga

SEQ ID NO: 1840969 - RNA, 13 nt, Salmonella typhimurium LT2
gcggccaaaggga

SEQ ID NO: 1840970 - RNA, 22 nt, Salmonella typhimurium LT2
gcggcaucccuuucauuuuucc

SEQ ID NO: 1840971 - RNA, 17 nt, Salmonella typhimurium LT2
gcggcaucguagucagg

SEQ ID NO: 1840972 - RNA, 15 nt, Salmonella typhimurium LT2
gcggcauggucugaa

SEQ ID NO: 1840973 - RNA, 17 nt, Salmonella typhimurium LT2
gcggcauguaaagcgcc

SEQ ID NO: 1840974 - RNA, 16 nt, Salmonella typhimurium LT2
gcggcauuaaaaaaaa

SEQ ID NO: 1840975 - RNA, 20 nt, Salmonella typhimurium LT2
gcggcccauucaacgggcga

SEQ ID NO: 1840976 - RNA, 22 nt, Salmonella typhimurium LT2
gcggcuugaguuuuccgccauu

SEQ ID NO: 1840977 - RNA, 13 nt, Salmonella typhimurium LT2
gcggcuuuuucau

SEQ ID NO: 1840978 - RNA, 16 nt, Salmonella typhimurium LT2
gcggcugacacucauc

SEQ ID NO: 1840979 - RNA, 16 nt, Salmonella typhimurium LT2
gcggcugcgccugugg

SEQ ID NO: 1840980 - RNA, 20 nt, Salmonella typhimurium LT2
gcgggcgauagagaccgcuu

SEQ ID NO: 1840981 - RNA, 13 nt, Salmonella typhimurium LT2
gcgggagcuguuc

SEQ ID NO: 1840982 - RNA, 19 nt, Salmonella typhimurium LT2
gcggggauaaucagcagcg

SEQ ID NO: 1840983 - RNA, 17 nt, Salmonella typhimurium LT2
gcggggauaaucagcag

SEQ ID NO: 1840984 - RNA, 14 nt, Salmonella typhimurium LT2
gcggggaacacaau

SEQ ID NO: 1840985 - RNA, 21 nt, Salmonella typhimurium LT2
gcgggcuuuuuuugcccgcuc

SEQ ID NO: 1840986 - RNA, 14 nt, Salmonella typhimurium LT2
gcgguaacaggcac

SEQ ID NO: 1840987 - RNA, 21 nt, Salmonella typhimurium LT2
gcgguaacguaacuggauucc

SEQ ID NO: 1840988 - RNA, 14 nt, Salmonella typhimurium LT2
gcgguaagcuguuc

SEQ ID NO: 1840989 - RNA, 16 nt, Salmonella typhimurium LT2
gcgguaaggcaccggu

SEQ ID NO: 1840990 - RNA, 14 nt, Salmonella typhimurium LT2
gcgggugaugacgc

SEQ ID NO: 1840991 - RNA, 21 nt, Salmonella typhimurium LT2
gcgggugacgcuggcggagag

SEQ ID NO: 1840992 - RNA, 18 nt, Salmonella typhimurium LT2
gcgggucaggaaacuggc

SEQ ID NO: 1840993 - RNA, 20 nt, Salmonella typhimurium LT2
gcggcggacaacgcuccagc

SEQ ID NO: 1840994 - RNA, 16 nt, Salmonella typhimurium LT2
gcggccgccgcugguc

SEQ ID NO: 1840995 - RNA, 16 nt, Salmonella typhimurium LT2
gcggcguagccgccga

SEQ ID NO: 1840996 - RNA, 20 nt, Salmonella typhimurium LT2
gcggcguacugcaacgcgca

SEQ ID NO: 1840997 - RNA, 20 nt, Salmonella typhimurium LT2
gcggcguaucauagcggcua

SEQ ID NO: 1840998 - RNA, 15 nt, Salmonella typhimurium LT2
gcggcguucccgcag

SEQ ID NO: 1840999 - RNA, 14 nt, Salmonella typhimurium LT2
gcggcucaccagcu

SEQ ID NO: 1841000 - RNA, 13 nt, Salmonella typhimurium LT2
gcggcucaggaag

SEQ ID NO: 1841001 - RNA, 19 nt, Salmonella typhimurium LT2
gcggcuacgccugauaagc

SEQ ID NO: 1841002 - RNA, 16 nt, Salmonella typhimurium LT2
gcggcggguaaauaga

SEQ ID NO: 1841003 - RNA, 21 nt, Salmonella typhimurium LT2
gcggcggggauaaucagcagc

SEQ ID NO: 1841004 - RNA, 19 nt, Salmonella typhimurium LT2
gcggcggguuaauggcagc

SEQ ID NO: 1841005 - RNA, 21 nt, Salmonella typhimurium LT2
gcggcgguuauccgccagcgc

SEQ ID NO: 1841006 - RNA, 16 nt, Salmonella typhimurium LT2
gcggcgguucauccug

SEQ ID NO: 1841007 - RNA, 19 nt, Salmonella typhimurium LT2
gcggcgguuauccgccagc

SEQ ID NO: 1841008 - RNA, 22 nt, Salmonella typhimurium LT2
gcggcguaaacacguuaucuga

SEQ ID NO: 1841009 - RNA, 17 nt, Salmonella typhimurium LT2
gcggcguaccgcgcgcc

SEQ ID NO: 1841010 - RNA, 21 nt, Salmonella typhimurium LT2
gcggcguaaaagcgauaaaga

SEQ ID NO: 1841011 - RNA, 18 nt, Salmonella typhimurium LT2
gcgcgacgguaaggcuau

SEQ ID NO: 1841012 - RNA, 16 nt, Salmonella typhimurium LT2
gcgcgacgccaaaccc

SEQ ID NO: 1841013 - RNA, 20 nt, Salmonella typhimurium LT2
gcgcgaucucuuuggccagu

SEQ ID NO: 1841014 - RNA, 19 nt, Salmonella typhimurium LT2
gcgcgccaauggccgcccc

SEQ ID NO: 1841015 - RNA, 14 nt, Salmonella typhimurium LT2
gcgcgccagcucuu

SEQ ID NO: 1841016 - RNA, 16 nt, Salmonella typhimurium LT2
gcgcgccagcggacuc

SEQ ID NO: 1841017 - RNA, 19 nt, Salmonella typhimurium LT2
gcgcgcaucgggccguccg

SEQ ID NO: 1841018 - RNA, 19 nt, Salmonella typhimurium LT2
gcgccuuuaauuccgccgg

SEQ ID NO: 1841019 - RNA, 21 nt, Salmonella typhimurium LT2
gcgccuuguuuucaucugcug

SEQ ID NO: 1841020 - RNA, 18 nt, Salmonella typhimurium LT2
gcgccuuuuggcagcagc

SEQ ID NO: 1841021 - RNA, 15 nt, Salmonella typhimurium LT2
gcgcgaaagcgccuu

SEQ ID NO: 1841022 - RNA, 17 nt, Salmonella typhimurium LT2
gcgccuuaaaaagaaca

SEQ ID NO: 1841023 - RNA, 13 nt, Salmonella typhimurium LT2
gcgccuuauccag

SEQ ID NO: 1841024 - RNA, 20 nt, Salmonella typhimurium LT2
gcgccuugcgauaacccgcu

SEQ ID NO: 1841025 - RNA, 13 nt, Salmonella typhimurium LT2
gcgcgccgcagcg

SEQ ID NO: 1841026 - RNA, 12 nt, Salmonella typhimurium LT2
gcgcgccgccuc

SEQ ID NO: 1841027 - RNA, 21 nt, Salmonella typhimurium LT2
gcgcgcggauauggcggcggc

SEQ ID NO: 1841028 - RNA, 16 nt, Salmonella typhimurium LT2
gcgcgcugagcggcuc

SEQ ID NO: 1841029 - RNA, 14 nt, Salmonella typhimurium LT2
gcgcgcgcaaagcg

SEQ ID NO: 1841030 - RNA, 13 nt, Salmonella typhimurium LT2
gcgcgcuggcaag

SEQ ID NO: 1841031 - RNA, 19 nt, Salmonella typhimurium LT2
gcgcgcuucguuuuccgca

SEQ ID NO: 1841032 - RNA, 18 nt, Salmonella typhimurium LT2
gcgcgcuuucaccgccuc

SEQ ID NO: 1841033 - RNA, 23 nt, Salmonella typhimurium LT2
gcgcggcacacaacacggcggcu

SEQ ID NO: 1841034 - RNA, 14 nt, Salmonella typhimurium LT2
gcgcggcagcgcgc

SEQ ID NO: 1841035 - RNA, 16 nt, Salmonella typhimurium LT2
gcgcggcagcgcgcac

SEQ ID NO: 1841036 - RNA, 13 nt, Salmonella typhimurium LT2
gcgcggcaggccg

SEQ ID NO: 1841037 - RNA, 18 nt, Salmonella typhimurium LT2
gcgccugcugccagccgc

SEQ ID NO: 1841038 - RNA, 14 nt, Salmonella typhimurium LT2
gcgccugcucccgc

SEQ ID NO: 1841039 - RNA, 16 nt, Salmonella typhimurium LT2
gcgccuguuagggcgc

SEQ ID NO: 1841040 - RNA, 20 nt, Salmonella typhimurium LT2
gcgccugugcuuucgccacc

SEQ ID NO: 1841041 - RNA, 23 nt, Salmonella typhimurium LT2
gcgccugugcuuucgccaccagc

SEQ ID NO: 1841042 - RNA, 17 nt, Salmonella typhimurium LT2
gcgccugcauacucaca

SEQ ID NO: 1841043 - RNA, 20 nt, Salmonella typhimurium LT2
gcgccugcaugucuucaugu

SEQ ID NO: 1841044 - RNA, 18 nt, Salmonella typhimurium LT2
gcgccugcauacucacau

SEQ ID NO: 1841045 - RNA, 14 nt, Salmonella typhimurium LT2
gcgccugcgcugca

SEQ ID NO: 1841046 - RNA, 21 nt, Salmonella typhimurium LT2
gcgccugacgcggacgccacc

SEQ ID NO: 1841047 - RNA, 11 nt, Salmonella typhimurium LT2
gcgccugaaua

SEQ ID NO: 1841048 - RNA, 17 nt, Salmonella typhimurium LT2
gcgccgugcccagcauc

SEQ ID NO: 1841049 - RNA, 15 nt, Salmonella typhimurium LT2
gcgccuccggccugc

SEQ ID NO: 1841050 - RNA, 17 nt, Salmonella typhimurium LT2
gcgccuccccugccggc

SEQ ID NO: 1841051 - RNA, 12 nt, Salmonella typhimurium LT2
gcgccucagcca

SEQ ID NO: 1841052 - RNA, 14 nt, Salmonella typhimurium LT2
gcgccucggcgccc

SEQ ID NO: 1841053 - RNA, 16 nt, Salmonella typhimurium LT2
gcgccuccgugguagu

SEQ ID NO: 1841054 - RNA, 13 nt, Salmonella typhimurium LT2
gcgccguaaacaa

SEQ ID NO: 1841055 - RNA, 13 nt, Salmonella typhimurium LT2
gcgccgucauccg

SEQ ID NO: 1841056 - RNA, 16 nt, Salmonella typhimurium LT2
gcgccggucgccagca

SEQ ID NO: 1841057 - RNA, 21 nt, Salmonella typhimurium LT2
gcgccgggaaaaucagugaac

SEQ ID NO: 1841058 - RNA, 12 nt, Salmonella typhimurium LT2
gcgccgccgccu

SEQ ID NO: 1841059 - RNA, 14 nt, Salmonella typhimurium LT2
gcgccgccgccaac

SEQ ID NO: 1841060 - RNA, 19 nt, Salmonella typhimurium LT2
gcgccgcgccaccgggccg

SEQ ID NO: 1841061 - RNA, 13 nt, Salmonella typhimurium LT2
gcgccgcgcacgc

SEQ ID NO: 1841062 - RNA, 14 nt, Salmonella typhimurium LT2
gcgccgcgccgccc

SEQ ID NO: 1841063 - RNA, 21 nt, Salmonella typhimurium LT2
gcgccgcucaucaccagcagc

SEQ ID NO: 1841064 - RNA, 16 nt, Salmonella typhimurium LT2
gcgccggacgccacgc

SEQ ID NO: 1841065 - RNA, 15 nt, Salmonella typhimurium LT2
gcgccgcuuccggca

SEQ ID NO: 1841066 - RNA, 11 nt, Salmonella typhimurium LT2
gcgccgcuucc

SEQ ID NO: 1841067 - RNA, 16 nt, Salmonella typhimurium LT2
gcgccgcugagaaaaa

SEQ ID NO: 1841068 - RNA, 20 nt, Salmonella typhimurium LT2
gcgccgauaacacggcuggc

SEQ ID NO: 1841069 - RNA, 20 nt, Salmonella typhimurium LT2
gcgccgacauagcugaacaa

SEQ ID NO: 1841070 - RNA, 16 nt, Salmonella typhimurium LT2
gcgccgacaucgccac

SEQ ID NO: 1841071 - RNA, 13 nt, Salmonella typhimurium LT2
gcgcccuccucca

SEQ ID NO: 1841072 - RNA, 16 nt, Salmonella typhimurium LT2
gcgccgaagcugacca

SEQ ID NO: 1841073 - RNA, 16 nt, Salmonella typhimurium LT2
gcgccauccggcacac

SEQ ID NO: 1841074 - RNA, 14 nt, Salmonella typhimurium LT2
gcgccauccggcag

SEQ ID NO: 1841075 - RNA, 22 nt, Salmonella typhimurium LT2
gcgccaucccaugcaccagccc

SEQ ID NO: 1841076 - RNA, 13 nt, Salmonella typhimurium LT2
gcgccaucaggcc

SEQ ID NO: 1841077 - RNA, 12 nt, Salmonella typhimurium LT2
gcgccauaaaaa

SEQ ID NO: 1841078 - RNA, 17 nt, Salmonella typhimurium LT2
gcgccaucuccuccuca

SEQ ID NO: 1841079 - RNA, 14 nt, Salmonella typhimurium LT2
gcgccaucuccucc

SEQ ID NO: 1841080 - RNA, 19 nt, Salmonella typhimurium LT2
gcgccauuccugccgccgc

SEQ ID NO: 1841081 - RNA, 18 nt, Salmonella typhimurium LT2
gcgccauuaacgcgguga

SEQ ID NO: 1841082 - RNA, 19 nt, Salmonella typhimurium LT2
gcgccauguucauaaagug

SEQ ID NO: 1841083 - RNA, 22 nt, Salmonella typhimurium LT2
gcgccauguucauaaagugcca

SEQ ID NO: 1841084 - RNA, 13 nt, Salmonella typhimurium LT2
gcgccaggaaacu

SEQ ID NO: 1841085 - RNA, 22 nt, Salmonella typhimurium LT2
gcgccaggaagguauuaaguga

SEQ ID NO: 1841086 - RNA, 22 nt, Salmonella typhimurium LT2
gcgccagcuccauagaaaucag

SEQ ID NO: 1841087 - RNA, 19 nt, Salmonella typhimurium LT2
gcgccaguccggucgacac

SEQ ID NO: 1841088 - RNA, 20 nt, Salmonella typhimurium LT2
gcgccaguaaugccgugccg

SEQ ID NO: 1841089 - RNA, 21 nt, Salmonella typhimurium LT2
gcgccaguuuuuccuguuccu

SEQ ID NO: 1841090 - RNA, 20 nt, Salmonella typhimurium LT2
gcgcccgacgcgccacuucc

SEQ ID NO: 1841091 - RNA, 14 nt, Salmonella typhimurium LT2
gcgccccggcggcg

SEQ ID NO: 1841092 - RNA, 12 nt, Salmonella typhimurium LT2
gcgcccagcgcc

SEQ ID NO: 1841093 - RNA, 19 nt, Salmonella typhimurium LT2
gcgcccgcgaucgcuucca

SEQ ID NO: 1841094 - RNA, 14 nt, Salmonella typhimurium LT2
gcgcccgcgcgcca

SEQ ID NO: 1841095 - RNA, 19 nt, Salmonella typhimurium LT2
gcgcccgaucguccgccuc

SEQ ID NO: 1841096 - RNA, 16 nt, Salmonella typhimurium LT2
gcgcccguccaugagu

SEQ ID NO: 1841097 - RNA, 13 nt, Salmonella typhimurium LT2
gcgagaccauauu

SEQ ID NO: 1841098 - RNA, 16 nt, Salmonella typhimurium LT2
gcgacucggugccgcu

SEQ ID NO: 1841099 - RNA, 11 nt, Salmonella typhimurium LT2
gcgagaaaaaa

SEQ ID NO: 1841100 - RNA, 13 nt, Salmonella typhimurium LT2
gcgacucauccac

SEQ ID NO: 1841101 - RNA, 20 nt, Salmonella typhimurium LT2
gcgacuaucccucugaagcg

SEQ ID NO: 1841102 - RNA, 22 nt, Salmonella typhimurium LT2
gcgacuaucccucugaagcgcu

SEQ ID NO: 1841103 - RNA, 23 nt, Salmonella typhimurium LT2
gcgacuacgguaaaccaggccag

SEQ ID NO: 1841104 - RNA, 11 nt, Salmonella typhimurium LT2
gcgagcccugu

SEQ ID NO: 1841105 - RNA, 23 nt, Salmonella typhimurium LT2
gcgagagaauuaacagcgcgacc

SEQ ID NO: 1841106 - RNA, 16 nt, Salmonella typhimurium LT2
gcgaagugcagcguuu

SEQ ID NO: 1841107 - RNA, 18 nt, Salmonella typhimurium LT2
gcgaagcucagccaggcg

SEQ ID NO: 1841108 - RNA, 19 nt, Salmonella typhimurium LT2
gcgaagcucagccaggcgc

SEQ ID NO: 1841109 - RNA, 14 nt, Salmonella typhimurium LT2
gcgaauaaacacau

SEQ ID NO: 1841110 - RNA, 16 nt, Salmonella typhimurium LT2
gcgaauaaucccggcg

SEQ ID NO: 1841111 - RNA, 16 nt, Salmonella typhimurium LT2
gcgacggacucgcgca

SEQ ID NO: 1841112 - RNA, 23 nt, Salmonella typhimurium LT2
gcgacggcaucggcaucuuccuu

SEQ ID NO: 1841113 - RNA, 14 nt, Salmonella typhimurium LT2
gcgauaaaccagcc

SEQ ID NO: 1841114 - RNA, 13 nt, Salmonella typhimurium LT2
gcgauaaaccagc

SEQ ID NO: 1841115 - RNA, 21 nt, Salmonella typhimurium LT2
gcgauauccacaauguugaug

SEQ ID NO: 1841116 - RNA, 19 nt, Salmonella typhimurium LT2
gcgauaaccgccgccgcgc

SEQ ID NO: 1841117 - RNA, 17 nt, Salmonella typhimurium LT2
gcgauaaccgccgccgc

SEQ ID NO: 1841118 - RNA, 20 nt, Salmonella typhimurium LT2
gcgagcugccaguucauucc

SEQ ID NO: 1841119 - RNA, 22 nt, Salmonella typhimurium LT2
gcgaggaacaucagccagcagc

SEQ ID NO: 1841120 - RNA, 16 nt, Salmonella typhimurium LT2
gcgagcuucucgccgg

SEQ ID NO: 1841121 - RNA, 17 nt, Salmonella typhimurium LT2
gcgaguuaagcgcccgc

SEQ ID NO: 1841122 - RNA, 23 nt, Salmonella typhimurium LT2
gcgaucgcgauucgcccacggau

SEQ ID NO: 1841123 - RNA, 23 nt, Salmonella typhimurium LT2
gcgauauuucuccgcccauccag

SEQ ID NO: 1841124 - RNA, 21 nt, Salmonella typhimurium LT2
gcgaucaccagcaccgccagc

SEQ ID NO: 1841125 - RNA, 14 nt, Salmonella typhimurium LT2
gcgaucucuuuauc

SEQ ID NO: 1841126 - RNA, 17 nt, Salmonella typhimurium LT2
gcgaucucuuuggccag

SEQ ID NO: 1841127 - RNA, 16 nt, Salmonella typhimurium LT2
gcgaucgucggugccu

SEQ ID NO: 1841128 - RNA, 23 nt, Salmonella typhimurium LT2
gcgaucuuuuguuuaccccaggc

SEQ ID NO: 1841129 - RNA, 21 nt, Salmonella typhimurium LT2
gcgaugaccaucaaauaauac

SEQ ID NO: 1841130 - RNA, 22 nt, Salmonella typhimurium LT2
gcgaugacgucacgaagauaug

SEQ ID NO: 1841131 - RNA, 14 nt, Salmonella typhimurium LT2
gcgaugagcgccag

SEQ ID NO: 1841132 - RNA, 23 nt, Salmonella typhimurium LT2
gcgaugaguaaaauuuuuuucau

SEQ ID NO: 1841133 - RNA, 14 nt, Salmonella typhimurium LT2
gcgaugauaguguc

SEQ ID NO: 1841134 - RNA, 23 nt, Salmonella typhimurium LT2
gcgauggucuucuuucagguucc

SEQ ID NO: 1841135 - RNA, 14 nt, Salmonella typhimurium LT2
gcgauggcagaccg

SEQ ID NO: 1841136 - RNA, 21 nt, Salmonella typhimurium LT2
gcgauggcagaccgauaauaa

SEQ ID NO: 1841137 - RNA, 20 nt, Salmonella typhimurium LT2
gcgcaaacacggcugucggu

SEQ ID NO: 1841138 - RNA, 13 nt, Salmonella typhimurium LT2
gcgcaaaagcgcg

SEQ ID NO: 1841139 - RNA, 13 nt, Salmonella typhimurium LT2
gcgaugugcuggg

SEQ ID NO: 1841140 - RNA, 22 nt, Salmonella typhimurium LT2
gcgauguuuucccucgccccgg

SEQ ID NO: 1841141 - RNA, 16 nt, Salmonella typhimurium LT2
gcgauucgcccacgga

SEQ ID NO: 1841142 - RNA, 18 nt, Salmonella typhimurium LT2
gcgcaaggccguuaucca

SEQ ID NO: 1841143 - RNA, 22 nt, Salmonella typhimurium LT2
gcgcaaucgguaaaggucgccg

SEQ ID NO: 1841144 - RNA, 20 nt, Salmonella typhimurium LT2
gcgcaaucugcucgacgcgc

SEQ ID NO: 1841145 - RNA, 19 nt, Salmonella typhimurium LT2
gcgcaaucgggccugcucc

SEQ ID NO: 1841146 - RNA, 22 nt, Salmonella typhimurium LT2
gcgcaauaugcagaucgacggu

SEQ ID NO: 1841147 - RNA, 19 nt, Salmonella typhimurium LT2
gcgcaacgcuuaaucccuu

SEQ ID NO: 1841148 - RNA, 12 nt, Salmonella typhimurium LT2
gcgcaaccugcg

SEQ ID NO: 1841149 - RNA, 18 nt, Salmonella typhimurium LT2
gcgcaaaucgccaucagc

SEQ ID NO: 1841150 - RNA, 22 nt, Salmonella typhimurium LT2
gcgcaauuucauucaccaccgg

SEQ ID NO: 1841151 - RNA, 12 nt, Salmonella typhimurium LT2
gcgcacaagccu

SEQ ID NO: 1841152 - RNA, 13 nt, Salmonella typhimurium LT2
gcgcacccgcugg

SEQ ID NO: 1841153 - RNA, 16 nt, Salmonella typhimurium LT2
gcgcaccccggccacg

SEQ ID NO: 1841154 - RNA, 17 nt, Salmonella typhimurium LT2
gcgcagugaccagcauc

SEQ ID NO: 1841155 - RNA, 13 nt, Salmonella typhimurium LT2
gcgcagucacaga

SEQ ID NO: 1841156 - RNA, 18 nt, Salmonella typhimurium LT2
gcgcagguuuugcagauc

SEQ ID NO: 1841157 - RNA, 14 nt, Salmonella typhimurium LT2
gcgcaggggcauuu

SEQ ID NO: 1841158 - RNA, 21 nt, Salmonella typhimurium LT2
gcgcaggguuucgauauccag

SEQ ID NO: 1841159 - RNA, 18 nt, Salmonella typhimurium LT2
gcgcagggcgauauccag

SEQ ID NO: 1841160 - RNA, 21 nt, Salmonella typhimurium LT2
gcgcagggcgauauccagcgc

SEQ ID NO: 1841161 - RNA, 15 nt, Salmonella typhimurium LT2
gcgcaggcgggggcg

SEQ ID NO: 1841162 - RNA, 20 nt, Salmonella typhimurium LT2
gcgcagcgaaacugcgcgcc

SEQ ID NO: 1841163 - RNA, 12 nt, Salmonella typhimurium LT2
gcgcaggccagg

SEQ ID NO: 1841164 - RNA, 14 nt, Salmonella typhimurium LT2
gcgcaggccaggcg

SEQ ID NO: 1841165 - RNA, 15 nt, Salmonella typhimurium LT2
gcgcagccccagcgc

SEQ ID NO: 1841166 - RNA, 12 nt, Salmonella typhimurium LT2
gcgcagcccaua

SEQ ID NO: 1841167 - RNA, 17 nt, Salmonella typhimurium LT2
gcgcagccgcucaauaa

SEQ ID NO: 1841168 - RNA, 16 nt, Salmonella typhimurium LT2
gcgcagccagcgcccc

SEQ ID NO: 1841169 - RNA, 22 nt, Salmonella typhimurium LT2
gcgcaccuucaacagcucgcca

SEQ ID NO: 1841170 - RNA, 18 nt, Salmonella typhimurium LT2
gcgcacgcccaucggcac

SEQ ID NO: 1841171 - RNA, 16 nt, Salmonella typhimurium LT2
gcgcagaaccauacug

SEQ ID NO: 1841172 - RNA, 13 nt, Salmonella typhimurium LT2
gcgcacugcucgu

SEQ ID NO: 1841173 - RNA, 15 nt, Salmonella typhimurium LT2
gcgcacucagaaaau

SEQ ID NO: 1841174 - RNA, 16 nt, Salmonella typhimurium LT2
gcgcacucagaaaauu

SEQ ID NO: 1841175 - RNA, 13 nt, Salmonella typhimurium LT2
gcgcacggucgcu

SEQ ID NO: 1841176 - RNA, 18 nt, Salmonella typhimurium LT2
gcgccacgcgccagccgu

SEQ ID NO: 1841177 - RNA, 16 nt, Salmonella typhimurium LT2
gcgccacgcgccaggu

SEQ ID NO: 1841178 - RNA, 16 nt, Salmonella typhimurium LT2
gcgccacuuccagcgc

SEQ ID NO: 1841179 - RNA, 15 nt, Salmonella typhimurium LT2
gcgccacgcccacgc

SEQ ID NO: 1841180 - RNA, 23 nt, Salmonella typhimurium LT2
gcgccaccaucgucgccagaccc

SEQ ID NO: 1841181 - RNA, 17 nt, Salmonella typhimurium LT2
gcgccagcggacuccac

SEQ ID NO: 1841182 - RNA, 23 nt, Salmonella typhimurium LT2
gcgccagcgcugacaucauccac

SEQ ID NO: 1841183 - RNA, 13 nt, Salmonella typhimurium LT2
gcgccagccgcuu

SEQ ID NO: 1841184 - RNA, 15 nt, Salmonella typhimurium LT2
gcgccagcgacugcu

SEQ ID NO: 1841185 - RNA, 13 nt, Salmonella typhimurium LT2
gcgccagcgccaa

SEQ ID NO: 1841186 - RNA, 11 nt, Salmonella typhimurium LT2
gcgccagcaug

SEQ ID NO: 1841187 - RNA, 14 nt, Salmonella typhimurium LT2
gcgccagcaguggg

SEQ ID NO: 1841188 - RNA, 19 nt, Salmonella typhimurium LT2
gcgccagcagcggcgaagc

SEQ ID NO: 1841189 - RNA, 13 nt, Salmonella typhimurium LT2
gcgccagccagcu

SEQ ID NO: 1841190 - RNA, 20 nt, Salmonella typhimurium LT2
gcgccagccagucgccaggc

SEQ ID NO: 1841191 - RNA, 19 nt, Salmonella typhimurium LT2
gcgccaauccaugccggcu

SEQ ID NO: 1841192 - RNA, 22 nt, Salmonella typhimurium LT2
gcgccaaugcgaaaauacuccc

SEQ ID NO: 1841193 - RNA, 14 nt, Salmonella typhimurium LT2
gcgccacaaaggau

SEQ ID NO: 1841194 - RNA, 18 nt, Salmonella typhimurium LT2
gcgccaauauagccgaug

SEQ ID NO: 1841195 - RNA, 14 nt, Salmonella typhimurium LT2
gcgccaagcgccuc

SEQ ID NO: 1841196 - RNA, 21 nt, Salmonella typhimurium LT2
gcgccaaacgggcaagccagc

SEQ ID NO: 1841197 - RNA, 17 nt, Salmonella typhimurium LT2
gcgcauuuuacugccgu

SEQ ID NO: 1841198 - RNA, 19 nt, Salmonella typhimurium LT2
gcgcauugcgucccagcac

SEQ ID NO: 1841199 - RNA, 21 nt, Salmonella typhimurium LT2
gcgcauucucuguugccgccc

SEQ ID NO: 1841200 - RNA, 16 nt, Salmonella typhimurium LT2
gcgcauuccagacccg

SEQ ID NO: 1841201 - RNA, 15 nt, Salmonella typhimurium LT2
gcgcauuccagaccc

SEQ ID NO: 1841202 - RNA, 15 nt, Salmonella typhimurium LT2
gcgcauggccauaga

SEQ ID NO: 1841203 - RNA, 22 nt, Salmonella typhimurium LT2
gcgcauuauguaauaacugacg

SEQ ID NO: 1841204 - RNA, 21 nt, Salmonella typhimurium LT2
gcgcauuaacgccgugcucau

SEQ ID NO: 1841205 - RNA, 20 nt, Salmonella typhimurium LT2
gcgcaucaaauacgcgcgcc

SEQ ID NO: 1841206 - RNA, 21 nt, Salmonella typhimurium LT2
gcgcaucaaauacgcgcgccg

SEQ ID NO: 1841207 - RNA, 19 nt, Salmonella typhimurium LT2
gcgcaucaacgccaggcag

SEQ ID NO: 1841208 - RNA, 15 nt, Salmonella typhimurium LT2
gcgcaucauggucgu

SEQ ID NO: 1841209 - RNA, 21 nt, Salmonella typhimurium LT2
gcgcaguuuacgcagcgccuu

SEQ ID NO: 1841210 - RNA, 19 nt, Salmonella typhimurium LT2
gcgcaguucgccaccagga

SEQ ID NO: 1841211 - RNA, 12 nt, Salmonella typhimurium LT2
gcgcauccggcg

SEQ ID NO: 1841212 - RNA, 17 nt, Salmonella typhimurium LT2
gcgcaucgcccugccag

SEQ ID NO: 1841213 - RNA, 23 nt, Salmonella typhimurium LT2
gcgcaucgcccugccagugaaag

SEQ ID NO: 1841214 - RNA, 20 nt, Salmonella typhimurium LT2
gcgcaucggucuccagcaac

SEQ ID NO: 1841215 - RNA, 17 nt, Salmonella typhimurium LT2
gccgucacagagagcgu

SEQ ID NO: 1841216 - RNA, 17 nt, Salmonella typhimurium LT2
gccgucaaugccgggca

SEQ ID NO: 1841217 - RNA, 16 nt, Salmonella typhimurium LT2
gccggaaaucacccaa

SEQ ID NO: 1841218 - RNA, 20 nt, Salmonella typhimurium LT2
gccgcuuugcgaacagcgca

SEQ ID NO: 1841219 - RNA, 20 nt, Salmonella typhimurium LT2
gccgcuuuuuccgccgccgu

SEQ ID NO: 1841220 - RNA, 17 nt, Salmonella typhimurium LT2
gccgcuuccggcaggua

SEQ ID NO: 1841221 - RNA, 18 nt, Salmonella typhimurium LT2
gccgucuggagcgaugac

SEQ ID NO: 1841222 - RNA, 15 nt, Salmonella typhimurium LT2
gccgucggcgccagc

SEQ ID NO: 1841223 - RNA, 12 nt, Salmonella typhimurium LT2
gccgucccagcg

SEQ ID NO: 1841224 - RNA, 22 nt, Salmonella typhimurium LT2
gccguuuuaaccaguucaggau

SEQ ID NO: 1841225 - RNA, 18 nt, Salmonella typhimurium LT2
gccguuuuagguucuuca

SEQ ID NO: 1841226 - RNA, 14 nt, Salmonella typhimurium LT2
gccuaaugagccag

SEQ ID NO: 1841227 - RNA, 21 nt, Salmonella typhimurium LT2
gccuacaacucagcguaacug

SEQ ID NO: 1841228 - RNA, 12 nt, Salmonella typhimurium LT2
gccuacaagaau

SEQ ID NO: 1841229 - RNA, 14 nt, Salmonella typhimurium LT2
gccuacagcugauu

SEQ ID NO: 1841230 - RNA, 22 nt, Salmonella typhimurium LT2
gccuacaggacugcacgaaaug

SEQ ID NO: 1841231 - RNA, 18 nt, Salmonella typhimurium LT2
gccuagcgcgcgcaguuu

SEQ ID NO: 1841232 - RNA, 16 nt, Salmonella typhimurium LT2
gccuacagcaucccgc

SEQ ID NO: 1841233 - RNA, 15 nt, Salmonella typhimurium LT2
gccguuaccguggcg

SEQ ID NO: 1841234 - RNA, 23 nt, Salmonella typhimurium LT2
gccguucaaagccgccauccggc

SEQ ID NO: 1841235 - RNA, 14 nt, Salmonella typhimurium LT2
gccguuccauucca

SEQ ID NO: 1841236 - RNA, 21 nt, Salmonella typhimurium LT2
gccguucauuugcaauggccc

SEQ ID NO: 1841237 - RNA, 12 nt, Salmonella typhimurium LT2
gccgugacacac

SEQ ID NO: 1841238 - RNA, 19 nt, Salmonella typhimurium LT2
gccgugcucauccaacugc

SEQ ID NO: 1841239 - RNA, 21 nt, Salmonella typhimurium LT2
gccuccgcguagcccagcgcc

SEQ ID NO: 1841240 - RNA, 20 nt, Salmonella typhimurium LT2
gccuccaggcuacccacccc

SEQ ID NO: 1841241 - RNA, 18 nt, Salmonella typhimurium LT2
gccuccggaugacgccgc

SEQ ID NO: 1841242 - RNA, 18 nt, Salmonella typhimurium LT2
gccucgaaaauauauucu

SEQ ID NO: 1841243 - RNA, 12 nt, Salmonella typhimurium LT2
gccucauggcgg

SEQ ID NO: 1841244 - RNA, 19 nt, Salmonella typhimurium LT2
gccuccaccaccucuuucg

SEQ ID NO: 1841245 - RNA, 13 nt, Salmonella typhimurium LT2
gccucaccccaug

SEQ ID NO: 1841246 - RNA, 16 nt, Salmonella typhimurium LT2
gccucacguagaucuu

SEQ ID NO: 1841247 - RNA, 16 nt, Salmonella typhimurium LT2
gccucgccaaagcgcu

SEQ ID NO: 1841248 - RNA, 18 nt, Salmonella typhimurium LT2
gccucgccaaagcgcugc

SEQ ID NO: 1841249 - RNA, 15 nt, Salmonella typhimurium LT2
gccucgaucuccucg

SEQ ID NO: 1841250 - RNA, 17 nt, Salmonella typhimurium LT2
gccucgcgauccgccag

SEQ ID NO: 1841251 - RNA, 16 nt, Salmonella typhimurium LT2
gccucgcgauccgcca

SEQ ID NO: 1841252 - RNA, 13 nt, Salmonella typhimurium LT2
gccucgccccuuc

SEQ ID NO: 1841253 - RNA, 18 nt, Salmonella typhimurium LT2
gccucgccccuucggggc

SEQ ID NO: 1841254 - RNA, 21 nt, Salmonella typhimurium LT2
gccucgcucucuuucaccagc

SEQ ID NO: 1841255 - RNA, 15 nt, Salmonella typhimurium LT2
gccucgcugacgcca

SEQ ID NO: 1841256 - RNA, 17 nt, Salmonella typhimurium LT2
gccucgcugacgccagc

SEQ ID NO: 1841257 - RNA, 18 nt, Salmonella typhimurium LT2
gccucgcugacgccagcc

SEQ ID NO: 1841258 - RNA, 22 nt, Salmonella typhimurium LT2
gccucgcugacgccagccagcc

SEQ ID NO: 1841259 - RNA, 16 nt, Salmonella typhimurium LT2
gccucuaucuucucag

SEQ ID NO: 1841260 - RNA, 15 nt, Salmonella typhimurium LT2
gccucguucccagcg

SEQ ID NO: 1841261 - RNA, 23 nt, Salmonella typhimurium LT2
gccucguuugcugagcagccagc

SEQ ID NO: 1841262 - RNA, 22 nt, Salmonella typhimurium LT2
gccucgcugauacgcaccagcu

SEQ ID NO: 1841263 - RNA, 22 nt, Salmonella typhimurium LT2
gccucuuccgccugauaaaacg

SEQ ID NO: 1841264 - RNA, 22 nt, Salmonella typhimurium LT2
gccucuuaucaggcgacccaua

SEQ ID NO: 1841265 - RNA, 14 nt, Salmonella typhimurium LT2
gccucuuccgccug

SEQ ID NO: 1841266 - RNA, 15 nt, Salmonella typhimurium LT2
gccucugucuugucu

SEQ ID NO: 1841267 - RNA, 19 nt, Salmonella typhimurium LT2
gccucuccucgaugcgccg

SEQ ID NO: 1841268 - RNA, 18 nt, Salmonella typhimurium LT2
gccugccgggccugcggc

SEQ ID NO: 1841269 - RNA, 13 nt, Salmonella typhimurium LT2
gccugccgggccu

SEQ ID NO: 1841270 - RNA, 15 nt, Salmonella typhimurium LT2
gccugccguccugau

SEQ ID NO: 1841271 - RNA, 18 nt, Salmonella typhimurium LT2
gccugccguuuuuaacac

SEQ ID NO: 1841272 - RNA, 16 nt, Salmonella typhimurium LT2
gccugccgucgcggcu

SEQ ID NO: 1841273 - RNA, 21 nt, Salmonella typhimurium LT2
gccugccgucgcggcuuucag

SEQ ID NO: 1841274 - RNA, 12 nt, Salmonella typhimurium LT2
gccugcgcggca

SEQ ID NO: 1841275 - RNA, 15 nt, Salmonella typhimurium LT2
gccugccugaagcgc

SEQ ID NO: 1841276 - RNA, 21 nt, Salmonella typhimurium LT2
gccugcgcggcaauuuccgcu

SEQ ID NO: 1841277 - RNA, 17 nt, Salmonella typhimurium LT2
gccugccggauuuuuca

SEQ ID NO: 1841278 - RNA, 15 nt, Salmonella typhimurium LT2
gccugccgcagcggc

SEQ ID NO: 1841279 - RNA, 21 nt, Salmonella typhimurium LT2
gccugcggauucaggacgaga

SEQ ID NO: 1841280 - RNA, 22 nt, Salmonella typhimurium LT2
gccugcggcgagguggcgaagc

SEQ ID NO: 1841281 - RNA, 20 nt, Salmonella typhimurium LT2
gccugcugcgguaaggcagc

SEQ ID NO: 1841282 - RNA, 18 nt, Salmonella typhimurium LT2
gccugcuggaaaggccgc

SEQ ID NO: 1841283 - RNA, 18 nt, Salmonella typhimurium LT2
gccugcugcagacugccg

SEQ ID NO: 1841284 - RNA, 15 nt, Salmonella typhimurium LT2
gccuggcgcagcgcu

SEQ ID NO: 1841285 - RNA, 14 nt, Salmonella typhimurium LT2
gccuggcgcagcgc

SEQ ID NO: 1841286 - RNA, 17 nt, Salmonella typhimurium LT2
gccuucacacugcgccg

SEQ ID NO: 1841287 - RNA, 17 nt, Salmonella typhimurium LT2
gccuuauugugccgcgg

SEQ ID NO: 1841288 - RNA, 15 nt, Salmonella typhimurium LT2
gccuguuuauauucu

SEQ ID NO: 1841289 - RNA, 16 nt, Salmonella typhimurium LT2
gccuuaaaaagaacaa

SEQ ID NO: 1841290 - RNA, 20 nt, Salmonella typhimurium LT2
gccuuaaccugguucaaaau

SEQ ID NO: 1841291 - RNA, 15 nt, Salmonella typhimurium LT2
gccuguucaucaggu

SEQ ID NO: 1841292 - RNA, 19 nt, Salmonella typhimurium LT2
gccuguucuucaguaauuu

SEQ ID NO: 1841293 - RNA, 18 nt, Salmonella typhimurium LT2
gccuguucuucaguaauu

SEQ ID NO: 1841294 - RNA, 16 nt, Salmonella typhimurium LT2
gccuggcugagaaaaa

SEQ ID NO: 1841295 - RNA, 16 nt, Salmonella typhimurium LT2
gccuggcgcuuuaaaa

SEQ ID NO: 1841296 - RNA, 16 nt, Salmonella typhimurium LT2
gccugggauaagcaga

SEQ ID NO: 1841297 - RNA, 18 nt, Salmonella typhimurium LT2
gccugggggggaaaccca

SEQ ID NO: 1841298 - RNA, 19 nt, Salmonella typhimurium LT2
gccugggggggaaacccac

SEQ ID NO: 1841299 - RNA, 18 nt, Salmonella typhimurium LT2
gccugguaagcgcagcgc

SEQ ID NO: 1841300 - RNA, 20 nt, Salmonella typhimurium LT2
gcgaaauuuaauauaugaac

SEQ ID NO: 1841301 - RNA, 14 nt, Salmonella typhimurium LT2
gcgaaauugguaga

SEQ ID NO: 1841302 - RNA, 17 nt, Salmonella typhimurium LT2
gcgaaaucauuucaucu

SEQ ID NO: 1841303 - RNA, 23 nt, Salmonella typhimurium LT2
gcgaaagcgaccggcacucaccu

SEQ ID NO: 1841304 - RNA, 22 nt, Salmonella typhimurium LT2
gccuuuucauauggaagcuguu

SEQ ID NO: 1841305 - RNA, 23 nt, Salmonella typhimurium LT2
gccuuuuauaauaaaagcucguc

SEQ ID NO: 1841306 - RNA, 14 nt, Salmonella typhimurium LT2
gcgaacuucaccag

SEQ ID NO: 1841307 - RNA, 17 nt, Salmonella typhimurium LT2
gcgaagcgccaucaggc

SEQ ID NO: 1841308 - RNA, 15 nt, Salmonella typhimurium LT2
gcgaagccgccaccc

SEQ ID NO: 1841309 - RNA, 14 nt, Salmonella typhimurium LT2
gcgaacguccagcg

SEQ ID NO: 1841310 - RNA, 21 nt, Salmonella typhimurium LT2
gcgaacgacucacgcgcgcuu

SEQ ID NO: 1841311 - RNA, 14 nt, Salmonella typhimurium LT2
gcgaacggauaaac

SEQ ID NO: 1841312 - RNA, 16 nt, Salmonella typhimurium LT2
gcgaacgccaggccaa

SEQ ID NO: 1841313 - RNA, 15 nt, Salmonella typhimurium LT2
gcgaaccaucauuaa

SEQ ID NO: 1841314 - RNA, 20 nt, Salmonella typhimurium LT2
gcgaacauuccgcccaggaa

SEQ ID NO: 1841315 - RNA, 14 nt, Salmonella typhimurium LT2
gccuuucaccauca

SEQ ID NO: 1841316 - RNA, 16 nt, Salmonella typhimurium LT2
gccuuucaccaucagc

SEQ ID NO: 1841317 - RNA, 23 nt, Salmonella typhimurium LT2
gccuuuuaucaaugcacugacuu

SEQ ID NO: 1841318 - RNA, 20 nt, Salmonella typhimurium LT2
gccuuuauucauuucaaugu

SEQ ID NO: 1841319 - RNA, 14 nt, Salmonella typhimurium LT2
gccuugcaaaccgg

SEQ ID NO: 1841320 - RNA, 13 nt, Salmonella typhimurium LT2
gccuugagcaaaa

SEQ ID NO: 1841321 - RNA, 17 nt, Salmonella typhimurium LT2
gccuugacaggaaacag

SEQ ID NO: 1841322 - RNA, 20 nt, Salmonella typhimurium LT2
gccuucgcggugaucccagg

SEQ ID NO: 1841323 - RNA, 14 nt, Salmonella typhimurium LT2
gccuucgccgccgc

SEQ ID NO: 1841324 - RNA, 22 nt, Salmonella typhimurium LT2
gccuucggucguuugccgugca

SEQ ID NO: 1841325 - RNA, 17 nt, Salmonella typhimurium LT2
gccuucgauuaacgcau

SEQ ID NO: 1841326 - RNA, 21 nt, Salmonella typhimurium LT2
gccuucgcauauuguaccugc

SEQ ID NO: 1841327 - RNA, 15 nt, Salmonella typhimurium LT2
gccuucagcgcgccc

SEQ ID NO: 1841328 - RNA, 24 nt, Salmonella typhimurium LT2
gccuucagccugaaucagcaucuu

SEQ ID NO: 1841329 - RNA, 15 nt, Salmonella typhimurium LT2
ggcgcgaaagcgccu

SEQ ID NO: 1841330 - RNA, 22 nt, Salmonella typhimurium LT2
ggcgcgaaacugcugccgcagc

SEQ ID NO: 1841331 - RNA, 17 nt, Salmonella typhimurium LT2
ggcgcgaaaacagcugg

SEQ ID NO: 1841332 - RNA, 23 nt, Salmonella typhimurium LT2
ggcgccagcucugccgguuggcc

SEQ ID NO: 1841333 - RNA, 11 nt, Salmonella typhimurium LT2
ggcgccaguac

SEQ ID NO: 1841334 - RNA, 13 nt, Salmonella typhimurium LT2
aaauaccgcacau

SEQ ID NO: 1841335 - RNA, 12 nt, Salmonella typhimurium LT2
aaauaccuaacu

SEQ ID NO: 1841336 - RNA, 15 nt, Salmonella typhimurium LT2
aaauaccgcacauca

SEQ ID NO: 1841337 - RNA, 22 nt, Salmonella typhimurium LT2
aaauacggcuuccacugcggca

SEQ ID NO: 1841338 - RNA, 19 nt, Salmonella typhimurium LT2
aaauacgccgccagcaaua

SEQ ID NO: 1841339 - RNA, 20 nt, Salmonella typhimurium LT2
aaauacgcucaauauacuua

SEQ ID NO: 1841340 - RNA, 13 nt, Salmonella typhimurium LT2
ggcgcggaaggga

SEQ ID NO: 1841341 - RNA, 12 nt, Salmonella typhimurium LT2
ggcgcgcccggc

SEQ ID NO: 1841342 - RNA, 14 nt, Salmonella typhimurium LT2
ggcggaauggcggg

SEQ ID NO: 1841343 - RNA, 21 nt, Salmonella typhimurium LT2
ggcggaauugguagacgcgcu

SEQ ID NO: 1841344 - RNA, 20 nt, Salmonella typhimurium LT2
ggcggacaacgcuccagcag

SEQ ID NO: 1841345 - RNA, 13 nt, Salmonella typhimurium LT2
ggcggacagcggc

SEQ ID NO: 1841346 - RNA, 23 nt, Salmonella typhimurium LT2
ggcgcugcgcuuauccggccuac

SEQ ID NO: 1841347 - RNA, 13 nt, Salmonella typhimurium LT2
ggcggccagcauu

SEQ ID NO: 1841348 - RNA, 20 nt, Salmonella typhimurium LT2
ggcggagccaaaagaagugg

SEQ ID NO: 1841349 - RNA, 20 nt, Salmonella typhimurium LT2
ggcggagccgccauccggca

SEQ ID NO: 1841350 - RNA, 15 nt, Salmonella typhimurium LT2
ggcggcaacaaaugu

SEQ ID NO: 1841351 - RNA, 14 nt, Salmonella typhimurium LT2
ggcggcaaagucuu

SEQ ID NO: 1841352 - RNA, 15 nt, Salmonella typhimurium LT2
ggcgggaucggggcg

SEQ ID NO: 1841353 - RNA, 20 nt, Salmonella typhimurium LT2
ggcgggcgauagagaccgcu

SEQ ID NO: 1841354 - RNA, 18 nt, Salmonella typhimurium LT2
ggcgggugcgcagcccca

SEQ ID NO: 1841355 - RNA, 17 nt, Salmonella typhimurium LT2
ggcgguaaucgcgcugu

SEQ ID NO: 1841356 - RNA, 13 nt, Salmonella typhimurium LT2
ggcguagacgacc

SEQ ID NO: 1841357 - RNA, 14 nt, Salmonella typhimurium LT2
aaauaccaaauauu

SEQ ID NO: 1841358 - RNA, 12 nt, Salmonella typhimurium LT2
aaauaccagcac

SEQ ID NO: 1841359 - RNA, 12 nt, Salmonella typhimurium LT2
ggcgcaggccag

SEQ ID NO: 1841360 - RNA, 12 nt, Salmonella typhimurium LT2
ggcgcagcuucu

SEQ ID NO: 1841361 - RNA, 17 nt, Salmonella typhimurium LT2
ggcgcaaauggcugcga

SEQ ID NO: 1841362 - RNA, 15 nt, Salmonella typhimurium LT2
ggcgauguuggcgcc

SEQ ID NO: 1841363 - RNA, 20 nt, Salmonella typhimurium LT2
ggcgauucggacuaauacuu

SEQ ID NO: 1841364 - RNA, 15 nt, Salmonella typhimurium LT2
ggcgauagcucgccc

SEQ ID NO: 1841365 - RNA, 16 nt, Salmonella typhimurium LT2
ggcgauagugucgcca

SEQ ID NO: 1841366 - RNA, 22 nt, Salmonella typhimurium LT2
ggcgauacuccgacggcgagcg

SEQ ID NO: 1841367 - RNA, 21 nt, Salmonella typhimurium LT2
ggcgauacugcuccgccggag

SEQ ID NO: 1841368 - RNA, 13 nt, Salmonella typhimurium LT2
ggcgauacuggca

SEQ ID NO: 1841369 - RNA, 13 nt, Salmonella typhimurium LT2
aaauaauugauaa

SEQ ID NO: 1841370 - RNA, 21 nt, Salmonella typhimurium LT2
ggcgauaaggucgcuauccag

SEQ ID NO: 1841371 - RNA, 18 nt, Salmonella typhimurium LT2
aaauaagaauccagucag

SEQ ID NO: 1841372 - RNA, 12 nt, Salmonella typhimurium LT2
aaauaauaccac

SEQ ID NO: 1841373 - RNA, 22 nt, Salmonella typhimurium LT2
aaauaauccgcugcaacucccg

SEQ ID NO: 1841374 - RNA, 16 nt, Salmonella typhimurium LT2
aaauaaucaccacauu

SEQ ID NO: 1841375 - RNA, 12 nt, Salmonella typhimurium LT2
ggcgaacauaag

SEQ ID NO: 1841376 - RNA, 19 nt, Salmonella typhimurium LT2
ggcgaacauuccgcccagg

SEQ ID NO: 1841377 - RNA, 15 nt, Salmonella typhimurium LT2
ggcgacaagaauaug

SEQ ID NO: 1841378 - RNA, 20 nt, Salmonella typhimurium LT2
ggcgacaaucaaucuggccg

SEQ ID NO: 1841379 - RNA, 23 nt, Salmonella typhimurium LT2
ggcgaccgaacagaacagugagu

SEQ ID NO: 1841380 - RNA, 14 nt, Salmonella typhimurium LT2
ggcgacccgcccac

SEQ ID NO: 1841381 - RNA, 15 nt, Salmonella typhimurium LT2
ggcgaccauccacca

SEQ ID NO: 1841382 - RNA, 23 nt, Salmonella typhimurium LT2
ggcgaccacuagcgccgccagcu

SEQ ID NO: 1841383 - RNA, 22 nt, Salmonella typhimurium LT2
ggcgaaauggaucggcuugccu

SEQ ID NO: 1841384 - RNA, 21 nt, Salmonella typhimurium LT2
ggccuuguagcgcugcccaau

SEQ ID NO: 1841385 - RNA, 14 nt, Salmonella typhimurium LT2
ggccgacaaaaauu

SEQ ID NO: 1841386 - RNA, 16 nt, Salmonella typhimurium LT2
aaauaagaaaaugccu

SEQ ID NO: 1841387 - RNA, 18 nt, Salmonella typhimurium LT2
ggcgacuagucgcccgcu

SEQ ID NO: 1841388 - RNA, 17 nt, Salmonella typhimurium LT2
ggcgacuuuuuucaaau

SEQ ID NO: 1841389 - RNA, 15 nt, Salmonella typhimurium LT2
ggcgagcacugccca

SEQ ID NO: 1841390 - RNA, 17 nt, Salmonella typhimurium LT2
ggcgagcagaaaaaguc

SEQ ID NO: 1841391 - RNA, 21 nt, Salmonella typhimurium LT2
aaauaacgccuuucaccauuc

SEQ ID NO: 1841392 - RNA, 19 nt, Salmonella typhimurium LT2
aaauaacgcgauaaucccc

SEQ ID NO: 1841393 - RNA, 14 nt, Salmonella typhimurium LT2
ggcugcggcauggc

SEQ ID NO: 1841394 - RNA, 15 nt, Salmonella typhimurium LT2
ggcugcggccuccgc

SEQ ID NO: 1841395 - RNA, 23 nt, Salmonella typhimurium LT2
ggcugcggccuccgcagcuucau

SEQ ID NO: 1841396 - RNA, 14 nt, Salmonella typhimurium LT2
ggcugccagccagc

SEQ ID NO: 1841397 - RNA, 17 nt, Salmonella typhimurium LT2
ggcugccagccagcggg

SEQ ID NO: 1841398 - RNA, 22 nt, Salmonella typhimurium LT2
ggcugccgaugaucccggcgcc

SEQ ID NO: 1841399 - RNA, 19 nt, Salmonella typhimurium LT2
ggcugccgacuacgccucc

SEQ ID NO: 1841400 - RNA, 23 nt, Salmonella typhimurium LT2
ggcugauacgccuggauagacga

SEQ ID NO: 1841401 - RNA, 18 nt, Salmonella typhimurium LT2
ggcugcaaagcaucugcc

SEQ ID NO: 1841402 - RNA, 22 nt, Salmonella typhimurium LT2
ggcugcaaagcaucugccggca

SEQ ID NO: 1841403 - RNA, 13 nt, Salmonella typhimurium LT2
ggcugagaaaaau

SEQ ID NO: 1841404 - RNA, 14 nt, Salmonella typhimurium LT2
ggcugagaaaaaua

SEQ ID NO: 1841405 - RNA, 15 nt, Salmonella typhimurium LT2
ggcugagaaaaauac

SEQ ID NO: 1841406 - RNA, 19 nt, Salmonella typhimurium LT2
ggcugaaugaagccuuagc

SEQ ID NO: 1841407 - RNA, 15 nt, Salmonella typhimurium LT2
ggcugaaagcgccuu

SEQ ID NO: 1841408 - RNA, 16 nt, Salmonella typhimurium LT2
ggcugaacgccaggcc

SEQ ID NO: 1841409 - RNA, 12 nt, Salmonella typhimurium LT2
ggcugaagcccc

SEQ ID NO: 1841410 - RNA, 18 nt, Salmonella typhimurium LT2
ggcucuguguaaaacgcu

SEQ ID NO: 1841411 - RNA, 16 nt, Salmonella typhimurium LT2
ggcucuuagcagcaua

SEQ ID NO: 1841412 - RNA, 16 nt, Salmonella typhimurium LT2
ggcucuuuggcaaucu

SEQ ID NO: 1841413 - RNA, 22 nt, Salmonella typhimurium LT2
ggcugaaaaauccccccuccuc

SEQ ID NO: 1841414 - RNA, 17 nt, Salmonella typhimurium LT2
ggcugaaccccuguuca

SEQ ID NO: 1841415 - RNA, 13 nt, Salmonella typhimurium LT2
ggcguagccgccg

SEQ ID NO: 1841416 - RNA, 16 nt, Salmonella typhimurium LT2
ggcguauagccaggca

SEQ ID NO: 1841417 - RNA, 19 nt, Salmonella typhimurium LT2
ggcguauagccaggcagau

SEQ ID NO: 1841418 - RNA, 17 nt, Salmonella typhimurium LT2
ggcguauagccaggcag

SEQ ID NO: 1841419 - RNA, 22 nt, Salmonella typhimurium LT2
ggcgucaccaccgcaggcagcg

SEQ ID NO: 1841420 - RNA, 20 nt, Salmonella typhimurium LT2
ggcgucaccaccgcaggcag

SEQ ID NO: 1841421 - RNA, 14 nt, Salmonella typhimurium LT2
ggcguauuuaugug

SEQ ID NO: 1841422 - RNA, 17 nt, Salmonella typhimurium LT2
ggcgucaaacagcuuaa

SEQ ID NO: 1841423 - RNA, 22 nt, Salmonella typhimurium LT2
ggcgucaaauccaccgccagca

SEQ ID NO: 1841424 - RNA, 20 nt, Salmonella typhimurium LT2
ggcuccagcgccagcuccau

SEQ ID NO: 1841425 - RNA, 14 nt, Salmonella typhimurium LT2
ggcuccagcgccag

SEQ ID NO: 1841426 - RNA, 13 nt, Salmonella typhimurium LT2
ggcucuaaaaagg

SEQ ID NO: 1841427 - RNA, 16 nt, Salmonella typhimurium LT2
ggcucuaaaaaggaaa

SEQ ID NO: 1841428 - RNA, 22 nt, Salmonella typhimurium LT2
ggcucgucguugaaaucgucag

SEQ ID NO: 1841429 - RNA, 21 nt, Salmonella typhimurium LT2
ggcucgcguugcgucauauaa

SEQ ID NO: 1841430 - RNA, 14 nt, Salmonella typhimurium LT2
ggcuugccagcaga

SEQ ID NO: 1841431 - RNA, 17 nt, Salmonella typhimurium LT2
ggcuugccagauagaca

SEQ ID NO: 1841432 - RNA, 22 nt, Salmonella typhimurium LT2
ggcuucguuaagcgguuuucaa

SEQ ID NO: 1841433 - RNA, 18 nt, Salmonella typhimurium LT2
ggcuucaaccguuucuuu

SEQ ID NO: 1841434 - RNA, 22 nt, Salmonella typhimurium LT2
ggcuuccaguugaaaaccacaa

SEQ ID NO: 1841435 - RNA, 16 nt, Salmonella typhimurium LT2
ggcuucgauuacagga

SEQ ID NO: 1841436 - RNA, 21 nt, Salmonella typhimurium LT2
ggcuuacuuuccaaaauccag

SEQ ID NO: 1841437 - RNA, 13 nt, Salmonella typhimurium LT2
ggcuuaccugcuc

SEQ ID NO: 1841438 - RNA, 20 nt, Salmonella typhimurium LT2
ggcuuacggcuauucuucga

SEQ ID NO: 1841439 - RNA, 11 nt, Salmonella typhimurium LT2
ggcuggcuggc

SEQ ID NO: 1841440 - RNA, 13 nt, Salmonella typhimurium LT2
ggcugucccagag

SEQ ID NO: 1841441 - RNA, 23 nt, Salmonella typhimurium LT2
ggcuguauguaggguacagcgcg

SEQ ID NO: 1841442 - RNA, 14 nt, Salmonella typhimurium LT2
ggcugguuucuccg

SEQ ID NO: 1841443 - RNA, 18 nt, Salmonella typhimurium LT2
ggcugucggcagaaccug

SEQ ID NO: 1841444 - RNA, 13 nt, Salmonella typhimurium LT2
ggcugucgauccc

SEQ ID NO: 1841445 - RNA, 23 nt, Salmonella typhimurium LT2
ggcuguggcguuuuaccgcccga

SEQ ID NO: 1841446 - RNA, 14 nt, Salmonella typhimurium LT2
ggcugcuugagcca

SEQ ID NO: 1841447 - RNA, 20 nt, Salmonella typhimurium LT2
ggcuggcaaugcgcuguauu

SEQ ID NO: 1841448 - RNA, 18 nt, Salmonella typhimurium LT2
gggcaggcgucaaaacag

SEQ ID NO: 1841449 - RNA, 16 nt, Salmonella typhimurium LT2
gggcauaaaugguacu

SEQ ID NO: 1841450 - RNA, 22 nt, Salmonella typhimurium LT2
gggcagucuccucgcaggcucg

SEQ ID NO: 1841451 - RNA, 11 nt, Salmonella typhimurium LT2
gggcagcaucu

SEQ ID NO: 1841452 - RNA, 13 nt, Salmonella typhimurium LT2
gggcagagccgga

SEQ ID NO: 1841453 - RNA, 12 nt, Salmonella typhimurium LT2
gggcagaaaaau

SEQ ID NO: 1841454 - RNA, 12 nt, Salmonella typhimurium LT2
gggcagaaacgu

SEQ ID NO: 1841455 - RNA, 21 nt, Salmonella typhimurium LT2
gggcaauauaauccggcgagg

SEQ ID NO: 1841456 - RNA, 20 nt, Salmonella typhimurium LT2
gggcaaucugaguauuuaca

SEQ ID NO: 1841457 - RNA, 20 nt, Salmonella typhimurium LT2
gggcaauaaagcggaugacg

SEQ ID NO: 1841458 - RNA, 18 nt, Salmonella typhimurium LT2
gggcaagggcaagggcaa

SEQ ID NO: 1841459 - RNA, 19 nt, Salmonella typhimurium LT2
gggcaaacagcacuacagc

SEQ ID NO: 1841460 - RNA, 13 nt, Salmonella typhimurium LT2
gggcaacggccag

SEQ ID NO: 1841461 - RNA, 19 nt, Salmonella typhimurium LT2
gggcaacggccagcgcagg

SEQ ID NO: 1841462 - RNA, 16 nt, Salmonella typhimurium LT2
gggaugguuaaauuca

SEQ ID NO: 1841463 - RNA, 21 nt, Salmonella typhimurium LT2
gggaucguucugcugauaaua

SEQ ID NO: 1841464 - RNA, 16 nt, Salmonella typhimurium LT2
gggaucagcggcugca

SEQ ID NO: 1841465 - RNA, 23 nt, Salmonella typhimurium LT2
gggaguaguguaauaccacugcc

SEQ ID NO: 1841466 - RNA, 20 nt, Salmonella typhimurium LT2
gggagguauaaucagcauca

SEQ ID NO: 1841467 - RNA, 15 nt, Salmonella typhimurium LT2
gggaaagccccuacc

SEQ ID NO: 1841468 - RNA, 19 nt, Salmonella typhimurium LT2
gggaaaucucccuggcagu

SEQ ID NO: 1841469 - RNA, 18 nt, Salmonella typhimurium LT2
gggaacauuuuucagccc

SEQ ID NO: 1841470 - RNA, 23 nt, Salmonella typhimurium LT2
gggaaggggauuuuccggcgcgg

SEQ ID NO: 1841471 - RNA, 16 nt, Salmonella typhimurium LT2
gggaacuccagcaggg

SEQ ID NO: 1841472 - RNA, 24 nt, Salmonella typhimurium LT2
gggaagcacauccauguacuccug

SEQ ID NO: 1841473 - RNA, 11 nt, Salmonella typhimurium LT2
gggaagcccuu

SEQ ID NO: 1841474 - RNA, 16 nt, Salmonella typhimurium LT2
gggaagaugugccacu

SEQ ID NO: 1841475 - RNA, 16 nt, Salmonella typhimurium LT2
ggcuuuggccucagca

SEQ ID NO: 1841476 - RNA, 14 nt, Salmonella typhimurium LT2
ggcuuuauugacua

SEQ ID NO: 1841477 - RNA, 15 nt, Salmonella typhimurium LT2
ggcuuucauccaaua

SEQ ID NO: 1841478 - RNA, 17 nt, Salmonella typhimurium LT2
gggaaaagcauucugaa

SEQ ID NO: 1841479 - RNA, 20 nt, Salmonella typhimurium LT2
gggaaaaauguguugcggcc

SEQ ID NO: 1841480 - RNA, 19 nt, Salmonella typhimurium LT2
gggaaaaauuugaucugaa

SEQ ID NO: 1841481 - RNA, 12 nt, Salmonella typhimurium LT2
ggcuuuuuaauc

SEQ ID NO: 1841482 - RNA, 14 nt, Salmonella typhimurium LT2
ggcuuuuaucgaca

SEQ ID NO: 1841483 - RNA, 20 nt, Salmonella typhimurium LT2
gggaauaucuuccgggcggg

SEQ ID NO: 1841484 - RNA, 17 nt, Salmonella typhimurium LT2
gggaaguagcaaaucau

SEQ ID NO: 1841485 - RNA, 21 nt, Salmonella typhimurium LT2
gggaaguaaggcauaaugcca

SEQ ID NO: 1841486 - RNA, 17 nt, Salmonella typhimurium LT2
gggaaucuccgggaaaa

SEQ ID NO: 1841487 - RNA, 15 nt, Salmonella typhimurium LT2
gggaaucucuucacg

SEQ ID NO: 1841488 - RNA, 12 nt, Salmonella typhimurium LT2
gggacacucaag

SEQ ID NO: 1841489 - RNA, 19 nt, Salmonella typhimurium LT2
gggaccaugauuucauccc

SEQ ID NO: 1841490 - RNA, 16 nt, Salmonella typhimurium LT2
gggacggcggccagca

SEQ ID NO: 1841491 - RNA, 23 nt, Salmonella typhimurium LT2
gggacguuucgauaaccaccagc

SEQ ID NO: 1841492 - RNA, 19 nt, Salmonella typhimurium LT2
gggagacgucaaagaguuc

SEQ ID NO: 1841493 - RNA, 20 nt, Salmonella typhimurium LT2
gggagacgucaaagaguucc

SEQ ID NO: 1841494 - RNA, 16 nt, Salmonella typhimurium LT2
gggagcagacuguaaa

SEQ ID NO: 1841495 - RNA, 18 nt, Salmonella typhimurium LT2
ggggcuaauuucccccca

SEQ ID NO: 1841496 - RNA, 20 nt, Salmonella typhimurium LT2
gggggccugauggcgcugcg

SEQ ID NO: 1841497 - RNA, 18 nt, Salmonella typhimurium LT2
ggggccacaggcggcaug

SEQ ID NO: 1841498 - RNA, 16 nt, Salmonella typhimurium LT2
ggggauaaccagaaaa

SEQ ID NO: 1841499 - RNA, 19 nt, Salmonella typhimurium LT2
ggggaaacccacgaccagu

SEQ ID NO: 1841500 - RNA, 12 nt, Salmonella typhimurium LT2
gggcuuaaucag

SEQ ID NO: 1841501 - RNA, 11 nt, Salmonella typhimurium LT2
ggguaauacug

SEQ ID NO: 1841502 - RNA, 22 nt, Salmonella typhimurium LT2
ggguaaugaucagcaaaauagu

SEQ ID NO: 1841503 - RNA, 21 nt, Salmonella typhimurium LT2
ggguaggugauggugccgccg

SEQ ID NO: 1841504 - RNA, 16 nt, Salmonella typhimurium LT2
ggguauagagcaaucu

SEQ ID NO: 1841505 - RNA, 18 nt, Salmonella typhimurium LT2
ggggguucaagucccccc

SEQ ID NO: 1841506 - RNA, 22 nt, Salmonella typhimurium LT2
gggguucaauagcacaucagcc

SEQ ID NO: 1841507 - RNA, 16 nt, Salmonella typhimurium LT2
gggguucagaccagaa

SEQ ID NO: 1841508 - RNA, 14 nt, Salmonella typhimurium LT2
ggggugagcgacaa

SEQ ID NO: 1841509 - RNA, 22 nt, Salmonella typhimurium LT2
gggucacauccagacagccgac

SEQ ID NO: 1841510 - RNA, 20 nt, Salmonella typhimurium LT2
gggucaagaaaaucggccag

SEQ ID NO: 1841511 - RNA, 20 nt, Salmonella typhimurium LT2
ggguauugcuucguggcaau

SEQ ID NO: 1841512 - RNA, 23 nt, Salmonella typhimurium LT2
ggguaucccgacgcacgagaucc

SEQ ID NO: 1841513 - RNA, 17 nt, Salmonella typhimurium LT2
ggguaugcgcaaaucaa

SEQ ID NO: 1841514 - RNA, 17 nt, Salmonella typhimurium LT2
gggucaguacgcgcgua

SEQ ID NO: 1841515 - RNA, 14 nt, Salmonella typhimurium LT2
gggucaggaaacug

SEQ ID NO: 1841516 - RNA, 11 nt, Salmonella typhimurium LT2
gggucaggaac

SEQ ID NO: 1841517 - RNA, 14 nt, Salmonella typhimurium LT2
ggguccgcccggca

SEQ ID NO: 1841518 - RNA, 18 nt, Salmonella typhimurium LT2
gggucgacguugccaggc

SEQ ID NO: 1841519 - RNA, 17 nt, Salmonella typhimurium LT2
gggucgcuucggcgacc

SEQ ID NO: 1841520 - RNA, 19 nt, Salmonella typhimurium LT2
gggucguacuaaagagcgc

SEQ ID NO: 1841521 - RNA, 11 nt, Salmonella typhimurium LT2
gggucuuccag

SEQ ID NO: 1841522 - RNA, 22 nt, Salmonella typhimurium LT2
gggucuuauuucuccugcgcca

SEQ ID NO: 1841523 - RNA, 22 nt, Salmonella typhimurium LT2
gggugagcaaaggcagccaaca

SEQ ID NO: 1841524 - RNA, 21 nt, Salmonella typhimurium LT2
gggcauauucuggcggcgggu

SEQ ID NO: 1841525 - RNA, 14 nt, Salmonella typhimurium LT2
gggcaucauaagag

SEQ ID NO: 1841526 - RNA, 12 nt, Salmonella typhimurium LT2
gggcauccgccg

SEQ ID NO: 1841527 - RNA, 15 nt, Salmonella typhimurium LT2
gggcauccgccgccg

SEQ ID NO: 1841528 - RNA, 23 nt, Salmonella typhimurium LT2
gggccagaaguagcagagaaaag

SEQ ID NO: 1841529 - RNA, 17 nt, Salmonella typhimurium LT2
gggccaccugccaggcu

SEQ ID NO: 1841530 - RNA, 21 nt, Salmonella typhimurium LT2
gggccgacguaacuaucuguu

SEQ ID NO: 1841531 - RNA, 17 nt, Salmonella typhimurium LT2
gggcccguggcccaggc

SEQ ID NO: 1841532 - RNA, 12 nt, Salmonella typhimurium LT2
gggccgacagac

SEQ ID NO: 1841533 - RNA, 16 nt, Salmonella typhimurium LT2
gggccgacagacgcca

SEQ ID NO: 1841534 - RNA, 20 nt, Salmonella typhimurium LT2
gggccgugguuucuccccag

SEQ ID NO: 1841535 - RNA, 20 nt, Salmonella typhimurium LT2
gggccuuuuuaaugacuuuu

SEQ ID NO: 1841536 - RNA, 21 nt, Salmonella typhimurium LT2
gggcgaacauuccgcccagga

SEQ ID NO: 1841537 - RNA, 23 nt, Salmonella typhimurium LT2
gggcgagauguuuuaccaguaca

SEQ ID NO: 1841538 - RNA, 15 nt, Salmonella typhimurium LT2
gggcgacacgcgcgc

SEQ ID NO: 1841539 - RNA, 15 nt, Salmonella typhimurium LT2
gggcgcacagcgcca

SEQ ID NO: 1841540 - RNA, 13 nt, Salmonella typhimurium LT2
gggcgcuucgcuu

SEQ ID NO: 1841541 - RNA, 12 nt, Salmonella typhimurium LT2
gggcgcggcugg

SEQ ID NO: 1841542 - RNA, 21 nt, Salmonella typhimurium LT2
gggcgcggcugguaagagagc

SEQ ID NO: 1841543 - RNA, 20 nt, Salmonella typhimurium LT2
gggcgggauaauacguacgg

SEQ ID NO: 1841544 - RNA, 15 nt, Salmonella typhimurium LT2
gggcguccacuuucu

SEQ ID NO: 1841545 - RNA, 17 nt, Salmonella typhimurium LT2
gggcguauagccaggca

SEQ ID NO: 1841546 - RNA, 16 nt, Salmonella typhimurium LT2
gggcgguacagcaucc

SEQ ID NO: 1841547 - RNA, 15 nt, Salmonella typhimurium LT2
gggcgugacgcgcca

SEQ ID NO: 1841548 - RNA, 13 nt, Salmonella typhimurium LT2
gggcgugucccug

SEQ ID NO: 1841549 - RNA, 22 nt, Salmonella typhimurium LT2
gggcuccauagggcagggugcc

SEQ ID NO: 1841550 - RNA, 16 nt, Salmonella typhimurium LT2
gguaacauaaaagcga

SEQ ID NO: 1841551 - RNA, 19 nt, Salmonella typhimurium LT2
gguaaccuuaauuugugau

SEQ ID NO: 1841552 - RNA, 15 nt, Salmonella typhimurium LT2
gguaacgaacgcugu

SEQ ID NO: 1841553 - RNA, 21 nt, Salmonella typhimurium LT2
gguaaacgcuccggcaggcaa

SEQ ID NO: 1841554 - RNA, 11 nt, Salmonella typhimurium LT2
gguaaaucaac

SEQ ID NO: 1841555 - RNA, 22 nt, Salmonella typhimurium LT2
gguaaaauccaccacguuaccg

SEQ ID NO: 1841556 - RNA, 13 nt, Salmonella typhimurium LT2
gguaaaacgcugg

SEQ ID NO: 1841557 - RNA, 22 nt, Salmonella typhimurium LT2
gguaaaauggacuuccgcacgc

SEQ ID NO: 1841558 - RNA, 18 nt, Salmonella typhimurium LT2
ggguuuucaggaaggagc

SEQ ID NO: 1841559 - RNA, 23 nt, Salmonella typhimurium LT2
ggguuugcagaugugccucaagg

SEQ ID NO: 1841560 - RNA, 15 nt, Salmonella typhimurium LT2
gguaagcagaccggg

SEQ ID NO: 1841561 - RNA, 22 nt, Salmonella typhimurium LT2
gguaagcccauggcaggcagca

SEQ ID NO: 1841562 - RNA, 21 nt, Salmonella typhimurium LT2
gguaagccuggcauaacauug

SEQ ID NO: 1841563 - RNA, 18 nt, Salmonella typhimurium LT2
gguaagcugcggcagaau

SEQ ID NO: 1841564 - RNA, 13 nt, Salmonella typhimurium LT2
gguaaguugaaag

SEQ ID NO: 1841565 - RNA, 22 nt, Salmonella typhimurium LT2
gguaauccgacgcuucaaaucc

SEQ ID NO: 1841566 - RNA, 17 nt, Salmonella typhimurium LT2
gguaaucagaucggcaa

SEQ ID NO: 1841567 - RNA, 22 nt, Salmonella typhimurium LT2
gguaaucauuucauuaaucagu

SEQ ID NO: 1841568 - RNA, 16 nt, Salmonella typhimurium LT2
gguaaugucauccagc

SEQ ID NO: 1841569 - RNA, 15 nt, Salmonella typhimurium LT2
gguaauggucagcau

SEQ ID NO: 1841570 - RNA, 13 nt, Salmonella typhimurium LT2
ggguuaaaccagc

SEQ ID NO: 1841571 - RNA, 14 nt, Salmonella typhimurium LT2
ggguuaauggcagc

SEQ ID NO: 1841572 - RNA, 20 nt, Salmonella typhimurium LT2
gggugguuucccugaccagu

SEQ ID NO: 1841573 - RNA, 15 nt, Salmonella typhimurium LT2
ggguggcggcugcgc

SEQ ID NO: 1841574 - RNA, 15 nt, Salmonella typhimurium LT2
ggguucguaauaagg

SEQ ID NO: 1841575 - RNA, 19 nt, Salmonella typhimurium LT2
ggguucccgagcggccaaa

SEQ ID NO: 1841576 - RNA, 14 nt, Salmonella typhimurium LT2
gggugcgcagcccc

SEQ ID NO: 1841577 - RNA, 12 nt, Salmonella typhimurium LT2
gguagccaggcg

SEQ ID NO: 1841578 - RNA, 15 nt, Salmonella typhimurium LT2
gguacucaacaucau

SEQ ID NO: 1841579 - RNA, 15 nt, Salmonella typhimurium LT2
gguagacgcaccaga

SEQ ID NO: 1841580 - RNA, 17 nt, Salmonella typhimurium LT2
gguacuucuccugccag

SEQ ID NO: 1841581 - RNA, 22 nt, Salmonella typhimurium LT2
gguacuuuucauccacagcgcc

SEQ ID NO: 1841582 - RNA, 16 nt, Salmonella typhimurium LT2
gguacucuuccagcug

SEQ ID NO: 1841583 - RNA, 15 nt, Salmonella typhimurium LT2
gguacggccagcgcg

SEQ ID NO: 1841584 - RNA, 15 nt, Salmonella typhimurium LT2
gguacgacgcggcuc

SEQ ID NO: 1841585 - RNA, 13 nt, Salmonella typhimurium LT2
gguacgauuucau

SEQ ID NO: 1841586 - RNA, 21 nt, Salmonella typhimurium LT2
gguacacucucggguacacaa

SEQ ID NO: 1841587 - RNA, 21 nt, Salmonella typhimurium LT2
gguaauuuucaccuccgggug

SEQ ID NO: 1841588 - RNA, 14 nt, Salmonella typhimurium LT2
gguacaggccgccg

SEQ ID NO: 1841589 - RNA, 14 nt, Salmonella typhimurium LT2
gguauccagcagaa

SEQ ID NO: 1841590 - RNA, 14 nt, Salmonella typhimurium LT2
gguauccagccagg

SEQ ID NO: 1841591 - RNA, 19 nt, Salmonella typhimurium LT2
gguauccauugccagauaa

SEQ ID NO: 1841592 - RNA, 15 nt, Salmonella typhimurium LT2
gguauccuccugcca

SEQ ID NO: 1841593 - RNA, 19 nt, Salmonella typhimurium LT2
gguaucauugcugcuguau

SEQ ID NO: 1841594 - RNA, 14 nt, Salmonella typhimurium LT2
gguaucagcgcguu

SEQ ID NO: 1841595 - RNA, 15 nt, Salmonella typhimurium LT2
gguauaggccaggcu

SEQ ID NO: 1841596 - RNA, 16 nt, Salmonella typhimurium LT2
gguauaaaaacugcca

SEQ ID NO: 1841597 - RNA, 22 nt, Salmonella typhimurium LT2
gguauaaaaacugccagggcca

SEQ ID NO: 1841598 - RNA, 16 nt, Salmonella typhimurium LT2
gguaguaauauuaaaa

SEQ ID NO: 1841599 - RNA, 19 nt, Salmonella typhimurium LT2
gguagucacggagagucgc

SEQ ID NO: 1841600 - RNA, 19 nt, Salmonella typhimurium LT2
gguaguggcgaucagcggc

SEQ ID NO: 1841601 - RNA, 19 nt, Salmonella typhimurium LT2
gguauucguuaccagcauc

SEQ ID NO: 1841602 - RNA, 21 nt, Salmonella typhimurium LT2
gguauugcccggcuguaaugg

SEQ ID NO: 1841603 - RNA, 13 nt, Salmonella typhimurium LT2
gguauucaucgug

SEQ ID NO: 1841604 - RNA, 18 nt, Salmonella typhimurium LT2
gguauuucugaaaaaccg

SEQ ID NO: 1841605 - RNA, 15 nt, Salmonella typhimurium LT2
ggucaaacaaaucau

SEQ ID NO: 1841606 - RNA, 20 nt, Salmonella typhimurium LT2
ggucaaaaaagcgacgcugu

SEQ ID NO: 1841607 - RNA, 19 nt, Salmonella typhimurium LT2
gguaugccuuccagaaaua

SEQ ID NO: 1841608 - RNA, 17 nt, Salmonella typhimurium LT2
gguauguauuuuaucca

SEQ ID NO: 1841609 - RNA, 13 nt, Salmonella typhimurium LT2
ggucaaucaucag

SEQ ID NO: 1841610 - RNA, 15 nt, Salmonella typhimurium LT2
ggucaaugugcucaa

SEQ ID NO: 1841611 - RNA, 23 nt, Salmonella typhimurium LT2
ggucacacuuaccgggcaucuga

SEQ ID NO: 1841612 - RNA, 17 nt, Salmonella typhimurium LT2
ggucagcauuucaucca

SEQ ID NO: 1841613 - RNA, 15 nt, Salmonella typhimurium LT2
ggucagcagaaacug

SEQ ID NO: 1841614 - RNA, 16 nt, Salmonella typhimurium LT2
ggucagcagaaacugg

SEQ ID NO: 1841615 - RNA, 23 nt, Salmonella typhimurium LT2
ggucagcauuucauccauuaaac

SEQ ID NO: 1841616 - RNA, 22 nt, Salmonella typhimurium LT2
ggucagggugaauaccagcggc

SEQ ID NO: 1841617 - RNA, 15 nt, Salmonella typhimurium LT2
ggucaguacgcgcgu

SEQ ID NO: 1841618 - RNA, 24 nt, Salmonella typhimurium LT2
ggucaguagcguucucuccaguuc

SEQ ID NO: 1841619 - RNA, 12 nt, Salmonella typhimurium LT2
ggucaggcagca

SEQ ID NO: 1841620 - RNA, 14 nt, Salmonella typhimurium LT2
ggucaggaaacugg

SEQ ID NO: 1841621 - RNA, 19 nt, Salmonella typhimurium LT2
gguccggcgcuaaccagcg

SEQ ID NO: 1841622 - RNA, 19 nt, Salmonella typhimurium LT2
gguccguuuucgcccccag

SEQ ID NO: 1841623 - RNA, 21 nt, Salmonella typhimurium LT2
ggucaugcggauguaaacgga

SEQ ID NO: 1841624 - RNA, 17 nt, Salmonella typhimurium LT2
ggucaucaccuccagca

SEQ ID NO: 1841625 - RNA, 18 nt, Salmonella typhimurium LT2
ggucaucaacuggcggcu

SEQ ID NO: 1841626 - RNA, 13 nt, Salmonella typhimurium LT2
ggucguaaacacg

SEQ ID NO: 1841627 - RNA, 19 nt, Salmonella typhimurium LT2
ggucguacuaaagagcgcc

SEQ ID NO: 1841628 - RNA, 21 nt, Salmonella typhimurium LT2
ggucucucgugcaggccggau

SEQ ID NO: 1841629 - RNA, 19 nt, Salmonella typhimurium LT2
ggucucauagcgccccagu

SEQ ID NO: 1841630 - RNA, 20 nt, Salmonella typhimurium LT2
ggucucuucaugcauaaccg

SEQ ID NO: 1841631 - RNA, 21 nt, Salmonella typhimurium LT2
ggugaaaaacaucggcaaagc

SEQ ID NO: 1841632 - RNA, 19 nt, Salmonella typhimurium LT2
ggugaaacguguuuauccc

SEQ ID NO: 1841633 - RNA, 20 nt, Salmonella typhimurium LT2
ggugaaaaugaaaaauccgc

SEQ ID NO: 1841634 - RNA, 22 nt, Salmonella typhimurium LT2
ggucuggauuacaaaaauagac

SEQ ID NO: 1841635 - RNA, 16 nt, Salmonella typhimurium LT2
ggucgcguccggggcc

SEQ ID NO: 1841636 - RNA, 15 nt, Salmonella typhimurium LT2
ggucgcuucccagug

SEQ ID NO: 1841637 - RNA, 16 nt, Salmonella typhimurium LT2
ggucgcuucggcgacc

SEQ ID NO: 1841638 - RNA, 13 nt, Salmonella typhimurium LT2
ggucgccagcgcc

SEQ ID NO: 1841639 - RNA, 15 nt, Salmonella typhimurium LT2
gguccugcggugcuu

SEQ ID NO: 1841640 - RNA, 17 nt, Salmonella typhimurium LT2
ggaacaagcaaaccuau

SEQ ID NO: 1841641 - RNA, 21 nt, Salmonella typhimurium LT2
ggaacaacgcaacacaggccg

SEQ ID NO: 1841642 - RNA, 16 nt, Salmonella typhimurium LT2
ggaacaacucucccaa

SEQ ID NO: 1841643 - RNA, 19 nt, Salmonella typhimurium LT2
ggaacagcggagcgaagaa

SEQ ID NO: 1841644 - RNA, 18 nt, Salmonella typhimurium LT2
ggaacacggcaugaagca

SEQ ID NO: 1841645 - RNA, 20 nt, Salmonella typhimurium LT2
ggaacacggcaugaagcagc

SEQ ID NO: 1841646 - RNA, 15 nt, Salmonella typhimurium LT2
ggaacagggccgcau

SEQ ID NO: 1841647 - RNA, 16 nt, Salmonella typhimurium LT2
ggaacaggccaaaccc

SEQ ID NO: 1841648 - RNA, 14 nt, Salmonella typhimurium LT2
ggaacaucagccag

SEQ ID NO: 1841649 - RNA, 14 nt, Salmonella typhimurium LT2
ggaacaucagcauu

SEQ ID NO: 1841650 - RNA, 16 nt, Salmonella typhimurium LT2
ggaacaucagccagca

SEQ ID NO: 1841651 - RNA, 13 nt, Salmonella typhimurium LT2
ggaacccagcaaa

SEQ ID NO: 1841652 - RNA, 14 nt, Salmonella typhimurium LT2
ggaacgucaucauu

SEQ ID NO: 1841653 - RNA, 13 nt, Salmonella typhimurium LT2
ggaagcggcuggg

SEQ ID NO: 1841654 - RNA, 20 nt, Salmonella typhimurium LT2
ggaagcggaacugaugauca

SEQ ID NO: 1841655 - RNA, 14 nt, Salmonella typhimurium LT2
ggacacccgcagcc

SEQ ID NO: 1841656 - RNA, 23 nt, Salmonella typhimurium LT2
ggacacggcgucaaauccaccgc

SEQ ID NO: 1841657 - RNA, 15 nt, Salmonella typhimurium LT2
ggaaguccuucuccu

SEQ ID NO: 1841658 - RNA, 20 nt, Salmonella typhimurium LT2
ggaagucagcuuccuguacg

SEQ ID NO: 1841659 - RNA, 21 nt, Salmonella typhimurium LT2
ggaaguuaccgcgccaggcgg

SEQ ID NO: 1841660 - RNA, 22 nt, Salmonella typhimurium LT2
ggaaguuaccgcgccaggcggc

SEQ ID NO: 1841661 - RNA, 21 nt, Salmonella typhimurium LT2
ggaauaacaucguaaaucaaa

SEQ ID NO: 1841662 - RNA, 17 nt, Salmonella typhimurium LT2
ggaauaaccggugccaa

SEQ ID NO: 1841663 - RNA, 23 nt, Salmonella typhimurium LT2
ggaauguuccccguugagaaugg

SEQ ID NO: 1841664 - RNA, 20 nt, Salmonella typhimurium LT2
ggacagacuucauuuuccac

SEQ ID NO: 1841665 - RNA, 12 nt, Salmonella typhimurium LT2
ggacagaaaaaa

SEQ ID NO: 1841666 - RNA, 20 nt, Salmonella typhimurium LT2
ggaccggcaaucgccugcaa

SEQ ID NO: 1841667 - RNA, 14 nt, Salmonella typhimurium LT2
ggacccugaccaca

SEQ ID NO: 1841668 - RNA, 23 nt, Salmonella typhimurium LT2
ggacccguggcugcgccugcgcg

SEQ ID NO: 1841669 - RNA, 16 nt, Salmonella typhimurium LT2
aaaggcuuuaaagcag

SEQ ID NO: 1841670 - RNA, 16 nt, Salmonella typhimurium LT2
aaagggaaaagccauu

SEQ ID NO: 1841671 - RNA, 17 nt, Salmonella typhimurium LT2
aaaggcuuuuuaaucaa

SEQ ID NO: 1841672 - RNA, 21 nt, Salmonella typhimurium LT2
aaaggggccacaggcggcaug

SEQ ID NO: 1841673 - RNA, 20 nt, Salmonella typhimurium LT2
ggacgcuuuuauccggcgcu

SEQ ID NO: 1841674 - RNA, 13 nt, Salmonella typhimurium LT2
aaaggguauacaa

SEQ ID NO: 1841675 - RNA, 19 nt, Salmonella typhimurium LT2
aaaggggggcuagcugugg

SEQ ID NO: 1841676 - RNA, 13 nt, Salmonella typhimurium LT2
ggagacgggcgga

SEQ ID NO: 1841677 - RNA, 12 nt, Salmonella typhimurium LT2
ggagagagccug

SEQ ID NO: 1841678 - RNA, 19 nt, Salmonella typhimurium LT2
ggagacgucaaagaguucc

SEQ ID NO: 1841679 - RNA, 19 nt, Salmonella typhimurium LT2
ggagacuucgcugaaaaug

SEQ ID NO: 1841680 - RNA, 18 nt, Salmonella typhimurium LT2
ggagaggcguucaugccu

SEQ ID NO: 1841681 - RNA, 17 nt, Salmonella typhimurium LT2
ggagauuaacagcgcga

SEQ ID NO: 1841682 - RNA, 17 nt, Salmonella typhimurium LT2
ggagauuucauccucuu

SEQ ID NO: 1841683 - RNA, 22 nt, Salmonella typhimurium LT2
aaaguaaccaacgucauuaaaa

SEQ ID NO: 1841684 - RNA, 22 nt, Salmonella typhimurium LT2
aaaggucuuucuguguugcuca

SEQ ID NO: 1841685 - RNA, 20 nt, Salmonella typhimurium LT2
aaaggucaucacaucccagc

SEQ ID NO: 1841686 - RNA, 16 nt, Salmonella typhimurium LT2
aaagggugaaaucacg

SEQ ID NO: 1841687 - RNA, 13 nt, Salmonella typhimurium LT2
ggaucaagccccc

SEQ ID NO: 1841688 - RNA, 14 nt, Salmonella typhimurium LT2
ggaucaagcccccg

SEQ ID NO: 1841689 - RNA, 13 nt, Salmonella typhimurium LT2
ggauauucauugc

SEQ ID NO: 1841690 - RNA, 21 nt, Salmonella typhimurium LT2
ggaucaaaaaggugagcauug

SEQ ID NO: 1841691 - RNA, 13 nt, Salmonella typhimurium LT2
ggauauggcaaaa

SEQ ID NO: 1841692 - RNA, 16 nt, Salmonella typhimurium LT2
ggauauguuugacaag

SEQ ID NO: 1841693 - RNA, 17 nt, Salmonella typhimurium LT2
ggauauguuugacaagc

SEQ ID NO: 1841694 - RNA, 16 nt, Salmonella typhimurium LT2
ggauagaguuaaaagg

SEQ ID NO: 1841695 - RNA, 17 nt, Salmonella typhimurium LT2
ggauagagaucuuccgc

SEQ ID NO: 1841696 - RNA, 17 nt, Salmonella typhimurium LT2
ggauaccguccaccagc

SEQ ID NO: 1841697 - RNA, 17 nt, Salmonella typhimurium LT2
ggauacagcgccgcgca

SEQ ID NO: 1841698 - RNA, 12 nt, Salmonella typhimurium LT2
ggauaaaacaga

SEQ ID NO: 1841699 - RNA, 14 nt, Salmonella typhimurium LT2
ggauaaagaccggc

SEQ ID NO: 1841700 - RNA, 14 nt, Salmonella typhimurium LT2
ggauaaaucaucau

SEQ ID NO: 1841701 - RNA, 15 nt, Salmonella typhimurium LT2
ggauaaaucaucauc

SEQ ID NO: 1841702 - RNA, 22 nt, Salmonella typhimurium LT2
ggaguugaugguuauuccuugu

SEQ ID NO: 1841703 - RNA, 18 nt, Salmonella typhimurium LT2
ggagccgccuggccuguc

SEQ ID NO: 1841704 - RNA, 16 nt, Salmonella typhimurium LT2
ggagccaaaagaagug

SEQ ID NO: 1841705 - RNA, 16 nt, Salmonella typhimurium LT2
ggaucaugauuucgac

SEQ ID NO: 1841706 - RNA, 17 nt, Salmonella typhimurium LT2
ggaucaguaacaggacg

SEQ ID NO: 1841707 - RNA, 22 nt, Salmonella typhimurium LT2
ggaucgucucugagaucaaaca

SEQ ID NO: 1841708 - RNA, 16 nt, Salmonella typhimurium LT2
ggaucgucggucagau

SEQ ID NO: 1841709 - RNA, 15 nt, Salmonella typhimurium LT2
ggaugaaacgacaca

SEQ ID NO: 1841710 - RNA, 17 nt, Salmonella typhimurium LT2
ggaugaccaguuaagca

SEQ ID NO: 1841711 - RNA, 13 nt, Salmonella typhimurium LT2
ggaucucaccacu

SEQ ID NO: 1841712 - RNA, 23 nt, Salmonella typhimurium LT2
ggaucguucugcugauaauacug

SEQ ID NO: 1841713 - RNA, 11 nt, Salmonella typhimurium LT2
ggauguauuuu

SEQ ID NO: 1841714 - RNA, 22 nt, Salmonella typhimurium LT2
aaaguacaucauuggcccggcg

SEQ ID NO: 1841715 - RNA, 21 nt, Salmonella typhimurium LT2
aaaguacaaugcaaagaaaaa

SEQ ID NO: 1841716 - RNA, 17 nt, Salmonella typhimurium LT2
ggaugcgcaaucaccca

SEQ ID NO: 1841717 - RNA, 15 nt, Salmonella typhimurium LT2
ggaugccaaccaccg

SEQ ID NO: 1841718 - RNA, 19 nt, Salmonella typhimurium LT2
ggaugcaucaugcuaaaag

SEQ ID NO: 1841719 - RNA, 11 nt, Salmonella typhimurium LT2
ggauggcggcu

SEQ ID NO: 1841720 - RNA, 14 nt, Salmonella typhimurium LT2
ggauggagcggcgc

SEQ ID NO: 1841721 - RNA, 17 nt, Salmonella typhimurium LT2
ggauggcaguacagggc

SEQ ID NO: 1841722 - RNA, 13 nt, Salmonella typhimurium LT2
ggauggcaaaaac

SEQ ID NO: 1841723 - RNA, 16 nt, Salmonella typhimurium LT2
ggauguggugcggcuu

SEQ ID NO: 1841724 - RNA, 12 nt, Salmonella typhimurium LT2
ggauuaucagaa

SEQ ID NO: 1841725 - RNA, 15 nt, Salmonella typhimurium LT2
ggauuacgacccaca

SEQ ID NO: 1841726 - RNA, 20 nt, Salmonella typhimurium LT2
ggcaaaaauccuucuuccau

SEQ ID NO: 1841727 - RNA, 21 nt, Salmonella typhimurium LT2
ggcaaaacgccgcagaaaaug

SEQ ID NO: 1841728 - RNA, 22 nt, Salmonella typhimurium LT2
ggcaaaaacggcgcuuuuaaaa

SEQ ID NO: 1841729 - RNA, 17 nt, Salmonella typhimurium LT2
ggcaagaauuucaauca

SEQ ID NO: 1841730 - RNA, 14 nt, Salmonella typhimurium LT2
ggccaguuuccuga

SEQ ID NO: 1841731 - RNA, 19 nt, Salmonella typhimurium LT2
ggccaguuuccugacccgc

SEQ ID NO: 1841732 - RNA, 21 nt, Salmonella typhimurium LT2
ggccaucuuccagcaucagca

SEQ ID NO: 1841733 - RNA, 16 nt, Salmonella typhimurium LT2
ggccaucuggcguugc

SEQ ID NO: 1841734 - RNA, 17 nt, Salmonella typhimurium LT2
ggccaucuuccagcauc

SEQ ID NO: 1841735 - RNA, 13 nt, Salmonella typhimurium LT2
ggcccacccauuc

SEQ ID NO: 1841736 - RNA, 21 nt, Salmonella typhimurium LT2
ggccaggcgugauugagcaga

SEQ ID NO: 1841737 - RNA, 15 nt, Salmonella typhimurium LT2
ggccagcucucgccg

SEQ ID NO: 1841738 - RNA, 15 nt, Salmonella typhimurium LT2
ggccagauggcaaac

SEQ ID NO: 1841739 - RNA, 23 nt, Salmonella typhimurium LT2
ggcccccuguuccagggcuucca

SEQ ID NO: 1841740 - RNA, 16 nt, Salmonella typhimurium LT2
ggcccccaucgccagc

SEQ ID NO: 1841741 - RNA, 15 nt, Salmonella typhimurium LT2
ggccccaauuugcug

SEQ ID NO: 1841742 - RNA, 17 nt, Salmonella typhimurium LT2
ggcccagcguacugcca

SEQ ID NO: 1841743 - RNA, 20 nt, Salmonella typhimurium LT2
ggcccagcuaaaccacggaa

SEQ ID NO: 1841744 - RNA, 17 nt, Salmonella typhimurium LT2
ggcccagcgcgguggcg

SEQ ID NO: 1841745 - RNA, 23 nt, Salmonella typhimurium LT2
ggcccacguaagugggaucaggu

SEQ ID NO: 1841746 - RNA, 17 nt, Salmonella typhimurium LT2
ggcccgccagcacagca

SEQ ID NO: 1841747 - RNA, 22 nt, Salmonella typhimurium LT2
ggcccggcaggcaucgcgccgc

SEQ ID NO: 1841748 - RNA, 14 nt, Salmonella typhimurium LT2
ggcccgcggcgacg

SEQ ID NO: 1841749 - RNA, 18 nt, Salmonella typhimurium LT2
aaagugaaaaaacggaac

SEQ ID NO: 1841750 - RNA, 23 nt, Salmonella typhimurium LT2
aaagucuucguuauagauaagaa

SEQ ID NO: 1841751 - RNA, 23 nt, Salmonella typhimurium LT2
ggcccgauaagcgccgcgccauc

SEQ ID NO: 1841752 - RNA, 16 nt, Salmonella typhimurium LT2
ggcccgauaagcgcug

SEQ ID NO: 1841753 - RNA, 21 nt, Salmonella typhimurium LT2
aaagugauuauaaaucaauag

SEQ ID NO: 1841754 - RNA, 14 nt, Salmonella typhimurium LT2
aaagugauucacuu

SEQ ID NO: 1841755 - RNA, 20 nt, Salmonella typhimurium LT2
ggccgaaggaagauagcggg

SEQ ID NO: 1841756 - RNA, 17 nt, Salmonella typhimurium LT2
ggcccguggcccaggcc

SEQ ID NO: 1841757 - RNA, 15 nt, Salmonella typhimurium LT2
ggcccguagggugag

SEQ ID NO: 1841758 - RNA, 21 nt, Salmonella typhimurium LT2
ggcccggugugccgcuugcca

SEQ ID NO: 1841759 - RNA, 20 nt, Salmonella typhimurium LT2
ggcccgguaagcgcagcgcc

SEQ ID NO: 1841760 - RNA, 22 nt, Salmonella typhimurium LT2
ggcccgguaagcacaacgcauu

SEQ ID NO: 1841761 - RNA, 22 nt, Salmonella typhimurium LT2
ggcagccggauuuuaaauuggu

SEQ ID NO: 1841762 - RNA, 15 nt, Salmonella typhimurium LT2
ggcagccgacagcgu

SEQ ID NO: 1841763 - RNA, 23 nt, Salmonella typhimurium LT2
ggcagccaugcuauucagcaguu

SEQ ID NO: 1841764 - RNA, 13 nt, Salmonella typhimurium LT2
ggcagccaggaac

SEQ ID NO: 1841765 - RNA, 15 nt, Salmonella typhimurium LT2
ggcaagggcaagggc

SEQ ID NO: 1841766 - RNA, 19 nt, Salmonella typhimurium LT2
ggcaagggcaagggcaagg

SEQ ID NO: 1841767 - RNA, 11 nt, Salmonella typhimurium LT2
ggcagaauaaa

SEQ ID NO: 1841768 - RNA, 19 nt, Salmonella typhimurium LT2
ggcagacaaaacauaucca

SEQ ID NO: 1841769 - RNA, 14 nt, Salmonella typhimurium LT2
ggcagacggcuggg

SEQ ID NO: 1841770 - RNA, 19 nt, Salmonella typhimurium LT2
ggcagacguuuaucggcca

SEQ ID NO: 1841771 - RNA, 22 nt, Salmonella typhimurium LT2
ggcagacguuuaucggccagca

SEQ ID NO: 1841772 - RNA, 19 nt, Salmonella typhimurium LT2
aaaguaguuggugggugau

SEQ ID NO: 1841773 - RNA, 12 nt, Salmonella typhimurium LT2
aaaguagccaau

SEQ ID NO: 1841774 - RNA, 21 nt, Salmonella typhimurium LT2
ggcagcgcaacgcuuaauccc

SEQ ID NO: 1841775 - RNA, 11 nt, Salmonella typhimurium LT2
ggcagcucucc

SEQ ID NO: 1841776 - RNA, 15 nt, Salmonella typhimurium LT2
ggcagcucuuucaac

SEQ ID NO: 1841777 - RNA, 19 nt, Salmonella typhimurium LT2
ggcaggaaauccagcagaa

SEQ ID NO: 1841778 - RNA, 13 nt, Salmonella typhimurium LT2
ggcagcuuacugu

SEQ ID NO: 1841779 - RNA, 15 nt, Salmonella typhimurium LT2
ggcagcuuacugugc

SEQ ID NO: 1841780 - RNA, 15 nt, Salmonella typhimurium LT2
ggcaggccuaacaca

SEQ ID NO: 1841781 - RNA, 16 nt, Salmonella typhimurium LT2
ggcaggcauggccaau

SEQ ID NO: 1841782 - RNA, 14 nt, Salmonella typhimurium LT2
ggcaggcaaaaaga

SEQ ID NO: 1841783 - RNA, 17 nt, Salmonella typhimurium LT2
ggcaggaugaaugacug

SEQ ID NO: 1841784 - RNA, 21 nt, Salmonella typhimurium LT2
ggcaggaugaaugacugucca

SEQ ID NO: 1841785 - RNA, 15 nt, Salmonella typhimurium LT2
ggcaggcagcgccag

SEQ ID NO: 1841786 - RNA, 15 nt, Salmonella typhimurium LT2
ggcaguaagccagcg

SEQ ID NO: 1841787 - RNA, 16 nt, Salmonella typhimurium LT2
ggcaucauaaaaggca

SEQ ID NO: 1841788 - RNA, 13 nt, Salmonella typhimurium LT2
ggcaucacgccgg

SEQ ID NO: 1841789 - RNA, 22 nt, Salmonella typhimurium LT2
ggcaguaaaaagaaagcugccg

SEQ ID NO: 1841790 - RNA, 19 nt, Salmonella typhimurium LT2
ggcaggucugauaaaaaug

SEQ ID NO: 1841791 - RNA, 19 nt, Salmonella typhimurium LT2
aaagucaacugcucuacca

SEQ ID NO: 1841792 - RNA, 14 nt, Salmonella typhimurium LT2
aaagucaguuuuca

SEQ ID NO: 1841793 - RNA, 22 nt, Salmonella typhimurium LT2
ggcaugcguugaaaaccugcaa

SEQ ID NO: 1841794 - RNA, 23 nt, Salmonella typhimurium LT2
aaaguauuguuuuuauguuaaaa

SEQ ID NO: 1841795 - RNA, 18 nt, Salmonella typhimurium LT2
ggcaucguagucaggcag

SEQ ID NO: 1841796 - RNA, 20 nt, Salmonella typhimurium LT2
ggcaucucaucuugcaagaa

SEQ ID NO: 1841797 - RNA, 15 nt, Salmonella typhimurium LT2
ggcauugcagcgcgu

SEQ ID NO: 1841798 - RNA, 19 nt, Salmonella typhimurium LT2
ggcauucgaauccuccugu

SEQ ID NO: 1841799 - RNA, 17 nt, Salmonella typhimurium LT2
ggcauuaauauccagug

SEQ ID NO: 1841800 - RNA, 21 nt, Salmonella typhimurium LT2
ggccaagcgccuguucaacau

SEQ ID NO: 1841801 - RNA, 15 nt, Salmonella typhimurium LT2
ggcauuucaggcacu

SEQ ID NO: 1841802 - RNA, 13 nt, Salmonella typhimurium LT2
ggccaaucaaccg

SEQ ID NO: 1841803 - RNA, 20 nt, Salmonella typhimurium LT2
ggccagaaguagcagagaaa

SEQ ID NO: 1841804 - RNA, 13 nt, Salmonella typhimurium LT2
ggccagacaggcu

SEQ ID NO: 1841805 - RNA, 23 nt, Salmonella typhimurium LT2
ggccacgaauuugucccuguucc

SEQ ID NO: 1841806 - RNA, 20 nt, Salmonella typhimurium LT2
gcuggcaaaacgcauccagc

SEQ ID NO: 1841807 - RNA, 15 nt, Salmonella typhimurium LT2
gcuggcacguucucg

SEQ ID NO: 1841808 - RNA, 17 nt, Salmonella typhimurium LT2
gcuggucgccgcccauc

SEQ ID NO: 1841809 - RNA, 19 nt, Salmonella typhimurium LT2
gcuggucgccgcccaucgg

SEQ ID NO: 1841810 - RNA, 15 nt, Salmonella typhimurium LT2
gcuggugaucuggcc

SEQ ID NO: 1841811 - RNA, 18 nt, Salmonella typhimurium LT2
aaaggaauaccugcgcuu

SEQ ID NO: 1841812 - RNA, 16 nt, Salmonella typhimurium LT2
aaaggagccuuacggc

SEQ ID NO: 1841813 - RNA, 19 nt, Salmonella typhimurium LT2
gcuggugccaaucuccagc

SEQ ID NO: 1841814 - RNA, 16 nt, Salmonella typhimurium LT2
gcuuaaaaaauccugc

SEQ ID NO: 1841815 - RNA, 18 nt, Salmonella typhimurium LT2
gcuuacacagacugcuug

SEQ ID NO: 1841816 - RNA, 21 nt, Salmonella typhimurium LT2
gcuuaauacgcagaucuuuuu

SEQ ID NO: 1841817 - RNA, 19 nt, Salmonella typhimurium LT2
gcuuaagccagccaaagcu

SEQ ID NO: 1841818 - RNA, 12 nt, Salmonella typhimurium LT2
gcuuaaacagaa

SEQ ID NO: 1841819 - RNA, 13 nt, Salmonella typhimurium LT2
gcuuaaacagaau

SEQ ID NO: 1841820 - RNA, 22 nt, Salmonella typhimurium LT2
gcuguccagauagggccaggcg

SEQ ID NO: 1841821 - RNA, 21 nt, Salmonella typhimurium LT2
gcuguccagauagggccaggc

SEQ ID NO: 1841822 - RNA, 14 nt, Salmonella typhimurium LT2
gcuguccagucaaa

SEQ ID NO: 1841823 - RNA, 16 nt, Salmonella typhimurium LT2
gcugucaucaaugagc

SEQ ID NO: 1841824 - RNA, 16 nt, Salmonella typhimurium LT2
gcuguguccaggucau

SEQ ID NO: 1841825 - RNA, 19 nt, Salmonella typhimurium LT2
gcuguuaaaaccggcugcc

SEQ ID NO: 1841826 - RNA, 13 nt, Salmonella typhimurium LT2
gcuguuccuggug

SEQ ID NO: 1841827 - RNA, 18 nt, Salmonella typhimurium LT2
gcuguugaggaaauucug

SEQ ID NO: 1841828 - RNA, 12 nt, Salmonella typhimurium LT2
gcuguucaccac

SEQ ID NO: 1841829 - RNA, 18 nt, Salmonella typhimurium LT2
gcuguuaccggacagcac

SEQ ID NO: 1841830 - RNA, 19 nt, Salmonella typhimurium LT2
gcuguuacgcggucuuuua

SEQ ID NO: 1841831 - RNA, 23 nt, Salmonella typhimurium LT2
gcuguuacgcggucuuuuaaaag

SEQ ID NO: 1841832 - RNA, 18 nt, Salmonella typhimurium LT2
gcuguuaguaaacagcau

SEQ ID NO: 1841833 - RNA, 13 nt, Salmonella typhimurium LT2
gcuucaccucagc

SEQ ID NO: 1841834 - RNA, 20 nt, Salmonella typhimurium LT2
gcuucacgaagucuggcugc

SEQ ID NO: 1841835 - RNA, 17 nt, Salmonella typhimurium LT2
gcuucacuaacugguac

SEQ ID NO: 1841836 - RNA, 16 nt, Salmonella typhimurium LT2
gcuucagccacuggcu

SEQ ID NO: 1841837 - RNA, 14 nt, Salmonella typhimurium LT2
gcuucacgccacag

SEQ ID NO: 1841838 - RNA, 11 nt, Salmonella typhimurium LT2
gcuucacgcca

SEQ ID NO: 1841839 - RNA, 17 nt, Salmonella typhimurium LT2
gcuucacgagcggucag

SEQ ID NO: 1841840 - RNA, 14 nt, Salmonella typhimurium LT2
gcuucaacagcggc

SEQ ID NO: 1841841 - RNA, 14 nt, Salmonella typhimurium LT2
gcuucaaccuccug

SEQ ID NO: 1841842 - RNA, 18 nt, Salmonella typhimurium LT2
gcuuaucugaccaugcca

SEQ ID NO: 1841843 - RNA, 20 nt, Salmonella typhimurium LT2
gcuucaaaaagcgcgcggcu

SEQ ID NO: 1841844 - RNA, 22 nt, Salmonella typhimurium LT2
gcuucaaaaagcgcgcggcugc

SEQ ID NO: 1841845 - RNA, 15 nt, Salmonella typhimurium LT2
gcuuaguaggcuggc

SEQ ID NO: 1841846 - RNA, 12 nt, Salmonella typhimurium LT2
gcuuagcuuccc

SEQ ID NO: 1841847 - RNA, 17 nt, Salmonella typhimurium LT2
gcuuauccggccugcac

SEQ ID NO: 1841848 - RNA, 20 nt, Salmonella typhimurium LT2
gcuuaucacguagccagagc

SEQ ID NO: 1841849 - RNA, 16 nt, Salmonella typhimurium LT2
gcuuauccggccuaca

SEQ ID NO: 1841850 - RNA, 20 nt, Salmonella typhimurium LT2
gcuuauccagccacuguucg

SEQ ID NO: 1841851 - RNA, 17 nt, Salmonella typhimurium LT2
gcuuacaggcacgccug

SEQ ID NO: 1841852 - RNA, 15 nt, Salmonella typhimurium LT2
gcuuacaguuuaucu

SEQ ID NO: 1841853 - RNA, 22 nt, Salmonella typhimurium LT2
gcuuaccgggucuggucaggua

SEQ ID NO: 1841854 - RNA, 19 nt, Salmonella typhimurium LT2
gcuuaccguaucccaccau

SEQ ID NO: 1841855 - RNA, 16 nt, Salmonella typhimurium LT2
gcuuacggccaugggu

SEQ ID NO: 1841856 - RNA, 18 nt, Salmonella typhimurium LT2
gcuuaccuuguucuucca

SEQ ID NO: 1841857 - RNA, 22 nt, Salmonella typhimurium LT2
gcuuacgaacugcggcuuuuuc

SEQ ID NO: 1841858 - RNA, 23 nt, Salmonella typhimurium LT2
gcuuacuuuccaaaauccaggga

SEQ ID NO: 1841859 - RNA, 16 nt, Salmonella typhimurium LT2
gcuuacggcuauucuu

SEQ ID NO: 1841860 - RNA, 21 nt, Salmonella typhimurium LT2
gcuuacuuuccaaaauccagg

SEQ ID NO: 1841861 - RNA, 15 nt, Salmonella typhimurium LT2
gcuuccgcauucugg

SEQ ID NO: 1841862 - RNA, 20 nt, Salmonella typhimurium LT2
gcuuccuguuuaugacccug

SEQ ID NO: 1841863 - RNA, 13 nt, Salmonella typhimurium LT2
gcuuccuggaugu

SEQ ID NO: 1841864 - RNA, 12 nt, Salmonella typhimurium LT2
gcuuccagcaug

SEQ ID NO: 1841865 - RNA, 18 nt, Salmonella typhimurium LT2
gcuucccgaugccagcaa

SEQ ID NO: 1841866 - RNA, 19 nt, Salmonella typhimurium LT2
gcuucccacagucggcgaa

SEQ ID NO: 1841867 - RNA, 15 nt, Salmonella typhimurium LT2
gcuucccaaaaggaa

SEQ ID NO: 1841868 - RNA, 21 nt, Salmonella typhimurium LT2
gcuucaucauucauccagacc

SEQ ID NO: 1841869 - RNA, 19 nt, Salmonella typhimurium LT2
gcuuccacgcacgccggcc

SEQ ID NO: 1841870 - RNA, 20 nt, Salmonella typhimurium LT2
gcuuccacgcacgccggccc

SEQ ID NO: 1841871 - RNA, 20 nt, Salmonella typhimurium LT2
gcuuccacccgggaagcccu

SEQ ID NO: 1841872 - RNA, 18 nt, Salmonella typhimurium LT2
gcuucagcccgaagaagc

SEQ ID NO: 1841873 - RNA, 16 nt, Salmonella typhimurium LT2
gcuucagcggcgcguu

SEQ ID NO: 1841874 - RNA, 22 nt, Salmonella typhimurium LT2
gcuucaggcgggguuaacugcu

SEQ ID NO: 1841875 - RNA, 15 nt, Salmonella typhimurium LT2
gcuucauaucgccau

SEQ ID NO: 1841876 - RNA, 20 nt, Salmonella typhimurium LT2
gcuucauaucgcccagcagc

SEQ ID NO: 1841877 - RNA, 17 nt, Salmonella typhimurium LT2
gcuucaucaccaucgcc

SEQ ID NO: 1841878 - RNA, 19 nt, Salmonella typhimurium LT2
gcuucggugaucuccucgc

SEQ ID NO: 1841879 - RNA, 15 nt, Salmonella typhimurium LT2
gcuucggacuccuga

SEQ ID NO: 1841880 - RNA, 15 nt, Salmonella typhimurium LT2
gcuucggcuccagcg

SEQ ID NO: 1841881 - RNA, 20 nt, Salmonella typhimurium LT2
gcuucgcgcagccagcgccc

SEQ ID NO: 1841882 - RNA, 21 nt, Salmonella typhimurium LT2
gcuucugccccccgacuucac

SEQ ID NO: 1841883 - RNA, 12 nt, Salmonella typhimurium LT2
gcuucugguugu

SEQ ID NO: 1841884 - RNA, 16 nt, Salmonella typhimurium LT2
gcuucugucugcguga

SEQ ID NO: 1841885 - RNA, 14 nt, Salmonella typhimurium LT2
gcuucgucuuuauu

SEQ ID NO: 1841886 - RNA, 20 nt, Salmonella typhimurium LT2
gcuucuccaccauaucgcag

SEQ ID NO: 1841887 - RNA, 22 nt, Salmonella typhimurium LT2
gcuucucacggauccagaacug

SEQ ID NO: 1841888 - RNA, 18 nt, Salmonella typhimurium LT2
gcuucucccugacuggcu

SEQ ID NO: 1841889 - RNA, 14 nt, Salmonella typhimurium LT2
gcuugcgccagcau

SEQ ID NO: 1841890 - RNA, 15 nt, Salmonella typhimurium LT2
gcuugcgccagcauc

SEQ ID NO: 1841891 - RNA, 12 nt, Salmonella typhimurium LT2
gcuugccugcuu

SEQ ID NO: 1841892 - RNA, 16 nt, Salmonella typhimurium LT2
gcuugccgaccgcaac

SEQ ID NO: 1841893 - RNA, 14 nt, Salmonella typhimurium LT2
gcuugcccggccgu

SEQ ID NO: 1841894 - RNA, 14 nt, Salmonella typhimurium LT2
gcuugccaagcagg

SEQ ID NO: 1841895 - RNA, 23 nt, Salmonella typhimurium LT2
gcuugagcaggcuuacgauauuu

SEQ ID NO: 1841896 - RNA, 13 nt, Salmonella typhimurium LT2
gcuucuucaacgu

SEQ ID NO: 1841897 - RNA, 20 nt, Salmonella typhimurium LT2
aaaggcagcgcgcugucuuu

SEQ ID NO: 1841898 - RNA, 19 nt, Salmonella typhimurium LT2
gcuugcuuuucaucaccau

SEQ ID NO: 1841899 - RNA, 14 nt, Salmonella typhimurium LT2
gcuuguaggccgga

SEQ ID NO: 1841900 - RNA, 19 nt, Salmonella typhimurium LT2
gcuugucgcgagcuuccag

SEQ ID NO: 1841901 - RNA, 17 nt, Salmonella typhimurium LT2
gcuuguuagcuuucugc

SEQ ID NO: 1841902 - RNA, 20 nt, Salmonella typhimurium LT2
gcuuguuagcuuucugccag

SEQ ID NO: 1841903 - RNA, 20 nt, Salmonella typhimurium LT2
aaaggccuggcugagaaaaa

SEQ ID NO: 1841904 - RNA, 16 nt, Salmonella typhimurium LT2
aaaggccuggcugaga

SEQ ID NO: 1841905 - RNA, 14 nt, Salmonella typhimurium LT2
aaaggcccggugug

SEQ ID NO: 1841906 - RNA, 20 nt, Salmonella typhimurium LT2
aaaggcgccgcuucccccgg

SEQ ID NO: 1841907 - RNA, 18 nt, Salmonella typhimurium LT2
gcuuggguauagagcaau

SEQ ID NO: 1841908 - RNA, 13 nt, Salmonella typhimurium LT2
gcuuuauugacua

SEQ ID NO: 1841909 - RNA, 12 nt, Salmonella typhimurium LT2
gcuuuauauaaa

SEQ ID NO: 1841910 - RNA, 22 nt, Salmonella typhimurium LT2
gcuuucaucauaucuucccgau

SEQ ID NO: 1841911 - RNA, 17 nt, Salmonella typhimurium LT2
gcuuucagauuagccag

SEQ ID NO: 1841912 - RNA, 17 nt, Salmonella typhimurium LT2
gcuuucagcuuuuugga

SEQ ID NO: 1841913 - RNA, 12 nt, Salmonella typhimurium LT2
gcuuuccagcuc

SEQ ID NO: 1841914 - RNA, 21 nt, Salmonella typhimurium LT2
gcuuuccgccaugaaaaaaac

SEQ ID NO: 1841915 - RNA, 14 nt, Salmonella typhimurium LT2
gcuuuccgccgccg

SEQ ID NO: 1841916 - RNA, 15 nt, Salmonella typhimurium LT2
gcuuucccuucagau

SEQ ID NO: 1841917 - RNA, 15 nt, Salmonella typhimurium LT2
gcuuguuaucuggca

SEQ ID NO: 1841918 - RNA, 16 nt, Salmonella typhimurium LT2
gcuuuaaauucagcac

SEQ ID NO: 1841919 - RNA, 18 nt, Salmonella typhimurium LT2
gcuuuaaucaccauggcg

SEQ ID NO: 1841920 - RNA, 21 nt, Salmonella typhimurium LT2
gcuuuaaugcuuuaaaugccu

SEQ ID NO: 1841921 - RNA, 15 nt, Salmonella typhimurium LT2
gcuuuagggcuuccu

SEQ ID NO: 1841922 - RNA, 12 nt, Salmonella typhimurium LT2
gcuuuagcuuua

SEQ ID NO: 1841923 - RNA, 16 nt, Salmonella typhimurium LT2
gcuuuacgaugagcaa

SEQ ID NO: 1841924 - RNA, 18 nt, Salmonella typhimurium LT2
gcuccauccaccagcccc

SEQ ID NO: 1841925 - RNA, 16 nt, Salmonella typhimurium LT2
gcuccaguuguuccag

SEQ ID NO: 1841926 - RNA, 15 nt, Salmonella typhimurium LT2
gcuccauccaccagc

SEQ ID NO: 1841927 - RNA, 18 nt, Salmonella typhimurium LT2
gcuccauagaaaucagca

SEQ ID NO: 1841928 - RNA, 19 nt, Salmonella typhimurium LT2
gcuccaucagaucaucaau

SEQ ID NO: 1841929 - RNA, 13 nt, Salmonella typhimurium LT2
gcuccgccagagc

SEQ ID NO: 1841930 - RNA, 22 nt, Salmonella typhimurium LT2
gcuccgagacucaaagaaaaca

SEQ ID NO: 1841931 - RNA, 24 nt, Salmonella typhimurium LT2
gcucccguuccaggcgcucgccgc

SEQ ID NO: 1841932 - RNA, 13 nt, Salmonella typhimurium LT2
gcuccggcacugg

SEQ ID NO: 1841933 - RNA, 20 nt, Salmonella typhimurium LT2
gcuccggcacuggcgcuggc

SEQ ID NO: 1841934 - RNA, 23 nt, Salmonella typhimurium LT2
gcuccggcacuggcgcuggcugc

SEQ ID NO: 1841935 - RNA, 21 nt, Salmonella typhimurium LT2
gcuccgggcgguucggcugcc

SEQ ID NO: 1841936 - RNA, 19 nt, Salmonella typhimurium LT2
gcuccguccacgcgagcug

SEQ ID NO: 1841937 - RNA, 16 nt, Salmonella typhimurium LT2
gcuccguaucgugcug

SEQ ID NO: 1841938 - RNA, 15 nt, Salmonella typhimurium LT2
gcuccguaggccgga

SEQ ID NO: 1841939 - RNA, 18 nt, Salmonella typhimurium LT2
gcuccagcgccagcucca

SEQ ID NO: 1841940 - RNA, 17 nt, Salmonella typhimurium LT2
gcuccagcgccugcugc

SEQ ID NO: 1841941 - RNA, 13 nt, Salmonella typhimurium LT2
gcuccaauaaaua

SEQ ID NO: 1841942 - RNA, 15 nt, Salmonella typhimurium LT2
gcucauuugcggcgu

SEQ ID NO: 1841943 - RNA, 13 nt, Salmonella typhimurium LT2
gcucaucucaagc

SEQ ID NO: 1841944 - RNA, 18 nt, Salmonella typhimurium LT2
gcucauaacccuccugcc

SEQ ID NO: 1841945 - RNA, 17 nt, Salmonella typhimurium LT2
gcucauaccuggcuuga

SEQ ID NO: 1841946 - RNA, 19 nt, Salmonella typhimurium LT2
gcucauaccuggcuugaug

SEQ ID NO: 1841947 - RNA, 20 nt, Salmonella typhimurium LT2
gcucauaauggaccagaaca

SEQ ID NO: 1841948 - RNA, 16 nt, Salmonella typhimurium LT2
gcucauccagcaacag

SEQ ID NO: 1841949 - RNA, 16 nt, Salmonella typhimurium LT2
gcucauccagcagcau

SEQ ID NO: 1841950 - RNA, 16 nt, Salmonella typhimurium LT2
gcggucaaaagcugca

SEQ ID NO: 1841951 - RNA, 17 nt, Salmonella typhimurium LT2
gcggucaccuucggucc

SEQ ID NO: 1841952 - RNA, 23 nt, Salmonella typhimurium LT2
gcggucagcacagcgaugaugau

SEQ ID NO: 1841953 - RNA, 18 nt, Salmonella typhimurium LT2
gcgguaauaacugacaga

SEQ ID NO: 1841954 - RNA, 13 nt, Salmonella typhimurium LT2
gcgguaucaaugc

SEQ ID NO: 1841955 - RNA, 12 nt, Salmonella typhimurium LT2
gcuccuggaacc

SEQ ID NO: 1841956 - RNA, 13 nt, Salmonella typhimurium LT2
gcuccugccagau

SEQ ID NO: 1841957 - RNA, 22 nt, Salmonella typhimurium LT2
gcuccugcgguacggccagcgc

SEQ ID NO: 1841958 - RNA, 13 nt, Salmonella typhimurium LT2
gcuccugcgggag

SEQ ID NO: 1841959 - RNA, 15 nt, Salmonella typhimurium LT2
gcuccugccagauuu

SEQ ID NO: 1841960 - RNA, 18 nt, Salmonella typhimurium LT2
gcuccuugauugcaagaa

SEQ ID NO: 1841961 - RNA, 19 nt, Salmonella typhimurium LT2
gcucgaucccgacccauac

SEQ ID NO: 1841962 - RNA, 20 nt, Salmonella typhimurium LT2
gcucgauaaucccggcgcgc

SEQ ID NO: 1841963 - RNA, 20 nt, Salmonella typhimurium LT2
gcucgccagcauacgucugc

SEQ ID NO: 1841964 - RNA, 22 nt, Salmonella typhimurium LT2
gcucgccagcgcagucagugaa

SEQ ID NO: 1841965 - RNA, 18 nt, Salmonella typhimurium LT2
gcucgcaggccauaaaac

SEQ ID NO: 1841966 - RNA, 13 nt, Salmonella typhimurium LT2
gcucgcauugcuc

SEQ ID NO: 1841967 - RNA, 18 nt, Salmonella typhimurium LT2
gcucgcccgcagcaaaaa

SEQ ID NO: 1841968 - RNA, 17 nt, Salmonella typhimurium LT2
gcucgcccgcgcucugg

SEQ ID NO: 1841969 - RNA, 17 nt, Salmonella typhimurium LT2
gcucgcccuucgggccg

SEQ ID NO: 1841970 - RNA, 18 nt, Salmonella typhimurium LT2
gcucgcuaccuuuuuuca

SEQ ID NO: 1841971 - RNA, 19 nt, Salmonella typhimurium LT2
gcucgcuuacgcggcgcgc

SEQ ID NO: 1841972 - RNA, 19 nt, Salmonella typhimurium LT2
gcucgcuuaaugaggccac

SEQ ID NO: 1841973 - RNA, 22 nt, Salmonella typhimurium LT2
gcucgcuguaccgccauccggc

SEQ ID NO: 1841974 - RNA, 15 nt, Salmonella typhimurium LT2
gcucgcuuuccauua

SEQ ID NO: 1841975 - RNA, 22 nt, Salmonella typhimurium LT2
gcucuacguugaccucaucacc

SEQ ID NO: 1841976 - RNA, 20 nt, Salmonella typhimurium LT2
gcucuaucgccgcccgcaug

SEQ ID NO: 1841977 - RNA, 14 nt, Salmonella typhimurium LT2
gcugccucuuuguu

SEQ ID NO: 1841978 - RNA, 15 nt, Salmonella typhimurium LT2
gcugcgacagcgaac

SEQ ID NO: 1841979 - RNA, 14 nt, Salmonella typhimurium LT2
gcugccuuuuuuaa

SEQ ID NO: 1841980 - RNA, 18 nt, Salmonella typhimurium LT2
gcugcgacaaugaagcau

SEQ ID NO: 1841981 - RNA, 12 nt, Salmonella typhimurium LT2
gcugccgcccgg

SEQ ID NO: 1841982 - RNA, 17 nt, Salmonella typhimurium LT2
gcugccgauugccgcuc

SEQ ID NO: 1841983 - RNA, 20 nt, Salmonella typhimurium LT2
gcugccgauugccgcucagc

SEQ ID NO: 1841984 - RNA, 20 nt, Salmonella typhimurium LT2
gcugccagggcaucgcgcga

SEQ ID NO: 1841985 - RNA, 12 nt, Salmonella typhimurium LT2
gcugccagcaug

SEQ ID NO: 1841986 - RNA, 13 nt, Salmonella typhimurium LT2
gcugccagccagc

SEQ ID NO: 1841987 - RNA, 14 nt, Salmonella typhimurium LT2
gcugccagccagcg

SEQ ID NO: 1841988 - RNA, 21 nt, Salmonella typhimurium LT2
gcugcgccgcaaagcgggcga

SEQ ID NO: 1841989 - RNA, 18 nt, Salmonella typhimurium LT2
gcugcgccugcgcgagcu

SEQ ID NO: 1841990 - RNA, 19 nt, Salmonella typhimurium LT2
gcugcgccugcgcgagcuc

SEQ ID NO: 1841991 - RNA, 22 nt, Salmonella typhimurium LT2
gcugcgccuggaaaaaagcgcc

SEQ ID NO: 1841992 - RNA, 17 nt, Salmonella typhimurium LT2
gcugcgcuuaccgggcc

SEQ ID NO: 1841993 - RNA, 16 nt, Salmonella typhimurium LT2
gcugcgcucgcccuuc

SEQ ID NO: 1841994 - RNA, 19 nt, Salmonella typhimurium LT2
gcuggacaugcuccgcccc

SEQ ID NO: 1841995 - RNA, 17 nt, Salmonella typhimurium LT2
gcuggaauguccacucc

SEQ ID NO: 1841996 - RNA, 14 nt, Salmonella typhimurium LT2
gcuggaagaggcgc

SEQ ID NO: 1841997 - RNA, 21 nt, Salmonella typhimurium LT2
gcuggaacgcgucggcgcggg

SEQ ID NO: 1841998 - RNA, 16 nt, Salmonella typhimurium LT2
gcuggaaacgcggccc

SEQ ID NO: 1841999 - RNA, 18 nt, Salmonella typhimurium LT2
gcuggaaacgcggcccug

SEQ ID NO: 1842000 - RNA, 16 nt, Salmonella typhimurium LT2
gcuggaaagcucuuca

SEQ ID NO: 1842001 - RNA, 22 nt, Salmonella typhimurium LT2
gcugcuguaacagacgcaggcc

SEQ ID NO: 1842002 - RNA, 19 nt, Salmonella typhimurium LT2
gcugcuuuuugagcggcac

SEQ ID NO: 1842003 - RNA, 19 nt, Salmonella typhimurium LT2
gcugcuggccuuccagaua

SEQ ID NO: 1842004 - RNA, 12 nt, Salmonella typhimurium LT2
gcugcuggcgcg

SEQ ID NO: 1842005 - RNA, 16 nt, Salmonella typhimurium LT2
gcugcuggugcgccug

SEQ ID NO: 1842006 - RNA, 19 nt, Salmonella typhimurium LT2
gcugcuggagaccaccggc

SEQ ID NO: 1842007 - RNA, 23 nt, Salmonella typhimurium LT2
gcugcuggagaccaccggcaaag

SEQ ID NO: 1842008 - RNA, 23 nt, Salmonella typhimurium LT2
gcugcugcgcuuuccaggccagc

SEQ ID NO: 1842009 - RNA, 20 nt, Salmonella typhimurium LT2
gcucucgugccaguaacguu

SEQ ID NO: 1842010 - RNA, 16 nt, Salmonella typhimurium LT2
gcugaaguaauguuca

SEQ ID NO: 1842011 - RNA, 16 nt, Salmonella typhimurium LT2
gcugaacgcggugacu

SEQ ID NO: 1842012 - RNA, 12 nt, Salmonella typhimurium LT2
gcugaagacugg

SEQ ID NO: 1842013 - RNA, 12 nt, Salmonella typhimurium LT2
gcugaauguucu

SEQ ID NO: 1842014 - RNA, 15 nt, Salmonella typhimurium LT2
gcugacaaucugcug

SEQ ID NO: 1842015 - RNA, 16 nt, Salmonella typhimurium LT2
gcugacaaucugcugg

SEQ ID NO: 1842016 - RNA, 17 nt, Salmonella typhimurium LT2
gcugacacucauccaga

SEQ ID NO: 1842017 - RNA, 13 nt, Salmonella typhimurium LT2
gcugacaucaucc

SEQ ID NO: 1842018 - RNA, 15 nt, Salmonella typhimurium LT2
gcugacaucauccac

SEQ ID NO: 1842019 - RNA, 17 nt, Salmonella typhimurium LT2
gcugacaucauccacgg

SEQ ID NO: 1842020 - RNA, 14 nt, Salmonella typhimurium LT2
gcugacgaccccag

SEQ ID NO: 1842021 - RNA, 19 nt, Salmonella typhimurium LT2
gcugacgacauucagcaca

SEQ ID NO: 1842022 - RNA, 17 nt, Salmonella typhimurium LT2
gcugaccuuaauccagc

SEQ ID NO: 1842023 - RNA, 15 nt, Salmonella typhimurium LT2
gcugacgacauucag

SEQ ID NO: 1842024 - RNA, 16 nt, Salmonella typhimurium LT2
gcugacgacauucagc

SEQ ID NO: 1842025 - RNA, 13 nt, Salmonella typhimurium LT2
gcugagaaaaaua

SEQ ID NO: 1842026 - RNA, 14 nt, Salmonella typhimurium LT2
gcugacgccagcca

SEQ ID NO: 1842027 - RNA, 16 nt, Salmonella typhimurium LT2
gcugacgcagcagcuc

SEQ ID NO: 1842028 - RNA, 15 nt, Salmonella typhimurium LT2
gcugacgcccaucag

SEQ ID NO: 1842029 - RNA, 20 nt, Salmonella typhimurium LT2
gcugcaacgucgcgcccugc

SEQ ID NO: 1842030 - RNA, 15 nt, Salmonella typhimurium LT2
gcugauuuguuaucu

SEQ ID NO: 1842031 - RNA, 16 nt, Salmonella typhimurium LT2
gcugcaaccagcggcg

SEQ ID NO: 1842032 - RNA, 15 nt, Salmonella typhimurium LT2
gcugcaacccgccgc

SEQ ID NO: 1842033 - RNA, 14 nt, Salmonella typhimurium LT2
gcugcacucagaaa

SEQ ID NO: 1842034 - RNA, 19 nt, Salmonella typhimurium LT2
gcugauugggauaaacaca

SEQ ID NO: 1842035 - RNA, 16 nt, Salmonella typhimurium LT2
gcugaugugcggccug

SEQ ID NO: 1842036 - RNA, 14 nt, Salmonella typhimurium LT2
gcugagaaaaauac

SEQ ID NO: 1842037 - RNA, 14 nt, Salmonella typhimurium LT2
gcugagcagccagc

SEQ ID NO: 1842038 - RNA, 15 nt, Salmonella typhimurium LT2
gcugagcagccagcc

SEQ ID NO: 1842039 - RNA, 20 nt, Salmonella typhimurium LT2
gcugauauuuucaggcaccg

SEQ ID NO: 1842040 - RNA, 15 nt, Salmonella typhimurium LT2
uaaacuguuuccagu

SEQ ID NO: 1842041 - RNA, 14 nt, Salmonella typhimurium LT2
uaaagauaaauaaa

SEQ ID NO: 1842042 - RNA, 22 nt, Salmonella typhimurium LT2
uaaacggcucugcaucauuccu

SEQ ID NO: 1842043 - RNA, 12 nt, Salmonella typhimurium LT2
uaaacgggcagc

SEQ ID NO: 1842044 - RNA, 21 nt, Salmonella typhimurium LT2
uaaacggcagccgccaccaca

SEQ ID NO: 1842045 - RNA, 17 nt, Salmonella typhimurium LT2
uaaacggcgcugaaagg

SEQ ID NO: 1842046 - RNA, 19 nt, Salmonella typhimurium LT2
uaaacgcuuuuucaaagau

SEQ ID NO: 1842047 - RNA, 19 nt, Salmonella typhimurium LT2
uaaacuccauuaaauuacu

SEQ ID NO: 1842048 - RNA, 19 nt, Salmonella typhimurium LT2
uaaacucuguguuaugaau

SEQ ID NO: 1842049 - RNA, 14 nt, Salmonella typhimurium LT2
uaaacgccccuucg

SEQ ID NO: 1842050 - RNA, 20 nt, Salmonella typhimurium LT2
uaaacgccgccgcaaggcgg

SEQ ID NO: 1842051 - RNA, 15 nt, Salmonella typhimurium LT2
uaaacgccugcacca

SEQ ID NO: 1842052 - RNA, 19 nt, Salmonella typhimurium LT2
uaaacgccugaugcugcga

SEQ ID NO: 1842053 - RNA, 23 nt, Salmonella typhimurium LT2
uaaaccgcugccacacucucucc

SEQ ID NO: 1842054 - RNA, 16 nt, Salmonella typhimurium LT2
uaaaccguguuccagc

SEQ ID NO: 1842055 - RNA, 21 nt, Salmonella typhimurium LT2
uaaaccacaugaccagcgccg

SEQ ID NO: 1842056 - RNA, 16 nt, Salmonella typhimurium LT2
uaaacagaugcucacu

SEQ ID NO: 1842057 - RNA, 18 nt, Salmonella typhimurium LT2
uaaacagcaucaccauac

SEQ ID NO: 1842058 - RNA, 19 nt, Salmonella typhimurium LT2
uaaacacucuccaccaaau

SEQ ID NO: 1842059 - RNA, 16 nt, Salmonella typhimurium LT2
uaaacagacaauuagc

SEQ ID NO: 1842060 - RNA, 12 nt, Salmonella typhimurium LT2
guuuuucaucaa

SEQ ID NO: 1842061 - RNA, 15 nt, Salmonella typhimurium LT2
guuuuuauuuuucuu

SEQ ID NO: 1842062 - RNA, 13 nt, Salmonella typhimurium LT2
guuuuucccggau

SEQ ID NO: 1842063 - RNA, 14 nt, Salmonella typhimurium LT2
guuuuucaucauca

SEQ ID NO: 1842064 - RNA, 20 nt, Salmonella typhimurium LT2
uaaagccgcauuuuuccagc

SEQ ID NO: 1842065 - RNA, 15 nt, Salmonella typhimurium LT2
uaaagccaauccaga

SEQ ID NO: 1842066 - RNA, 23 nt, Salmonella typhimurium LT2
uaaagcauagcgucaucaacaua

SEQ ID NO: 1842067 - RNA, 17 nt, Salmonella typhimurium LT2
uaaaguaguuggugggu

SEQ ID NO: 1842068 - RNA, 23 nt, Salmonella typhimurium LT2
uaaaguccugcgucgcuucgcca

SEQ ID NO: 1842069 - RNA, 14 nt, Salmonella typhimurium LT2
uaaagugaguguua

SEQ ID NO: 1842070 - RNA, 18 nt, Salmonella typhimurium LT2
uaaaguuauacagcaccu

SEQ ID NO: 1842071 - RNA, 14 nt, Salmonella typhimurium LT2
uaaauagugcgcua

SEQ ID NO: 1842072 - RNA, 14 nt, Salmonella typhimurium LT2
uaaauaaucaccac

SEQ ID NO: 1842073 - RNA, 15 nt, Salmonella typhimurium LT2
uaaauaaaaaccauu

SEQ ID NO: 1842074 - RNA, 16 nt, Salmonella typhimurium LT2
uaaauaacaaaugaag

SEQ ID NO: 1842075 - RNA, 13 nt, Salmonella typhimurium LT2
uaaauaacaaaag

SEQ ID NO: 1842076 - RNA, 14 nt, Salmonella typhimurium LT2
uaaauaagaaaaug

SEQ ID NO: 1842077 - RNA, 17 nt, Salmonella typhimurium LT2
uaaauaagaaaaugccu

SEQ ID NO: 1842078 - RNA, 22 nt, Salmonella typhimurium LT2
uaaauaacgccagaucucacaa

SEQ ID NO: 1842079 - RNA, 16 nt, Salmonella typhimurium LT2
uaaauaugaaagagaa

SEQ ID NO: 1842080 - RNA, 20 nt, Salmonella typhimurium LT2
uaaaucacgcugaaaaccgc

SEQ ID NO: 1842081 - RNA, 11 nt, Salmonella typhimurium LT2
uaaaucaucau

SEQ ID NO: 1842082 - RNA, 10 nt, Salmonella typhimurium LT2
uaaaucagcc

SEQ ID NO: 1842083 - RNA, 23 nt, Salmonella typhimurium LT2
uaaaucagcuuugcggccagcau

SEQ ID NO: 1842084 - RNA, 15 nt, Salmonella typhimurium LT2
uaaaucaggaaaaag

SEQ ID NO: 1842085 - RNA, 20 nt, Salmonella typhimurium LT2
uaaaucagcgcggcaaggau

SEQ ID NO: 1842086 - RNA, 23 nt, Salmonella typhimurium LT2
uaaaucauaccagcgaaaugcga

SEQ ID NO: 1842087 - RNA, 14 nt, Salmonella typhimurium LT2
uaacacggcuggca

SEQ ID NO: 1842088 - RNA, 16 nt, Salmonella typhimurium LT2
uaacacgguuuccggc

SEQ ID NO: 1842089 - RNA, 21 nt, Salmonella typhimurium LT2
uaacagacgcaucuuuuuccc

SEQ ID NO: 1842090 - RNA, 19 nt, Salmonella typhimurium LT2
uaacagacgcaucuuuuuc

SEQ ID NO: 1842091 - RNA, 22 nt, Salmonella typhimurium LT2
uaacagacgcaucuuuuucccg

SEQ ID NO: 1842092 - RNA, 21 nt, Salmonella typhimurium LT2
uaacacuuugaacgagucuua

SEQ ID NO: 1842093 - RNA, 21 nt, Salmonella typhimurium LT2
uaacaucaccuuucauuuuau

SEQ ID NO: 1842094 - RNA, 17 nt, Salmonella typhimurium LT2
uaacagaauaagccagg

SEQ ID NO: 1842095 - RNA, 22 nt, Salmonella typhimurium LT2
uaaccaccgcugcgugcgcgcc

SEQ ID NO: 1842096 - RNA, 16 nt, Salmonella typhimurium LT2
uaacaucguaaaucaa

SEQ ID NO: 1842097 - RNA, 18 nt, Salmonella typhimurium LT2
uaaccagcgcgccgccaa

SEQ ID NO: 1842098 - RNA, 20 nt, Salmonella typhimurium LT2
uaaccagcgagcuacaggug

SEQ ID NO: 1842099 - RNA, 12 nt, Salmonella typhimurium LT2
uaaccagcaguc

SEQ ID NO: 1842100 - RNA, 17 nt, Salmonella typhimurium LT2
uaaccacugauggcugg

SEQ ID NO: 1842101 - RNA, 15 nt, Salmonella typhimurium LT2
uaacccugaagcugc

SEQ ID NO: 1842102 - RNA, 15 nt, Salmonella typhimurium LT2
uaacggaugaaagcc

SEQ ID NO: 1842103 - RNA, 23 nt, Salmonella typhimurium LT2
uaacggcgaaaagcuggcugaca

SEQ ID NO: 1842104 - RNA, 17 nt, Salmonella typhimurium LT2
uaacgcgcuuuuuucgu

SEQ ID NO: 1842105 - RNA, 23 nt, Salmonella typhimurium LT2
uaacgcgccaucuuucacccauu

SEQ ID NO: 1842106 - RNA, 17 nt, Salmonella typhimurium LT2
uaacgcgaaaaaaagau

SEQ ID NO: 1842107 - RNA, 16 nt, Salmonella typhimurium LT2
uaacgcgccaucuuuc

SEQ ID NO: 1842108 - RNA, 21 nt, Salmonella typhimurium LT2
uaacgccuucgcaaagugcca

SEQ ID NO: 1842109 - RNA, 18 nt, Salmonella typhimurium LT2
uaacgccgauuaaugcuc

SEQ ID NO: 1842110 - RNA, 15 nt, Salmonella typhimurium LT2
uaacgccgauuaaug

SEQ ID NO: 1842111 - RNA, 21 nt, Salmonella typhimurium LT2
uaacgcuguaccggcagguga

SEQ ID NO: 1842112 - RNA, 21 nt, Salmonella typhimurium LT2
uaacgcuggaagaggcgccug

SEQ ID NO: 1842113 - RNA, 22 nt, Salmonella typhimurium LT2
uaacgcggguuuuuacuuucca

SEQ ID NO: 1842114 - RNA, 19 nt, Salmonella typhimurium LT2
uaacgcgggcguaauacau

SEQ ID NO: 1842115 - RNA, 23 nt, Salmonella typhimurium LT2
uaacgcaggcgauagccccagua

SEQ ID NO: 1842116 - RNA, 15 nt, Salmonella typhimurium LT2
uaacgcaacaacagu

SEQ ID NO: 1842117 - RNA, 16 nt, Salmonella typhimurium LT2
uaacgauuuuauagau

SEQ ID NO: 1842118 - RNA, 23 nt, Salmonella typhimurium LT2
uaacgcacuggucgggcaggcuu

SEQ ID NO: 1842119 - RNA, 19 nt, Salmonella typhimurium LT2
uaaccguaacgcuccugga

SEQ ID NO: 1842120 - RNA, 21 nt, Salmonella typhimurium LT2
uaaccguagauuuucaucaua

SEQ ID NO: 1842121 - RNA, 19 nt, Salmonella typhimurium LT2
uaaccggcaaccaacgccc

SEQ ID NO: 1842122 - RNA, 14 nt, Salmonella typhimurium LT2
uaaccggcaacuuu

SEQ ID NO: 1842123 - RNA, 18 nt, Salmonella typhimurium LT2
uaaccgauaacgcggccc

SEQ ID NO: 1842124 - RNA, 15 nt, Salmonella typhimurium LT2
uaaccguucuuccug

SEQ ID NO: 1842125 - RNA, 16 nt, Salmonella typhimurium LT2
uaaccguucuuccugg

SEQ ID NO: 1842126 - RNA, 18 nt, Salmonella typhimurium LT2
uaaccgucuucauccaug

SEQ ID NO: 1842127 - RNA, 15 nt, Salmonella typhimurium LT2
uaaccuauuuuaaaa

SEQ ID NO: 1842128 - RNA, 17 nt, Salmonella typhimurium LT2
uaaccuauuuuaaaaaa

SEQ ID NO: 1842129 - RNA, 23 nt, Salmonella typhimurium LT2
uaacaaaccgguaaucccuucac

SEQ ID NO: 1842130 - RNA, 16 nt, Salmonella typhimurium LT2
uaacaacuguuuuuca

SEQ ID NO: 1842131 - RNA, 22 nt, Salmonella typhimurium LT2
uaacaaaagcgguuaagauaca

SEQ ID NO: 1842132 - RNA, 23 nt, Salmonella typhimurium LT2
uaacaaaagcgguuaagauacau

SEQ ID NO: 1842133 - RNA, 20 nt, Salmonella typhimurium LT2
uaacaaaaugagauugauaa

SEQ ID NO: 1842134 - RNA, 13 nt, Salmonella typhimurium LT2
uaaauuuucauua

SEQ ID NO: 1842135 - RNA, 15 nt, Salmonella typhimurium LT2
uaaauuuuuuaacag

SEQ ID NO: 1842136 - RNA, 22 nt, Salmonella typhimurium LT2
uaacaccuuuuccucuucuugc

SEQ ID NO: 1842137 - RNA, 22 nt, Salmonella typhimurium LT2
uaacaccacgaaggaaacgcca

SEQ ID NO: 1842138 - RNA, 19 nt, Salmonella typhimurium LT2
uaacacacaguugccuucg

SEQ ID NO: 1842139 - RNA, 12 nt, Salmonella typhimurium LT2
uaacacaugcaa

SEQ ID NO: 1842140 - RNA, 13 nt, Salmonella typhimurium LT2
uaacacaugcaag

SEQ ID NO: 1842141 - RNA, 14 nt, Salmonella typhimurium LT2
uaacaauuuaucag

SEQ ID NO: 1842142 - RNA, 15 nt, Salmonella typhimurium LT2
uaacaauuuaucaga

SEQ ID NO: 1842143 - RNA, 18 nt, Salmonella typhimurium LT2
uaacaauuuaucagacaa

SEQ ID NO: 1842144 - RNA, 15 nt, Salmonella typhimurium LT2
uaacaacuguuuuuc

SEQ ID NO: 1842145 - RNA, 22 nt, Salmonella typhimurium LT2
uaaaugcgguuaauuggcccuu

SEQ ID NO: 1842146 - RNA, 14 nt, Salmonella typhimurium LT2
uaaauccuucgccg

SEQ ID NO: 1842147 - RNA, 19 nt, Salmonella typhimurium LT2
uaaaucgcggcgauuaaua

SEQ ID NO: 1842148 - RNA, 14 nt, Salmonella typhimurium LT2
uaaauccauauucu

SEQ ID NO: 1842149 - RNA, 17 nt, Salmonella typhimurium LT2
uaaauccacauuccaga

SEQ ID NO: 1842150 - RNA, 13 nt, Salmonella typhimurium LT2
uaaauucgcuacg

SEQ ID NO: 1842151 - RNA, 18 nt, Salmonella typhimurium LT2
uaaauuccggcucgccuu

SEQ ID NO: 1842152 - RNA, 19 nt, Salmonella typhimurium LT2
uaaauucauauuuaaauau

SEQ ID NO: 1842153 - RNA, 20 nt, Salmonella typhimurium LT2
uaaauuaaacagcuguaaau

SEQ ID NO: 1842154 - RNA, 17 nt, Salmonella typhimurium LT2
uaaauguuugcuuuagc

SEQ ID NO: 1842155 - RNA, 21 nt, Salmonella typhimurium LT2
uaaauuaacucucucuguaau

SEQ ID NO: 1842156 - RNA, 17 nt, Salmonella typhimurium LT2
uaaguuuguaaaauaca

SEQ ID NO: 1842157 - RNA, 15 nt, Salmonella typhimurium LT2
uaauaaaaaacaacu

SEQ ID NO: 1842158 - RNA, 16 nt, Salmonella typhimurium LT2
uaauaaaauauuauuu

SEQ ID NO: 1842159 - RNA, 20 nt, Salmonella typhimurium LT2
uaauaaauuuucauuauaaa

SEQ ID NO: 1842160 - RNA, 16 nt, Salmonella typhimurium LT2
uaaguugaaaggaaag

SEQ ID NO: 1842161 - RNA, 16 nt, Salmonella typhimurium LT2
uaaguucgcaacauga

SEQ ID NO: 1842162 - RNA, 22 nt, Salmonella typhimurium LT2
uaaguguagcgccgccugacug

SEQ ID NO: 1842163 - RNA, 13 nt, Salmonella typhimurium LT2
uaagugauacaua

SEQ ID NO: 1842164 - RNA, 14 nt, Salmonella typhimurium LT2
uaagucauccagac

SEQ ID NO: 1842165 - RNA, 19 nt, Salmonella typhimurium LT2
uaagucgccgcagcuccau

SEQ ID NO: 1842166 - RNA, 20 nt, Salmonella typhimurium LT2
uaagucuccuguuuacaggc

SEQ ID NO: 1842167 - RNA, 18 nt, Salmonella typhimurium LT2
uaagguucgcuuaaucuc

SEQ ID NO: 1842168 - RNA, 16 nt, Salmonella typhimurium LT2
uaaguaaggaggaauc

SEQ ID NO: 1842169 - RNA, 22 nt, Salmonella typhimurium LT2
uaaguaaagauuuuuauuaaaa

SEQ ID NO: 1842170 - RNA, 23 nt, Salmonella typhimurium LT2
uaaguaaagauuuuuauuaaaau

SEQ ID NO: 1842171 - RNA, 18 nt, Salmonella typhimurium LT2
uaagggugaaagggugcg

SEQ ID NO: 1842172 - RNA, 14 nt, Salmonella typhimurium LT2
uaagggccuucauu

SEQ ID NO: 1842173 - RNA, 21 nt, Salmonella typhimurium LT2
uaagguccagggaauaaaaua

SEQ ID NO: 1842174 - RNA, 19 nt, Salmonella typhimurium LT2
uaaggucgcuauccagcag

SEQ ID NO: 1842175 - RNA, 19 nt, Salmonella typhimurium LT2
uaagguauccuaaugccac

SEQ ID NO: 1842176 - RNA, 21 nt, Salmonella typhimurium LT2
uaagguaacgcgaaaaaaaga

SEQ ID NO: 1842177 - RNA, 19 nt, Salmonella typhimurium LT2
uaagccaugugacggcaug

SEQ ID NO: 1842178 - RNA, 12 nt, Salmonella typhimurium LT2
uaagccagcccu

SEQ ID NO: 1842179 - RNA, 14 nt, Salmonella typhimurium LT2
uaagccagcgauga

SEQ ID NO: 1842180 - RNA, 20 nt, Salmonella typhimurium LT2
uaagcccauggcaggcagca

SEQ ID NO: 1842181 - RNA, 21 nt, Salmonella typhimurium LT2
uaagcccauggcaggcagcac

SEQ ID NO: 1842182 - RNA, 23 nt, Salmonella typhimurium LT2
uaagcccauggcaggcagcacaa

SEQ ID NO: 1842183 - RNA, 15 nt, Salmonella typhimurium LT2
uaagcauccaggaag

SEQ ID NO: 1842184 - RNA, 18 nt, Salmonella typhimurium LT2
uaagcgcaaacuuccaca

SEQ ID NO: 1842185 - RNA, 12 nt, Salmonella typhimurium LT2
uaagccuuuuua

SEQ ID NO: 1842186 - RNA, 13 nt, Salmonella typhimurium LT2
uaagccuggcaua

SEQ ID NO: 1842187 - RNA, 22 nt, Salmonella typhimurium LT2
uaagcgcagcgccaucaggccu

SEQ ID NO: 1842188 - RNA, 14 nt, Salmonella typhimurium LT2
uaagcgcagcgcca

SEQ ID NO: 1842189 - RNA, 21 nt, Salmonella typhimurium LT2
uaagcaacugauuaaucugcc

SEQ ID NO: 1842190 - RNA, 21 nt, Salmonella typhimurium LT2
uaagcauccaggaaguaaauu

SEQ ID NO: 1842191 - RNA, 21 nt, Salmonella typhimurium LT2
uaagcagugagauugacagaa

SEQ ID NO: 1842192 - RNA, 13 nt, Salmonella typhimurium LT2
uaaggcaggcaaa

SEQ ID NO: 1842193 - RNA, 18 nt, Salmonella typhimurium LT2
uaaggcauaaugccacga

SEQ ID NO: 1842194 - RNA, 22 nt, Salmonella typhimurium LT2
uaaggcgugccgccgcgaaccu

SEQ ID NO: 1842195 - RNA, 22 nt, Salmonella typhimurium LT2
uaaggccggcauuuuauucaua

SEQ ID NO: 1842196 - RNA, 20 nt, Salmonella typhimurium LT2
uaaggcgauaccuaaucccu

SEQ ID NO: 1842197 - RNA, 16 nt, Salmonella typhimurium LT2
uaaggcuggcacguuc

SEQ ID NO: 1842198 - RNA, 15 nt, Salmonella typhimurium LT2
uaaggcugauuauau

SEQ ID NO: 1842199 - RNA, 18 nt, Salmonella typhimurium LT2
uaagcugagccuucaccg

SEQ ID NO: 1842200 - RNA, 20 nt, Salmonella typhimurium LT2
uaagcuuccgccaugguugg

SEQ ID NO: 1842201 - RNA, 16 nt, Salmonella typhimurium LT2
uaagcgcgaaauuuau

SEQ ID NO: 1842202 - RNA, 20 nt, Salmonella typhimurium LT2
uaagcgcagcgccauugagc

SEQ ID NO: 1842203 - RNA, 19 nt, Salmonella typhimurium LT2
uaagcggcgucauccggag

SEQ ID NO: 1842204 - RNA, 14 nt, Salmonella typhimurium LT2
uaagcguucaucag

SEQ ID NO: 1842205 - RNA, 18 nt, Salmonella typhimurium LT2
uaagcguucaucaggcau

SEQ ID NO: 1842206 - RNA, 13 nt, Salmonella typhimurium LT2
uaagcguagcgcc

SEQ ID NO: 1842207 - RNA, 13 nt, Salmonella typhimurium LT2
uaagaacgagaac

SEQ ID NO: 1842208 - RNA, 13 nt, Salmonella typhimurium LT2
uaagaacuuuauc

SEQ ID NO: 1842209 - RNA, 16 nt, Salmonella typhimurium LT2
uaagaaagauaaaaua

SEQ ID NO: 1842210 - RNA, 19 nt, Salmonella typhimurium LT2
uaagaauuauuaccaauga

SEQ ID NO: 1842211 - RNA, 19 nt, Salmonella typhimurium LT2
uaagaaguaaacagaauca

SEQ ID NO: 1842212 - RNA, 19 nt, Salmonella typhimurium LT2
uaagaagucugugaggaaa

SEQ ID NO: 1842213 - RNA, 21 nt, Salmonella typhimurium LT2
uaagaaacugagugugucuuu

SEQ ID NO: 1842214 - RNA, 23 nt, Salmonella typhimurium LT2
uaacuucuugguaccaaacagca

SEQ ID NO: 1842215 - RNA, 22 nt, Salmonella typhimurium LT2
uaacuucuuaauggauucuguu

SEQ ID NO: 1842216 - RNA, 18 nt, Salmonella typhimurium LT2
uaacuugccgccugccug

SEQ ID NO: 1842217 - RNA, 19 nt, Salmonella typhimurium LT2
uaagagaccgguuauugag

SEQ ID NO: 1842218 - RNA, 20 nt, Salmonella typhimurium LT2
uaagacuuuuuaauucacaa

SEQ ID NO: 1842219 - RNA, 14 nt, Salmonella typhimurium LT2
uaagagcuggucgg

SEQ ID NO: 1842220 - RNA, 19 nt, Salmonella typhimurium LT2
uaagaguccauucggccug

SEQ ID NO: 1842221 - RNA, 14 nt, Salmonella typhimurium LT2
uaagaccagcauca

SEQ ID NO: 1842222 - RNA, 19 nt, Salmonella typhimurium LT2
uaagacuacauacgcgcau

SEQ ID NO: 1842223 - RNA, 20 nt, Salmonella typhimurium LT2
uaagauauuuuguuuuaaau

SEQ ID NO: 1842224 - RNA, 14 nt, Salmonella typhimurium LT2
uaagauccugacuc

SEQ ID NO: 1842225 - RNA, 18 nt, Salmonella typhimurium LT2
uaacugaagguuuuuccc

SEQ ID NO: 1842226 - RNA, 12 nt, Salmonella typhimurium LT2
uaacugacagac

SEQ ID NO: 1842227 - RNA, 19 nt, Salmonella typhimurium LT2
aaauccaugagaagaaaaa

SEQ ID NO: 1842228 - RNA, 23 nt, Salmonella typhimurium LT2
aaaucccccaacgucaccaucaa

SEQ ID NO: 1842229 - RNA, 17 nt, Salmonella typhimurium LT2
aaauccggaucaucuuu

SEQ ID NO: 1842230 - RNA, 21 nt, Salmonella typhimurium LT2
uaacugcaaaucuucggcaaa

SEQ ID NO: 1842231 - RNA, 22 nt, Salmonella typhimurium LT2
aaauccgcgcucagucacuuca

SEQ ID NO: 1842232 - RNA, 19 nt, Salmonella typhimurium LT2
aaaucccggacacauaacc

SEQ ID NO: 1842233 - RNA, 17 nt, Salmonella typhimurium LT2
aaaucccggaggcgaua

SEQ ID NO: 1842234 - RNA, 17 nt, Salmonella typhimurium LT2
uaacuuauccacgcccu

SEQ ID NO: 1842235 - RNA, 16 nt, Salmonella typhimurium LT2
uaacuuaaauaaaaau

SEQ ID NO: 1842236 - RNA, 20 nt, Salmonella typhimurium LT2
uaacuucagcaucaucuccc

SEQ ID NO: 1842237 - RNA, 23 nt, Salmonella typhimurium LT2
uaacuuccuuugccuuucuuauu

SEQ ID NO: 1842238 - RNA, 16 nt, Salmonella typhimurium LT2
uaacuucggccagcga

SEQ ID NO: 1842239 - RNA, 16 nt, Salmonella typhimurium LT2
uaacuggaaaaagacc

SEQ ID NO: 1842240 - RNA, 15 nt, Salmonella typhimurium LT2
uaacuggauuccugg

SEQ ID NO: 1842241 - RNA, 20 nt, Salmonella typhimurium LT2
uaacuggucaaacaaaucau

SEQ ID NO: 1842242 - RNA, 17 nt, Salmonella typhimurium LT2
uaacgucaccgcuuuuu

SEQ ID NO: 1842243 - RNA, 18 nt, Salmonella typhimurium LT2
uaacguccugggcugcca

SEQ ID NO: 1842244 - RNA, 22 nt, Salmonella typhimurium LT2
uaacguguuuucgauuucauuc

SEQ ID NO: 1842245 - RNA, 15 nt, Salmonella typhimurium LT2
uaacguuaaggaaac

SEQ ID NO: 1842246 - RNA, 16 nt, Salmonella typhimurium LT2
uaacguucuuaauacc

SEQ ID NO: 1842247 - RNA, 18 nt, Salmonella typhimurium LT2
uaacgucgucauucaugg

SEQ ID NO: 1842248 - RNA, 17 nt, Salmonella typhimurium LT2
uaacguuuuacgcugcc

SEQ ID NO: 1842249 - RNA, 13 nt, Salmonella typhimurium LT2
uaacuaaaauacu

SEQ ID NO: 1842250 - RNA, 14 nt, Salmonella typhimurium LT2
uaacucguccuguu

SEQ ID NO: 1842251 - RNA, 19 nt, Salmonella typhimurium LT2
uaacucuuuugcagcaaau

SEQ ID NO: 1842252 - RNA, 20 nt, Salmonella typhimurium LT2
uaacucuuuugcagcaaaua

SEQ ID NO: 1842253 - RNA, 19 nt, Salmonella typhimurium LT2
uaacuccuucuaauuccag

SEQ ID NO: 1842254 - RNA, 16 nt, Salmonella typhimurium LT2
uaacuccagcaucauu

SEQ ID NO: 1842255 - RNA, 20 nt, Salmonella typhimurium LT2
uaacuauaauugcuuuuuuc

SEQ ID NO: 1842256 - RNA, 14 nt, Salmonella typhimurium LT2
uaacucauugggua

SEQ ID NO: 1842257 - RNA, 19 nt, Salmonella typhimurium LT2
uaacucaagcgaauccaga

SEQ ID NO: 1842258 - RNA, 23 nt, Salmonella typhimurium LT2
uaauacgucgugacccacacaua

SEQ ID NO: 1842259 - RNA, 19 nt, Salmonella typhimurium LT2
uaauacguacugaaauaac

SEQ ID NO: 1842260 - RNA, 20 nt, Salmonella typhimurium LT2
uaauacguacugaaauaacu

SEQ ID NO: 1842261 - RNA, 19 nt, Salmonella typhimurium LT2
uaauacguaaaccgcucac

SEQ ID NO: 1842262 - RNA, 19 nt, Salmonella typhimurium LT2
uaauacguuuauucuuuuc

SEQ ID NO: 1842263 - RNA, 15 nt, Salmonella typhimurium LT2
uaauacuggcgccuu

SEQ ID NO: 1842264 - RNA, 15 nt, Salmonella typhimurium LT2
uaauacgcuugcgcc

SEQ ID NO: 1842265 - RNA, 16 nt, Salmonella typhimurium LT2
uaauacgcuugcgcca

SEQ ID NO: 1842266 - RNA, 20 nt, Salmonella typhimurium LT2
uaauacgcuugcgccagcau

SEQ ID NO: 1842267 - RNA, 21 nt, Salmonella typhimurium LT2
uaauagagauccuggcgaaag

SEQ ID NO: 1842268 - RNA, 14 nt, Salmonella typhimurium LT2
uaauagguugcgcc

SEQ ID NO: 1842269 - RNA, 19 nt, Salmonella typhimurium LT2
uaauaauuggcauccagca

SEQ ID NO: 1842270 - RNA, 12 nt, Salmonella typhimurium LT2
uaauaauuaaca

SEQ ID NO: 1842271 - RNA, 15 nt, Salmonella typhimurium LT2
uaauacauugccgca

SEQ ID NO: 1842272 - RNA, 20 nt, Salmonella typhimurium LT2
uaauacaggcguguggcaua

SEQ ID NO: 1842273 - RNA, 18 nt, Salmonella typhimurium LT2
uaauaacugacagacuca

SEQ ID NO: 1842274 - RNA, 16 nt, Salmonella typhimurium LT2
uaaucaguucaggaac

SEQ ID NO: 1842275 - RNA, 18 nt, Salmonella typhimurium LT2
uaaucaguucaggaacau

SEQ ID NO: 1842276 - RNA, 19 nt, Salmonella typhimurium LT2
uaaucaguucaggaacauc

SEQ ID NO: 1842277 - RNA, 16 nt, Salmonella typhimurium LT2
uaaucaggacaucaaa

SEQ ID NO: 1842278 - RNA, 16 nt, Salmonella typhimurium LT2
uaaucaggagggcugc

SEQ ID NO: 1842279 - RNA, 15 nt, Salmonella typhimurium LT2
uaaucaccaccucaa

SEQ ID NO: 1842280 - RNA, 20 nt, Salmonella typhimurium LT2
uaaucacacaagucaccguu

SEQ ID NO: 1842281 - RNA, 20 nt, Salmonella typhimurium LT2
uaaucgaaucgccucaacca

SEQ ID NO: 1842282 - RNA, 11 nt, Salmonella typhimurium LT2
uaaucccuugc

SEQ ID NO: 1842283 - RNA, 17 nt, Salmonella typhimurium LT2
uaaucccaaaauuuacc

SEQ ID NO: 1842284 - RNA, 15 nt, Salmonella typhimurium LT2
uaauccauuacgcag

SEQ ID NO: 1842285 - RNA, 21 nt, Salmonella typhimurium LT2
uaauccagaggguaauuucuu

SEQ ID NO: 1842286 - RNA, 21 nt, Salmonella typhimurium LT2
uaauccacgccaauaaucaga

SEQ ID NO: 1842287 - RNA, 12 nt, Salmonella typhimurium LT2
uaauccacaacg

SEQ ID NO: 1842288 - RNA, 15 nt, Salmonella typhimurium LT2
uaaucaugaacgcua

SEQ ID NO: 1842289 - RNA, 21 nt, Salmonella typhimurium LT2
uaaucaacugcgccacaucau

SEQ ID NO: 1842290 - RNA, 15 nt, Salmonella typhimurium LT2
uaaucaacucuccuu

SEQ ID NO: 1842291 - RNA, 13 nt, Salmonella typhimurium LT2
uaauauuauugac

SEQ ID NO: 1842292 - RNA, 15 nt, Salmonella typhimurium LT2
uaauauuaucagcaa

SEQ ID NO: 1842293 - RNA, 16 nt, Salmonella typhimurium LT2
uaauauuaucagcaau

SEQ ID NO: 1842294 - RNA, 17 nt, Salmonella typhimurium LT2
uaauauuaucagcaaua

SEQ ID NO: 1842295 - RNA, 21 nt, Salmonella typhimurium LT2
uaauauaugaaccaagauaag

SEQ ID NO: 1842296 - RNA, 13 nt, Salmonella typhimurium LT2
uaauauccaguga

SEQ ID NO: 1842297 - RNA, 24 nt, Salmonella typhimurium LT2
uaauauauuuauauauagagcagc

SEQ ID NO: 1842298 - RNA, 14 nt, Salmonella typhimurium LT2
uaauauuaagcagc

SEQ ID NO: 1842299 - RNA, 15 nt, Salmonella typhimurium LT2
uaauauuaaaaccau

SEQ ID NO: 1842300 - RNA, 17 nt, Salmonella typhimurium LT2
uaauauuaaaaccauug

SEQ ID NO: 1842301 - RNA, 23 nt, Salmonella typhimurium LT2
uaaugagccagauggauaaccug

SEQ ID NO: 1842302 - RNA, 19 nt, Salmonella typhimurium LT2
uaaugagcgucgccagacc

SEQ ID NO: 1842303 - RNA, 15 nt, Salmonella typhimurium LT2
uaaucgccagcagcg

SEQ ID NO: 1842304 - RNA, 16 nt, Salmonella typhimurium LT2
uaaucgauaagccagc

SEQ ID NO: 1842305 - RNA, 13 nt, Salmonella typhimurium LT2
uaaucgaucccgc

SEQ ID NO: 1842306 - RNA, 22 nt, Salmonella typhimurium LT2
uaaugaucaugcugcaccgcau

SEQ ID NO: 1842307 - RNA, 21 nt, Salmonella typhimurium LT2
uaaugaucagcaaaauagugu

SEQ ID NO: 1842308 - RNA, 14 nt, Salmonella typhimurium LT2
uaaugcgaaaaaua

SEQ ID NO: 1842309 - RNA, 18 nt, Salmonella typhimurium LT2
uaaugcgaaaauaaaggu

SEQ ID NO: 1842310 - RNA, 18 nt, Salmonella typhimurium LT2
uaaugccuaucuugauau

SEQ ID NO: 1842311 - RNA, 21 nt, Salmonella typhimurium LT2
uaaugccucauuaaaaaaaca

SEQ ID NO: 1842312 - RNA, 18 nt, Salmonella typhimurium LT2
uaaugccgucaucagcaa

SEQ ID NO: 1842313 - RNA, 17 nt, Salmonella typhimurium LT2
uaaugcaauaaacuaag

SEQ ID NO: 1842314 - RNA, 19 nt, Salmonella typhimurium LT2
uaaugucuggugcagcaag

SEQ ID NO: 1842315 - RNA, 16 nt, Salmonella typhimurium LT2
uaaugugauccgcccc

SEQ ID NO: 1842316 - RNA, 17 nt, Salmonella typhimurium LT2
uaaugucgacauaauuu

SEQ ID NO: 1842317 - RNA, 19 nt, Salmonella typhimurium LT2
uaauguaaaggugagcucu

SEQ ID NO: 1842318 - RNA, 15 nt, Salmonella typhimurium LT2
uaaugcgugagcagg

SEQ ID NO: 1842319 - RNA, 17 nt, Salmonella typhimurium LT2
uaauguuuucugccagc

SEQ ID NO: 1842320 - RNA, 18 nt, Salmonella typhimurium LT2
uaauguucaguuuuucca

SEQ ID NO: 1842321 - RNA, 17 nt, Salmonella typhimurium LT2
uaauuacgcccaucgca

SEQ ID NO: 1842322 - RNA, 19 nt, Salmonella typhimurium LT2
uaauuaaaaagagaaaaaa

SEQ ID NO: 1842323 - RNA, 17 nt, Salmonella typhimurium LT2
uaauuccucagaauccg

SEQ ID NO: 1842324 - RNA, 17 nt, Salmonella typhimurium LT2
uaauuccgcaucauuca

SEQ ID NO: 1842325 - RNA, 15 nt, Salmonella typhimurium LT2
uacaagauuugcaau

SEQ ID NO: 1842326 - RNA, 14 nt, Salmonella typhimurium LT2
uacaaauuacacaa

SEQ ID NO: 1842327 - RNA, 16 nt, Salmonella typhimurium LT2
uacaaauuacacaaua

SEQ ID NO: 1842328 - RNA, 13 nt, Salmonella typhimurium LT2
uacaacaauaaug

SEQ ID NO: 1842329 - RNA, 15 nt, Salmonella typhimurium LT2
uacaaacgcaccgcc

SEQ ID NO: 1842330 - RNA, 23 nt, Salmonella typhimurium LT2
uacaaagccaaaauuuucaauac

SEQ ID NO: 1842331 - RNA, 23 nt, Salmonella typhimurium LT2
uacaaagcagauagagcauaaua

SEQ ID NO: 1842332 - RNA, 24 nt, Salmonella typhimurium LT2
uacaaagcagauagagcauaauaa

SEQ ID NO: 1842333 - RNA, 18 nt, Salmonella typhimurium LT2
uacaaacaaauaaaucca

SEQ ID NO: 1842334 - RNA, 21 nt, Salmonella typhimurium LT2
uacaaacacgucuuugcugcc

SEQ ID NO: 1842335 - RNA, 22 nt, Salmonella typhimurium LT2
uacaaacacgucuuugcugcca

SEQ ID NO: 1842336 - RNA, 19 nt, Salmonella typhimurium LT2
uaauuuuguuaaagugagu

SEQ ID NO: 1842337 - RNA, 14 nt, Salmonella typhimurium LT2
uaauuuucuuuuau

SEQ ID NO: 1842338 - RNA, 14 nt, Salmonella typhimurium LT2
uaauuuucuguaau

SEQ ID NO: 1842339 - RNA, 18 nt, Salmonella typhimurium LT2
uacaaaacccauaucccc

SEQ ID NO: 1842340 - RNA, 22 nt, Salmonella typhimurium LT2
uaauuuuuccagcauuucuuca

SEQ ID NO: 1842341 - RNA, 14 nt, Salmonella typhimurium LT2
uaauuuuuccuuca

SEQ ID NO: 1842342 - RNA, 21 nt, Salmonella typhimurium LT2
uaauugccugacgaaaacccg

SEQ ID NO: 1842343 - RNA, 22 nt, Salmonella typhimurium LT2
uaauugccuggcagcuugccuu

SEQ ID NO: 1842344 - RNA, 15 nt, Salmonella typhimurium LT2
uaauuuauccaguaa

SEQ ID NO: 1842345 - RNA, 20 nt, Salmonella typhimurium LT2
uaauugcccccuuuuuauuc

SEQ ID NO: 1842346 - RNA, 14 nt, Salmonella typhimurium LT2
uaauuucaggcugc

SEQ ID NO: 1842347 - RNA, 21 nt, Salmonella typhimurium LT2
uacaggucgacgugaacugcc

SEQ ID NO: 1842348 - RNA, 14 nt, Salmonella typhimurium LT2
uacaggugcagggc

SEQ ID NO: 1842349 - RNA, 21 nt, Salmonella typhimurium LT2
uacaauuauugcguugcuuua

SEQ ID NO: 1842350 - RNA, 15 nt, Salmonella typhimurium LT2
uacaaguucagcagg

SEQ ID NO: 1842351 - RNA, 16 nt, Salmonella typhimurium LT2
uacaucagaaaacagc

SEQ ID NO: 1842352 - RNA, 15 nt, Salmonella typhimurium LT2
uacaucagaguaauu

SEQ ID NO: 1842353 - RNA, 21 nt, Salmonella typhimurium LT2
uacauccaggaggcaaaaugc

SEQ ID NO: 1842354 - RNA, 18 nt, Salmonella typhimurium LT2
uacauccaucacuccuua

SEQ ID NO: 1842355 - RNA, 16 nt, Salmonella typhimurium LT2
uacauccggcaggcau

SEQ ID NO: 1842356 - RNA, 18 nt, Salmonella typhimurium LT2
uacaucguaaagcaccau

SEQ ID NO: 1842357 - RNA, 14 nt, Salmonella typhimurium LT2
uacaucgucugcuu

SEQ ID NO: 1842358 - RNA, 13 nt, Salmonella typhimurium LT2
uacauagcaggcc

SEQ ID NO: 1842359 - RNA, 17 nt, Salmonella typhimurium LT2
uaccacaacaagaauau

SEQ ID NO: 1842360 - RNA, 20 nt, Salmonella typhimurium LT2
uaccacaacaagaauauauu

SEQ ID NO: 1842361 - RNA, 19 nt, Salmonella typhimurium LT2
uacauucgauggccgacua

SEQ ID NO: 1842362 - RNA, 10 nt, Salmonella typhimurium LT2
uacauucugu

SEQ ID NO: 1842363 - RNA, 19 nt, Salmonella typhimurium LT2
uacaucucgaguaaucacu

SEQ ID NO: 1842364 - RNA, 13 nt, Salmonella typhimurium LT2
uacauuaauguca

SEQ ID NO: 1842365 - RNA, 20 nt, Salmonella typhimurium LT2
uacauuaaugucaugaagcu

SEQ ID NO: 1842366 - RNA, 13 nt, Salmonella typhimurium LT2
uaccagacacagu

SEQ ID NO: 1842367 - RNA, 17 nt, Salmonella typhimurium LT2
uaccagaccggcaucuc

SEQ ID NO: 1842368 - RNA, 11 nt, Salmonella typhimurium LT2
uaccacaucag

SEQ ID NO: 1842369 - RNA, 15 nt, Salmonella typhimurium LT2
uaccagcaucgcguu

SEQ ID NO: 1842370 - RNA, 11 nt, Salmonella typhimurium LT2
uaccagcaccu

SEQ ID NO: 1842371 - RNA, 17 nt, Salmonella typhimurium LT2
uaccagauuaauaauag

SEQ ID NO: 1842372 - RNA, 13 nt, Salmonella typhimurium LT2
uaccagcaauaac

SEQ ID NO: 1842373 - RNA, 21 nt, Salmonella typhimurium LT2
uaccagcggucauugagccac

SEQ ID NO: 1842374 - RNA, 17 nt, Salmonella typhimurium LT2
uaccagcgucaucggau

SEQ ID NO: 1842375 - RNA, 19 nt, Salmonella typhimurium LT2
uaccagcgcgaacauuaca

SEQ ID NO: 1842376 - RNA, 23 nt, Salmonella typhimurium LT2
uaccagccuucggacugcuggua

SEQ ID NO: 1842377 - RNA, 19 nt, Salmonella typhimurium LT2
uaccagccuggcugaacca

SEQ ID NO: 1842378 - RNA, 18 nt, Salmonella typhimurium LT2
uacccagcgaaugcugca

SEQ ID NO: 1842379 - RNA, 22 nt, Salmonella typhimurium LT2
uacccagcgccaacgccacugc

SEQ ID NO: 1842380 - RNA, 23 nt, Salmonella typhimurium LT2
uaccccagcgcgccgcagcgccg

SEQ ID NO: 1842381 - RNA, 13 nt, Salmonella typhimurium LT2
uaccccagcaucu

SEQ ID NO: 1842382 - RNA, 17 nt, Salmonella typhimurium LT2
uaccccacgccauaaug

SEQ ID NO: 1842383 - RNA, 16 nt, Salmonella typhimurium LT2
uaccccgccaccgccg

SEQ ID NO: 1842384 - RNA, 18 nt, Salmonella typhimurium LT2
uacccaguaccauaccgg

SEQ ID NO: 1842385 - RNA, 13 nt, Salmonella typhimurium LT2
uacccaguaccau

SEQ ID NO: 1842386 - RNA, 20 nt, Salmonella typhimurium LT2
uacccaggcgucgaacuccu

SEQ ID NO: 1842387 - RNA, 15 nt, Salmonella typhimurium LT2
uacccagcucagcuu

SEQ ID NO: 1842388 - RNA, 23 nt, Salmonella typhimurium LT2
uacccagcuuucucacuugcaga

SEQ ID NO: 1842389 - RNA, 19 nt, Salmonella typhimurium LT2
uaccaucuacuaucaucug

SEQ ID NO: 1842390 - RNA, 19 nt, Salmonella typhimurium LT2
uaccaggcggcuuuuucau

SEQ ID NO: 1842391 - RNA, 23 nt, Salmonella typhimurium LT2
uaccaggcggcuuuuucaucauc

SEQ ID NO: 1842392 - RNA, 17 nt, Salmonella typhimurium LT2
uaccagcgauaguuguu

SEQ ID NO: 1842393 - RNA, 23 nt, Salmonella typhimurium LT2
uaccaggcauaauggaacugccu

SEQ ID NO: 1842394 - RNA, 22 nt, Salmonella typhimurium LT2
uaccauaccggugcgccccagc

SEQ ID NO: 1842395 - RNA, 21 nt, Salmonella typhimurium LT2
uacccgguacuuucuccaugc

SEQ ID NO: 1842396 - RNA, 21 nt, Salmonella typhimurium LT2
uacccgguguaaaaaaugggu

SEQ ID NO: 1842397 - RNA, 19 nt, Salmonella typhimurium LT2
uacccgcgcaucccacacc

SEQ ID NO: 1842398 - RNA, 21 nt, Salmonella typhimurium LT2
uacccgcgcaucccacaccac

SEQ ID NO: 1842399 - RNA, 19 nt, Salmonella typhimurium LT2
uacccgcgccgguucuccc

SEQ ID NO: 1842400 - RNA, 21 nt, Salmonella typhimurium LT2
uaccccuuuuucaauuuccag

SEQ ID NO: 1842401 - RNA, 21 nt, Salmonella typhimurium LT2
uaccccucuuucacagcuccu

SEQ ID NO: 1842402 - RNA, 18 nt, Salmonella typhimurium LT2
uacccgcaguagcuaaug

SEQ ID NO: 1842403 - RNA, 21 nt, Salmonella typhimurium LT2
uacccgacagcggcgcagaca

SEQ ID NO: 1842404 - RNA, 17 nt, Salmonella typhimurium LT2
uacccuguauuuuuucc

SEQ ID NO: 1842405 - RNA, 18 nt, Salmonella typhimurium LT2
uacccuguauuuuuucca

SEQ ID NO: 1842406 - RNA, 15 nt, Salmonella typhimurium LT2
uaccgaacagccagg

SEQ ID NO: 1842407 - RNA, 19 nt, Salmonella typhimurium LT2
uacccuuuucuuuaaacaa

SEQ ID NO: 1842408 - RNA, 21 nt, Salmonella typhimurium LT2
uacccucccuuucuucucaac

SEQ ID NO: 1842409 - RNA, 16 nt, Salmonella typhimurium LT2
uaccgacacaucaucg

SEQ ID NO: 1842410 - RNA, 15 nt, Salmonella typhimurium LT2
uaccgaaaucaucaa

SEQ ID NO: 1842411 - RNA, 21 nt, Salmonella typhimurium LT2
uaccgaacaaugugcgggggu

SEQ ID NO: 1842412 - RNA, 15 nt, Salmonella typhimurium LT2
uaccgauagcgcgga

SEQ ID NO: 1842413 - RNA, 19 nt, Salmonella typhimurium LT2
uaccgauaaaucaaacgca

SEQ ID NO: 1842414 - RNA, 20 nt, Salmonella typhimurium LT2
uaccgauaaaucaaacgcac

SEQ ID NO: 1842415 - RNA, 21 nt, Salmonella typhimurium LT2
uaccgccaccuuucugcucca

SEQ ID NO: 1842416 - RNA, 16 nt, Salmonella typhimurium LT2
uaccgcuaaaauaccc

SEQ ID NO: 1842417 - RNA, 18 nt, Salmonella typhimurium LT2
uaccgcagcgaaugugcu

SEQ ID NO: 1842418 - RNA, 20 nt, Salmonella typhimurium LT2
uaccggaaucgccugcgucg

SEQ ID NO: 1842419 - RNA, 20 nt, Salmonella typhimurium LT2
uaccgcuugggccaccugcc

SEQ ID NO: 1842420 - RNA, 23 nt, Salmonella typhimurium LT2
uaccgcuugggccaccugccagg

SEQ ID NO: 1842421 - RNA, 22 nt, Salmonella typhimurium LT2
uaccgcuucuuaauggccagua

SEQ ID NO: 1842422 - RNA, 23 nt, Salmonella typhimurium LT2
uacugcucauaacccuccugccu

SEQ ID NO: 1842423 - RNA, 21 nt, Salmonella typhimurium LT2
uacugcgcucuaucaccgccc

SEQ ID NO: 1842424 - RNA, 18 nt, Salmonella typhimurium LT2
uacugcgcguggcaaaua

SEQ ID NO: 1842425 - RNA, 18 nt, Salmonella typhimurium LT2
uacugcuuagcuguuacg

SEQ ID NO: 1842426 - RNA, 18 nt, Salmonella typhimurium LT2
uacugcuuagcucaucag

SEQ ID NO: 1842427 - RNA, 18 nt, Salmonella typhimurium LT2
uacugcuguccgccagca

SEQ ID NO: 1842428 - RNA, 20 nt, Salmonella typhimurium LT2
uacuucucgaaguucucaau

SEQ ID NO: 1842429 - RNA, 16 nt, Salmonella typhimurium LT2
uacuucugacagugac

SEQ ID NO: 1842430 - RNA, 18 nt, Salmonella typhimurium LT2
uacuuaucaacuucuuca

SEQ ID NO: 1842431 - RNA, 15 nt, Salmonella typhimurium LT2
uacucugcucgccag

SEQ ID NO: 1842432 - RNA, 19 nt, Salmonella typhimurium LT2
uacucuuggagagcaucau

SEQ ID NO: 1842433 - RNA, 13 nt, Salmonella typhimurium LT2
uacucuuguugug

SEQ ID NO: 1842434 - RNA, 12 nt, Salmonella typhimurium LT2
uacucuuccucc

SEQ ID NO: 1842435 - RNA, 16 nt, Salmonella typhimurium LT2
uacucugcuuuuucac

SEQ ID NO: 1842436 - RNA, 14 nt, Salmonella typhimurium LT2
uacugauaagcaua

SEQ ID NO: 1842437 - RNA, 16 nt, Salmonella typhimurium LT2
uacugauuccugccag

SEQ ID NO: 1842438 - RNA, 17 nt, Salmonella typhimurium LT2
uacugauuuaacauguu

SEQ ID NO: 1842439 - RNA, 15 nt, Salmonella typhimurium LT2
uacugcauuuucaau

SEQ ID NO: 1842440 - RNA, 20 nt, Salmonella typhimurium LT2
uacugcaacgccagaugcgu

SEQ ID NO: 1842441 - RNA, 14 nt, Salmonella typhimurium LT2
uacugacuuaauaa

SEQ ID NO: 1842442 - RNA, 20 nt, Salmonella typhimurium LT2
uacugaccaagcgucagcau

SEQ ID NO: 1842443 - RNA, 16 nt, Salmonella typhimurium LT2
uacugaauaccuucuu

SEQ ID NO: 1842444 - RNA, 22 nt, Salmonella typhimurium LT2
uacugaaaaguagcaagguaug

SEQ ID NO: 1842445 - RNA, 13 nt, Salmonella typhimurium LT2
uacucuuuuuccg

SEQ ID NO: 1842446 - RNA, 19 nt, Salmonella typhimurium LT2
uacucuuugaacagccaga

SEQ ID NO: 1842447 - RNA, 23 nt, Salmonella typhimurium LT2
uacgucgcacggaucaucuaccc

SEQ ID NO: 1842448 - RNA, 16 nt, Salmonella typhimurium LT2
uacgucauaucaucca

SEQ ID NO: 1842449 - RNA, 16 nt, Salmonella typhimurium LT2
uacgugaaacugauag

SEQ ID NO: 1842450 - RNA, 13 nt, Salmonella typhimurium LT2
uacggcuuccacu

SEQ ID NO: 1842451 - RNA, 20 nt, Salmonella typhimurium LT2
uacggcuuucacaccguuau

SEQ ID NO: 1842452 - RNA, 21 nt, Salmonella typhimurium LT2
uacgggagagcguauccagca

SEQ ID NO: 1842453 - RNA, 20 nt, Salmonella typhimurium LT2
uacggcguuucacuucugag

SEQ ID NO: 1842454 - RNA, 15 nt, Salmonella typhimurium LT2
uacguaacaugaccu

SEQ ID NO: 1842455 - RNA, 18 nt, Salmonella typhimurium LT2
uacgggcaugaagaaaau

SEQ ID NO: 1842456 - RNA, 19 nt, Salmonella typhimurium LT2
uacguagccgcaaaugcca

SEQ ID NO: 1842457 - RNA, 14 nt, Salmonella typhimurium LT2
uacggcccagaccc

SEQ ID NO: 1842458 - RNA, 14 nt, Salmonella typhimurium LT2
uacgcgucaauuac

SEQ ID NO: 1842459 - RNA, 16 nt, Salmonella typhimurium LT2
uacgcgggguaaaaug

SEQ ID NO: 1842460 - RNA, 22 nt, Salmonella typhimurium LT2
uacgcggugcgccguaaacaau

SEQ ID NO: 1842461 - RNA, 18 nt, Salmonella typhimurium LT2
uacgcgccacgccauugc

SEQ ID NO: 1842462 - RNA, 22 nt, Salmonella typhimurium LT2
uacgcggcgcgcucuuuuucuu

SEQ ID NO: 1842463 - RNA, 17 nt, Salmonella typhimurium LT2
uacgcgcugcaaauacu

SEQ ID NO: 1842464 - RNA, 21 nt, Salmonella typhimurium LT2
uacgcgaugagauaauaaaug

SEQ ID NO: 1842465 - RNA, 19 nt, Salmonella typhimurium LT2
uaccguaagcuuucugaau

SEQ ID NO: 1842466 - RNA, 15 nt, Salmonella typhimurium LT2
uaccgucaaaacgcc

SEQ ID NO: 1842467 - RNA, 15 nt, Salmonella typhimurium LT2
uaccgucagcagcac

SEQ ID NO: 1842468 - RNA, 16 nt, Salmonella typhimurium LT2
uacgacuggauacagg

SEQ ID NO: 1842469 - RNA, 14 nt, Salmonella typhimurium LT2
uacgacuuacgcag

SEQ ID NO: 1842470 - RNA, 14 nt, Salmonella typhimurium LT2
uacgaccgccgaca

SEQ ID NO: 1842471 - RNA, 16 nt, Salmonella typhimurium LT2
uacgcaaaaaaagcca

SEQ ID NO: 1842472 - RNA, 17 nt, Salmonella typhimurium LT2
uacgcaaaaaaagccau

SEQ ID NO: 1842473 - RNA, 19 nt, Salmonella typhimurium LT2
uacgauuucucgccauugc

SEQ ID NO: 1842474 - RNA, 13 nt, Salmonella typhimurium LT2
uacgcaucaccag

SEQ ID NO: 1842475 - RNA, 20 nt, Salmonella typhimurium LT2
uacgccaggaucgucgguca

SEQ ID NO: 1842476 - RNA, 14 nt, Salmonella typhimurium LT2
uacgccacgcucca

SEQ ID NO: 1842477 - RNA, 21 nt, Salmonella typhimurium LT2
uacgcaccagcucuacaucgc

SEQ ID NO: 1842478 - RNA, 16 nt, Salmonella typhimurium LT2
uacgcagcaggcagac

SEQ ID NO: 1842479 - RNA, 17 nt, Salmonella typhimurium LT2
uacgcaguuuaaagcca

SEQ ID NO: 1842480 - RNA, 20 nt, Salmonella typhimurium LT2
uacgccaucagcauuuucac

SEQ ID NO: 1842481 - RNA, 15 nt, Salmonella typhimurium LT2
uacgccccacuuuca

SEQ ID NO: 1842482 - RNA, 13 nt, Salmonella typhimurium LT2
guccauauucagu

SEQ ID NO: 1842483 - RNA, 15 nt, Salmonella typhimurium LT2
guccaucagauucaa

SEQ ID NO: 1842484 - RNA, 14 nt, Salmonella typhimurium LT2
gucccagcacaauc

SEQ ID NO: 1842485 - RNA, 16 nt, Salmonella typhimurium LT2
gucccagcgucaacug

SEQ ID NO: 1842486 - RNA, 17 nt, Salmonella typhimurium LT2
guccaggccguagcgca

SEQ ID NO: 1842487 - RNA, 20 nt, Salmonella typhimurium LT2
guccauaccggacuccaggc

SEQ ID NO: 1842488 - RNA, 13 nt, Salmonella typhimurium LT2
guccaccagcaca

SEQ ID NO: 1842489 - RNA, 14 nt, Salmonella typhimurium LT2
guccaccagcgcca

SEQ ID NO: 1842490 - RNA, 17 nt, Salmonella typhimurium LT2
guccacaccuuccacuu

SEQ ID NO: 1842491 - RNA, 14 nt, Salmonella typhimurium LT2
guccagcggcagcu

SEQ ID NO: 1842492 - RNA, 16 nt, Salmonella typhimurium LT2
guccagccggugguuc

SEQ ID NO: 1842493 - RNA, 14 nt, Salmonella typhimurium LT2
gucaugaagcucaa

SEQ ID NO: 1842494 - RNA, 14 nt, Salmonella typhimurium LT2
gucaucgcucauca

SEQ ID NO: 1842495 - RNA, 12 nt, Salmonella typhimurium LT2
gucauuuugccg

SEQ ID NO: 1842496 - RNA, 22 nt, Salmonella typhimurium LT2
gucaucaaauuaucuguugaua

SEQ ID NO: 1842497 - RNA, 22 nt, Salmonella typhimurium LT2
gucaucaagauuuugugaccgc

SEQ ID NO: 1842498 - RNA, 16 nt, Salmonella typhimurium LT2
gucaucaccuccagca

SEQ ID NO: 1842499 - RNA, 19 nt, Salmonella typhimurium LT2
gucauaucgaugguaauaa

SEQ ID NO: 1842500 - RNA, 20 nt, Salmonella typhimurium LT2
gucagguuacgcacuacauc

SEQ ID NO: 1842501 - RNA, 14 nt, Salmonella typhimurium LT2
gucauauugccgcc

SEQ ID NO: 1842502 - RNA, 13 nt, Salmonella typhimurium LT2
gucauauuuucag

SEQ ID NO: 1842503 - RNA, 15 nt, Salmonella typhimurium LT2
gucaucaucaggaac

SEQ ID NO: 1842504 - RNA, 18 nt, Salmonella typhimurium LT2
gucaucauuacaggcgaa

SEQ ID NO: 1842505 - RNA, 13 nt, Salmonella typhimurium LT2
gucauccagcgag

SEQ ID NO: 1842506 - RNA, 17 nt, Salmonella typhimurium LT2
gucaucccgaaccuggu

SEQ ID NO: 1842507 - RNA, 17 nt, Salmonella typhimurium LT2
gucauccauccacggca

SEQ ID NO: 1842508 - RNA, 11 nt, Salmonella typhimurium LT2
gucauccgcgu

SEQ ID NO: 1842509 - RNA, 17 nt, Salmonella typhimurium LT2
gucauccuguucaucca

SEQ ID NO: 1842510 - RNA, 16 nt, Salmonella typhimurium LT2
gucaucgcaaauucug

SEQ ID NO: 1842511 - RNA, 12 nt, Salmonella typhimurium LT2
gucagccuugac

SEQ ID NO: 1842512 - RNA, 20 nt, Salmonella typhimurium LT2
gucaggccggugugcuugcg

SEQ ID NO: 1842513 - RNA, 23 nt, Salmonella typhimurium LT2
gucagggucuuauuucuccugcg

SEQ ID NO: 1842514 - RNA, 19 nt, Salmonella typhimurium LT2
gucagggugaauaccagcg

SEQ ID NO: 1842515 - RNA, 21 nt, Salmonella typhimurium LT2
gucagggugaauaccagcggc

SEQ ID NO: 1842516 - RNA, 12 nt, Salmonella typhimurium LT2
gucaggcuaaau

SEQ ID NO: 1842517 - RNA, 15 nt, Salmonella typhimurium LT2
gucaggcucuaauaa

SEQ ID NO: 1842518 - RNA, 14 nt, Salmonella typhimurium LT2
gucacuaacuccag

SEQ ID NO: 1842519 - RNA, 24 nt, Salmonella typhimurium LT2
gucacgugacgcagacgauaccag

SEQ ID NO: 1842520 - RNA, 19 nt, Salmonella typhimurium LT2
gucacgguuuauccccgcu

SEQ ID NO: 1842521 - RNA, 19 nt, Salmonella typhimurium LT2
gucagcauaauauccugca

SEQ ID NO: 1842522 - RNA, 18 nt, Salmonella typhimurium LT2
gucagcacuucccacugu

SEQ ID NO: 1842523 - RNA, 21 nt, Salmonella typhimurium LT2
gucaagaucgcgcagcaggcc

SEQ ID NO: 1842524 - RNA, 20 nt, Salmonella typhimurium LT2
ggugaaggcaaaacaccaua

SEQ ID NO: 1842525 - RNA, 20 nt, Salmonella typhimurium LT2
ggugaaccaaagcaaaaaau

SEQ ID NO: 1842526 - RNA, 22 nt, Salmonella typhimurium LT2
ggugaaccaaagcaaaaaauga

SEQ ID NO: 1842527 - RNA, 16 nt, Salmonella typhimurium LT2
gucaaugaucagcuug

SEQ ID NO: 1842528 - RNA, 22 nt, Salmonella typhimurium LT2
gucacgcaugucguauccccag

SEQ ID NO: 1842529 - RNA, 16 nt, Salmonella typhimurium LT2
gucaccgccagugcau

SEQ ID NO: 1842530 - RNA, 15 nt, Salmonella typhimurium LT2
guccccuuuucaccc

SEQ ID NO: 1842531 - RNA, 15 nt, Salmonella typhimurium LT2
guccccugacagagc

SEQ ID NO: 1842532 - RNA, 20 nt, Salmonella typhimurium LT2
gucccgacgaacgaagagcc

SEQ ID NO: 1842533 - RNA, 21 nt, Salmonella typhimurium LT2
gucccgcagcauuuccgccgc

SEQ ID NO: 1842534 - RNA, 13 nt, Salmonella typhimurium LT2
gucccggcagugc

SEQ ID NO: 1842535 - RNA, 21 nt, Salmonella typhimurium LT2
guccugauagccguaaauaau

SEQ ID NO: 1842536 - RNA, 23 nt, Salmonella typhimurium LT2
guccugauagccguaaauaauca

SEQ ID NO: 1842537 - RNA, 16 nt, Salmonella typhimurium LT2
guccugccccugccag

SEQ ID NO: 1842538 - RNA, 17 nt, Salmonella typhimurium LT2
guccuccagcgugcaga

SEQ ID NO: 1842539 - RNA, 18 nt, Salmonella typhimurium LT2
guccuccggcugaagccc

SEQ ID NO: 1842540 - RNA, 19 nt, Salmonella typhimurium LT2
guccuccggcugaagcccc

SEQ ID NO: 1842541 - RNA, 17 nt, Salmonella typhimurium LT2
guccggcgcuaaccagc

SEQ ID NO: 1842542 - RNA, 13 nt, Salmonella typhimurium LT2
guccggggccagc

SEQ ID NO: 1842543 - RNA, 21 nt, Salmonella typhimurium LT2
guccucacacugauggcagac

SEQ ID NO: 1842544 - RNA, 17 nt, Salmonella typhimurium LT2
guccuaggacgaaaaau

SEQ ID NO: 1842545 - RNA, 18 nt, Salmonella typhimurium LT2
gucgagcucaguccagcc

SEQ ID NO: 1842546 - RNA, 15 nt, Salmonella typhimurium LT2
gucgagcgcggaggg

SEQ ID NO: 1842547 - RNA, 17 nt, Salmonella typhimurium LT2
gucgauaaaauccucua

SEQ ID NO: 1842548 - RNA, 23 nt, Salmonella typhimurium LT2
gucgauacucacgacuuucacca

SEQ ID NO: 1842549 - RNA, 16 nt, Salmonella typhimurium LT2
gucgaucacgguggug

SEQ ID NO: 1842550 - RNA, 15 nt, Salmonella typhimurium LT2
gucgaucucggccac

SEQ ID NO: 1842551 - RNA, 16 nt, Salmonella typhimurium LT2
gucgacgucuuucuua

SEQ ID NO: 1842552 - RNA, 14 nt, Salmonella typhimurium LT2
gucgagcagcagga

SEQ ID NO: 1842553 - RNA, 15 nt, Salmonella typhimurium LT2
gucgagcagcaggac

SEQ ID NO: 1842554 - RNA, 14 nt, Salmonella typhimurium LT2
gucgaccauacgca

SEQ ID NO: 1842555 - RNA, 20 nt, Salmonella typhimurium LT2
gucgaaacacgaauaauucu

SEQ ID NO: 1842556 - RNA, 14 nt, Salmonella typhimurium LT2
gucgcacuccucug

SEQ ID NO: 1842557 - RNA, 23 nt, Salmonella typhimurium LT2
gucgcccgcuaagggcaccagca

SEQ ID NO: 1842558 - RNA, 15 nt, Salmonella typhimurium LT2
gucgccgcgcccagc

SEQ ID NO: 1842559 - RNA, 15 nt, Salmonella typhimurium LT2
gucgcggaacgcccu

SEQ ID NO: 1842560 - RNA, 14 nt, Salmonella typhimurium LT2
gucgccuuccagcg

SEQ ID NO: 1842561 - RNA, 18 nt, Salmonella typhimurium LT2
gucgccuuccugcaggcg

SEQ ID NO: 1842562 - RNA, 13 nt, Salmonella typhimurium LT2
gucgggccugcug

SEQ ID NO: 1842563 - RNA, 17 nt, Salmonella typhimurium LT2
gucgggccgcgcugcgc

SEQ ID NO: 1842564 - RNA, 12 nt, Salmonella typhimurium LT2
gucgcuuccugu

SEQ ID NO: 1842565 - RNA, 15 nt, Salmonella typhimurium LT2
gucggcucauccagc

SEQ ID NO: 1842566 - RNA, 22 nt, Salmonella typhimurium LT2
gucuggauuuggcugccgagca

SEQ ID NO: 1842567 - RNA, 15 nt, Salmonella typhimurium LT2
gucugcuucgucugg

SEQ ID NO: 1842568 - RNA, 23 nt, Salmonella typhimurium LT2
gucugcugggcgauuucacgaau

SEQ ID NO: 1842569 - RNA, 19 nt, Salmonella typhimurium LT2
gucugcgucuucuuccacu

SEQ ID NO: 1842570 - RNA, 15 nt, Salmonella typhimurium LT2
gucugcgcugggccg

SEQ ID NO: 1842571 - RNA, 18 nt, Salmonella typhimurium LT2
gucugcgcucuuuuuuaa

SEQ ID NO: 1842572 - RNA, 22 nt, Salmonella typhimurium LT2
gucugcgcugggccgggccuga

SEQ ID NO: 1842573 - RNA, 15 nt, Salmonella typhimurium LT2
gucuggugauccagc

SEQ ID NO: 1842574 - RNA, 20 nt, Salmonella typhimurium LT2
gucugguaucugucaugcgg

SEQ ID NO: 1842575 - RNA, 20 nt, Salmonella typhimurium LT2
gucugacaacuauugcugcc

SEQ ID NO: 1842576 - RNA, 17 nt, Salmonella typhimurium LT2
gucugacggccugucuc

SEQ ID NO: 1842577 - RNA, 23 nt, Salmonella typhimurium LT2
gucugaaucaaugcaucuucacu

SEQ ID NO: 1842578 - RNA, 19 nt, Salmonella typhimurium LT2
gucugaagaaguucuucug

SEQ ID NO: 1842579 - RNA, 16 nt, Salmonella typhimurium LT2
gucugcccgcgccauc

SEQ ID NO: 1842580 - RNA, 14 nt, Salmonella typhimurium LT2
gucugccagcuccu

SEQ ID NO: 1842581 - RNA, 21 nt, Salmonella typhimurium LT2
gucugauugcgcccuccggca

SEQ ID NO: 1842582 - RNA, 23 nt, Salmonella typhimurium LT2
gucugauugcgcccuccggcaag

SEQ ID NO: 1842583 - RNA, 20 nt, Salmonella typhimurium LT2
gucugaugagcgcagcgacu

SEQ ID NO: 1842584 - RNA, 21 nt, Salmonella typhimurium LT2
gucugcacgccaauaauuucg

SEQ ID NO: 1842585 - RNA, 15 nt, Salmonella typhimurium LT2
gucucuucaugccuc

SEQ ID NO: 1842586 - RNA, 14 nt, Salmonella typhimurium LT2
gucucuucuuccgc

SEQ ID NO: 1842587 - RNA, 14 nt, Salmonella typhimurium LT2
gucucuucgcuggc

SEQ ID NO: 1842588 - RNA, 23 nt, Salmonella typhimurium LT2
gucucuuuagaaaaagaaaccuc

SEQ ID NO: 1842589 - RNA, 14 nt, Salmonella typhimurium LT2
gucucgcguccauu

SEQ ID NO: 1842590 - RNA, 18 nt, Salmonella typhimurium LT2
gucuccggcgcgccgcug

SEQ ID NO: 1842591 - RNA, 19 nt, Salmonella typhimurium LT2
gucuccugccgaugaaaua

SEQ ID NO: 1842592 - RNA, 17 nt, Salmonella typhimurium LT2
gucucccagaugaaaaa

SEQ ID NO: 1842593 - RNA, 21 nt, Salmonella typhimurium LT2
gucucauuguguacauccagg

SEQ ID NO: 1842594 - RNA, 23 nt, Salmonella typhimurium LT2
gucguuaaaacgguaugaaggac

SEQ ID NO: 1842595 - RNA, 16 nt, Salmonella typhimurium LT2
gucguuaucgccccag

SEQ ID NO: 1842596 - RNA, 14 nt, Salmonella typhimurium LT2
gucgugccuuccgc

SEQ ID NO: 1842597 - RNA, 18 nt, Salmonella typhimurium LT2
gucgugcaaccgccugca

SEQ ID NO: 1842598 - RNA, 17 nt, Salmonella typhimurium LT2
gucgugcaaccgccugc

SEQ ID NO: 1842599 - RNA, 13 nt, Salmonella typhimurium LT2
gucuuccuuccac

SEQ ID NO: 1842600 - RNA, 21 nt, Salmonella typhimurium LT2
gucuuccagcauucuauuguu

SEQ ID NO: 1842601 - RNA, 21 nt, Salmonella typhimurium LT2
gucuucgcacugcccuucccg

SEQ ID NO: 1842602 - RNA, 15 nt, Salmonella typhimurium LT2
gucuucugccagcag

SEQ ID NO: 1842603 - RNA, 19 nt, Salmonella typhimurium LT2
gucuucuaccgcuucuuaa

SEQ ID NO: 1842604 - RNA, 18 nt, Salmonella typhimurium LT2
gucuucuuaguaacauaa

SEQ ID NO: 1842605 - RNA, 17 nt, Salmonella typhimurium LT2
gucuuauuucuccugcg

SEQ ID NO: 1842606 - RNA, 19 nt, Salmonella typhimurium LT2
gucuuauccggccuccaaa

SEQ ID NO: 1842607 - RNA, 19 nt, Salmonella typhimurium LT2
gucuuagcuaucugcccug

SEQ ID NO: 1842608 - RNA, 18 nt, Salmonella typhimurium LT2
gucuuaaccuuuuguauc

SEQ ID NO: 1842609 - RNA, 17 nt, Salmonella typhimurium LT2
gucuuaaaugccgccgg

SEQ ID NO: 1842610 - RNA, 21 nt, Salmonella typhimurium LT2
gucugucagaacccugucaau

SEQ ID NO: 1842611 - RNA, 22 nt, Salmonella typhimurium LT2
gucuugucaggcucuaauaacu

SEQ ID NO: 1842612 - RNA, 21 nt, Salmonella typhimurium LT2
gucuuuacugaaucucagaua

SEQ ID NO: 1842613 - RNA, 20 nt, Salmonella typhimurium LT2
gucuuuauucugaaagaaaa

SEQ ID NO: 1842614 - RNA, 15 nt, Salmonella typhimurium LT2
gucuuucuucgcugc

SEQ ID NO: 1842615 - RNA, 13 nt, Salmonella typhimurium LT2
gucuuugaauaac

SEQ ID NO: 1842616 - RNA, 23 nt, Salmonella typhimurium LT2
gugaaaaagcggcuguagccagc

SEQ ID NO: 1842617 - RNA, 16 nt, Salmonella typhimurium LT2
gugaaaaaucccccau

SEQ ID NO: 1842618 - RNA, 22 nt, Salmonella typhimurium LT2
gugaaaaaauaucgcugcccag

SEQ ID NO: 1842619 - RNA, 13 nt, Salmonella typhimurium LT2
gucuuuuucucaa

SEQ ID NO: 1842620 - RNA, 14 nt, Salmonella typhimurium LT2
gucuuuuucucaau

SEQ ID NO: 1842621 - RNA, 16 nt, Salmonella typhimurium LT2
gucuuuguugccuucg

SEQ ID NO: 1842622 - RNA, 11 nt, Salmonella typhimurium LT2
gugaaauaaau

SEQ ID NO: 1842623 - RNA, 21 nt, Salmonella typhimurium LT2
gugaaauaaacguaccgauga

SEQ ID NO: 1842624 - RNA, 19 nt, Salmonella typhimurium LT2
gugaacauuacaauguaca

SEQ ID NO: 1842625 - RNA, 16 nt, Salmonella typhimurium LT2
gugaacaccacugaaa

SEQ ID NO: 1842626 - RNA, 15 nt, Salmonella typhimurium LT2
gugaaccaaagcaaa

SEQ ID NO: 1842627 - RNA, 22 nt, Salmonella typhimurium LT2
gugaaccaaagcaaaaaaugac

SEQ ID NO: 1842628 - RNA, 20 nt, Salmonella typhimurium LT2
gugcaggauuuguaucacaa

SEQ ID NO: 1842629 - RNA, 17 nt, Salmonella typhimurium LT2
gugcagcguuuccagcc

SEQ ID NO: 1842630 - RNA, 13 nt, Salmonella typhimurium LT2
gugcacugccuga

SEQ ID NO: 1842631 - RNA, 23 nt, Salmonella typhimurium LT2
gugcaaucccggaacagcggagc

SEQ ID NO: 1842632 - RNA, 24 nt, Salmonella typhimurium LT2
gugcaaucccggaacagcggagcg

SEQ ID NO: 1842633 - RNA, 21 nt, Salmonella typhimurium LT2
gugcaauccugucgucaccag

SEQ ID NO: 1842634 - RNA, 23 nt, Salmonella typhimurium LT2
gugcaauccugucgucaccagca

SEQ ID NO: 1842635 - RNA, 21 nt, Salmonella typhimurium LT2
gugauuaugaucgucaacgca

SEQ ID NO: 1842636 - RNA, 18 nt, Salmonella typhimurium LT2
gugaucggagaaauagac

SEQ ID NO: 1842637 - RNA, 14 nt, Salmonella typhimurium LT2
gugauuguccaacu

SEQ ID NO: 1842638 - RNA, 14 nt, Salmonella typhimurium LT2
gugauugaaguucu

SEQ ID NO: 1842639 - RNA, 19 nt, Salmonella typhimurium LT2
gugauugaaguucuuccca

SEQ ID NO: 1842640 - RNA, 21 nt, Salmonella typhimurium LT2
gugagacgcagccucucuucu

SEQ ID NO: 1842641 - RNA, 15 nt, Salmonella typhimurium LT2
gugacuuuccaguua

SEQ ID NO: 1842642 - RNA, 16 nt, Salmonella typhimurium LT2
gugacuuuccaguuaa

SEQ ID NO: 1842643 - RNA, 14 nt, Salmonella typhimurium LT2
gugagcgaaguucu

SEQ ID NO: 1842644 - RNA, 15 nt, Salmonella typhimurium LT2
gugagccuaaaacau

SEQ ID NO: 1842645 - RNA, 23 nt, Salmonella typhimurium LT2
gugagcccuccuccagcgcgucc

SEQ ID NO: 1842646 - RNA, 23 nt, Salmonella typhimurium LT2
gugagaucguuauuaaacagaca

SEQ ID NO: 1842647 - RNA, 14 nt, Salmonella typhimurium LT2
gugagauauggcac

SEQ ID NO: 1842648 - RNA, 15 nt, Salmonella typhimurium LT2
gugagauugacagaa

SEQ ID NO: 1842649 - RNA, 18 nt, Salmonella typhimurium LT2
gugaggggggauugacuc

SEQ ID NO: 1842650 - RNA, 14 nt, Salmonella typhimurium LT2
gugagcucuuucug

SEQ ID NO: 1842651 - RNA, 15 nt, Salmonella typhimurium LT2
gugaguacgcaggag

SEQ ID NO: 1842652 - RNA, 19 nt, Salmonella typhimurium LT2
gugaguguuacucuuccuc

SEQ ID NO: 1842653 - RNA, 16 nt, Salmonella typhimurium LT2
gugauaaagcagacca

SEQ ID NO: 1842654 - RNA, 14 nt, Salmonella typhimurium LT2
gugauaaagcccgu

SEQ ID NO: 1842655 - RNA, 14 nt, Salmonella typhimurium LT2
aaauaggagaugca

SEQ ID NO: 1842656 - RNA, 22 nt, Salmonella typhimurium LT2
gugaccaaaccugcgcaucguu

SEQ ID NO: 1842657 - RNA, 21 nt, Salmonella typhimurium LT2
gugacgauacggcccagaccc

SEQ ID NO: 1842658 - RNA, 15 nt, Salmonella typhimurium LT2
gugacgcagacguca

SEQ ID NO: 1842659 - RNA, 17 nt, Salmonella typhimurium LT2
gugacgucauacggagu

SEQ ID NO: 1842660 - RNA, 15 nt, Salmonella typhimurium LT2
gugacguucaucauu

SEQ ID NO: 1842661 - RNA, 21 nt, Salmonella typhimurium LT2
gugaccgguaagcccauggca

SEQ ID NO: 1842662 - RNA, 14 nt, Salmonella typhimurium LT2
gugaccugcugacu

SEQ ID NO: 1842663 - RNA, 15 nt, Salmonella typhimurium LT2
gugaccgauaaaaaa

SEQ ID NO: 1842664 - RNA, 20 nt, Salmonella typhimurium LT2
gugaccccggccucgcccgc

SEQ ID NO: 1842665 - RNA, 21 nt, Salmonella typhimurium LT2
gugaaggcaaaacaccauauu

SEQ ID NO: 1842666 - RNA, 17 nt, Salmonella typhimurium LT2
gugaagggggccagagc

SEQ ID NO: 1842667 - RNA, 16 nt, Salmonella typhimurium LT2
gugaauaccagcggca

SEQ ID NO: 1842668 - RNA, 18 nt, Salmonella typhimurium LT2
gugaauauauuggcagga

SEQ ID NO: 1842669 - RNA, 19 nt, Salmonella typhimurium LT2
gugaauaucaccccagguu

SEQ ID NO: 1842670 - RNA, 14 nt, Salmonella typhimurium LT2
gugaaccgguaaag

SEQ ID NO: 1842671 - RNA, 19 nt, Salmonella typhimurium LT2
aaauagcgccagacagaua

SEQ ID NO: 1842672 - RNA, 22 nt, Salmonella typhimurium LT2
aaauagcgcgccauauuaacaa

SEQ ID NO: 1842673 - RNA, 17 nt, Salmonella typhimurium LT2
gugaacgccuccauuuu

SEQ ID NO: 1842674 - RNA, 18 nt, Salmonella typhimurium LT2
gugaacgccaaauacguc

SEQ ID NO: 1842675 - RNA, 15 nt, Salmonella typhimurium LT2
gugaaccuccuguga

SEQ ID NO: 1842676 - RNA, 17 nt, Salmonella typhimurium LT2
gugaacgguugagcuuu

SEQ ID NO: 1842677 - RNA, 18 nt, Salmonella typhimurium LT2
guuuccacugaguuucac

SEQ ID NO: 1842678 - RNA, 21 nt, Salmonella typhimurium LT2
guuuccagcaucgaccaggau

SEQ ID NO: 1842679 - RNA, 17 nt, Salmonella typhimurium LT2
aaauauugauuaaucgu

SEQ ID NO: 1842680 - RNA, 20 nt, Salmonella typhimurium LT2
aaauauugauuaaucgucau

SEQ ID NO: 1842681 - RNA, 21 nt, Salmonella typhimurium LT2
guuucccgcgcggaaggcgcc

SEQ ID NO: 1842682 - RNA, 22 nt, Salmonella typhimurium LT2
guuucccauugggccagcagcg

SEQ ID NO: 1842683 - RNA, 21 nt, Salmonella typhimurium LT2
guuucccagucaacaaccucu

SEQ ID NO: 1842684 - RNA, 21 nt, Salmonella typhimurium LT2
guuuccguuuguaacauauuu

SEQ ID NO: 1842685 - RNA, 22 nt, Salmonella typhimurium LT2
guuuccguuuguaacauauuuu

SEQ ID NO: 1842686 - RNA, 14 nt, Salmonella typhimurium LT2
guuuccggcgggag

SEQ ID NO: 1842687 - RNA, 14 nt, Salmonella typhimurium LT2
aaauauuucuuugu

SEQ ID NO: 1842688 - RNA, 22 nt, Salmonella typhimurium LT2
guuucgaaacguucgcauccca

SEQ ID NO: 1842689 - RNA, 18 nt, Salmonella typhimurium LT2
aaaucaaagaccuccgcc

SEQ ID NO: 1842690 - RNA, 15 nt, Salmonella typhimurium LT2
aaaucaaacagaaua

SEQ ID NO: 1842691 - RNA, 13 nt, Salmonella typhimurium LT2
aaaucaaauaaga

SEQ ID NO: 1842692 - RNA, 17 nt, Salmonella typhimurium LT2
aaaucaacaaccggcug

SEQ ID NO: 1842693 - RNA, 22 nt, Salmonella typhimurium LT2
aaaucaacgaaaucagagacaa

SEQ ID NO: 1842694 - RNA, 19 nt, Salmonella typhimurium LT2
guuucucccgccagaugca

SEQ ID NO: 1842695 - RNA, 18 nt, Salmonella typhimurium LT2
guuucuagaugaugauuu

SEQ ID NO: 1842696 - RNA, 15 nt, Salmonella typhimurium LT2
guuucuacaauagag

SEQ ID NO: 1842697 - RNA, 15 nt, Salmonella typhimurium LT2
guuucuacauucaaa

SEQ ID NO: 1842698 - RNA, 22 nt, Salmonella typhimurium LT2
guuucuacuuccaccaccuccu

SEQ ID NO: 1842699 - RNA, 22 nt, Salmonella typhimurium LT2
aaaucacuggagcgcauuuuac

SEQ ID NO: 1842700 - RNA, 17 nt, Salmonella typhimurium LT2
guuucgacgggagguga

SEQ ID NO: 1842701 - RNA, 21 nt, Salmonella typhimurium LT2
guuucgauacauccggcaggc

SEQ ID NO: 1842702 - RNA, 22 nt, Salmonella typhimurium LT2
aaaucaauuccgguugcccauu

SEQ ID NO: 1842703 - RNA, 17 nt, Salmonella typhimurium LT2
aaaucaauuuuaauuua

SEQ ID NO: 1842704 - RNA, 20 nt, Salmonella typhimurium LT2
aaaucaauuuuaauuuaaua

SEQ ID NO: 1842705 - RNA, 21 nt, Salmonella typhimurium LT2
aaaucaauuuuaauuuaauaa

SEQ ID NO: 1842706 - RNA, 22 nt, Salmonella typhimurium LT2
aaaucaacgcucagaccgaucu

SEQ ID NO: 1842707 - RNA, 16 nt, Salmonella typhimurium LT2
aaaucaacggcauuca

SEQ ID NO: 1842708 - RNA, 13 nt, Salmonella typhimurium LT2
guuucgccagcgc

SEQ ID NO: 1842709 - RNA, 14 nt, Salmonella typhimurium LT2
guuucggcauccca

SEQ ID NO: 1842710 - RNA, 17 nt, Salmonella typhimurium LT2
guuucggugauuuccag

SEQ ID NO: 1842711 - RNA, 18 nt, Salmonella typhimurium LT2
guuugcucgccauaaauc

SEQ ID NO: 1842712 - RNA, 19 nt, Salmonella typhimurium LT2
guuuuacgaugguugugug

SEQ ID NO: 1842713 - RNA, 15 nt, Salmonella typhimurium LT2
guuuguuuaauuuug

SEQ ID NO: 1842714 - RNA, 14 nt, Salmonella typhimurium LT2
guuuuagcaugaca

SEQ ID NO: 1842715 - RNA, 23 nt, Salmonella typhimurium LT2
guuugaggaaaccuuucuucucu

SEQ ID NO: 1842716 - RNA, 13 nt, Salmonella typhimurium LT2
guuucuucugucc

SEQ ID NO: 1842717 - RNA, 19 nt, Salmonella typhimurium LT2
guuugagaaaaacaucaug

SEQ ID NO: 1842718 - RNA, 19 nt, Salmonella typhimurium LT2
guuugaggcuugcagcauu

SEQ ID NO: 1842719 - RNA, 17 nt, Salmonella typhimurium LT2
guuucuucaggccagcc

SEQ ID NO: 1842720 - RNA, 19 nt, Salmonella typhimurium LT2
guuucucuugugcuuccag

SEQ ID NO: 1842721 - RNA, 22 nt, Salmonella typhimurium LT2
guuucucuugugcuuccagcuc

SEQ ID NO: 1842722 - RNA, 14 nt, Salmonella typhimurium LT2
guuuugcccauuuc

SEQ ID NO: 1842723 - RNA, 18 nt, Salmonella typhimurium LT2
guuuugcugauaugaaac

SEQ ID NO: 1842724 - RNA, 18 nt, Salmonella typhimurium LT2
guuuugccaguuucucaa

SEQ ID NO: 1842725 - RNA, 21 nt, Salmonella typhimurium LT2
guuuugaucgaaucucccgau

SEQ ID NO: 1842726 - RNA, 21 nt, Salmonella typhimurium LT2
guuuucaggaaggagcaaaca

SEQ ID NO: 1842727 - RNA, 22 nt, Salmonella typhimurium LT2
aaaucauuuguacaaaaaaugu

SEQ ID NO: 1842728 - RNA, 14 nt, Salmonella typhimurium LT2
aaauccaacucagu

SEQ ID NO: 1842729 - RNA, 15 nt, Salmonella typhimurium LT2
aaauccaacucaguu

SEQ ID NO: 1842730 - RNA, 24 nt, Salmonella typhimurium LT2
aaaucaucaaucgcuaucugacag

SEQ ID NO: 1842731 - RNA, 19 nt, Salmonella typhimurium LT2
aaaucaucaauggcgauuu

SEQ ID NO: 1842732 - RNA, 20 nt, Salmonella typhimurium LT2
aaaucauuuguacaaaaaau

SEQ ID NO: 1842733 - RNA, 22 nt, Salmonella typhimurium LT2
aaaucaguuguacuuguugcug

SEQ ID NO: 1842734 - RNA, 11 nt, Salmonella typhimurium LT2
aaauauuaaga

SEQ ID NO: 1842735 - RNA, 12 nt, Salmonella typhimurium LT2
aaauauuaagau

SEQ ID NO: 1842736 - RNA, 14 nt, Salmonella typhimurium LT2
aaauauuccaucaa

SEQ ID NO: 1842737 - RNA, 14 nt, Salmonella typhimurium LT2
guuucagugauaaa

SEQ ID NO: 1842738 - RNA, 17 nt, Salmonella typhimurium LT2
guuucacgcucuucgcc

SEQ ID NO: 1842739 - RNA, 16 nt, Salmonella typhimurium LT2
guuucaccgccagagc

SEQ ID NO: 1842740 - RNA, 13 nt, Salmonella typhimurium LT2
guuucaccagcac

SEQ ID NO: 1842741 - RNA, 14 nt, Salmonella typhimurium LT2
guuucagcagcggu

SEQ ID NO: 1842742 - RNA, 21 nt, Salmonella typhimurium LT2
guuucagcguuucaccuucac

SEQ ID NO: 1842743 - RNA, 15 nt, Salmonella typhimurium LT2
guuucagcuuccagu

SEQ ID NO: 1842744 - RNA, 20 nt, Salmonella typhimurium LT2
aaauaucgcguuaauuuuua

SEQ ID NO: 1842745 - RNA, 15 nt, Salmonella typhimurium LT2
aaauaugcaauuaau

SEQ ID NO: 1842746 - RNA, 19 nt, Salmonella typhimurium LT2
aaauaugaugcuaucuuug

SEQ ID NO: 1842747 - RNA, 22 nt, Salmonella typhimurium LT2
aaauaugaugcuaucuuugcug

SEQ ID NO: 1842748 - RNA, 23 nt, Salmonella typhimurium LT2
guuucaauauagccguggcuggc

SEQ ID NO: 1842749 - RNA, 18 nt, Salmonella typhimurium LT2
guuucaauuccacaggcg

SEQ ID NO: 1842750 - RNA, 21 nt, Salmonella typhimurium LT2
guuucaacccccucagcaaug

SEQ ID NO: 1842751 - RNA, 18 nt, Salmonella typhimurium LT2
guuuauccccgucauacu

SEQ ID NO: 1842752 - RNA, 18 nt, Salmonella typhimurium LT2
guuuauccgccagccagc

SEQ ID NO: 1842753 - RNA, 13 nt, Salmonella typhimurium LT2
guuuauccggcac

SEQ ID NO: 1842754 - RNA, 17 nt, Salmonella typhimurium LT2
guuuaucucugcgcaau

SEQ ID NO: 1842755 - RNA, 17 nt, Salmonella typhimurium LT2
guuuaucugaugccuga

SEQ ID NO: 1842756 - RNA, 21 nt, Salmonella typhimurium LT2
guuuaucuggcuuacaggcac

SEQ ID NO: 1842757 - RNA, 14 nt, Salmonella typhimurium LT2
guuguccagcagca

SEQ ID NO: 1842758 - RNA, 16 nt, Salmonella typhimurium LT2
guugucgagguuauaa

SEQ ID NO: 1842759 - RNA, 15 nt, Salmonella typhimurium LT2
guuuacgccgccauc

SEQ ID NO: 1842760 - RNA, 20 nt, Salmonella typhimurium LT2
guuuacgcgcaaucagcacc

SEQ ID NO: 1842761 - RNA, 20 nt, Salmonella typhimurium LT2
guuuaaugucaccaucaucg

SEQ ID NO: 1842762 - RNA, 15 nt, Salmonella typhimurium LT2
guuuaaucauaaaac

SEQ ID NO: 1842763 - RNA, 18 nt, Salmonella typhimurium LT2
guuuacgcccucaucggc

SEQ ID NO: 1842764 - RNA, 14 nt, Salmonella typhimurium LT2
guuuacgcugcucc

SEQ ID NO: 1842765 - RNA, 13 nt, Salmonella typhimurium LT2
guuuacuccauuc

SEQ ID NO: 1842766 - RNA, 17 nt, Salmonella typhimurium LT2
guugcgucaccgggcug

SEQ ID NO: 1842767 - RNA, 13 nt, Salmonella typhimurium LT2
guugcuaaaucca

SEQ ID NO: 1842768 - RNA, 12 nt, Salmonella typhimurium LT2
guugcucuuucu

SEQ ID NO: 1842769 - RNA, 18 nt, Salmonella typhimurium LT2
guugcuguuccagccgcc

SEQ ID NO: 1842770 - RNA, 14 nt, Salmonella typhimurium LT2
guugcgcccaucau

SEQ ID NO: 1842771 - RNA, 14 nt, Salmonella typhimurium LT2
guugcgcugguugg

SEQ ID NO: 1842772 - RNA, 20 nt, Salmonella typhimurium LT2
guugcggguguucaccgcua

SEQ ID NO: 1842773 - RNA, 14 nt, Salmonella typhimurium LT2
guugcguauuuuua

SEQ ID NO: 1842774 - RNA, 15 nt, Salmonella typhimurium LT2
guugcgcuucgcucc

SEQ ID NO: 1842775 - RNA, 16 nt, Salmonella typhimurium LT2
guugcuuuauaaaaag

SEQ ID NO: 1842776 - RNA, 18 nt, Salmonella typhimurium LT2
guuggcguaaaucaggcc

SEQ ID NO: 1842777 - RNA, 17 nt, Salmonella typhimurium LT2
guugccuuugucaucca

SEQ ID NO: 1842778 - RNA, 21 nt, Salmonella typhimurium LT2
guugcgcagcguuuccagacu

SEQ ID NO: 1842779 - RNA, 14 nt, Salmonella typhimurium LT2
guugcgcaauauaa

SEQ ID NO: 1842780 - RNA, 15 nt, Salmonella typhimurium LT2
guugcgacaaccugu

SEQ ID NO: 1842781 - RNA, 19 nt, Salmonella typhimurium LT2
guugauacaggaauaacca

SEQ ID NO: 1842782 - RNA, 23 nt, Salmonella typhimurium LT2
guugauacagaaaaccggcaaau

SEQ ID NO: 1842783 - RNA, 20 nt, Salmonella typhimurium LT2
guugauaaaacacucuuuuu

SEQ ID NO: 1842784 - RNA, 13 nt, Salmonella typhimurium LT2
guugauaauauua

SEQ ID NO: 1842785 - RNA, 21 nt, Salmonella typhimurium LT2
guugcaauaaaauauccucca

SEQ ID NO: 1842786 - RNA, 15 nt, Salmonella typhimurium LT2
guugcaaucgccuga

SEQ ID NO: 1842787 - RNA, 17 nt, Salmonella typhimurium LT2
guugagcgcuugcugcg

SEQ ID NO: 1842788 - RNA, 23 nt, Salmonella typhimurium LT2
guugagcguuacgggaacagaau

SEQ ID NO: 1842789 - RNA, 11 nt, Salmonella typhimurium LT2
guuaauuucuu

SEQ ID NO: 1842790 - RNA, 20 nt, Salmonella typhimurium LT2
guuaauuggcccuucagacg

SEQ ID NO: 1842791 - RNA, 21 nt, Salmonella typhimurium LT2
guuaaugguaccaauagccuu

SEQ ID NO: 1842792 - RNA, 23 nt, Salmonella typhimurium LT2
guuaacucaagcgaauccagauc

SEQ ID NO: 1842793 - RNA, 19 nt, Salmonella typhimurium LT2
guuaacccacaacgcacca

SEQ ID NO: 1842794 - RNA, 18 nt, Salmonella typhimurium LT2
guuaacucuuuugcagca

SEQ ID NO: 1842795 - RNA, 17 nt, Salmonella typhimurium LT2
guuaacccgguuuaucc

SEQ ID NO: 1842796 - RNA, 19 nt, Salmonella typhimurium LT2
guuaacccgguuuaucccc

SEQ ID NO: 1842797 - RNA, 17 nt, Salmonella typhimurium LT2
guuaacccguccauauu

SEQ ID NO: 1842798 - RNA, 12 nt, Salmonella typhimurium LT2
guuaacuucaag

SEQ ID NO: 1842799 - RNA, 21 nt, Salmonella typhimurium LT2
guuaaaaaucgcuauauugcu

SEQ ID NO: 1842800 - RNA, 18 nt, Salmonella typhimurium LT2
guuaaaacggaucagccu

SEQ ID NO: 1842801 - RNA, 21 nt, Salmonella typhimurium LT2
guguugaaauacuuacuguuu

SEQ ID NO: 1842802 - RNA, 19 nt, Salmonella typhimurium LT2
guuaucuuuuauuucaucu

SEQ ID NO: 1842803 - RNA, 16 nt, Salmonella typhimurium LT2
guuaugaaacccgcca

SEQ ID NO: 1842804 - RNA, 21 nt, Salmonella typhimurium LT2
guuaugccaucuaacacaaau

SEQ ID NO: 1842805 - RNA, 15 nt, Salmonella typhimurium LT2
guuaugcccuuccag

SEQ ID NO: 1842806 - RNA, 20 nt, Salmonella typhimurium LT2
guuaugccgacaguuuuacc

SEQ ID NO: 1842807 - RNA, 11 nt, Salmonella typhimurium LT2
guuaugccauc

SEQ ID NO: 1842808 - RNA, 17 nt, Salmonella typhimurium LT2
guuaucaaaaaaaacca

SEQ ID NO: 1842809 - RNA, 13 nt, Salmonella typhimurium LT2
guuagcuggcugu

SEQ ID NO: 1842810 - RNA, 21 nt, Salmonella typhimurium LT2
guuauagacgccggucaugcc

SEQ ID NO: 1842811 - RNA, 11 nt, Salmonella typhimurium LT2
guuaguguccu

SEQ ID NO: 1842812 - RNA, 22 nt, Salmonella typhimurium LT2
guuacucuuccuccccaggcgc

SEQ ID NO: 1842813 - RNA, 15 nt, Salmonella typhimurium LT2
guuacuauuuuucac

SEQ ID NO: 1842814 - RNA, 16 nt, Salmonella typhimurium LT2
guuaccguuuaacgca

SEQ ID NO: 1842815 - RNA, 19 nt, Salmonella typhimurium LT2
guuaccccaucauugacuu

SEQ ID NO: 1842816 - RNA, 18 nt, Salmonella typhimurium LT2
guuaccgggcaaacagca

SEQ ID NO: 1842817 - RNA, 18 nt, Salmonella typhimurium LT2
guuaccguaaucaucgcg

SEQ ID NO: 1842818 - RNA, 17 nt, Salmonella typhimurium LT2
guuagggcgcggcuggu

SEQ ID NO: 1842819 - RNA, 13 nt, Salmonella typhimurium LT2
guuagcuuucugc

SEQ ID NO: 1842820 - RNA, 17 nt, Salmonella typhimurium LT2
guuacucuucugaccau

SEQ ID NO: 1842821 - RNA, 16 nt, Salmonella typhimurium LT2
guuccgccagauacaa

SEQ ID NO: 1842822 - RNA, 22 nt, Salmonella typhimurium LT2
guuccgccacggcguccugcgc

SEQ ID NO: 1842823 - RNA, 21 nt, Salmonella typhimurium LT2
guuccauauccagcgcaggca

SEQ ID NO: 1842824 - RNA, 23 nt, Salmonella typhimurium LT2
guuccauauccagcgcaggcaac

SEQ ID NO: 1842825 - RNA, 23 nt, Salmonella typhimurium LT2
guuccgcgacaaugauuugcaac

SEQ ID NO: 1842826 - RNA, 17 nt, Salmonella typhimurium LT2
guuccugagucacagaa

SEQ ID NO: 1842827 - RNA, 16 nt, Salmonella typhimurium LT2
guuccggcagacggcu

SEQ ID NO: 1842828 - RNA, 16 nt, Salmonella typhimurium LT2
guuccugcuggcaaaa

SEQ ID NO: 1842829 - RNA, 22 nt, Salmonella typhimurium LT2
guuccugcuuggccugaagcug

SEQ ID NO: 1842830 - RNA, 16 nt, Salmonella typhimurium LT2
guucggguuuuccugc

SEQ ID NO: 1842831 - RNA, 15 nt, Salmonella typhimurium LT2
guucggguaaacgcu

SEQ ID NO: 1842832 - RNA, 15 nt, Salmonella typhimurium LT2
guuccuucagcuuca

SEQ ID NO: 1842833 - RNA, 16 nt, Salmonella typhimurium LT2
guuccuucagcuucac

SEQ ID NO: 1842834 - RNA, 13 nt, Salmonella typhimurium LT2
guucgcgacugau

SEQ ID NO: 1842835 - RNA, 17 nt, Salmonella typhimurium LT2
guucgcgcaguucaucc

SEQ ID NO: 1842836 - RNA, 15 nt, Salmonella typhimurium LT2
guucgcgcauaccuu

SEQ ID NO: 1842837 - RNA, 15 nt, Salmonella typhimurium LT2
guucgcgcaguucau

SEQ ID NO: 1842838 - RNA, 21 nt, Salmonella typhimurium LT2
guucgccuaagcguucaucag

SEQ ID NO: 1842839 - RNA, 20 nt, Salmonella typhimurium LT2
guucaccaccacccagugcc

SEQ ID NO: 1842840 - RNA, 23 nt, Salmonella typhimurium LT2
guuauuuuuguaucgauaaguca

SEQ ID NO: 1842841 - RNA, 21 nt, Salmonella typhimurium LT2
guuauuuggcgauggcagacc

SEQ ID NO: 1842842 - RNA, 12 nt, Salmonella typhimurium LT2
guucagccgcca

SEQ ID NO: 1842843 - RNA, 14 nt, Salmonella typhimurium LT2
guucagccgccagu

SEQ ID NO: 1842844 - RNA, 12 nt, Salmonella typhimurium LT2
guucagccagca

SEQ ID NO: 1842845 - RNA, 22 nt, Salmonella typhimurium LT2
guucagcgaccugcagcuccac

SEQ ID NO: 1842846 - RNA, 18 nt, Salmonella typhimurium LT2
guucagcgacaggcuguc

SEQ ID NO: 1842847 - RNA, 13 nt, Salmonella typhimurium LT2
guucaccggcggc

SEQ ID NO: 1842848 - RNA, 20 nt, Salmonella typhimurium LT2
guucacgcgccgccugcacg

SEQ ID NO: 1842849 - RNA, 18 nt, Salmonella typhimurium LT2
guuccacacguccauccg

SEQ ID NO: 1842850 - RNA, 22 nt, Salmonella typhimurium LT2
guucaucgacagguuaaaaucu

SEQ ID NO: 1842851 - RNA, 17 nt, Salmonella typhimurium LT2
guucaugcgacugccca

SEQ ID NO: 1842852 - RNA, 19 nt, Salmonella typhimurium LT2
guucaugcgacugcccaac

SEQ ID NO: 1842853 - RNA, 17 nt, Salmonella typhimurium LT2
guucaggcggcaaaaaa

SEQ ID NO: 1842854 - RNA, 19 nt, Salmonella typhimurium LT2
guucaggcggcaaaaaacg

SEQ ID NO: 1842855 - RNA, 17 nt, Salmonella typhimurium LT2
guucagguaaaugagga

SEQ ID NO: 1842856 - RNA, 15 nt, Salmonella typhimurium LT2
guucaugcacucgcg

SEQ ID NO: 1842857 - RNA, 22 nt, Salmonella typhimurium LT2
guucaugccgacgauuugcgcu

SEQ ID NO: 1842858 - RNA, 14 nt, Salmonella typhimurium LT2
gugucacucaucgg

SEQ ID NO: 1842859 - RNA, 20 nt, Salmonella typhimurium LT2
gugucagacaccgggcuauu

SEQ ID NO: 1842860 - RNA, 19 nt, Salmonella typhimurium LT2
guguaggaaaggcagagaa

SEQ ID NO: 1842861 - RNA, 16 nt, Salmonella typhimurium LT2
gugucugcuucgucug

SEQ ID NO: 1842862 - RNA, 18 nt, Salmonella typhimurium LT2
gugucuuuuacgccagga

SEQ ID NO: 1842863 - RNA, 21 nt, Salmonella typhimurium LT2
guguccaggucaucaccucca

SEQ ID NO: 1842864 - RNA, 18 nt, Salmonella typhimurium LT2
guguccacaagcccgggc

SEQ ID NO: 1842865 - RNA, 14 nt, Salmonella typhimurium LT2
gugucguaguggca

SEQ ID NO: 1842866 - RNA, 21 nt, Salmonella typhimurium LT2
gugggucugcggcggugccug

SEQ ID NO: 1842867 - RNA, 12 nt, Salmonella typhimurium LT2
guguacauccag

SEQ ID NO: 1842868 - RNA, 21 nt, Salmonella typhimurium LT2
guguacauccaggaggcaaaa

SEQ ID NO: 1842869 - RNA, 21 nt, Salmonella typhimurium LT2
guguaccauuguuuacuuuuu

SEQ ID NO: 1842870 - RNA, 15 nt, Salmonella typhimurium LT2
gugguucuggcggcg

SEQ ID NO: 1842871 - RNA, 14 nt, Salmonella typhimurium LT2
gugugcagugacag

SEQ ID NO: 1842872 - RNA, 16 nt, Salmonella typhimurium LT2
aaauaucaagaaaacu

SEQ ID NO: 1842873 - RNA, 10 nt, Salmonella typhimurium LT2
aaauauccua

SEQ ID NO: 1842874 - RNA, 14 nt, Salmonella typhimurium LT2
aaauauccuccacc

SEQ ID NO: 1842875 - RNA, 19 nt, Salmonella typhimurium LT2
guguggucgucagccguga

SEQ ID NO: 1842876 - RNA, 18 nt, Salmonella typhimurium LT2
guguggucgcggcucacc

SEQ ID NO: 1842877 - RNA, 16 nt, Salmonella typhimurium LT2
gugugggcacucgaag

SEQ ID NO: 1842878 - RNA, 15 nt, Salmonella typhimurium LT2
guguuccauugcugc

SEQ ID NO: 1842879 - RNA, 15 nt, Salmonella typhimurium LT2
guguucacaauugug

SEQ ID NO: 1842880 - RNA, 17 nt, Salmonella typhimurium LT2
guguucaccauuuccgc

SEQ ID NO: 1842881 - RNA, 20 nt, Salmonella typhimurium LT2
guggaaaacagcauaauaaa

SEQ ID NO: 1842882 - RNA, 19 nt, Salmonella typhimurium LT2
guggaacaacucucccaac

SEQ ID NO: 1842883 - RNA, 15 nt, Salmonella typhimurium LT2
guggaacaaacgcaa

SEQ ID NO: 1842884 - RNA, 14 nt, Salmonella typhimurium LT2
gugcuggcggccgu

SEQ ID NO: 1842885 - RNA, 13 nt, Salmonella typhimurium LT2
gugcuggcggccg

SEQ ID NO: 1842886 - RNA, 22 nt, Salmonella typhimurium LT2
guggagaucgacaacaacaucu

SEQ ID NO: 1842887 - RNA, 15 nt, Salmonella typhimurium LT2
guggcaaaauccaac

SEQ ID NO: 1842888 - RNA, 15 nt, Salmonella typhimurium LT2
guggagucuaaaaau

SEQ ID NO: 1842889 - RNA, 17 nt, Salmonella typhimurium LT2
guggauagaguuaaaag

SEQ ID NO: 1842890 - RNA, 22 nt, Salmonella typhimurium LT2
guggcgaacaggcucagcgcca

SEQ ID NO: 1842891 - RNA, 19 nt, Salmonella typhimurium LT2
guggcccgcacugccgagu

SEQ ID NO: 1842892 - RNA, 18 nt, Salmonella typhimurium LT2
guggccagcaugcccgcc

SEQ ID NO: 1842893 - RNA, 18 nt, Salmonella typhimurium LT2
guggcccagcgcgguggc

SEQ ID NO: 1842894 - RNA, 22 nt, Salmonella typhimurium LT2
guggccacacuucgggcagagc

SEQ ID NO: 1842895 - RNA, 15 nt, Salmonella typhimurium LT2
guggcguuuucauua

SEQ ID NO: 1842896 - RNA, 16 nt, Salmonella typhimurium LT2
guggcuaacgggcuga

SEQ ID NO: 1842897 - RNA, 19 nt, Salmonella typhimurium LT2
gugggaucgacucauccag

SEQ ID NO: 1842898 - RNA, 19 nt, Salmonella typhimurium LT2
gugggaugcguaauccggc

SEQ ID NO: 1842899 - RNA, 14 nt, Salmonella typhimurium LT2
guggcgucggcugu

SEQ ID NO: 1842900 - RNA, 21 nt, Salmonella typhimurium LT2
ucagcccuaucgcugcgcugc

SEQ ID NO: 1842901 - RNA, 15 nt, Salmonella typhimurium LT2
ucagcccuacaaagg

SEQ ID NO: 1842902 - RNA, 16 nt, Salmonella typhimurium LT2
ucagccacgacgcuca

SEQ ID NO: 1842903 - RNA, 18 nt, Salmonella typhimurium LT2
ucagccacggaauaucuu

SEQ ID NO: 1842904 - RNA, 18 nt, Salmonella typhimurium LT2
ucagcauuuucacaaccg

SEQ ID NO: 1842905 - RNA, 16 nt, Salmonella typhimurium LT2
ucagccaaaacccuuc

SEQ ID NO: 1842906 - RNA, 16 nt, Salmonella typhimurium LT2
ucagcgauucaaacuc

SEQ ID NO: 1842907 - RNA, 19 nt, Salmonella typhimurium LT2
ucagcgcguuuuccaucau

SEQ ID NO: 1842908 - RNA, 18 nt, Salmonella typhimurium LT2
ucagcgcuaccagcgcgg

SEQ ID NO: 1842909 - RNA, 18 nt, Salmonella typhimurium LT2
ucagcgcccccaguuccu

SEQ ID NO: 1842910 - RNA, 15 nt, Salmonella typhimurium LT2
ucagcgccaccacaa

SEQ ID NO: 1842911 - RNA, 17 nt, Salmonella typhimurium LT2
ucagcgccaccacaaac

SEQ ID NO: 1842912 - RNA, 18 nt, Salmonella typhimurium LT2
ucagcgucagcaccagua

SEQ ID NO: 1842913 - RNA, 20 nt, Salmonella typhimurium LT2
ucagcgucagcaccaguaca

SEQ ID NO: 1842914 - RNA, 15 nt, Salmonella typhimurium LT2
ucagcggccagggca

SEQ ID NO: 1842915 - RNA, 18 nt, Salmonella typhimurium LT2
ucagcggcgcaggggcau

SEQ ID NO: 1842916 - RNA, 14 nt, Salmonella typhimurium LT2
ucagcggccagggc

SEQ ID NO: 1842917 - RNA, 14 nt, Salmonella typhimurium LT2
ucagcgcugucgcc

SEQ ID NO: 1842918 - RNA, 16 nt, Salmonella typhimurium LT2
ucagcggcagcucgug

SEQ ID NO: 1842919 - RNA, 20 nt, Salmonella typhimurium LT2
ucagcacaaagugcgcuguc

SEQ ID NO: 1842920 - RNA, 12 nt, Salmonella typhimurium LT2
ucagcaccagcg

SEQ ID NO: 1842921 - RNA, 20 nt, Salmonella typhimurium LT2
ucagcaauuucucgcccgcc

SEQ ID NO: 1842922 - RNA, 17 nt, Salmonella typhimurium LT2
ucagcaauuucucgccc

SEQ ID NO: 1842923 - RNA, 17 nt, Salmonella typhimurium LT2
ucagcaccgcgcgcugc

SEQ ID NO: 1842924 - RNA, 13 nt, Salmonella typhimurium LT2
ucagcagaacaaa

SEQ ID NO: 1842925 - RNA, 14 nt, Salmonella typhimurium LT2
ucagcacgcggaac

SEQ ID NO: 1842926 - RNA, 22 nt, Salmonella typhimurium LT2
ucagcacgcuuuggcaggccuc

SEQ ID NO: 1842927 - RNA, 12 nt, Salmonella typhimurium LT2
ucagcauggugu

SEQ ID NO: 1842928 - RNA, 19 nt, Salmonella typhimurium LT2
ucagcauguuucuccugcc

SEQ ID NO: 1842929 - RNA, 20 nt, Salmonella typhimurium LT2
ucagcauuucauccauuaaa

SEQ ID NO: 1842930 - RNA, 13 nt, Salmonella typhimurium LT2
ucagcaucaucac

SEQ ID NO: 1842931 - RNA, 18 nt, Salmonella typhimurium LT2
ucagcauauccagcgccu

SEQ ID NO: 1842932 - RNA, 19 nt, Salmonella typhimurium LT2
ucagcaucgggaaucaucg

SEQ ID NO: 1842933 - RNA, 15 nt, Salmonella typhimurium LT2
ucagcagccgggcca

SEQ ID NO: 1842934 - RNA, 21 nt, Salmonella typhimurium LT2
ucagcauaauauccugcaccg

SEQ ID NO: 1842935 - RNA, 17 nt, Salmonella typhimurium LT2
ucaggcgcgauggaguc

SEQ ID NO: 1842936 - RNA, 20 nt, Salmonella typhimurium LT2
ucaggccuacgacagcgcug

SEQ ID NO: 1842937 - RNA, 17 nt, Salmonella typhimurium LT2
aaaucucaagagugaac

SEQ ID NO: 1842938 - RNA, 16 nt, Salmonella typhimurium LT2
aaaucucgcuaaucau

SEQ ID NO: 1842939 - RNA, 13 nt, Salmonella typhimurium LT2
ucaggcauguugc

SEQ ID NO: 1842940 - RNA, 13 nt, Salmonella typhimurium LT2
ucaggcaaugucu

SEQ ID NO: 1842941 - RNA, 14 nt, Salmonella typhimurium LT2
ucaggcagaaauaa

SEQ ID NO: 1842942 - RNA, 15 nt, Salmonella typhimurium LT2
ucaggcagaaauaac

SEQ ID NO: 1842943 - RNA, 15 nt, Salmonella typhimurium LT2
ucaggcacuggcuua

SEQ ID NO: 1842944 - RNA, 19 nt, Salmonella typhimurium LT2
ucaggcacuguauaugcua

SEQ ID NO: 1842945 - RNA, 22 nt, Salmonella typhimurium LT2
ucaggaauuuaucaacaaauuc

SEQ ID NO: 1842946 - RNA, 23 nt, Salmonella typhimurium LT2
ucaggagauugccccccagccau

SEQ ID NO: 1842947 - RNA, 16 nt, Salmonella typhimurium LT2
ucaggaggccugaaua

SEQ ID NO: 1842948 - RNA, 19 nt, Salmonella typhimurium LT2
ucaggaguaaauaacaaaa

SEQ ID NO: 1842949 - RNA, 21 nt, Salmonella typhimurium LT2
ucaggaguaaauaacaaaagc

SEQ ID NO: 1842950 - RNA, 23 nt, Salmonella typhimurium LT2
ucaggacggcauaagccagcccu

SEQ ID NO: 1842951 - RNA, 21 nt, Salmonella typhimurium LT2
ucaggcucgucgccuuccagc

SEQ ID NO: 1842952 - RNA, 22 nt, Salmonella typhimurium LT2
ucaggcuggcaaagcaggugag

SEQ ID NO: 1842953 - RNA, 20 nt, Salmonella typhimurium LT2
ucaguagccgccgcaggaca

SEQ ID NO: 1842954 - RNA, 14 nt, Salmonella typhimurium LT2
ucaggcuugucgcg

SEQ ID NO: 1842955 - RNA, 14 nt, Salmonella typhimurium LT2
ucagguaucccgcc

SEQ ID NO: 1842956 - RNA, 12 nt, Salmonella typhimurium LT2
ucaguauggcca

SEQ ID NO: 1842957 - RNA, 23 nt, Salmonella typhimurium LT2
ucaguagcuuuuccgcuggaaua

SEQ ID NO: 1842958 - RNA, 18 nt, Salmonella typhimurium LT2
ucaguggcguagcguacu

SEQ ID NO: 1842959 - RNA, 18 nt, Salmonella typhimurium LT2
ucagugccaaaucaugag

SEQ ID NO: 1842960 - RNA, 12 nt, Salmonella typhimurium LT2
ucagugauaaag

SEQ ID NO: 1842961 - RNA, 21 nt, Salmonella typhimurium LT2
ucagugauaaagcacagcccc

SEQ ID NO: 1842962 - RNA, 18 nt, Salmonella typhimurium LT2
ucagcaacggaagcugac

SEQ ID NO: 1842963 - RNA, 19 nt, Salmonella typhimurium LT2
ucagcaacggaagcugacc

SEQ ID NO: 1842964 - RNA, 13 nt, Salmonella typhimurium LT2
ucagcaacugcgu

SEQ ID NO: 1842965 - RNA, 14 nt, Salmonella typhimurium LT2
ucagcaacaccacc

SEQ ID NO: 1842966 - RNA, 21 nt, Salmonella typhimurium LT2
aaaucggggucuuccagcaga

SEQ ID NO: 1842967 - RNA, 22 nt, Salmonella typhimurium LT2
aaaucggucauuaauccccggc

SEQ ID NO: 1842968 - RNA, 22 nt, Salmonella typhimurium LT2
aaaucgguaaucaugucguaga

SEQ ID NO: 1842969 - RNA, 22 nt, Salmonella typhimurium LT2
aaaucgucagccgccaguucaa

SEQ ID NO: 1842970 - RNA, 16 nt, Salmonella typhimurium LT2
ucagauccuucauuca

SEQ ID NO: 1842971 - RNA, 18 nt, Salmonella typhimurium LT2
ucagaucgguaaaggcgu

SEQ ID NO: 1842972 - RNA, 21 nt, Salmonella typhimurium LT2
ucagauccuggcgugucccca

SEQ ID NO: 1842973 - RNA, 15 nt, Salmonella typhimurium LT2
ucagauccaacgcuu

SEQ ID NO: 1842974 - RNA, 18 nt, Salmonella typhimurium LT2
ucagauacggcuccagca

SEQ ID NO: 1842975 - RNA, 20 nt, Salmonella typhimurium LT2
ucagaucuuauaugagcggg

SEQ ID NO: 1842976 - RNA, 14 nt, Salmonella typhimurium LT2
ucagaugacagucc

SEQ ID NO: 1842977 - RNA, 18 nt, Salmonella typhimurium LT2
ucagaugacaguccgggc

SEQ ID NO: 1842978 - RNA, 15 nt, Salmonella typhimurium LT2
ucagaucugcgccca

SEQ ID NO: 1842979 - RNA, 17 nt, Salmonella typhimurium LT2
ucagaucuuauaugagc

SEQ ID NO: 1842980 - RNA, 17 nt, Salmonella typhimurium LT2
ucagaugugguauuuuc

SEQ ID NO: 1842981 - RNA, 18 nt, Salmonella typhimurium LT2
ucagaugugguauuuucu

SEQ ID NO: 1842982 - RNA, 19 nt, Salmonella typhimurium LT2
ucagauucgcuacugcauc

SEQ ID NO: 1842983 - RNA, 20 nt, Salmonella typhimurium LT2
ucagacgaggcgcaacauuu

SEQ ID NO: 1842984 - RNA, 16 nt, Salmonella typhimurium LT2
ucagacgcuauuugca

SEQ ID NO: 1842985 - RNA, 15 nt, Salmonella typhimurium LT2
ucagacggcugaccu

SEQ ID NO: 1842986 - RNA, 17 nt, Salmonella typhimurium LT2
ucagaggggauggcgua

SEQ ID NO: 1842987 - RNA, 15 nt, Salmonella typhimurium LT2
ucagagcuauguacu

SEQ ID NO: 1842988 - RNA, 15 nt, Salmonella typhimurium LT2
ucagagcauaaaaau

SEQ ID NO: 1842989 - RNA, 19 nt, Salmonella typhimurium LT2
ucagagcauaaaaaucauu

SEQ ID NO: 1842990 - RNA, 19 nt, Salmonella typhimurium LT2
ucagaccauaguccaugcc

SEQ ID NO: 1842991 - RNA, 23 nt, Salmonella typhimurium LT2
ucagaccagaaccucacggagaa

SEQ ID NO: 1842992 - RNA, 20 nt, Salmonella typhimurium LT2
ucagacacauucugugaucc

SEQ ID NO: 1842993 - RNA, 13 nt, Salmonella typhimurium LT2
ucagaauaaugcu

SEQ ID NO: 1842994 - RNA, 15 nt, Salmonella typhimurium LT2
ucagaauaugccagg

SEQ ID NO: 1842995 - RNA, 16 nt, Salmonella typhimurium LT2
ucagaauaugccaggg

SEQ ID NO: 1842996 - RNA, 15 nt, Salmonella typhimurium LT2
ucagaagaagacaac

SEQ ID NO: 1842997 - RNA, 19 nt, Salmonella typhimurium LT2
ucagaaauguauucucccg

SEQ ID NO: 1842998 - RNA, 20 nt, Salmonella typhimurium LT2
ucacuuucagauuuuuaaug

SEQ ID NO: 1842999 - RNA, 19 nt, Salmonella typhimurium LT2
ucacuuucuugccacuggc

SEQ ID NO: 1843000 - RNA, 22 nt, Salmonella typhimurium LT2
ucacuuucuugccacuggccuc

SEQ ID NO: 1843001 - RNA, 18 nt, Salmonella typhimurium LT2
ucacuuuucuuuccugca

SEQ ID NO: 1843002 - RNA, 16 nt, Salmonella typhimurium LT2
ucacuuuugggccgcg

SEQ ID NO: 1843003 - RNA, 15 nt, Salmonella typhimurium LT2
ucacuucaucaucau

SEQ ID NO: 1843004 - RNA, 21 nt, Salmonella typhimurium LT2
ucacuuccgccaccacgccca

SEQ ID NO: 1843005 - RNA, 19 nt, Salmonella typhimurium LT2
ucacuuucagauuuuuaau

SEQ ID NO: 1843006 - RNA, 17 nt, Salmonella typhimurium LT2
ucacuggagggcauuaa

SEQ ID NO: 1843007 - RNA, 12 nt, Salmonella typhimurium LT2
ucacgccacagu

SEQ ID NO: 1843008 - RNA, 19 nt, Salmonella typhimurium LT2
ucacgccgacgacaggcag

SEQ ID NO: 1843009 - RNA, 15 nt, Salmonella typhimurium LT2
ucacgccguccagca

SEQ ID NO: 1843010 - RNA, 20 nt, Salmonella typhimurium LT2
ucacccugaauuucaauaau

SEQ ID NO: 1843011 - RNA, 16 nt, Salmonella typhimurium LT2
ucacccugaauuucaa

SEQ ID NO: 1843012 - RNA, 18 nt, Salmonella typhimurium LT2
ucacccugaaauccggcu

SEQ ID NO: 1843013 - RNA, 14 nt, Salmonella typhimurium LT2
ucacccugaauuuc

SEQ ID NO: 1843014 - RNA, 19 nt, Salmonella typhimurium LT2
ucacccggauacgcggcac

SEQ ID NO: 1843015 - RNA, 18 nt, Salmonella typhimurium LT2
ucacccgcgccagcaggu

SEQ ID NO: 1843016 - RNA, 16 nt, Salmonella typhimurium LT2
ucacguucagcgcggu

SEQ ID NO: 1843017 - RNA, 19 nt, Salmonella typhimurium LT2
ucacggcaucugcggcaug

SEQ ID NO: 1843018 - RNA, 13 nt, Salmonella typhimurium LT2
ucacgggcaucau

SEQ ID NO: 1843019 - RNA, 14 nt, Salmonella typhimurium LT2
ucacguucgguacg

SEQ ID NO: 1843020 - RNA, 18 nt, Salmonella typhimurium LT2
ucacguuuugcagcgcca

SEQ ID NO: 1843021 - RNA, 20 nt, Salmonella typhimurium LT2
ucacguuuugcagcgccauc

SEQ ID NO: 1843022 - RNA, 17 nt, Salmonella typhimurium LT2
ucaaacuuguguuccca

SEQ ID NO: 1843023 - RNA, 21 nt, Salmonella typhimurium LT2
ucaaauagguauguaacgugc

SEQ ID NO: 1843024 - RNA, 22 nt, Salmonella typhimurium LT2
ucaaauguuguuugaaaaguga

SEQ ID NO: 1843025 - RNA, 16 nt, Salmonella typhimurium LT2
ucaaauuugcccagca

SEQ ID NO: 1843026 - RNA, 14 nt, Salmonella typhimurium LT2
ucaaacgucacauu

SEQ ID NO: 1843027 - RNA, 18 nt, Salmonella typhimurium LT2
ucaaaccaguuuuucauu

SEQ ID NO: 1843028 - RNA, 19 nt, Salmonella typhimurium LT2
ucaaacaggcgaaaacgua

SEQ ID NO: 1843029 - RNA, 20 nt, Salmonella typhimurium LT2
ucaaacacaaauuucgagca

SEQ ID NO: 1843030 - RNA, 13 nt, Salmonella typhimurium LT2
ucaaacaaaucau

SEQ ID NO: 1843031 - RNA, 20 nt, Salmonella typhimurium LT2
ucaaacaaacauugcuggaa

SEQ ID NO: 1843032 - RNA, 18 nt, Salmonella typhimurium LT2
ucaaaagauugauuuauu

SEQ ID NO: 1843033 - RNA, 16 nt, Salmonella typhimurium LT2
ucaaaagcguguagca

SEQ ID NO: 1843034 - RNA, 21 nt, Salmonella typhimurium LT2
ucaaaacuggaaacgcaucca

SEQ ID NO: 1843035 - RNA, 15 nt, Salmonella typhimurium LT2
uauuuaagcucuucu

SEQ ID NO: 1843036 - RNA, 16 nt, Salmonella typhimurium LT2
ucaaaauuaccuuuac

SEQ ID NO: 1843037 - RNA, 19 nt, Salmonella typhimurium LT2
ucaaaaugcccgcauugcg

SEQ ID NO: 1843038 - RNA, 15 nt, Salmonella typhimurium LT2
ucaaaaugacaaauu

SEQ ID NO: 1843039 - RNA, 20 nt, Salmonella typhimurium LT2
ucaacccgaucgccauccug

SEQ ID NO: 1843040 - RNA, 16 nt, Salmonella typhimurium LT2
ucaaccgagccaaacu

SEQ ID NO: 1843041 - RNA, 20 nt, Salmonella typhimurium LT2
ucaaccguuucuuuuucgau

SEQ ID NO: 1843042 - RNA, 20 nt, Salmonella typhimurium LT2
ucaacgccgcgcuucuggaa

SEQ ID NO: 1843043 - RNA, 20 nt, Salmonella typhimurium LT2
ucaacgcccgcuuucaccau

SEQ ID NO: 1843044 - RNA, 16 nt, Salmonella typhimurium LT2
ucaacgcccugcuccc

SEQ ID NO: 1843045 - RNA, 18 nt, Salmonella typhimurium LT2
ucaacgccgaacaggcca

SEQ ID NO: 1843046 - RNA, 18 nt, Salmonella typhimurium LT2
ucaacgcaucaaauaccu

SEQ ID NO: 1843047 - RNA, 22 nt, Salmonella typhimurium LT2
ucaacucgcggcccaaccacua

SEQ ID NO: 1843048 - RNA, 18 nt, Salmonella typhimurium LT2
ucaacuucucgcaggcca

SEQ ID NO: 1843049 - RNA, 17 nt, Salmonella typhimurium LT2
ucaacgcguucauccag

SEQ ID NO: 1843050 - RNA, 18 nt, Salmonella typhimurium LT2
ucaacgcguucauccagc

SEQ ID NO: 1843051 - RNA, 18 nt, Salmonella typhimurium LT2
ucaacagcgcggcaggcc

SEQ ID NO: 1843052 - RNA, 18 nt, Salmonella typhimurium LT2
ucaacagcggcggcagua

SEQ ID NO: 1843053 - RNA, 13 nt, Salmonella typhimurium LT2
ucaacauauccag

SEQ ID NO: 1843054 - RNA, 21 nt, Salmonella typhimurium LT2
ucaacaucagcgcuaccagcg

SEQ ID NO: 1843055 - RNA, 13 nt, Salmonella typhimurium LT2
ucaacaucauuaa

SEQ ID NO: 1843056 - RNA, 20 nt, Salmonella typhimurium LT2
ucaaccacggauaagccagc

SEQ ID NO: 1843057 - RNA, 18 nt, Salmonella typhimurium LT2
ucaacaccuccaguucag

SEQ ID NO: 1843058 - RNA, 19 nt, Salmonella typhimurium LT2
ucaacaaucguuaauucau

SEQ ID NO: 1843059 - RNA, 20 nt, Salmonella typhimurium LT2
ucacaggcuucgacaaacag

SEQ ID NO: 1843060 - RNA, 19 nt, Salmonella typhimurium LT2
ucacagccacacugcugug

SEQ ID NO: 1843061 - RNA, 14 nt, Salmonella typhimurium LT2
ucacagaugacaga

SEQ ID NO: 1843062 - RNA, 16 nt, Salmonella typhimurium LT2
ucacagaugacagagu

SEQ ID NO: 1843063 - RNA, 19 nt, Salmonella typhimurium LT2
ucacagaugacagagucca

SEQ ID NO: 1843064 - RNA, 23 nt, Salmonella typhimurium LT2
ucacaaacaccaccaguaaccgc

SEQ ID NO: 1843065 - RNA, 15 nt, Salmonella typhimurium LT2
ucacaaacaauuucc

SEQ ID NO: 1843066 - RNA, 22 nt, Salmonella typhimurium LT2
ucacaaacaauuucccccacuu

SEQ ID NO: 1843067 - RNA, 23 nt, Salmonella typhimurium LT2
ucacaaacggcacacgcggcgcu

SEQ ID NO: 1843068 - RNA, 18 nt, Salmonella typhimurium LT2
ucacaaacggcgguuuuu

SEQ ID NO: 1843069 - RNA, 17 nt, Salmonella typhimurium LT2
aaaucgcgagccuucaa

SEQ ID NO: 1843070 - RNA, 17 nt, Salmonella typhimurium LT2
ucacauacagcacuucc

SEQ ID NO: 1843071 - RNA, 14 nt, Salmonella typhimurium LT2
ucacauacuucugu

SEQ ID NO: 1843072 - RNA, 20 nt, Salmonella typhimurium LT2
ucaccaguugcgaagccacu

SEQ ID NO: 1843073 - RNA, 19 nt, Salmonella typhimurium LT2
ucaccaucguugccagcgg

SEQ ID NO: 1843074 - RNA, 21 nt, Salmonella typhimurium LT2
ucaccaucagcgucagcacca

SEQ ID NO: 1843075 - RNA, 18 nt, Salmonella typhimurium LT2
ucaccagcugacgcagca

SEQ ID NO: 1843076 - RNA, 21 nt, Salmonella typhimurium LT2
ucaccagcugacgcagcagcu

SEQ ID NO: 1843077 - RNA, 22 nt, Salmonella typhimurium LT2
ucaccaggcguaagaucccagg

SEQ ID NO: 1843078 - RNA, 18 nt, Salmonella typhimurium LT2
ucaccaccgcaggcagcg

SEQ ID NO: 1843079 - RNA, 20 nt, Salmonella typhimurium LT2
ucacauggcgaauaucacua

SEQ ID NO: 1843080 - RNA, 21 nt, Salmonella typhimurium LT2
ucacauggcgaauaucacuau

SEQ ID NO: 1843081 - RNA, 20 nt, Salmonella typhimurium LT2
ucacaugcggaagcaaaaua

SEQ ID NO: 1843082 - RNA, 16 nt, Salmonella typhimurium LT2
ucacaugcggaugcug

SEQ ID NO: 1843083 - RNA, 13 nt, Salmonella typhimurium LT2
ucacaucccagca

SEQ ID NO: 1843084 - RNA, 20 nt, Salmonella typhimurium LT2
ucacaucguaaaucagcgug

SEQ ID NO: 1843085 - RNA, 18 nt, Salmonella typhimurium LT2
ucacauauucaauaauau

SEQ ID NO: 1843086 - RNA, 15 nt, Salmonella typhimurium LT2
ucaaugguuaauuaa

SEQ ID NO: 1843087 - RNA, 20 nt, Salmonella typhimurium LT2
ucaaugggauagugccugcc

SEQ ID NO: 1843088 - RNA, 14 nt, Salmonella typhimurium LT2
ucaaugggaaaaau

SEQ ID NO: 1843089 - RNA, 22 nt, Salmonella typhimurium LT2
ucaaucacuugaagccuuucug

SEQ ID NO: 1843090 - RNA, 14 nt, Salmonella typhimurium LT2
ucaaucacuuauca

SEQ ID NO: 1843091 - RNA, 12 nt, Salmonella typhimurium LT2
ucaaucaggcua

SEQ ID NO: 1843092 - RNA, 14 nt, Salmonella typhimurium LT2
ucaauaugccaggc

SEQ ID NO: 1843093 - RNA, 14 nt, Salmonella typhimurium LT2
ucaauaugcguuaa

SEQ ID NO: 1843094 - RNA, 16 nt, Salmonella typhimurium LT2
ucaaucaucagaagaa

SEQ ID NO: 1843095 - RNA, 13 nt, Salmonella typhimurium LT2
ucaauauccagcc

SEQ ID NO: 1843096 - RNA, 19 nt, Salmonella typhimurium LT2
ucaaugucugauggcgcug

SEQ ID NO: 1843097 - RNA, 15 nt, Salmonella typhimurium LT2
ucaauguccugaauu

SEQ ID NO: 1843098 - RNA, 13 nt, Salmonella typhimurium LT2
ucaauugccaccu

SEQ ID NO: 1843099 - RNA, 15 nt, Salmonella typhimurium LT2
ucaauaaucccuucu

SEQ ID NO: 1843100 - RNA, 16 nt, Salmonella typhimurium LT2
ucaauaaccgccagca

SEQ ID NO: 1843101 - RNA, 22 nt, Salmonella typhimurium LT2
ucaauaagaaacugcuguagca

SEQ ID NO: 1843102 - RNA, 21 nt, Salmonella typhimurium LT2
ucaacuuuuuuaccauugauu

SEQ ID NO: 1843103 - RNA, 21 nt, Salmonella typhimurium LT2
ucaauaaacauuuuuuuugca

SEQ ID NO: 1843104 - RNA, 19 nt, Salmonella typhimurium LT2
ucaauauaguuuuuaccau

SEQ ID NO: 1843105 - RNA, 15 nt, Salmonella typhimurium LT2
ucaauagcacaucag

SEQ ID NO: 1843106 - RNA, 22 nt, Salmonella typhimurium LT2
ucaauaccguccagcgcauacg

SEQ ID NO: 1843107 - RNA, 18 nt, Salmonella typhimurium LT2
ucaauagagcgcagcaaa

SEQ ID NO: 1843108 - RNA, 16 nt, Salmonella typhimurium LT2
ucaauacguaacgcaa

SEQ ID NO: 1843109 - RNA, 17 nt, Salmonella typhimurium LT2
ucaauacgaaaaccaag

SEQ ID NO: 1843110 - RNA, 18 nt, Salmonella typhimurium LT2
ucaauacauucaguacaa

SEQ ID NO: 1843111 - RNA, 17 nt, Salmonella typhimurium LT2
uauuaagccuuuuuaaa

SEQ ID NO: 1843112 - RNA, 18 nt, Salmonella typhimurium LT2
uauuaagccuuuuuaaau

SEQ ID NO: 1843113 - RNA, 19 nt, Salmonella typhimurium LT2
uauuaagccuuuuuaaaua

SEQ ID NO: 1843114 - RNA, 17 nt, Salmonella typhimurium LT2
uauuaauugcagacgcu

SEQ ID NO: 1843115 - RNA, 15 nt, Salmonella typhimurium LT2
uauuaccaauauuaa

SEQ ID NO: 1843116 - RNA, 15 nt, Salmonella typhimurium LT2
uauuaccaaugagcu

SEQ ID NO: 1843117 - RNA, 12 nt, Salmonella typhimurium LT2
uauuauaaaaua

SEQ ID NO: 1843118 - RNA, 21 nt, Salmonella typhimurium LT2
uauguuaacgccgauuaaugc

SEQ ID NO: 1843119 - RNA, 22 nt, Salmonella typhimurium LT2
uauguuaaaagagaaaaagaag

SEQ ID NO: 1843120 - RNA, 20 nt, Salmonella typhimurium LT2
uauguuaccuguuaaauugu

SEQ ID NO: 1843121 - RNA, 18 nt, Salmonella typhimurium LT2
uauguuguggcaauauuu

SEQ ID NO: 1843122 - RNA, 13 nt, Salmonella typhimurium LT2
uauuaaaaccauu

SEQ ID NO: 1843123 - RNA, 22 nt, Salmonella typhimurium LT2
uauuaaaaccauugcuaaaaau

SEQ ID NO: 1843124 - RNA, 22 nt, Salmonella typhimurium LT2
uauuaaaauuguaauaauuuaa

SEQ ID NO: 1843125 - RNA, 21 nt, Salmonella typhimurium LT2
uaugucaguaauauauuacga

SEQ ID NO: 1843126 - RNA, 23 nt, Salmonella typhimurium LT2
uaugugaucuauauauucuucuu

SEQ ID NO: 1843127 - RNA, 17 nt, Salmonella typhimurium LT2
uaugucuaugauuuuaa

SEQ ID NO: 1843128 - RNA, 15 nt, Salmonella typhimurium LT2
uauguacaaccucau

SEQ ID NO: 1843129 - RNA, 22 nt, Salmonella typhimurium LT2
uauguaacugaacccaucgccc

SEQ ID NO: 1843130 - RNA, 16 nt, Salmonella typhimurium LT2
uauguagcgcugaagc

SEQ ID NO: 1843131 - RNA, 19 nt, Salmonella typhimurium LT2
uauguauuuaauuuuuccu

SEQ ID NO: 1843132 - RNA, 22 nt, Salmonella typhimurium LT2
uauugcuucguggcaaucagca

SEQ ID NO: 1843133 - RNA, 21 nt, Salmonella typhimurium LT2
uauuggccgucgguucgucug

SEQ ID NO: 1843134 - RNA, 21 nt, Salmonella typhimurium LT2
uauuggcgcagccuuuuucuc

SEQ ID NO: 1843135 - RNA, 21 nt, Salmonella typhimurium LT2
uauuuaacgaaauguuuucuu

SEQ ID NO: 1843136 - RNA, 15 nt, Salmonella typhimurium LT2
uauuuaauacaucag

SEQ ID NO: 1843137 - RNA, 16 nt, Salmonella typhimurium LT2
uauugaacauuuuuuc

SEQ ID NO: 1843138 - RNA, 21 nt, Salmonella typhimurium LT2
aaauccggcaggcagccggau

SEQ ID NO: 1843139 - RNA, 20 nt, Salmonella typhimurium LT2
uauugaacggcucaaaauaa

SEQ ID NO: 1843140 - RNA, 23 nt, Salmonella typhimurium LT2
aaauccuggauacguuccagcag

SEQ ID NO: 1843141 - RNA, 13 nt, Salmonella typhimurium LT2
aaauccuggauga

SEQ ID NO: 1843142 - RNA, 16 nt, Salmonella typhimurium LT2
aaauccugcacuucca

SEQ ID NO: 1843143 - RNA, 13 nt, Salmonella typhimurium LT2
aaauccuguucca

SEQ ID NO: 1843144 - RNA, 16 nt, Salmonella typhimurium LT2
uauucuguuuuuucag

SEQ ID NO: 1843145 - RNA, 19 nt, Salmonella typhimurium LT2
uauucccguuuuucaucca

SEQ ID NO: 1843146 - RNA, 20 nt, Salmonella typhimurium LT2
uauuccgagucgaucucuuu

SEQ ID NO: 1843147 - RNA, 15 nt, Salmonella typhimurium LT2
uauuauuuuucuauu

SEQ ID NO: 1843148 - RNA, 14 nt, Salmonella typhimurium LT2
uauuauuuuuucuu

SEQ ID NO: 1843149 - RNA, 22 nt, Salmonella typhimurium LT2
uauuauuuugauaaucaucaua

SEQ ID NO: 1843150 - RNA, 17 nt, Salmonella typhimurium LT2
uaucuuuaugucaguaa

SEQ ID NO: 1843151 - RNA, 22 nt, Salmonella typhimurium LT2
uaucuuugcugccgauugguca

SEQ ID NO: 1843152 - RNA, 15 nt, Salmonella typhimurium LT2
uaugaaauucuugcc

SEQ ID NO: 1843153 - RNA, 17 nt, Salmonella typhimurium LT2
uaugaaagagaaaucuc

SEQ ID NO: 1843154 - RNA, 20 nt, Salmonella typhimurium LT2
uaugaaaccccaaaucagca

SEQ ID NO: 1843155 - RNA, 13 nt, Salmonella typhimurium LT2
uaugaaagagaaa

SEQ ID NO: 1843156 - RNA, 20 nt, Salmonella typhimurium LT2
uaugaacaggcagcguaaua

SEQ ID NO: 1843157 - RNA, 13 nt, Salmonella typhimurium LT2
uaugaauaaaaaa

SEQ ID NO: 1843158 - RNA, 15 nt, Salmonella typhimurium LT2
uaugaauaaaaaaca

SEQ ID NO: 1843159 - RNA, 23 nt, Salmonella typhimurium LT2
uaugaauaaaaaacaagauuaau

SEQ ID NO: 1843160 - RNA, 13 nt, Salmonella typhimurium LT2
uaucuugcuuuau

SEQ ID NO: 1843161 - RNA, 20 nt, Salmonella typhimurium LT2
uaucuuuaaacuuuuuuaug

SEQ ID NO: 1843162 - RNA, 21 nt, Salmonella typhimurium LT2
uaucuguugauaaaacacucu

SEQ ID NO: 1843163 - RNA, 19 nt, Salmonella typhimurium LT2
uaucuguauaaauaaaauu

SEQ ID NO: 1843164 - RNA, 20 nt, Salmonella typhimurium LT2
uaucuguauaaauaaaauug

SEQ ID NO: 1843165 - RNA, 15 nt, Salmonella typhimurium LT2
uaucuuacggaaaaa

SEQ ID NO: 1843166 - RNA, 15 nt, Salmonella typhimurium LT2
uaucucucuggcgca

SEQ ID NO: 1843167 - RNA, 23 nt, Salmonella typhimurium LT2
uaucugaaaguaagcuauuucug

SEQ ID NO: 1843168 - RNA, 20 nt, Salmonella typhimurium LT2
uaucugggucaggaacugcu

SEQ ID NO: 1843169 - RNA, 20 nt, Salmonella typhimurium LT2
uaucguuaccgcccucaugg

SEQ ID NO: 1843170 - RNA, 18 nt, Salmonella typhimurium LT2
uaucguugcgcgcaauca

SEQ ID NO: 1843171 - RNA, 21 nt, Salmonella typhimurium LT2
uaucguuuuauuucugcccca

SEQ ID NO: 1843172 - RNA, 21 nt, Salmonella typhimurium LT2
uaucuaccagccgauuuuucg

SEQ ID NO: 1843173 - RNA, 21 nt, Salmonella typhimurium LT2
uaugauagccguucuccagcg

SEQ ID NO: 1843174 - RNA, 17 nt, Salmonella typhimurium LT2
uaugaccgagucuacau

SEQ ID NO: 1843175 - RNA, 15 nt, Salmonella typhimurium LT2
uaugacaacauaaag

SEQ ID NO: 1843176 - RNA, 15 nt, Salmonella typhimurium LT2
uaugauuuuaacauc

SEQ ID NO: 1843177 - RNA, 13 nt, Salmonella typhimurium LT2
uaugcagcggaau

SEQ ID NO: 1843178 - RNA, 21 nt, Salmonella typhimurium LT2
uaugcaauuaauauauuuaua

SEQ ID NO: 1843179 - RNA, 19 nt, Salmonella typhimurium LT2
uaugcaggggcaguaaauu

SEQ ID NO: 1843180 - RNA, 21 nt, Salmonella typhimurium LT2
uaugaugcuugcucguaccag

SEQ ID NO: 1843181 - RNA, 22 nt, Salmonella typhimurium LT2
uaugaucgguuuuuuuagaacc

SEQ ID NO: 1843182 - RNA, 12 nt, Salmonella typhimurium LT2
uauggcaaugcc

SEQ ID NO: 1843183 - RNA, 22 nt, Salmonella typhimurium LT2
uauggaaguugccgccauaggu

SEQ ID NO: 1843184 - RNA, 21 nt, Salmonella typhimurium LT2
uauggguuuccuccaucagcg

SEQ ID NO: 1843185 - RNA, 17 nt, Salmonella typhimurium LT2
uaugguaauuuaaagua

SEQ ID NO: 1843186 - RNA, 16 nt, Salmonella typhimurium LT2
uauggguguagcucau

SEQ ID NO: 1843187 - RNA, 17 nt, Salmonella typhimurium LT2
uauggguguagcucaua

SEQ ID NO: 1843188 - RNA, 17 nt, Salmonella typhimurium LT2
uaugguauucgugcauc

SEQ ID NO: 1843189 - RNA, 23 nt, Salmonella typhimurium LT2
uaugccacucuuuuaaggcccuc

SEQ ID NO: 1843190 - RNA, 16 nt, Salmonella typhimurium LT2
uaugccaggcuuccug

SEQ ID NO: 1843191 - RNA, 16 nt, Salmonella typhimurium LT2
uaugcccccuccagcc

SEQ ID NO: 1843192 - RNA, 14 nt, Salmonella typhimurium LT2
uaugcgcaaaucaa

SEQ ID NO: 1843193 - RNA, 19 nt, Salmonella typhimurium LT2
uaugcgacugaaaaucaaa

SEQ ID NO: 1843194 - RNA, 21 nt, Salmonella typhimurium LT2
uaugcgacgguaaaaauaucu

SEQ ID NO: 1843195 - RNA, 19 nt, Salmonella typhimurium LT2
uaugccuggggucgucagc

SEQ ID NO: 1843196 - RNA, 20 nt, Salmonella typhimurium LT2
uaugccggaggauauuuauu

SEQ ID NO: 1843197 - RNA, 14 nt, Salmonella typhimurium LT2
uaugcgccuguuag

SEQ ID NO: 1843198 - RNA, 18 nt, Salmonella typhimurium LT2
uaucagcgcguuuuccau

SEQ ID NO: 1843199 - RNA, 16 nt, Salmonella typhimurium LT2
uaucauagugccggug

SEQ ID NO: 1843200 - RNA, 19 nt, Salmonella typhimurium LT2
uauccagaccuauugccuu

SEQ ID NO: 1843201 - RNA, 22 nt, Salmonella typhimurium LT2
uauccacugucgggcaaaaugc

SEQ ID NO: 1843202 - RNA, 13 nt, Salmonella typhimurium LT2
uaucauauuuucu

SEQ ID NO: 1843203 - RNA, 14 nt, Salmonella typhimurium LT2
uaucauauuuucuu

SEQ ID NO: 1843204 - RNA, 16 nt, Salmonella typhimurium LT2
uauccagcaguaaaua

SEQ ID NO: 1843205 - RNA, 16 nt, Salmonella typhimurium LT2
uauccagccaggucag

SEQ ID NO: 1843206 - RNA, 23 nt, Salmonella typhimurium LT2
uauccagcagguagcguuucagu

SEQ ID NO: 1843207 - RNA, 23 nt, Salmonella typhimurium LT2
uauccagcgccaggauaucuucc

SEQ ID NO: 1843208 - RNA, 19 nt, Salmonella typhimurium LT2
uauccagcuucugacguaa

SEQ ID NO: 1843209 - RNA, 17 nt, Salmonella typhimurium LT2
uauccggccugcaggca

SEQ ID NO: 1843210 - RNA, 19 nt, Salmonella typhimurium LT2
uauccggcggcaaaggcau

SEQ ID NO: 1843211 - RNA, 14 nt, Salmonella typhimurium LT2
uauccggcuuaucc

SEQ ID NO: 1843212 - RNA, 22 nt, Salmonella typhimurium LT2
uauccggcuuacggcuauucuu

SEQ ID NO: 1843213 - RNA, 20 nt, Salmonella typhimurium LT2
uauccguacuuucuacaaau

SEQ ID NO: 1843214 - RNA, 16 nt, Salmonella typhimurium LT2
uauccguccucuuucc

SEQ ID NO: 1843215 - RNA, 21 nt, Salmonella typhimurium LT2
uauccucgcauccuccaucca

SEQ ID NO: 1843216 - RNA, 19 nt, Salmonella typhimurium LT2
uauccuaaaucugccauca

SEQ ID NO: 1843217 - RNA, 19 nt, Salmonella typhimurium LT2
uauccuaaugccacggcug

SEQ ID NO: 1843218 - RNA, 19 nt, Salmonella typhimurium LT2
uauccagucagcguuacug

SEQ ID NO: 1843219 - RNA, 23 nt, Salmonella typhimurium LT2
uauccagucgccaggagacaaua

SEQ ID NO: 1843220 - RNA, 18 nt, Salmonella typhimurium LT2
uauccccagucuuccugc

SEQ ID NO: 1843221 - RNA, 14 nt, Salmonella typhimurium LT2
uaucccugcugagu

SEQ ID NO: 1843222 - RNA, 18 nt, Salmonella typhimurium LT2
uauccggcaaaagaggcu

SEQ ID NO: 1843223 - RNA, 15 nt, Salmonella typhimurium LT2
uauccggcaacauga

SEQ ID NO: 1843224 - RNA, 14 nt, Salmonella typhimurium LT2
uaucccuauucuga

SEQ ID NO: 1843225 - RNA, 17 nt, Salmonella typhimurium LT2
uauccccgucauacuuc

SEQ ID NO: 1843226 - RNA, 12 nt, Salmonella typhimurium LT2
uauccuggccug

SEQ ID NO: 1843227 - RNA, 21 nt, Salmonella typhimurium LT2
uauccugaaggacaagcugcg

SEQ ID NO: 1843228 - RNA, 13 nt, Salmonella typhimurium LT2
uauccucuccuga

SEQ ID NO: 1843229 - RNA, 18 nt, Salmonella typhimurium LT2
uaucgaaguaauaaaaaa

SEQ ID NO: 1843230 - RNA, 23 nt, Salmonella typhimurium LT2
uaucgaagugcgaaauuuaauau

SEQ ID NO: 1843231 - RNA, 14 nt, Salmonella typhimurium LT2
uaucgacacuauuu

SEQ ID NO: 1843232 - RNA, 21 nt, Salmonella typhimurium LT2
uaucgacacuauuuuucaggg

SEQ ID NO: 1843233 - RNA, 21 nt, Salmonella typhimurium LT2
uaucgauaaucaacaaugucg

SEQ ID NO: 1843234 - RNA, 15 nt, Salmonella typhimurium LT2
uaucgagggaacucu

SEQ ID NO: 1843235 - RNA, 18 nt, Salmonella typhimurium LT2
uaucgaugcuuauuauuu

SEQ ID NO: 1843236 - RNA, 14 nt, Salmonella typhimurium LT2
uaucgcugcccaga

SEQ ID NO: 1843237 - RNA, 17 nt, Salmonella typhimurium LT2
uaucgcugcuaaacgaa

SEQ ID NO: 1843238 - RNA, 17 nt, Salmonella typhimurium LT2
uaucgcgccagguauac

SEQ ID NO: 1843239 - RNA, 20 nt, Salmonella typhimurium LT2
uaucgcgccggacagcagca

SEQ ID NO: 1843240 - RNA, 19 nt, Salmonella typhimurium LT2
uaucgcuaauucucccugc

SEQ ID NO: 1843241 - RNA, 17 nt, Salmonella typhimurium LT2
uaucgccauauacgcca

SEQ ID NO: 1843242 - RNA, 15 nt, Salmonella typhimurium LT2
uaucgucguauuauc

SEQ ID NO: 1843243 - RNA, 13 nt, Salmonella typhimurium LT2
uaucggccagcgc

SEQ ID NO: 1843244 - RNA, 12 nt, Salmonella typhimurium LT2
uaucaagccuac

SEQ ID NO: 1843245 - RNA, 17 nt, Salmonella typhimurium LT2
uaucaacgggaacuuuc

SEQ ID NO: 1843246 - RNA, 18 nt, Salmonella typhimurium LT2
uaucaacgucuugccaug

SEQ ID NO: 1843247 - RNA, 19 nt, Salmonella typhimurium LT2
uaucagccauuaaccagau

SEQ ID NO: 1843248 - RNA, 14 nt, Salmonella typhimurium LT2
uaucagcaauaauu

SEQ ID NO: 1843249 - RNA, 21 nt, Salmonella typhimurium LT2
uaucagaugugguauuuucua

SEQ ID NO: 1843250 - RNA, 15 nt, Salmonella typhimurium LT2
uaucagacaaucugu

SEQ ID NO: 1843251 - RNA, 14 nt, Salmonella typhimurium LT2
uaucagaccgacaa

SEQ ID NO: 1843252 - RNA, 12 nt, Salmonella typhimurium LT2
uaucaccaucuu

SEQ ID NO: 1843253 - RNA, 16 nt, Salmonella typhimurium LT2
uaucaccccagguuga

SEQ ID NO: 1843254 - RNA, 17 nt, Salmonella typhimurium LT2
uaucacagaugacagag

SEQ ID NO: 1843255 - RNA, 15 nt, Salmonella typhimurium LT2
uauaugcaaaacugu

SEQ ID NO: 1843256 - RNA, 16 nt, Salmonella typhimurium LT2
uauaugggcaauuaua

SEQ ID NO: 1843257 - RNA, 21 nt, Salmonella typhimurium LT2
uauaugaaaucgccuguuaau

SEQ ID NO: 1843258 - RNA, 20 nt, Salmonella typhimurium LT2
uauauauguucaauauucaa

SEQ ID NO: 1843259 - RNA, 14 nt, Salmonella typhimurium LT2
uauauaacauauag

SEQ ID NO: 1843260 - RNA, 21 nt, Salmonella typhimurium LT2
uauaguuuuuaccauauuuau

SEQ ID NO: 1843261 - RNA, 13 nt, Salmonella typhimurium LT2
uauaguuuuucaa

SEQ ID NO: 1843262 - RNA, 14 nt, Salmonella typhimurium LT2
uauaggggccaagc

SEQ ID NO: 1843263 - RNA, 20 nt, Salmonella typhimurium LT2
uauacaaaacccauaucccc

SEQ ID NO: 1843264 - RNA, 15 nt, Salmonella typhimurium LT2
uauacaaaaaagaca

SEQ ID NO: 1843265 - RNA, 17 nt, Salmonella typhimurium LT2
uauacacuucauccuuu

SEQ ID NO: 1843266 - RNA, 13 nt, Salmonella typhimurium LT2
uauaaguaacugg

SEQ ID NO: 1843267 - RNA, 20 nt, Salmonella typhimurium LT2
uauaauaucaacccucccug

SEQ ID NO: 1843268 - RNA, 18 nt, Salmonella typhimurium LT2
uauaauugcuuuuuucca

SEQ ID NO: 1843269 - RNA, 14 nt, Salmonella typhimurium LT2
uauaaucugaaaga

SEQ ID NO: 1843270 - RNA, 18 nt, Salmonella typhimurium LT2
uauaaucugaaagacaug

SEQ ID NO: 1843271 - RNA, 23 nt, Salmonella typhimurium LT2
uauaaugccuggagccagccuga

SEQ ID NO: 1843272 - RNA, 12 nt, Salmonella typhimurium LT2
uauaaauaucau

SEQ ID NO: 1843273 - RNA, 11 nt, Salmonella typhimurium LT2
uauaaauauag

SEQ ID NO: 1843274 - RNA, 11 nt, Salmonella typhimurium LT2
uauaacagaau

SEQ ID NO: 1843275 - RNA, 18 nt, Salmonella typhimurium LT2
uauaacagaauaagccag

SEQ ID NO: 1843276 - RNA, 22 nt, Salmonella typhimurium LT2
uauaaccgucgcccguccgcua

SEQ ID NO: 1843277 - RNA, 17 nt, Salmonella typhimurium LT2
uaguugaauaaccucaa

SEQ ID NO: 1843278 - RNA, 15 nt, Salmonella typhimurium LT2
uaguugauaauauua

SEQ ID NO: 1843279 - RNA, 19 nt, Salmonella typhimurium LT2
uauaaauaaaguguuauua

SEQ ID NO: 1843280 - RNA, 13 nt, Salmonella typhimurium LT2
uauaaaauuuaau

SEQ ID NO: 1843281 - RNA, 12 nt, Salmonella typhimurium LT2
uauaaaauuuaa

SEQ ID NO: 1843282 - RNA, 13 nt, Salmonella typhimurium LT2
uaguaccaggcag

SEQ ID NO: 1843283 - RNA, 15 nt, Salmonella typhimurium LT2
uaguaaugcaugguc

SEQ ID NO: 1843284 - RNA, 15 nt, Salmonella typhimurium LT2
uaguaauauuaaaag

SEQ ID NO: 1843285 - RNA, 12 nt, Salmonella typhimurium LT2
uagucacuccag

SEQ ID NO: 1843286 - RNA, 13 nt, Salmonella typhimurium LT2
uagucaggcagca

SEQ ID NO: 1843287 - RNA, 17 nt, Salmonella typhimurium LT2
uagucagcuuaauuguu

SEQ ID NO: 1843288 - RNA, 20 nt, Salmonella typhimurium LT2
uaguccugccgacaggcagg

SEQ ID NO: 1843289 - RNA, 23 nt, Salmonella typhimurium LT2
uagucaucaacgcgaucuucaua

SEQ ID NO: 1843290 - RNA, 21 nt, Salmonella typhimurium LT2
uaguaacgacgaauauccaga

SEQ ID NO: 1843291 - RNA, 16 nt, Salmonella typhimurium LT2
uaguaauaaagcguag

SEQ ID NO: 1843292 - RNA, 21 nt, Salmonella typhimurium LT2
uacuuuauaaaucaggaaaaa

SEQ ID NO: 1843293 - RNA, 21 nt, Salmonella typhimurium LT2
uacuuucaccugcauaccgag

SEQ ID NO: 1843294 - RNA, 12 nt, Salmonella typhimurium LT2
uacuuucaaaau

SEQ ID NO: 1843295 - RNA, 19 nt, Salmonella typhimurium LT2
uaguucuaaaaguaagcua

SEQ ID NO: 1843296 - RNA, 15 nt, Salmonella typhimurium LT2
uaguggaucagcaga

SEQ ID NO: 1843297 - RNA, 20 nt, Salmonella typhimurium LT2
uagugcuucucuucaaacuc

SEQ ID NO: 1843298 - RNA, 21 nt, Salmonella typhimurium LT2
uagucgacagcccgccagcau

SEQ ID NO: 1843299 - RNA, 18 nt, Salmonella typhimurium LT2
uagucgcuuuucauacug

SEQ ID NO: 1843300 - RNA, 12 nt, Salmonella typhimurium LT2
uagucuccgcca

SEQ ID NO: 1843301 - RNA, 19 nt, Salmonella typhimurium LT2
uagucuauguucaguaaga

SEQ ID NO: 1843302 - RNA, 18 nt, Salmonella typhimurium LT2
uagucugccauuuccuga

SEQ ID NO: 1843303 - RNA, 10 nt, Salmonella typhimurium LT2
uccuucuucc

SEQ ID NO: 1843304 - RNA, 16 nt, Salmonella typhimurium LT2
uccuuccgcuuuaagc

SEQ ID NO: 1843305 - RNA, 20 nt, Salmonella typhimurium LT2
uccuuccggcuuuaacccug

SEQ ID NO: 1843306 - RNA, 15 nt, Salmonella typhimurium LT2
uccuucccccaccac

SEQ ID NO: 1843307 - RNA, 23 nt, Salmonella typhimurium LT2
uccuuccgaaucaauuccuacaa

SEQ ID NO: 1843308 - RNA, 13 nt, Salmonella typhimurium LT2
uccuuccgccgca

SEQ ID NO: 1843309 - RNA, 20 nt, Salmonella typhimurium LT2
uccuuccacugguaggcauc

SEQ ID NO: 1843310 - RNA, 13 nt, Salmonella typhimurium LT2
uccuucuuccauu

SEQ ID NO: 1843311 - RNA, 18 nt, Salmonella typhimurium LT2
uccuucuuccauucccac

SEQ ID NO: 1843312 - RNA, 16 nt, Salmonella typhimurium LT2
uccuucuucgccguca

SEQ ID NO: 1843313 - RNA, 19 nt, Salmonella typhimurium LT2
uccuugcacgccaaaaagu

SEQ ID NO: 1843314 - RNA, 19 nt, Salmonella typhimurium LT2
uccuuuaucugcccuuucu

SEQ ID NO: 1843315 - RNA, 15 nt, Salmonella typhimurium LT2
uccuuuaucugcccu

SEQ ID NO: 1843316 - RNA, 20 nt, Salmonella typhimurium LT2
uccuugccagugaaaaaaag

SEQ ID NO: 1843317 - RNA, 22 nt, Salmonella typhimurium LT2
uccuugcagccagaacucaucu

SEQ ID NO: 1843318 - RNA, 23 nt, Salmonella typhimurium LT2
uccuugcccuguuucgcaggccg

SEQ ID NO: 1843319 - RNA, 23 nt, Salmonella typhimurium LT2
uccuugcagccagaacucaucuu

SEQ ID NO: 1843320 - RNA, 21 nt, Salmonella typhimurium LT2
uccuugcuucgauggccucau

SEQ ID NO: 1843321 - RNA, 15 nt, Salmonella typhimurium LT2
uccuuuuucaggcac

SEQ ID NO: 1843322 - RNA, 13 nt, Salmonella typhimurium LT2
uccuuuuucaggc

SEQ ID NO: 1843323 - RNA, 13 nt, Salmonella typhimurium LT2
uccuuuuaauuuu

SEQ ID NO: 1843324 - RNA, 14 nt, Salmonella typhimurium LT2
uccuuugccuuucu

SEQ ID NO: 1843325 - RNA, 18 nt, Salmonella typhimurium LT2
uccuuucgagaagcccag

SEQ ID NO: 1843326 - RNA, 22 nt, Salmonella typhimurium LT2
ucgaaacguucgcaucccagga

SEQ ID NO: 1843327 - RNA, 20 nt, Salmonella typhimurium LT2
ucgaaacuggcauugugagc

SEQ ID NO: 1843328 - RNA, 16 nt, Salmonella typhimurium LT2
ucgaacgguaacagga

SEQ ID NO: 1843329 - RNA, 17 nt, Salmonella typhimurium LT2
ucgaacgguaacaggaa

SEQ ID NO: 1843330 - RNA, 19 nt, Salmonella typhimurium LT2
ucgaacgcuuccgggcuca

SEQ ID NO: 1843331 - RNA, 16 nt, Salmonella typhimurium LT2
ucgaaguaauaaaaaa

SEQ ID NO: 1843332 - RNA, 13 nt, Salmonella typhimurium LT2
ucgaagcuuuuca

SEQ ID NO: 1843333 - RNA, 11 nt, Salmonella typhimurium LT2
ucgacaagcua

SEQ ID NO: 1843334 - RNA, 18 nt, Salmonella typhimurium LT2
ucgacaagcggguggucu

SEQ ID NO: 1843335 - RNA, 16 nt, Salmonella typhimurium LT2
ucgacaagcuaauccc

SEQ ID NO: 1843336 - RNA, 12 nt, Salmonella typhimurium LT2
ucgacaccagcg

SEQ ID NO: 1843337 - RNA, 14 nt, Salmonella typhimurium LT2
ucgacaaaggcaag

SEQ ID NO: 1843338 - RNA, 16 nt, Salmonella typhimurium LT2
ucgaaucgccucaacc

SEQ ID NO: 1843339 - RNA, 17 nt, Salmonella typhimurium LT2
ucgaaucgccucaacca

SEQ ID NO: 1843340 - RNA, 12 nt, Salmonella typhimurium LT2
ucgaauucugau

SEQ ID NO: 1843341 - RNA, 14 nt, Salmonella typhimurium LT2
ucgacccccaccau

SEQ ID NO: 1843342 - RNA, 19 nt, Salmonella typhimurium LT2
ucgacccccaccaugucaa

SEQ ID NO: 1843343 - RNA, 22 nt, Salmonella typhimurium LT2
ucgacccccaccaugucaaggu

SEQ ID NO: 1843344 - RNA, 22 nt, Salmonella typhimurium LT2
ucgacccgcaaugugcagcagg

SEQ ID NO: 1843345 - RNA, 18 nt, Salmonella typhimurium LT2
ucgacagauuggucagca

SEQ ID NO: 1843346 - RNA, 14 nt, Salmonella typhimurium LT2
ucgacagcagcgcu

SEQ ID NO: 1843347 - RNA, 21 nt, Salmonella typhimurium LT2
ucgacauauugauagagcaaa

SEQ ID NO: 1843348 - RNA, 18 nt, Salmonella typhimurium LT2
ucgacaugguuggccacc

SEQ ID NO: 1843349 - RNA, 17 nt, Salmonella typhimurium LT2
ucgacaugcagaucgcg

SEQ ID NO: 1843350 - RNA, 21 nt, Salmonella typhimurium LT2
ucgacaugcgcaugugaguau

SEQ ID NO: 1843351 - RNA, 13 nt, Salmonella typhimurium LT2
ucgacgccagcgg

SEQ ID NO: 1843352 - RNA, 13 nt, Salmonella typhimurium LT2
ucgacgaaauggu

SEQ ID NO: 1843353 - RNA, 16 nt, Salmonella typhimurium LT2
ucgacgaaauggugug

SEQ ID NO: 1843354 - RNA, 20 nt, Salmonella typhimurium LT2
ucgaccucuucguucauccg

SEQ ID NO: 1843355 - RNA, 20 nt, Salmonella typhimurium LT2
ucgacguucagcauauccag

SEQ ID NO: 1843356 - RNA, 23 nt, Salmonella typhimurium LT2
ucgacuccuauuaucggcaccau

SEQ ID NO: 1843357 - RNA, 23 nt, Salmonella typhimurium LT2
ucgacucgagcgaaagaacguug

SEQ ID NO: 1843358 - RNA, 21 nt, Salmonella typhimurium LT2
ucgacuuuguugaucucauug

SEQ ID NO: 1843359 - RNA, 21 nt, Salmonella typhimurium LT2
ucgacuggucgcagcccagca

SEQ ID NO: 1843360 - RNA, 13 nt, Salmonella typhimurium LT2
ucgacuuaaaaga

SEQ ID NO: 1843361 - RNA, 21 nt, Salmonella typhimurium LT2
ucgacuucaaugggaaaaauu

SEQ ID NO: 1843362 - RNA, 16 nt, Salmonella typhimurium LT2
ucgacguccagcgcgu

SEQ ID NO: 1843363 - RNA, 17 nt, Salmonella typhimurium LT2
ucgagaugcauaaaaaa

SEQ ID NO: 1843364 - RNA, 23 nt, Salmonella typhimurium LT2
ucgagaugcguuggcucgcugcc

SEQ ID NO: 1843365 - RNA, 15 nt, Salmonella typhimurium LT2
ucgaggccauauuuu

SEQ ID NO: 1843366 - RNA, 23 nt, Salmonella typhimurium LT2
ucgagcuuuugcugcgccagcca

SEQ ID NO: 1843367 - RNA, 19 nt, Salmonella typhimurium LT2
ucgagcugcgcuuuuucau

SEQ ID NO: 1843368 - RNA, 18 nt, Salmonella typhimurium LT2
ucgagcguaauuccggcc

SEQ ID NO: 1843369 - RNA, 19 nt, Salmonella typhimurium LT2
ucgagcaucuccagcgcau

SEQ ID NO: 1843370 - RNA, 17 nt, Salmonella typhimurium LT2
ucgagcgccgucacucc

SEQ ID NO: 1843371 - RNA, 20 nt, Salmonella typhimurium LT2
ucgauaaccuguaaauaaua

SEQ ID NO: 1843372 - RNA, 16 nt, Salmonella typhimurium LT2
ucgauaaccaccagcg

SEQ ID NO: 1843373 - RNA, 16 nt, Salmonella typhimurium LT2
ucgauaaucgcgcgcu

SEQ ID NO: 1843374 - RNA, 22 nt, Salmonella typhimurium LT2
ucgauaaucauacagcgcagcc

SEQ ID NO: 1843375 - RNA, 14 nt, Salmonella typhimurium LT2
ucgauaauaaaaua

SEQ ID NO: 1843376 - RNA, 17 nt, Salmonella typhimurium LT2
ucgauaauaaaauauua

SEQ ID NO: 1843377 - RNA, 22 nt, Salmonella typhimurium LT2
ucgauccccucuuccaucagcc

SEQ ID NO: 1843378 - RNA, 19 nt, Salmonella typhimurium LT2
ucgauaccaauucccagac

SEQ ID NO: 1843379 - RNA, 14 nt, Salmonella typhimurium LT2
ucgauagcauuuuu

SEQ ID NO: 1843380 - RNA, 15 nt, Salmonella typhimurium LT2
ucgauaucugccugc

SEQ ID NO: 1843381 - RNA, 19 nt, Salmonella typhimurium LT2
ucgauaucgauaaucaaca

SEQ ID NO: 1843382 - RNA, 19 nt, Salmonella typhimurium LT2
ucgaugccaugaacgaccc

SEQ ID NO: 1843383 - RNA, 15 nt, Salmonella typhimurium LT2
ucgaugaaaaagagg

SEQ ID NO: 1843384 - RNA, 22 nt, Salmonella typhimurium LT2
ucgaucucgauauucacacgcu

SEQ ID NO: 1843385 - RNA, 16 nt, Salmonella typhimurium LT2
ucgaucaugccuuuaa

SEQ ID NO: 1843386 - RNA, 15 nt, Salmonella typhimurium LT2
ucgaucucaggcuua

SEQ ID NO: 1843387 - RNA, 14 nt, Salmonella typhimurium LT2
ucgauucucuucuu

SEQ ID NO: 1843388 - RNA, 17 nt, Salmonella typhimurium LT2
ucgauuaaacgccuggg

SEQ ID NO: 1843389 - RNA, 21 nt, Salmonella typhimurium LT2
ucgauguuaaaggucagaagc

SEQ ID NO: 1843390 - RNA, 20 nt, Salmonella typhimurium LT2
ucgcaauauacugauauugc

SEQ ID NO: 1843391 - RNA, 20 nt, Salmonella typhimurium LT2
ucgcacaguuuuccccccuc

SEQ ID NO: 1843392 - RNA, 21 nt, Salmonella typhimurium LT2
ucgcacgaacgggaucaugau

SEQ ID NO: 1843393 - RNA, 15 nt, Salmonella typhimurium LT2
ucgcaccaccggacu

SEQ ID NO: 1843394 - RNA, 14 nt, Salmonella typhimurium LT2
ucgcacaucaugau

SEQ ID NO: 1843395 - RNA, 22 nt, Salmonella typhimurium LT2
ucgcaacagauaagcaccugca

SEQ ID NO: 1843396 - RNA, 16 nt, Salmonella typhimurium LT2
ucgcaacagguuaacc

SEQ ID NO: 1843397 - RNA, 15 nt, Salmonella typhimurium LT2
ucgcaaacuggucga

SEQ ID NO: 1843398 - RNA, 20 nt, Salmonella typhimurium LT2
ucgcaaggcgcgguccgccc

SEQ ID NO: 1843399 - RNA, 17 nt, Salmonella typhimurium LT2
ucgcagcaauucugcug

SEQ ID NO: 1843400 - RNA, 16 nt, Salmonella typhimurium LT2
ucgcagcccaucgcgu

SEQ ID NO: 1843401 - RNA, 22 nt, Salmonella typhimurium LT2
ucgcacgucugucguuuguagg

SEQ ID NO: 1843402 - RNA, 21 nt, Salmonella typhimurium LT2
ucgcaggguaugaauuuuuuc

SEQ ID NO: 1843403 - RNA, 24 nt, Salmonella typhimurium LT2
ucgcagcgcuuugccgcugcugcc

SEQ ID NO: 1843404 - RNA, 16 nt, Salmonella typhimurium LT2
uccggcucgucccgca

SEQ ID NO: 1843405 - RNA, 11 nt, Salmonella typhimurium LT2
uccggcugccu

SEQ ID NO: 1843406 - RNA, 18 nt, Salmonella typhimurium LT2
uccggcugcaccagcguu

SEQ ID NO: 1843407 - RNA, 19 nt, Salmonella typhimurium LT2
uccggcugccagccagcgg

SEQ ID NO: 1843408 - RNA, 24 nt, Salmonella typhimurium LT2
uccggcguuucguuuagcgccugc

SEQ ID NO: 1843409 - RNA, 15 nt, Salmonella typhimurium LT2
uccggcuacaggcgu

SEQ ID NO: 1843410 - RNA, 17 nt, Salmonella typhimurium LT2
uccggcggucagccagc

SEQ ID NO: 1843411 - RNA, 20 nt, Salmonella typhimurium LT2
uccggcgucagcauggugug

SEQ ID NO: 1843412 - RNA, 22 nt, Salmonella typhimurium LT2
uccggcgucccuuucccuucca

SEQ ID NO: 1843413 - RNA, 23 nt, Salmonella typhimurium LT2
uccggcgucuggguuugcagcag

SEQ ID NO: 1843414 - RNA, 23 nt, Salmonella typhimurium LT2
uccggcgcgguauuucgccgccg

SEQ ID NO: 1843415 - RNA, 14 nt, Salmonella typhimurium LT2
uccggcgcggcgcg

SEQ ID NO: 1843416 - RNA, 21 nt, Salmonella typhimurium LT2
uccggcgcugaugacgcgccg

SEQ ID NO: 1843417 - RNA, 14 nt, Salmonella typhimurium LT2
uccggcggcagccg

SEQ ID NO: 1843418 - RNA, 13 nt, Salmonella typhimurium LT2
uccggccugcaug

SEQ ID NO: 1843419 - RNA, 21 nt, Salmonella typhimurium LT2
uccggcgaaaaaccaggcaac

SEQ ID NO: 1843420 - RNA, 20 nt, Salmonella typhimurium LT2
uccggcgaucaccacgccuu

SEQ ID NO: 1843421 - RNA, 15 nt, Salmonella typhimurium LT2
uccggccuacagcug

SEQ ID NO: 1843422 - RNA, 16 nt, Salmonella typhimurium LT2
uccggccugcagggaa

SEQ ID NO: 1843423 - RNA, 16 nt, Salmonella typhimurium LT2
uccgggguucgaaucc

SEQ ID NO: 1843424 - RNA, 22 nt, Salmonella typhimurium LT2
uccgggguucuuuuuaaaacac

SEQ ID NO: 1843425 - RNA, 13 nt, Salmonella typhimurium LT2
uccggguaauuuu

SEQ ID NO: 1843426 - RNA, 14 nt, Salmonella typhimurium LT2
uccgguaucggcaa

SEQ ID NO: 1843427 - RNA, 15 nt, Salmonella typhimurium LT2
uccgguacgccuaaa

SEQ ID NO: 1843428 - RNA, 14 nt, Salmonella typhimurium LT2
uccgguacguccac

SEQ ID NO: 1843429 - RNA, 12 nt, Salmonella typhimurium LT2
uccggucaucca

SEQ ID NO: 1843430 - RNA, 22 nt, Salmonella typhimurium LT2
uccgggccacucuccagcaucc

SEQ ID NO: 1843431 - RNA, 16 nt, Salmonella typhimurium LT2
uccgggauauaaaauu

SEQ ID NO: 1843432 - RNA, 14 nt, Salmonella typhimurium LT2
uccggggccagcgc

SEQ ID NO: 1843433 - RNA, 16 nt, Salmonella typhimurium LT2
uccgcugacacgcgca

SEQ ID NO: 1843434 - RNA, 16 nt, Salmonella typhimurium LT2
uccgcuuuugguuuuu

SEQ ID NO: 1843435 - RNA, 15 nt, Salmonella typhimurium LT2
uccggaucgcggcug

SEQ ID NO: 1843436 - RNA, 23 nt, Salmonella typhimurium LT2
uccggcaacugccggggaaguac

SEQ ID NO: 1843437 - RNA, 13 nt, Salmonella typhimurium LT2
uccggauuguuuu

SEQ ID NO: 1843438 - RNA, 18 nt, Salmonella typhimurium LT2
uccggaguaaugaaaccg

SEQ ID NO: 1843439 - RNA, 17 nt, Salmonella typhimurium LT2
uccggacugauagucau

SEQ ID NO: 1843440 - RNA, 12 nt, Salmonella typhimurium LT2
uccggcauuuuu

SEQ ID NO: 1843441 - RNA, 15 nt, Salmonella typhimurium LT2
uccggcauaaauaau

SEQ ID NO: 1843442 - RNA, 16 nt, Salmonella typhimurium LT2
uccggcauaaauaaua

SEQ ID NO: 1843443 - RNA, 17 nt, Salmonella typhimurium LT2
uccggccaucaugcagg

SEQ ID NO: 1843444 - RNA, 13 nt, Salmonella typhimurium LT2
uccggcaaucaaa

SEQ ID NO: 1843445 - RNA, 16 nt, Salmonella typhimurium LT2
uccggcacucuucuuc

SEQ ID NO: 1843446 - RNA, 18 nt, Salmonella typhimurium LT2
uccggcacgauaaauugc

SEQ ID NO: 1843447 - RNA, 17 nt, Salmonella typhimurium LT2
uccggcagacggcuggg

SEQ ID NO: 1843448 - RNA, 18 nt, Salmonella typhimurium LT2
uccgucgugccuuucagg

SEQ ID NO: 1843449 - RNA, 20 nt, Salmonella typhimurium LT2
uccgucguuaaucagcgcgg

SEQ ID NO: 1843450 - RNA, 14 nt, Salmonella typhimurium LT2
uccguuagcccuuu

SEQ ID NO: 1843451 - RNA, 13 nt, Salmonella typhimurium LT2
uccguucccucug

SEQ ID NO: 1843452 - RNA, 15 nt, Salmonella typhimurium LT2
uccguucccucugag

SEQ ID NO: 1843453 - RNA, 21 nt, Salmonella typhimurium LT2
uccguugccacccaaugaucc

SEQ ID NO: 1843454 - RNA, 18 nt, Salmonella typhimurium LT2
uccguugugaacagcguu

SEQ ID NO: 1843455 - RNA, 23 nt, Salmonella typhimurium LT2
uccguuuucgacaugguuggcca

SEQ ID NO: 1843456 - RNA, 18 nt, Salmonella typhimurium LT2
uccguuuguaacauauuu

SEQ ID NO: 1843457 - RNA, 19 nt, Salmonella typhimurium LT2
uccguauucggaauaaugu

SEQ ID NO: 1843458 - RNA, 16 nt, Salmonella typhimurium LT2
uccguauugcaaugcg

SEQ ID NO: 1843459 - RNA, 23 nt, Salmonella typhimurium LT2
uccguauuacacuacuucuucag

SEQ ID NO: 1843460 - RNA, 23 nt, Salmonella typhimurium LT2
uccgucagcgucacguuauacca

SEQ ID NO: 1843461 - RNA, 23 nt, Salmonella typhimurium LT2
uccgucagaauaucuuuuacaaa

SEQ ID NO: 1843462 - RNA, 13 nt, Salmonella typhimurium LT2
uccguccagaccg

SEQ ID NO: 1843463 - RNA, 18 nt, Salmonella typhimurium LT2
uccguaaucgcuuucauu

SEQ ID NO: 1843464 - RNA, 20 nt, Salmonella typhimurium LT2
uccguacauaacagcagcag

SEQ ID NO: 1843465 - RNA, 20 nt, Salmonella typhimurium LT2
uccguaagcggcggaccagc

SEQ ID NO: 1843466 - RNA, 12 nt, Salmonella typhimurium LT2
uccgguuucaac

SEQ ID NO: 1843467 - RNA, 15 nt, Salmonella typhimurium LT2
uccucaauguuaacu

SEQ ID NO: 1843468 - RNA, 18 nt, Salmonella typhimurium LT2
uccucaaugguuucacgc

SEQ ID NO: 1843469 - RNA, 22 nt, Salmonella typhimurium LT2
uccucaaccugaggaagaagcg

SEQ ID NO: 1843470 - RNA, 20 nt, Salmonella typhimurium LT2
uccuauuggcgcagccuuuu

SEQ ID NO: 1843471 - RNA, 23 nt, Salmonella typhimurium LT2
uccuauucgccgcgcgacagagc

SEQ ID NO: 1843472 - RNA, 23 nt, Salmonella typhimurium LT2
uccuaccacgccgcuacugccgc

SEQ ID NO: 1843473 - RNA, 23 nt, Salmonella typhimurium LT2
uccuaccuugccgggccuggcau

SEQ ID NO: 1843474 - RNA, 22 nt, Salmonella typhimurium LT2
uccugauagccguaaauaauca

SEQ ID NO: 1843475 - RNA, 20 nt, Salmonella typhimurium LT2
uccugacguggcggaaaauc

SEQ ID NO: 1843476 - RNA, 12 nt, Salmonella typhimurium LT2
uccugacgcuga

SEQ ID NO: 1843477 - RNA, 15 nt, Salmonella typhimurium LT2
uccugaauuucacgc

SEQ ID NO: 1843478 - RNA, 20 nt, Salmonella typhimurium LT2
uccugaauagcaggcaaaaa

SEQ ID NO: 1843479 - RNA, 16 nt, Salmonella typhimurium LT2
uccugaaucaccagcc

SEQ ID NO: 1843480 - RNA, 13 nt, Salmonella typhimurium LT2
uccucuuucccuu

SEQ ID NO: 1843481 - RNA, 15 nt, Salmonella typhimurium LT2
uccucuucaguaaga

SEQ ID NO: 1843482 - RNA, 16 nt, Salmonella typhimurium LT2
uccucuugucaggcag

SEQ ID NO: 1843483 - RNA, 20 nt, Salmonella typhimurium LT2
uccucuggcccguuucgggc

SEQ ID NO: 1843484 - RNA, 15 nt, Salmonella typhimurium LT2
uccucugaaaaauau

SEQ ID NO: 1843485 - RNA, 16 nt, Salmonella typhimurium LT2
uccucuauuuuuucaa

SEQ ID NO: 1843486 - RNA, 22 nt, Salmonella typhimurium LT2
uccugaaccagcggcaccagca

SEQ ID NO: 1843487 - RNA, 19 nt, Salmonella typhimurium LT2
uccugaaggacaagcugcg

SEQ ID NO: 1843488 - RNA, 18 nt, Salmonella typhimurium LT2
uccucuuucccuuuuuaa

SEQ ID NO: 1843489 - RNA, 15 nt, Salmonella typhimurium LT2
uccucuuucccuuuu

SEQ ID NO: 1843490 - RNA, 21 nt, Salmonella typhimurium LT2
uccucuuuucgaacgccgaca

SEQ ID NO: 1843491 - RNA, 14 nt, Salmonella typhimurium LT2
uccucgcauccucc

SEQ ID NO: 1843492 - RNA, 20 nt, Salmonella typhimurium LT2
uccucggacgaaaaaugaau

SEQ ID NO: 1843493 - RNA, 20 nt, Salmonella typhimurium LT2
uccuccggcgagcgaugcug

SEQ ID NO: 1843494 - RNA, 14 nt, Salmonella typhimurium LT2
uccuccugcagacu

SEQ ID NO: 1843495 - RNA, 16 nt, Salmonella typhimurium LT2
uccuccugcagacucc

SEQ ID NO: 1843496 - RNA, 14 nt, Salmonella typhimurium LT2
uccucauucagcgg

SEQ ID NO: 1843497 - RNA, 16 nt, Salmonella typhimurium LT2
uccucauucagcggcu

SEQ ID NO: 1843498 - RNA, 19 nt, Salmonella typhimurium LT2
uccucauuuuguugcucca

SEQ ID NO: 1843499 - RNA, 16 nt, Salmonella typhimurium LT2
uccucauacagcccgc

SEQ ID NO: 1843500 - RNA, 17 nt, Salmonella typhimurium LT2
uccucagaauccgucag

SEQ ID NO: 1843501 - RNA, 18 nt, Salmonella typhimurium LT2
uccugcaauccgacaaga

SEQ ID NO: 1843502 - RNA, 14 nt, Salmonella typhimurium LT2
uccugcaaucgcuc

SEQ ID NO: 1843503 - RNA, 23 nt, Salmonella typhimurium LT2
uccugcaggguaauuagccccug

SEQ ID NO: 1843504 - RNA, 22 nt, Salmonella typhimurium LT2
uccugcgcuuuuugcuucgcca

SEQ ID NO: 1843505 - RNA, 22 nt, Salmonella typhimurium LT2
uccugccgccgcaccacugcug

SEQ ID NO: 1843506 - RNA, 13 nt, Salmonella typhimurium LT2
uccugccccugcc

SEQ ID NO: 1843507 - RNA, 15 nt, Salmonella typhimurium LT2
uccugccagacccca

SEQ ID NO: 1843508 - RNA, 16 nt, Salmonella typhimurium LT2
uccugccaaauaaucc

SEQ ID NO: 1843509 - RNA, 17 nt, Salmonella typhimurium LT2
uccugcuggcaaaacgc

SEQ ID NO: 1843510 - RNA, 21 nt, Salmonella typhimurium LT2
uccugcuccugcggcguggaa

SEQ ID NO: 1843511 - RNA, 12 nt, Salmonella typhimurium LT2
uccugcucgccu

SEQ ID NO: 1843512 - RNA, 21 nt, Salmonella typhimurium LT2
uccugcuggcaaaacgcaucc

SEQ ID NO: 1843513 - RNA, 12 nt, Salmonella typhimurium LT2
uccugcuguggu

SEQ ID NO: 1843514 - RNA, 14 nt, Salmonella typhimurium LT2
uccuggaagacuuc

SEQ ID NO: 1843515 - RNA, 16 nt, Salmonella typhimurium LT2
uccuggcuuaccugcu

SEQ ID NO: 1843516 - RNA, 12 nt, Salmonella typhimurium LT2
uccuggcuucaa

SEQ ID NO: 1843517 - RNA, 16 nt, Salmonella typhimurium LT2
uccuggcgugucccca

SEQ ID NO: 1843518 - RNA, 20 nt, Salmonella typhimurium LT2
uccuggcgcuuuaagugcau

SEQ ID NO: 1843519 - RNA, 13 nt, Salmonella typhimurium LT2
uccuggauuuuac

SEQ ID NO: 1843520 - RNA, 21 nt, Salmonella typhimurium LT2
uccuggcaaagcgucauguaa

SEQ ID NO: 1843521 - RNA, 13 nt, Salmonella typhimurium LT2
uccuucauauuuc

SEQ ID NO: 1843522 - RNA, 20 nt, Salmonella typhimurium LT2
uccuucauauuucaagccgc

SEQ ID NO: 1843523 - RNA, 13 nt, Salmonella typhimurium LT2
uccuucagcuuca

SEQ ID NO: 1843524 - RNA, 18 nt, Salmonella typhimurium LT2
uccuucagcuucacgaag

SEQ ID NO: 1843525 - RNA, 21 nt, Salmonella typhimurium LT2
uccuucagcuucacgaagucu

SEQ ID NO: 1843526 - RNA, 18 nt, Salmonella typhimurium LT2
uccuucagcguuugcgcc

SEQ ID NO: 1843527 - RNA, 22 nt, Salmonella typhimurium LT2
uccuuaugggucacauccagac

SEQ ID NO: 1843528 - RNA, 13 nt, Salmonella typhimurium LT2
uccuuaacacaaa

SEQ ID NO: 1843529 - RNA, 15 nt, Salmonella typhimurium LT2
uccugguaggggaaa

SEQ ID NO: 1843530 - RNA, 17 nt, Salmonella typhimurium LT2
uccugggcugccagggc

SEQ ID NO: 1843531 - RNA, 16 nt, Salmonella typhimurium LT2
uccuggggaacagaag

SEQ ID NO: 1843532 - RNA, 21 nt, Salmonella typhimurium LT2
uccugggcaaaauagcccggc

SEQ ID NO: 1843533 - RNA, 19 nt, Salmonella typhimurium LT2
uccuguaugacguuugcuu

SEQ ID NO: 1843534 - RNA, 19 nt, Salmonella typhimurium LT2
uccuguuuacaggcgauuu

SEQ ID NO: 1843535 - RNA, 12 nt, Salmonella typhimurium LT2
ucccagaagaaa

SEQ ID NO: 1843536 - RNA, 14 nt, Salmonella typhimurium LT2
ucccacucuuccag

SEQ ID NO: 1843537 - RNA, 17 nt, Salmonella typhimurium LT2
ucccacugaccugcugg

SEQ ID NO: 1843538 - RNA, 13 nt, Salmonella typhimurium LT2
ucccacucuucca

SEQ ID NO: 1843539 - RNA, 21 nt, Salmonella typhimurium LT2
ucccagccgggcaggaaaagc

SEQ ID NO: 1843540 - RNA, 14 nt, Salmonella typhimurium LT2
ucccagccgggcag

SEQ ID NO: 1843541 - RNA, 20 nt, Salmonella typhimurium LT2
ucccagcagagaucuuucac

SEQ ID NO: 1843542 - RNA, 11 nt, Salmonella typhimurium LT2
ucccagcacaa

SEQ ID NO: 1843543 - RNA, 13 nt, Salmonella typhimurium LT2
ucccagaccauuc

SEQ ID NO: 1843544 - RNA, 19 nt, Salmonella typhimurium LT2
ucccaggcgcgcagcugcc

SEQ ID NO: 1843545 - RNA, 15 nt, Salmonella typhimurium LT2
ucccagcggacugau

SEQ ID NO: 1843546 - RNA, 20 nt, Salmonella typhimurium LT2
ucccagcgcgcgcgcaaagc

SEQ ID NO: 1843547 - RNA, 18 nt, Salmonella typhimurium LT2
ucccagucauccgguuca

SEQ ID NO: 1843548 - RNA, 23 nt, Salmonella typhimurium LT2
ucccaguaguuaccguaaucauc

SEQ ID NO: 1843549 - RNA, 19 nt, Salmonella typhimurium LT2
ucccauccgugcgauaaga

SEQ ID NO: 1843550 - RNA, 16 nt, Salmonella typhimurium LT2
uccccaucccaaucag

SEQ ID NO: 1843551 - RNA, 23 nt, Salmonella typhimurium LT2
uccccauacugacggcgcucuuu

SEQ ID NO: 1843552 - RNA, 19 nt, Salmonella typhimurium LT2
uccccauaucccgaaaagc

SEQ ID NO: 1843553 - RNA, 18 nt, Salmonella typhimurium LT2
uccccagcguaccacgcc

SEQ ID NO: 1843554 - RNA, 23 nt, Salmonella typhimurium LT2
uccccagcguaccacgccgcaca

SEQ ID NO: 1843555 - RNA, 19 nt, Salmonella typhimurium LT2
uccccagcuaaaaacgcca

SEQ ID NO: 1843556 - RNA, 21 nt, Salmonella typhimurium LT2
uccccauaaucgaccguaucc

SEQ ID NO: 1843557 - RNA, 20 nt, Salmonella typhimurium LT2
uccccaggcuggcgcagccg

SEQ ID NO: 1843558 - RNA, 21 nt, Salmonella typhimurium LT2
ucccccggcaccacgcacagu

SEQ ID NO: 1843559 - RNA, 20 nt, Salmonella typhimurium LT2
ucccccggcgccuuuuaaau

SEQ ID NO: 1843560 - RNA, 22 nt, Salmonella typhimurium LT2
ucccccuccauacccuauuuac

SEQ ID NO: 1843561 - RNA, 13 nt, Salmonella typhimurium LT2
ucccccccuuccc

SEQ ID NO: 1843562 - RNA, 22 nt, Salmonella typhimurium LT2
ucccccacgccuguucaucagg

SEQ ID NO: 1843563 - RNA, 16 nt, Salmonella typhimurium LT2
uccccauuuuuuucag

SEQ ID NO: 1843564 - RNA, 14 nt, Salmonella typhimurium LT2
ucccccaaaaugcc

SEQ ID NO: 1843565 - RNA, 16 nt, Salmonella typhimurium LT2
uccccaacagcgacca

SEQ ID NO: 1843566 - RNA, 16 nt, Salmonella typhimurium LT2
uccccaacaucauguc

SEQ ID NO: 1843567 - RNA, 21 nt, Salmonella typhimurium LT2
uccccaacaucauuacugcuu

SEQ ID NO: 1843568 - RNA, 21 nt, Salmonella typhimurium LT2
uccccacgccgaccaccagcu

SEQ ID NO: 1843569 - RNA, 22 nt, Salmonella typhimurium LT2
uccccaacgagagcacuacgcu

SEQ ID NO: 1843570 - RNA, 17 nt, Salmonella typhimurium LT2
uccccacaaucccgcca

SEQ ID NO: 1843571 - RNA, 14 nt, Salmonella typhimurium LT2
uccccggcuucaca

SEQ ID NO: 1843572 - RNA, 17 nt, Salmonella typhimurium LT2
uccccggcgaaagaaaa

SEQ ID NO: 1843573 - RNA, 22 nt, Salmonella typhimurium LT2
uccccggcaaccuuaaacaucg

SEQ ID NO: 1843574 - RNA, 14 nt, Salmonella typhimurium LT2
uccccgucauacuu

SEQ ID NO: 1843575 - RNA, 19 nt, Salmonella typhimurium LT2
uccccguuuuacaccagcu

SEQ ID NO: 1843576 - RNA, 20 nt, Salmonella typhimurium LT2
uccccgcuggcgcggggaac

SEQ ID NO: 1843577 - RNA, 21 nt, Salmonella typhimurium LT2
uccccgcuucgucgccaucca

SEQ ID NO: 1843578 - RNA, 17 nt, Salmonella typhimurium LT2
uccccgccgccaucacc

SEQ ID NO: 1843579 - RNA, 12 nt, Salmonella typhimurium LT2
uccccgccgcca

SEQ ID NO: 1843580 - RNA, 20 nt, Salmonella typhimurium LT2
ucccgacuuuacaccccacu

SEQ ID NO: 1843581 - RNA, 21 nt, Salmonella typhimurium LT2
ucccgaacugucugaaucaau

SEQ ID NO: 1843582 - RNA, 19 nt, Salmonella typhimurium LT2
ucccgacgaauaacaaaau

SEQ ID NO: 1843583 - RNA, 17 nt, Salmonella typhimurium LT2
ucccgaugguggcgucg

SEQ ID NO: 1843584 - RNA, 21 nt, Salmonella typhimurium LT2
ucccgauuucgcuccacuggc

SEQ ID NO: 1843585 - RNA, 15 nt, Salmonella typhimurium LT2
uccccugcuccugcc

SEQ ID NO: 1843586 - RNA, 12 nt, Salmonella typhimurium LT2
uccccugcagau

SEQ ID NO: 1843587 - RNA, 14 nt, Salmonella typhimurium LT2
uccccuucaggaau

SEQ ID NO: 1843588 - RNA, 12 nt, Salmonella typhimurium LT2
ucccgggugcgc

SEQ ID NO: 1843589 - RNA, 16 nt, Salmonella typhimurium LT2
ucccguagcgucaaca

SEQ ID NO: 1843590 - RNA, 14 nt, Salmonella typhimurium LT2
ucccguaaaagaag

SEQ ID NO: 1843591 - RNA, 17 nt, Salmonella typhimurium LT2
ucccguaaaagaagaaa

SEQ ID NO: 1843592 - RNA, 21 nt, Salmonella typhimurium LT2
ucccggcaauuaccgccagcg

SEQ ID NO: 1843593 - RNA, 14 nt, Salmonella typhimurium LT2
ucccggcagugcau

SEQ ID NO: 1843594 - RNA, 14 nt, Salmonella typhimurium LT2
ucccggcauuauaa

SEQ ID NO: 1843595 - RNA, 16 nt, Salmonella typhimurium LT2
ucccgggcgauaaacc

SEQ ID NO: 1843596 - RNA, 23 nt, Salmonella typhimurium LT2
ucccgggcgauaaaccagcccca

SEQ ID NO: 1843597 - RNA, 18 nt, Salmonella typhimurium LT2
ucccgcugugauccaugu

SEQ ID NO: 1843598 - RNA, 13 nt, Salmonella typhimurium LT2
ucccgcugaagac

SEQ ID NO: 1843599 - RNA, 14 nt, Salmonella typhimurium LT2
ucccgcugaagacu

SEQ ID NO: 1843600 - RNA, 21 nt, Salmonella typhimurium LT2
ucccggaacagcggagcgaag

SEQ ID NO: 1843601 - RNA, 22 nt, Salmonella typhimurium LT2
ucccgcguucgcgcaguucauc

SEQ ID NO: 1843602 - RNA, 16 nt, Salmonella typhimurium LT2
ucccgcgcuucauccg

SEQ ID NO: 1843603 - RNA, 17 nt, Salmonella typhimurium LT2
ucccgcgcuucauccga

SEQ ID NO: 1843604 - RNA, 18 nt, Salmonella typhimurium LT2
ucccgcggcggacagcgg

SEQ ID NO: 1843605 - RNA, 17 nt, Salmonella typhimurium LT2
ucccgccacuguccuga

SEQ ID NO: 1843606 - RNA, 23 nt, Salmonella typhimurium LT2
ucccgcacccgggaaagcggauc

SEQ ID NO: 1843607 - RNA, 17 nt, Salmonella typhimurium LT2
ucccgcacuuuccagcc

SEQ ID NO: 1843608 - RNA, 19 nt, Salmonella typhimurium LT2
ucccgccgccaucgccagu

SEQ ID NO: 1843609 - RNA, 13 nt, Salmonella typhimurium LT2
ucccuaauaaaau

SEQ ID NO: 1843610 - RNA, 11 nt, Salmonella typhimurium LT2
ucccucuccag

SEQ ID NO: 1843611 - RNA, 14 nt, Salmonella typhimurium LT2
ucccucgaaguauu

SEQ ID NO: 1843612 - RNA, 12 nt, Salmonella typhimurium LT2
ucccucgccccg

SEQ ID NO: 1843613 - RNA, 14 nt, Salmonella typhimurium LT2
ucccucaucaauac

SEQ ID NO: 1843614 - RNA, 14 nt, Salmonella typhimurium LT2
ucccucuccagggc

SEQ ID NO: 1843615 - RNA, 14 nt, Salmonella typhimurium LT2
ucccucuuaauuuu

SEQ ID NO: 1843616 - RNA, 17 nt, Salmonella typhimurium LT2
ucccugcggcugguugc

SEQ ID NO: 1843617 - RNA, 23 nt, Salmonella typhimurium LT2
ucccuggccggaauacguaauac

SEQ ID NO: 1843618 - RNA, 16 nt, Salmonella typhimurium LT2
ucccuucucgcuaaua

SEQ ID NO: 1843619 - RNA, 12 nt, Salmonella typhimurium LT2
ucccuucuuuua

SEQ ID NO: 1843620 - RNA, 13 nt, Salmonella typhimurium LT2
ucccuguucgcca

SEQ ID NO: 1843621 - RNA, 21 nt, Salmonella typhimurium LT2
uccgaauacggacauuuauuu

SEQ ID NO: 1843622 - RNA, 16 nt, Salmonella typhimurium LT2
ucccuuucaaaaaaga

SEQ ID NO: 1843623 - RNA, 15 nt, Salmonella typhimurium LT2
ucccuucuuuuacug

SEQ ID NO: 1843624 - RNA, 15 nt, Salmonella typhimurium LT2
ucccuugccagcgca

SEQ ID NO: 1843625 - RNA, 15 nt, Salmonella typhimurium LT2
aaaucugguuuuccg

SEQ ID NO: 1843626 - RNA, 19 nt, Salmonella typhimurium LT2
aaaucugaaauaaaagcaa

SEQ ID NO: 1843627 - RNA, 22 nt, Salmonella typhimurium LT2
aaaucugaaauaaaagcaaugu

SEQ ID NO: 1843628 - RNA, 15 nt, Salmonella typhimurium LT2
uccgccgucgucacc

SEQ ID NO: 1843629 - RNA, 17 nt, Salmonella typhimurium LT2
uccgccgcgggcagcag

SEQ ID NO: 1843630 - RNA, 13 nt, Salmonella typhimurium LT2
uccgccgccuucu

SEQ ID NO: 1843631 - RNA, 18 nt, Salmonella typhimurium LT2
uccgccuggaacccaggc

SEQ ID NO: 1843632 - RNA, 20 nt, Salmonella typhimurium LT2
uccgccuggaacccaggcac

SEQ ID NO: 1843633 - RNA, 19 nt, Salmonella typhimurium LT2
uccgccuuaucaggccugu

SEQ ID NO: 1843634 - RNA, 19 nt, Salmonella typhimurium LT2
uccgcccgcgcucccgccc

SEQ ID NO: 1843635 - RNA, 17 nt, Salmonella typhimurium LT2
uccgcccggugcucaau

SEQ ID NO: 1843636 - RNA, 17 nt, Salmonella typhimurium LT2
uccgcccaggaacauga

SEQ ID NO: 1843637 - RNA, 23 nt, Salmonella typhimurium LT2
uccgcgauaucaaucaccucuuc

SEQ ID NO: 1843638 - RNA, 18 nt, Salmonella typhimurium LT2
uccgcgauagagcgcggu

SEQ ID NO: 1843639 - RNA, 14 nt, Salmonella typhimurium LT2
uccgcgagcagcca

SEQ ID NO: 1843640 - RNA, 21 nt, Salmonella typhimurium LT2
uccgcgacguacuggaacagu

SEQ ID NO: 1843641 - RNA, 23 nt, Salmonella typhimurium LT2
uccgcgauggucuucuuucaggu

SEQ ID NO: 1843642 - RNA, 15 nt, Salmonella typhimurium LT2
uccgcgcugaugguu

SEQ ID NO: 1843643 - RNA, 16 nt, Salmonella typhimurium LT2
uccgcuauuaccagua

SEQ ID NO: 1843644 - RNA, 23 nt, Salmonella typhimurium LT2
uccgcaaagcccaucagcgccag

SEQ ID NO: 1843645 - RNA, 22 nt, Salmonella typhimurium LT2
uccgcaaagacaacgaccagug

SEQ ID NO: 1843646 - RNA, 16 nt, Salmonella typhimurium LT2
uccgcaauuuccugau

SEQ ID NO: 1843647 - RNA, 17 nt, Salmonella typhimurium LT2
uccgcacauaaucaccg

SEQ ID NO: 1843648 - RNA, 15 nt, Salmonella typhimurium LT2
uccgcaauccuggcu

SEQ ID NO: 1843649 - RNA, 22 nt, Salmonella typhimurium LT2
uccgcaugagcugguggucuac

SEQ ID NO: 1843650 - RNA, 21 nt, Salmonella typhimurium LT2
uccgcaggcgacgugacggug

SEQ ID NO: 1843651 - RNA, 16 nt, Salmonella typhimurium LT2
uccgccacgcucgcug

SEQ ID NO: 1843652 - RNA, 12 nt, Salmonella typhimurium LT2
uccgccacggcu

SEQ ID NO: 1843653 - RNA, 19 nt, Salmonella typhimurium LT2
uccgccagacucagccagg

SEQ ID NO: 1843654 - RNA, 19 nt, Salmonella typhimurium LT2
uccgccagauacaaaucuc

SEQ ID NO: 1843655 - RNA, 15 nt, Salmonella typhimurium LT2
uccgccagcaacacu

SEQ ID NO: 1843656 - RNA, 16 nt, Salmonella typhimurium LT2
uccgccaggcccauga

SEQ ID NO: 1843657 - RNA, 16 nt, Salmonella typhimurium LT2
uccaugaccguugcca

SEQ ID NO: 1843658 - RNA, 15 nt, Salmonella typhimurium LT2
uccaucagaucauca

SEQ ID NO: 1843659 - RNA, 13 nt, Salmonella typhimurium LT2
uccaucagcgcgg

SEQ ID NO: 1843660 - RNA, 16 nt, Salmonella typhimurium LT2
uccaugucuugcuauc

SEQ ID NO: 1843661 - RNA, 16 nt, Salmonella typhimurium LT2
uccauuagcgccugau

SEQ ID NO: 1843662 - RNA, 22 nt, Salmonella typhimurium LT2
uccauuagcgccugaugcacau

SEQ ID NO: 1843663 - RNA, 19 nt, Salmonella typhimurium LT2
uccauuacucucauguuca

SEQ ID NO: 1843664 - RNA, 20 nt, Salmonella typhimurium LT2
uccauuaaguugaugaauga

SEQ ID NO: 1843665 - RNA, 15 nt, Salmonella typhimurium LT2
uccauguaaacucca

SEQ ID NO: 1843666 - RNA, 14 nt, Salmonella typhimurium LT2
uccauggcaaaauu

SEQ ID NO: 1843667 - RNA, 13 nt, Salmonella typhimurium LT2
uccaugccggcuu

SEQ ID NO: 1843668 - RNA, 21 nt, Salmonella typhimurium LT2
uccaugccuuuggccuggaga

SEQ ID NO: 1843669 - RNA, 21 nt, Salmonella typhimurium LT2
uccauuuuggggaaaauaccg

SEQ ID NO: 1843670 - RNA, 12 nt, Salmonella typhimurium LT2
uccauuuuucag

SEQ ID NO: 1843671 - RNA, 17 nt, Salmonella typhimurium LT2
uccauuuccguuuucag

SEQ ID NO: 1843672 - RNA, 21 nt, Salmonella typhimurium LT2
uccauugcuuccuugauauuu

SEQ ID NO: 1843673 - RNA, 13 nt, Salmonella typhimurium LT2
uccauucccagcu

SEQ ID NO: 1843674 - RNA, 18 nt, Salmonella typhimurium LT2
uccauugcgagaaaaaac

SEQ ID NO: 1843675 - RNA, 18 nt, Salmonella typhimurium LT2
ucccaacaaugccacgcc

SEQ ID NO: 1843676 - RNA, 18 nt, Salmonella typhimurium LT2
ucccaacccgaccaggac

SEQ ID NO: 1843677 - RNA, 21 nt, Salmonella typhimurium LT2
ucccaacccgaccaggacaaa

SEQ ID NO: 1843678 - RNA, 16 nt, Salmonella typhimurium LT2
ucccaauaccggcgua

SEQ ID NO: 1843679 - RNA, 14 nt, Salmonella typhimurium LT2
ucccaacuguuuuc

SEQ ID NO: 1843680 - RNA, 13 nt, Salmonella typhimurium LT2
ucccaccacgcag

SEQ ID NO: 1843681 - RNA, 14 nt, Salmonella typhimurium LT2
ucccacccagcaau

SEQ ID NO: 1843682 - RNA, 17 nt, Salmonella typhimurium LT2
uccacuuucucggcuuu

SEQ ID NO: 1843683 - RNA, 21 nt, Salmonella typhimurium LT2
uccacuuucucggcuuuccag

SEQ ID NO: 1843684 - RNA, 19 nt, Salmonella typhimurium LT2
uccagaacugcgaaaucac

SEQ ID NO: 1843685 - RNA, 24 nt, Salmonella typhimurium LT2
uccagaacgaauuuacucgccaau

SEQ ID NO: 1843686 - RNA, 20 nt, Salmonella typhimurium LT2
uccagaaauaaaauacgcuc

SEQ ID NO: 1843687 - RNA, 20 nt, Salmonella typhimurium LT2
uccagcagguggaucugaau

SEQ ID NO: 1843688 - RNA, 18 nt, Salmonella typhimurium LT2
uccagcagguggaucuga

SEQ ID NO: 1843689 - RNA, 13 nt, Salmonella typhimurium LT2
uccagcagggcgu

SEQ ID NO: 1843690 - RNA, 20 nt, Salmonella typhimurium LT2
uccagcagggcguuuuccag

SEQ ID NO: 1843691 - RNA, 22 nt, Salmonella typhimurium LT2
uccagcauaaugugaugcagac

SEQ ID NO: 1843692 - RNA, 16 nt, Salmonella typhimurium LT2
uccagcauccugcguu

SEQ ID NO: 1843693 - RNA, 22 nt, Salmonella typhimurium LT2
uccagcgcauggaagaaaauau

SEQ ID NO: 1843694 - RNA, 13 nt, Salmonella typhimurium LT2
uccagcgcaugga

SEQ ID NO: 1843695 - RNA, 16 nt, Salmonella typhimurium LT2
uccagcgucgggccgc

SEQ ID NO: 1843696 - RNA, 16 nt, Salmonella typhimurium LT2
uccaggagagcaccuu

SEQ ID NO: 1843697 - RNA, 15 nt, Salmonella typhimurium LT2
uccaggcacucaacc

SEQ ID NO: 1843698 - RNA, 18 nt, Salmonella typhimurium LT2
uccaggcacucaaccugu

SEQ ID NO: 1843699 - RNA, 20 nt, Salmonella typhimurium LT2
uccagcggcaggauccccau

SEQ ID NO: 1843700 - RNA, 18 nt, Salmonella typhimurium LT2
uccagcgguagccagcgc

SEQ ID NO: 1843701 - RNA, 17 nt, Salmonella typhimurium LT2
uccagcgguagcggcac

SEQ ID NO: 1843702 - RNA, 20 nt, Salmonella typhimurium LT2
uccaguaaaaucgggccucc

SEQ ID NO: 1843703 - RNA, 16 nt, Salmonella typhimurium LT2
uccagucgcuccacca

SEQ ID NO: 1843704 - RNA, 13 nt, Salmonella typhimurium LT2
uccagucgccagg

SEQ ID NO: 1843705 - RNA, 19 nt, Salmonella typhimurium LT2
uccagucgcguaugguuca

SEQ ID NO: 1843706 - RNA, 15 nt, Salmonella typhimurium LT2
uccagugccgccaga

SEQ ID NO: 1843707 - RNA, 15 nt, Salmonella typhimurium LT2
uccagugacaaugua

SEQ ID NO: 1843708 - RNA, 21 nt, Salmonella typhimurium LT2
uccaggucaucaccuccagca

SEQ ID NO: 1843709 - RNA, 21 nt, Salmonella typhimurium LT2
uccaggccgucggcgccagcc

SEQ ID NO: 1843710 - RNA, 16 nt, Salmonella typhimurium LT2
uccaggccgccagcgu

SEQ ID NO: 1843711 - RNA, 18 nt, Salmonella typhimurium LT2
uccaggcgcugcuggcag

SEQ ID NO: 1843712 - RNA, 18 nt, Salmonella typhimurium LT2
uccaggcgggcaucgccu

SEQ ID NO: 1843713 - RNA, 20 nt, Salmonella typhimurium LT2
uccaucaaaagcuuuucgcu

SEQ ID NO: 1843714 - RNA, 15 nt, Salmonella typhimurium LT2
uccaguugcggcauc

SEQ ID NO: 1843715 - RNA, 14 nt, Salmonella typhimurium LT2
uccaguucauaagu

SEQ ID NO: 1843716 - RNA, 18 nt, Salmonella typhimurium LT2
uccaguucauaagucauc

SEQ ID NO: 1843717 - RNA, 18 nt, Salmonella typhimurium LT2
uccaguguuguucucuga

SEQ ID NO: 1843718 - RNA, 22 nt, Salmonella typhimurium LT2
uccaguugaaaaccacaaucac

SEQ ID NO: 1843719 - RNA, 17 nt, Salmonella typhimurium LT2
uccaacuggcuuucauc

SEQ ID NO: 1843720 - RNA, 16 nt, Salmonella typhimurium LT2
uccaacuuaugaaaac

SEQ ID NO: 1843721 - RNA, 12 nt, Salmonella typhimurium LT2
uccaacauagcu

SEQ ID NO: 1843722 - RNA, 14 nt, Salmonella typhimurium LT2
uccaacucaguuuc

SEQ ID NO: 1843723 - RNA, 18 nt, Salmonella typhimurium LT2
uccaacucaguuuccagc

SEQ ID NO: 1843724 - RNA, 18 nt, Salmonella typhimurium LT2
uccaacgcgguuuucccu

SEQ ID NO: 1843725 - RNA, 17 nt, Salmonella typhimurium LT2
uccaccaggcaugcagc

SEQ ID NO: 1843726 - RNA, 18 nt, Salmonella typhimurium LT2
uccaccagcuuaucugac

SEQ ID NO: 1843727 - RNA, 16 nt, Salmonella typhimurium LT2
uccaccagcuuaucug

SEQ ID NO: 1843728 - RNA, 13 nt, Salmonella typhimurium LT2
uccaccagcgcca

SEQ ID NO: 1843729 - RNA, 16 nt, Salmonella typhimurium LT2
uccaccauaggccagc

SEQ ID NO: 1843730 - RNA, 18 nt, Salmonella typhimurium LT2
uccaccauaggccagcgu

SEQ ID NO: 1843731 - RNA, 12 nt, Salmonella typhimurium LT2
uccacaccuucc

SEQ ID NO: 1843732 - RNA, 15 nt, Salmonella typhimurium LT2
uccacaccuuccacu

SEQ ID NO: 1843733 - RNA, 16 nt, Salmonella typhimurium LT2
uccacaccuuccacuu

SEQ ID NO: 1843734 - RNA, 18 nt, Salmonella typhimurium LT2
uccacuucagccagcugc

SEQ ID NO: 1843735 - RNA, 17 nt, Salmonella typhimurium LT2
uccacguauaauaauau

SEQ ID NO: 1843736 - RNA, 22 nt, Salmonella typhimurium LT2
uccacguauaauaauauccuuu

SEQ ID NO: 1843737 - RNA, 16 nt, Salmonella typhimurium LT2
uccacuaacuggcaau

SEQ ID NO: 1843738 - RNA, 22 nt, Salmonella typhimurium LT2
uccacguuccgcaaucgcugcc

SEQ ID NO: 1843739 - RNA, 18 nt, Salmonella typhimurium LT2
uccacggucggucaagcu

SEQ ID NO: 1843740 - RNA, 15 nt, Salmonella typhimurium LT2
uccacgguaaaacac

SEQ ID NO: 1843741 - RNA, 22 nt, Salmonella typhimurium LT2
uccacgcgaugagcugcgguaa

SEQ ID NO: 1843742 - RNA, 21 nt, Salmonella typhimurium LT2
ucauugccguuaacugcugcu

SEQ ID NO: 1843743 - RNA, 16 nt, Salmonella typhimurium LT2
ucauugccuuucaaua

SEQ ID NO: 1843744 - RNA, 18 nt, Salmonella typhimurium LT2
ucauugcgaucuccuuua

SEQ ID NO: 1843745 - RNA, 17 nt, Salmonella typhimurium LT2
ucauugccguaaauuga

SEQ ID NO: 1843746 - RNA, 15 nt, Salmonella typhimurium LT2
ucauuguauuucuca

SEQ ID NO: 1843747 - RNA, 13 nt, Salmonella typhimurium LT2
ucauuuucccacu

SEQ ID NO: 1843748 - RNA, 14 nt, Salmonella typhimurium LT2
ucauuuucccacug

SEQ ID NO: 1843749 - RNA, 21 nt, Salmonella typhimurium LT2
ucauuuucccacugaccugcu

SEQ ID NO: 1843750 - RNA, 20 nt, Salmonella typhimurium LT2
ucauuuguacaaaaaaugug

SEQ ID NO: 1843751 - RNA, 23 nt, Salmonella typhimurium LT2
uccaaagauaaacgacagcgcca

SEQ ID NO: 1843752 - RNA, 16 nt, Salmonella typhimurium LT2
uccaacagaaggcuuc

SEQ ID NO: 1843753 - RNA, 13 nt, Salmonella typhimurium LT2
uccaacaauuaua

SEQ ID NO: 1843754 - RNA, 19 nt, Salmonella typhimurium LT2
uccaacacaucgacaugca

SEQ ID NO: 1843755 - RNA, 15 nt, Salmonella typhimurium LT2
ucauuuguacaaaaa

SEQ ID NO: 1843756 - RNA, 14 nt, Salmonella typhimurium LT2
ucauuuugauucag

SEQ ID NO: 1843757 - RNA, 20 nt, Salmonella typhimurium LT2
ucauucauccagaccugagc

SEQ ID NO: 1843758 - RNA, 13 nt, Salmonella typhimurium LT2
ucauuagcgcggu

SEQ ID NO: 1843759 - RNA, 12 nt, Salmonella typhimurium LT2
ucauuauaaaac

SEQ ID NO: 1843760 - RNA, 20 nt, Salmonella typhimurium LT2
ucauugacccucccugcgcu

SEQ ID NO: 1843761 - RNA, 12 nt, Salmonella typhimurium LT2
ucauuaaaaugc

SEQ ID NO: 1843762 - RNA, 13 nt, Salmonella typhimurium LT2
ucauuaaaaaacc

SEQ ID NO: 1843763 - RNA, 13 nt, Salmonella typhimurium LT2
ucaguuucggccc

SEQ ID NO: 1843764 - RNA, 21 nt, Salmonella typhimurium LT2
ucauguugcggguuucugaau

SEQ ID NO: 1843765 - RNA, 17 nt, Salmonella typhimurium LT2
ugaugaugaagcuacag

SEQ ID NO: 1843766 - RNA, 14 nt, Salmonella typhimurium LT2
ugaugauuacucuu

SEQ ID NO: 1843767 - RNA, 13 nt, Salmonella typhimurium LT2
ugaugauaaauug

SEQ ID NO: 1843768 - RNA, 13 nt, Salmonella typhimurium LT2
ugauuuaaaagua

SEQ ID NO: 1843769 - RNA, 13 nt, Salmonella typhimurium LT2
ugauugaugcuug

SEQ ID NO: 1843770 - RNA, 18 nt, Salmonella typhimurium LT2
ugcaaaaugcuucuucaa

SEQ ID NO: 1843771 - RNA, 14 nt, Salmonella typhimurium LT2
ugcaaauauucgcc

SEQ ID NO: 1843772 - RNA, 14 nt, Salmonella typhimurium LT2
ugcaaaucaccaca

SEQ ID NO: 1843773 - RNA, 21 nt, Salmonella typhimurium LT2
ugcaaacuaaacgacguggag

SEQ ID NO: 1843774 - RNA, 19 nt, Salmonella typhimurium LT2
ugauuuuuuaauucauaua

SEQ ID NO: 1843775 - RNA, 12 nt, Salmonella typhimurium LT2
ugauuuuucauc

SEQ ID NO: 1843776 - RNA, 20 nt, Salmonella typhimurium LT2
ugcaaucagcgaaggcaacu

SEQ ID NO: 1843777 - RNA, 23 nt, Salmonella typhimurium LT2
ugcaaucagcgaaggcaacugau

SEQ ID NO: 1843778 - RNA, 15 nt, Salmonella typhimurium LT2
ugcaaucacacuaca

SEQ ID NO: 1843779 - RNA, 16 nt, Salmonella typhimurium LT2
ugcaauauuuaagccc

SEQ ID NO: 1843780 - RNA, 14 nt, Salmonella typhimurium LT2
ugcaauaucaauac

SEQ ID NO: 1843781 - RNA, 20 nt, Salmonella typhimurium LT2
ugcaauaccgggauuguaua

SEQ ID NO: 1843782 - RNA, 17 nt, Salmonella typhimurium LT2
ugcaauaccggcugcuu

SEQ ID NO: 1843783 - RNA, 17 nt, Salmonella typhimurium LT2
ugcaauaaaauauccuc

SEQ ID NO: 1843784 - RNA, 22 nt, Salmonella typhimurium LT2
ugcaaugccguuaccguucagg

SEQ ID NO: 1843785 - RNA, 15 nt, Salmonella typhimurium LT2
ugcaaugcgcuccag

SEQ ID NO: 1843786 - RNA, 21 nt, Salmonella typhimurium LT2
ugcaauguucaauaucaaauu

SEQ ID NO: 1843787 - RNA, 22 nt, Salmonella typhimurium LT2
ugcaauguucaauaucaaauug

SEQ ID NO: 1843788 - RNA, 16 nt, Salmonella typhimurium LT2
ugcaauuguuccugcg

SEQ ID NO: 1843789 - RNA, 19 nt, Salmonella typhimurium LT2
ugcaauuucuuuuccagac

SEQ ID NO: 1843790 - RNA, 14 nt, Salmonella typhimurium LT2
ugcaauuuccccug

SEQ ID NO: 1843791 - RNA, 13 nt, Salmonella typhimurium LT2
ugcacaaaauacu

SEQ ID NO: 1843792 - RNA, 13 nt, Salmonella typhimurium LT2
ugcaauuaauaua

SEQ ID NO: 1843793 - RNA, 15 nt, Salmonella typhimurium LT2
ugcaauuaauauauu

SEQ ID NO: 1843794 - RNA, 19 nt, Salmonella typhimurium LT2
ugcaagccugauacuuuua

SEQ ID NO: 1843795 - RNA, 17 nt, Salmonella typhimurium LT2
ugcaacgccagaugcgu

SEQ ID NO: 1843796 - RNA, 17 nt, Salmonella typhimurium LT2
ugcaacuccugggcaaa

SEQ ID NO: 1843797 - RNA, 13 nt, Salmonella typhimurium LT2
ugcaacagcacca

SEQ ID NO: 1843798 - RNA, 22 nt, Salmonella typhimurium LT2
ugcaacagaagaguuaacuucu

SEQ ID NO: 1843799 - RNA, 14 nt, Salmonella typhimurium LT2
ugcaacagcaccag

SEQ ID NO: 1843800 - RNA, 19 nt, Salmonella typhimurium LT2
ugcaacagcaccagcaggu

SEQ ID NO: 1843801 - RNA, 15 nt, Salmonella typhimurium LT2
ugcaacccgccgcca

SEQ ID NO: 1843802 - RNA, 15 nt, Salmonella typhimurium LT2
ugcagcaaauacaga

SEQ ID NO: 1843803 - RNA, 16 nt, Salmonella typhimurium LT2
ugcagcguuuccagcc

SEQ ID NO: 1843804 - RNA, 17 nt, Salmonella typhimurium LT2
ugcacugacuuacaggc

SEQ ID NO: 1843805 - RNA, 18 nt, Salmonella typhimurium LT2
ugcacuucaugccgaaca

SEQ ID NO: 1843806 - RNA, 15 nt, Salmonella typhimurium LT2
ugcacugcugauagu

SEQ ID NO: 1843807 - RNA, 21 nt, Salmonella typhimurium LT2
ugcacugguagaaaaacccuu

SEQ ID NO: 1843808 - RNA, 13 nt, Salmonella typhimurium LT2
ugcagauuuugcu

SEQ ID NO: 1843809 - RNA, 18 nt, Salmonella typhimurium LT2
ugcagauuacugagcagu

SEQ ID NO: 1843810 - RNA, 13 nt, Salmonella typhimurium LT2
ugcagaugcugcu

SEQ ID NO: 1843811 - RNA, 17 nt, Salmonella typhimurium LT2
ugcaccgcuaaaaaaca

SEQ ID NO: 1843812 - RNA, 22 nt, Salmonella typhimurium LT2
ugcacgucgagacgguguuuag

SEQ ID NO: 1843813 - RNA, 16 nt, Salmonella typhimurium LT2
ugcacaauaccaauaa

SEQ ID NO: 1843814 - RNA, 17 nt, Salmonella typhimurium LT2
ugcaccaaauccuccag

SEQ ID NO: 1843815 - RNA, 15 nt, Salmonella typhimurium LT2
ugcacauguuucagc

SEQ ID NO: 1843816 - RNA, 18 nt, Salmonella typhimurium LT2
ugcacagucugcagaccu

SEQ ID NO: 1843817 - RNA, 19 nt, Salmonella typhimurium LT2
ugcacauaacgugccaucu

SEQ ID NO: 1843818 - RNA, 14 nt, Salmonella typhimurium LT2
ugcauaaaaaaacg

SEQ ID NO: 1843819 - RNA, 19 nt, Salmonella typhimurium LT2
ugcaguuccguugcaauau

SEQ ID NO: 1843820 - RNA, 19 nt, Salmonella typhimurium LT2
ugcaguucguacuccugca

SEQ ID NO: 1843821 - RNA, 22 nt, Salmonella typhimurium LT2
ugcaguucaucauccugcaggg

SEQ ID NO: 1843822 - RNA, 14 nt, Salmonella typhimurium LT2
ugcauaaaacugag

SEQ ID NO: 1843823 - RNA, 20 nt, Salmonella typhimurium LT2
ugcauaaagcgguuuucaaa

SEQ ID NO: 1843824 - RNA, 23 nt, Salmonella typhimurium LT2
ugcaucagaacaaacuuauccca

SEQ ID NO: 1843825 - RNA, 15 nt, Salmonella typhimurium LT2
ugcauagccccagcg

SEQ ID NO: 1843826 - RNA, 13 nt, Salmonella typhimurium LT2
ugcauacauaaau

SEQ ID NO: 1843827 - RNA, 14 nt, Salmonella typhimurium LT2
ugcagguucccgcc

SEQ ID NO: 1843828 - RNA, 13 nt, Salmonella typhimurium LT2
ugcagcuccacaa

SEQ ID NO: 1843829 - RNA, 16 nt, Salmonella typhimurium LT2
ugcagcucaagcgccg

SEQ ID NO: 1843830 - RNA, 17 nt, Salmonella typhimurium LT2
ugcagugacagaggaau

SEQ ID NO: 1843831 - RNA, 18 nt, Salmonella typhimurium LT2
ugcagugcacugccugau

SEQ ID NO: 1843832 - RNA, 19 nt, Salmonella typhimurium LT2
ugcagucgcggaauaauca

SEQ ID NO: 1843833 - RNA, 19 nt, Salmonella typhimurium LT2
ugcaguauugcaccaggaa

SEQ ID NO: 1843834 - RNA, 22 nt, Salmonella typhimurium LT2
ugccacaaccgcccccaacuga

SEQ ID NO: 1843835 - RNA, 23 nt, Salmonella typhimurium LT2
ugccaauggcgauaaaaauaucc

SEQ ID NO: 1843836 - RNA, 15 nt, Salmonella typhimurium LT2
ugcauuuaucuuuaa

SEQ ID NO: 1843837 - RNA, 22 nt, Salmonella typhimurium LT2
ugcaucguuugcaguuccgcaa

SEQ ID NO: 1843838 - RNA, 15 nt, Salmonella typhimurium LT2
ugcaucucuuccagg

SEQ ID NO: 1843839 - RNA, 22 nt, Salmonella typhimurium LT2
ugcaucucuuccaggauacaca

SEQ ID NO: 1843840 - RNA, 18 nt, Salmonella typhimurium LT2
ugcaucuggucaggagau

SEQ ID NO: 1843841 - RNA, 15 nt, Salmonella typhimurium LT2
ugcauugcuuuuagu

SEQ ID NO: 1843842 - RNA, 20 nt, Salmonella typhimurium LT2
ugcauuauuuuagugaaaaa

SEQ ID NO: 1843843 - RNA, 21 nt, Salmonella typhimurium LT2
ugcauuauuuuagugaaaaaa

SEQ ID NO: 1843844 - RNA, 21 nt, Salmonella typhimurium LT2
ugcauuaugggcaaugauaua

SEQ ID NO: 1843845 - RNA, 23 nt, Salmonella typhimurium LT2
ugagcggaacgucuuuuuccagc

SEQ ID NO: 1843846 - RNA, 21 nt, Salmonella typhimurium LT2
ugagcaaugagauccacugag

SEQ ID NO: 1843847 - RNA, 17 nt, Salmonella typhimurium LT2
ugagcggauauucuccg

SEQ ID NO: 1843848 - RNA, 12 nt, Salmonella typhimurium LT2
ugagcgggccgu

SEQ ID NO: 1843849 - RNA, 18 nt, Salmonella typhimurium LT2
ugagcaaaccgcaaauaa

SEQ ID NO: 1843850 - RNA, 12 nt, Salmonella typhimurium LT2
ugagcaaaggca

SEQ ID NO: 1843851 - RNA, 19 nt, Salmonella typhimurium LT2
ugagcaaaggcagccaaca

SEQ ID NO: 1843852 - RNA, 12 nt, Salmonella typhimurium LT2
ugagcaaaacac

SEQ ID NO: 1843853 - RNA, 14 nt, Salmonella typhimurium LT2
ugagcaaaaugcuc

SEQ ID NO: 1843854 - RNA, 20 nt, Salmonella typhimurium LT2
ugagauuguggaacuuuauc

SEQ ID NO: 1843855 - RNA, 15 nt, Salmonella typhimurium LT2
ugagcguguccucug

SEQ ID NO: 1843856 - RNA, 20 nt, Salmonella typhimurium LT2
ugagcguguccucugcugcg

SEQ ID NO: 1843857 - RNA, 11 nt, Salmonella typhimurium LT2
ugagcuaauca

SEQ ID NO: 1843858 - RNA, 22 nt, Salmonella typhimurium LT2
ugagcugcugcuugcuuuucau

SEQ ID NO: 1843859 - RNA, 20 nt, Salmonella typhimurium LT2
ugaggagucauugcuaugcc

SEQ ID NO: 1843860 - RNA, 14 nt, Salmonella typhimurium LT2
ugauaaaacgcagg

SEQ ID NO: 1843861 - RNA, 14 nt, Salmonella typhimurium LT2
ugauaagagaaaau

SEQ ID NO: 1843862 - RNA, 22 nt, Salmonella typhimurium LT2
ugaguucccggugaguccgcga

SEQ ID NO: 1843863 - RNA, 15 nt, Salmonella typhimurium LT2
ugaguucagcugauu

SEQ ID NO: 1843864 - RNA, 20 nt, Salmonella typhimurium LT2
ugauaccuuuaaccucuuuu

SEQ ID NO: 1843865 - RNA, 21 nt, Salmonella typhimurium LT2
ugauacggcguuggcugcucu

SEQ ID NO: 1843866 - RNA, 15 nt, Salmonella typhimurium LT2
ugauacuccaucuga

SEQ ID NO: 1843867 - RNA, 17 nt, Salmonella typhimurium LT2
ugauaccggaggagugc

SEQ ID NO: 1843868 - RNA, 19 nt, Salmonella typhimurium LT2
ugauaccgucuuccuucca

SEQ ID NO: 1843869 - RNA, 20 nt, Salmonella typhimurium LT2
ugauaccgucuuccuuccac

SEQ ID NO: 1843870 - RNA, 13 nt, Salmonella typhimurium LT2
ugauaauaugcuc

SEQ ID NO: 1843871 - RNA, 21 nt, Salmonella typhimurium LT2
ugauaauaauuguaggcagga

SEQ ID NO: 1843872 - RNA, 18 nt, Salmonella typhimurium LT2
ugauaagcgcagcgccau

SEQ ID NO: 1843873 - RNA, 18 nt, Salmonella typhimurium LT2
ugauaagcguagcgccau

SEQ ID NO: 1843874 - RNA, 18 nt, Salmonella typhimurium LT2
ugauaagcauagcgccau

SEQ ID NO: 1843875 - RNA, 13 nt, Salmonella typhimurium LT2
ugauagccacggc

SEQ ID NO: 1843876 - RNA, 15 nt, Salmonella typhimurium LT2
ugauagcgaggcagc

SEQ ID NO: 1843877 - RNA, 18 nt, Salmonella typhimurium LT2
ugauagcgaucagcgcca

SEQ ID NO: 1843878 - RNA, 18 nt, Salmonella typhimurium LT2
ugauagggcgccuguuua

SEQ ID NO: 1843879 - RNA, 21 nt, Salmonella typhimurium LT2
ugauaggcucaauaugccagg

SEQ ID NO: 1843880 - RNA, 21 nt, Salmonella typhimurium LT2
ugauagucguuauaauccuga

SEQ ID NO: 1843881 - RNA, 18 nt, Salmonella typhimurium LT2
ugauaguuuaaauccagc

SEQ ID NO: 1843882 - RNA, 15 nt, Salmonella typhimurium LT2
ugauaguguccacuu

SEQ ID NO: 1843883 - RNA, 20 nt, Salmonella typhimurium LT2
ugauauaaccgucuucaucc

SEQ ID NO: 1843884 - RNA, 22 nt, Salmonella typhimurium LT2
ugauaucgcaacagauaagcac

SEQ ID NO: 1843885 - RNA, 13 nt, Salmonella typhimurium LT2
ugaucuggccaau

SEQ ID NO: 1843886 - RNA, 20 nt, Salmonella typhimurium LT2
ugaucuggccaauuuuucac

SEQ ID NO: 1843887 - RNA, 14 nt, Salmonella typhimurium LT2
ugaucgccucuucg

SEQ ID NO: 1843888 - RNA, 21 nt, Salmonella typhimurium LT2
ugaucgccacgccuaaacuga

SEQ ID NO: 1843889 - RNA, 15 nt, Salmonella typhimurium LT2
ugaucauacugccgc

SEQ ID NO: 1843890 - RNA, 19 nt, Salmonella typhimurium LT2
ugauccgcccccuccagua

SEQ ID NO: 1843891 - RNA, 22 nt, Salmonella typhimurium LT2
ugauccugcaacagcaccagca

SEQ ID NO: 1843892 - RNA, 21 nt, Salmonella typhimurium LT2
ugauaucggccggaugccagu

SEQ ID NO: 1843893 - RNA, 18 nt, Salmonella typhimurium LT2
ugaucaggaaaucuucca

SEQ ID NO: 1843894 - RNA, 13 nt, Salmonella typhimurium LT2
ugaucagcgcucc

SEQ ID NO: 1843895 - RNA, 20 nt, Salmonella typhimurium LT2
ugauaugcaguucaucaucc

SEQ ID NO: 1843896 - RNA, 15 nt, Salmonella typhimurium LT2
ugauaugcaguucau

SEQ ID NO: 1843897 - RNA, 18 nt, Salmonella typhimurium LT2
ugacguuaacgcagcauc

SEQ ID NO: 1843898 - RNA, 13 nt, Salmonella typhimurium LT2
ugacguuuuccuc

SEQ ID NO: 1843899 - RNA, 15 nt, Salmonella typhimurium LT2
ugacguuuuccucgu

SEQ ID NO: 1843900 - RNA, 15 nt, Salmonella typhimurium LT2
ugacuauccacagcg

SEQ ID NO: 1843901 - RNA, 15 nt, Salmonella typhimurium LT2
ugacucaccagcacg

SEQ ID NO: 1843902 - RNA, 21 nt, Salmonella typhimurium LT2
ugacucaccagcacgcaggca

SEQ ID NO: 1843903 - RNA, 16 nt, Salmonella typhimurium LT2
ugacuacucccgucgc

SEQ ID NO: 1843904 - RNA, 19 nt, Salmonella typhimurium LT2
ugacggauucuuccucucg

SEQ ID NO: 1843905 - RNA, 16 nt, Salmonella typhimurium LT2
ugacggauuugacuuc

SEQ ID NO: 1843906 - RNA, 21 nt, Salmonella typhimurium LT2
ugacggcaaagcccacgcccu

SEQ ID NO: 1843907 - RNA, 23 nt, Salmonella typhimurium LT2
ugacggccugucuccgcagcagg

SEQ ID NO: 1843908 - RNA, 20 nt, Salmonella typhimurium LT2
ugacgggaaaucucccuggc

SEQ ID NO: 1843909 - RNA, 22 nt, Salmonella typhimurium LT2
ugacgggaaaucucccuggcag

SEQ ID NO: 1843910 - RNA, 22 nt, Salmonella typhimurium LT2
ugacggcuacuccggcgcggcg

SEQ ID NO: 1843911 - RNA, 18 nt, Salmonella typhimurium LT2
ugacgggaaaucucccug

SEQ ID NO: 1843912 - RNA, 16 nt, Salmonella typhimurium LT2
ugacguaaauucugau

SEQ ID NO: 1843913 - RNA, 18 nt, Salmonella typhimurium LT2
ugacguaaauucugauug

SEQ ID NO: 1843914 - RNA, 15 nt, Salmonella typhimurium LT2
ugacgguuuauaugc

SEQ ID NO: 1843915 - RNA, 16 nt, Salmonella typhimurium LT2
ugacggugauguuggc

SEQ ID NO: 1843916 - RNA, 22 nt, Salmonella typhimurium LT2
ugacgucgguaaucacgucauu

SEQ ID NO: 1843917 - RNA, 13 nt, Salmonella typhimurium LT2
ugacguccaggcc

SEQ ID NO: 1843918 - RNA, 20 nt, Salmonella typhimurium LT2
ugacgucacugucagcauca

SEQ ID NO: 1843919 - RNA, 16 nt, Salmonella typhimurium LT2
ugacucuguggccgcg

SEQ ID NO: 1843920 - RNA, 12 nt, Salmonella typhimurium LT2
ugacugaagacg

SEQ ID NO: 1843921 - RNA, 17 nt, Salmonella typhimurium LT2
ugacugaagauguucag

SEQ ID NO: 1843922 - RNA, 18 nt, Salmonella typhimurium LT2
ugagacccaaaggaggaa

SEQ ID NO: 1843923 - RNA, 18 nt, Salmonella typhimurium LT2
ugagaaauuauuuuaaau

SEQ ID NO: 1843924 - RNA, 17 nt, Salmonella typhimurium LT2
ugagaaauagcgcgcca

SEQ ID NO: 1843925 - RNA, 22 nt, Salmonella typhimurium LT2
ugagagucgauacucacgacuu

SEQ ID NO: 1843926 - RNA, 22 nt, Salmonella typhimurium LT2
ugagacgcgaaacgaaacccaa

SEQ ID NO: 1843927 - RNA, 15 nt, Salmonella typhimurium LT2
ugacgaucaacagac

SEQ ID NO: 1843928 - RNA, 14 nt, Salmonella typhimurium LT2
ugacgauauuccgc

SEQ ID NO: 1843929 - RNA, 18 nt, Salmonella typhimurium LT2
ugacgcaaacugccaggc

SEQ ID NO: 1843930 - RNA, 14 nt, Salmonella typhimurium LT2
ugacgcacaguguu

SEQ ID NO: 1843931 - RNA, 16 nt, Salmonella typhimurium LT2
ugacgcagcaucucaa

SEQ ID NO: 1843932 - RNA, 16 nt, Salmonella typhimurium LT2
ugacgcagcagcuccc

SEQ ID NO: 1843933 - RNA, 18 nt, Salmonella typhimurium LT2
ugacgcagcagcuccccg

SEQ ID NO: 1843934 - RNA, 21 nt, Salmonella typhimurium LT2
ugacgcaguaauacgccgccg

SEQ ID NO: 1843935 - RNA, 17 nt, Salmonella typhimurium LT2
ugacgccaagcugcaga

SEQ ID NO: 1843936 - RNA, 22 nt, Salmonella typhimurium LT2
ugacgcuaaccucuauaguaaa

SEQ ID NO: 1843937 - RNA, 14 nt, Salmonella typhimurium LT2
ugacgcuccugaau

SEQ ID NO: 1843938 - RNA, 12 nt, Salmonella typhimurium LT2
ugacgcuauugu

SEQ ID NO: 1843939 - RNA, 22 nt, Salmonella typhimurium LT2
ugaccguuaguaaucggaucaa

SEQ ID NO: 1843940 - RNA, 17 nt, Salmonella typhimurium LT2
ugaccggcuauccaugc

SEQ ID NO: 1843941 - RNA, 20 nt, Salmonella typhimurium LT2
ugaccgaaccgcuguagucu

SEQ ID NO: 1843942 - RNA, 15 nt, Salmonella typhimurium LT2
ugacgaccgcggccu

SEQ ID NO: 1843943 - RNA, 21 nt, Salmonella typhimurium LT2
ugacgacuuuaucaauacuga

SEQ ID NO: 1843944 - RNA, 23 nt, Salmonella typhimurium LT2
ugacgagcagguuacucuuccac

SEQ ID NO: 1843945 - RNA, 20 nt, Salmonella typhimurium LT2
ugacgaauaccgugcacgcu

SEQ ID NO: 1843946 - RNA, 16 nt, Salmonella typhimurium LT2
ugacgaauagcgcgcu

SEQ ID NO: 1843947 - RNA, 15 nt, Salmonella typhimurium LT2
ugaccaccagcgcga

SEQ ID NO: 1843948 - RNA, 18 nt, Salmonella typhimurium LT2
ugaccaccagcgcgaccg

SEQ ID NO: 1843949 - RNA, 20 nt, Salmonella typhimurium LT2
ugacccgccagugcuuuuaa

SEQ ID NO: 1843950 - RNA, 18 nt, Salmonella typhimurium LT2
ugacccagucgggaaacu

SEQ ID NO: 1843951 - RNA, 15 nt, Salmonella typhimurium LT2
ugaauaacagcacca

SEQ ID NO: 1843952 - RNA, 17 nt, Salmonella typhimurium LT2
ugaauaaccauuccuau

SEQ ID NO: 1843953 - RNA, 15 nt, Salmonella typhimurium LT2
ugacauccauaauac

SEQ ID NO: 1843954 - RNA, 17 nt, Salmonella typhimurium LT2
ugacauccauaauacga

SEQ ID NO: 1843955 - RNA, 21 nt, Salmonella typhimurium LT2
ugacauuugcucccuuaaaag

SEQ ID NO: 1843956 - RNA, 20 nt, Salmonella typhimurium LT2
ugacauuccuuuuaauuuuc

SEQ ID NO: 1843957 - RNA, 16 nt, Salmonella typhimurium LT2
ugacauuaauucaguc

SEQ ID NO: 1843958 - RNA, 18 nt, Salmonella typhimurium LT2
ugacauucccauugagca

SEQ ID NO: 1843959 - RNA, 22 nt, Salmonella typhimurium LT2
ucugauagcuaaccagcgagcu

SEQ ID NO: 1843960 - RNA, 20 nt, Salmonella typhimurium LT2
ucugaucuguuugccagagg

SEQ ID NO: 1843961 - RNA, 13 nt, Salmonella typhimurium LT2
ucugacggccugu

SEQ ID NO: 1843962 - RNA, 22 nt, Salmonella typhimurium LT2
ucugaauuuccugcgcuuuuug

SEQ ID NO: 1843963 - RNA, 13 nt, Salmonella typhimurium LT2
aaaugcucugcaa

SEQ ID NO: 1843964 - RNA, 20 nt, Salmonella typhimurium LT2
aaaugcgguuaauuggcccu

SEQ ID NO: 1843965 - RNA, 23 nt, Salmonella typhimurium LT2
ucugaaaaaccgucggcaauaca

SEQ ID NO: 1843966 - RNA, 15 nt, Salmonella typhimurium LT2
ucucuuuggccagua

SEQ ID NO: 1843967 - RNA, 15 nt, Salmonella typhimurium LT2
ucugaaaaauaugug

SEQ ID NO: 1843968 - RNA, 20 nt, Salmonella typhimurium LT2
ucucuuccaggauacacaug

SEQ ID NO: 1843969 - RNA, 16 nt, Salmonella typhimurium LT2
ucucuuccgccagcgc

SEQ ID NO: 1843970 - RNA, 18 nt, Salmonella typhimurium LT2
ucucugguuucccugccu

SEQ ID NO: 1843971 - RNA, 23 nt, Salmonella typhimurium LT2
ucucuauaaucagguaaguguaa

SEQ ID NO: 1843972 - RNA, 14 nt, Salmonella typhimurium LT2
ucucuacgccggcg

SEQ ID NO: 1843973 - RNA, 16 nt, Salmonella typhimurium LT2
ucgcaucccaggagau

SEQ ID NO: 1843974 - RNA, 15 nt, Salmonella typhimurium LT2
ucgcauccuccaucc

SEQ ID NO: 1843975 - RNA, 20 nt, Salmonella typhimurium LT2
ucgcauguugacugcgcucc

SEQ ID NO: 1843976 - RNA, 23 nt, Salmonella typhimurium LT2
ucgcauuuuuaucggcuauuagc

SEQ ID NO: 1843977 - RNA, 17 nt, Salmonella typhimurium LT2
ucgccaaacacccagcc

SEQ ID NO: 1843978 - RNA, 15 nt, Salmonella typhimurium LT2
ucucgguauccagcu

SEQ ID NO: 1843979 - RNA, 12 nt, Salmonella typhimurium LT2
ucucgucaaggu

SEQ ID NO: 1843980 - RNA, 15 nt, Salmonella typhimurium LT2
ucugcgucuucuucc

SEQ ID NO: 1843981 - RNA, 18 nt, Salmonella typhimurium LT2
ucugcgggacgcaucauc

SEQ ID NO: 1843982 - RNA, 13 nt, Salmonella typhimurium LT2
ucugcuccgccag

SEQ ID NO: 1843983 - RNA, 16 nt, Salmonella typhimurium LT2
ucugcugacauuccuu

SEQ ID NO: 1843984 - RNA, 19 nt, Salmonella typhimurium LT2
ucugcugccucaucaauuc

SEQ ID NO: 1843985 - RNA, 21 nt, Salmonella typhimurium LT2
ucugcugggcgauuucacgaa

SEQ ID NO: 1843986 - RNA, 23 nt, Salmonella typhimurium LT2
ucugggcugacaaaaauuuaagc

SEQ ID NO: 1843987 - RNA, 19 nt, Salmonella typhimurium LT2
ucuggcgcauuccagaccc

SEQ ID NO: 1843988 - RNA, 19 nt, Salmonella typhimurium LT2
ucuggcgacaucuggcuca

SEQ ID NO: 1843989 - RNA, 24 nt, Salmonella typhimurium LT2
ucuggcgaauaauguuguccacaa

SEQ ID NO: 1843990 - RNA, 19 nt, Salmonella typhimurium LT2
ucuggccuacgugcucacg

SEQ ID NO: 1843991 - RNA, 19 nt, Salmonella typhimurium LT2
ucuggaaagcgccucgcaa

SEQ ID NO: 1843992 - RNA, 19 nt, Salmonella typhimurium LT2
ucuggacgggccgccaucu

SEQ ID NO: 1843993 - RNA, 15 nt, Salmonella typhimurium LT2
ucugccugcagaccc

SEQ ID NO: 1843994 - RNA, 13 nt, Salmonella typhimurium LT2
ucugccgcuuuga

SEQ ID NO: 1843995 - RNA, 14 nt, Salmonella typhimurium LT2
ucugccuuuuuuaa

SEQ ID NO: 1843996 - RNA, 15 nt, Salmonella typhimurium LT2
ucugcgcaauguuca

SEQ ID NO: 1843997 - RNA, 22 nt, Salmonella typhimurium LT2
ucugcgccagccagcucaccag

SEQ ID NO: 1843998 - RNA, 14 nt, Salmonella typhimurium LT2
ucugcgccaccagc

SEQ ID NO: 1843999 - RNA, 18 nt, Salmonella typhimurium LT2
ucugcgccgcuugugccg

SEQ ID NO: 1844000 - RNA, 12 nt, Salmonella typhimurium LT2
ucugcgccgccg

SEQ ID NO: 1844001 - RNA, 18 nt, Salmonella typhimurium LT2
ucugcgccuuuggcagga

SEQ ID NO: 1844002 - RNA, 15 nt, Salmonella typhimurium LT2
ucugauggcgcugcg

SEQ ID NO: 1844003 - RNA, 17 nt, Salmonella typhimurium LT2
ucugcaaaauauauaau

SEQ ID NO: 1844004 - RNA, 16 nt, Salmonella typhimurium LT2
ucugccauuucugcuc

SEQ ID NO: 1844005 - RNA, 18 nt, Salmonella typhimurium LT2
ucugcccauuucagcauu

SEQ ID NO: 1844006 - RNA, 16 nt, Salmonella typhimurium LT2
ucugcccuggcucuac

SEQ ID NO: 1844007 - RNA, 14 nt, Salmonella typhimurium LT2
ucuuaaaucaugaa

SEQ ID NO: 1844008 - RNA, 23 nt, Salmonella typhimurium LT2
ucuguuuuuggaaacuaugcaaa

SEQ ID NO: 1844009 - RNA, 20 nt, Salmonella typhimurium LT2
ucuuauuagcgauuuaaugu

SEQ ID NO: 1844010 - RNA, 15 nt, Salmonella typhimurium LT2
ucuuaugccgcuuuu

SEQ ID NO: 1844011 - RNA, 23 nt, Salmonella typhimurium LT2
ucuuccgccauacccggcuccca

SEQ ID NO: 1844012 - RNA, 15 nt, Salmonella typhimurium LT2
ucuuccgacagggcc

SEQ ID NO: 1844013 - RNA, 16 nt, Salmonella typhimurium LT2
ucuuccgacagggccc

SEQ ID NO: 1844014 - RNA, 17 nt, Salmonella typhimurium LT2
ucuucaugcagcgcggu

SEQ ID NO: 1844015 - RNA, 21 nt, Salmonella typhimurium LT2
ucuucaucggucagagcauaa

SEQ ID NO: 1844016 - RNA, 15 nt, Salmonella typhimurium LT2
ucuucaucguuucug

SEQ ID NO: 1844017 - RNA, 17 nt, Salmonella typhimurium LT2
ucuucaucccagcuaaa

SEQ ID NO: 1844018 - RNA, 15 nt, Salmonella typhimurium LT2
ucuucaucccagucg

SEQ ID NO: 1844019 - RNA, 11 nt, Salmonella typhimurium LT2
ucuucaucaaa

SEQ ID NO: 1844020 - RNA, 23 nt, Salmonella typhimurium LT2
ucuucauauuguagguuuuccuc

SEQ ID NO: 1844021 - RNA, 12 nt, Salmonella typhimurium LT2
ucuucauauuug

SEQ ID NO: 1844022 - RNA, 18 nt, Salmonella typhimurium LT2
ucuucauagucgcuuuuc

SEQ ID NO: 1844023 - RNA, 18 nt, Salmonella typhimurium LT2
ucuucaguaaccagggcg

SEQ ID NO: 1844024 - RNA, 22 nt, Salmonella typhimurium LT2
ucuucaguaauuucgaugauga

SEQ ID NO: 1844025 - RNA, 22 nt, Salmonella typhimurium LT2
ucuucuuagaauagcaucaauu

SEQ ID NO: 1844026 - RNA, 13 nt, Salmonella typhimurium LT2
ucuucuucucaau

SEQ ID NO: 1844027 - RNA, 13 nt, Salmonella typhimurium LT2
ucuucuuccggcu

SEQ ID NO: 1844028 - RNA, 21 nt, Salmonella typhimurium LT2
ucuucuugcugacgaucgauc

SEQ ID NO: 1844029 - RNA, 15 nt, Salmonella typhimurium LT2
ucuucgcaaucuccg

SEQ ID NO: 1844030 - RNA, 19 nt, Salmonella typhimurium LT2
ucuucgccaaacacccagc

SEQ ID NO: 1844031 - RNA, 18 nt, Salmonella typhimurium LT2
ucuucgccgucauaaaac

SEQ ID NO: 1844032 - RNA, 21 nt, Salmonella typhimurium LT2
ucuucgauuguugacugccag

SEQ ID NO: 1844033 - RNA, 14 nt, Salmonella typhimurium LT2
ucuucgauaaaggg

SEQ ID NO: 1844034 - RNA, 16 nt, Salmonella typhimurium LT2
ucuucgacauauuuac

SEQ ID NO: 1844035 - RNA, 20 nt, Salmonella typhimurium LT2
ucuucgacauauuuacgugc

SEQ ID NO: 1844036 - RNA, 18 nt, Salmonella typhimurium LT2
ucuucgacacauuucagc

SEQ ID NO: 1844037 - RNA, 18 nt, Salmonella typhimurium LT2
ucuucucaacgccggaug

SEQ ID NO: 1844038 - RNA, 23 nt, Salmonella typhimurium LT2
ucuucucaggcgagcccugugcg

SEQ ID NO: 1844039 - RNA, 14 nt, Salmonella typhimurium LT2
ucuucuacaaugcg

SEQ ID NO: 1844040 - RNA, 15 nt, Salmonella typhimurium LT2
ucuucuaaaucauac

SEQ ID NO: 1844041 - RNA, 15 nt, Salmonella typhimurium LT2
ucuucuuucaucaua

SEQ ID NO: 1844042 - RNA, 19 nt, Salmonella typhimurium LT2
ucuucuuuagauaauuucg

SEQ ID NO: 1844043 - RNA, 21 nt, Salmonella typhimurium LT2
ucuucuuuaaggcccuggcuc

SEQ ID NO: 1844044 - RNA, 14 nt, Salmonella typhimurium LT2
ucuugccacuggcc

SEQ ID NO: 1844045 - RNA, 18 nt, Salmonella typhimurium LT2
ucuugccacuggccuccc

SEQ ID NO: 1844046 - RNA, 14 nt, Salmonella typhimurium LT2
ucuugcccgcugag

SEQ ID NO: 1844047 - RNA, 18 nt, Salmonella typhimurium LT2
ucuugcaggcaggucucc

SEQ ID NO: 1844048 - RNA, 15 nt, Salmonella typhimurium LT2
ucuuuaccaaugugc

SEQ ID NO: 1844049 - RNA, 20 nt, Salmonella typhimurium LT2
ucuuuaauuugugccagcgu

SEQ ID NO: 1844050 - RNA, 16 nt, Salmonella typhimurium LT2
ucuuuaauuaaauuuu

SEQ ID NO: 1844051 - RNA, 17 nt, Salmonella typhimurium LT2
ucuuuagauaauuucgc

SEQ ID NO: 1844052 - RNA, 16 nt, Salmonella typhimurium LT2
ucuuuagauaauuucg

SEQ ID NO: 1844053 - RNA, 12 nt, Salmonella typhimurium LT2
ucuuucaauccu

SEQ ID NO: 1844054 - RNA, 13 nt, Salmonella typhimurium LT2
ucuuucaccauua

SEQ ID NO: 1844055 - RNA, 15 nt, Salmonella typhimurium LT2
ucuuuaucuaucacc

SEQ ID NO: 1844056 - RNA, 14 nt, Salmonella typhimurium LT2
ucuuuauugguugc

SEQ ID NO: 1844057 - RNA, 21 nt, Salmonella typhimurium LT2
ucuuuaucuucugcugcuccc

SEQ ID NO: 1844058 - RNA, 17 nt, Salmonella typhimurium LT2
ucuuuauccugaaggac

SEQ ID NO: 1844059 - RNA, 12 nt, Salmonella typhimurium LT2
ucuuuaucaaac

SEQ ID NO: 1844060 - RNA, 19 nt, Salmonella typhimurium LT2
ucuuguuuucuacucuuca

SEQ ID NO: 1844061 - RNA, 21 nt, Salmonella typhimurium LT2
ucuugugcuuccagcuccauc

SEQ ID NO: 1844062 - RNA, 13 nt, Salmonella typhimurium LT2
ucuuuaaacuuuu

SEQ ID NO: 1844063 - RNA, 16 nt, Salmonella typhimurium LT2
ucuuuaaauuucaggg

SEQ ID NO: 1844064 - RNA, 22 nt, Salmonella typhimurium LT2
ucuuguagugugauccaucccu

SEQ ID NO: 1844065 - RNA, 17 nt, Salmonella typhimurium LT2
ucuuguagugugaucca

SEQ ID NO: 1844066 - RNA, 21 nt, Salmonella typhimurium LT2
ucuugucaggcagaaauaacu

SEQ ID NO: 1844067 - RNA, 15 nt, Salmonella typhimurium LT2
ucuugcucaauaaua

SEQ ID NO: 1844068 - RNA, 14 nt, Salmonella typhimurium LT2
ucuugcucacggcg

SEQ ID NO: 1844069 - RNA, 15 nt, Salmonella typhimurium LT2
ucuugcuuuauuuuu

SEQ ID NO: 1844070 - RNA, 19 nt, Salmonella typhimurium LT2
ucuuggagagcaucaucug

SEQ ID NO: 1844071 - RNA, 19 nt, Salmonella typhimurium LT2
ucuuucuggaacugucccg

SEQ ID NO: 1844072 - RNA, 15 nt, Salmonella typhimurium LT2
ucuuucuguguugcu

SEQ ID NO: 1844073 - RNA, 22 nt, Salmonella typhimurium LT2
ucuuuggccaguaucgcgccgc

SEQ ID NO: 1844074 - RNA, 14 nt, Salmonella typhimurium LT2
ucuuugcugccguc

SEQ ID NO: 1844075 - RNA, 12 nt, Salmonella typhimurium LT2
ucuuuggagauu

SEQ ID NO: 1844076 - RNA, 17 nt, Salmonella typhimurium LT2
ucuuuggagauuucggc

SEQ ID NO: 1844077 - RNA, 14 nt, Salmonella typhimurium LT2
ucuuucggcgccug

SEQ ID NO: 1844078 - RNA, 13 nt, Salmonella typhimurium LT2
ucuuucgucacua

SEQ ID NO: 1844079 - RNA, 21 nt, Salmonella typhimurium LT2
ucuuucugaaacggaucaaaa

SEQ ID NO: 1844080 - RNA, 13 nt, Salmonella typhimurium LT2
ucuuucaucaaac

SEQ ID NO: 1844081 - RNA, 13 nt, Salmonella typhimurium LT2
ucuuucccuuuuu

SEQ ID NO: 1844082 - RNA, 14 nt, Salmonella typhimurium LT2
ucuuuccgcuacua

SEQ ID NO: 1844083 - RNA, 17 nt, Salmonella typhimurium LT2
ucuuuuguuuuucucuu

SEQ ID NO: 1844084 - RNA, 12 nt, Salmonella typhimurium LT2
ucuuuugcaaua

SEQ ID NO: 1844085 - RNA, 13 nt, Salmonella typhimurium LT2
ucuuuucaauaaa

SEQ ID NO: 1844086 - RNA, 20 nt, Salmonella typhimurium LT2
ucuuuuauuauuacaggagu

SEQ ID NO: 1844087 - RNA, 23 nt, Salmonella typhimurium LT2
ucuuugugcgagaguuuuucagc

SEQ ID NO: 1844088 - RNA, 22 nt, Salmonella typhimurium LT2
ucuuuuaaggcggcaaagauaa

SEQ ID NO: 1844089 - RNA, 21 nt, Salmonella typhimurium LT2
ugaacagggugacucauuuca

SEQ ID NO: 1844090 - RNA, 18 nt, Salmonella typhimurium LT2
ugaacauacguuuaaagc

SEQ ID NO: 1844091 - RNA, 16 nt, Salmonella typhimurium LT2
ugaaccauaucaaaca

SEQ ID NO: 1844092 - RNA, 20 nt, Salmonella typhimurium LT2
ugaacccgaccgucuuuguc

SEQ ID NO: 1844093 - RNA, 20 nt, Salmonella typhimurium LT2
ugaaccgaaauccaccagcg

SEQ ID NO: 1844094 - RNA, 20 nt, Salmonella typhimurium LT2
ugaaccuccugugaagacau

SEQ ID NO: 1844095 - RNA, 20 nt, Salmonella typhimurium LT2
ugaaaucgccuguuaauggu

SEQ ID NO: 1844096 - RNA, 15 nt, Salmonella typhimurium LT2
ugaaaucuugcuguc

SEQ ID NO: 1844097 - RNA, 18 nt, Salmonella typhimurium LT2
ugaacagucccaccagcg

SEQ ID NO: 1844098 - RNA, 11 nt, Salmonella typhimurium LT2
ugaacaggcag

SEQ ID NO: 1844099 - RNA, 16 nt, Salmonella typhimurium LT2
ugaacggcucaaaaua

SEQ ID NO: 1844100 - RNA, 20 nt, Salmonella typhimurium LT2
ugaacucgacgccuucuucg

SEQ ID NO: 1844101 - RNA, 17 nt, Salmonella typhimurium LT2
ugaacucgacuuuuucc

SEQ ID NO: 1844102 - RNA, 14 nt, Salmonella typhimurium LT2
ugaacucuuucaga

SEQ ID NO: 1844103 - RNA, 21 nt, Salmonella typhimurium LT2
ugaacugacguuagucauauu

SEQ ID NO: 1844104 - RNA, 19 nt, Salmonella typhimurium LT2
ugaacugcccggagccaau

SEQ ID NO: 1844105 - RNA, 22 nt, Salmonella typhimurium LT2
ugaacuacgccccggcgcgcca

SEQ ID NO: 1844106 - RNA, 13 nt, Salmonella typhimurium LT2
ugaauaaaccaga

SEQ ID NO: 1844107 - RNA, 14 nt, Salmonella typhimurium LT2
ugaagcugccguag

SEQ ID NO: 1844108 - RNA, 13 nt, Salmonella typhimurium LT2
ugaagcuguuuug

SEQ ID NO: 1844109 - RNA, 17 nt, Salmonella typhimurium LT2
ugaaggcaaaacaccau

SEQ ID NO: 1844110 - RNA, 15 nt, Salmonella typhimurium LT2
ugaaguaauguucag

SEQ ID NO: 1844111 - RNA, 16 nt, Salmonella typhimurium LT2
ugaaguaauguucagg

SEQ ID NO: 1844112 - RNA, 17 nt, Salmonella typhimurium LT2
ugaagaagucgaaggcg

SEQ ID NO: 1844113 - RNA, 11 nt, Salmonella typhimurium LT2
ugaaaaaaacg

SEQ ID NO: 1844114 - RNA, 11 nt, Salmonella typhimurium LT2
ugaaaagugaa

SEQ ID NO: 1844115 - RNA, 12 nt, Salmonella typhimurium LT2
ugaaaaggaaaa

SEQ ID NO: 1844116 - RNA, 12 nt, Salmonella typhimurium LT2
ugaaaaccugca

SEQ ID NO: 1844117 - RNA, 16 nt, Salmonella typhimurium LT2
ugaaaaccugcaaaaa

SEQ ID NO: 1844118 - RNA, 13 nt, Salmonella typhimurium LT2
ugaaaaauguuca

SEQ ID NO: 1844119 - RNA, 12 nt, Salmonella typhimurium LT2
ugaaaaaucccc

SEQ ID NO: 1844120 - RNA, 23 nt, Salmonella typhimurium LT2
ugaaagccaucgcuaaguugaac

SEQ ID NO: 1844121 - RNA, 22 nt, Salmonella typhimurium LT2
ugaaagcucggcgggguuuuuu

SEQ ID NO: 1844122 - RNA, 18 nt, Salmonella typhimurium LT2
ugaaacugaaucaauagc

SEQ ID NO: 1844123 - RNA, 14 nt, Salmonella typhimurium LT2
ugaaagauuauuuu

SEQ ID NO: 1844124 - RNA, 20 nt, Salmonella typhimurium LT2
ugaaagauuauuuuaucauc

SEQ ID NO: 1844125 - RNA, 23 nt, Salmonella typhimurium LT2
ugaaagauuauuuuaucaucagc

SEQ ID NO: 1844126 - RNA, 22 nt, Salmonella typhimurium LT2
ugaaauaccaggcggcuuuuuc

SEQ ID NO: 1844127 - RNA, 19 nt, Salmonella typhimurium LT2
ugaaauaaucguguaaucu

SEQ ID NO: 1844128 - RNA, 22 nt, Salmonella typhimurium LT2
ugaaacaguccggcgaaaaaag

SEQ ID NO: 1844129 - RNA, 15 nt, Salmonella typhimurium LT2
ugaaacagaauaaac

SEQ ID NO: 1844130 - RNA, 15 nt, Salmonella typhimurium LT2
ugaaaauagcgccau

SEQ ID NO: 1844131 - RNA, 18 nt, Salmonella typhimurium LT2
ugaaaaucgacuggugau

SEQ ID NO: 1844132 - RNA, 21 nt, Salmonella typhimurium LT2
ugaaaaucgacuggugauuuu

SEQ ID NO: 1844133 - RNA, 21 nt, Salmonella typhimurium LT2
ugaaaaugcguccagaggauc

SEQ ID NO: 1844134 - RNA, 13 nt, Salmonella typhimurium LT2
ugaaaaugaaaaa

SEQ ID NO: 1844135 - RNA, 21 nt, Salmonella typhimurium LT2
ugcucgccauaaaucgcggcg

SEQ ID NO: 1844136 - RNA, 17 nt, Salmonella typhimurium LT2
ugcucguaccaggcccc

SEQ ID NO: 1844137 - RNA, 22 nt, Salmonella typhimurium LT2
ugcucguaccaggccccugcca

SEQ ID NO: 1844138 - RNA, 20 nt, Salmonella typhimurium LT2
ugcucuaaccaacugagcua

SEQ ID NO: 1844139 - RNA, 13 nt, Salmonella typhimurium LT2
ugcucguuuuuau

SEQ ID NO: 1844140 - RNA, 18 nt, Salmonella typhimurium LT2
ugcucguuuuuauacaaa

SEQ ID NO: 1844141 - RNA, 23 nt, Salmonella typhimurium LT2
ugcucucccagcugagcuaauca

SEQ ID NO: 1844142 - RNA, 19 nt, Salmonella typhimurium LT2
ugcucucccagcugagcua

SEQ ID NO: 1844143 - RNA, 17 nt, Salmonella typhimurium LT2
ugcucucccagcugagc

SEQ ID NO: 1844144 - RNA, 13 nt, Salmonella typhimurium LT2
ugcucuuuaacaa

SEQ ID NO: 1844145 - RNA, 15 nt, Salmonella typhimurium LT2
ugcugaaaugauaag

SEQ ID NO: 1844146 - RNA, 17 nt, Salmonella typhimurium LT2
ugcugaauagccagccc

SEQ ID NO: 1844147 - RNA, 19 nt, Salmonella typhimurium LT2
ugcugaauauugucggcgu

SEQ ID NO: 1844148 - RNA, 15 nt, Salmonella typhimurium LT2
ugcugaccuuaaucc

SEQ ID NO: 1844149 - RNA, 16 nt, Salmonella typhimurium LT2
ugcugacguaaauucu

SEQ ID NO: 1844150 - RNA, 20 nt, Salmonella typhimurium LT2
ugcugacauuccuuuuaauu

SEQ ID NO: 1844151 - RNA, 23 nt, Salmonella typhimurium LT2
ugcugacauuccuuuuaauuuuc

SEQ ID NO: 1844152 - RNA, 21 nt, Salmonella typhimurium LT2
ugcugacaaaauaaagugaaa

SEQ ID NO: 1844153 - RNA, 15 nt, Salmonella typhimurium LT2
ugcugagcagccagc

SEQ ID NO: 1844154 - RNA, 15 nt, Salmonella typhimurium LT2
ugcugcccgccgcca

SEQ ID NO: 1844155 - RNA, 16 nt, Salmonella typhimurium LT2
ugcugcccgccgccag

SEQ ID NO: 1844156 - RNA, 15 nt, Salmonella typhimurium LT2
ugcugccggaaaacg

SEQ ID NO: 1844157 - RNA, 20 nt, Salmonella typhimurium LT2
ugcugccgauuggucaauaa

SEQ ID NO: 1844158 - RNA, 21 nt, Salmonella typhimurium LT2
ugcugauguccgcagccgcau

SEQ ID NO: 1844159 - RNA, 18 nt, Salmonella typhimurium LT2
ugcugcaccaaucaucac

SEQ ID NO: 1844160 - RNA, 14 nt, Salmonella typhimurium LT2
aaaugguuuugccc

SEQ ID NO: 1844161 - RNA, 16 nt, Salmonella typhimurium LT2
aaaugguuuugcccau

SEQ ID NO: 1844162 - RNA, 17 nt, Salmonella typhimurium LT2
aaaugguuuugcccauu

SEQ ID NO: 1844163 - RNA, 16 nt, Salmonella typhimurium LT2
ugcuggcuuaacucac

SEQ ID NO: 1844164 - RNA, 14 nt, Salmonella typhimurium LT2
ugcuggcgaugagu

SEQ ID NO: 1844165 - RNA, 18 nt, Salmonella typhimurium LT2
ugcuggccuguucaagug

SEQ ID NO: 1844166 - RNA, 22 nt, Salmonella typhimurium LT2
ugcuggcgcuacguuugucagu

SEQ ID NO: 1844167 - RNA, 14 nt, Salmonella typhimurium LT2
ugcugcgacggucg

SEQ ID NO: 1844168 - RNA, 19 nt, Salmonella typhimurium LT2
ugcugcgaggccaacggcc

SEQ ID NO: 1844169 - RNA, 14 nt, Salmonella typhimurium LT2
ugcugcgcuuuguc

SEQ ID NO: 1844170 - RNA, 20 nt, Salmonella typhimurium LT2
ugcugcgcuuuccaggccag

SEQ ID NO: 1844171 - RNA, 23 nt, Salmonella typhimurium LT2
ugcugcgcuuuccaggccagcga

SEQ ID NO: 1844172 - RNA, 13 nt, Salmonella typhimurium LT2
ugcugcgccagcc

SEQ ID NO: 1844173 - RNA, 20 nt, Salmonella typhimurium LT2
ugcugcgcggccagaaccug

SEQ ID NO: 1844174 - RNA, 17 nt, Salmonella typhimurium LT2
ugcugcuguuaccggac

SEQ ID NO: 1844175 - RNA, 17 nt, Salmonella typhimurium LT2
ugcuggaaacgcggccc

SEQ ID NO: 1844176 - RNA, 21 nt, Salmonella typhimurium LT2
ugcugcuucaguaaaucccgc

SEQ ID NO: 1844177 - RNA, 23 nt, Salmonella typhimurium LT2
ugcuggacaggagcggaagaggc

SEQ ID NO: 1844178 - RNA, 17 nt, Salmonella typhimurium LT2
ugcuguaaguuuccguc

SEQ ID NO: 1844179 - RNA, 17 nt, Salmonella typhimurium LT2
ugcuguacauauccagu

SEQ ID NO: 1844180 - RNA, 22 nt, Salmonella typhimurium LT2
ugcuguauaaacucagcaauau

SEQ ID NO: 1844181 - RNA, 19 nt, Salmonella typhimurium LT2
ugcugguguuuuuuucauc

SEQ ID NO: 1844182 - RNA, 14 nt, Salmonella typhimurium LT2
ugcugguuaacucu

SEQ ID NO: 1844183 - RNA, 12 nt, Salmonella typhimurium LT2
ugcuguaaaccg

SEQ ID NO: 1844184 - RNA, 16 nt, Salmonella typhimurium LT2
ugcuggguacgugcaa

SEQ ID NO: 1844185 - RNA, 19 nt, Salmonella typhimurium LT2
ugcuggugaagacgcugca

SEQ ID NO: 1844186 - RNA, 18 nt, Salmonella typhimurium LT2
aaaugucccgauauuggu

SEQ ID NO: 1844187 - RNA, 20 nt, Salmonella typhimurium LT2
ugcugggcgauuucacgaau

SEQ ID NO: 1844188 - RNA, 23 nt, Salmonella typhimurium LT2
ugcuguuaccguaagcgggaugg

SEQ ID NO: 1844189 - RNA, 16 nt, Salmonella typhimurium LT2
ugcugucuuagugaaa

SEQ ID NO: 1844190 - RNA, 14 nt, Salmonella typhimurium LT2
ugcugugcauaucu

SEQ ID NO: 1844191 - RNA, 16 nt, Salmonella typhimurium LT2
ugcuguccgccagcaa

SEQ ID NO: 1844192 - RNA, 14 nt, Salmonella typhimurium LT2
ugcuuaauucauaa

SEQ ID NO: 1844193 - RNA, 13 nt, Salmonella typhimurium LT2
ugcuuaacuucug

SEQ ID NO: 1844194 - RNA, 13 nt, Salmonella typhimurium LT2
ugcuuaccagacc

SEQ ID NO: 1844195 - RNA, 19 nt, Salmonella typhimurium LT2
ugcuuacggcaaacugaaa

SEQ ID NO: 1844196 - RNA, 18 nt, Salmonella typhimurium LT2
ugcuuagcuguuacggau

SEQ ID NO: 1844197 - RNA, 18 nt, Salmonella typhimurium LT2
ugcuuauguaggccugau

SEQ ID NO: 1844198 - RNA, 21 nt, Salmonella typhimurium LT2
ugcuuauuauuuuuucuuuaa

SEQ ID NO: 1844199 - RNA, 18 nt, Salmonella typhimurium LT2
ugcuuauugucgccgccg

SEQ ID NO: 1844200 - RNA, 18 nt, Salmonella typhimurium LT2
ugcuuaucgauaucugcc

SEQ ID NO: 1844201 - RNA, 20 nt, Salmonella typhimurium LT2
ugcuucagacaacgccgccu

SEQ ID NO: 1844202 - RNA, 13 nt, Salmonella typhimurium LT2
ugcuucucuucaa

SEQ ID NO: 1844203 - RNA, 16 nt, Salmonella typhimurium LT2
ugcuucguccagaucc

SEQ ID NO: 1844204 - RNA, 23 nt, Salmonella typhimurium LT2
ugcuucgccacgaccuacaccgu

SEQ ID NO: 1844205 - RNA, 16 nt, Salmonella typhimurium LT2
ugcuuccuugauauuu

SEQ ID NO: 1844206 - RNA, 20 nt, Salmonella typhimurium LT2
ugcuuccggcacugcgccuu

SEQ ID NO: 1844207 - RNA, 15 nt, Salmonella typhimurium LT2
ugcuuccugccgcga

SEQ ID NO: 1844208 - RNA, 19 nt, Salmonella typhimurium LT2
ugcuuccagcuccauccac

SEQ ID NO: 1844209 - RNA, 19 nt, Salmonella typhimurium LT2
ugcuuuaaaugccuguuua

SEQ ID NO: 1844210 - RNA, 14 nt, Salmonella typhimurium LT2
ugcuuucgccagcc

SEQ ID NO: 1844211 - RNA, 22 nt, Salmonella typhimurium LT2
ugcuuugaucacccacaccaca

SEQ ID NO: 1844212 - RNA, 20 nt, Salmonella typhimurium LT2
ugcuuuuuauuuuucuggcu

SEQ ID NO: 1844213 - RNA, 22 nt, Salmonella typhimurium LT2
uggaaaacagcauaauaaagca

SEQ ID NO: 1844214 - RNA, 22 nt, Salmonella typhimurium LT2
uggaaaacuuuaccgucagcca

SEQ ID NO: 1844215 - RNA, 19 nt, Salmonella typhimurium LT2
uggaaaaucagcgacuggu

SEQ ID NO: 1844216 - RNA, 17 nt, Salmonella typhimurium LT2
uggaaacuccagcggca

SEQ ID NO: 1844217 - RNA, 16 nt, Salmonella typhimurium LT2
uggaaacuaugcaaaa

SEQ ID NO: 1844218 - RNA, 18 nt, Salmonella typhimurium LT2
uggaaauagaauuauaua

SEQ ID NO: 1844219 - RNA, 18 nt, Salmonella typhimurium LT2
uggaaauguucucagcca

SEQ ID NO: 1844220 - RNA, 15 nt, Salmonella typhimurium LT2
uggaaccgccggaga

SEQ ID NO: 1844221 - RNA, 15 nt, Salmonella typhimurium LT2
uggaagagaauuuuu

SEQ ID NO: 1844222 - RNA, 15 nt, Salmonella typhimurium LT2
uggaaggaaggccgc

SEQ ID NO: 1844223 - RNA, 15 nt, Salmonella typhimurium LT2
uggaagcggaacuga

SEQ ID NO: 1844224 - RNA, 19 nt, Salmonella typhimurium LT2
uggaccagaacaucaucuu

SEQ ID NO: 1844225 - RNA, 19 nt, Salmonella typhimurium LT2
uggacaaguaaaccgguca

SEQ ID NO: 1844226 - RNA, 16 nt, Salmonella typhimurium LT2
uggaaucauccaccag

SEQ ID NO: 1844227 - RNA, 22 nt, Salmonella typhimurium LT2
uggaaguacgccucgcgcacca

SEQ ID NO: 1844228 - RNA, 13 nt, Salmonella typhimurium LT2
uggaauucuucau

SEQ ID NO: 1844229 - RNA, 24 nt, Salmonella typhimurium LT2
uggaauuugucgucaugcgccagg

SEQ ID NO: 1844230 - RNA, 18 nt, Salmonella typhimurium LT2
ugcgucugaauggacucg

SEQ ID NO: 1844231 - RNA, 17 nt, Salmonella typhimurium LT2
ugcgugacaaucuccuc

SEQ ID NO: 1844232 - RNA, 18 nt, Salmonella typhimurium LT2
ugcgucagauaaaaugag

SEQ ID NO: 1844233 - RNA, 14 nt, Salmonella typhimurium LT2
ugcgucauggugua

SEQ ID NO: 1844234 - RNA, 21 nt, Salmonella typhimurium LT2
ugcguggcgccugcggcaggc

SEQ ID NO: 1844235 - RNA, 15 nt, Salmonella typhimurium LT2
ugcguugcuauggca

SEQ ID NO: 1844236 - RNA, 18 nt, Salmonella typhimurium LT2
ugcgggaacagauaaaug

SEQ ID NO: 1844237 - RNA, 23 nt, Salmonella typhimurium LT2
ugcgggaaauaccauccgcgccg

SEQ ID NO: 1844238 - RNA, 22 nt, Salmonella typhimurium LT2
ugcguaaagaucugcgccgccg

SEQ ID NO: 1844239 - RNA, 16 nt, Salmonella typhimurium LT2
ugcgcugucaccagca

SEQ ID NO: 1844240 - RNA, 18 nt, Salmonella typhimurium LT2
ugcgcuuuggcugccagu

SEQ ID NO: 1844241 - RNA, 20 nt, Salmonella typhimurium LT2
ugcggaauaugagcacagcc

SEQ ID NO: 1844242 - RNA, 20 nt, Salmonella typhimurium LT2
ugcggaauuaaacgccgccu

SEQ ID NO: 1844243 - RNA, 16 nt, Salmonella typhimurium LT2
ugcgcuuuuccaggcg

SEQ ID NO: 1844244 - RNA, 22 nt, Salmonella typhimurium LT2
ugcgcuuuagcguaggccacaa

SEQ ID NO: 1844245 - RNA, 14 nt, Salmonella typhimurium LT2
ugcggcguggcgca

SEQ ID NO: 1844246 - RNA, 15 nt, Salmonella typhimurium LT2
ugcggcuuucaucau

SEQ ID NO: 1844247 - RNA, 16 nt, Salmonella typhimurium LT2
ugcggcguacugcaac

SEQ ID NO: 1844248 - RNA, 22 nt, Salmonella typhimurium LT2
ugcggcgaggaguaguuaaaaa

SEQ ID NO: 1844249 - RNA, 14 nt, Salmonella typhimurium LT2
ugcggcgcagggcg

SEQ ID NO: 1844250 - RNA, 15 nt, Salmonella typhimurium LT2
ugcggcgccaucaau

SEQ ID NO: 1844251 - RNA, 13 nt, Salmonella typhimurium LT2
ugcggcaucagau

SEQ ID NO: 1844252 - RNA, 19 nt, Salmonella typhimurium LT2
ugcggcacacagccaaaau

SEQ ID NO: 1844253 - RNA, 14 nt, Salmonella typhimurium LT2
ugcuacgccugccu

SEQ ID NO: 1844254 - RNA, 14 nt, Salmonella typhimurium LT2
ugcuaucccaggcg

SEQ ID NO: 1844255 - RNA, 15 nt, Salmonella typhimurium LT2
ugcuauccgccgcca

SEQ ID NO: 1844256 - RNA, 17 nt, Salmonella typhimurium LT2
ugcuaucuuugcugccg

SEQ ID NO: 1844257 - RNA, 21 nt, Salmonella typhimurium LT2
ugcuauaaauaaggccugagc

SEQ ID NO: 1844258 - RNA, 19 nt, Salmonella typhimurium LT2
ugcuaguggauaaacauua

SEQ ID NO: 1844259 - RNA, 14 nt, Salmonella typhimurium LT2
ugcuauaccgcuuu

SEQ ID NO: 1844260 - RNA, 22 nt, Salmonella typhimurium LT2
ugcucaacccgaccuacaaauu

SEQ ID NO: 1844261 - RNA, 22 nt, Salmonella typhimurium LT2
ugcucauaacccuccugccuuu

SEQ ID NO: 1844262 - RNA, 19 nt, Salmonella typhimurium LT2
ugcucauaagacgcauuaa

SEQ ID NO: 1844263 - RNA, 20 nt, Salmonella typhimurium LT2
ugcucauaagacgcauuaac

SEQ ID NO: 1844264 - RNA, 17 nt, Salmonella typhimurium LT2
ugcucaggcugaccguc

SEQ ID NO: 1844265 - RNA, 21 nt, Salmonella typhimurium LT2
ugcucagggcauccgccgccg

SEQ ID NO: 1844266 - RNA, 19 nt, Salmonella typhimurium LT2
ugcucagcuuguagaaagg

SEQ ID NO: 1844267 - RNA, 14 nt, Salmonella typhimurium LT2
ugcucaacucugug

SEQ ID NO: 1844268 - RNA, 12 nt, Salmonella typhimurium LT2
ugcucagccccu

SEQ ID NO: 1844269 - RNA, 13 nt, Salmonella typhimurium LT2
ugcuccguccugu

SEQ ID NO: 1844270 - RNA, 12 nt, Salmonella typhimurium LT2
ugcuccgggccg

SEQ ID NO: 1844271 - RNA, 13 nt, Salmonella typhimurium LT2
ugcuccgggccgu

SEQ ID NO: 1844272 - RNA, 17 nt, Salmonella typhimurium LT2
ugcucccuuaaaaggga

SEQ ID NO: 1844273 - RNA, 14 nt, Salmonella typhimurium LT2
ugcucgacaauaaa

SEQ ID NO: 1844274 - RNA, 12 nt, Salmonella typhimurium LT2
ugcuccaugauc

SEQ ID NO: 1844275 - RNA, 16 nt, Salmonella typhimurium LT2
ugcuccaguuguucca

SEQ ID NO: 1844276 - RNA, 20 nt, Salmonella typhimurium LT2
ugcuccagcccgaaaggaca

SEQ ID NO: 1844277 - RNA, 13 nt, Salmonella typhimurium LT2
ugcgccagauuca

SEQ ID NO: 1844278 - RNA, 14 nt, Salmonella typhimurium LT2
ugcgccagcaccau

SEQ ID NO: 1844279 - RNA, 20 nt, Salmonella typhimurium LT2
ugcgccagauaaccaaucac

SEQ ID NO: 1844280 - RNA, 14 nt, Salmonella typhimurium LT2
ugcgccacaucauu

SEQ ID NO: 1844281 - RNA, 15 nt, Salmonella typhimurium LT2
ugcgccaccaucggg

SEQ ID NO: 1844282 - RNA, 11 nt, Salmonella typhimurium LT2
ugcgccacgac

SEQ ID NO: 1844283 - RNA, 22 nt, Salmonella typhimurium LT2
ugcgaucgggauuccagugaca

SEQ ID NO: 1844284 - RNA, 14 nt, Salmonella typhimurium LT2
ugcgcaauguucau

SEQ ID NO: 1844285 - RNA, 23 nt, Salmonella typhimurium LT2
ugcgccauugccguaucagcaag

SEQ ID NO: 1844286 - RNA, 15 nt, Salmonella typhimurium LT2
ugcgccaucgggccg

SEQ ID NO: 1844287 - RNA, 15 nt, Salmonella typhimurium LT2
ugcgccagcgcgcgu

SEQ ID NO: 1844288 - RNA, 13 nt, Salmonella typhimurium LT2
ugcgccagccgcu

SEQ ID NO: 1844289 - RNA, 23 nt, Salmonella typhimurium LT2
ugcgccagccagucgccaggcaa

SEQ ID NO: 1844290 - RNA, 20 nt, Salmonella typhimurium LT2
ugcgccagccagcucaccag

SEQ ID NO: 1844291 - RNA, 22 nt, Salmonella typhimurium LT2
ugcgccgccgggaucagcggcu

SEQ ID NO: 1844292 - RNA, 21 nt, Salmonella typhimurium LT2
ugcgccgcuugugccgacguc

SEQ ID NO: 1844293 - RNA, 18 nt, Salmonella typhimurium LT2
ugcgccgcgaacaucggu

SEQ ID NO: 1844294 - RNA, 17 nt, Salmonella typhimurium LT2
ugcgccgcgagugcagg

SEQ ID NO: 1844295 - RNA, 19 nt, Salmonella typhimurium LT2
ugcgccgaauucguuaccc

SEQ ID NO: 1844296 - RNA, 22 nt, Salmonella typhimurium LT2
ugcgaaagaauuacugaauacc

SEQ ID NO: 1844297 - RNA, 18 nt, Salmonella typhimurium LT2
ugcgaaaauacucccggc

SEQ ID NO: 1844298 - RNA, 16 nt, Salmonella typhimurium LT2
ugcgaaacaggcggca

SEQ ID NO: 1844299 - RNA, 18 nt, Salmonella typhimurium LT2
ugccuuuuugcagcgcgg

SEQ ID NO: 1844300 - RNA, 19 nt, Salmonella typhimurium LT2
ugccuuuuucccacugcgc

SEQ ID NO: 1844301 - RNA, 15 nt, Salmonella typhimurium LT2
ugcgaauaaacacau

SEQ ID NO: 1844302 - RNA, 18 nt, Salmonella typhimurium LT2
ugcgacaacucgacuuuu

SEQ ID NO: 1844303 - RNA, 19 nt, Salmonella typhimurium LT2
ugcgacacgcugcauauaa

SEQ ID NO: 1844304 - RNA, 12 nt, Salmonella typhimurium LT2
ugcgacagauac

SEQ ID NO: 1844305 - RNA, 16 nt, Salmonella typhimurium LT2
ugcgauagcccggcau

SEQ ID NO: 1844306 - RNA, 17 nt, Salmonella typhimurium LT2
ugcgagcuuuccaccag

SEQ ID NO: 1844307 - RNA, 17 nt, Salmonella typhimurium LT2
ugcgaguagcaaauccc

SEQ ID NO: 1844308 - RNA, 17 nt, Salmonella typhimurium LT2
ugcgauaaccguauugc

SEQ ID NO: 1844309 - RNA, 23 nt, Salmonella typhimurium LT2
ugccggguucguuaacccggcau

SEQ ID NO: 1844310 - RNA, 13 nt, Salmonella typhimurium LT2
ugccggucggcgu

SEQ ID NO: 1844311 - RNA, 18 nt, Salmonella typhimurium LT2
ugccggugcgagaaaaag

SEQ ID NO: 1844312 - RNA, 21 nt, Salmonella typhimurium LT2
ugccgucggcaauuaacauuu

SEQ ID NO: 1844313 - RNA, 19 nt, Salmonella typhimurium LT2
ugccgucgcggcuuucagc

SEQ ID NO: 1844314 - RNA, 22 nt, Salmonella typhimurium LT2
ugccguacgcggcuugccaagc

SEQ ID NO: 1844315 - RNA, 22 nt, Salmonella typhimurium LT2
ugccguaaauugaguggacauc

SEQ ID NO: 1844316 - RNA, 15 nt, Salmonella typhimurium LT2
ugccgguuggccggc

SEQ ID NO: 1844317 - RNA, 17 nt, Salmonella typhimurium LT2
ugccagacgggccaggc

SEQ ID NO: 1844318 - RNA, 14 nt, Salmonella typhimurium LT2
ugccagaagagaau

SEQ ID NO: 1844319 - RNA, 13 nt, Salmonella typhimurium LT2
ugccagaaacauc

SEQ ID NO: 1844320 - RNA, 17 nt, Salmonella typhimurium LT2
ugccacgagccuucugg

SEQ ID NO: 1844321 - RNA, 22 nt, Salmonella typhimurium LT2
ugccagaggaaauccuuccagc

SEQ ID NO: 1844322 - RNA, 18 nt, Salmonella typhimurium LT2
ugccuucucugucgagca

SEQ ID NO: 1844323 - RNA, 15 nt, Salmonella typhimurium LT2
ugccugauggcgcga

SEQ ID NO: 1844324 - RNA, 18 nt, Salmonella typhimurium LT2
ugccugccggauuuuuca

SEQ ID NO: 1844325 - RNA, 18 nt, Salmonella typhimurium LT2
ugccucuggccaguuuca

SEQ ID NO: 1844326 - RNA, 14 nt, Salmonella typhimurium LT2
ugccucgaaaauau

SEQ ID NO: 1844327 - RNA, 22 nt, Salmonella typhimurium LT2
uguaaagaaugaaaaaaaauua

SEQ ID NO: 1844328 - RNA, 21 nt, Salmonella typhimurium LT2
uguaaacccgauucugccagu

SEQ ID NO: 1844329 - RNA, 22 nt, Salmonella typhimurium LT2
ugguuuuaagcuucuuauuauc

SEQ ID NO: 1844330 - RNA, 18 nt, Salmonella typhimurium LT2
uguaaaggugagcucuuu

SEQ ID NO: 1844331 - RNA, 22 nt, Salmonella typhimurium LT2
uguaaauaacgccagaucucac

SEQ ID NO: 1844332 - RNA, 10 nt, Salmonella typhimurium LT2
uguaaaucug

SEQ ID NO: 1844333 - RNA, 23 nt, Salmonella typhimurium LT2
ugguugugccaguaaucccgguc

SEQ ID NO: 1844334 - RNA, 16 nt, Salmonella typhimurium LT2
ugguugcuucguccag

SEQ ID NO: 1844335 - RNA, 21 nt, Salmonella typhimurium LT2
ugguugccgcaaaugaccaga

SEQ ID NO: 1844336 - RNA, 17 nt, Salmonella typhimurium LT2
uguacauaacaucucac

SEQ ID NO: 1844337 - RNA, 21 nt, Salmonella typhimurium LT2
uguaauucucccaaauuuuuu

SEQ ID NO: 1844338 - RNA, 18 nt, Salmonella typhimurium LT2
uguaauucaccaaauccu

SEQ ID NO: 1844339 - RNA, 15 nt, Salmonella typhimurium LT2
uguacgcugaacaac

SEQ ID NO: 1844340 - RNA, 22 nt, Salmonella typhimurium LT2
uguacggcgucagccacgguuc

SEQ ID NO: 1844341 - RNA, 20 nt, Salmonella typhimurium LT2
uguacuaccugaugaacagg

SEQ ID NO: 1844342 - RNA, 21 nt, Salmonella typhimurium LT2
uguaagggaggugcucuccca

SEQ ID NO: 1844343 - RNA, 22 nt, Salmonella typhimurium LT2
uguaagggaggugcucucccag

SEQ ID NO: 1844344 - RNA, 21 nt, Salmonella typhimurium LT2
uguaaggggcauaaaaaagcc

SEQ ID NO: 1844345 - RNA, 17 nt, Salmonella typhimurium LT2
uguaagcaauuacggac

SEQ ID NO: 1844346 - RNA, 17 nt, Salmonella typhimurium LT2
uguaaugcuugcugcuu

SEQ ID NO: 1844347 - RNA, 17 nt, Salmonella typhimurium LT2
uguaauaauuuaaaauu

SEQ ID NO: 1844348 - RNA, 16 nt, Salmonella typhimurium LT2
uguaauaauuaacaga

SEQ ID NO: 1844349 - RNA, 20 nt, Salmonella typhimurium LT2
uguaaguuacuaaaaguaaa

SEQ ID NO: 1844350 - RNA, 16 nt, Salmonella typhimurium LT2
ugguuauccagcagcc

SEQ ID NO: 1844351 - RNA, 18 nt, Salmonella typhimurium LT2
ugguucaacaucagcgcu

SEQ ID NO: 1844352 - RNA, 18 nt, Salmonella typhimurium LT2
ugguuagaauaccugccu

SEQ ID NO: 1844353 - RNA, 16 nt, Salmonella typhimurium LT2
ugguguuaguuucuau

SEQ ID NO: 1844354 - RNA, 22 nt, Salmonella typhimurium LT2
ugguuaaauucauauuuaaaua

SEQ ID NO: 1844355 - RNA, 15 nt, Salmonella typhimurium LT2
ugguuaaugaccugc

SEQ ID NO: 1844356 - RNA, 14 nt, Salmonella typhimurium LT2
ugguuaauucaaaa

SEQ ID NO: 1844357 - RNA, 15 nt, Salmonella typhimurium LT2
uggugugaacaucac

SEQ ID NO: 1844358 - RNA, 16 nt, Salmonella typhimurium LT2
ugguggcgaauacugu

SEQ ID NO: 1844359 - RNA, 21 nt, Salmonella typhimurium LT2
uggugggacuguucagcugac

SEQ ID NO: 1844360 - RNA, 13 nt, Salmonella typhimurium LT2
uggugauucaaau

SEQ ID NO: 1844361 - RNA, 23 nt, Salmonella typhimurium LT2
uggugaucuggccaauuuuucac

SEQ ID NO: 1844362 - RNA, 17 nt, Salmonella typhimurium LT2
uggugauauaaacgggc

SEQ ID NO: 1844363 - RNA, 20 nt, Salmonella typhimurium LT2
uggugacugucgagaugcgu

SEQ ID NO: 1844364 - RNA, 20 nt, Salmonella typhimurium LT2
uggguauuuuuuagcgccaa

SEQ ID NO: 1844365 - RNA, 14 nt, Salmonella typhimurium LT2
uggguaguccgggc

SEQ ID NO: 1844366 - RNA, 21 nt, Salmonella typhimurium LT2
uggucguuagccagauggcug

SEQ ID NO: 1844367 - RNA, 11 nt, Salmonella typhimurium LT2
ugucacaaacg

SEQ ID NO: 1844368 - RNA, 16 nt, Salmonella typhimurium LT2
ugucacaaacggcaca

SEQ ID NO: 1844369 - RNA, 23 nt, Salmonella typhimurium LT2
uguauuuucuaucuuuuuaagau

SEQ ID NO: 1844370 - RNA, 17 nt, Salmonella typhimurium LT2
uguauuguaauaacgaa

SEQ ID NO: 1844371 - RNA, 15 nt, Salmonella typhimurium LT2
uguauugcauuuuau

SEQ ID NO: 1844372 - RNA, 16 nt, Salmonella typhimurium LT2
uguagcaacagacuau

SEQ ID NO: 1844373 - RNA, 20 nt, Salmonella typhimurium LT2
uguaucgcgcggauuccgcc

SEQ ID NO: 1844374 - RNA, 16 nt, Salmonella typhimurium LT2
uguauccaccaccugg

SEQ ID NO: 1844375 - RNA, 23 nt, Salmonella typhimurium LT2
uguaucugguggaaaagaaaaca

SEQ ID NO: 1844376 - RNA, 13 nt, Salmonella typhimurium LT2
uguaucuugcuuu

SEQ ID NO: 1844377 - RNA, 14 nt, Salmonella typhimurium LT2
uguaugacaaauaa

SEQ ID NO: 1844378 - RNA, 21 nt, Salmonella typhimurium LT2
ugucccuucaugacuuuuuuc

SEQ ID NO: 1844379 - RNA, 18 nt, Salmonella typhimurium LT2
uguccauugcgagaaaaa

SEQ ID NO: 1844380 - RNA, 17 nt, Salmonella typhimurium LT2
uguccauguaaacucca

SEQ ID NO: 1844381 - RNA, 12 nt, Salmonella typhimurium LT2
ugucaggaugaa

SEQ ID NO: 1844382 - RNA, 16 nt, Salmonella typhimurium LT2
ugucaggcaaaaauaa

SEQ ID NO: 1844383 - RNA, 20 nt, Salmonella typhimurium LT2
uguccgccuuaucaggccug

SEQ ID NO: 1844384 - RNA, 18 nt, Salmonella typhimurium LT2
uguccguuuuuucugucg

SEQ ID NO: 1844385 - RNA, 15 nt, Salmonella typhimurium LT2
uguccgucagcgcau

SEQ ID NO: 1844386 - RNA, 15 nt, Salmonella typhimurium LT2
ugucgauaaacucau

SEQ ID NO: 1844387 - RNA, 21 nt, Salmonella typhimurium LT2
ugucgagcaucuccagcgcau

SEQ ID NO: 1844388 - RNA, 18 nt, Salmonella typhimurium LT2
ugucgcaauaaacgggca

SEQ ID NO: 1844389 - RNA, 18 nt, Salmonella typhimurium LT2
ugucgcuggauagcacca

SEQ ID NO: 1844390 - RNA, 17 nt, Salmonella typhimurium LT2
ugucgacaauaaauugc

SEQ ID NO: 1844391 - RNA, 19 nt, Salmonella typhimurium LT2
ugucgaaauugccgcccgu

SEQ ID NO: 1844392 - RNA, 20 nt, Salmonella typhimurium LT2
ugucgaaacaacacacggcg

SEQ ID NO: 1844393 - RNA, 22 nt, Salmonella typhimurium LT2
uguccuuugcuacaccccuucu

SEQ ID NO: 1844394 - RNA, 15 nt, Salmonella typhimurium LT2
ugucgaaaccagcau

SEQ ID NO: 1844395 - RNA, 19 nt, Salmonella typhimurium LT2
uguccuguucguaaucacu

SEQ ID NO: 1844396 - RNA, 22 nt, Salmonella typhimurium LT2
ugucguuaaugcucuuaaaaug

SEQ ID NO: 1844397 - RNA, 15 nt, Salmonella typhimurium LT2
ugucgucgauuuucu

SEQ ID NO: 1844398 - RNA, 23 nt, Salmonella typhimurium LT2
ugucggacguaugcuuacagagc

SEQ ID NO: 1844399 - RNA, 13 nt, Salmonella typhimurium LT2
ugucucuccagua

SEQ ID NO: 1844400 - RNA, 18 nt, Salmonella typhimurium LT2
ugucuucgcacugcccuu

SEQ ID NO: 1844401 - RNA, 12 nt, Salmonella typhimurium LT2
ugucuuuuucuc

SEQ ID NO: 1844402 - RNA, 21 nt, Salmonella typhimurium LT2
ugugccagcucguuauuuccg

SEQ ID NO: 1844403 - RNA, 21 nt, Salmonella typhimurium LT2
ugugccaguaccgccgccggg

SEQ ID NO: 1844404 - RNA, 21 nt, Salmonella typhimurium LT2
ugugauccgcccccuccagua

SEQ ID NO: 1844405 - RNA, 22 nt, Salmonella typhimurium LT2
ugugaucgccgcgaggaaaauc

SEQ ID NO: 1844406 - RNA, 16 nt, Salmonella typhimurium LT2
uggguaaauaccaggc

SEQ ID NO: 1844407 - RNA, 12 nt, Salmonella typhimurium LT2
uggguaauuuuu

SEQ ID NO: 1844408 - RNA, 17 nt, Salmonella typhimurium LT2
ugggcuugcauugcuuu

SEQ ID NO: 1844409 - RNA, 19 nt, Salmonella typhimurium LT2
uggggaacagaagcgccga

SEQ ID NO: 1844410 - RNA, 17 nt, Salmonella typhimurium LT2
ugggccagcagcgcauc

SEQ ID NO: 1844411 - RNA, 13 nt, Salmonella typhimurium LT2
ugggccagcagcg

SEQ ID NO: 1844412 - RNA, 14 nt, Salmonella typhimurium LT2
ugggccucaauaua

SEQ ID NO: 1844413 - RNA, 18 nt, Salmonella typhimurium LT2
ugggccgguacuuucgcc

SEQ ID NO: 1844414 - RNA, 20 nt, Salmonella typhimurium LT2
uggcugaggccgcucgccau

SEQ ID NO: 1844415 - RNA, 18 nt, Salmonella typhimurium LT2
uggcucggcgucaucccg

SEQ ID NO: 1844416 - RNA, 19 nt, Salmonella typhimurium LT2
uggcucccgcagccacucc

SEQ ID NO: 1844417 - RNA, 14 nt, Salmonella typhimurium LT2
uggcugagaaaaau

SEQ ID NO: 1844418 - RNA, 17 nt, Salmonella typhimurium LT2
uggcugagaaaaauacg

SEQ ID NO: 1844419 - RNA, 16 nt, Salmonella typhimurium LT2
uggcugugcgugaccc

SEQ ID NO: 1844420 - RNA, 12 nt, Salmonella typhimurium LT2
ugggaaggaaaa

SEQ ID NO: 1844421 - RNA, 19 nt, Salmonella typhimurium LT2
ugggaagggcgaagggcca

SEQ ID NO: 1844422 - RNA, 21 nt, Salmonella typhimurium LT2
ugggaccaccgcgcuagugcc

SEQ ID NO: 1844423 - RNA, 22 nt, Salmonella typhimurium LT2
uggcgccaugcuuuccgggccu

SEQ ID NO: 1844424 - RNA, 17 nt, Salmonella typhimurium LT2
uggcgcgucacaacagc

SEQ ID NO: 1844425 - RNA, 22 nt, Salmonella typhimurium LT2
uggcgcguagguuggcugaggc

SEQ ID NO: 1844426 - RNA, 20 nt, Salmonella typhimurium LT2
uggcgcgucaaucagcgugg

SEQ ID NO: 1844427 - RNA, 13 nt, Salmonella typhimurium LT2
uggcguaaauauu

SEQ ID NO: 1844428 - RNA, 16 nt, Salmonella typhimurium LT2
uggcggcucagggcaa

SEQ ID NO: 1844429 - RNA, 20 nt, Salmonella typhimurium LT2
uggcgguucgccacaauaua

SEQ ID NO: 1844430 - RNA, 20 nt, Salmonella typhimurium LT2
uggcucaagauucaguucca

SEQ ID NO: 1844431 - RNA, 18 nt, Salmonella typhimurium LT2
uggcucagauugaacgcu

SEQ ID NO: 1844432 - RNA, 18 nt, Salmonella typhimurium LT2
uggcuaucccgaugcuca

SEQ ID NO: 1844433 - RNA, 15 nt, Salmonella typhimurium LT2
uggcuaaauaagguc

SEQ ID NO: 1844434 - RNA, 15 nt, Salmonella typhimurium LT2
uggcgucaaucaacu

SEQ ID NO: 1844435 - RNA, 17 nt, Salmonella typhimurium LT2
uggcguagauauucccc

SEQ ID NO: 1844436 - RNA, 17 nt, Salmonella typhimurium LT2
uggcguacgcauccgcg

SEQ ID NO: 1844437 - RNA, 21 nt, Salmonella typhimurium LT2
uggcgcagccgcuuuuuaauu

SEQ ID NO: 1844438 - RNA, 12 nt, Salmonella typhimurium LT2
uggcgccaauau

SEQ ID NO: 1844439 - RNA, 21 nt, Salmonella typhimurium LT2
uggcgaugcuaucgguagugu

SEQ ID NO: 1844440 - RNA, 16 nt, Salmonella typhimurium LT2
uggcgauuucggugac

SEQ ID NO: 1844441 - RNA, 14 nt, Salmonella typhimurium LT2
uggcgauuuccagc

SEQ ID NO: 1844442 - RNA, 18 nt, Salmonella typhimurium LT2
uggcgacggcaucggcau

SEQ ID NO: 1844443 - RNA, 19 nt, Salmonella typhimurium LT2
uggcgacgaucagcgccac

SEQ ID NO: 1844444 - RNA, 14 nt, Salmonella typhimurium LT2
uggcgaccgggucg

SEQ ID NO: 1844445 - RNA, 15 nt, Salmonella typhimurium LT2
uggcgaccgggucga

SEQ ID NO: 1844446 - RNA, 20 nt, Salmonella typhimurium LT2
uggcccugccggaaaaugcg

SEQ ID NO: 1844447 - RNA, 13 nt, Salmonella typhimurium LT2
uggacgcguucca

SEQ ID NO: 1844448 - RNA, 13 nt, Salmonella typhimurium LT2
uggacgucaugcc

SEQ ID NO: 1844449 - RNA, 21 nt, Salmonella typhimurium LT2
uggacguggguuucaauauag

SEQ ID NO: 1844450 - RNA, 16 nt, Salmonella typhimurium LT2
uggagacacuucagcc

SEQ ID NO: 1844451 - RNA, 16 nt, Salmonella typhimurium LT2
uggagacagaacagga

SEQ ID NO: 1844452 - RNA, 20 nt, Salmonella typhimurium LT2
uggagagcaucaucugccau

SEQ ID NO: 1844453 - RNA, 19 nt, Salmonella typhimurium LT2
uggagaggccaccagcgcc

SEQ ID NO: 1844454 - RNA, 15 nt, Salmonella typhimurium LT2
uggagaguauuuccu

SEQ ID NO: 1844455 - RNA, 14 nt, Salmonella typhimurium LT2
uggagcgagcuggu

SEQ ID NO: 1844456 - RNA, 16 nt, Salmonella typhimurium LT2
uggaggguaagaaagu

SEQ ID NO: 1844457 - RNA, 18 nt, Salmonella typhimurium LT2
uggaguagauguagcuga

SEQ ID NO: 1844458 - RNA, 13 nt, Salmonella typhimurium LT2
uggagguuguuuu

SEQ ID NO: 1844459 - RNA, 15 nt, Salmonella typhimurium LT2
uggagguuucuucau

SEQ ID NO: 1844460 - RNA, 15 nt, Salmonella typhimurium LT2
uggaggaacagcgcc

SEQ ID NO: 1844461 - RNA, 24 nt, Salmonella typhimurium LT2
uggagcugcccgucgcuacaggca

SEQ ID NO: 1844462 - RNA, 22 nt, Salmonella typhimurium LT2
uggauauaacauuuuuguaaua

SEQ ID NO: 1844463 - RNA, 14 nt, Salmonella typhimurium LT2
uggaucaggcgcuu

SEQ ID NO: 1844464 - RNA, 22 nt, Salmonella typhimurium LT2
uggaucaggcgcuugcgccgcc

SEQ ID NO: 1844465 - RNA, 13 nt, Salmonella typhimurium LT2
uggaugcguucaa

SEQ ID NO: 1844466 - RNA, 14 nt, Salmonella typhimurium LT2
uggaugaacucaau

SEQ ID NO: 1844467 - RNA, 23 nt, Salmonella typhimurium LT2
uggaugaacucaauccauuccga

SEQ ID NO: 1844468 - RNA, 21 nt, Salmonella typhimurium LT2
uggauagcaccauaaacggca

SEQ ID NO: 1844469 - RNA, 23 nt, Salmonella typhimurium LT2
uggaguuuaaacacucuccacca

SEQ ID NO: 1844470 - RNA, 17 nt, Salmonella typhimurium LT2
uggagucuaaaaauaau

SEQ ID NO: 1844471 - RNA, 18 nt, Salmonella typhimurium LT2
uggagucuaaaaauaauu

SEQ ID NO: 1844472 - RNA, 21 nt, Salmonella typhimurium LT2
uggcaaguaugaaaagcgcgu

SEQ ID NO: 1844473 - RNA, 17 nt, Salmonella typhimurium LT2
uggcaaggguaugaaua

SEQ ID NO: 1844474 - RNA, 17 nt, Salmonella typhimurium LT2
uggcaagauuaaccagc

SEQ ID NO: 1844475 - RNA, 13 nt, Salmonella typhimurium LT2
uggcaagaaucac

SEQ ID NO: 1844476 - RNA, 21 nt, Salmonella typhimurium LT2
uggcacuggcagccucguccu

SEQ ID NO: 1844477 - RNA, 12 nt, Salmonella typhimurium LT2
uggcaggccucu

SEQ ID NO: 1844478 - RNA, 16 nt, Salmonella typhimurium LT2
uggcagaccguggccg

SEQ ID NO: 1844479 - RNA, 17 nt, Salmonella typhimurium LT2
uggauuacaaaaauaga

SEQ ID NO: 1844480 - RNA, 14 nt, Salmonella typhimurium LT2
uggauuaaggccgg

SEQ ID NO: 1844481 - RNA, 22 nt, Salmonella typhimurium LT2
uggauuaaaaaaggcagaagaa

SEQ ID NO: 1844482 - RNA, 20 nt, Salmonella typhimurium LT2
uggcaaaacgcucaacgcgu

SEQ ID NO: 1844483 - RNA, 14 nt, Salmonella typhimurium LT2
uggcaaaagacauu

SEQ ID NO: 1844484 - RNA, 22 nt, Salmonella typhimurium LT2
uggcaaaaaaggccagacucau

SEQ ID NO: 1844485 - RNA, 21 nt, Salmonella typhimurium LT2
uggcaaaaaaggccagacuca

SEQ ID NO: 1844486 - RNA, 20 nt, Salmonella typhimurium LT2
uggauucaugaucuuuccuu

SEQ ID NO: 1844487 - RNA, 13 nt, Salmonella typhimurium LT2
uggcaucaagcau

SEQ ID NO: 1844488 - RNA, 22 nt, Salmonella typhimurium LT2
uggcauauuugccccuuccgcc

SEQ ID NO: 1844489 - RNA, 19 nt, Salmonella typhimurium LT2
uggcauaaccgcagcgcgg

SEQ ID NO: 1844490 - RNA, 17 nt, Salmonella typhimurium LT2
uggcauagccaguggaa

SEQ ID NO: 1844491 - RNA, 12 nt, Salmonella typhimurium LT2
uggccaccagcu

SEQ ID NO: 1844492 - RNA, 14 nt, Salmonella typhimurium LT2
uggccccugagcaa

SEQ ID NO: 1844493 - RNA, 23 nt, Salmonella typhimurium LT2
uggccccggucaacgcgccgcca

SEQ ID NO: 1844494 - RNA, 19 nt, Salmonella typhimurium LT2
uggcccauuuuggccgcuu

SEQ ID NO: 1844495 - RNA, 19 nt, Salmonella typhimurium LT2
uggcccaguuaacagaaug

SEQ ID NO: 1844496 - RNA, 17 nt, Salmonella typhimurium LT2
uggcccagcgcgguggc

SEQ ID NO: 1844497 - RNA, 19 nt, Salmonella typhimurium LT2
uggccauuugcggaauaug

SEQ ID NO: 1844498 - RNA, 23 nt, Salmonella typhimurium LT2
uuaagacgcuucauaucgcccag

SEQ ID NO: 1844499 - RNA, 19 nt, Salmonella typhimurium LT2
uuaagccgggucagccccc

SEQ ID NO: 1844500 - RNA, 22 nt, Salmonella typhimurium LT2
uuaagcggauuuuuucgcuuuu

SEQ ID NO: 1844501 - RNA, 18 nt, Salmonella typhimurium LT2
uuaagccuuuuuaaauau

SEQ ID NO: 1844502 - RNA, 22 nt, Salmonella typhimurium LT2
uuaagaagucugugaggaaagc

SEQ ID NO: 1844503 - RNA, 20 nt, Salmonella typhimurium LT2
uuaacguuuccccgcuauug

SEQ ID NO: 1844504 - RNA, 15 nt, Salmonella typhimurium LT2
ugugcuuccagcucc

SEQ ID NO: 1844505 - RNA, 17 nt, Salmonella typhimurium LT2
ugugcuuccagcuccau

SEQ ID NO: 1844506 - RNA, 18 nt, Salmonella typhimurium LT2
ugugcuuucgccaccagc

SEQ ID NO: 1844507 - RNA, 15 nt, Salmonella typhimurium LT2
uuaaccagcaguccu

SEQ ID NO: 1844508 - RNA, 15 nt, Salmonella typhimurium LT2
uguggagguuucuuc

SEQ ID NO: 1844509 - RNA, 17 nt, Salmonella typhimurium LT2
uuaacccuguggauuaa

SEQ ID NO: 1844510 - RNA, 19 nt, Salmonella typhimurium LT2
uuaaccugagaauauuaac

SEQ ID NO: 1844511 - RNA, 19 nt, Salmonella typhimurium LT2
uuaacguccauaccgguug

SEQ ID NO: 1844512 - RNA, 13 nt, Salmonella typhimurium LT2
uuaaucacccgcg

SEQ ID NO: 1844513 - RNA, 20 nt, Salmonella typhimurium LT2
uuaauccgcggauagacgau

SEQ ID NO: 1844514 - RNA, 11 nt, Salmonella typhimurium LT2
uuaaucaaaau

SEQ ID NO: 1844515 - RNA, 16 nt, Salmonella typhimurium LT2
uuaaucgagccuuuca

SEQ ID NO: 1844516 - RNA, 14 nt, Salmonella typhimurium LT2
uuaauauuuuauca

SEQ ID NO: 1844517 - RNA, 20 nt, Salmonella typhimurium LT2
uuaaguuugccgacauccuu

SEQ ID NO: 1844518 - RNA, 14 nt, Salmonella typhimurium LT2
uuaauacgcugucg

SEQ ID NO: 1844519 - RNA, 13 nt, Salmonella typhimurium LT2
uuaauaacccagg

SEQ ID NO: 1844520 - RNA, 21 nt, Salmonella typhimurium LT2
uuaauaaccaauuaaauuauu

SEQ ID NO: 1844521 - RNA, 21 nt, Salmonella typhimurium LT2
uuaauuccgcaucauucaucu

SEQ ID NO: 1844522 - RNA, 21 nt, Salmonella typhimurium LT2
uuaauuccucagaauccguca

SEQ ID NO: 1844523 - RNA, 17 nt, Salmonella typhimurium LT2
uuaauucgucagcggcu

SEQ ID NO: 1844524 - RNA, 23 nt, Salmonella typhimurium LT2
uuaauuauuaauccaaugacagu

SEQ ID NO: 1844525 - RNA, 11 nt, Salmonella typhimurium LT2
uuaauuauucc

SEQ ID NO: 1844526 - RNA, 14 nt, Salmonella typhimurium LT2
uuaauuauacuguc

SEQ ID NO: 1844527 - RNA, 13 nt, Salmonella typhimurium LT2
uuaauuaaauguu

SEQ ID NO: 1844528 - RNA, 19 nt, Salmonella typhimurium LT2
uuaauuaaauguuugcuuu

SEQ ID NO: 1844529 - RNA, 12 nt, Salmonella typhimurium LT2
uuaauuaaauuu

SEQ ID NO: 1844530 - RNA, 22 nt, Salmonella typhimurium LT2
uuaaucucacaaauaucacaaa

SEQ ID NO: 1844531 - RNA, 19 nt, Salmonella typhimurium LT2
uuaaugccguuauacaucg

SEQ ID NO: 1844532 - RNA, 19 nt, Salmonella typhimurium LT2
uuaaugccgcaaugucccu

SEQ ID NO: 1844533 - RNA, 15 nt, Salmonella typhimurium LT2
uuaaugcucugcugu

SEQ ID NO: 1844534 - RNA, 21 nt, Salmonella typhimurium LT2
uuaaugcgccccugcaggcga

SEQ ID NO: 1844535 - RNA, 18 nt, Salmonella typhimurium LT2
uuaaugcgcacgccagcg

SEQ ID NO: 1844536 - RNA, 15 nt, Salmonella typhimurium LT2
uuaauggucagaucu

SEQ ID NO: 1844537 - RNA, 16 nt, Salmonella typhimurium LT2
uuaauggucagaucug

SEQ ID NO: 1844538 - RNA, 15 nt, Salmonella typhimurium LT2
uuaauggcuuucacc

SEQ ID NO: 1844539 - RNA, 19 nt, Salmonella typhimurium LT2
uuaaugccuucgccgccgc

SEQ ID NO: 1844540 - RNA, 18 nt, Salmonella typhimurium LT2
uuaauuugcaucaggcca

SEQ ID NO: 1844541 - RNA, 15 nt, Salmonella typhimurium LT2
uuaauuugugccagc

SEQ ID NO: 1844542 - RNA, 15 nt, Salmonella typhimurium LT2
uuaauuucuuuccaa

SEQ ID NO: 1844543 - RNA, 14 nt, Salmonella typhimurium LT2
uuacagcucauaaa

SEQ ID NO: 1844544 - RNA, 14 nt, Salmonella typhimurium LT2
uuacagcauacgcc

SEQ ID NO: 1844545 - RNA, 12 nt, Salmonella typhimurium LT2
uuaccaaaucaa

SEQ ID NO: 1844546 - RNA, 21 nt, Salmonella typhimurium LT2
uuaccaaacagccguaccugc

SEQ ID NO: 1844547 - RNA, 13 nt, Salmonella typhimurium LT2
uuacccccuucgu

SEQ ID NO: 1844548 - RNA, 16 nt, Salmonella typhimurium LT2
uuacaggcuccaggua

SEQ ID NO: 1844549 - RNA, 22 nt, Salmonella typhimurium LT2
uuacaggcauccgugaccugcu

SEQ ID NO: 1844550 - RNA, 21 nt, Salmonella typhimurium LT2
uuacaucggcguguuucauuu

SEQ ID NO: 1844551 - RNA, 15 nt, Salmonella typhimurium LT2
uuacaugcugaagca

SEQ ID NO: 1844552 - RNA, 22 nt, Salmonella typhimurium LT2
uuaguaccgaacagccaggcuu

SEQ ID NO: 1844553 - RNA, 13 nt, Salmonella typhimurium LT2
uuauaaaauaacg

SEQ ID NO: 1844554 - RNA, 23 nt, Salmonella typhimurium LT2
uuauaaaacuucgauaauaaaau

SEQ ID NO: 1844555 - RNA, 21 nt, Salmonella typhimurium LT2
uuaguuacgcacgccagauaa

SEQ ID NO: 1844556 - RNA, 17 nt, Salmonella typhimurium LT2
uuagucugccauuuccu

SEQ ID NO: 1844557 - RNA, 15 nt, Salmonella typhimurium LT2
uuagugcucagcuug

SEQ ID NO: 1844558 - RNA, 23 nt, Salmonella typhimurium LT2
uuauaaauaagaauccagucagg

SEQ ID NO: 1844559 - RNA, 19 nt, Salmonella typhimurium LT2
uuauaaaucaggaaaaagg

SEQ ID NO: 1844560 - RNA, 22 nt, Salmonella typhimurium LT2
uuauaaaauauuuaacuuaaau

SEQ ID NO: 1844561 - RNA, 15 nt, Salmonella typhimurium LT2
uuauaacguaucguu

SEQ ID NO: 1844562 - RNA, 22 nt, Salmonella typhimurium LT2
uuauaacuaaacucaucuuuau

SEQ ID NO: 1844563 - RNA, 20 nt, Salmonella typhimurium LT2
uuauaagguugccugccaga

SEQ ID NO: 1844564 - RNA, 23 nt, Salmonella typhimurium LT2
uuauacauccugugaaguaaaaa

SEQ ID NO: 1844565 - RNA, 15 nt, Salmonella typhimurium LT2
uuauacaucgcuuuc

SEQ ID NO: 1844566 - RNA, 16 nt, Salmonella typhimurium LT2
uuauacuugcugcuau

SEQ ID NO: 1844567 - RNA, 19 nt, Salmonella typhimurium LT2
uuacguuaaguucaaggau

SEQ ID NO: 1844568 - RNA, 19 nt, Salmonella typhimurium LT2
uuaccgcccuguccuccau

SEQ ID NO: 1844569 - RNA, 18 nt, Salmonella typhimurium LT2
uuacccggccuacacauc

SEQ ID NO: 1844570 - RNA, 19 nt, Salmonella typhimurium LT2
uuacccggccuacacauca

SEQ ID NO: 1844571 - RNA, 15 nt, Salmonella typhimurium LT2
uuacguuugcagcgg

SEQ ID NO: 1844572 - RNA, 13 nt, Salmonella typhimurium LT2
uuacuauuuuuca

SEQ ID NO: 1844573 - RNA, 14 nt, Salmonella typhimurium LT2
uuacuauuuuucac

SEQ ID NO: 1844574 - RNA, 15 nt, Salmonella typhimurium LT2
uuacuuucauuccuu

SEQ ID NO: 1844575 - RNA, 18 nt, Salmonella typhimurium LT2
uuacuuucaaaauacugg

SEQ ID NO: 1844576 - RNA, 17 nt, Salmonella typhimurium LT2
uuacuccgcuauaaaaa

SEQ ID NO: 1844577 - RNA, 18 nt, Salmonella typhimurium LT2
uuacugcucguagcguuu

SEQ ID NO: 1844578 - RNA, 20 nt, Salmonella typhimurium LT2
uuacuggcuaguauauuaaa

SEQ ID NO: 1844579 - RNA, 15 nt, Salmonella typhimurium LT2
uuagcuuucugccag

SEQ ID NO: 1844580 - RNA, 20 nt, Salmonella typhimurium LT2
uuagggcguaaauauaacgc

SEQ ID NO: 1844581 - RNA, 14 nt, Salmonella typhimurium LT2
uuagccacgccguc

SEQ ID NO: 1844582 - RNA, 17 nt, Salmonella typhimurium LT2
uuagccccugacgcugc

SEQ ID NO: 1844583 - RNA, 23 nt, Salmonella typhimurium LT2
uuagaacgcggaaguauccugga

SEQ ID NO: 1844584 - RNA, 21 nt, Salmonella typhimurium LT2
uuagagcacaucacucauaau

SEQ ID NO: 1844585 - RNA, 19 nt, Salmonella typhimurium LT2
uuagcagccacacacuguu

SEQ ID NO: 1844586 - RNA, 14 nt, Salmonella typhimurium LT2
uuagcagcaauaau

SEQ ID NO: 1844587 - RNA, 19 nt, Salmonella typhimurium LT2
uucaacgcguugccugaaa

SEQ ID NO: 1844588 - RNA, 18 nt, Salmonella typhimurium LT2
uucaagaaucgaugguau

SEQ ID NO: 1844589 - RNA, 17 nt, Salmonella typhimurium LT2
uucaagcaguuccagca

SEQ ID NO: 1844590 - RNA, 14 nt, Salmonella typhimurium LT2
uucaagcaguucca

SEQ ID NO: 1844591 - RNA, 23 nt, Salmonella typhimurium LT2
uucaagccguuuuggcagcgccc

SEQ ID NO: 1844592 - RNA, 22 nt, Salmonella typhimurium LT2
uucaauaaauugaaauucuaug

SEQ ID NO: 1844593 - RNA, 17 nt, Salmonella typhimurium LT2
uucaaacggcuggaauc

SEQ ID NO: 1844594 - RNA, 18 nt, Salmonella typhimurium LT2
uucaaccucacuguugau

SEQ ID NO: 1844595 - RNA, 16 nt, Salmonella typhimurium LT2
uucaaccuccugcaau

SEQ ID NO: 1844596 - RNA, 15 nt, Salmonella typhimurium LT2
uucaaccguuucuuu

SEQ ID NO: 1844597 - RNA, 20 nt, Salmonella typhimurium LT2
uucaacgaaugccugcauau

SEQ ID NO: 1844598 - RNA, 20 nt, Salmonella typhimurium LT2
uucaaccugagauggcacaa

SEQ ID NO: 1844599 - RNA, 18 nt, Salmonella typhimurium LT2
uucaacauauuuuucaca

SEQ ID NO: 1844600 - RNA, 12 nt, Salmonella typhimurium LT2
uucaaaaugaca

SEQ ID NO: 1844601 - RNA, 13 nt, Salmonella typhimurium LT2
uucaaaaucaaac

SEQ ID NO: 1844602 - RNA, 18 nt, Salmonella typhimurium LT2
uuauuuuuucuuuaauua

SEQ ID NO: 1844603 - RNA, 16 nt, Salmonella typhimurium LT2
uuauuuuuuuaucgaa

SEQ ID NO: 1844604 - RNA, 11 nt, Salmonella typhimurium LT2
uucaaaaagag

SEQ ID NO: 1844605 - RNA, 18 nt, Salmonella typhimurium LT2
uuauuuggcguacuuagg

SEQ ID NO: 1844606 - RNA, 15 nt, Salmonella typhimurium LT2
uuauuuaacgccagu

SEQ ID NO: 1844607 - RNA, 14 nt, Salmonella typhimurium LT2
uuauuucugcccca

SEQ ID NO: 1844608 - RNA, 13 nt, Salmonella typhimurium LT2
uuauucucgcacu

SEQ ID NO: 1844609 - RNA, 15 nt, Salmonella typhimurium LT2
uuauugagauaauuu

SEQ ID NO: 1844610 - RNA, 15 nt, Salmonella typhimurium LT2
uuauugacgcuuucu

SEQ ID NO: 1844611 - RNA, 14 nt, Salmonella typhimurium LT2
uucacagaaggcua

SEQ ID NO: 1844612 - RNA, 16 nt, Salmonella typhimurium LT2
uucacacgaauuccuu

SEQ ID NO: 1844613 - RNA, 21 nt, Salmonella typhimurium LT2
uucacaccguuauccggcaaa

SEQ ID NO: 1844614 - RNA, 20 nt, Salmonella typhimurium LT2
uucacaccguuauccggcaa

SEQ ID NO: 1844615 - RNA, 17 nt, Salmonella typhimurium LT2
uucaaucaacaccagca

SEQ ID NO: 1844616 - RNA, 19 nt, Salmonella typhimurium LT2
uucaauagucgacagcccg

SEQ ID NO: 1844617 - RNA, 20 nt, Salmonella typhimurium LT2
uucaauauugaacauuuuuu

SEQ ID NO: 1844618 - RNA, 17 nt, Salmonella typhimurium LT2
uucaccuggaaaggcuu

SEQ ID NO: 1844619 - RNA, 20 nt, Salmonella typhimurium LT2
uucacgagcggucaggccag

SEQ ID NO: 1844620 - RNA, 24 nt, Salmonella typhimurium LT2
uucacguacccaaauaucaaauac

SEQ ID NO: 1844621 - RNA, 20 nt, Salmonella typhimurium LT2
uucaccguuuaaaaacauca

SEQ ID NO: 1844622 - RNA, 20 nt, Salmonella typhimurium LT2
uucacccagacugugauggc

SEQ ID NO: 1844623 - RNA, 20 nt, Salmonella typhimurium LT2
uucacccgcgugaacacacc

SEQ ID NO: 1844624 - RNA, 19 nt, Salmonella typhimurium LT2
uucaccccuucaucaguaa

SEQ ID NO: 1844625 - RNA, 15 nt, Salmonella typhimurium LT2
uucacccauugaacc

SEQ ID NO: 1844626 - RNA, 22 nt, Salmonella typhimurium LT2
uucagaccagaaccucacggag

SEQ ID NO: 1844627 - RNA, 19 nt, Salmonella typhimurium LT2
uucagaauacaaccucaaa

SEQ ID NO: 1844628 - RNA, 17 nt, Salmonella typhimurium LT2
uucagaauaugccaggg

SEQ ID NO: 1844629 - RNA, 23 nt, Salmonella typhimurium LT2
uucacuaaacuaaugccuggcag

SEQ ID NO: 1844630 - RNA, 14 nt, Salmonella typhimurium LT2
uucaggcaaaguug

SEQ ID NO: 1844631 - RNA, 20 nt, Salmonella typhimurium LT2
uucaggcaaaguuguuuuaa

SEQ ID NO: 1844632 - RNA, 23 nt, Salmonella typhimurium LT2
uucagcugcggcugaaccacccu

SEQ ID NO: 1844633 - RNA, 22 nt, Salmonella typhimurium LT2
uucaggacgagagacugauaau

SEQ ID NO: 1844634 - RNA, 13 nt, Salmonella typhimurium LT2
uucagccugaagc

SEQ ID NO: 1844635 - RNA, 19 nt, Salmonella typhimurium LT2
uucagccaggcggcaauau

SEQ ID NO: 1844636 - RNA, 19 nt, Salmonella typhimurium LT2
uucagccagaguuuuaaaa

SEQ ID NO: 1844637 - RNA, 14 nt, Salmonella typhimurium LT2
uucagcccaggcuu

SEQ ID NO: 1844638 - RNA, 16 nt, Salmonella typhimurium LT2
uucagcaucauaucaa

SEQ ID NO: 1844639 - RNA, 19 nt, Salmonella typhimurium LT2
uucagcauauccagcgccu

SEQ ID NO: 1844640 - RNA, 18 nt, Salmonella typhimurium LT2
uuaugggcauuucauuua

SEQ ID NO: 1844641 - RNA, 13 nt, Salmonella typhimurium LT2
uuauggguuugcu

SEQ ID NO: 1844642 - RNA, 13 nt, Salmonella typhimurium LT2
uuauguauuuaau

SEQ ID NO: 1844643 - RNA, 22 nt, Salmonella typhimurium LT2
uuaugccgaccaaugacgcuau

SEQ ID NO: 1844644 - RNA, 22 nt, Salmonella typhimurium LT2
uuaugcaguuccguugcaauau

SEQ ID NO: 1844645 - RNA, 13 nt, Salmonella typhimurium LT2
uuaugcaguuccg

SEQ ID NO: 1844646 - RNA, 21 nt, Salmonella typhimurium LT2
uuaugcacgccgggaauaauu

SEQ ID NO: 1844647 - RNA, 19 nt, Salmonella typhimurium LT2
uuaugcacaaccagcggca

SEQ ID NO: 1844648 - RNA, 17 nt, Salmonella typhimurium LT2
uuaugauuuuaacauca

SEQ ID NO: 1844649 - RNA, 19 nt, Salmonella typhimurium LT2
uuaugcguuuaauugaauu

SEQ ID NO: 1844650 - RNA, 19 nt, Salmonella typhimurium LT2
uuaugcucauugccuuuca

SEQ ID NO: 1844651 - RNA, 23 nt, Salmonella typhimurium LT2
uuauuaaaacucuccaugccauc

SEQ ID NO: 1844652 - RNA, 12 nt, Salmonella typhimurium LT2
uuauuaccaaug

SEQ ID NO: 1844653 - RNA, 13 nt, Salmonella typhimurium LT2
uuauuaacgugcu

SEQ ID NO: 1844654 - RNA, 12 nt, Salmonella typhimurium LT2
uuaucgcuauca

SEQ ID NO: 1844655 - RNA, 23 nt, Salmonella typhimurium LT2
uuaucggcgucgcggcaauagcg

SEQ ID NO: 1844656 - RNA, 14 nt, Salmonella typhimurium LT2
uuaucguccgucag

SEQ ID NO: 1844657 - RNA, 18 nt, Salmonella typhimurium LT2
uuaucugggucaggaacu

SEQ ID NO: 1844658 - RNA, 16 nt, Salmonella typhimurium LT2
uuaucuugacaugaaa

SEQ ID NO: 1844659 - RNA, 16 nt, Salmonella typhimurium LT2
uuaucuuuaaauuuca

SEQ ID NO: 1844660 - RNA, 12 nt, Salmonella typhimurium LT2
uuaucuuauaaa

SEQ ID NO: 1844661 - RNA, 22 nt, Salmonella typhimurium LT2
uuaucuuauaaauaagaaucca

SEQ ID NO: 1844662 - RNA, 17 nt, Salmonella typhimurium LT2
uuaucuuuuacgcuguc

SEQ ID NO: 1844663 - RNA, 16 nt, Salmonella typhimurium LT2
uuaucuuuuauuucau

SEQ ID NO: 1844664 - RNA, 14 nt, Salmonella typhimurium LT2
uuauaggucagguu

SEQ ID NO: 1844665 - RNA, 17 nt, Salmonella typhimurium LT2
uuauagcuggcuuuaua

SEQ ID NO: 1844666 - RNA, 19 nt, Salmonella typhimurium LT2
uuauaggugucagauccuu

SEQ ID NO: 1844667 - RNA, 19 nt, Salmonella typhimurium LT2
uuauagucuaauaacacaa

SEQ ID NO: 1844668 - RNA, 14 nt, Salmonella typhimurium LT2
uuauauaaaaauag

SEQ ID NO: 1844669 - RNA, 13 nt, Salmonella typhimurium LT2
uuauauaagcaua

SEQ ID NO: 1844670 - RNA, 14 nt, Salmonella typhimurium LT2
uuauauauguucaa

SEQ ID NO: 1844671 - RNA, 20 nt, Salmonella typhimurium LT2
uuauauauguucaauauuca

SEQ ID NO: 1844672 - RNA, 22 nt, Salmonella typhimurium LT2
uuauauauguucaauauucaau

SEQ ID NO: 1844673 - RNA, 17 nt, Salmonella typhimurium LT2
uuaucaaaccaguuuuu

SEQ ID NO: 1844674 - RNA, 14 nt, Salmonella typhimurium LT2
uuaucaaaaaccuu

SEQ ID NO: 1844675 - RNA, 19 nt, Salmonella typhimurium LT2
uuauccggccuacagcuga

SEQ ID NO: 1844676 - RNA, 14 nt, Salmonella typhimurium LT2
uuauccggccuaca

SEQ ID NO: 1844677 - RNA, 17 nt, Salmonella typhimurium LT2
uuauccugcaaauagcg

SEQ ID NO: 1844678 - RNA, 22 nt, Salmonella typhimurium LT2
uuaucgaaauagcggugaacuu

SEQ ID NO: 1844679 - RNA, 21 nt, Salmonella typhimurium LT2
uuauccucuccugaagccagc

SEQ ID NO: 1844680 - RNA, 13 nt, Salmonella typhimurium LT2
uuauccugcacga

SEQ ID NO: 1844681 - RNA, 20 nt, Salmonella typhimurium LT2
uuauccuggguuugaccgcc

SEQ ID NO: 1844682 - RNA, 20 nt, Salmonella typhimurium LT2
uuaucauuuuuucuaagaug

SEQ ID NO: 1844683 - RNA, 16 nt, Salmonella typhimurium LT2
uuauccagacugcuaa

SEQ ID NO: 1844684 - RNA, 17 nt, Salmonella typhimurium LT2
uuauccacaaacuccag

SEQ ID NO: 1844685 - RNA, 11 nt, Salmonella typhimurium LT2
uuauccagcag

SEQ ID NO: 1844686 - RNA, 11 nt, Salmonella typhimurium LT2
uuauccccuuc

SEQ ID NO: 1844687 - RNA, 15 nt, Salmonella typhimurium LT2
uuauccggcaaaaga

SEQ ID NO: 1844688 - RNA, 17 nt, Salmonella typhimurium LT2
uuauccgccagccaguc

SEQ ID NO: 1844689 - RNA, 14 nt, Salmonella typhimurium LT2
uuaucaugcugacu

SEQ ID NO: 1844690 - RNA, 16 nt, Salmonella typhimurium LT2
uuaucaucguaaaauc

SEQ ID NO: 1844691 - RNA, 17 nt, Salmonella typhimurium LT2
uuaucaggauaauuuca

SEQ ID NO: 1844692 - RNA, 19 nt, Salmonella typhimurium LT2
uuaucagaugugguauuuu

SEQ ID NO: 1844693 - RNA, 15 nt, Salmonella typhimurium LT2
uuaucagcaauaauu

SEQ ID NO: 1844694 - RNA, 20 nt, Salmonella typhimurium LT2
uuaucagcaauaauuuuacc

SEQ ID NO: 1844695 - RNA, 18 nt, Salmonella typhimurium LT2
uuaucaaugguuaauuaa

SEQ ID NO: 1844696 - RNA, 14 nt, Salmonella typhimurium LT2
uucuaugugcgcca

SEQ ID NO: 1844697 - RNA, 14 nt, Salmonella typhimurium LT2
uucucaaugaacag

SEQ ID NO: 1844698 - RNA, 21 nt, Salmonella typhimurium LT2
uucuacauuccaucauguuaa

SEQ ID NO: 1844699 - RNA, 16 nt, Salmonella typhimurium LT2
uucucacggucuccug

SEQ ID NO: 1844700 - RNA, 18 nt, Salmonella typhimurium LT2
uucucauccccccuguag

SEQ ID NO: 1844701 - RNA, 19 nt, Salmonella typhimurium LT2
uucucauccccccuguagg

SEQ ID NO: 1844702 - RNA, 15 nt, Salmonella typhimurium LT2
uucucgccgugacug

SEQ ID NO: 1844703 - RNA, 17 nt, Salmonella typhimurium LT2
uucucgcggcaguaagc

SEQ ID NO: 1844704 - RNA, 21 nt, Salmonella typhimurium LT2
uucucgcguggacgcuuuuau

SEQ ID NO: 1844705 - RNA, 15 nt, Salmonella typhimurium LT2
uucucgcgcagccag

SEQ ID NO: 1844706 - RNA, 17 nt, Salmonella typhimurium LT2
uucucggcuuuccagcu

SEQ ID NO: 1844707 - RNA, 17 nt, Salmonella typhimurium LT2
uucucgggccucgcgcu

SEQ ID NO: 1844708 - RNA, 15 nt, Salmonella typhimurium LT2
uucucuucuucaaug

SEQ ID NO: 1844709 - RNA, 12 nt, Salmonella typhimurium LT2
uucucuucuucu

SEQ ID NO: 1844710 - RNA, 19 nt, Salmonella typhimurium LT2
uucucuuaugccgcuuuug

SEQ ID NO: 1844711 - RNA, 14 nt, Salmonella typhimurium LT2
uucucuuccacaaa

SEQ ID NO: 1844712 - RNA, 14 nt, Salmonella typhimurium LT2
uucucuguugccgc

SEQ ID NO: 1844713 - RNA, 13 nt, Salmonella typhimurium LT2
uucugcaggccaa

SEQ ID NO: 1844714 - RNA, 16 nt, Salmonella typhimurium LT2
uucggagauauacauc

SEQ ID NO: 1844715 - RNA, 17 nt, Salmonella typhimurium LT2
uucggagauauacaucu

SEQ ID NO: 1844716 - RNA, 20 nt, Salmonella typhimurium LT2
uucgcuucuucuaccaccuu

SEQ ID NO: 1844717 - RNA, 17 nt, Salmonella typhimurium LT2
uucgcuugcggcugcca

SEQ ID NO: 1844718 - RNA, 13 nt, Salmonella typhimurium LT2
uucguagacucag

SEQ ID NO: 1844719 - RNA, 16 nt, Salmonella typhimurium LT2
uucguagacucaggcg

SEQ ID NO: 1844720 - RNA, 23 nt, Salmonella typhimurium LT2
uucguaggauuuaaaccgccccg

SEQ ID NO: 1844721 - RNA, 21 nt, Salmonella typhimurium LT2
uucguaggcaacaauuucuac

SEQ ID NO: 1844722 - RNA, 20 nt, Salmonella typhimurium LT2
uucguaauagcgucuaaauu

SEQ ID NO: 1844723 - RNA, 17 nt, Salmonella typhimurium LT2
uucgucaggaggccuga

SEQ ID NO: 1844724 - RNA, 17 nt, Salmonella typhimurium LT2
uucgugcaguccuguag

SEQ ID NO: 1844725 - RNA, 14 nt, Salmonella typhimurium LT2
uucguuauagauaa

SEQ ID NO: 1844726 - RNA, 16 nt, Salmonella typhimurium LT2
uucgccgucaccugaa

SEQ ID NO: 1844727 - RNA, 19 nt, Salmonella typhimurium LT2
uucgccgcccaaccagccc

SEQ ID NO: 1844728 - RNA, 22 nt, Salmonella typhimurium LT2
uucgcucccucaucaauacguu

SEQ ID NO: 1844729 - RNA, 14 nt, Salmonella typhimurium LT2
uucgcucucgccac

SEQ ID NO: 1844730 - RNA, 14 nt, Salmonella typhimurium LT2
uucgcucucuuuuu

SEQ ID NO: 1844731 - RNA, 15 nt, Salmonella typhimurium LT2
uucgcuuaccaggcc

SEQ ID NO: 1844732 - RNA, 13 nt, Salmonella typhimurium LT2
uucgcucgcuuug

SEQ ID NO: 1844733 - RNA, 13 nt, Salmonella typhimurium LT2
uucgcugcccguc

SEQ ID NO: 1844734 - RNA, 12 nt, Salmonella typhimurium LT2
uuccuuuuucag

SEQ ID NO: 1844735 - RNA, 13 nt, Salmonella typhimurium LT2
uuccuuuucgcag

SEQ ID NO: 1844736 - RNA, 15 nt, Salmonella typhimurium LT2
uuccuuugccuuucu

SEQ ID NO: 1844737 - RNA, 16 nt, Salmonella typhimurium LT2
uuccuuguuccaccug

SEQ ID NO: 1844738 - RNA, 18 nt, Salmonella typhimurium LT2
uucgcagcgauauuucuc

SEQ ID NO: 1844739 - RNA, 18 nt, Salmonella typhimurium LT2
uucgcagcguucgaaugc

SEQ ID NO: 1844740 - RNA, 17 nt, Salmonella typhimurium LT2
uuccaggccagcgacac

SEQ ID NO: 1844741 - RNA, 20 nt, Salmonella typhimurium LT2
uuccaguugcgcuacuuuau

SEQ ID NO: 1844742 - RNA, 16 nt, Salmonella typhimurium LT2
uuccagcggcaggccg

SEQ ID NO: 1844743 - RNA, 12 nt, Salmonella typhimurium LT2
uuccagcggcag

SEQ ID NO: 1844744 - RNA, 24 nt, Salmonella typhimurium LT2
uuccagcgcgccgucaucgcucau

SEQ ID NO: 1844745 - RNA, 18 nt, Salmonella typhimurium LT2
uuccagcgcguccagccc

SEQ ID NO: 1844746 - RNA, 20 nt, Salmonella typhimurium LT2
uuccagcuguaccaucaccu

SEQ ID NO: 1844747 - RNA, 19 nt, Salmonella typhimurium LT2
uuccagcuguaccaucacc

SEQ ID NO: 1844748 - RNA, 17 nt, Salmonella typhimurium LT2
uuccauuagcuguuguu

SEQ ID NO: 1844749 - RNA, 19 nt, Salmonella typhimurium LT2
uuccauggcaaaauucgua

SEQ ID NO: 1844750 - RNA, 15 nt, Salmonella typhimurium LT2
uuccaugacguucaa

SEQ ID NO: 1844751 - RNA, 12 nt, Salmonella typhimurium LT2
uuccaucaccau

SEQ ID NO: 1844752 - RNA, 12 nt, Salmonella typhimurium LT2
uuccaucaaaag

SEQ ID NO: 1844753 - RNA, 20 nt, Salmonella typhimurium LT2
uuccacaaucccggcaacug

SEQ ID NO: 1844754 - RNA, 17 nt, Salmonella typhimurium LT2
uuccacacguccauccg

SEQ ID NO: 1844755 - RNA, 23 nt, Salmonella typhimurium LT2
uuccacaaaaggauacagcgccg

SEQ ID NO: 1844756 - RNA, 17 nt, Salmonella typhimurium LT2
uucaggcggcaaaaaac

SEQ ID NO: 1844757 - RNA, 13 nt, Salmonella typhimurium LT2
uucaggcuggcaa

SEQ ID NO: 1844758 - RNA, 23 nt, Salmonella typhimurium LT2
uucagggcuuauucaagcaacug

SEQ ID NO: 1844759 - RNA, 21 nt, Salmonella typhimurium LT2
uuccacgccgucgaugauggc

SEQ ID NO: 1844760 - RNA, 23 nt, Salmonella typhimurium LT2
uuccacgcguacgguuacaaccc

SEQ ID NO: 1844761 - RNA, 14 nt, Salmonella typhimurium LT2
uuccagcgccauaa

SEQ ID NO: 1844762 - RNA, 21 nt, Salmonella typhimurium LT2
uuccagcaucgaccaggauuu

SEQ ID NO: 1844763 - RNA, 22 nt, Salmonella typhimurium LT2
uuccagcagauccauuaaaugc

SEQ ID NO: 1844764 - RNA, 22 nt, Salmonella typhimurium LT2
uuccagcauccugacauuaccc

SEQ ID NO: 1844765 - RNA, 20 nt, Salmonella typhimurium LT2
uuccagcagcucaucaauaa

SEQ ID NO: 1844766 - RNA, 12 nt, Salmonella typhimurium LT2
uuccggcagacg

SEQ ID NO: 1844767 - RNA, 20 nt, Salmonella typhimurium LT2
uuccgcuaaaugggcaggag

SEQ ID NO: 1844768 - RNA, 15 nt, Salmonella typhimurium LT2
uuccgcuggaauaaa

SEQ ID NO: 1844769 - RNA, 16 nt, Salmonella typhimurium LT2
uuccugauccgccuua

SEQ ID NO: 1844770 - RNA, 17 nt, Salmonella typhimurium LT2
uuccugaucaaucaacu

SEQ ID NO: 1844771 - RNA, 17 nt, Salmonella typhimurium LT2
uuccucgucgcgcgccg

SEQ ID NO: 1844772 - RNA, 23 nt, Salmonella typhimurium LT2
uuccucgucggcaagaauuucaa

SEQ ID NO: 1844773 - RNA, 11 nt, Salmonella typhimurium LT2
uuccugucaac

SEQ ID NO: 1844774 - RNA, 18 nt, Salmonella typhimurium LT2
uuccugucucuauuaacc

SEQ ID NO: 1844775 - RNA, 19 nt, Salmonella typhimurium LT2
uuccuguucguucaaaucg

SEQ ID NO: 1844776 - RNA, 21 nt, Salmonella typhimurium LT2
uuccuggaacuggcuccagcu

SEQ ID NO: 1844777 - RNA, 23 nt, Salmonella typhimurium LT2
uucccacaguuaacgccaacgcc

SEQ ID NO: 1844778 - RNA, 19 nt, Salmonella typhimurium LT2
uucccaacaaugccacgcc

SEQ ID NO: 1844779 - RNA, 15 nt, Salmonella typhimurium LT2
uucccaacuguauuu

SEQ ID NO: 1844780 - RNA, 13 nt, Salmonella typhimurium LT2
uuccauuuuucag

SEQ ID NO: 1844781 - RNA, 14 nt, Salmonella typhimurium LT2
uucccaaaaggaag

SEQ ID NO: 1844782 - RNA, 11 nt, Salmonella typhimurium LT2
uuccauuuuuc

SEQ ID NO: 1844783 - RNA, 17 nt, Salmonella typhimurium LT2
uucccagcgggaacauc

SEQ ID NO: 1844784 - RNA, 18 nt, Salmonella typhimurium LT2
uucccagcgggaacauca

SEQ ID NO: 1844785 - RNA, 14 nt, Salmonella typhimurium LT2
uucccacugcgccg

SEQ ID NO: 1844786 - RNA, 14 nt, Salmonella typhimurium LT2
uucccacuccgccc

SEQ ID NO: 1844787 - RNA, 13 nt, Salmonella typhimurium LT2
uucccacuuugcg

SEQ ID NO: 1844788 - RNA, 20 nt, Salmonella typhimurium LT2
uucccaucgcuuugcagaaa

SEQ ID NO: 1844789 - RNA, 14 nt, Salmonella typhimurium LT2
uucccaucgcuuug

SEQ ID NO: 1844790 - RNA, 24 nt, Salmonella typhimurium LT2
uucccaguauugcaccugggaguc

SEQ ID NO: 1844791 - RNA, 16 nt, Salmonella typhimurium LT2
uucccgccgcaauucc

SEQ ID NO: 1844792 - RNA, 12 nt, Salmonella typhimurium LT2
uuccccauaauc

SEQ ID NO: 1844793 - RNA, 20 nt, Salmonella typhimurium LT2
uuccccuuuaggcggcgccg

SEQ ID NO: 1844794 - RNA, 23 nt, Salmonella typhimurium LT2
uuccccaccacauuuagcgcagu

SEQ ID NO: 1844795 - RNA, 19 nt, Salmonella typhimurium LT2
uucccauugggccagcagc

SEQ ID NO: 1844796 - RNA, 17 nt, Salmonella typhimurium LT2
uucccauugagcagccg

SEQ ID NO: 1844797 - RNA, 17 nt, Salmonella typhimurium LT2
uucccgcgccagcgucg

SEQ ID NO: 1844798 - RNA, 17 nt, Salmonella typhimurium LT2
uugccuucgccgcccaa

SEQ ID NO: 1844799 - RNA, 18 nt, Salmonella typhimurium LT2
uugccugccgcagcggcu

SEQ ID NO: 1844800 - RNA, 14 nt, Salmonella typhimurium LT2
uugcgucuguuuuu

SEQ ID NO: 1844801 - RNA, 12 nt, Salmonella typhimurium LT2
uugcgucauggu

SEQ ID NO: 1844802 - RNA, 17 nt, Salmonella typhimurium LT2
uugcgccagcacgccua

SEQ ID NO: 1844803 - RNA, 16 nt, Salmonella typhimurium LT2
uugcgccagcaucaug

SEQ ID NO: 1844804 - RNA, 23 nt, Salmonella typhimurium LT2
uugcucaacuggaugacugaauu

SEQ ID NO: 1844805 - RNA, 17 nt, Salmonella typhimurium LT2
uugcucaauggauuuuc

SEQ ID NO: 1844806 - RNA, 11 nt, Salmonella typhimurium LT2
uugcucaagcu

SEQ ID NO: 1844807 - RNA, 12 nt, Salmonella typhimurium LT2
uugcucuuucug

SEQ ID NO: 1844808 - RNA, 17 nt, Salmonella typhimurium LT2
uugcucucggguacacu

SEQ ID NO: 1844809 - RNA, 20 nt, Salmonella typhimurium LT2
uugcccgguggcgcugcgcu

SEQ ID NO: 1844810 - RNA, 23 nt, Salmonella typhimurium LT2
uugcccgcaggcuuccagauaca

SEQ ID NO: 1844811 - RNA, 20 nt, Salmonella typhimurium LT2
uugccgauuccaugcccagu

SEQ ID NO: 1844812 - RNA, 17 nt, Salmonella typhimurium LT2
uugccggauggcgcuuu

SEQ ID NO: 1844813 - RNA, 14 nt, Salmonella typhimurium LT2
uugccggcaucauu

SEQ ID NO: 1844814 - RNA, 20 nt, Salmonella typhimurium LT2
uugccggauggcgcugcgcu

SEQ ID NO: 1844815 - RNA, 21 nt, Salmonella typhimurium LT2
uugccacaauaucaucgucau

SEQ ID NO: 1844816 - RNA, 15 nt, Salmonella typhimurium LT2
uugccccgcuuucag

SEQ ID NO: 1844817 - RNA, 24 nt, Salmonella typhimurium LT2
uugccccgcuuucagcguugcagc

SEQ ID NO: 1844818 - RNA, 23 nt, Salmonella typhimurium LT2
uugcccauuuaacagauaguuaa

SEQ ID NO: 1844819 - RNA, 19 nt, Salmonella typhimurium LT2
uugcaccgcuaaaaaacag

SEQ ID NO: 1844820 - RNA, 16 nt, Salmonella typhimurium LT2
uugcauuuuaucuuuu

SEQ ID NO: 1844821 - RNA, 19 nt, Salmonella typhimurium LT2
uugauuuuucugguaaacc

SEQ ID NO: 1844822 - RNA, 21 nt, Salmonella typhimurium LT2
uugauucaguucaucuuccac

SEQ ID NO: 1844823 - RNA, 20 nt, Salmonella typhimurium LT2
uugaugauaaccgccgccaa

SEQ ID NO: 1844824 - RNA, 22 nt, Salmonella typhimurium LT2
uugaugcaaauggcggauuugc

SEQ ID NO: 1844825 - RNA, 12 nt, Salmonella typhimurium LT2
uugaugccuggc

SEQ ID NO: 1844826 - RNA, 15 nt, Salmonella typhimurium LT2
uugaugccuggcagu

SEQ ID NO: 1844827 - RNA, 16 nt, Salmonella typhimurium LT2
uugcaaagcccauaaa

SEQ ID NO: 1844828 - RNA, 15 nt, Salmonella typhimurium LT2
uugcaaagcccauaa

SEQ ID NO: 1844829 - RNA, 17 nt, Salmonella typhimurium LT2
uugcaaugcgcuccagc

SEQ ID NO: 1844830 - RNA, 21 nt, Salmonella typhimurium LT2
uugcaauuccaagaucaaccg

SEQ ID NO: 1844831 - RNA, 12 nt, Salmonella typhimurium LT2
uugauaaagcgc

SEQ ID NO: 1844832 - RNA, 13 nt, Salmonella typhimurium LT2
uugauaacccaac

SEQ ID NO: 1844833 - RNA, 19 nt, Salmonella typhimurium LT2
uugacuucaacgcaggcga

SEQ ID NO: 1844834 - RNA, 20 nt, Salmonella typhimurium LT2
uugaucaggaaaucuuccag

SEQ ID NO: 1844835 - RNA, 23 nt, Salmonella typhimurium LT2
uugaucaucagggcgaacauucc

SEQ ID NO: 1844836 - RNA, 18 nt, Salmonella typhimurium LT2
uugaucccgcugaagacu

SEQ ID NO: 1844837 - RNA, 21 nt, Salmonella typhimurium LT2
uugauaacgacucauaauguc

SEQ ID NO: 1844838 - RNA, 14 nt, Salmonella typhimurium LT2
uugauaucuucaag

SEQ ID NO: 1844839 - RNA, 16 nt, Salmonella typhimurium LT2
uugaacauuuuuucag

SEQ ID NO: 1844840 - RNA, 11 nt, Salmonella typhimurium LT2
uugaaccaucu

SEQ ID NO: 1844841 - RNA, 18 nt, Salmonella typhimurium LT2
uugaaacaucauuucuac

SEQ ID NO: 1844842 - RNA, 22 nt, Salmonella typhimurium LT2
uugaaauacucuuugaacagcc

SEQ ID NO: 1844843 - RNA, 16 nt, Salmonella typhimurium LT2
uucuuuucaauaaagc

SEQ ID NO: 1844844 - RNA, 14 nt, Salmonella typhimurium LT2
uucuuuccugcaaa

SEQ ID NO: 1844845 - RNA, 17 nt, Salmonella typhimurium LT2
uucuuugcgccuuauuc

SEQ ID NO: 1844846 - RNA, 13 nt, Salmonella typhimurium LT2
uucuuugcuaucc

SEQ ID NO: 1844847 - RNA, 15 nt, Salmonella typhimurium LT2
uucuuugccuuuuuc

SEQ ID NO: 1844848 - RNA, 19 nt, Salmonella typhimurium LT2
uucuuuacgcagcaagaac

SEQ ID NO: 1844849 - RNA, 17 nt, Salmonella typhimurium LT2
uucuuuaauuugugcca

SEQ ID NO: 1844850 - RNA, 15 nt, Salmonella typhimurium LT2
uucuuuaauuugugc

SEQ ID NO: 1844851 - RNA, 19 nt, Salmonella typhimurium LT2
uucuuuauucacuuuuucu

SEQ ID NO: 1844852 - RNA, 12 nt, Salmonella typhimurium LT2
uucuugagcugg

SEQ ID NO: 1844853 - RNA, 13 nt, Salmonella typhimurium LT2
uugaauggcugcu

SEQ ID NO: 1844854 - RNA, 18 nt, Salmonella typhimurium LT2
uugaauaaccauacugac

SEQ ID NO: 1844855 - RNA, 17 nt, Salmonella typhimurium LT2
uugaauaacguguuaug

SEQ ID NO: 1844856 - RNA, 16 nt, Salmonella typhimurium LT2
uugaauaaugcccguu

SEQ ID NO: 1844857 - RNA, 22 nt, Salmonella typhimurium LT2
uugaaccuaaaaaccagaacuu

SEQ ID NO: 1844858 - RNA, 21 nt, Salmonella typhimurium LT2
uugaaguccucuauuuuuuua

SEQ ID NO: 1844859 - RNA, 15 nt, Salmonella typhimurium LT2
uugacgcuuugcauu

SEQ ID NO: 1844860 - RNA, 17 nt, Salmonella typhimurium LT2
uugacgcuaaccucuau

SEQ ID NO: 1844861 - RNA, 15 nt, Salmonella typhimurium LT2
uugacgcuauaacug

SEQ ID NO: 1844862 - RNA, 13 nt, Salmonella typhimurium LT2
uugacgcaaacug

SEQ ID NO: 1844863 - RNA, 16 nt, Salmonella typhimurium LT2
uugacgauaucaucuu

SEQ ID NO: 1844864 - RNA, 17 nt, Salmonella typhimurium LT2
uugaccguccccagcca

SEQ ID NO: 1844865 - RNA, 22 nt, Salmonella typhimurium LT2
uugacuacucccgucgccuguu

SEQ ID NO: 1844866 - RNA, 13 nt, Salmonella typhimurium LT2
uugacgcuuugca

SEQ ID NO: 1844867 - RNA, 18 nt, Salmonella typhimurium LT2
uugacucaaaaagaggaa

SEQ ID NO: 1844868 - RNA, 17 nt, Salmonella typhimurium LT2
uugacaacaaaucgcaa

SEQ ID NO: 1844869 - RNA, 15 nt, Salmonella typhimurium LT2
uugaccagcaauaaa

SEQ ID NO: 1844870 - RNA, 15 nt, Salmonella typhimurium LT2
uugacauccauaaua

SEQ ID NO: 1844871 - RNA, 18 nt, Salmonella typhimurium LT2
uuuacccacuucuuccag

SEQ ID NO: 1844872 - RNA, 18 nt, Salmonella typhimurium LT2
uuuaccaucuacuaucau

SEQ ID NO: 1844873 - RNA, 21 nt, Salmonella typhimurium LT2
uuuacccggcguauccaguaa

SEQ ID NO: 1844874 - RNA, 14 nt, Salmonella typhimurium LT2
uuuaauuuuuccuu

SEQ ID NO: 1844875 - RNA, 23 nt, Salmonella typhimurium LT2
uuuacaaccguggcguuuucauu

SEQ ID NO: 1844876 - RNA, 15 nt, Salmonella typhimurium LT2
uuuacacaauucuga

SEQ ID NO: 1844877 - RNA, 16 nt, Salmonella typhimurium LT2
uuuaaccggcaacuuu

SEQ ID NO: 1844878 - RNA, 18 nt, Salmonella typhimurium LT2
uuuaauguugccguggca

SEQ ID NO: 1844879 - RNA, 14 nt, Salmonella typhimurium LT2
uuuaauuuaauaau

SEQ ID NO: 1844880 - RNA, 16 nt, Salmonella typhimurium LT2
uuuagcgccagcagca

SEQ ID NO: 1844881 - RNA, 19 nt, Salmonella typhimurium LT2
uuuacgcagcaagaacaga

SEQ ID NO: 1844882 - RNA, 21 nt, Salmonella typhimurium LT2
uuuacgccgccauccggcaca

SEQ ID NO: 1844883 - RNA, 13 nt, Salmonella typhimurium LT2
uuuacgcugcucc

SEQ ID NO: 1844884 - RNA, 18 nt, Salmonella typhimurium LT2
uuuacucuucgacacauu

SEQ ID NO: 1844885 - RNA, 16 nt, Salmonella typhimurium LT2
uuuaguuaucaggcau

SEQ ID NO: 1844886 - RNA, 14 nt, Salmonella typhimurium LT2
uuuauaaaauuuaa

SEQ ID NO: 1844887 - RNA, 15 nt, Salmonella typhimurium LT2
uuuaggucaaaaaag

SEQ ID NO: 1844888 - RNA, 22 nt, Salmonella typhimurium LT2
uugcugagaauuuccaguucaa

SEQ ID NO: 1844889 - RNA, 14 nt, Salmonella typhimurium LT2
uugcugauaaucaa

SEQ ID NO: 1844890 - RNA, 15 nt, Salmonella typhimurium LT2
uugcugauuaaaauc

SEQ ID NO: 1844891 - RNA, 19 nt, Salmonella typhimurium LT2
uugcugcguugccgccuug

SEQ ID NO: 1844892 - RNA, 16 nt, Salmonella typhimurium LT2
uuguuugaaaagugaa

SEQ ID NO: 1844893 - RNA, 17 nt, Salmonella typhimurium LT2
uuuaacaauuuaucaga

SEQ ID NO: 1844894 - RNA, 15 nt, Salmonella typhimurium LT2
uuuaaaccacaccug

SEQ ID NO: 1844895 - RNA, 13 nt, Salmonella typhimurium LT2
uuuaaaaucaacg

SEQ ID NO: 1844896 - RNA, 12 nt, Salmonella typhimurium LT2
uuuaaaaugacc

SEQ ID NO: 1844897 - RNA, 14 nt, Salmonella typhimurium LT2
uuucaccauuaaga

SEQ ID NO: 1844898 - RNA, 20 nt, Salmonella typhimurium LT2
uuucaccucacuccagaccu

SEQ ID NO: 1844899 - RNA, 15 nt, Salmonella typhimurium LT2
uuucaccuccacgua

SEQ ID NO: 1844900 - RNA, 19 nt, Salmonella typhimurium LT2
uuucaccuggaugcugccu

SEQ ID NO: 1844901 - RNA, 21 nt, Salmonella typhimurium LT2
uuucacgccuuuugacgcuuc

SEQ ID NO: 1844902 - RNA, 21 nt, Salmonella typhimurium LT2
uuucacuaauccccauuuuuu

SEQ ID NO: 1844903 - RNA, 19 nt, Salmonella typhimurium LT2
uuucaacuuccgcguuagg

SEQ ID NO: 1844904 - RNA, 12 nt, Salmonella typhimurium LT2
uuucaacuggcu

SEQ ID NO: 1844905 - RNA, 17 nt, Salmonella typhimurium LT2
uuucaagacagaacuug

SEQ ID NO: 1844906 - RNA, 23 nt, Salmonella typhimurium LT2
uuucaauaauggcgcgaaaacag

SEQ ID NO: 1844907 - RNA, 17 nt, Salmonella typhimurium LT2
uuucaauuccacaggcg

SEQ ID NO: 1844908 - RNA, 13 nt, Salmonella typhimurium LT2
uuucaaucaucau

SEQ ID NO: 1844909 - RNA, 12 nt, Salmonella typhimurium LT2
uuucaauaaucu

SEQ ID NO: 1844910 - RNA, 18 nt, Salmonella typhimurium LT2
uuucaauacuccacaguu

SEQ ID NO: 1844911 - RNA, 19 nt, Salmonella typhimurium LT2
uuucaaauccagcuguccg

SEQ ID NO: 1844912 - RNA, 18 nt, Salmonella typhimurium LT2
uuucaacccccucagcaa

SEQ ID NO: 1844913 - RNA, 15 nt, Salmonella typhimurium LT2
uuucaacugccccuu

SEQ ID NO: 1844914 - RNA, 20 nt, Salmonella typhimurium LT2
uuucaacauauuuuucacac

SEQ ID NO: 1844915 - RNA, 17 nt, Salmonella typhimurium LT2
uuucaaaaugacaaauu

SEQ ID NO: 1844916 - RNA, 21 nt, Salmonella typhimurium LT2
uuuauuuccaauguaaauuaa

SEQ ID NO: 1844917 - RNA, 18 nt, Salmonella typhimurium LT2
uuuauuuaggauuugucu

SEQ ID NO: 1844918 - RNA, 16 nt, Salmonella typhimurium LT2
uuuauaaauuaacucu

SEQ ID NO: 1844919 - RNA, 15 nt, Salmonella typhimurium LT2
uuuauacucaaaaaa

SEQ ID NO: 1844920 - RNA, 19 nt, Salmonella typhimurium LT2
uuuauacucaauaaccucu

SEQ ID NO: 1844921 - RNA, 11 nt, Salmonella typhimurium LT2
uuucauccucu

SEQ ID NO: 1844922 - RNA, 20 nt, Salmonella typhimurium LT2
uuucaucaucuguugcaauu

SEQ ID NO: 1844923 - RNA, 15 nt, Salmonella typhimurium LT2
uuucaucugcaguaa

SEQ ID NO: 1844924 - RNA, 14 nt, Salmonella typhimurium LT2
uuucaucuauuauu

SEQ ID NO: 1844925 - RNA, 22 nt, Salmonella typhimurium LT2
uuucaucuauuauuuuucuauu

SEQ ID NO: 1844926 - RNA, 12 nt, Salmonella typhimurium LT2
uuucaucaccau

SEQ ID NO: 1844927 - RNA, 12 nt, Salmonella typhimurium LT2
uuucaucacgcu

SEQ ID NO: 1844928 - RNA, 20 nt, Salmonella typhimurium LT2
uuucauaugcgggguuugca

SEQ ID NO: 1844929 - RNA, 13 nt, Salmonella typhimurium LT2
uuucauuauaaaa

SEQ ID NO: 1844930 - RNA, 22 nt, Salmonella typhimurium LT2
uuucauggucaucgcaaauucu

SEQ ID NO: 1844931 - RNA, 22 nt, Salmonella typhimurium LT2
uuuccagcuccagccgcugccu

SEQ ID NO: 1844932 - RNA, 20 nt, Salmonella typhimurium LT2
uuuccagaguacauucucuu

SEQ ID NO: 1844933 - RNA, 16 nt, Salmonella typhimurium LT2
uuucauuucugccugc

SEQ ID NO: 1844934 - RNA, 13 nt, Salmonella typhimurium LT2
uuuccaaaaucca

SEQ ID NO: 1844935 - RNA, 19 nt, Salmonella typhimurium LT2
uuucauuucgcccaucgcu

SEQ ID NO: 1844936 - RNA, 21 nt, Salmonella typhimurium LT2
uuucagugacgcguuaauauc

SEQ ID NO: 1844937 - RNA, 13 nt, Salmonella typhimurium LT2
uuucagucaucau

SEQ ID NO: 1844938 - RNA, 16 nt, Salmonella typhimurium LT2
uuucagugauaaagcc

SEQ ID NO: 1844939 - RNA, 14 nt, Salmonella typhimurium LT2
uuucagugauaaag

SEQ ID NO: 1844940 - RNA, 15 nt, Salmonella typhimurium LT2
uuucaggcugcucau

SEQ ID NO: 1844941 - RNA, 15 nt, Salmonella typhimurium LT2
uuucauagaaccacu

SEQ ID NO: 1844942 - RNA, 23 nt, Salmonella typhimurium LT2
uuucauagcagcaaguauaauca

SEQ ID NO: 1844943 - RNA, 15 nt, Salmonella typhimurium LT2
uuucaguuguccauu

SEQ ID NO: 1844944 - RNA, 18 nt, Salmonella typhimurium LT2
uuucauaauaagcgcuca

SEQ ID NO: 1844945 - RNA, 20 nt, Salmonella typhimurium LT2
uuucacugucgccaggccau

SEQ ID NO: 1844946 - RNA, 17 nt, Salmonella typhimurium LT2
uuucacuuucaaugaca

SEQ ID NO: 1844947 - RNA, 18 nt, Salmonella typhimurium LT2
uuucagccgcgcauagcu

SEQ ID NO: 1844948 - RNA, 13 nt, Salmonella typhimurium LT2
uuucagcaggccu

SEQ ID NO: 1844949 - RNA, 18 nt, Salmonella typhimurium LT2
uuucagauagcgaaccau

SEQ ID NO: 1844950 - RNA, 17 nt, Salmonella typhimurium LT2
uuugcauaccaaguuug

SEQ ID NO: 1844951 - RNA, 20 nt, Salmonella typhimurium LT2
uuugcauaggccccgguggc

SEQ ID NO: 1844952 - RNA, 15 nt, Salmonella typhimurium LT2
uuugcauucgcuccu

SEQ ID NO: 1844953 - RNA, 15 nt, Salmonella typhimurium LT2
uuugcauuaaccuga

SEQ ID NO: 1844954 - RNA, 14 nt, Salmonella typhimurium LT2
uuugccagcaccag

SEQ ID NO: 1844955 - RNA, 14 nt, Salmonella typhimurium LT2
uuugccuuucuuau

SEQ ID NO: 1844956 - RNA, 15 nt, Salmonella typhimurium LT2
uuugccucuggccag

SEQ ID NO: 1844957 - RNA, 17 nt, Salmonella typhimurium LT2
uuugccgccuugucuca

SEQ ID NO: 1844958 - RNA, 21 nt, Salmonella typhimurium LT2
uuugccccauuguucuuucau

SEQ ID NO: 1844959 - RNA, 17 nt, Salmonella typhimurium LT2
uuugcccgcguucugcu

SEQ ID NO: 1844960 - RNA, 16 nt, Salmonella typhimurium LT2
uuugcucaauuuuuuu

SEQ ID NO: 1844961 - RNA, 12 nt, Salmonella typhimurium LT2
uuugcucgccau

SEQ ID NO: 1844962 - RNA, 17 nt, Salmonella typhimurium LT2
uuugcucuggcuuguuc

SEQ ID NO: 1844963 - RNA, 16 nt, Salmonella typhimurium LT2
uuugcugaaguucuca

SEQ ID NO: 1844964 - RNA, 19 nt, Salmonella typhimurium LT2
uuugcuacaccccuucugg

SEQ ID NO: 1844965 - RNA, 18 nt, Salmonella typhimurium LT2
uuugcgguuuuaauuucc

SEQ ID NO: 1844966 - RNA, 16 nt, Salmonella typhimurium LT2
uuugcguaaaaaaaca

SEQ ID NO: 1844967 - RNA, 17 nt, Salmonella typhimurium LT2
uuugcguaaaaaaacau

SEQ ID NO: 1844968 - RNA, 19 nt, Salmonella typhimurium LT2
uuugcguaaaaaaacauca

SEQ ID NO: 1844969 - RNA, 15 nt, Salmonella typhimurium LT2
uuugcgccuuccagu

SEQ ID NO: 1844970 - RNA, 21 nt, Salmonella typhimurium LT2
uuugcgcgaggucgagcucag

SEQ ID NO: 1844971 - RNA, 11 nt, Salmonella typhimurium LT2
uuugcgcggcu

SEQ ID NO: 1844972 - RNA, 22 nt, Salmonella typhimurium LT2
uuugcggacuagacagccucuc

SEQ ID NO: 1844973 - RNA, 19 nt, Salmonella typhimurium LT2
uuugccuuuugacagcaca

SEQ ID NO: 1844974 - RNA, 15 nt, Salmonella typhimurium LT2
uuugcgacacgcugc

SEQ ID NO: 1844975 - RNA, 12 nt, Salmonella typhimurium LT2
uuugauuuaauu

SEQ ID NO: 1844976 - RNA, 22 nt, Salmonella typhimurium LT2
uuugauucaguucaucuuccac

SEQ ID NO: 1844977 - RNA, 13 nt, Salmonella typhimurium LT2
uuugcaacagggc

SEQ ID NO: 1844978 - RNA, 13 nt, Salmonella typhimurium LT2
uuugcaaaacuga

SEQ ID NO: 1844979 - RNA, 17 nt, Salmonella typhimurium LT2
uuugcacguucugcugg

SEQ ID NO: 1844980 - RNA, 12 nt, Salmonella typhimurium LT2
uuugcagaaaau

SEQ ID NO: 1844981 - RNA, 13 nt, Salmonella typhimurium LT2
uuugcagcaacug

SEQ ID NO: 1844982 - RNA, 17 nt, Salmonella typhimurium LT2
uuugcaccgcuaaaaaa

SEQ ID NO: 1844983 - RNA, 16 nt, Salmonella typhimurium LT2
uuugcaccgcuaaaaa

SEQ ID NO: 1844984 - RNA, 19 nt, Salmonella typhimurium LT2
uuugcaaugcgcuccagcu

SEQ ID NO: 1844985 - RNA, 13 nt, Salmonella typhimurium LT2
uuugcaauggccc

SEQ ID NO: 1844986 - RNA, 21 nt, Salmonella typhimurium LT2
uuugaucccguccgcgcucau

SEQ ID NO: 1844987 - RNA, 18 nt, Salmonella typhimurium LT2
uuugauccguuucagaaa

SEQ ID NO: 1844988 - RNA, 23 nt, Salmonella typhimurium LT2
uuugaucugaagcguauuucugu

SEQ ID NO: 1844989 - RNA, 22 nt, Salmonella typhimurium LT2
uuugauaaacugcgccauguuc

SEQ ID NO: 1844990 - RNA, 19 nt, Salmonella typhimurium LT2
uuugagguaugucgaauau

SEQ ID NO: 1844991 - RNA, 17 nt, Salmonella typhimurium LT2
uuugagucgcauccagu

SEQ ID NO: 1844992 - RNA, 21 nt, Salmonella typhimurium LT2
uuucuugccacuggccuccca

SEQ ID NO: 1844993 - RNA, 11 nt, Salmonella typhimurium LT2
uuucuucuuca

SEQ ID NO: 1844994 - RNA, 18 nt, Salmonella typhimurium LT2
uuucuucgcucucgacau

SEQ ID NO: 1844995 - RNA, 13 nt, Salmonella typhimurium LT2
uuucuuucaucag

SEQ ID NO: 1844996 - RNA, 13 nt, Salmonella typhimurium LT2
uuucuuucaucaa

SEQ ID NO: 1844997 - RNA, 11 nt, Salmonella typhimurium LT2
uuucuuuaaac

SEQ ID NO: 1844998 - RNA, 19 nt, Salmonella typhimurium LT2
uuucuuccauuagcuguug

SEQ ID NO: 1844999 - RNA, 23 nt, Salmonella typhimurium LT2
uuucuucaggccagccugaucca

SEQ ID NO: 1845000 - RNA, 16 nt, Salmonella typhimurium LT2
uuucuucaucaacacu

SEQ ID NO: 1845001 - RNA, 17 nt, Salmonella typhimurium LT2
uuucuucaucccagcua

SEQ ID NO: 1845002 - RNA, 17 nt, Salmonella typhimurium LT2
uuucuguaauuugaaau

SEQ ID NO: 1845003 - RNA, 13 nt, Salmonella typhimurium LT2
uuucuuaauuccu

SEQ ID NO: 1845004 - RNA, 22 nt, Salmonella typhimurium LT2
uuugacgccgggaaauuuuucg

SEQ ID NO: 1845005 - RNA, 20 nt, Salmonella typhimurium LT2
uuugacuucacuuucaagcc

SEQ ID NO: 1845006 - RNA, 18 nt, Salmonella typhimurium LT2
uuugaggaaaccuuucuu

SEQ ID NO: 1845007 - RNA, 13 nt, Salmonella typhimurium LT2
uuugaaaaucaca

SEQ ID NO: 1845008 - RNA, 17 nt, Salmonella typhimurium LT2
uuuccgccgccuucugc

SEQ ID NO: 1845009 - RNA, 18 nt, Salmonella typhimurium LT2
uuuccgcagccagaauca

SEQ ID NO: 1845010 - RNA, 22 nt, Salmonella typhimurium LT2
uuuccgccauagaacauauuca

SEQ ID NO: 1845011 - RNA, 18 nt, Salmonella typhimurium LT2
uuuccgcgagagaaaaaa

SEQ ID NO: 1845012 - RNA, 14 nt, Salmonella typhimurium LT2
uuuccggaaugaga

SEQ ID NO: 1845013 - RNA, 18 nt, Salmonella typhimurium LT2
uuucccucauauuuguau

SEQ ID NO: 1845014 - RNA, 17 nt, Salmonella typhimurium LT2
uuucccggauaaauguu

SEQ ID NO: 1845015 - RNA, 23 nt, Salmonella typhimurium LT2
uuucccggcguaauccagcuuca

SEQ ID NO: 1845016 - RNA, 15 nt, Salmonella typhimurium LT2
uuucccuucugaaau

SEQ ID NO: 1845017 - RNA, 18 nt, Salmonella typhimurium LT2
uuucccuuuuuaaaauga

SEQ ID NO: 1845018 - RNA, 15 nt, Salmonella typhimurium LT2
uuucccccacuucug

SEQ ID NO: 1845019 - RNA, 23 nt, Salmonella typhimurium LT2
uuucccccgcugaggccugcaca

SEQ ID NO: 1845020 - RNA, 15 nt, Salmonella typhimurium LT2
uuuccccgaugccau

SEQ ID NO: 1845021 - RNA, 16 nt, Salmonella typhimurium LT2
uuuccccgaugccauu

SEQ ID NO: 1845022 - RNA, 13 nt, Salmonella typhimurium LT2
uuucccacuguuc

SEQ ID NO: 1845023 - RNA, 21 nt, Salmonella typhimurium LT2
uuuccagucccugaagaaaag

SEQ ID NO: 1845024 - RNA, 13 nt, Salmonella typhimurium LT2
uuuccaucaccau

SEQ ID NO: 1845025 - RNA, 23 nt, Salmonella typhimurium LT2
uuuccugccauuguuccggcgac

SEQ ID NO: 1845026 - RNA, 16 nt, Salmonella typhimurium LT2
uuuccugcugccaucg

SEQ ID NO: 1845027 - RNA, 20 nt, Salmonella typhimurium LT2
uuuccugauuugcggcagaa

SEQ ID NO: 1845028 - RNA, 16 nt, Salmonella typhimurium LT2
uuuccucuucuugcug

SEQ ID NO: 1845029 - RNA, 16 nt, Salmonella typhimurium LT2
uuuccucaaccucuuu

SEQ ID NO: 1845030 - RNA, 22 nt, Salmonella typhimurium LT2
uuuccucccauacccagguuug

SEQ ID NO: 1845031 - RNA, 19 nt, Salmonella typhimurium LT2
uuuccucguuuaaugcgaa

SEQ ID NO: 1845032 - RNA, 16 nt, Salmonella typhimurium LT2
uuuccguuagcccuuu

SEQ ID NO: 1845033 - RNA, 22 nt, Salmonella typhimurium LT2
uuuccguuuguaacauauuuuu

SEQ ID NO: 1845034 - RNA, 23 nt, Salmonella typhimurium LT2
uuucgcgauaauagaacccaaag

SEQ ID NO: 1845035 - RNA, 18 nt, Salmonella typhimurium LT2
uuucgcuccacuggcccc

SEQ ID NO: 1845036 - RNA, 16 nt, Salmonella typhimurium LT2
uuucgcucaacaaacu

SEQ ID NO: 1845037 - RNA, 20 nt, Salmonella typhimurium LT2
uuucgcucaacaaacuuaau

SEQ ID NO: 1845038 - RNA, 16 nt, Salmonella typhimurium LT2
uuucgcucgcuuugcc

SEQ ID NO: 1845039 - RNA, 21 nt, Salmonella typhimurium LT2
uuucgcucgcuuugccgccau

SEQ ID NO: 1845040 - RNA, 14 nt, Salmonella typhimurium LT2
uuucgcucuuauca

SEQ ID NO: 1845041 - RNA, 16 nt, Salmonella typhimurium LT2
uuucgaugaaaaagag

SEQ ID NO: 1845042 - RNA, 20 nt, Salmonella typhimurium LT2
uuucgccacgcucacuuuuc

SEQ ID NO: 1845043 - RNA, 15 nt, Salmonella typhimurium LT2
uuucgcccucgccac

SEQ ID NO: 1845044 - RNA, 15 nt, Salmonella typhimurium LT2
uuucgagcagaacug

SEQ ID NO: 1845045 - RNA, 17 nt, Salmonella typhimurium LT2
uuucgacggcaaccuuc

SEQ ID NO: 1845046 - RNA, 21 nt, Salmonella typhimurium LT2
uuucgagccuugccgcaauug

SEQ ID NO: 1845047 - RNA, 22 nt, Salmonella typhimurium LT2
uuucgacaaacaccgagccaga

SEQ ID NO: 1845048 - RNA, 13 nt, Salmonella typhimurium LT2
uuucgaaacguuc

SEQ ID NO: 1845049 - RNA, 22 nt, Salmonella typhimurium LT2
uuucgucacuaacuccagcauc

SEQ ID NO: 1845050 - RNA, 13 nt, Salmonella typhimurium LT2
uuucgucaauauu

SEQ ID NO: 1845051 - RNA, 18 nt, Salmonella typhimurium LT2
uuucguugccagaguuca

SEQ ID NO: 1845052 - RNA, 20 nt, Salmonella typhimurium LT2
uuucguucuuucugccaucg

SEQ ID NO: 1845053 - RNA, 13 nt, Salmonella typhimurium LT2
uuucuaucccuuc

SEQ ID NO: 1845054 - RNA, 19 nt, Salmonella typhimurium LT2
uuucuagggauaacaguau

SEQ ID NO: 1845055 - RNA, 16 nt, Salmonella typhimurium LT2
uuucuaaugucagcuc

SEQ ID NO: 1845056 - RNA, 16 nt, Salmonella typhimurium LT2
uuucuaccugcaaugu

SEQ ID NO: 1845057 - RNA, 13 nt, Salmonella typhimurium LT2
uuucucaauacga

SEQ ID NO: 1845058 - RNA, 14 nt, Salmonella typhimurium LT2
uuucucaaaaacac

SEQ ID NO: 1845059 - RNA, 13 nt, Salmonella typhimurium LT2
uuucucauuaaaa

SEQ ID NO: 1845060 - RNA, 12 nt, Salmonella typhimurium LT2
uuucucaucaag

SEQ ID NO: 1845061 - RNA, 18 nt, Salmonella typhimurium LT2
uuucucccgccagaugca

SEQ ID NO: 1845062 - RNA, 22 nt, Salmonella typhimurium LT2
uuucucccggauggcaaaaaca

SEQ ID NO: 1845063 - RNA, 23 nt, Salmonella typhimurium LT2
uuucucgcacaccagauucccca

SEQ ID NO: 1845064 - RNA, 18 nt, Salmonella typhimurium LT2
uuucuccuucauauuuca

SEQ ID NO: 1845065 - RNA, 16 nt, Salmonella typhimurium LT2
uuucuccugauuaauc

SEQ ID NO: 1845066 - RNA, 14 nt, Salmonella typhimurium LT2
uuucuccguuguug

SEQ ID NO: 1845067 - RNA, 16 nt, Salmonella typhimurium LT2
uuucuccggccagaca

SEQ ID NO: 1845068 - RNA, 15 nt, Salmonella typhimurium LT2
uuucugcuggccuuu

SEQ ID NO: 1845069 - RNA, 14 nt, Salmonella typhimurium LT2
uuucuguauuuucu

SEQ ID NO: 1845070 - RNA, 16 nt, Salmonella typhimurium LT2
uuucuguauuuucuau

SEQ ID NO: 1845071 - RNA, 14 nt, Salmonella typhimurium LT2
uuucugaucuguuu

SEQ ID NO: 1845072 - RNA, 20 nt, Salmonella typhimurium LT2
uuucugauaacgcaggcgau

SEQ ID NO: 1845073 - RNA, 14 nt, Salmonella typhimurium LT2
uuuucauuauaaaa

SEQ ID NO: 1845074 - RNA, 16 nt, Salmonella typhimurium LT2
uuuucauuauaaaacu

SEQ ID NO: 1845075 - RNA, 13 nt, Salmonella typhimurium LT2
uuuucaucaucau

SEQ ID NO: 1845076 - RNA, 15 nt, Salmonella typhimurium LT2
uuuucauauguuuga

SEQ ID NO: 1845077 - RNA, 23 nt, Salmonella typhimurium LT2
uuuucacuaauccccauuuuuuu

SEQ ID NO: 1845078 - RNA, 15 nt, Salmonella typhimurium LT2
uuuucacuaaucccc

SEQ ID NO: 1845079 - RNA, 13 nt, Salmonella typhimurium LT2
uuuucagcauuaa

SEQ ID NO: 1845080 - RNA, 19 nt, Salmonella typhimurium LT2
uuuucacgaccagccaaca

SEQ ID NO: 1845081 - RNA, 16 nt, Salmonella typhimurium LT2
uuuucacuuauaaaua

SEQ ID NO: 1845082 - RNA, 12 nt, Salmonella typhimurium LT2
uuuucaauaauc

SEQ ID NO: 1845083 - RNA, 15 nt, Salmonella typhimurium LT2
uuuucaaauccagcu

SEQ ID NO: 1845084 - RNA, 17 nt, Salmonella typhimurium LT2
uuuuauuuuuauauucc

SEQ ID NO: 1845085 - RNA, 13 nt, Salmonella typhimurium LT2
uuuuauuuucagc

SEQ ID NO: 1845086 - RNA, 14 nt, Salmonella typhimurium LT2
uuuucaaaagagag

SEQ ID NO: 1845087 - RNA, 22 nt, Salmonella typhimurium LT2
uuuuccagugccgccagaauca

SEQ ID NO: 1845088 - RNA, 13 nt, Salmonella typhimurium LT2
uuuuccaucacgu

SEQ ID NO: 1845089 - RNA, 14 nt, Salmonella typhimurium LT2
uuuucccaacugua

SEQ ID NO: 1845090 - RNA, 14 nt, Salmonella typhimurium LT2
uuuuccacaauacc

SEQ ID NO: 1845091 - RNA, 18 nt, Salmonella typhimurium LT2
uuuuccacagacccagua

SEQ ID NO: 1845092 - RNA, 12 nt, Salmonella typhimurium LT2
uuuucggcucac

SEQ ID NO: 1845093 - RNA, 20 nt, Salmonella typhimurium LT2
uuuucgcccccagcacgaca

SEQ ID NO: 1845094 - RNA, 19 nt, Salmonella typhimurium LT2
uuuuccugcugccaucgcu

SEQ ID NO: 1845095 - RNA, 16 nt, Salmonella typhimurium LT2
uuuuccugcggcuuga

SEQ ID NO: 1845096 - RNA, 22 nt, Salmonella typhimurium LT2
uuuucgcagagucgcagcggcg

SEQ ID NO: 1845097 - RNA, 18 nt, Salmonella typhimurium LT2
uuuucgcagcaauucugc

SEQ ID NO: 1845098 - RNA, 15 nt, Salmonella typhimurium LT2
uuuucgaucuucucc

SEQ ID NO: 1845099 - RNA, 17 nt, Salmonella typhimurium LT2
uuuucgaugcacgccac

SEQ ID NO: 1845100 - RNA, 13 nt, Salmonella typhimurium LT2
uuuuauacauccu

SEQ ID NO: 1845101 - RNA, 13 nt, Salmonella typhimurium LT2
uuuuauaaaauuu

SEQ ID NO: 1845102 - RNA, 14 nt, Salmonella typhimurium LT2
uuuuagcuuaaaaa

SEQ ID NO: 1845103 - RNA, 15 nt, Salmonella typhimurium LT2
uuuuaggcuauaaaa

SEQ ID NO: 1845104 - RNA, 20 nt, Salmonella typhimurium LT2
uuuuagcuuaaaaaauccug

SEQ ID NO: 1845105 - RNA, 19 nt, Salmonella typhimurium LT2
uuuuacugcguaaucuuuu

SEQ ID NO: 1845106 - RNA, 14 nt, Salmonella typhimurium LT2
uuuuagaacuaucu

SEQ ID NO: 1845107 - RNA, 21 nt, Salmonella typhimurium LT2
uuuuagcagcaauaauuacag

SEQ ID NO: 1845108 - RNA, 16 nt, Salmonella typhimurium LT2
uuuuagcauaacguuu

SEQ ID NO: 1845109 - RNA, 17 nt, Salmonella typhimurium LT2
uuuuagccgcaucuucc

SEQ ID NO: 1845110 - RNA, 20 nt, Salmonella typhimurium LT2
uuuuaugcacgcuauaacgu

SEQ ID NO: 1845111 - RNA, 12 nt, Salmonella typhimurium LT2
uuuuaugcguuu

SEQ ID NO: 1845112 - RNA, 12 nt, Salmonella typhimurium LT2
uuuuaucagacc

SEQ ID NO: 1845113 - RNA, 20 nt, Salmonella typhimurium LT2
uuuuaucagaccugccugau

SEQ ID NO: 1845114 - RNA, 23 nt, Salmonella typhimurium LT2
uuuuaucgaaguaauaaaaaaca

SEQ ID NO: 1845115 - RNA, 12 nt, Salmonella typhimurium LT2
uuuuauccauuu

SEQ ID NO: 1845116 - RNA, 21 nt, Salmonella typhimurium LT2
uuuuauuuuagcuucuucaua

SEQ ID NO: 1845117 - RNA, 21 nt, Salmonella typhimurium LT2
uuuuauguguauagcuuuucu

SEQ ID NO: 1845118 - RNA, 23 nt, Salmonella typhimurium LT2
uuuuauuaaaauuguaauaauuu

SEQ ID NO: 1845119 - RNA, 14 nt, Salmonella typhimurium LT2
uuuguccauuucuu

SEQ ID NO: 1845120 - RNA, 18 nt, Salmonella typhimurium LT2
uuugucguccccuggacg

SEQ ID NO: 1845121 - RNA, 16 nt, Salmonella typhimurium LT2
uuuguggcguguggcu

SEQ ID NO: 1845122 - RNA, 23 nt, Salmonella typhimurium LT2
uuuguggccugcuuaaacagaau

SEQ ID NO: 1845123 - RNA, 12 nt, Salmonella typhimurium LT2
uuugugcgcgcc

SEQ ID NO: 1845124 - RNA, 18 nt, Salmonella typhimurium LT2
uuugugcccguuuuacau

SEQ ID NO: 1845125 - RNA, 13 nt, Salmonella typhimurium LT2
uuuguacaaaaaa

SEQ ID NO: 1845126 - RNA, 13 nt, Salmonella typhimurium LT2
uuuguaaauacug

SEQ ID NO: 1845127 - RNA, 14 nt, Salmonella typhimurium LT2
uuugguuccuucag

SEQ ID NO: 1845128 - RNA, 19 nt, Salmonella typhimurium LT2
uuuguaggccuaaaaauag

SEQ ID NO: 1845129 - RNA, 20 nt, Salmonella typhimurium LT2
uuuguaucccuuucaaaaaa

SEQ ID NO: 1845130 - RNA, 15 nt, Salmonella typhimurium LT2
uuugcugcauuucuu

SEQ ID NO: 1845131 - RNA, 15 nt, Salmonella typhimurium LT2
uuugcugacaaucug

SEQ ID NO: 1845132 - RNA, 19 nt, Salmonella typhimurium LT2
uuugcugacaaucugcugg

SEQ ID NO: 1845133 - RNA, 22 nt, Salmonella typhimurium LT2
uuugcuucgccaucuccaucau

SEQ ID NO: 1845134 - RNA, 17 nt, Salmonella typhimurium LT2
uuugcuucucgccuuca

SEQ ID NO: 1845135 - RNA, 13 nt, Salmonella typhimurium LT2
uuugcuucuucag

SEQ ID NO: 1845136 - RNA, 21 nt, Salmonella typhimurium LT2
uuugggaacuagcgaaucaca

SEQ ID NO: 1845137 - RNA, 20 nt, Salmonella typhimurium LT2
uuuggguaaauaccaggcac

SEQ ID NO: 1845138 - RNA, 19 nt, Salmonella typhimurium LT2
uuugguuagggaucaucuu

SEQ ID NO: 1845139 - RNA, 21 nt, Salmonella typhimurium LT2
uuuggugcccgcguggaaaac

SEQ ID NO: 1845140 - RNA, 20 nt, Salmonella typhimurium LT2
uuugguuauccagcagccag

SEQ ID NO: 1845141 - RNA, 15 nt, Salmonella typhimurium LT2
uuuggugugacagca

SEQ ID NO: 1845142 - RNA, 19 nt, Salmonella typhimurium LT2
uuuggcuuuaugaauauca

SEQ ID NO: 1845143 - RNA, 17 nt, Salmonella typhimurium LT2
uuuggcuuaaauaaucu

SEQ ID NO: 1845144 - RNA, 23 nt, Salmonella typhimurium LT2
uuuggcguacuuagguacuuccu

SEQ ID NO: 1845145 - RNA, 15 nt, Salmonella typhimurium LT2
uuuggcaaucuuuag

SEQ ID NO: 1845146 - RNA, 20 nt, Salmonella typhimurium LT2
uuuggcagacaaccauauuu

SEQ ID NO: 1845147 - RNA, 19 nt, Salmonella typhimurium LT2
uuuggcaccguuagugauu

SEQ ID NO: 1845148 - RNA, 23 nt, Salmonella typhimurium LT2
uuuuacgagaaccaacugccaaa

SEQ ID NO: 1845149 - RNA, 20 nt, Salmonella typhimurium LT2
uuuuaccaguacaauuucug

SEQ ID NO: 1845150 - RNA, 14 nt, Salmonella typhimurium LT2
uuuuaauuuaauaa

SEQ ID NO: 1845151 - RNA, 19 nt, Salmonella typhimurium LT2
uuuuaaugacuuuuuauau

SEQ ID NO: 1845152 - RNA, 18 nt, Salmonella typhimurium LT2
uuuuaaugauguagucau

SEQ ID NO: 1845153 - RNA, 22 nt, Salmonella typhimurium LT2
uuuuaacgucaucaccaguuga

SEQ ID NO: 1845154 - RNA, 18 nt, Salmonella typhimurium LT2
uuuuaaccuucuaccccg

SEQ ID NO: 1845155 - RNA, 21 nt, Salmonella typhimurium LT2
uuuuaagccguagaccuggcu

SEQ ID NO: 1845156 - RNA, 16 nt, Salmonella typhimurium LT2
uuuuaagcuucuuauu

SEQ ID NO: 1845157 - RNA, 20 nt, Salmonella typhimurium LT2
uuuuaaggcggcaaagauaa

SEQ ID NO: 1845158 - RNA, 11 nt, Salmonella typhimurium LT2
uuuguuacucu

SEQ ID NO: 1845159 - RNA, 14 nt, Salmonella typhimurium LT2
uuuuaaaaaaccag

SEQ ID NO: 1845160 - RNA, 12 nt, Salmonella typhimurium LT2
uuuguuuaaaaa

SEQ ID NO: 1845161 - RNA, 12 nt, Salmonella typhimurium LT2
uuuuaaaaauaa

SEQ ID NO: 1845162 - RNA, 23 nt, Salmonella typhimurium LT2
uuuuaaaaaauuggguaguaaua

SEQ ID NO: 1845163 - RNA, 13 nt, Salmonella typhimurium LT2
uuuuaaaaccauu

SEQ ID NO: 1845164 - RNA, 12 nt, Salmonella typhimurium LT2
uuuuaaaaguua

SEQ ID NO: 1845165 - RNA, 14 nt, Salmonella typhimurium LT2
uuuuaaaccaaucu

SEQ ID NO: 1845166 - RNA, 19 nt, Salmonella typhimurium LT2
uuuuaaaccgcgauaaacc

SEQ ID NO: 1845167 - RNA, 21 nt, Salmonella typhimurium LT2
uuuugcucucggguacacucu

SEQ ID NO: 1845168 - RNA, 16 nt, Salmonella typhimurium LT2
uuuuggggaaaauacc

SEQ ID NO: 1845169 - RNA, 21 nt, Salmonella typhimurium LT2
uuuugcccgaucccauguuca

SEQ ID NO: 1845170 - RNA, 10 nt, Salmonella typhimurium LT2
uuuugccgcc

SEQ ID NO: 1845171 - RNA, 15 nt, Salmonella typhimurium LT2
uuuugccgauaaaaa

SEQ ID NO: 1845172 - RNA, 20 nt, Salmonella typhimurium LT2
uuuugauaagagaaaauacc

SEQ ID NO: 1845173 - RNA, 18 nt, Salmonella typhimurium LT2
uuuucugcgccaccagcg

SEQ ID NO: 1845174 - RNA, 12 nt, Salmonella typhimurium LT2
uuuucuggaaca

SEQ ID NO: 1845175 - RNA, 19 nt, Salmonella typhimurium LT2
uuuucucgcgcagccagua

SEQ ID NO: 1845176 - RNA, 12 nt, Salmonella typhimurium LT2
uuuuucaucauc

SEQ ID NO: 1845177 - RNA, 12 nt, Salmonella typhimurium LT2
uuuuucaucugc

SEQ ID NO: 1845178 - RNA, 19 nt, Salmonella typhimurium LT2
uuuuucaucugcaguaagu

SEQ ID NO: 1845179 - RNA, 23 nt, Salmonella typhimurium LT2
uuuuuccgccaccuguuucgcca

SEQ ID NO: 1845180 - RNA, 21 nt, Salmonella typhimurium LT2
uuuuuccagcacggcauaagc

SEQ ID NO: 1845181 - RNA, 19 nt, Salmonella typhimurium LT2
uuuuucacgaccagccaac

SEQ ID NO: 1845182 - RNA, 14 nt, Salmonella typhimurium LT2
uuuuucagccgcgc

SEQ ID NO: 1845183 - RNA, 16 nt, Salmonella typhimurium LT2
uuuuuaccauauuuau

SEQ ID NO: 1845184 - RNA, 16 nt, Salmonella typhimurium LT2
uuuuuacgccugaacg

SEQ ID NO: 1845185 - RNA, 18 nt, Salmonella typhimurium LT2
uuuuuacgucagcaauac

SEQ ID NO: 1845186 - RNA, 16 nt, Salmonella typhimurium LT2
uuuuuauauucgcuca

SEQ ID NO: 1845187 - RNA, 21 nt, Salmonella typhimurium LT2
uuuuuauauuccgcaggcaag

SEQ ID NO: 1845188 - RNA, 22 nt, Salmonella typhimurium LT2
uuuuuauacugaucgcuggugc

SEQ ID NO: 1845189 - RNA, 14 nt, Salmonella typhimurium LT2
uuuuuaucuuuucu

SEQ ID NO: 1845190 - RNA, 12 nt, Salmonella typhimurium LT2
uuuuuauucaua

SEQ ID NO: 1845191 - RNA, 15 nt, Salmonella typhimurium LT2
uuuuuaauccaggaa

SEQ ID NO: 1845192 - RNA, 12 nt, Salmonella typhimurium LT2
uuuuuaauaaua

SEQ ID NO: 1845193 - RNA, 13 nt, Salmonella typhimurium LT2
uuuuuaaauauua

SEQ ID NO: 1845194 - RNA, 21 nt, Salmonella typhimurium LT2
uuuuguaggccuaaaaauagc

SEQ ID NO: 1845195 - RNA, 23 nt, Salmonella typhimurium LT2
uuuugucauaaggcgauauugcc

SEQ ID NO: 1845196 - RNA, 17 nt, Salmonella typhimurium LT2
uuuugucggaauuuccg

SEQ ID NO: 1845197 - RNA, 19 nt, Salmonella typhimurium LT2
uuuugugaauaucacccca

SEQ ID NO: 1845198 - RNA, 22 nt, Salmonella typhimurium LT2
aaauguucagcgaccugcagcu

SEQ ID NO: 1845199 - RNA, 17 nt, Salmonella typhimurium LT2
aaauguuggauugcauc

SEQ ID NO: 1845200 - RNA, 12 nt, Salmonella typhimurium LT2
uuuuuuaccauu

SEQ ID NO: 1845201 - RNA, 13 nt, Salmonella typhimurium LT2
uuuuuuauccauu

SEQ ID NO: 1845202 - RNA, 19 nt, Salmonella typhimurium LT2
aaauuaagcgacccgauaa

SEQ ID NO: 1845203 - RNA, 13 nt, Salmonella typhimurium LT2
aaauuaaucgcca

SEQ ID NO: 1845204 - RNA, 18 nt, Salmonella typhimurium LT2
aaauuaaucgccagcagc

SEQ ID NO: 1845205 - RNA, 21 nt, Salmonella typhimurium LT2
aaauuaacgacauuuuugccc

SEQ ID NO: 1845206 - RNA, 16 nt, Salmonella typhimurium LT2
aaauuaaaucaucuug

SEQ ID NO: 1845207 - RNA, 16 nt, Salmonella typhimurium LT2
aaauuaaaauucauua

SEQ ID NO: 1845208 - RNA, 17 nt, Salmonella typhimurium LT2
aaauuaaaauucauuau

SEQ ID NO: 1845209 - RNA, 21 nt, Salmonella typhimurium LT2
uuuuucucgauaucuuccccg

SEQ ID NO: 1845210 - RNA, 22 nt, Salmonella typhimurium LT2
uuuuucugucguguccuugcca

SEQ ID NO: 1845211 - RNA, 23 nt, Salmonella typhimurium LT2
uuuuucugucguguccuugccag

SEQ ID NO: 1845212 - RNA, 16 nt, Salmonella typhimurium LT2
uuuuucgaucagcaua

SEQ ID NO: 1845213 - RNA, 18 nt, Salmonella typhimurium LT2
uuuuucguaccguaaacc

SEQ ID NO: 1845214 - RNA, 19 nt, Salmonella typhimurium LT2
uuuuugaguuugucaucca

SEQ ID NO: 1845215 - RNA, 19 nt, Salmonella typhimurium LT2
aaauucacgcuucucuggc

SEQ ID NO: 1845216 - RNA, 14 nt, Salmonella typhimurium LT2
aaauuauuuuaaau

SEQ ID NO: 1845217 - RNA, 23 nt, Salmonella typhimurium LT2
aaauuauuccuugaucaggaaau

SEQ ID NO: 1845218 - RNA, 15 nt, Salmonella typhimurium LT2
aaauuauuuuaaauu

SEQ ID NO: 1845219 - RNA, 13 nt, Salmonella typhimurium LT2
aaauucagacugc

SEQ ID NO: 1845220 - RNA, 17 nt, Salmonella typhimurium LT2
aaauucuaugccaagcg

SEQ ID NO: 1845221 - RNA, 17 nt, Salmonella typhimurium LT2
aaauuccuuguuuuaac

SEQ ID NO: 1845222 - RNA, 12 nt, Salmonella typhimurium LT2
aaauucgaaaua

SEQ ID NO: 1845223 - RNA, 19 nt, Salmonella typhimurium LT2
aaauuccccauaaucgacc

SEQ ID NO: 1845224 - RNA, 10 nt, Salmonella typhimurium LT2
uuuuuuugca

SEQ ID NO: 1845225 - RNA, 12 nt, Salmonella typhimurium LT2
uuuuuucagccu

SEQ ID NO: 1845226 - RNA, 21 nt, Salmonella typhimurium LT2
uuuuuucuguuauuuccgcaa

SEQ ID NO: 1845227 - RNA, 15 nt, Salmonella typhimurium LT2
uuuuuucuccuucau

SEQ ID NO: 1845228 - RNA, 17 nt, Salmonella typhimurium LT2
aaauuauccguuuucag

SEQ ID NO: 1845229 - RNA, 21 nt, Salmonella typhimurium LT2
aaauuauccguuuucaguaaa

SEQ ID NO: 1845230 - RNA, 19 nt, Salmonella typhimurium LT2
aaauuauccacaaacucca

SEQ ID NO: 1845231 - RNA, 18 nt, Salmonella typhimurium LT2
aaauuauuggcuuuguaa

SEQ ID NO: 1845232 - RNA, 13 nt, Salmonella typhimurium LT2
aaauuauuuuaaa

SEQ ID NO: 1845233 - RNA, 14 nt, Salmonella typhimurium LT2
aaauuauuuaagcu

SEQ ID NO: 1845234 - RNA, 23 nt, Salmonella typhimurium LT2
aaauuauugugagaaaagcagag

SEQ ID NO: 1845235 - RNA, 15 nt, Salmonella typhimurium LT2
aauacacaaugcuuc

SEQ ID NO: 1845236 - RNA, 24 nt, Salmonella typhimurium LT2
aauacaauccgccgcaauagccaa

SEQ ID NO: 1845237 - RNA, 20 nt, Salmonella typhimurium LT2
aauaaaggcgcuguuggcau

SEQ ID NO: 1845238 - RNA, 15 nt, Salmonella typhimurium LT2
aauaaagccgcccau

SEQ ID NO: 1845239 - RNA, 15 nt, Salmonella typhimurium LT2
aauaaagacuggccc

SEQ ID NO: 1845240 - RNA, 22 nt, Salmonella typhimurium LT2
aauacacgcgacaaugccauaa

SEQ ID NO: 1845241 - RNA, 21 nt, Salmonella typhimurium LT2
aauacaggcguguggcauaaa

SEQ ID NO: 1845242 - RNA, 20 nt, Salmonella typhimurium LT2
aauacaguuuuccuucagca

SEQ ID NO: 1845243 - RNA, 14 nt, Salmonella typhimurium LT2
aauacaucuuccuc

SEQ ID NO: 1845244 - RNA, 16 nt, Salmonella typhimurium LT2
aauacauucaguacaa

SEQ ID NO: 1845245 - RNA, 19 nt, Salmonella typhimurium LT2
aauacucccggcgcuggac

SEQ ID NO: 1845246 - RNA, 18 nt, Salmonella typhimurium LT2
aauacguuuauucuuuuc

SEQ ID NO: 1845247 - RNA, 17 nt, Salmonella typhimurium LT2
aauacguuuauucuuuu

SEQ ID NO: 1845248 - RNA, 15 nt, Salmonella typhimurium LT2
aauacuuacuguuuc

SEQ ID NO: 1845249 - RNA, 18 nt, Salmonella typhimurium LT2
aauacuucgcucucuuuu

SEQ ID NO: 1845250 - RNA, 13 nt, Salmonella typhimurium LT2
aauacuucguuau

SEQ ID NO: 1845251 - RNA, 21 nt, Salmonella typhimurium LT2
aauacuucaaaugauuuuuau

SEQ ID NO: 1845252 - RNA, 16 nt, Salmonella typhimurium LT2
aauacgacucaauaca

SEQ ID NO: 1845253 - RNA, 20 nt, Salmonella typhimurium LT2
aauacgucgugacccacaca

SEQ ID NO: 1845254 - RNA, 18 nt, Salmonella typhimurium LT2
aauacguccauuugauga

SEQ ID NO: 1845255 - RNA, 21 nt, Salmonella typhimurium LT2
aauacccagcuuucucacuug

SEQ ID NO: 1845256 - RNA, 19 nt, Salmonella typhimurium LT2
aauaccagcaccugaauaa

SEQ ID NO: 1845257 - RNA, 14 nt, Salmonella typhimurium LT2
aauacgaaaauccu

SEQ ID NO: 1845258 - RNA, 19 nt, Salmonella typhimurium LT2
aauaccaggcggcuuuuuc

SEQ ID NO: 1845259 - RNA, 16 nt, Salmonella typhimurium LT2
aauaccagaaaucgcu

SEQ ID NO: 1845260 - RNA, 18 nt, Salmonella typhimurium LT2
aauaccagaaucaccgac

SEQ ID NO: 1845261 - RNA, 12 nt, Salmonella typhimurium LT2
aauaccagcccc

SEQ ID NO: 1845262 - RNA, 16 nt, Salmonella typhimurium LT2
aauagaguaaugacaa

SEQ ID NO: 1845263 - RNA, 17 nt, Salmonella typhimurium LT2
aauagaggaaauaacau

SEQ ID NO: 1845264 - RNA, 15 nt, Salmonella typhimurium LT2
aauagcggcuaauca

SEQ ID NO: 1845265 - RNA, 17 nt, Salmonella typhimurium LT2
aauagagagaaucgggu

SEQ ID NO: 1845266 - RNA, 22 nt, Salmonella typhimurium LT2
aauaguauggagcaggaaaaga

SEQ ID NO: 1845267 - RNA, 15 nt, Salmonella typhimurium LT2
aauaguagcugagag

SEQ ID NO: 1845268 - RNA, 20 nt, Salmonella typhimurium LT2
aauagcuuuuuacucagggc

SEQ ID NO: 1845269 - RNA, 18 nt, Salmonella typhimurium LT2
aauagcugccgcccggcg

SEQ ID NO: 1845270 - RNA, 14 nt, Salmonella typhimurium LT2
aauaucgucaguau

SEQ ID NO: 1845271 - RNA, 14 nt, Salmonella typhimurium LT2
aauaugaaagagaa

SEQ ID NO: 1845272 - RNA, 13 nt, Salmonella typhimurium LT2
aauaucuuuaugc

SEQ ID NO: 1845273 - RNA, 18 nt, Salmonella typhimurium LT2
aauaucgauagcauuuuu

SEQ ID NO: 1845274 - RNA, 20 nt, Salmonella typhimurium LT2
aauaucgaugcuuauuauuu

SEQ ID NO: 1845275 - RNA, 12 nt, Salmonella typhimurium LT2
aauauccuucag

SEQ ID NO: 1845276 - RNA, 21 nt, Salmonella typhimurium LT2
aauauccugccgcaacagaaa

SEQ ID NO: 1845277 - RNA, 16 nt, Salmonella typhimurium LT2
aauauaugaaccaaga

SEQ ID NO: 1845278 - RNA, 19 nt, Salmonella typhimurium LT2
aauaucaagaaaacugcca

SEQ ID NO: 1845279 - RNA, 15 nt, Salmonella typhimurium LT2
aauaugcaauuaaua

SEQ ID NO: 1845280 - RNA, 20 nt, Salmonella typhimurium LT2
aauaugcaauuaauauauuu

SEQ ID NO: 1845281 - RNA, 17 nt, Salmonella typhimurium LT2
aauauuaacggucuuuc

SEQ ID NO: 1845282 - RNA, 16 nt, Salmonella typhimurium LT2
aauauuaucagcaaua

SEQ ID NO: 1845283 - RNA, 22 nt, Salmonella typhimurium LT2
aauauuaaggccgaauuugaaa

SEQ ID NO: 1845284 - RNA, 12 nt, Salmonella typhimurium LT2
aauauuaccuuc

SEQ ID NO: 1845285 - RNA, 19 nt, Salmonella typhimurium LT2
aauauucagaauaugccag

SEQ ID NO: 1845286 - RNA, 17 nt, Salmonella typhimurium LT2
aauauucacacgaauuc

SEQ ID NO: 1845287 - RNA, 16 nt, Salmonella typhimurium LT2
aauauugaacauuuuu

SEQ ID NO: 1845288 - RNA, 17 nt, Salmonella typhimurium LT2
aauauucuggcuuucug

SEQ ID NO: 1845289 - RNA, 23 nt, Salmonella typhimurium LT2
aauauuuuguaggccuaaaaaua

SEQ ID NO: 1845290 - RNA, 11 nt, Salmonella typhimurium LT2
aaucaccugau

SEQ ID NO: 1845291 - RNA, 20 nt, Salmonella typhimurium LT2
aaucacguuuugcagcgcca

SEQ ID NO: 1845292 - RNA, 15 nt, Salmonella typhimurium LT2
aaucacgccgaugac

SEQ ID NO: 1845293 - RNA, 18 nt, Salmonella typhimurium LT2
aaucagauaguauuuccc

SEQ ID NO: 1845294 - RNA, 17 nt, Salmonella typhimurium LT2
aaucagauugccacagg

SEQ ID NO: 1845295 - RNA, 16 nt, Salmonella typhimurium LT2
aaucagcaacuuuucc

SEQ ID NO: 1845296 - RNA, 13 nt, Salmonella typhimurium LT2
aaucagaugcuca

SEQ ID NO: 1845297 - RNA, 15 nt, Salmonella typhimurium LT2
aaucagaugcugacu

SEQ ID NO: 1845298 - RNA, 18 nt, Salmonella typhimurium LT2
aaucagagacaaauacau

SEQ ID NO: 1845299 - RNA, 21 nt, Salmonella typhimurium LT2
aaucagacuaucuucgauaaa

SEQ ID NO: 1845300 - RNA, 18 nt, Salmonella typhimurium LT2
aaucagcaauuuuguuaa

SEQ ID NO: 1845301 - RNA, 20 nt, Salmonella typhimurium LT2
aaucagaugcgcuucagcga

SEQ ID NO: 1845302 - RNA, 20 nt, Salmonella typhimurium LT2
aaucagcgcggcaaggauaa

SEQ ID NO: 1845303 - RNA, 15 nt, Salmonella typhimurium LT2
aaucagcgcaauaaa

SEQ ID NO: 1845304 - RNA, 13 nt, Salmonella typhimurium LT2
aaucagcgccccc

SEQ ID NO: 1845305 - RNA, 16 nt, Salmonella typhimurium LT2
aaucagcucagcaaca

SEQ ID NO: 1845306 - RNA, 21 nt, Salmonella typhimurium LT2
aaucaguucucgguauccagc

SEQ ID NO: 1845307 - RNA, 11 nt, Salmonella typhimurium LT2
aaucaguucac

SEQ ID NO: 1845308 - RNA, 17 nt, Salmonella typhimurium LT2
aaucaucagcaucuuug

SEQ ID NO: 1845309 - RNA, 21 nt, Salmonella typhimurium LT2
aaucaucagaccgauaaauac

SEQ ID NO: 1845310 - RNA, 18 nt, Salmonella typhimurium LT2
aaucaacuccauaauuug

SEQ ID NO: 1845311 - RNA, 19 nt, Salmonella typhimurium LT2
aaucaacugcgccacauca

SEQ ID NO: 1845312 - RNA, 20 nt, Salmonella typhimurium LT2
aaucaacgccgccaggauaa

SEQ ID NO: 1845313 - RNA, 15 nt, Salmonella typhimurium LT2
aaucaauacugccau

SEQ ID NO: 1845314 - RNA, 17 nt, Salmonella typhimurium LT2
aaucaauuccuacaaug

SEQ ID NO: 1845315 - RNA, 18 nt, Salmonella typhimurium LT2
aaucacccacgucaguaa

SEQ ID NO: 1845316 - RNA, 20 nt, Salmonella typhimurium LT2
aaucacccacgucaguaaga

SEQ ID NO: 1845317 - RNA, 22 nt, Salmonella typhimurium LT2
aaucacccagaugcgaaucuuc

SEQ ID NO: 1845318 - RNA, 14 nt, Salmonella typhimurium LT2
aaucaccagcccga

SEQ ID NO: 1845319 - RNA, 20 nt, Salmonella typhimurium LT2
aaucacauacagcacuuccc

SEQ ID NO: 1845320 - RNA, 13 nt, Salmonella typhimurium LT2
aaucacauccgcc

SEQ ID NO: 1845321 - RNA, 20 nt, Salmonella typhimurium LT2
aaucacaaugucaucaagau

SEQ ID NO: 1845322 - RNA, 23 nt, Salmonella typhimurium LT2
aaucacacaagucaccguuuuuc

SEQ ID NO: 1845323 - RNA, 23 nt, Salmonella typhimurium LT2
aaucuucuucagcuuguggaaau

SEQ ID NO: 1845324 - RNA, 15 nt, Salmonella typhimurium LT2
aaucugccaucagca

SEQ ID NO: 1845325 - RNA, 16 nt, Salmonella typhimurium LT2
aaucuggauagucagg

SEQ ID NO: 1845326 - RNA, 17 nt, Salmonella typhimurium LT2
aaucuggcaguauaaga

SEQ ID NO: 1845327 - RNA, 23 nt, Salmonella typhimurium LT2
aaugacaaacgccaccgcuaccu

SEQ ID NO: 1845328 - RNA, 19 nt, Salmonella typhimurium LT2
aaugacauagugcaagaug

SEQ ID NO: 1845329 - RNA, 18 nt, Salmonella typhimurium LT2
aaugaagcggaaaggacg

SEQ ID NO: 1845330 - RNA, 16 nt, Salmonella typhimurium LT2
aaugaagcauaaaaag

SEQ ID NO: 1845331 - RNA, 21 nt, Salmonella typhimurium LT2
aaugaaggauuguacuuauua

SEQ ID NO: 1845332 - RNA, 23 nt, Salmonella typhimurium LT2
aaugaagguuagcgucugcggcu

SEQ ID NO: 1845333 - RNA, 17 nt, Salmonella typhimurium LT2
aaugauaucgcgccagg

SEQ ID NO: 1845334 - RNA, 20 nt, Salmonella typhimurium LT2
aaugaucagaacucacauau

SEQ ID NO: 1845335 - RNA, 20 nt, Salmonella typhimurium LT2
aaugcaauauuacaaagcag

SEQ ID NO: 1845336 - RNA, 14 nt, Salmonella typhimurium LT2
aaugauuaucuuuu

SEQ ID NO: 1845337 - RNA, 15 nt, Salmonella typhimurium LT2
aaugauaaugccgcu

SEQ ID NO: 1845338 - RNA, 14 nt, Salmonella typhimurium LT2
aaugagaaaaggaa

SEQ ID NO: 1845339 - RNA, 15 nt, Salmonella typhimurium LT2
aaugaguaaccagac

SEQ ID NO: 1845340 - RNA, 15 nt, Salmonella typhimurium LT2
aaugaccagaucaac

SEQ ID NO: 1845341 - RNA, 20 nt, Salmonella typhimurium LT2
aaucucaucugcaaaauaua

SEQ ID NO: 1845342 - RNA, 23 nt, Salmonella typhimurium LT2
aaucucagauaauagcugcggcu

SEQ ID NO: 1845343 - RNA, 22 nt, Salmonella typhimurium LT2
aaucucagauaauagcugcggc

SEQ ID NO: 1845344 - RNA, 17 nt, Salmonella typhimurium LT2
aaucucaagagugaaca

SEQ ID NO: 1845345 - RNA, 14 nt, Salmonella typhimurium LT2
aaucugacagauau

SEQ ID NO: 1845346 - RNA, 14 nt, Salmonella typhimurium LT2
aaucugaaauaaaa

SEQ ID NO: 1845347 - RNA, 19 nt, Salmonella typhimurium LT2
aaucugaauaucaagauaa

SEQ ID NO: 1845348 - RNA, 21 nt, Salmonella typhimurium LT2
aaucgaaucguucgccaguga

SEQ ID NO: 1845349 - RNA, 14 nt, Salmonella typhimurium LT2
aaucgauaagccag

SEQ ID NO: 1845350 - RNA, 16 nt, Salmonella typhimurium LT2
aaucgaacacauuucc

SEQ ID NO: 1845351 - RNA, 23 nt, Salmonella typhimurium LT2
aaucaucgacaguaccagcagaa

SEQ ID NO: 1845352 - RNA, 19 nt, Salmonella typhimurium LT2
aaucguucgccagugacaa

SEQ ID NO: 1845353 - RNA, 19 nt, Salmonella typhimurium LT2
aaucggaugccauguuucu

SEQ ID NO: 1845354 - RNA, 18 nt, Salmonella typhimurium LT2
aaucggcgucuggagcgu

SEQ ID NO: 1845355 - RNA, 19 nt, Salmonella typhimurium LT2
aaucgggaacagccacaau

SEQ ID NO: 1845356 - RNA, 19 nt, Salmonella typhimurium LT2
aaucgauagcgauuuuuga

SEQ ID NO: 1845357 - RNA, 15 nt, Salmonella typhimurium LT2
aaucgcaaacgccag

SEQ ID NO: 1845358 - RNA, 23 nt, Salmonella typhimurium LT2
aauuaagcgacccgauaaacacc

SEQ ID NO: 1845359 - RNA, 15 nt, Salmonella typhimurium LT2
aauuaacucaucaca

SEQ ID NO: 1845360 - RNA, 18 nt, Salmonella typhimurium LT2
aauuaacgacauuuuugc

SEQ ID NO: 1845361 - RNA, 17 nt, Salmonella typhimurium LT2
aauuacuuaugauauau

SEQ ID NO: 1845362 - RNA, 23 nt, Salmonella typhimurium LT2
aauuaccgguuucgguauuaagc

SEQ ID NO: 1845363 - RNA, 17 nt, Salmonella typhimurium LT2
aauuacaucaauaaaca

SEQ ID NO: 1845364 - RNA, 22 nt, Salmonella typhimurium LT2
aauuacaucaaaugaacacaaa

SEQ ID NO: 1845365 - RNA, 17 nt, Salmonella typhimurium LT2
aauuaaucacaauguca

SEQ ID NO: 1845366 - RNA, 18 nt, Salmonella typhimurium LT2
aauuaaaaagagaaaaaa

SEQ ID NO: 1845367 - RNA, 20 nt, Salmonella typhimurium LT2
aauguucauaucucaugcau

SEQ ID NO: 1845368 - RNA, 22 nt, Salmonella typhimurium LT2
aauguuagcauuauuuuuaacc

SEQ ID NO: 1845369 - RNA, 20 nt, Salmonella typhimurium LT2
aaugcucauuauuuggauua

SEQ ID NO: 1845370 - RNA, 13 nt, Salmonella typhimurium LT2
aaugcuauuugug

SEQ ID NO: 1845371 - RNA, 15 nt, Salmonella typhimurium LT2
aaugcccccucggca

SEQ ID NO: 1845372 - RNA, 21 nt, Salmonella typhimurium LT2
aaugccccgugacuuuccagu

SEQ ID NO: 1845373 - RNA, 13 nt, Salmonella typhimurium LT2
aaugcccacgccg

SEQ ID NO: 1845374 - RNA, 19 nt, Salmonella typhimurium LT2
aaugcccagcgcaaucacg

SEQ ID NO: 1845375 - RNA, 22 nt, Salmonella typhimurium LT2
aaugccauauacauauggauga

SEQ ID NO: 1845376 - RNA, 23 nt, Salmonella typhimurium LT2
aauggauucaugguacucaacau

SEQ ID NO: 1845377 - RNA, 15 nt, Salmonella typhimurium LT2
aauggcguugcuggc

SEQ ID NO: 1845378 - RNA, 23 nt, Salmonella typhimurium LT2
aauggcggcuucgccauccggua

SEQ ID NO: 1845379 - RNA, 20 nt, Salmonella typhimurium LT2
aauggcggagaucuccagau

SEQ ID NO: 1845380 - RNA, 18 nt, Salmonella typhimurium LT2
aaugcuggcggagccaaa

SEQ ID NO: 1845381 - RNA, 23 nt, Salmonella typhimurium LT2
aaugcuguuguagaaugaauuuc

SEQ ID NO: 1845382 - RNA, 20 nt, Salmonella typhimurium LT2
aaugcugcuuugaugcggca

SEQ ID NO: 1845383 - RNA, 14 nt, Salmonella typhimurium LT2
aauggucgcgccag

SEQ ID NO: 1845384 - RNA, 15 nt, Salmonella typhimurium LT2
aauguauuauuauuu

SEQ ID NO: 1845385 - RNA, 22 nt, Salmonella typhimurium LT2
aaugguauaugggcaauuauau

SEQ ID NO: 1845386 - RNA, 18 nt, Salmonella typhimurium LT2
aauggucccugauauaca

SEQ ID NO: 1845387 - RNA, 16 nt, Salmonella typhimurium LT2
aaugugauccgccccc

SEQ ID NO: 1845388 - RNA, 16 nt, Salmonella typhimurium LT2
aaugucgcgucagguu

SEQ ID NO: 1845389 - RNA, 16 nt, Salmonella typhimurium LT2
aaugucgcaaucggcu

SEQ ID NO: 1845390 - RNA, 21 nt, Salmonella typhimurium LT2
aaugucggccugauuucugac

SEQ ID NO: 1845391 - RNA, 21 nt, Salmonella typhimurium LT2
aaugucguuacggcugaagcu

SEQ ID NO: 1845392 - RNA, 15 nt, Salmonella typhimurium LT2
aaugucaugaagcuc

SEQ ID NO: 1845393 - RNA, 17 nt, Salmonella typhimurium LT2
aaugucaugaagcucaa

SEQ ID NO: 1845394 - RNA, 20 nt, Salmonella typhimurium LT2
aauguccagcagugucugcu

SEQ ID NO: 1845395 - RNA, 13 nt, Salmonella typhimurium LT2
aauguccccugac

SEQ ID NO: 1845396 - RNA, 13 nt, Salmonella typhimurium LT2
aaugucgaaacaa

SEQ ID NO: 1845397 - RNA, 21 nt, Salmonella typhimurium LT2
aagacccgacaguaaaaccca

SEQ ID NO: 1845398 - RNA, 22 nt, Salmonella typhimurium LT2
aagaccggcgguacgcugacga

SEQ ID NO: 1845399 - RNA, 15 nt, Salmonella typhimurium LT2
aagaccuccgcccgg

SEQ ID NO: 1845400 - RNA, 22 nt, Salmonella typhimurium LT2
aagacgaagccgaagcuaaucc

SEQ ID NO: 1845401 - RNA, 14 nt, Salmonella typhimurium LT2
aagaauuucaauca

SEQ ID NO: 1845402 - RNA, 18 nt, Salmonella typhimurium LT2
aagaauuucaaucaucau

SEQ ID NO: 1845403 - RNA, 20 nt, Salmonella typhimurium LT2
aagaauuugaacucuuucag

SEQ ID NO: 1845404 - RNA, 14 nt, Salmonella typhimurium LT2
aagaauucgcaaug

SEQ ID NO: 1845405 - RNA, 16 nt, Salmonella typhimurium LT2
aagacagcuuauacug

SEQ ID NO: 1845406 - RNA, 16 nt, Salmonella typhimurium LT2
aagacagaacuuggcu

SEQ ID NO: 1845407 - RNA, 16 nt, Salmonella typhimurium LT2
aagacaaaaauggaua

SEQ ID NO: 1845408 - RNA, 12 nt, Salmonella typhimurium LT2
aagaauaugaga

SEQ ID NO: 1845409 - RNA, 14 nt, Salmonella typhimurium LT2
aagaaucacgccga

SEQ ID NO: 1845410 - RNA, 15 nt, Salmonella typhimurium LT2
aagaaucgccaggcg

SEQ ID NO: 1845411 - RNA, 16 nt, Salmonella typhimurium LT2
aagaaucgccaggcgc

SEQ ID NO: 1845412 - RNA, 16 nt, Salmonella typhimurium LT2
aagaaugaaaaaaaau

SEQ ID NO: 1845413 - RNA, 17 nt, Salmonella typhimurium LT2
aagaauuauuaccaaug

SEQ ID NO: 1845414 - RNA, 20 nt, Salmonella typhimurium LT2
aaauucuuuacgcagcaaga

SEQ ID NO: 1845415 - RNA, 13 nt, Salmonella typhimurium LT2
aaauugaagaguu

SEQ ID NO: 1845416 - RNA, 17 nt, Salmonella typhimurium LT2
aagaauaccuaucggcu

SEQ ID NO: 1845417 - RNA, 15 nt, Salmonella typhimurium LT2
aagagagccuuauag

SEQ ID NO: 1845418 - RNA, 22 nt, Salmonella typhimurium LT2
aagagaggcuuuaugcugacaa

SEQ ID NO: 1845419 - RNA, 21 nt, Salmonella typhimurium LT2
aagagagcaacauaccgcaga

SEQ ID NO: 1845420 - RNA, 19 nt, Salmonella typhimurium LT2
aagagauggaaugagcauc

SEQ ID NO: 1845421 - RNA, 15 nt, Salmonella typhimurium LT2
aagacuacgcaaaaa

SEQ ID NO: 1845422 - RNA, 19 nt, Salmonella typhimurium LT2
aagacggcuuuugguuccu

SEQ ID NO: 1845423 - RNA, 19 nt, Salmonella typhimurium LT2
aagacgcucgacguccagc

SEQ ID NO: 1845424 - RNA, 22 nt, Salmonella typhimurium LT2
aagacggaaaccagauaccccg

SEQ ID NO: 1845425 - RNA, 21 nt, Salmonella typhimurium LT2
aagacgcauuaacggcaauau

SEQ ID NO: 1845426 - RNA, 19 nt, Salmonella typhimurium LT2
aagacuauccagccaggga

SEQ ID NO: 1845427 - RNA, 14 nt, Salmonella typhimurium LT2
aagacuccccugca

SEQ ID NO: 1845428 - RNA, 12 nt, Salmonella typhimurium LT2
aagaggcagcaa

SEQ ID NO: 1845429 - RNA, 15 nt, Salmonella typhimurium LT2
aagagguauccugaa

SEQ ID NO: 1845430 - RNA, 18 nt, Salmonella typhimurium LT2
aagagggagagagccugu

SEQ ID NO: 1845431 - RNA, 23 nt, Salmonella typhimurium LT2
aagagcgacgaguuguuucaaca

SEQ ID NO: 1845432 - RNA, 16 nt, Salmonella typhimurium LT2
aagauaaacagcagcg

SEQ ID NO: 1845433 - RNA, 15 nt, Salmonella typhimurium LT2
aagauaaaaagacag

SEQ ID NO: 1845434 - RNA, 18 nt, Salmonella typhimurium LT2
aagaguuguugaccaaca

SEQ ID NO: 1845435 - RNA, 20 nt, Salmonella typhimurium LT2
aagaguucaacgccgaacag

SEQ ID NO: 1845436 - RNA, 14 nt, Salmonella typhimurium LT2
aagauaagaaguaa

SEQ ID NO: 1845437 - RNA, 19 nt, Salmonella typhimurium LT2
aagagugacgguuuucacu

SEQ ID NO: 1845438 - RNA, 11 nt, Salmonella typhimurium LT2
aagaguuaacu

SEQ ID NO: 1845439 - RNA, 22 nt, Salmonella typhimurium LT2
aagagugaacacguaauucauu

SEQ ID NO: 1845440 - RNA, 21 nt, Salmonella typhimurium LT2
aagaguaucucucuggcgcau

SEQ ID NO: 1845441 - RNA, 22 nt, Salmonella typhimurium LT2
aagcaauauggcugcgacaaug

SEQ ID NO: 1845442 - RNA, 15 nt, Salmonella typhimurium LT2
aagcaaucgccagcg

SEQ ID NO: 1845443 - RNA, 22 nt, Salmonella typhimurium LT2
aagcaauuacggacagaaaaaa

SEQ ID NO: 1845444 - RNA, 20 nt, Salmonella typhimurium LT2
aagcaacugauuaaucugcc

SEQ ID NO: 1845445 - RNA, 17 nt, Salmonella typhimurium LT2
aagcaacaugaaaggga

SEQ ID NO: 1845446 - RNA, 14 nt, Salmonella typhimurium LT2
aagcaagugcugga

SEQ ID NO: 1845447 - RNA, 20 nt, Salmonella typhimurium LT2
aagcaaagcgccauccggca

SEQ ID NO: 1845448 - RNA, 15 nt, Salmonella typhimurium LT2
aagauuuuuauuaaa

SEQ ID NO: 1845449 - RNA, 20 nt, Salmonella typhimurium LT2
aagcaaaaaaugacacccag

SEQ ID NO: 1845450 - RNA, 18 nt, Salmonella typhimurium LT2
aagcaaaccuauuucagu

SEQ ID NO: 1845451 - RNA, 14 nt, Salmonella typhimurium LT2
aagcaccgccagcg

SEQ ID NO: 1845452 - RNA, 20 nt, Salmonella typhimurium LT2
aagcacccaugaagauguag

SEQ ID NO: 1845453 - RNA, 20 nt, Salmonella typhimurium LT2
aagcacauagcugagacuca

SEQ ID NO: 1845454 - RNA, 13 nt, Salmonella typhimurium LT2
aagcacagcccca

SEQ ID NO: 1845455 - RNA, 19 nt, Salmonella typhimurium LT2
aagcacucguaagaggcgu

SEQ ID NO: 1845456 - RNA, 19 nt, Salmonella typhimurium LT2
aagcaccuagguuccagcu

SEQ ID NO: 1845457 - RNA, 23 nt, Salmonella typhimurium LT2
aagcacuagucaggcacaaaaaa

SEQ ID NO: 1845458 - RNA, 17 nt, Salmonella typhimurium LT2
aagcacuauuauauuuu

SEQ ID NO: 1845459 - RNA, 13 nt, Salmonella typhimurium LT2
aagcauuagcgcc

SEQ ID NO: 1845460 - RNA, 12 nt, Salmonella typhimurium LT2
aagcauucagau

SEQ ID NO: 1845461 - RNA, 20 nt, Salmonella typhimurium LT2
aagcaugguuaacuccuucu

SEQ ID NO: 1845462 - RNA, 16 nt, Salmonella typhimurium LT2
aagcaugauaccgaua

SEQ ID NO: 1845463 - RNA, 18 nt, Salmonella typhimurium LT2
aagcauugccguuuucaa

SEQ ID NO: 1845464 - RNA, 18 nt, Salmonella typhimurium LT2
aagcauugugcagccaug

SEQ ID NO: 1845465 - RNA, 19 nt, Salmonella typhimurium LT2
aagcauagcgucaucaaca

SEQ ID NO: 1845466 - RNA, 19 nt, Salmonella typhimurium LT2
aagcauagcgccaucagac

SEQ ID NO: 1845467 - RNA, 15 nt, Salmonella typhimurium LT2
aagcauccguuuccc

SEQ ID NO: 1845468 - RNA, 23 nt, Salmonella typhimurium LT2
aagcagguagcgccuuuacuggu

SEQ ID NO: 1845469 - RNA, 16 nt, Salmonella typhimurium LT2
aagcagcuugcugcuu

SEQ ID NO: 1845470 - RNA, 19 nt, Salmonella typhimurium LT2
aagcagguguuauuuuugu

SEQ ID NO: 1845471 - RNA, 21 nt, Salmonella typhimurium LT2
aagcagguguuauuuuuguau

SEQ ID NO: 1845472 - RNA, 18 nt, Salmonella typhimurium LT2
aagcaggcgggacgccau

SEQ ID NO: 1845473 - RNA, 15 nt, Salmonella typhimurium LT2
aagcagugaaucccc

SEQ ID NO: 1845474 - RNA, 15 nt, Salmonella typhimurium LT2
aagcaguuccagcau

SEQ ID NO: 1845475 - RNA, 16 nt, Salmonella typhimurium LT2
aagcaguuccagcauc

SEQ ID NO: 1845476 - RNA, 15 nt, Salmonella typhimurium LT2
aagcagcgacaauau

SEQ ID NO: 1845477 - RNA, 12 nt, Salmonella typhimurium LT2
aagcagcgacaa

SEQ ID NO: 1845478 - RNA, 23 nt, Salmonella typhimurium LT2
aagcagcugcuuaacuucugcag

SEQ ID NO: 1845479 - RNA, 12 nt, Salmonella typhimurium LT2
aagcagcuugcu

SEQ ID NO: 1845480 - RNA, 20 nt, Salmonella typhimurium LT2
aagauacauaucauuauguc

SEQ ID NO: 1845481 - RNA, 17 nt, Salmonella typhimurium LT2
aagauccgggcuggcaa

SEQ ID NO: 1845482 - RNA, 18 nt, Salmonella typhimurium LT2
aagaucgccaagcuguga

SEQ ID NO: 1845483 - RNA, 21 nt, Salmonella typhimurium LT2
aagaucgcauuuaaucgccug

SEQ ID NO: 1845484 - RNA, 20 nt, Salmonella typhimurium LT2
aagaucgcaggccaaaaaaa

SEQ ID NO: 1845485 - RNA, 22 nt, Salmonella typhimurium LT2
aagauauuuuguuuuaaauuca

SEQ ID NO: 1845486 - RNA, 11 nt, Salmonella typhimurium LT2
aagaucaggag

SEQ ID NO: 1845487 - RNA, 19 nt, Salmonella typhimurium LT2
aagaucaggaguaaauaac

SEQ ID NO: 1845488 - RNA, 16 nt, Salmonella typhimurium LT2
aagaucguuauccagc

SEQ ID NO: 1845489 - RNA, 22 nt, Salmonella typhimurium LT2
aagaucggagauauaaaccuga

SEQ ID NO: 1845490 - RNA, 19 nt, Salmonella typhimurium LT2
aagaucgcgaggcaacaga

SEQ ID NO: 1845491 - RNA, 23 nt, Salmonella typhimurium LT2
aagaucgcgaggcaacagauacg

SEQ ID NO: 1845492 - RNA, 17 nt, Salmonella typhimurium LT2
aagaucuggcgaaagua

SEQ ID NO: 1845493 - RNA, 16 nt, Salmonella typhimurium LT2
aagauuaaccagcagu

SEQ ID NO: 1845494 - RNA, 17 nt, Salmonella typhimurium LT2
aagauuacaccacuuuu

SEQ ID NO: 1845495 - RNA, 19 nt, Salmonella typhimurium LT2
aagauuagccguugaguuu

SEQ ID NO: 1845496 - RNA, 22 nt, Salmonella typhimurium LT2
aagauuacucccuugccagcgc

SEQ ID NO: 1845497 - RNA, 15 nt, Salmonella typhimurium LT2
aagauguagucgccu

SEQ ID NO: 1845498 - RNA, 22 nt, Salmonella typhimurium LT2
aagauuagcguuuuuaucuuuu

SEQ ID NO: 1845499 - RNA, 18 nt, Salmonella typhimurium LT2
aaguuuuuuuaaaaaacc

SEQ ID NO: 1845500 - RNA, 20 nt, Salmonella typhimurium LT2
aauaaaaaacaagauuaauu

SEQ ID NO: 1845501 - RNA, 13 nt, Salmonella typhimurium LT2
aauaaaaaauucc

SEQ ID NO: 1845502 - RNA, 13 nt, Salmonella typhimurium LT2
aauaaaaaccauu

SEQ ID NO: 1845503 - RNA, 16 nt, Salmonella typhimurium LT2
aauaaaaaccauuuau

SEQ ID NO: 1845504 - RNA, 19 nt, Salmonella typhimurium LT2
aauaaaaaccauuuauaaa

SEQ ID NO: 1845505 - RNA, 22 nt, Salmonella typhimurium LT2
aauaaacgccaguggaugcgcu

SEQ ID NO: 1845506 - RNA, 20 nt, Salmonella typhimurium LT2
aauaaacauuuuuuuugcau

SEQ ID NO: 1845507 - RNA, 13 nt, Salmonella typhimurium LT2
aauaaaauaacua

SEQ ID NO: 1845508 - RNA, 20 nt, Salmonella typhimurium LT2
aauaaaauauccuccaccuc

SEQ ID NO: 1845509 - RNA, 13 nt, Salmonella typhimurium LT2
aauaaaauauuau

SEQ ID NO: 1845510 - RNA, 13 nt, Salmonella typhimurium LT2
aaguuuaugguaa

SEQ ID NO: 1845511 - RNA, 10 nt, Salmonella typhimurium LT2
aagucccccc

SEQ ID NO: 1845512 - RNA, 15 nt, Salmonella typhimurium LT2
aagucccagaaagua

SEQ ID NO: 1845513 - RNA, 14 nt, Salmonella typhimurium LT2
aagucagcuuuuag

SEQ ID NO: 1845514 - RNA, 23 nt, Salmonella typhimurium LT2
aaguaaggcugauuauauaacac

SEQ ID NO: 1845515 - RNA, 12 nt, Salmonella typhimurium LT2
aaguaauaaaaa

SEQ ID NO: 1845516 - RNA, 12 nt, Salmonella typhimurium LT2
aagucagacaag

SEQ ID NO: 1845517 - RNA, 22 nt, Salmonella typhimurium LT2
aagucaccuuagcgaaauguuc

SEQ ID NO: 1845518 - RNA, 22 nt, Salmonella typhimurium LT2
aaguuaaucagcgcugucgcca

SEQ ID NO: 1845519 - RNA, 16 nt, Salmonella typhimurium LT2
aaguuacuaaaaguaa

SEQ ID NO: 1845520 - RNA, 12 nt, Salmonella typhimurium LT2
aaguuaaacgga

SEQ ID NO: 1845521 - RNA, 22 nt, Salmonella typhimurium LT2
aaguguguaccagcaacgccag

SEQ ID NO: 1845522 - RNA, 15 nt, Salmonella typhimurium LT2
aagugccagcacuaa

SEQ ID NO: 1845523 - RNA, 19 nt, Salmonella typhimurium LT2
aagugcaggauagaaaaca

SEQ ID NO: 1845524 - RNA, 16 nt, Salmonella typhimurium LT2
aagcucccggggauuu

SEQ ID NO: 1845525 - RNA, 23 nt, Salmonella typhimurium LT2
aagcucugcgguaacaaucucuu

SEQ ID NO: 1845526 - RNA, 20 nt, Salmonella typhimurium LT2
aagcuauccucuuuuaucac

SEQ ID NO: 1845527 - RNA, 19 nt, Salmonella typhimurium LT2
aagcguuacggaaaaaaua

SEQ ID NO: 1845528 - RNA, 22 nt, Salmonella typhimurium LT2
aagcuacaggucgacgugaacu

SEQ ID NO: 1845529 - RNA, 17 nt, Salmonella typhimurium LT2
aagccaauacucagggu

SEQ ID NO: 1845530 - RNA, 21 nt, Salmonella typhimurium LT2
aagccaacgcagucaaaacga

SEQ ID NO: 1845531 - RNA, 16 nt, Salmonella typhimurium LT2
aagcggaccaaugcug

SEQ ID NO: 1845532 - RNA, 18 nt, Salmonella typhimurium LT2
aagcgcuuuggucaggcu

SEQ ID NO: 1845533 - RNA, 13 nt, Salmonella typhimurium LT2
aagcggcacugcu

SEQ ID NO: 1845534 - RNA, 21 nt, Salmonella typhimurium LT2
aagcggcacugcucuuuaaca

SEQ ID NO: 1845535 - RNA, 15 nt, Salmonella typhimurium LT2
aagcgucaggcgaag

SEQ ID NO: 1845536 - RNA, 14 nt, Salmonella typhimurium LT2
aaggacaagcugcg

SEQ ID NO: 1845537 - RNA, 17 nt, Salmonella typhimurium LT2
aagcuuugcguaaaaaa

SEQ ID NO: 1845538 - RNA, 18 nt, Salmonella typhimurium LT2
aagcuuugcguaaaaaaa

SEQ ID NO: 1845539 - RNA, 20 nt, Salmonella typhimurium LT2
aagcuuugcguaaaaaaaca

SEQ ID NO: 1845540 - RNA, 14 nt, Salmonella typhimurium LT2
aagcugcaaccagc

SEQ ID NO: 1845541 - RNA, 15 nt, Salmonella typhimurium LT2
aagcugcggcccaga

SEQ ID NO: 1845542 - RNA, 24 nt, Salmonella typhimurium LT2
aagcugcgccacgcgcucgugcaa

SEQ ID NO: 1845543 - RNA, 17 nt, Salmonella typhimurium LT2
aagcugcgccauacccc

SEQ ID NO: 1845544 - RNA, 23 nt, Salmonella typhimurium LT2
aagcuguuaauuugcaucaggcc

SEQ ID NO: 1845545 - RNA, 20 nt, Salmonella typhimurium LT2
aagcuguuccggcuucguua

SEQ ID NO: 1845546 - RNA, 23 nt, Salmonella typhimurium LT2
aaggcugauuauauaacacgauu

SEQ ID NO: 1845547 - RNA, 22 nt, Salmonella typhimurium LT2
aaggcgcuugugauaucugacu

SEQ ID NO: 1845548 - RNA, 17 nt, Salmonella typhimurium LT2
aaggcggaaaucagcac

SEQ ID NO: 1845549 - RNA, 17 nt, Salmonella typhimurium LT2
aaggcuggcacguucuc

SEQ ID NO: 1845550 - RNA, 13 nt, Salmonella typhimurium LT2
aaggcuugacuca

SEQ ID NO: 1845551 - RNA, 20 nt, Salmonella typhimurium LT2
aaggcuugacucaaaaagag

SEQ ID NO: 1845552 - RNA, 13 nt, Salmonella typhimurium LT2
aaggcuugguugu

SEQ ID NO: 1845553 - RNA, 13 nt, Salmonella typhimurium LT2
aagguaaaaguag

SEQ ID NO: 1845554 - RNA, 13 nt, Salmonella typhimurium LT2
aaggugagaaaaa

SEQ ID NO: 1845555 - RNA, 17 nt, Salmonella typhimurium LT2
aagguaacgcgaaaaaa

SEQ ID NO: 1845556 - RNA, 14 nt, Salmonella typhimurium LT2
aagguaauaauccu

SEQ ID NO: 1845557 - RNA, 15 nt, Salmonella typhimurium LT2
aagguagccacgccc

SEQ ID NO: 1845558 - RNA, 19 nt, Salmonella typhimurium LT2
aagguugccugccagagga

SEQ ID NO: 1845559 - RNA, 23 nt, Salmonella typhimurium LT2
aagguugccaaaaaaucagcaau

SEQ ID NO: 1845560 - RNA, 14 nt, Salmonella typhimurium LT2
aaggugagaaaaag

SEQ ID NO: 1845561 - RNA, 18 nt, Salmonella typhimurium LT2
aaggcagaagaaucugcc

SEQ ID NO: 1845562 - RNA, 11 nt, Salmonella typhimurium LT2
aaggccagacu

SEQ ID NO: 1845563 - RNA, 20 nt, Salmonella typhimurium LT2
aaggcauuucuaccggcaga

SEQ ID NO: 1845564 - RNA, 15 nt, Salmonella typhimurium LT2
aaggcaucuucagac

SEQ ID NO: 1845565 - RNA, 20 nt, Salmonella typhimurium LT2
aaggcaucuucagacaguuu

SEQ ID NO: 1845566 - RNA, 17 nt, Salmonella typhimurium LT2
aaggcaccgguuuuuga

SEQ ID NO: 1845567 - RNA, 15 nt, Salmonella typhimurium LT2
aaggcgcuagccgca

SEQ ID NO: 1845568 - RNA, 22 nt, Salmonella typhimurium LT2
aaggcgacgaugugcauaaccg

SEQ ID NO: 1845569 - RNA, 18 nt, Salmonella typhimurium LT2
aaggccgggaaaucuucu

SEQ ID NO: 1845570 - RNA, 22 nt, Salmonella typhimurium LT2
aaggccagacucaucgccgcaa

SEQ ID NO: 1845571 - RNA, 21 nt, Salmonella typhimurium LT2
aaggcccggugugccgcuugc

SEQ ID NO: 1845572 - RNA, 24 nt, Salmonella typhimurium LT2
aaggcccggugugccgcuugccag

SEQ ID NO: 1845573 - RNA, 21 nt, Salmonella typhimurium LT2
acaaaucggcuccggcaaaau

SEQ ID NO: 1845574 - RNA, 20 nt, Salmonella typhimurium LT2
acaaaugaccucaagaauau

SEQ ID NO: 1845575 - RNA, 15 nt, Salmonella typhimurium LT2
acaaauccaaucuga

SEQ ID NO: 1845576 - RNA, 16 nt, Salmonella typhimurium LT2
acaaauccaaucugac

SEQ ID NO: 1845577 - RNA, 23 nt, Salmonella typhimurium LT2
acaaauagaagccacaaucugau

SEQ ID NO: 1845578 - RNA, 13 nt, Salmonella typhimurium LT2
acaaauaaaucca

SEQ ID NO: 1845579 - RNA, 13 nt, Salmonella typhimurium LT2
acaaauaaaauaa

SEQ ID NO: 1845580 - RNA, 19 nt, Salmonella typhimurium LT2
acaaauaaaauaagcaauu

SEQ ID NO: 1845581 - RNA, 16 nt, Salmonella typhimurium LT2
acaacaagaauauauu

SEQ ID NO: 1845582 - RNA, 19 nt, Salmonella typhimurium LT2
acaaauuucgagcagaacu

SEQ ID NO: 1845583 - RNA, 19 nt, Salmonella typhimurium LT2
acaaauuccggcacaaccu

SEQ ID NO: 1845584 - RNA, 13 nt, Salmonella typhimurium LT2
acaaauuauaaac

SEQ ID NO: 1845585 - RNA, 15 nt, Salmonella typhimurium LT2
acaaauuauaaacua

SEQ ID NO: 1845586 - RNA, 21 nt, Salmonella typhimurium LT2
acaaauuacacaauaucaaua

SEQ ID NO: 1845587 - RNA, 13 nt, Salmonella typhimurium LT2
acaaagguaaacg

SEQ ID NO: 1845588 - RNA, 18 nt, Salmonella typhimurium LT2
acaaaggaucauuggcca

SEQ ID NO: 1845589 - RNA, 21 nt, Salmonella typhimurium LT2
acaaagcguucggccugcugc

SEQ ID NO: 1845590 - RNA, 14 nt, Salmonella typhimurium LT2
acaaagccggauau

SEQ ID NO: 1845591 - RNA, 16 nt, Salmonella typhimurium LT2
acaaagagcuccccac

SEQ ID NO: 1845592 - RNA, 13 nt, Salmonella typhimurium LT2
acaaagaggcugc

SEQ ID NO: 1845593 - RNA, 15 nt, Salmonella typhimurium LT2
acaaacuccagcacg

SEQ ID NO: 1845594 - RNA, 22 nt, Salmonella typhimurium LT2
acaaacgccgucacaaagccca

SEQ ID NO: 1845595 - RNA, 16 nt, Salmonella typhimurium LT2
acaaacuuaauuauua

SEQ ID NO: 1845596 - RNA, 18 nt, Salmonella typhimurium LT2
acaaaccccacccgcuga

SEQ ID NO: 1845597 - RNA, 16 nt, Salmonella typhimurium LT2
acaaaccacugcugua

SEQ ID NO: 1845598 - RNA, 17 nt, Salmonella typhimurium LT2
acaaacauuagcggugc

SEQ ID NO: 1845599 - RNA, 23 nt, Salmonella typhimurium LT2
acaaacagcgccccgacaaaacg

SEQ ID NO: 1845600 - RNA, 15 nt, Salmonella typhimurium LT2
acaagcuaaucccca

SEQ ID NO: 1845601 - RNA, 17 nt, Salmonella typhimurium LT2
acaagccgauaucgacc

SEQ ID NO: 1845602 - RNA, 21 nt, Salmonella typhimurium LT2
acaagauuaauuuaauugaua

SEQ ID NO: 1845603 - RNA, 19 nt, Salmonella typhimurium LT2
acaagauucacucugaaaa

SEQ ID NO: 1845604 - RNA, 21 nt, Salmonella typhimurium LT2
acaagcaaaccuauuucagua

SEQ ID NO: 1845605 - RNA, 21 nt, Salmonella typhimurium LT2
acaagaauuuaucgcaauaua

SEQ ID NO: 1845606 - RNA, 23 nt, Salmonella typhimurium LT2
acaagaaggccucuauccggagg

SEQ ID NO: 1845607 - RNA, 19 nt, Salmonella typhimurium LT2
acaacuucuaauuuuucca

SEQ ID NO: 1845608 - RNA, 21 nt, Salmonella typhimurium LT2
acaacuucuaauuuuuccagc

SEQ ID NO: 1845609 - RNA, 12 nt, Salmonella typhimurium LT2
acaacuccagca

SEQ ID NO: 1845610 - RNA, 14 nt, Salmonella typhimurium LT2
acaacuagcaaaac

SEQ ID NO: 1845611 - RNA, 15 nt, Salmonella typhimurium LT2
acaacuagcaaaaca

SEQ ID NO: 1845612 - RNA, 17 nt, Salmonella typhimurium LT2
acaacucuauuaaaaua

SEQ ID NO: 1845613 - RNA, 19 nt, Salmonella typhimurium LT2
acaacgucaguggaaaaca

SEQ ID NO: 1845614 - RNA, 15 nt, Salmonella typhimurium LT2
acaacguuacgccag

SEQ ID NO: 1845615 - RNA, 19 nt, Salmonella typhimurium LT2
acaacguaauauuaagcag

SEQ ID NO: 1845616 - RNA, 17 nt, Salmonella typhimurium LT2
acaacggcgaccuucac

SEQ ID NO: 1845617 - RNA, 21 nt, Salmonella typhimurium LT2
acaacgccgguacgcagcagg

SEQ ID NO: 1845618 - RNA, 13 nt, Salmonella typhimurium LT2
acaaccugcccuu

SEQ ID NO: 1845619 - RNA, 17 nt, Salmonella typhimurium LT2
acaaccgcccccaacug

SEQ ID NO: 1845620 - RNA, 15 nt, Salmonella typhimurium LT2
acaacauuguuacgu

SEQ ID NO: 1845621 - RNA, 23 nt, Salmonella typhimurium LT2
acaaccaggauucaacgcgugau

SEQ ID NO: 1845622 - RNA, 22 nt, Salmonella typhimurium LT2
acaaccagcagggcaauagcga

SEQ ID NO: 1845623 - RNA, 15 nt, Salmonella typhimurium LT2
aauuuucauuauaaa

SEQ ID NO: 1845624 - RNA, 19 nt, Salmonella typhimurium LT2
aauuuuccccgaugccauu

SEQ ID NO: 1845625 - RNA, 15 nt, Salmonella typhimurium LT2
aauuuugcauaaaua

SEQ ID NO: 1845626 - RNA, 11 nt, Salmonella typhimurium LT2
aauuuugauaa

SEQ ID NO: 1845627 - RNA, 17 nt, Salmonella typhimurium LT2
aauuuucgcucaacaaa

SEQ ID NO: 1845628 - RNA, 16 nt, Salmonella typhimurium LT2
acaaaaaaaccgcuca

SEQ ID NO: 1845629 - RNA, 13 nt, Salmonella typhimurium LT2
aauuuuuccuuca

SEQ ID NO: 1845630 - RNA, 15 nt, Salmonella typhimurium LT2
acaaaaauuaaaaca

SEQ ID NO: 1845631 - RNA, 18 nt, Salmonella typhimurium LT2
acaaaaaaacggccucaa

SEQ ID NO: 1845632 - RNA, 15 nt, Salmonella typhimurium LT2
acaaaaaaaucccaa

SEQ ID NO: 1845633 - RNA, 21 nt, Salmonella typhimurium LT2
acaaaaagcgcgccgaaaaua

SEQ ID NO: 1845634 - RNA, 19 nt, Salmonella typhimurium LT2
acaaacaaauaaauccaug

SEQ ID NO: 1845635 - RNA, 19 nt, Salmonella typhimurium LT2
acaaacaccaccaguaacc

SEQ ID NO: 1845636 - RNA, 15 nt, Salmonella typhimurium LT2
aauuuuaauuuaaua

SEQ ID NO: 1845637 - RNA, 21 nt, Salmonella typhimurium LT2
aauuuuacuuucauuccuuua

SEQ ID NO: 1845638 - RNA, 17 nt, Salmonella typhimurium LT2
aauuugucgauaagcau

SEQ ID NO: 1845639 - RNA, 17 nt, Salmonella typhimurium LT2
aauuucuuccauuagcu

SEQ ID NO: 1845640 - RNA, 16 nt, Salmonella typhimurium LT2
aauuucuugaucaauc

SEQ ID NO: 1845641 - RNA, 14 nt, Salmonella typhimurium LT2
aauuucucgcccgc

SEQ ID NO: 1845642 - RNA, 18 nt, Salmonella typhimurium LT2
aauuucguuuuacccaua

SEQ ID NO: 1845643 - RNA, 15 nt, Salmonella typhimurium LT2
aauuucuacugauuu

SEQ ID NO: 1845644 - RNA, 23 nt, Salmonella typhimurium LT2
aauuuccucuugucaggcagaaa

SEQ ID NO: 1845645 - RNA, 22 nt, Salmonella typhimurium LT2
aauuuccgcacgcgcgcccaug

SEQ ID NO: 1845646 - RNA, 14 nt, Salmonella typhimurium LT2
aauuagagccaaua

SEQ ID NO: 1845647 - RNA, 15 nt, Salmonella typhimurium LT2
acaauuugcccagcg

SEQ ID NO: 1845648 - RNA, 16 nt, Salmonella typhimurium LT2
acaauuugaauuaccc

SEQ ID NO: 1845649 - RNA, 17 nt, Salmonella typhimurium LT2
acaauuccggcccaggc

SEQ ID NO: 1845650 - RNA, 11 nt, Salmonella typhimurium LT2
acaauuauaua

SEQ ID NO: 1845651 - RNA, 21 nt, Salmonella typhimurium LT2
acaauuacgcaagagagcaac

SEQ ID NO: 1845652 - RNA, 17 nt, Salmonella typhimurium LT2
acaauggucagcgccgc

SEQ ID NO: 1845653 - RNA, 16 nt, Salmonella typhimurium LT2
acaaugccauaaagcg

SEQ ID NO: 1845654 - RNA, 18 nt, Salmonella typhimurium LT2
acaaugccauuuuugcau

SEQ ID NO: 1845655 - RNA, 14 nt, Salmonella typhimurium LT2
acacauagauaaaa

SEQ ID NO: 1845656 - RNA, 14 nt, Salmonella typhimurium LT2
acacaucaccucca

SEQ ID NO: 1845657 - RNA, 15 nt, Salmonella typhimurium LT2
acacaucaccuccag

SEQ ID NO: 1845658 - RNA, 17 nt, Salmonella typhimurium LT2
acacauaacgcccgaca

SEQ ID NO: 1845659 - RNA, 15 nt, Salmonella typhimurium LT2
acacaggccugcauu

SEQ ID NO: 1845660 - RNA, 20 nt, Salmonella typhimurium LT2
acacagcucaauaucauagu

SEQ ID NO: 1845661 - RNA, 21 nt, Salmonella typhimurium LT2
acacacucggugcauuugucg

SEQ ID NO: 1845662 - RNA, 14 nt, Salmonella typhimurium LT2
acacaccagcagga

SEQ ID NO: 1845663 - RNA, 22 nt, Salmonella typhimurium LT2
acacacaguugccuucgauuaa

SEQ ID NO: 1845664 - RNA, 15 nt, Salmonella typhimurium LT2
acacaauugccaugg

SEQ ID NO: 1845665 - RNA, 22 nt, Salmonella typhimurium LT2
acacagacuuugcacagucugc

SEQ ID NO: 1845666 - RNA, 12 nt, Salmonella typhimurium LT2
acacagaauuac

SEQ ID NO: 1845667 - RNA, 18 nt, Salmonella typhimurium LT2
acaagcugcgccauaccc

SEQ ID NO: 1845668 - RNA, 20 nt, Salmonella typhimurium LT2
acaaggcgcuauccugguag

SEQ ID NO: 1845669 - RNA, 17 nt, Salmonella typhimurium LT2
acaaggcuuuuggcuua

SEQ ID NO: 1845670 - RNA, 16 nt, Salmonella typhimurium LT2
acaaggcuuuuggcuu

SEQ ID NO: 1845671 - RNA, 20 nt, Salmonella typhimurium LT2
acaaguaggccggauaaggu

SEQ ID NO: 1845672 - RNA, 12 nt, Salmonella typhimurium LT2
acaauaccaaua

SEQ ID NO: 1845673 - RNA, 22 nt, Salmonella typhimurium LT2
acaauaaucgcgagaaaauaga

SEQ ID NO: 1845674 - RNA, 16 nt, Salmonella typhimurium LT2
acaauacuucaaauga

SEQ ID NO: 1845675 - RNA, 19 nt, Salmonella typhimurium LT2
acaauaccguuuggaucug

SEQ ID NO: 1845676 - RNA, 14 nt, Salmonella typhimurium LT2
acaauacgccgagc

SEQ ID NO: 1845677 - RNA, 17 nt, Salmonella typhimurium LT2
acaauaccaauaagaac

SEQ ID NO: 1845678 - RNA, 13 nt, Salmonella typhimurium LT2
acaauaaaaaugc

SEQ ID NO: 1845679 - RNA, 21 nt, Salmonella typhimurium LT2
acaauaaaguuauacagcacc

SEQ ID NO: 1845680 - RNA, 18 nt, Salmonella typhimurium LT2
acaauauccucgcauccu

SEQ ID NO: 1845681 - RNA, 23 nt, Salmonella typhimurium LT2
acaauaucucccgguugauaauc

SEQ ID NO: 1845682 - RNA, 17 nt, Salmonella typhimurium LT2
acaaucagcacacuaca

SEQ ID NO: 1845683 - RNA, 16 nt, Salmonella typhimurium LT2
acaaucacagcgcaga

SEQ ID NO: 1845684 - RNA, 16 nt, Salmonella typhimurium LT2
acaauccgccacgcuc

SEQ ID NO: 1845685 - RNA, 13 nt, Salmonella typhimurium LT2
acaaugcaaacga

SEQ ID NO: 1845686 - RNA, 16 nt, Salmonella typhimurium LT2
acaaugcaaagaaaaa

SEQ ID NO: 1845687 - RNA, 15 nt, Salmonella typhimurium LT2
acaaugaauccucgg

SEQ ID NO: 1845688 - RNA, 13 nt, Salmonella typhimurium LT2
acaaugaagcaua

SEQ ID NO: 1845689 - RNA, 21 nt, Salmonella typhimurium LT2
acaaugaagcauaaaaagacu

SEQ ID NO: 1845690 - RNA, 16 nt, Salmonella typhimurium LT2
acaaucugaauaucaa

SEQ ID NO: 1845691 - RNA, 19 nt, Salmonella typhimurium LT2
acaaucgccgugaucccaa

SEQ ID NO: 1845692 - RNA, 14 nt, Salmonella typhimurium LT2
acaaucgccagccc

SEQ ID NO: 1845693 - RNA, 18 nt, Salmonella typhimurium LT2
acaaucgcauaaccggcg

SEQ ID NO: 1845694 - RNA, 16 nt, Salmonella typhimurium LT2
acaauccguuccaauc

SEQ ID NO: 1845695 - RNA, 20 nt, Salmonella typhimurium LT2
acaauccguuccaaucucuu

SEQ ID NO: 1845696 - RNA, 17 nt, Salmonella typhimurium LT2
acaaucguuaauucaug

SEQ ID NO: 1845697 - RNA, 14 nt, Salmonella typhimurium LT2
acaccugcaucacg

SEQ ID NO: 1845698 - RNA, 15 nt, Salmonella typhimurium LT2
acaccuccaguucag

SEQ ID NO: 1845699 - RNA, 15 nt, Salmonella typhimurium LT2
acaccuuugcccgag

SEQ ID NO: 1845700 - RNA, 17 nt, Salmonella typhimurium LT2
acaccuuuaucaauaga

SEQ ID NO: 1845701 - RNA, 12 nt, Salmonella typhimurium LT2
acacgauaguga

SEQ ID NO: 1845702 - RNA, 13 nt, Salmonella typhimurium LT2
acacgauggcaaa

SEQ ID NO: 1845703 - RNA, 16 nt, Salmonella typhimurium LT2
acacgauuaaccucac

SEQ ID NO: 1845704 - RNA, 18 nt, Salmonella typhimurium LT2
acacgccacaaacugcgc

SEQ ID NO: 1845705 - RNA, 12 nt, Salmonella typhimurium LT2
acacccugcccc

SEQ ID NO: 1845706 - RNA, 12 nt, Salmonella typhimurium LT2
acacccugcaga

SEQ ID NO: 1845707 - RNA, 13 nt, Salmonella typhimurium LT2
acaccgagacaga

SEQ ID NO: 1845708 - RNA, 14 nt, Salmonella typhimurium LT2
acaccauuucacaa

SEQ ID NO: 1845709 - RNA, 14 nt, Salmonella typhimurium LT2
acacccgcagccgg

SEQ ID NO: 1845710 - RNA, 23 nt, Salmonella typhimurium LT2
acaccccgcgccgcugagaaaaa

SEQ ID NO: 1845711 - RNA, 13 nt, Salmonella typhimurium LT2
acaccccuggcuu

SEQ ID NO: 1845712 - RNA, 14 nt, Salmonella typhimurium LT2
acaccagccguuca

SEQ ID NO: 1845713 - RNA, 17 nt, Salmonella typhimurium LT2
acaccaagacgacgggu

SEQ ID NO: 1845714 - RNA, 15 nt, Salmonella typhimurium LT2
acacauccagcguca

SEQ ID NO: 1845715 - RNA, 16 nt, Salmonella typhimurium LT2
acacauuucuuuugau

SEQ ID NO: 1845716 - RNA, 16 nt, Salmonella typhimurium LT2
acacauuuuaaaccaa

SEQ ID NO: 1845717 - RNA, 14 nt, Salmonella typhimurium LT2
acacuaucuccuuc

SEQ ID NO: 1845718 - RNA, 13 nt, Salmonella typhimurium LT2
acacuauuuuuca

SEQ ID NO: 1845719 - RNA, 16 nt, Salmonella typhimurium LT2
acacucaaggcuauua

SEQ ID NO: 1845720 - RNA, 13 nt, Salmonella typhimurium LT2
acacuauauugcg

SEQ ID NO: 1845721 - RNA, 15 nt, Salmonella typhimurium LT2
acacuaccagacaca

SEQ ID NO: 1845722 - RNA, 23 nt, Salmonella typhimurium LT2
acagaaauagcuuacuuucagau

SEQ ID NO: 1845723 - RNA, 21 nt, Salmonella typhimurium LT2
acacguaaguucgcaacauga

SEQ ID NO: 1845724 - RNA, 19 nt, Salmonella typhimurium LT2
acacguaauucauuacgaa

SEQ ID NO: 1845725 - RNA, 21 nt, Salmonella typhimurium LT2
acacgguguaguacacaaucg

SEQ ID NO: 1845726 - RNA, 17 nt, Salmonella typhimurium LT2
acacggcgcucaggauc

SEQ ID NO: 1845727 - RNA, 20 nt, Salmonella typhimurium LT2
acacggcgugaccaccgccu

SEQ ID NO: 1845728 - RNA, 16 nt, Salmonella typhimurium LT2
acacgcuuagcuugcc

SEQ ID NO: 1845729 - RNA, 21 nt, Salmonella typhimurium LT2
acacgcgcaccaguucacucc

SEQ ID NO: 1845730 - RNA, 15 nt, Salmonella typhimurium LT2
acagcaucuaauuaa

SEQ ID NO: 1845731 - RNA, 20 nt, Salmonella typhimurium LT2
acagcaucuaauuaaaaaga

SEQ ID NO: 1845732 - RNA, 14 nt, Salmonella typhimurium LT2
acagcaacaucuau

SEQ ID NO: 1845733 - RNA, 21 nt, Salmonella typhimurium LT2
acagaccugucgcaaucccga

SEQ ID NO: 1845734 - RNA, 23 nt, Salmonella typhimurium LT2
acagaagguuauucgccuuucac

SEQ ID NO: 1845735 - RNA, 12 nt, Salmonella typhimurium LT2
acagaccgccau

SEQ ID NO: 1845736 - RNA, 14 nt, Salmonella typhimurium LT2
acagaccgccaugc

SEQ ID NO: 1845737 - RNA, 22 nt, Salmonella typhimurium LT2
acagacccaguacaaacaaaua

SEQ ID NO: 1845738 - RNA, 17 nt, Salmonella typhimurium LT2
acagacuucauuuucca

SEQ ID NO: 1845739 - RNA, 23 nt, Salmonella typhimurium LT2
acagacucaccgcuaaucccagc

SEQ ID NO: 1845740 - RNA, 23 nt, Salmonella typhimurium LT2
acagauagcccugaucccacagc

SEQ ID NO: 1845741 - RNA, 13 nt, Salmonella typhimurium LT2
acauaccgcagau

SEQ ID NO: 1845742 - RNA, 19 nt, Salmonella typhimurium LT2
acauaccgucaccacgcgc

SEQ ID NO: 1845743 - RNA, 15 nt, Salmonella typhimurium LT2
acauacgccacgcuc

SEQ ID NO: 1845744 - RNA, 20 nt, Salmonella typhimurium LT2
acauacugcuuuuucggcuc

SEQ ID NO: 1845745 - RNA, 20 nt, Salmonella typhimurium LT2
acauagcuaaauuaaaaaua

SEQ ID NO: 1845746 - RNA, 12 nt, Salmonella typhimurium LT2
acauagcaucca

SEQ ID NO: 1845747 - RNA, 15 nt, Salmonella typhimurium LT2
acauagucuauguuc

SEQ ID NO: 1845748 - RNA, 20 nt, Salmonella typhimurium LT2
acaguuuuuucguuccagag

SEQ ID NO: 1845749 - RNA, 12 nt, Salmonella typhimurium LT2
acaguuugucaa

SEQ ID NO: 1845750 - RNA, 22 nt, Salmonella typhimurium LT2
acagccaaacugcuguagcugu

SEQ ID NO: 1845751 - RNA, 16 nt, Salmonella typhimurium LT2
acaucaauagcaaggg

SEQ ID NO: 1845752 - RNA, 22 nt, Salmonella typhimurium LT2
acauauauauccgcuauuacca

SEQ ID NO: 1845753 - RNA, 17 nt, Salmonella typhimurium LT2
acauauccaguugaccg

SEQ ID NO: 1845754 - RNA, 19 nt, Salmonella typhimurium LT2
acauaugaguuauguauuu

SEQ ID NO: 1845755 - RNA, 23 nt, Salmonella typhimurium LT2
acaucaccgugcucuucguggaa

SEQ ID NO: 1845756 - RNA, 18 nt, Salmonella typhimurium LT2
acaucauccguucccucu

SEQ ID NO: 1845757 - RNA, 17 nt, Salmonella typhimurium LT2
acauccaucacuccuua

SEQ ID NO: 1845758 - RNA, 10 nt, Salmonella typhimurium LT2
acauccauaa

SEQ ID NO: 1845759 - RNA, 14 nt, Salmonella typhimurium LT2
acauccagacagcc

SEQ ID NO: 1845760 - RNA, 24 nt, Salmonella typhimurium LT2
acauccggcaggcauuuuacaccc

SEQ ID NO: 1845761 - RNA, 15 nt, Salmonella typhimurium LT2
acauccggcggcguc

SEQ ID NO: 1845762 - RNA, 17 nt, Salmonella typhimurium LT2
acauccggcguguaaac

SEQ ID NO: 1845763 - RNA, 18 nt, Salmonella typhimurium LT2
acauccugugaaguaaaa

SEQ ID NO: 1845764 - RNA, 17 nt, Salmonella typhimurium LT2
acauccugugaaguaaa

SEQ ID NO: 1845765 - RNA, 15 nt, Salmonella typhimurium LT2
acaucccagacaaaa

SEQ ID NO: 1845766 - RNA, 19 nt, Salmonella typhimurium LT2
acauccagcuauagacgac

SEQ ID NO: 1845767 - RNA, 18 nt, Salmonella typhimurium LT2
acauccauguacuccugg

SEQ ID NO: 1845768 - RNA, 13 nt, Salmonella typhimurium LT2
acaugaaaaauag

SEQ ID NO: 1845769 - RNA, 14 nt, Salmonella typhimurium LT2
acaugaacucgacu

SEQ ID NO: 1845770 - RNA, 14 nt, Salmonella typhimurium LT2
acaugaaagggaaa

SEQ ID NO: 1845771 - RNA, 20 nt, Salmonella typhimurium LT2
acaugaaagggaaaccgcuc

SEQ ID NO: 1845772 - RNA, 20 nt, Salmonella typhimurium LT2
acaucguuacccaucaccug

SEQ ID NO: 1845773 - RNA, 18 nt, Salmonella typhimurium LT2
acauuaaucgccauugca

SEQ ID NO: 1845774 - RNA, 18 nt, Salmonella typhimurium LT2
acauugcucauaccgccg

SEQ ID NO: 1845775 - RNA, 14 nt, Salmonella typhimurium LT2
acauugccggcauc

SEQ ID NO: 1845776 - RNA, 14 nt, Salmonella typhimurium LT2
acauugaguaaaua

SEQ ID NO: 1845777 - RNA, 20 nt, Salmonella typhimurium LT2
acauucgucugccgggaaca

SEQ ID NO: 1845778 - RNA, 14 nt, Salmonella typhimurium LT2
acauucauugccgc

SEQ ID NO: 1845779 - RNA, 22 nt, Salmonella typhimurium LT2
acauucauaaaagaucauuccc

SEQ ID NO: 1845780 - RNA, 13 nt, Salmonella typhimurium LT2
acauucagcacau

SEQ ID NO: 1845781 - RNA, 19 nt, Salmonella typhimurium LT2
acauuauaggugucagauc

SEQ ID NO: 1845782 - RNA, 13 nt, Salmonella typhimurium LT2
acauuacauccuc

SEQ ID NO: 1845783 - RNA, 15 nt, Salmonella typhimurium LT2
acauuacaauguaca

SEQ ID NO: 1845784 - RNA, 18 nt, Salmonella typhimurium LT2
acauugucagcugaacag

SEQ ID NO: 1845785 - RNA, 19 nt, Salmonella typhimurium LT2
acauuggcguccggauggc

SEQ ID NO: 1845786 - RNA, 21 nt, Salmonella typhimurium LT2
acauugguuaucaaaaaccuu

SEQ ID NO: 1845787 - RNA, 18 nt, Salmonella typhimurium LT2
acauugucggugcaugcg

SEQ ID NO: 1845788 - RNA, 19 nt, Salmonella typhimurium LT2
acauuuggggcuggcgaca

SEQ ID NO: 1845789 - RNA, 18 nt, Salmonella typhimurium LT2
acauuugcucccuuaaaa

SEQ ID NO: 1845790 - RNA, 22 nt, Salmonella typhimurium LT2
accaaacccuuuggcaaaaaag

SEQ ID NO: 1845791 - RNA, 15 nt, Salmonella typhimurium LT2
accaaacacgaggcu

SEQ ID NO: 1845792 - RNA, 19 nt, Salmonella typhimurium LT2
accaaaucaucaaucgcuu

SEQ ID NO: 1845793 - RNA, 16 nt, Salmonella typhimurium LT2
accaaaaucaaacuga

SEQ ID NO: 1845794 - RNA, 12 nt, Salmonella typhimurium LT2
accaaaagcauu

SEQ ID NO: 1845795 - RNA, 21 nt, Salmonella typhimurium LT2
accaauaauugccgaauauug

SEQ ID NO: 1845796 - RNA, 12 nt, Salmonella typhimurium LT2
accaauaaugca

SEQ ID NO: 1845797 - RNA, 17 nt, Salmonella typhimurium LT2
accaauaaugcaggcua

SEQ ID NO: 1845798 - RNA, 23 nt, Salmonella typhimurium LT2
accaauaauaaucccaacauggu

SEQ ID NO: 1845799 - RNA, 14 nt, Salmonella typhimurium LT2
accaauaagaacuu

SEQ ID NO: 1845800 - RNA, 21 nt, Salmonella typhimurium LT2
accaagaucggagauauaaac

SEQ ID NO: 1845801 - RNA, 17 nt, Salmonella typhimurium LT2
accaacaagaagggagg

SEQ ID NO: 1845802 - RNA, 22 nt, Salmonella typhimurium LT2
accacaauaaucgcgagaaaau

SEQ ID NO: 1845803 - RNA, 18 nt, Salmonella typhimurium LT2
accacaaagagugccaga

SEQ ID NO: 1845804 - RNA, 21 nt, Salmonella typhimurium LT2
accacaacaagaauauauucu

SEQ ID NO: 1845805 - RNA, 15 nt, Salmonella typhimurium LT2
accacaaaggcgcgu

SEQ ID NO: 1845806 - RNA, 18 nt, Salmonella typhimurium LT2
accacaccugaugguuau

SEQ ID NO: 1845807 - RNA, 16 nt, Salmonella typhimurium LT2
accagcggcaccagca

SEQ ID NO: 1845808 - RNA, 20 nt, Salmonella typhimurium LT2
accagccgagugcuuaugua

SEQ ID NO: 1845809 - RNA, 18 nt, Salmonella typhimurium LT2
accagcccggcgcacacc

SEQ ID NO: 1845810 - RNA, 20 nt, Salmonella typhimurium LT2
accagcccggcgcacacccu

SEQ ID NO: 1845811 - RNA, 15 nt, Salmonella typhimurium LT2
accagccgaucauca

SEQ ID NO: 1845812 - RNA, 22 nt, Salmonella typhimurium LT2
accagccgcauaauagcgccag

SEQ ID NO: 1845813 - RNA, 18 nt, Salmonella typhimurium LT2
accagccgcaucuuauau

SEQ ID NO: 1845814 - RNA, 15 nt, Salmonella typhimurium LT2
accagcugacgcagc

SEQ ID NO: 1845815 - RNA, 19 nt, Salmonella typhimurium LT2
accagcugacgcagcagcu

SEQ ID NO: 1845816 - RNA, 21 nt, Salmonella typhimurium LT2
accagcgguuggaucucacca

SEQ ID NO: 1845817 - RNA, 19 nt, Salmonella typhimurium LT2
accagcgugaccgguaagc

SEQ ID NO: 1845818 - RNA, 16 nt, Salmonella typhimurium LT2
accagcagcacaaaaa

SEQ ID NO: 1845819 - RNA, 19 nt, Salmonella typhimurium LT2
accagcaccgccagcgcau

SEQ ID NO: 1845820 - RNA, 14 nt, Salmonella typhimurium LT2
accagcacaggcgu

SEQ ID NO: 1845821 - RNA, 14 nt, Salmonella typhimurium LT2
accagcaauaacag

SEQ ID NO: 1845822 - RNA, 21 nt, Salmonella typhimurium LT2
accagcaauaacaggcacagu

SEQ ID NO: 1845823 - RNA, 13 nt, Salmonella typhimurium LT2
accagcaauaaca

SEQ ID NO: 1845824 - RNA, 14 nt, Salmonella typhimurium LT2
accagcaacgccag

SEQ ID NO: 1845825 - RNA, 22 nt, Salmonella typhimurium LT2
accagcaacugaccaucuucgu

SEQ ID NO: 1845826 - RNA, 21 nt, Salmonella typhimurium LT2
accacuuuaccgcucacaaug

SEQ ID NO: 1845827 - RNA, 17 nt, Salmonella typhimurium LT2
accacuugauucugcag

SEQ ID NO: 1845828 - RNA, 19 nt, Salmonella typhimurium LT2
accacgucauccggcaagc

SEQ ID NO: 1845829 - RNA, 20 nt, Salmonella typhimurium LT2
accacgucugcgcuuucagc

SEQ ID NO: 1845830 - RNA, 17 nt, Salmonella typhimurium LT2
accacguuaccgcgcag

SEQ ID NO: 1845831 - RNA, 17 nt, Salmonella typhimurium LT2
accacgcccgccgccag

SEQ ID NO: 1845832 - RNA, 15 nt, Salmonella typhimurium LT2
accacgccaccgccg

SEQ ID NO: 1845833 - RNA, 19 nt, Salmonella typhimurium LT2
accacgccauggccgcagc

SEQ ID NO: 1845834 - RNA, 16 nt, Salmonella typhimurium LT2
accacgccaucaacag

SEQ ID NO: 1845835 - RNA, 14 nt, Salmonella typhimurium LT2
accacguuaucuuc

SEQ ID NO: 1845836 - RNA, 14 nt, Salmonella typhimurium LT2
accaccguuauuuc

SEQ ID NO: 1845837 - RNA, 13 nt, Salmonella typhimurium LT2
accaccucuuucg

SEQ ID NO: 1845838 - RNA, 20 nt, Salmonella typhimurium LT2
accacaucagaccgccaagc

SEQ ID NO: 1845839 - RNA, 21 nt, Salmonella typhimurium LT2
accaccaguaaccgccacagc

SEQ ID NO: 1845840 - RNA, 18 nt, Salmonella typhimurium LT2
accaccauacccaacagc

SEQ ID NO: 1845841 - RNA, 16 nt, Salmonella typhimurium LT2
accaccaguaaccgcc

SEQ ID NO: 1845842 - RNA, 21 nt, Salmonella typhimurium LT2
accaucgggucggccauaucg

SEQ ID NO: 1845843 - RNA, 16 nt, Salmonella typhimurium LT2
accaucgccagccauu

SEQ ID NO: 1845844 - RNA, 21 nt, Salmonella typhimurium LT2
accaucuaaaucaaucacuua

SEQ ID NO: 1845845 - RNA, 16 nt, Salmonella typhimurium LT2
accaugacgcagugca

SEQ ID NO: 1845846 - RNA, 22 nt, Salmonella typhimurium LT2
accaugacgcagugcaauauua

SEQ ID NO: 1845847 - RNA, 18 nt, Salmonella typhimurium LT2
accaggcaaugccccgcc

SEQ ID NO: 1845848 - RNA, 13 nt, Salmonella typhimurium LT2
accaggcaacaga

SEQ ID NO: 1845849 - RNA, 14 nt, Salmonella typhimurium LT2
accaggcacuugag

SEQ ID NO: 1845850 - RNA, 18 nt, Salmonella typhimurium LT2
accaggauaaaggccggg

SEQ ID NO: 1845851 - RNA, 17 nt, Salmonella typhimurium LT2
accaggaugccaaccac

SEQ ID NO: 1845852 - RNA, 18 nt, Salmonella typhimurium LT2
accagcuuguuauccauc

SEQ ID NO: 1845853 - RNA, 21 nt, Salmonella typhimurium LT2
accagcuuguuauccaucagc

SEQ ID NO: 1845854 - RNA, 20 nt, Salmonella typhimurium LT2
accagcuuuuaugagaaaag

SEQ ID NO: 1845855 - RNA, 18 nt, Salmonella typhimurium LT2
accaggaagacuauccag

SEQ ID NO: 1845856 - RNA, 16 nt, Salmonella typhimurium LT2
accaggacaaaaggcg

SEQ ID NO: 1845857 - RNA, 15 nt, Salmonella typhimurium LT2
accauauucccacag

SEQ ID NO: 1845858 - RNA, 14 nt, Salmonella typhimurium LT2
accaugcugguugg

SEQ ID NO: 1845859 - RNA, 14 nt, Salmonella typhimurium LT2
accauuaacaucag

SEQ ID NO: 1845860 - RNA, 22 nt, Salmonella typhimurium LT2
accauguauuugcauuucaacc

SEQ ID NO: 1845861 - RNA, 23 nt, Salmonella typhimurium LT2
accaugucaagguggugcucuaa

SEQ ID NO: 1845862 - RNA, 18 nt, Salmonella typhimurium LT2
acccaccgacaaccccaa

SEQ ID NO: 1845863 - RNA, 21 nt, Salmonella typhimurium LT2
acccaccgauaaaguuaaaca

SEQ ID NO: 1845864 - RNA, 19 nt, Salmonella typhimurium LT2
accauuuauaaaauauuua

SEQ ID NO: 1845865 - RNA, 21 nt, Salmonella typhimurium LT2
acccauauucgucuucaucuu

SEQ ID NO: 1845866 - RNA, 19 nt, Salmonella typhimurium LT2
acccauaacgggaagccgu

SEQ ID NO: 1845867 - RNA, 15 nt, Salmonella typhimurium LT2
acccaggccaucaga

SEQ ID NO: 1845868 - RNA, 15 nt, Salmonella typhimurium LT2
acccaggcaucagau

SEQ ID NO: 1845869 - RNA, 20 nt, Salmonella typhimurium LT2
acccaggauggcggccaaau

SEQ ID NO: 1845870 - RNA, 15 nt, Salmonella typhimurium LT2
acccacgucaguaag

SEQ ID NO: 1845871 - RNA, 21 nt, Salmonella typhimurium LT2
acccacgucauccgagaccag

SEQ ID NO: 1845872 - RNA, 14 nt, Salmonella typhimurium LT2
acccgacacggcuc

SEQ ID NO: 1845873 - RNA, 22 nt, Salmonella typhimurium LT2
acccgaucgccauccugcaccg

SEQ ID NO: 1845874 - RNA, 15 nt, Salmonella typhimurium LT2
acccgauucugccag

SEQ ID NO: 1845875 - RNA, 20 nt, Salmonella typhimurium LT2
acccgaugcgaguagcaaau

SEQ ID NO: 1845876 - RNA, 19 nt, Salmonella typhimurium LT2
acccgauaccgccagcccc

SEQ ID NO: 1845877 - RNA, 21 nt, Salmonella typhimurium LT2
acccgaucgccauccugcacc

SEQ ID NO: 1845878 - RNA, 18 nt, Salmonella typhimurium LT2
acccgccaucaugcccac

SEQ ID NO: 1845879 - RNA, 21 nt, Salmonella typhimurium LT2
acccgcaguagcuaaugauua

SEQ ID NO: 1845880 - RNA, 15 nt, Salmonella typhimurium LT2
acccgcagcggaaga

SEQ ID NO: 1845881 - RNA, 15 nt, Salmonella typhimurium LT2
acccaugacgguagc

SEQ ID NO: 1845882 - RNA, 17 nt, Salmonella typhimurium LT2
accccuucgccuucgcc

SEQ ID NO: 1845883 - RNA, 22 nt, Salmonella typhimurium LT2
accccggcauauggauauucau

SEQ ID NO: 1845884 - RNA, 21 nt, Salmonella typhimurium LT2
acccgggccaucuuuuuucac

SEQ ID NO: 1845885 - RNA, 15 nt, Salmonella typhimurium LT2
acccggcguuuucag

SEQ ID NO: 1845886 - RNA, 17 nt, Salmonella typhimurium LT2
acccggccuacacauca

SEQ ID NO: 1845887 - RNA, 13 nt, Salmonella typhimurium LT2
acccgcuccagaa

SEQ ID NO: 1845888 - RNA, 22 nt, Salmonella typhimurium LT2
acccgcucgcccgcagcaaaaa

SEQ ID NO: 1845889 - RNA, 16 nt, Salmonella typhimurium LT2
acccggagagaaacaa

SEQ ID NO: 1845890 - RNA, 23 nt, Salmonella typhimurium LT2
acccggcaaaggaauuacggacg

SEQ ID NO: 1845891 - RNA, 14 nt, Salmonella typhimurium LT2
acccgccgauaaac

SEQ ID NO: 1845892 - RNA, 15 nt, Salmonella typhimurium LT2
acccgcgccagcagg

SEQ ID NO: 1845893 - RNA, 15 nt, Salmonella typhimurium LT2
acccgccugcgccuu

SEQ ID NO: 1845894 - RNA, 21 nt, Salmonella typhimurium LT2
accgcgaucgaugugauaaau

SEQ ID NO: 1845895 - RNA, 22 nt, Salmonella typhimurium LT2
accgccgcgauagaccacgcca

SEQ ID NO: 1845896 - RNA, 17 nt, Salmonella typhimurium LT2
accgccgccgcgcucgc

SEQ ID NO: 1845897 - RNA, 20 nt, Salmonella typhimurium LT2
accgcgaugaccaucaaaua

SEQ ID NO: 1845898 - RNA, 13 nt, Salmonella typhimurium LT2
accgcgcccgguu

SEQ ID NO: 1845899 - RNA, 13 nt, Salmonella typhimurium LT2
accgcgccagccg

SEQ ID NO: 1845900 - RNA, 20 nt, Salmonella typhimurium LT2
accgcuuucaaaaugacaaa

SEQ ID NO: 1845901 - RNA, 18 nt, Salmonella typhimurium LT2
accgcuugggccaccugc

SEQ ID NO: 1845902 - RNA, 23 nt, Salmonella typhimurium LT2
accggaaauggucgcuccggaac

SEQ ID NO: 1845903 - RNA, 18 nt, Salmonella typhimurium LT2
accggaaauaaagguuuc

SEQ ID NO: 1845904 - RNA, 17 nt, Salmonella typhimurium LT2
accgcuuucgccugguc

SEQ ID NO: 1845905 - RNA, 17 nt, Salmonella typhimurium LT2
accggaccgccgagccc

SEQ ID NO: 1845906 - RNA, 13 nt, Salmonella typhimurium LT2
accggacgugcca

SEQ ID NO: 1845907 - RNA, 15 nt, Salmonella typhimurium LT2
accggacuccaggca

SEQ ID NO: 1845908 - RNA, 17 nt, Salmonella typhimurium LT2
accgcuucgccuucgcc

SEQ ID NO: 1845909 - RNA, 16 nt, Salmonella typhimurium LT2
accgcuucgcgcgcca

SEQ ID NO: 1845910 - RNA, 23 nt, Salmonella typhimurium LT2
accgcuaucauaccuacaccaac

SEQ ID NO: 1845911 - RNA, 14 nt, Salmonella typhimurium LT2
accgcuacaaucca

SEQ ID NO: 1845912 - RNA, 16 nt, Salmonella typhimurium LT2
accgcuaaaaaacagg

SEQ ID NO: 1845913 - RNA, 16 nt, Salmonella typhimurium LT2
accgcuaaugaggaaa

SEQ ID NO: 1845914 - RNA, 13 nt, Salmonella typhimurium LT2
accgcguuugcgc

SEQ ID NO: 1845915 - RNA, 20 nt, Salmonella typhimurium LT2
accgcccgcggcgaucacca

SEQ ID NO: 1845916 - RNA, 14 nt, Salmonella typhimurium LT2
accgcccugcaggc

SEQ ID NO: 1845917 - RNA, 18 nt, Salmonella typhimurium LT2
accgccgccaaacugcgc

SEQ ID NO: 1845918 - RNA, 18 nt, Salmonella typhimurium LT2
accgccgccaccaaaaac

SEQ ID NO: 1845919 - RNA, 21 nt, Salmonella typhimurium LT2
accgccagaacgcuguugccg

SEQ ID NO: 1845920 - RNA, 15 nt, Salmonella typhimurium LT2
accgccagaggcggc

SEQ ID NO: 1845921 - RNA, 15 nt, Salmonella typhimurium LT2
accgcaucgcgccca

SEQ ID NO: 1845922 - RNA, 14 nt, Salmonella typhimurium LT2
accgcauaacgcgc

SEQ ID NO: 1845923 - RNA, 18 nt, Salmonella typhimurium LT2
accgauccgaagaacaga

SEQ ID NO: 1845924 - RNA, 13 nt, Salmonella typhimurium LT2
accgcagaaaaag

SEQ ID NO: 1845925 - RNA, 13 nt, Salmonella typhimurium LT2
accgcagccuuga

SEQ ID NO: 1845926 - RNA, 17 nt, Salmonella typhimurium LT2
accgaguuccaguccac

SEQ ID NO: 1845927 - RNA, 19 nt, Salmonella typhimurium LT2
accgauaaucaccagcccg

SEQ ID NO: 1845928 - RNA, 15 nt, Salmonella typhimurium LT2
accgacgaacaaaau

SEQ ID NO: 1845929 - RNA, 16 nt, Salmonella typhimurium LT2
accgacgcguggugaa

SEQ ID NO: 1845930 - RNA, 17 nt, Salmonella typhimurium LT2
accgacauccgccaccu

SEQ ID NO: 1845931 - RNA, 13 nt, Salmonella typhimurium LT2
accgagacagaga

SEQ ID NO: 1845932 - RNA, 14 nt, Salmonella typhimurium LT2
accgaggcaggggc

SEQ ID NO: 1845933 - RNA, 16 nt, Salmonella typhimurium LT2
accgagccagaaaugu

SEQ ID NO: 1845934 - RNA, 15 nt, Salmonella typhimurium LT2
accgaauccuuugga

SEQ ID NO: 1845935 - RNA, 23 nt, Salmonella typhimurium LT2
accgaaaggguauacaaaaaaga

SEQ ID NO: 1845936 - RNA, 13 nt, Salmonella typhimurium LT2
accgaaaucauca

SEQ ID NO: 1845937 - RNA, 18 nt, Salmonella typhimurium LT2
accgaaauccgcuuugag

SEQ ID NO: 1845938 - RNA, 17 nt, Salmonella typhimurium LT2
accgaacagccaggcuu

SEQ ID NO: 1845939 - RNA, 20 nt, Salmonella typhimurium LT2
acccucccuuucuucucaac

SEQ ID NO: 1845940 - RNA, 17 nt, Salmonella typhimurium LT2
acccguggcugcgccug

SEQ ID NO: 1845941 - RNA, 13 nt, Salmonella typhimurium LT2
acccguucgcugc

SEQ ID NO: 1845942 - RNA, 19 nt, Salmonella typhimurium LT2
acccuucuucuggcucaga

SEQ ID NO: 1845943 - RNA, 16 nt, Salmonella typhimurium LT2
acccugcgaaucccgg

SEQ ID NO: 1845944 - RNA, 16 nt, Salmonella typhimurium LT2
acccugaaauccggcu

SEQ ID NO: 1845945 - RNA, 20 nt, Salmonella typhimurium LT2
acccugaagcugcaaccagc

SEQ ID NO: 1845946 - RNA, 16 nt, Salmonella typhimurium LT2
acccugaaaaguuaca

SEQ ID NO: 1845947 - RNA, 20 nt, Salmonella typhimurium LT2
acgggcagcgggugcuccag

SEQ ID NO: 1845948 - RNA, 19 nt, Salmonella typhimurium LT2
acgggcacggucugcugac

SEQ ID NO: 1845949 - RNA, 22 nt, Salmonella typhimurium LT2
acgggcaagguuaugcagcaug

SEQ ID NO: 1845950 - RNA, 11 nt, Salmonella typhimurium LT2
acgggcaaagc

SEQ ID NO: 1845951 - RNA, 14 nt, Salmonella typhimurium LT2
acgggaaaucuccc

SEQ ID NO: 1845952 - RNA, 13 nt, Salmonella typhimurium LT2
acggcuuuucuuc

SEQ ID NO: 1845953 - RNA, 17 nt, Salmonella typhimurium LT2
acgggaaguaaggcaua

SEQ ID NO: 1845954 - RNA, 19 nt, Salmonella typhimurium LT2
acguagcucgcccagcacu

SEQ ID NO: 1845955 - RNA, 19 nt, Salmonella typhimurium LT2
acguagcuuauaaaucagc

SEQ ID NO: 1845956 - RNA, 23 nt, Salmonella typhimurium LT2
acguagcccauugucaucaguau

SEQ ID NO: 1845957 - RNA, 12 nt, Salmonella typhimurium LT2
acgucaccauca

SEQ ID NO: 1845958 - RNA, 16 nt, Salmonella typhimurium LT2
acgucaacaccuccag

SEQ ID NO: 1845959 - RNA, 12 nt, Salmonella typhimurium LT2
acgucagcaaua

SEQ ID NO: 1845960 - RNA, 18 nt, Salmonella typhimurium LT2
acgucacugucagcauca

SEQ ID NO: 1845961 - RNA, 17 nt, Salmonella typhimurium LT2
acgucaguggaaaacag

SEQ ID NO: 1845962 - RNA, 19 nt, Salmonella typhimurium LT2
acgucaguggaaaacagca

SEQ ID NO: 1845963 - RNA, 10 nt, Salmonella typhimurium LT2
acgucaugcc

SEQ ID NO: 1845964 - RNA, 19 nt, Salmonella typhimurium LT2
acgucaugaccgguuuuuc

SEQ ID NO: 1845965 - RNA, 22 nt, Salmonella typhimurium LT2
acgucauaucauccagccccgg

SEQ ID NO: 1845966 - RNA, 14 nt, Salmonella typhimurium LT2
acgucaucaccagu

SEQ ID NO: 1845967 - RNA, 22 nt, Salmonella typhimurium LT2
acgucaucaccaguugaccaaa

SEQ ID NO: 1845968 - RNA, 16 nt, Salmonella typhimurium LT2
acgugaccaaaccugc

SEQ ID NO: 1845969 - RNA, 18 nt, Salmonella typhimurium LT2
acgucuuuuuccagcagc

SEQ ID NO: 1845970 - RNA, 16 nt, Salmonella typhimurium LT2
acgugagguuugacuc

SEQ ID NO: 1845971 - RNA, 19 nt, Salmonella typhimurium LT2
acgugagugguagaaacug

SEQ ID NO: 1845972 - RNA, 15 nt, Salmonella typhimurium LT2
acguggccagcaugc

SEQ ID NO: 1845973 - RNA, 21 nt, Salmonella typhimurium LT2
acguucccggggauuugcugc

SEQ ID NO: 1845974 - RNA, 22 nt, Salmonella typhimurium LT2
acguucccggggauuugcugcg

SEQ ID NO: 1845975 - RNA, 23 nt, Salmonella typhimurium LT2
acguucagcauauccagcgccug

SEQ ID NO: 1845976 - RNA, 20 nt, Salmonella typhimurium LT2
acguucagggauaccacgcc

SEQ ID NO: 1845977 - RNA, 19 nt, Salmonella typhimurium LT2
acguucaucaggccugcaa

SEQ ID NO: 1845978 - RNA, 14 nt, Salmonella typhimurium LT2
acguucaucauuuu

SEQ ID NO: 1845979 - RNA, 17 nt, Salmonella typhimurium LT2
acguucaucauuuuccc

SEQ ID NO: 1845980 - RNA, 13 nt, Salmonella typhimurium LT2
acguuaacucauu

SEQ ID NO: 1845981 - RNA, 14 nt, Salmonella typhimurium LT2
acuagcaaaacaua

SEQ ID NO: 1845982 - RNA, 12 nt, Salmonella typhimurium LT2
acuacugaaaag

SEQ ID NO: 1845983 - RNA, 20 nt, Salmonella typhimurium LT2
acuacuggcugguuucuccg

SEQ ID NO: 1845984 - RNA, 21 nt, Salmonella typhimurium LT2
acuaaucugucgcuaaagcac

SEQ ID NO: 1845985 - RNA, 21 nt, Salmonella typhimurium LT2
acuacgguugccuuucgccag

SEQ ID NO: 1845986 - RNA, 16 nt, Salmonella typhimurium LT2
acuacggugugccugc

SEQ ID NO: 1845987 - RNA, 18 nt, Salmonella typhimurium LT2
acuacggugugccugcgc

SEQ ID NO: 1845988 - RNA, 21 nt, Salmonella typhimurium LT2
acuacgguaaaccaggccagc

SEQ ID NO: 1845989 - RNA, 18 nt, Salmonella typhimurium LT2
acuagcgccgccagcucg

SEQ ID NO: 1845990 - RNA, 22 nt, Salmonella typhimurium LT2
acuagcucagcuggauagagca

SEQ ID NO: 1845991 - RNA, 13 nt, Salmonella typhimurium LT2
acuauagauauua

SEQ ID NO: 1845992 - RNA, 14 nt, Salmonella typhimurium LT2
acuauagauauuaa

SEQ ID NO: 1845993 - RNA, 15 nt, Salmonella typhimurium LT2
acuauagauauuaaa

SEQ ID NO: 1845994 - RNA, 16 nt, Salmonella typhimurium LT2
acuauaggaaaauaau

SEQ ID NO: 1845995 - RNA, 22 nt, Salmonella typhimurium LT2
acuaauccaguccucgcccacu

SEQ ID NO: 1845996 - RNA, 17 nt, Salmonella typhimurium LT2
acuaauccccauuuuuu

SEQ ID NO: 1845997 - RNA, 16 nt, Salmonella typhimurium LT2
acuaauccccauuuuu

SEQ ID NO: 1845998 - RNA, 15 nt, Salmonella typhimurium LT2
acuaacuccagcauc

SEQ ID NO: 1845999 - RNA, 16 nt, Salmonella typhimurium LT2
acuaaguaaggaggaa

SEQ ID NO: 1846000 - RNA, 15 nt, Salmonella typhimurium LT2
acuaagaccagcauc

SEQ ID NO: 1846001 - RNA, 17 nt, Salmonella typhimurium LT2
acuaagaccagcaucag

SEQ ID NO: 1846002 - RNA, 20 nt, Salmonella typhimurium LT2
acuaaauccuugagugcugc

SEQ ID NO: 1846003 - RNA, 12 nt, Salmonella typhimurium LT2
acguucuucucc

SEQ ID NO: 1846004 - RNA, 19 nt, Salmonella typhimurium LT2
acguucuucgauaaaggga

SEQ ID NO: 1846005 - RNA, 19 nt, Salmonella typhimurium LT2
acguucggguagcuggaga

SEQ ID NO: 1846006 - RNA, 14 nt, Salmonella typhimurium LT2
acguucgaugauuu

SEQ ID NO: 1846007 - RNA, 13 nt, Salmonella typhimurium LT2
acucaugcgccuu

SEQ ID NO: 1846008 - RNA, 15 nt, Salmonella typhimurium LT2
acucauuucaacaua

SEQ ID NO: 1846009 - RNA, 15 nt, Salmonella typhimurium LT2
acucauauuuaaacc

SEQ ID NO: 1846010 - RNA, 20 nt, Salmonella typhimurium LT2
acucaucacagccacacugc

SEQ ID NO: 1846011 - RNA, 13 nt, Salmonella typhimurium LT2
acucaucuuuauu

SEQ ID NO: 1846012 - RNA, 16 nt, Salmonella typhimurium LT2
acucaucgccgcaaug

SEQ ID NO: 1846013 - RNA, 14 nt, Salmonella typhimurium LT2
acucauccagacca

SEQ ID NO: 1846014 - RNA, 15 nt, Salmonella typhimurium LT2
acucauccagcaaaa

SEQ ID NO: 1846015 - RNA, 17 nt, Salmonella typhimurium LT2
acuccagcggcaggauc

SEQ ID NO: 1846016 - RNA, 14 nt, Salmonella typhimurium LT2
acuccagcggcagg

SEQ ID NO: 1846017 - RNA, 22 nt, Salmonella typhimurium LT2
acuccaggaacaggcccgccag

SEQ ID NO: 1846018 - RNA, 17 nt, Salmonella typhimurium LT2
acuccaggcguuuauga

SEQ ID NO: 1846019 - RNA, 18 nt, Salmonella typhimurium LT2
acuccauucccagcucuu

SEQ ID NO: 1846020 - RNA, 16 nt, Salmonella typhimurium LT2
acuccauucccagcuc

SEQ ID NO: 1846021 - RNA, 16 nt, Salmonella typhimurium LT2
acuccauuaaauuacu

SEQ ID NO: 1846022 - RNA, 15 nt, Salmonella typhimurium LT2
acuccauugucggca

SEQ ID NO: 1846023 - RNA, 12 nt, Salmonella typhimurium LT2
acucccaaauuu

SEQ ID NO: 1846024 - RNA, 14 nt, Salmonella typhimurium LT2
acuccagcccauca

SEQ ID NO: 1846025 - RNA, 14 nt, Salmonella typhimurium LT2
acuccagaauauug

SEQ ID NO: 1846026 - RNA, 11 nt, Salmonella typhimurium LT2
acuccagaccu

SEQ ID NO: 1846027 - RNA, 16 nt, Salmonella typhimurium LT2
acuccagcaaaucaau

SEQ ID NO: 1846028 - RNA, 12 nt, Salmonella typhimurium LT2
acuccacccgga

SEQ ID NO: 1846029 - RNA, 17 nt, Salmonella typhimurium LT2
acucagcgccagcgcug

SEQ ID NO: 1846030 - RNA, 13 nt, Salmonella typhimurium LT2
acucagccagguc

SEQ ID NO: 1846031 - RNA, 17 nt, Salmonella typhimurium LT2
acucagcuaaaaacagc

SEQ ID NO: 1846032 - RNA, 14 nt, Salmonella typhimurium LT2
acucagggcgaaaa

SEQ ID NO: 1846033 - RNA, 17 nt, Salmonella typhimurium LT2
acucaggcgcaucugac

SEQ ID NO: 1846034 - RNA, 12 nt, Salmonella typhimurium LT2
acucacgggcgu

SEQ ID NO: 1846035 - RNA, 19 nt, Salmonella typhimurium LT2
acucaccugaugcgaugaa

SEQ ID NO: 1846036 - RNA, 21 nt, Salmonella typhimurium LT2
acucacgcgcgcuuuucgcca

SEQ ID NO: 1846037 - RNA, 15 nt, Salmonella typhimurium LT2
acucacgcaacaaca

SEQ ID NO: 1846038 - RNA, 20 nt, Salmonella typhimurium LT2
acucacgcaacaacaggcca

SEQ ID NO: 1846039 - RNA, 22 nt, Salmonella typhimurium LT2
acucagaaaauuauuuuaaauu

SEQ ID NO: 1846040 - RNA, 11 nt, Salmonella typhimurium LT2
acucagcaaua

SEQ ID NO: 1846041 - RNA, 15 nt, Salmonella typhimurium LT2
acucagcacauucag

SEQ ID NO: 1846042 - RNA, 19 nt, Salmonella typhimurium LT2
acucacgacuuucaccaga

SEQ ID NO: 1846043 - RNA, 17 nt, Salmonella typhimurium LT2
acucaccgcuaauccca

SEQ ID NO: 1846044 - RNA, 20 nt, Salmonella typhimurium LT2
acucuauuaaaauaaauuaa

SEQ ID NO: 1846045 - RNA, 22 nt, Salmonella typhimurium LT2
acucggugccgcugcugaccuu

SEQ ID NO: 1846046 - RNA, 13 nt, Salmonella typhimurium LT2
acucggugccgcu

SEQ ID NO: 1846047 - RNA, 15 nt, Salmonella typhimurium LT2
acucguagccaaaau

SEQ ID NO: 1846048 - RNA, 14 nt, Salmonella typhimurium LT2
acuccccuuuuuuc

SEQ ID NO: 1846049 - RNA, 16 nt, Salmonella typhimurium LT2
acucccgaauggcuuc

SEQ ID NO: 1846050 - RNA, 23 nt, Salmonella typhimurium LT2
acuccccuguuugcaucacgcgc

SEQ ID NO: 1846051 - RNA, 12 nt, Salmonella typhimurium LT2
acucccaguccg

SEQ ID NO: 1846052 - RNA, 21 nt, Salmonella typhimurium LT2
acucccaggugugacguccca

SEQ ID NO: 1846053 - RNA, 23 nt, Salmonella typhimurium LT2
acucccgcacgcuggcaucaaua

SEQ ID NO: 1846054 - RNA, 19 nt, Salmonella typhimurium LT2
acucccuggugacgcgcau

SEQ ID NO: 1846055 - RNA, 17 nt, Salmonella typhimurium LT2
acucccuugccagcgca

SEQ ID NO: 1846056 - RNA, 16 nt, Salmonella typhimurium LT2
acucgcauucuucagc

SEQ ID NO: 1846057 - RNA, 13 nt, Salmonella typhimurium LT2
acucgauucccau

SEQ ID NO: 1846058 - RNA, 14 nt, Salmonella typhimurium LT2
acuccgcccuaauc

SEQ ID NO: 1846059 - RNA, 17 nt, Salmonella typhimurium LT2
acucuucgacauauuua

SEQ ID NO: 1846060 - RNA, 22 nt, Salmonella typhimurium LT2
acucuucgacacauuucagcgc

SEQ ID NO: 1846061 - RNA, 19 nt, Salmonella typhimurium LT2
acucuuccgggcugacaua

SEQ ID NO: 1846062 - RNA, 16 nt, Salmonella typhimurium LT2
acucuuguaggcccga

SEQ ID NO: 1846063 - RNA, 17 nt, Salmonella typhimurium LT2
acucuuccgcaaucaca

SEQ ID NO: 1846064 - RNA, 21 nt, Salmonella typhimurium LT2
acucuuccaccacggcaaaaa

SEQ ID NO: 1846065 - RNA, 12 nt, Salmonella typhimurium LT2
acucuuccagca

SEQ ID NO: 1846066 - RNA, 13 nt, Salmonella typhimurium LT2
acucuucaucgcg

SEQ ID NO: 1846067 - RNA, 15 nt, Salmonella typhimurium LT2
acucucccggcgccc

SEQ ID NO: 1846068 - RNA, 21 nt, Salmonella typhimurium LT2
acucucccaucaauaagcgaa

SEQ ID NO: 1846069 - RNA, 12 nt, Salmonella typhimurium LT2
acucucccaacu

SEQ ID NO: 1846070 - RNA, 14 nt, Salmonella typhimurium LT2
acucucccaacugu

SEQ ID NO: 1846071 - RNA, 21 nt, Salmonella typhimurium LT2
acucucccaacuguuuucgug

SEQ ID NO: 1846072 - RNA, 15 nt, Salmonella typhimurium LT2
acucuucacccuucu

SEQ ID NO: 1846073 - RNA, 17 nt, Salmonella typhimurium LT2
acugaauuaucaggguu

SEQ ID NO: 1846074 - RNA, 18 nt, Salmonella typhimurium LT2
acugacacgccaguucau

SEQ ID NO: 1846075 - RNA, 13 nt, Salmonella typhimurium LT2
acugaccagaccg

SEQ ID NO: 1846076 - RNA, 16 nt, Salmonella typhimurium LT2
acugacagcagugaca

SEQ ID NO: 1846077 - RNA, 17 nt, Salmonella typhimurium LT2
acugacccgccagugcu

SEQ ID NO: 1846078 - RNA, 13 nt, Salmonella typhimurium LT2
acugaagauaaac

SEQ ID NO: 1846079 - RNA, 11 nt, Salmonella typhimurium LT2
acugaacugcg

SEQ ID NO: 1846080 - RNA, 17 nt, Salmonella typhimurium LT2
acugaacccggguaggc

SEQ ID NO: 1846081 - RNA, 16 nt, Salmonella typhimurium LT2
acugaacuauaggaaa

SEQ ID NO: 1846082 - RNA, 11 nt, Salmonella typhimurium LT2
acugaacccgg

SEQ ID NO: 1846083 - RNA, 16 nt, Salmonella typhimurium LT2
acugaagguuuuuccc

SEQ ID NO: 1846084 - RNA, 18 nt, Salmonella typhimurium LT2
acugaagcauacccuucc

SEQ ID NO: 1846085 - RNA, 16 nt, Salmonella typhimurium LT2
acgccgacgacaggca

SEQ ID NO: 1846086 - RNA, 14 nt, Salmonella typhimurium LT2
acgccgaagugcgc

SEQ ID NO: 1846087 - RNA, 16 nt, Salmonella typhimurium LT2
acgccgcacacagcgg

SEQ ID NO: 1846088 - RNA, 15 nt, Salmonella typhimurium LT2
acgccgauuaaugcu

SEQ ID NO: 1846089 - RNA, 16 nt, Salmonella typhimurium LT2
acgccgauuaaugcuc

SEQ ID NO: 1846090 - RNA, 23 nt, Salmonella typhimurium LT2
acgccgagcaucgcuuuuaggcu

SEQ ID NO: 1846091 - RNA, 15 nt, Salmonella typhimurium LT2
acgccgccgcccaga

SEQ ID NO: 1846092 - RNA, 23 nt, Salmonella typhimurium LT2
acgccgccgcgucugaccgccgc

SEQ ID NO: 1846093 - RNA, 22 nt, Salmonella typhimurium LT2
acgccgcuggcggaaauaaaca

SEQ ID NO: 1846094 - RNA, 16 nt, Salmonella typhimurium LT2
acgccgcgcuucugga

SEQ ID NO: 1846095 - RNA, 13 nt, Salmonella typhimurium LT2
acgccgcgcucgc

SEQ ID NO: 1846096 - RNA, 20 nt, Salmonella typhimurium LT2
acgcccgaccacgcccagcu

SEQ ID NO: 1846097 - RNA, 16 nt, Salmonella typhimurium LT2
acgccccuaaggcagc

SEQ ID NO: 1846098 - RNA, 15 nt, Salmonella typhimurium LT2
acgcccccuuccccc

SEQ ID NO: 1846099 - RNA, 16 nt, Salmonella typhimurium LT2
acgcccauuaugccgc

SEQ ID NO: 1846100 - RNA, 17 nt, Salmonella typhimurium LT2
acgcccaucagcauccc

SEQ ID NO: 1846101 - RNA, 23 nt, Salmonella typhimurium LT2
acgcccaucagcaucccaccgga

SEQ ID NO: 1846102 - RNA, 17 nt, Salmonella typhimurium LT2
acgcccagcuauuuuuc

SEQ ID NO: 1846103 - RNA, 12 nt, Salmonella typhimurium LT2
acgcccagcgcc

SEQ ID NO: 1846104 - RNA, 19 nt, Salmonella typhimurium LT2
acgcccaggucgcccagcc

SEQ ID NO: 1846105 - RNA, 22 nt, Salmonella typhimurium LT2
acgcccagcgccgggaaaauca

SEQ ID NO: 1846106 - RNA, 14 nt, Salmonella typhimurium LT2
acgcccagccguga

SEQ ID NO: 1846107 - RNA, 21 nt, Salmonella typhimurium LT2
acgcccgguugcgaauaaaca

SEQ ID NO: 1846108 - RNA, 17 nt, Salmonella typhimurium LT2
acgcccgccgccagcau

SEQ ID NO: 1846109 - RNA, 13 nt, Salmonella typhimurium LT2
acgcccgcccgcc

SEQ ID NO: 1846110 - RNA, 14 nt, Salmonella typhimurium LT2
acgcccgauaaugu

SEQ ID NO: 1846111 - RNA, 17 nt, Salmonella typhimurium LT2
acgcccucaauaucuuu

SEQ ID NO: 1846112 - RNA, 23 nt, Salmonella typhimurium LT2
acgcccucucgccaaaucaugcc

SEQ ID NO: 1846113 - RNA, 13 nt, Salmonella typhimurium LT2
acgcccucaauau

SEQ ID NO: 1846114 - RNA, 18 nt, Salmonella typhimurium LT2
acgcccugcucccacagc

SEQ ID NO: 1846115 - RNA, 16 nt, Salmonella typhimurium LT2
acgcccuccuguugaa

SEQ ID NO: 1846116 - RNA, 17 nt, Salmonella typhimurium LT2
acgccguacuccagccc

SEQ ID NO: 1846117 - RNA, 16 nt, Salmonella typhimurium LT2
acgccgucacaaagcc

SEQ ID NO: 1846118 - RNA, 14 nt, Salmonella typhimurium LT2
acgccguccagcac

SEQ ID NO: 1846119 - RNA, 18 nt, Salmonella typhimurium LT2
acgccgucggcagccaga

SEQ ID NO: 1846120 - RNA, 23 nt, Salmonella typhimurium LT2
acgccgugcucauccaacugcgc

SEQ ID NO: 1846121 - RNA, 16 nt, Salmonella typhimurium LT2
acgccuaaugaagcgc

SEQ ID NO: 1846122 - RNA, 17 nt, Salmonella typhimurium LT2
acgccuauuuucugcuc

SEQ ID NO: 1846123 - RNA, 16 nt, Salmonella typhimurium LT2
acgccguuaccagcau

SEQ ID NO: 1846124 - RNA, 18 nt, Salmonella typhimurium LT2
acgccgggaaauuuuucg

SEQ ID NO: 1846125 - RNA, 21 nt, Salmonella typhimurium LT2
acgccgguacgggcagcggcu

SEQ ID NO: 1846126 - RNA, 20 nt, Salmonella typhimurium LT2
acgccggugccugccgccuc

SEQ ID NO: 1846127 - RNA, 14 nt, Salmonella typhimurium LT2
acgccgggccugcc

SEQ ID NO: 1846128 - RNA, 15 nt, Salmonella typhimurium LT2
acgccgggccugcca

SEQ ID NO: 1846129 - RNA, 19 nt, Salmonella typhimurium LT2
acgccggcaacacccgccg

SEQ ID NO: 1846130 - RNA, 15 nt, Salmonella typhimurium LT2
acgccggcaucauca

SEQ ID NO: 1846131 - RNA, 22 nt, Salmonella typhimurium LT2
acgccucuuucagccggcuauc

SEQ ID NO: 1846132 - RNA, 23 nt, Salmonella typhimurium LT2
acgccucguuugcugagcagcca

SEQ ID NO: 1846133 - RNA, 16 nt, Salmonella typhimurium LT2
acgccugcauaaagga

SEQ ID NO: 1846134 - RNA, 15 nt, Salmonella typhimurium LT2
acgccuccaggcuac

SEQ ID NO: 1846135 - RNA, 13 nt, Salmonella typhimurium LT2
acgccuccugccg

SEQ ID NO: 1846136 - RNA, 12 nt, Salmonella typhimurium LT2
acgccuggagug

SEQ ID NO: 1846137 - RNA, 16 nt, Salmonella typhimurium LT2
acgccuguucaucagg

SEQ ID NO: 1846138 - RNA, 15 nt, Salmonella typhimurium LT2
acgccugcuucacgg

SEQ ID NO: 1846139 - RNA, 23 nt, Salmonella typhimurium LT2
acgcgaagauuaauccggucauc

SEQ ID NO: 1846140 - RNA, 16 nt, Salmonella typhimurium LT2
acgcgaagcggcgcca

SEQ ID NO: 1846141 - RNA, 16 nt, Salmonella typhimurium LT2
acgccuuugcccggug

SEQ ID NO: 1846142 - RNA, 17 nt, Salmonella typhimurium LT2
acgcgaaauagugggga

SEQ ID NO: 1846143 - RNA, 15 nt, Salmonella typhimurium LT2
acgccuuugcccggu

SEQ ID NO: 1846144 - RNA, 21 nt, Salmonella typhimurium LT2
acgccuucauauuaaauuccg

SEQ ID NO: 1846145 - RNA, 15 nt, Salmonella typhimurium LT2
accggauauggcaaa

SEQ ID NO: 1846146 - RNA, 16 nt, Salmonella typhimurium LT2
acgcacaguacgcccg

SEQ ID NO: 1846147 - RNA, 13 nt, Salmonella typhimurium LT2
acgcagaccaaaa

SEQ ID NO: 1846148 - RNA, 15 nt, Salmonella typhimurium LT2
acgcagaccaaaauc

SEQ ID NO: 1846149 - RNA, 21 nt, Salmonella typhimurium LT2
acgcaccgccaaacgcgguca

SEQ ID NO: 1846150 - RNA, 18 nt, Salmonella typhimurium LT2
acgcaccguggaagcgga

SEQ ID NO: 1846151 - RNA, 13 nt, Salmonella typhimurium LT2
acgcacuaccaga

SEQ ID NO: 1846152 - RNA, 13 nt, Salmonella typhimurium LT2
acgcacuaacacc

SEQ ID NO: 1846153 - RNA, 12 nt, Salmonella typhimurium LT2
acgcagccaugu

SEQ ID NO: 1846154 - RNA, 11 nt, Salmonella typhimurium LT2
acgcagcccca

SEQ ID NO: 1846155 - RNA, 17 nt, Salmonella typhimurium LT2
acgcagcaagaacagag

SEQ ID NO: 1846156 - RNA, 14 nt, Salmonella typhimurium LT2
acgcagcaucgcca

SEQ ID NO: 1846157 - RNA, 13 nt, Salmonella typhimurium LT2
acgcagcacuuuc

SEQ ID NO: 1846158 - RNA, 14 nt, Salmonella typhimurium LT2
acgcagcaagaaca

SEQ ID NO: 1846159 - RNA, 15 nt, Salmonella typhimurium LT2
acgcagcaagaacag

SEQ ID NO: 1846160 - RNA, 19 nt, Salmonella typhimurium LT2
acgcagccggucagcguca

SEQ ID NO: 1846161 - RNA, 20 nt, Salmonella typhimurium LT2
acgcagcucauacccuucca

SEQ ID NO: 1846162 - RNA, 14 nt, Salmonella typhimurium LT2
acgcagcuccagcu

SEQ ID NO: 1846163 - RNA, 22 nt, Salmonella typhimurium LT2
acgcaggcuaacgcgccccagg

SEQ ID NO: 1846164 - RNA, 20 nt, Salmonella typhimurium LT2
acgcagggccgcgagaacuu

SEQ ID NO: 1846165 - RNA, 16 nt, Salmonella typhimurium LT2
acgcaggcuaacgcgc

SEQ ID NO: 1846166 - RNA, 18 nt, Salmonella typhimurium LT2
acgcaggcgaaggaggac

SEQ ID NO: 1846167 - RNA, 19 nt, Salmonella typhimurium LT2
acgcaggcgcaaaaaauau

SEQ ID NO: 1846168 - RNA, 17 nt, Salmonella typhimurium LT2
acgcauacgcagcacuu

SEQ ID NO: 1846169 - RNA, 19 nt, Salmonella typhimurium LT2
acgcauaaaaaaugagaaa

SEQ ID NO: 1846170 - RNA, 23 nt, Salmonella typhimurium LT2
acgcaucaaauaccuuuucauug

SEQ ID NO: 1846171 - RNA, 12 nt, Salmonella typhimurium LT2
acgcaucaaaua

SEQ ID NO: 1846172 - RNA, 19 nt, Salmonella typhimurium LT2
acgcaucaaauaccuuuuc

SEQ ID NO: 1846173 - RNA, 14 nt, Salmonella typhimurium LT2
acgcauccugcacu

SEQ ID NO: 1846174 - RNA, 15 nt, Salmonella typhimurium LT2
acgcaucuuuuuccc

SEQ ID NO: 1846175 - RNA, 17 nt, Salmonella typhimurium LT2
acgcaucugggcugaca

SEQ ID NO: 1846176 - RNA, 18 nt, Salmonella typhimurium LT2
acgcaucugggcugacaa

SEQ ID NO: 1846177 - RNA, 15 nt, Salmonella typhimurium LT2
acgccaaaaagugaa

SEQ ID NO: 1846178 - RNA, 13 nt, Salmonella typhimurium LT2
acgccaaaaagug

SEQ ID NO: 1846179 - RNA, 15 nt, Salmonella typhimurium LT2
acgccaagcugcaau

SEQ ID NO: 1846180 - RNA, 14 nt, Salmonella typhimurium LT2
acgccaagcugcaa

SEQ ID NO: 1846181 - RNA, 16 nt, Salmonella typhimurium LT2
acgccaccacagucau

SEQ ID NO: 1846182 - RNA, 15 nt, Salmonella typhimurium LT2
acgccacaguugguu

SEQ ID NO: 1846183 - RNA, 14 nt, Salmonella typhimurium LT2
acgccacaaacugc

SEQ ID NO: 1846184 - RNA, 19 nt, Salmonella typhimurium LT2
acgccagaucguuaauaau

SEQ ID NO: 1846185 - RNA, 20 nt, Salmonella typhimurium LT2
acgccagauaaucacgccag

SEQ ID NO: 1846186 - RNA, 23 nt, Salmonella typhimurium LT2
acgccagcuucgcuauuuucuau

SEQ ID NO: 1846187 - RNA, 20 nt, Salmonella typhimurium LT2
acgccacgauuaaccccccg

SEQ ID NO: 1846188 - RNA, 24 nt, Salmonella typhimurium LT2
acgccagacuauccguccucuuuc

SEQ ID NO: 1846189 - RNA, 18 nt, Salmonella typhimurium LT2
acgccagaccgacgccaa

SEQ ID NO: 1846190 - RNA, 21 nt, Salmonella typhimurium LT2
acgccaugacgccaagcugca

SEQ ID NO: 1846191 - RNA, 19 nt, Salmonella typhimurium LT2
acgccauugcugucgacaa

SEQ ID NO: 1846192 - RNA, 19 nt, Salmonella typhimurium LT2
acgcccaaaaugcggcauc

SEQ ID NO: 1846193 - RNA, 14 nt, Salmonella typhimurium LT2
acgccaucaacagc

SEQ ID NO: 1846194 - RNA, 18 nt, Salmonella typhimurium LT2
acgccaggguaauacugg

SEQ ID NO: 1846195 - RNA, 21 nt, Salmonella typhimurium LT2
acgccagguagccgacggcca

SEQ ID NO: 1846196 - RNA, 18 nt, Salmonella typhimurium LT2
acgcuacaccaagacgac

SEQ ID NO: 1846197 - RNA, 20 nt, Salmonella typhimurium LT2
acgcuauguuugcugagaau

SEQ ID NO: 1846198 - RNA, 17 nt, Salmonella typhimurium LT2
acgcgucagguuacgca

SEQ ID NO: 1846199 - RNA, 17 nt, Salmonella typhimurium LT2
acgcgucugaaugacgc

SEQ ID NO: 1846200 - RNA, 22 nt, Salmonella typhimurium LT2
acgcgucggcgcggggaacaca

SEQ ID NO: 1846201 - RNA, 16 nt, Salmonella typhimurium LT2
acgcuaaaaaaggcag

SEQ ID NO: 1846202 - RNA, 20 nt, Salmonella typhimurium LT2
acgcguugccugaaaagggg

SEQ ID NO: 1846203 - RNA, 13 nt, Salmonella typhimurium LT2
acgcgugcgaauu

SEQ ID NO: 1846204 - RNA, 12 nt, Salmonella typhimurium LT2
acgcucacuuuu

SEQ ID NO: 1846205 - RNA, 15 nt, Salmonella typhimurium LT2
acgcuccugcuccug

SEQ ID NO: 1846206 - RNA, 13 nt, Salmonella typhimurium LT2
acgcuccuggauu

SEQ ID NO: 1846207 - RNA, 12 nt, Salmonella typhimurium LT2
acgcuccagcag

SEQ ID NO: 1846208 - RNA, 18 nt, Salmonella typhimurium LT2
acgcuccagcuggcuggc

SEQ ID NO: 1846209 - RNA, 22 nt, Salmonella typhimurium LT2
acgcucauaccuggcuugaugu

SEQ ID NO: 1846210 - RNA, 17 nt, Salmonella typhimurium LT2
acgcugaauaucuucac

SEQ ID NO: 1846211 - RNA, 15 nt, Salmonella typhimurium LT2
acgcugaacaacccc

SEQ ID NO: 1846212 - RNA, 13 nt, Salmonella typhimurium LT2
acgcucuucgcca

SEQ ID NO: 1846213 - RNA, 15 nt, Salmonella typhimurium LT2
acgcggucaggguga

SEQ ID NO: 1846214 - RNA, 20 nt, Salmonella typhimurium LT2
acgcggucuuuuaaaagacc

SEQ ID NO: 1846215 - RNA, 22 nt, Salmonella typhimurium LT2
acgcggucuuuuaaaagaccug

SEQ ID NO: 1846216 - RNA, 16 nt, Salmonella typhimurium LT2
acgcgguaugauuaua

SEQ ID NO: 1846217 - RNA, 13 nt, Salmonella typhimurium LT2
acgcgggucgaga

SEQ ID NO: 1846218 - RNA, 22 nt, Salmonella typhimurium LT2
acgcgggaucgucaaugguugu

SEQ ID NO: 1846219 - RNA, 14 nt, Salmonella typhimurium LT2
acgcggcuugccaa

SEQ ID NO: 1846220 - RNA, 12 nt, Salmonella typhimurium LT2
acgcggcgcgcu

SEQ ID NO: 1846221 - RNA, 21 nt, Salmonella typhimurium LT2
acgcggcacaaaguccgccgu

SEQ ID NO: 1846222 - RNA, 15 nt, Salmonella typhimurium LT2
acgcgcucgccagcg

SEQ ID NO: 1846223 - RNA, 18 nt, Salmonella typhimurium LT2
acgcgcucgccagcgcag

SEQ ID NO: 1846224 - RNA, 19 nt, Salmonella typhimurium LT2
acgcggaacuggugaaaca

SEQ ID NO: 1846225 - RNA, 14 nt, Salmonella typhimurium LT2
acgcgcuggcgcgc

SEQ ID NO: 1846226 - RNA, 18 nt, Salmonella typhimurium LT2
acgcgccuggaucugcgc

SEQ ID NO: 1846227 - RNA, 23 nt, Salmonella typhimurium LT2
acgcgccugcucccgcugcggcg

SEQ ID NO: 1846228 - RNA, 18 nt, Salmonella typhimurium LT2
acgcgcgagaacugcugc

SEQ ID NO: 1846229 - RNA, 23 nt, Salmonella typhimurium LT2
acgcgcgccggugaucccaccag

SEQ ID NO: 1846230 - RNA, 18 nt, Salmonella typhimurium LT2
acgcgcgccgccugcucc

SEQ ID NO: 1846231 - RNA, 14 nt, Salmonella typhimurium LT2
acgcgcuaaaugca

SEQ ID NO: 1846232 - RNA, 14 nt, Salmonella typhimurium LT2
acgcgcuagcuuca

SEQ ID NO: 1846233 - RNA, 13 nt, Salmonella typhimurium LT2
acgcgcguucguu

SEQ ID NO: 1846234 - RNA, 16 nt, Salmonella typhimurium LT2
acgcgcuagcuucagg

SEQ ID NO: 1846235 - RNA, 20 nt, Salmonella typhimurium LT2
acgcgcagagauagccagcg

SEQ ID NO: 1846236 - RNA, 20 nt, Salmonella typhimurium LT2
acgcgccacuuccagcgcgc

SEQ ID NO: 1846237 - RNA, 15 nt, Salmonella typhimurium LT2
acgcgccagcaaaau

SEQ ID NO: 1846238 - RNA, 21 nt, Salmonella typhimurium LT2
acgcgccaucgucaccggauc

SEQ ID NO: 1846239 - RNA, 14 nt, Salmonella typhimurium LT2
acgcgauagauacc

SEQ ID NO: 1846240 - RNA, 21 nt, Salmonella typhimurium LT2
acgcgauaaaaaacgcccaga

SEQ ID NO: 1846241 - RNA, 19 nt, Salmonella typhimurium LT2
acgcgacucccaggcgcgc

SEQ ID NO: 1846242 - RNA, 15 nt, Salmonella typhimurium LT2
acgcgagaagcccgg

SEQ ID NO: 1846243 - RNA, 15 nt, Salmonella typhimurium LT2
acgcgcaaucagcac

SEQ ID NO: 1846244 - RNA, 16 nt, Salmonella typhimurium LT2
acgcgaucuucauagu

SEQ ID NO: 1846245 - RNA, 15 nt, Salmonella typhimurium LT2
acgcgaugagauaau

SEQ ID NO: 1846246 - RNA, 15 nt, Salmonella typhimurium LT2
acgcgaugccaguag

SEQ ID NO: 1846247 - RNA, 15 nt, Salmonella typhimurium LT2
acgcugcgccgcgcc

SEQ ID NO: 1846248 - RNA, 15 nt, Salmonella typhimurium LT2
acgcugcggccugcc

SEQ ID NO: 1846249 - RNA, 14 nt, Salmonella typhimurium LT2
acgcuuaucccagc

SEQ ID NO: 1846250 - RNA, 20 nt, Salmonella typhimurium LT2
acgcugauacguaacaugac

SEQ ID NO: 1846251 - RNA, 18 nt, Salmonella typhimurium LT2
acgcugauagccacggcg

SEQ ID NO: 1846252 - RNA, 21 nt, Salmonella typhimurium LT2
acgcuugcaugaccauccacg

SEQ ID NO: 1846253 - RNA, 14 nt, Salmonella typhimurium LT2
acgcuucugguugu

SEQ ID NO: 1846254 - RNA, 21 nt, Salmonella typhimurium LT2
acgcuuguuagcuuucugcca

SEQ ID NO: 1846255 - RNA, 22 nt, Salmonella typhimurium LT2
acgcuucauugguuaauucaaa

SEQ ID NO: 1846256 - RNA, 17 nt, Salmonella typhimurium LT2
acgcuucggcuccagcg

SEQ ID NO: 1846257 - RNA, 20 nt, Salmonella typhimurium LT2
acgcuucggugaucuccucg

SEQ ID NO: 1846258 - RNA, 20 nt, Salmonella typhimurium LT2
acgcuucguauuucuucgcu

SEQ ID NO: 1846259 - RNA, 20 nt, Salmonella typhimurium LT2
acgcuuccggcgaggcguaa

SEQ ID NO: 1846260 - RNA, 21 nt, Salmonella typhimurium LT2
acggcagccgccaccacaaag

SEQ ID NO: 1846261 - RNA, 12 nt, Salmonella typhimurium LT2
acggauaagcca

SEQ ID NO: 1846262 - RNA, 19 nt, Salmonella typhimurium LT2
acggauacgcugcgucagg

SEQ ID NO: 1846263 - RNA, 12 nt, Salmonella typhimurium LT2
acggauaaaaac

SEQ ID NO: 1846264 - RNA, 11 nt, Salmonella typhimurium LT2
acggagaaaag

SEQ ID NO: 1846265 - RNA, 12 nt, Salmonella typhimurium LT2
acggacgugggg

SEQ ID NO: 1846266 - RNA, 23 nt, Salmonella typhimurium LT2
acggagcauaauuuuccugucgu

SEQ ID NO: 1846267 - RNA, 23 nt, Salmonella typhimurium LT2
acgcuuuuaaauucgcuccacug

SEQ ID NO: 1846268 - RNA, 23 nt, Salmonella typhimurium LT2
acgcuuuggcaggccucuaucuu

SEQ ID NO: 1846269 - RNA, 16 nt, Salmonella typhimurium LT2
acgcuuugccagcauc

SEQ ID NO: 1846270 - RNA, 21 nt, Salmonella typhimurium LT2
acgcuuugcgauagcccggca

SEQ ID NO: 1846271 - RNA, 23 nt, Salmonella typhimurium LT2
acgcuuugcgauagcccggcaug

SEQ ID NO: 1846272 - RNA, 19 nt, Salmonella typhimurium LT2
acgcuuucuucccuccccu

SEQ ID NO: 1846273 - RNA, 23 nt, Salmonella typhimurium LT2
acggcuauucuucgaucgccugg

SEQ ID NO: 1846274 - RNA, 21 nt, Salmonella typhimurium LT2
acggcucaaacggccugcgcu

SEQ ID NO: 1846275 - RNA, 19 nt, Salmonella typhimurium LT2
acggcugcacaaaauacug

SEQ ID NO: 1846276 - RNA, 13 nt, Salmonella typhimurium LT2
acggcugaagcug

SEQ ID NO: 1846277 - RNA, 16 nt, Salmonella typhimurium LT2
acggcgugaccaccgc

SEQ ID NO: 1846278 - RNA, 16 nt, Salmonella typhimurium LT2
acggcuuuccagcagc

SEQ ID NO: 1846279 - RNA, 14 nt, Salmonella typhimurium LT2
acggcuuuucuuca

SEQ ID NO: 1846280 - RNA, 15 nt, Salmonella typhimurium LT2
acggcuggcaaugcg

SEQ ID NO: 1846281 - RNA, 15 nt, Salmonella typhimurium LT2
acggcuuaacgccag

SEQ ID NO: 1846282 - RNA, 23 nt, Salmonella typhimurium LT2
acggcgguaccauaccugcggcc

SEQ ID NO: 1846283 - RNA, 14 nt, Salmonella typhimurium LT2
acggcgucagccac

SEQ ID NO: 1846284 - RNA, 18 nt, Salmonella typhimurium LT2
acggcguaccagaaugcc

SEQ ID NO: 1846285 - RNA, 23 nt, Salmonella typhimurium LT2
acggcgcagauauuuuccaucac

SEQ ID NO: 1846286 - RNA, 19 nt, Salmonella typhimurium LT2
acggcgcagguaaaaucca

SEQ ID NO: 1846287 - RNA, 13 nt, Salmonella typhimurium LT2
acggcgcgccacc

SEQ ID NO: 1846288 - RNA, 13 nt, Salmonella typhimurium LT2
acggcaucaggaa

SEQ ID NO: 1846289 - RNA, 18 nt, Salmonella typhimurium LT2
acggcaucugcggcauga

SEQ ID NO: 1846290 - RNA, 19 nt, Salmonella typhimurium LT2
acggcauaagccagcccug

SEQ ID NO: 1846291 - RNA, 23 nt, Salmonella typhimurium LT2
acggcaguguuucccaacaaugc

SEQ ID NO: 1846292 - RNA, 21 nt, Salmonella typhimurium LT2
agaauaacguuuaacgcgugc

SEQ ID NO: 1846293 - RNA, 17 nt, Salmonella typhimurium LT2
agaauaaugcuggcgga

SEQ ID NO: 1846294 - RNA, 22 nt, Salmonella typhimurium LT2
agaauauauucuuuguuuaaaa

SEQ ID NO: 1846295 - RNA, 14 nt, Salmonella typhimurium LT2
agaauaaaacagcu

SEQ ID NO: 1846296 - RNA, 13 nt, Salmonella typhimurium LT2
agaaugcccagca

SEQ ID NO: 1846297 - RNA, 13 nt, Salmonella typhimurium LT2
agaaugcccugcu

SEQ ID NO: 1846298 - RNA, 14 nt, Salmonella typhimurium LT2
agaauguccccaua

SEQ ID NO: 1846299 - RNA, 15 nt, Salmonella typhimurium LT2
agaaugucgccaugu

SEQ ID NO: 1846300 - RNA, 13 nt, Salmonella typhimurium LT2
agaauaugccagg

SEQ ID NO: 1846301 - RNA, 13 nt, Salmonella typhimurium LT2
agaaucaccucuu

SEQ ID NO: 1846302 - RNA, 12 nt, Salmonella typhimurium LT2
agaaucacguaa

SEQ ID NO: 1846303 - RNA, 20 nt, Salmonella typhimurium LT2
agaaucagcaacacaaucag

SEQ ID NO: 1846304 - RNA, 13 nt, Salmonella typhimurium LT2
agaaaugcagggg

SEQ ID NO: 1846305 - RNA, 14 nt, Salmonella typhimurium LT2
agaaauuaaaucau

SEQ ID NO: 1846306 - RNA, 15 nt, Salmonella typhimurium LT2
agaagagaauggcca

SEQ ID NO: 1846307 - RNA, 17 nt, Salmonella typhimurium LT2
agaagcgccugucuauu

SEQ ID NO: 1846308 - RNA, 22 nt, Salmonella typhimurium LT2
agaagucugugaggaaagcgaa

SEQ ID NO: 1846309 - RNA, 16 nt, Salmonella typhimurium LT2
agaagugccaguaacu

SEQ ID NO: 1846310 - RNA, 16 nt, Salmonella typhimurium LT2
agaaggcgaacauaag

SEQ ID NO: 1846311 - RNA, 12 nt, Salmonella typhimurium LT2
agacaaaaaugg

SEQ ID NO: 1846312 - RNA, 10 nt, Salmonella typhimurium LT2
agacaacauc

SEQ ID NO: 1846313 - RNA, 14 nt, Salmonella typhimurium LT2
agacaacauccaga

SEQ ID NO: 1846314 - RNA, 16 nt, Salmonella typhimurium LT2
agaauuuguugguuua

SEQ ID NO: 1846315 - RNA, 17 nt, Salmonella typhimurium LT2
agaauuuguugguuuaa

SEQ ID NO: 1846316 - RNA, 20 nt, Salmonella typhimurium LT2
agaauuuguugguuuaaacu

SEQ ID NO: 1846317 - RNA, 20 nt, Salmonella typhimurium LT2
agaauuaccgguuucgguau

SEQ ID NO: 1846318 - RNA, 20 nt, Salmonella typhimurium LT2
agacaacccgucaccgccag

SEQ ID NO: 1846319 - RNA, 12 nt, Salmonella typhimurium LT2
agacaugaccgc

SEQ ID NO: 1846320 - RNA, 21 nt, Salmonella typhimurium LT2
agacagcuuauacugauaucu

SEQ ID NO: 1846321 - RNA, 22 nt, Salmonella typhimurium LT2
agacaggugaacauuacaaugu

SEQ ID NO: 1846322 - RNA, 17 nt, Salmonella typhimurium LT2
agaccgacuuuuuugcc

SEQ ID NO: 1846323 - RNA, 19 nt, Salmonella typhimurium LT2
agaccgaaccugcgccggu

SEQ ID NO: 1846324 - RNA, 16 nt, Salmonella typhimurium LT2
agaccgauuuggucag

SEQ ID NO: 1846325 - RNA, 16 nt, Salmonella typhimurium LT2
agaccgccuaacagcg

SEQ ID NO: 1846326 - RNA, 14 nt, Salmonella typhimurium LT2
agaccggggcaggc

SEQ ID NO: 1846327 - RNA, 13 nt, Salmonella typhimurium LT2
agaccuuuccagg

SEQ ID NO: 1846328 - RNA, 19 nt, Salmonella typhimurium LT2
agaccugucgcaaucccga

SEQ ID NO: 1846329 - RNA, 22 nt, Salmonella typhimurium LT2
agacgccaacgucgacagacgc

SEQ ID NO: 1846330 - RNA, 14 nt, Salmonella typhimurium LT2
agacgcauuaaaau

SEQ ID NO: 1846331 - RNA, 22 nt, Salmonella typhimurium LT2
agacgacaucgcucaaaacacu

SEQ ID NO: 1846332 - RNA, 16 nt, Salmonella typhimurium LT2
agacgacaucuuuucc

SEQ ID NO: 1846333 - RNA, 14 nt, Salmonella typhimurium LT2
agacgaccagggaa

SEQ ID NO: 1846334 - RNA, 20 nt, Salmonella typhimurium LT2
agacgaauaaucucaucgcc

SEQ ID NO: 1846335 - RNA, 21 nt, Salmonella typhimurium LT2
agacgaacaaacuccagcacg

SEQ ID NO: 1846336 - RNA, 21 nt, Salmonella typhimurium LT2
agacgaagaguucaacgccga

SEQ ID NO: 1846337 - RNA, 17 nt, Salmonella typhimurium LT2
agaccgacaucgccagu

SEQ ID NO: 1846338 - RNA, 23 nt, Salmonella typhimurium LT2
agaccaauaagucccaucgagcc

SEQ ID NO: 1846339 - RNA, 15 nt, Salmonella typhimurium LT2
agaccccgccaggcg

SEQ ID NO: 1846340 - RNA, 23 nt, Salmonella typhimurium LT2
agacauuuuuugugaccagcuuc

SEQ ID NO: 1846341 - RNA, 19 nt, Salmonella typhimurium LT2
agacaugaccgcacagcag

SEQ ID NO: 1846342 - RNA, 16 nt, Salmonella typhimurium LT2
agacgccgccgcaucc

SEQ ID NO: 1846343 - RNA, 23 nt, Salmonella typhimurium LT2
agacgcgaaacgaaacccaaaua

SEQ ID NO: 1846344 - RNA, 21 nt, Salmonella typhimurium LT2
agacgcuucauaucgcccagc

SEQ ID NO: 1846345 - RNA, 18 nt, Salmonella typhimurium LT2
agacucaccccuucuuua

SEQ ID NO: 1846346 - RNA, 19 nt, Salmonella typhimurium LT2
agacgcuggcacuggcagc

SEQ ID NO: 1846347 - RNA, 18 nt, Salmonella typhimurium LT2
agacgcuggcacuggcag

SEQ ID NO: 1846348 - RNA, 13 nt, Salmonella typhimurium LT2
agacgcugguugu

SEQ ID NO: 1846349 - RNA, 12 nt, Salmonella typhimurium LT2
agacucaucgcc

SEQ ID NO: 1846350 - RNA, 13 nt, Salmonella typhimurium LT2
agacucagccagg

SEQ ID NO: 1846351 - RNA, 18 nt, Salmonella typhimurium LT2
agacucaucgccgcaaug

SEQ ID NO: 1846352 - RNA, 13 nt, Salmonella typhimurium LT2
agacugcccggca

SEQ ID NO: 1846353 - RNA, 21 nt, Salmonella typhimurium LT2
agacuguugaaagccccggcu

SEQ ID NO: 1846354 - RNA, 17 nt, Salmonella typhimurium LT2
agacugugauggcgguc

SEQ ID NO: 1846355 - RNA, 16 nt, Salmonella typhimurium LT2
agacucgcggguuuca

SEQ ID NO: 1846356 - RNA, 21 nt, Salmonella typhimurium LT2
agacucgcgccuucgccgggu

SEQ ID NO: 1846357 - RNA, 14 nt, Salmonella typhimurium LT2
agacugauaagacu

SEQ ID NO: 1846358 - RNA, 14 nt, Salmonella typhimurium LT2
agacugacaaugac

SEQ ID NO: 1846359 - RNA, 16 nt, Salmonella typhimurium LT2
agacugacgaaacacu

SEQ ID NO: 1846360 - RNA, 16 nt, Salmonella typhimurium LT2
agacuucauuuuccac

SEQ ID NO: 1846361 - RNA, 22 nt, Salmonella typhimurium LT2
agacuucaaugccgcacacuca

SEQ ID NO: 1846362 - RNA, 23 nt, Salmonella typhimurium LT2
agacuucacgccauuccagcugg

SEQ ID NO: 1846363 - RNA, 18 nt, Salmonella typhimurium LT2
agacuuugcacagucugc

SEQ ID NO: 1846364 - RNA, 22 nt, Salmonella typhimurium LT2
agagaaacaacaccguaaaagg

SEQ ID NO: 1846365 - RNA, 12 nt, Salmonella typhimurium LT2
agagaaaaaaau

SEQ ID NO: 1846366 - RNA, 17 nt, Salmonella typhimurium LT2
agagaaaaaaauccagu

SEQ ID NO: 1846367 - RNA, 11 nt, Salmonella typhimurium LT2
agagaaaaaaa

SEQ ID NO: 1846368 - RNA, 10 nt, Salmonella typhimurium LT2
agagaaaaaa

SEQ ID NO: 1846369 - RNA, 16 nt, Salmonella typhimurium LT2
agagaaguguacaaac

SEQ ID NO: 1846370 - RNA, 20 nt, Salmonella typhimurium LT2
agagaagcuuuuucuuuauu

SEQ ID NO: 1846371 - RNA, 14 nt, Salmonella typhimurium LT2
agagaaccugaaca

SEQ ID NO: 1846372 - RNA, 18 nt, Salmonella typhimurium LT2
agagaaccugaacaauaa

SEQ ID NO: 1846373 - RNA, 20 nt, Salmonella typhimurium LT2
agagaaccugaacaauaauc

SEQ ID NO: 1846374 - RNA, 22 nt, Salmonella typhimurium LT2
agagaacgaaauauggcacagc

SEQ ID NO: 1846375 - RNA, 13 nt, Salmonella typhimurium LT2
agauaaauguccg

SEQ ID NO: 1846376 - RNA, 19 nt, Salmonella typhimurium LT2
agauaacuaugugcccggg

SEQ ID NO: 1846377 - RNA, 12 nt, Salmonella typhimurium LT2
agauaagaucuu

SEQ ID NO: 1846378 - RNA, 18 nt, Salmonella typhimurium LT2
agauaagccuccggauga

SEQ ID NO: 1846379 - RNA, 15 nt, Salmonella typhimurium LT2
agauaaacagcagcg

SEQ ID NO: 1846380 - RNA, 17 nt, Salmonella typhimurium LT2
agauaaacagcagcgcg

SEQ ID NO: 1846381 - RNA, 15 nt, Salmonella typhimurium LT2
agauaaaacaaaagg

SEQ ID NO: 1846382 - RNA, 19 nt, Salmonella typhimurium LT2
agauaaacagguaaaacaa

SEQ ID NO: 1846383 - RNA, 20 nt, Salmonella typhimurium LT2
agauaaacagguaaaacaaa

SEQ ID NO: 1846384 - RNA, 23 nt, Salmonella typhimurium LT2
agagugcuucuucaaacuuagcg

SEQ ID NO: 1846385 - RNA, 24 nt, Salmonella typhimurium LT2
agaguucauagcgcacaacgucag

SEQ ID NO: 1846386 - RNA, 18 nt, Salmonella typhimurium LT2
agaguucacguagcucaa

SEQ ID NO: 1846387 - RNA, 21 nt, Salmonella typhimurium LT2
agaguaaucguauucauugcc

SEQ ID NO: 1846388 - RNA, 15 nt, Salmonella typhimurium LT2
agaguaaauuauuua

SEQ ID NO: 1846389 - RNA, 11 nt, Salmonella typhimurium LT2
agaguaaccac

SEQ ID NO: 1846390 - RNA, 23 nt, Salmonella typhimurium LT2
agaggcugaaggcgcuccccugc

SEQ ID NO: 1846391 - RNA, 15 nt, Salmonella typhimurium LT2
agaggcagcaaagcu

SEQ ID NO: 1846392 - RNA, 15 nt, Salmonella typhimurium LT2
agaggaauguccagc

SEQ ID NO: 1846393 - RNA, 18 nt, Salmonella typhimurium LT2
agaggaauauuaucaauc

SEQ ID NO: 1846394 - RNA, 22 nt, Salmonella typhimurium LT2
agagcggauaagcgcagcgcca

SEQ ID NO: 1846395 - RNA, 21 nt, Salmonella typhimurium LT2
agagcgcuucuaacaaaacag

SEQ ID NO: 1846396 - RNA, 20 nt, Salmonella typhimurium LT2
agagcgggccguggccagga

SEQ ID NO: 1846397 - RNA, 24 nt, Salmonella typhimurium LT2
agagcggcuuauaaaacgcccugu

SEQ ID NO: 1846398 - RNA, 23 nt, Salmonella typhimurium LT2
agagcgucuuuuauccccacuac

SEQ ID NO: 1846399 - RNA, 17 nt, Salmonella typhimurium LT2
agagcaucaauggugaa

SEQ ID NO: 1846400 - RNA, 19 nt, Salmonella typhimurium LT2
agagcagcgccagcgacag

SEQ ID NO: 1846401 - RNA, 16 nt, Salmonella typhimurium LT2
agagcaggccaaaaaa

SEQ ID NO: 1846402 - RNA, 15 nt, Salmonella typhimurium LT2
agagacugaaaauaa

SEQ ID NO: 1846403 - RNA, 21 nt, Salmonella typhimurium LT2
acuuuuccacuaacuggcaau

SEQ ID NO: 1846404 - RNA, 17 nt, Salmonella typhimurium LT2
agaaaaagaagaaaaaa

SEQ ID NO: 1846405 - RNA, 19 nt, Salmonella typhimurium LT2
agaaaaagaagaaaaaauu

SEQ ID NO: 1846406 - RNA, 23 nt, Salmonella typhimurium LT2
agaaaacagcaugguguuaguuu

SEQ ID NO: 1846407 - RNA, 22 nt, Salmonella typhimurium LT2
agaaaaagaccgacaucgccag

SEQ ID NO: 1846408 - RNA, 18 nt, Salmonella typhimurium LT2
agaaaaccagaccuccac

SEQ ID NO: 1846409 - RNA, 16 nt, Salmonella typhimurium LT2
agaaaaccccguacag

SEQ ID NO: 1846410 - RNA, 17 nt, Salmonella typhimurium LT2
agaaaagcgaaaauaaa

SEQ ID NO: 1846411 - RNA, 15 nt, Salmonella typhimurium LT2
agaaaaggaauaccu

SEQ ID NO: 1846412 - RNA, 19 nt, Salmonella typhimurium LT2
agaaaaggaagaauaaaua

SEQ ID NO: 1846413 - RNA, 19 nt, Salmonella typhimurium LT2
agaaaauagaggaaauaac

SEQ ID NO: 1846414 - RNA, 22 nt, Salmonella typhimurium LT2
agaaagauaaaauacgugcgga

SEQ ID NO: 1846415 - RNA, 22 nt, Salmonella typhimurium LT2
agaaauaaaauacgcucaauau

SEQ ID NO: 1846416 - RNA, 12 nt, Salmonella typhimurium LT2
agaaauaaaaua

SEQ ID NO: 1846417 - RNA, 14 nt, Salmonella typhimurium LT2
agaaauaacucccu

SEQ ID NO: 1846418 - RNA, 22 nt, Salmonella typhimurium LT2
agaaauaacucccuauaaugcg

SEQ ID NO: 1846419 - RNA, 15 nt, Salmonella typhimurium LT2
agaaacaccagaaug

SEQ ID NO: 1846420 - RNA, 14 nt, Salmonella typhimurium LT2
agaaacaccagaau

SEQ ID NO: 1846421 - RNA, 13 nt, Salmonella typhimurium LT2
agaaauccacauu

SEQ ID NO: 1846422 - RNA, 14 nt, Salmonella typhimurium LT2
agaaaucaacgaaa

SEQ ID NO: 1846423 - RNA, 13 nt, Salmonella typhimurium LT2
agaaaucagcagg

SEQ ID NO: 1846424 - RNA, 14 nt, Salmonella typhimurium LT2
agaaauagaaaaau

SEQ ID NO: 1846425 - RNA, 13 nt, Salmonella typhimurium LT2
agaaauagcgcgc

SEQ ID NO: 1846426 - RNA, 23 nt, Salmonella typhimurium LT2
agaaauagacgagcgaaaaacug

SEQ ID NO: 1846427 - RNA, 14 nt, Salmonella typhimurium LT2
agaaaucaacguga

SEQ ID NO: 1846428 - RNA, 17 nt, Salmonella typhimurium LT2
acuuuaccggcccuucc

SEQ ID NO: 1846429 - RNA, 11 nt, Salmonella typhimurium LT2
acuuucaaaau

SEQ ID NO: 1846430 - RNA, 12 nt, Salmonella typhimurium LT2
acuuucagauuu

SEQ ID NO: 1846431 - RNA, 17 nt, Salmonella typhimurium LT2
acuuucagauuuuuaau

SEQ ID NO: 1846432 - RNA, 15 nt, Salmonella typhimurium LT2
acuuucauuccuuua

SEQ ID NO: 1846433 - RNA, 23 nt, Salmonella typhimurium LT2
acuuucagauaccaaauuacgca

SEQ ID NO: 1846434 - RNA, 19 nt, Salmonella typhimurium LT2
acuuuccaaaauccaggga

SEQ ID NO: 1846435 - RNA, 16 nt, Salmonella typhimurium LT2
acuuuccaaaauccag

SEQ ID NO: 1846436 - RNA, 13 nt, Salmonella typhimurium LT2
acuuuauaaauca

SEQ ID NO: 1846437 - RNA, 22 nt, Salmonella typhimurium LT2
acuuuacugaauaacagcacca

SEQ ID NO: 1846438 - RNA, 17 nt, Salmonella typhimurium LT2
acuuuuaaauugaagag

SEQ ID NO: 1846439 - RNA, 17 nt, Salmonella typhimurium LT2
acuuugcuuuucugcuu

SEQ ID NO: 1846440 - RNA, 16 nt, Salmonella typhimurium LT2
acuuugcgcuccugcu

SEQ ID NO: 1846441 - RNA, 14 nt, Salmonella typhimurium LT2
acuuugccagaggc

SEQ ID NO: 1846442 - RNA, 20 nt, Salmonella typhimurium LT2
acuuugcccuuuuugcauuc

SEQ ID NO: 1846443 - RNA, 22 nt, Salmonella typhimurium LT2
acuuucucggcuuuccagcuca

SEQ ID NO: 1846444 - RNA, 13 nt, Salmonella typhimurium LT2
acuuucuacaaau

SEQ ID NO: 1846445 - RNA, 18 nt, Salmonella typhimurium LT2
acuuucuccaugccagaa

SEQ ID NO: 1846446 - RNA, 18 nt, Salmonella typhimurium LT2
acuuucuugccacuggcc

SEQ ID NO: 1846447 - RNA, 19 nt, Salmonella typhimurium LT2
acuuuccuggcugucggca

SEQ ID NO: 1846448 - RNA, 23 nt, Salmonella typhimurium LT2
acuuucgcccggcgccagcucaa

SEQ ID NO: 1846449 - RNA, 16 nt, Salmonella typhimurium LT2
acuuaccgggcaucug

SEQ ID NO: 1846450 - RNA, 21 nt, Salmonella typhimurium LT2
acuuacccagagucaccagca

SEQ ID NO: 1846451 - RNA, 12 nt, Salmonella typhimurium LT2
acuuacuuagua

SEQ ID NO: 1846452 - RNA, 16 nt, Salmonella typhimurium LT2
acuuauugcaagaaau

SEQ ID NO: 1846453 - RNA, 17 nt, Salmonella typhimurium LT2
acuuauuuuauuuuuau

SEQ ID NO: 1846454 - RNA, 18 nt, Salmonella typhimurium LT2
acuucaugcguuagccua

SEQ ID NO: 1846455 - RNA, 21 nt, Salmonella typhimurium LT2
acuucaucgccacagacgaag

SEQ ID NO: 1846456 - RNA, 19 nt, Salmonella typhimurium LT2
acuucauccggauaaagcc

SEQ ID NO: 1846457 - RNA, 15 nt, Salmonella typhimurium LT2
acuguugcgccagca

SEQ ID NO: 1846458 - RNA, 15 nt, Salmonella typhimurium LT2
acuguugcaguuuac

SEQ ID NO: 1846459 - RNA, 20 nt, Salmonella typhimurium LT2
acuguugccccgcuuucagc

SEQ ID NO: 1846460 - RNA, 18 nt, Salmonella typhimurium LT2
acuguuuaaugcuuucaa

SEQ ID NO: 1846461 - RNA, 19 nt, Salmonella typhimurium LT2
acuguuuuaccaaaucaau

SEQ ID NO: 1846462 - RNA, 15 nt, Salmonella typhimurium LT2
acuguuugcugacaa

SEQ ID NO: 1846463 - RNA, 16 nt, Salmonella typhimurium LT2
acugugcgaagguggc

SEQ ID NO: 1846464 - RNA, 18 nt, Salmonella typhimurium LT2
acugugcgccgcguucgc

SEQ ID NO: 1846465 - RNA, 22 nt, Salmonella typhimurium LT2
acugugcugauuuuggcuucac

SEQ ID NO: 1846466 - RNA, 14 nt, Salmonella typhimurium LT2
acugucgaaaccag

SEQ ID NO: 1846467 - RNA, 21 nt, Salmonella typhimurium LT2
acugugaggcgucuuccagca

SEQ ID NO: 1846468 - RNA, 15 nt, Salmonella typhimurium LT2
acugugauuacgacu

SEQ ID NO: 1846469 - RNA, 22 nt, Salmonella typhimurium LT2
acuguagcgccgcuuccaggcg

SEQ ID NO: 1846470 - RNA, 21 nt, Salmonella typhimurium LT2
acuguacgccacggcuuaaau

SEQ ID NO: 1846471 - RNA, 16 nt, Salmonella typhimurium LT2
acugacuauccacagc

SEQ ID NO: 1846472 - RNA, 12 nt, Salmonella typhimurium LT2
acuguaaauugc

SEQ ID NO: 1846473 - RNA, 16 nt, Salmonella typhimurium LT2
acugacgcgccagcuc

SEQ ID NO: 1846474 - RNA, 15 nt, Salmonella typhimurium LT2
acugacggcgcucuu

SEQ ID NO: 1846475 - RNA, 15 nt, Salmonella typhimurium LT2
acugucccgaauauu

SEQ ID NO: 1846476 - RNA, 19 nt, Salmonella typhimurium LT2
acuguccacgacagaaccc

SEQ ID NO: 1846477 - RNA, 22 nt, Salmonella typhimurium LT2
acugucauuacugggucgcguu

SEQ ID NO: 1846478 - RNA, 12 nt, Salmonella typhimurium LT2
acugucagaaau

SEQ ID NO: 1846479 - RNA, 10 nt, Salmonella typhimurium LT2
acuuccagcg

SEQ ID NO: 1846480 - RNA, 15 nt, Salmonella typhimurium LT2
acuucuaauuuuucc

SEQ ID NO: 1846481 - RNA, 12 nt, Salmonella typhimurium LT2
acuucuaauuuu

SEQ ID NO: 1846482 - RNA, 14 nt, Salmonella typhimurium LT2
acuucuccuccauc

SEQ ID NO: 1846483 - RNA, 21 nt, Salmonella typhimurium LT2
acuugaaguaugaaggguaug

SEQ ID NO: 1846484 - RNA, 22 nt, Salmonella typhimurium LT2
acuugccguuuuucucaucaag

SEQ ID NO: 1846485 - RNA, 14 nt, Salmonella typhimurium LT2
acuugauggaaaac

SEQ ID NO: 1846486 - RNA, 13 nt, Salmonella typhimurium LT2
acuugcgccgcca

SEQ ID NO: 1846487 - RNA, 20 nt, Salmonella typhimurium LT2
acuugcugcuaugaaaaauc

SEQ ID NO: 1846488 - RNA, 17 nt, Salmonella typhimurium LT2
agccaacacaucagcaa

SEQ ID NO: 1846489 - RNA, 23 nt, Salmonella typhimurium LT2
agccaaaagcgccacgcgucagg

SEQ ID NO: 1846490 - RNA, 12 nt, Salmonella typhimurium LT2
agcauuuguagc

SEQ ID NO: 1846491 - RNA, 14 nt, Salmonella typhimurium LT2
agcauuugcgcuuu

SEQ ID NO: 1846492 - RNA, 21 nt, Salmonella typhimurium LT2
agccacaggaaccgguagcca

SEQ ID NO: 1846493 - RNA, 20 nt, Salmonella typhimurium LT2
agccacagauuaugcagcuc

SEQ ID NO: 1846494 - RNA, 17 nt, Salmonella typhimurium LT2
agccacaaucugauaau

SEQ ID NO: 1846495 - RNA, 17 nt, Salmonella typhimurium LT2
agccacaagagcagcaa

SEQ ID NO: 1846496 - RNA, 23 nt, Salmonella typhimurium LT2
agccaauauccggauauucugca

SEQ ID NO: 1846497 - RNA, 13 nt, Salmonella typhimurium LT2
agcauuauuuuua

SEQ ID NO: 1846498 - RNA, 15 nt, Salmonella typhimurium LT2
agcauuauuuuuaac

SEQ ID NO: 1846499 - RNA, 23 nt, Salmonella typhimurium LT2
agcauuacccccgccauaauaca

SEQ ID NO: 1846500 - RNA, 14 nt, Salmonella typhimurium LT2
agcauucuauuguu

SEQ ID NO: 1846501 - RNA, 21 nt, Salmonella typhimurium LT2
agcauugaggcuacccagaca

SEQ ID NO: 1846502 - RNA, 15 nt, Salmonella typhimurium LT2
agcauugauuuuuca

SEQ ID NO: 1846503 - RNA, 16 nt, Salmonella typhimurium LT2
agcauugauuuuucau

SEQ ID NO: 1846504 - RNA, 21 nt, Salmonella typhimurium LT2
agcauugauuuuucaucugca

SEQ ID NO: 1846505 - RNA, 18 nt, Salmonella typhimurium LT2
agcauugccguuuucaau

SEQ ID NO: 1846506 - RNA, 23 nt, Salmonella typhimurium LT2
agcauuggucaucgcccaugaca

SEQ ID NO: 1846507 - RNA, 21 nt, Salmonella typhimurium LT2
agcauugccguuuucaauaau

SEQ ID NO: 1846508 - RNA, 16 nt, Salmonella typhimurium LT2
agcaugggcuaaagca

SEQ ID NO: 1846509 - RNA, 20 nt, Salmonella typhimurium LT2
agcaugacugugcgccgcgu

SEQ ID NO: 1846510 - RNA, 23 nt, Salmonella typhimurium LT2
agccacuucaugcgcuuuuucac

SEQ ID NO: 1846511 - RNA, 17 nt, Salmonella typhimurium LT2
agccagaagcccggguc

SEQ ID NO: 1846512 - RNA, 22 nt, Salmonella typhimurium LT2
agccagaaugacauggucgaac

SEQ ID NO: 1846513 - RNA, 20 nt, Salmonella typhimurium LT2
agccagaacgagaggaggag

SEQ ID NO: 1846514 - RNA, 15 nt, Salmonella typhimurium LT2
agccagaacucaucu

SEQ ID NO: 1846515 - RNA, 18 nt, Salmonella typhimurium LT2
agccacugcgccauuaac

SEQ ID NO: 1846516 - RNA, 17 nt, Salmonella typhimurium LT2
agccacugcauuacucg

SEQ ID NO: 1846517 - RNA, 16 nt, Salmonella typhimurium LT2
agccacguaaagacga

SEQ ID NO: 1846518 - RNA, 15 nt, Salmonella typhimurium LT2
agccagccggagagc

SEQ ID NO: 1846519 - RNA, 18 nt, Salmonella typhimurium LT2
agccagcguuucuggaag

SEQ ID NO: 1846520 - RNA, 20 nt, Salmonella typhimurium LT2
agccagcucaccagccaaau

SEQ ID NO: 1846521 - RNA, 23 nt, Salmonella typhimurium LT2
agccagcguaaauagcccggauc

SEQ ID NO: 1846522 - RNA, 20 nt, Salmonella typhimurium LT2
agccagcguaaauagcccgg

SEQ ID NO: 1846523 - RNA, 19 nt, Salmonella typhimurium LT2
agccagcgagcgcagucca

SEQ ID NO: 1846524 - RNA, 13 nt, Salmonella typhimurium LT2
agccagcagcuca

SEQ ID NO: 1846525 - RNA, 13 nt, Salmonella typhimurium LT2
agccagccaaagc

SEQ ID NO: 1846526 - RNA, 14 nt, Salmonella typhimurium LT2
agccagauaaagca

SEQ ID NO: 1846527 - RNA, 21 nt, Salmonella typhimurium LT2
agccagaguuuuaaaaccauu

SEQ ID NO: 1846528 - RNA, 16 nt, Salmonella typhimurium LT2
agccagaggcuaauca

SEQ ID NO: 1846529 - RNA, 18 nt, Salmonella typhimurium LT2
agccagauguaaucugac

SEQ ID NO: 1846530 - RNA, 18 nt, Salmonella typhimurium LT2
agccagauaaagcagcga

SEQ ID NO: 1846531 - RNA, 23 nt, Salmonella typhimurium LT2
agccagacgcuccgcaguaauca

SEQ ID NO: 1846532 - RNA, 19 nt, Salmonella typhimurium LT2
agccagacgcgcagcaccg

SEQ ID NO: 1846533 - RNA, 19 nt, Salmonella typhimurium LT2
agccauguaaaauagcgcc

SEQ ID NO: 1846534 - RNA, 17 nt, Salmonella typhimurium LT2
agccauuaaugcaggca

SEQ ID NO: 1846535 - RNA, 17 nt, Salmonella typhimurium LT2
agccauucgaauucuga

SEQ ID NO: 1846536 - RNA, 16 nt, Salmonella typhimurium LT2
agccauucgccacugg

SEQ ID NO: 1846537 - RNA, 19 nt, Salmonella typhimurium LT2
agccaugcauaaugcagcc

SEQ ID NO: 1846538 - RNA, 17 nt, Salmonella typhimurium LT2
agccaugccagcaguuu

SEQ ID NO: 1846539 - RNA, 15 nt, Salmonella typhimurium LT2
agccaugccagcagu

SEQ ID NO: 1846540 - RNA, 13 nt, Salmonella typhimurium LT2
agccaugcccggc

SEQ ID NO: 1846541 - RNA, 14 nt, Salmonella typhimurium LT2
agccaugcccggcg

SEQ ID NO: 1846542 - RNA, 14 nt, Salmonella typhimurium LT2
agccauggcccaaa

SEQ ID NO: 1846543 - RNA, 18 nt, Salmonella typhimurium LT2
agccauccucacgcaacc

SEQ ID NO: 1846544 - RNA, 17 nt, Salmonella typhimurium LT2
agccauaauacaauccg

SEQ ID NO: 1846545 - RNA, 12 nt, Salmonella typhimurium LT2
agccauccugca

SEQ ID NO: 1846546 - RNA, 12 nt, Salmonella typhimurium LT2
agccauaaugcu

SEQ ID NO: 1846547 - RNA, 21 nt, Salmonella typhimurium LT2
agccauaaugcugccagcaug

SEQ ID NO: 1846548 - RNA, 22 nt, Salmonella typhimurium LT2
agccauaaugcugccagcauga

SEQ ID NO: 1846549 - RNA, 16 nt, Salmonella typhimurium LT2
agccaguguucccugc

SEQ ID NO: 1846550 - RNA, 13 nt, Salmonella typhimurium LT2
agccaguucucaa

SEQ ID NO: 1846551 - RNA, 22 nt, Salmonella typhimurium LT2
agccaguuguucgauaaccugu

SEQ ID NO: 1846552 - RNA, 17 nt, Salmonella typhimurium LT2
agccagucgccaggcaa

SEQ ID NO: 1846553 - RNA, 18 nt, Salmonella typhimurium LT2
agccagucgccaggcaag

SEQ ID NO: 1846554 - RNA, 16 nt, Salmonella typhimurium LT2
agccaguagcugguga

SEQ ID NO: 1846555 - RNA, 19 nt, Salmonella typhimurium LT2
agccaguagcuggugacuu

SEQ ID NO: 1846556 - RNA, 20 nt, Salmonella typhimurium LT2
agccagguugcgcccggcgc

SEQ ID NO: 1846557 - RNA, 22 nt, Salmonella typhimurium LT2
agccagguauuuagccacgccg

SEQ ID NO: 1846558 - RNA, 17 nt, Salmonella typhimurium LT2
agccaggucagcggaga

SEQ ID NO: 1846559 - RNA, 14 nt, Salmonella typhimurium LT2
agccagguccagau

SEQ ID NO: 1846560 - RNA, 19 nt, Salmonella typhimurium LT2
agccaggcggcaauauccu

SEQ ID NO: 1846561 - RNA, 19 nt, Salmonella typhimurium LT2
agccaggcuuuaaauucag

SEQ ID NO: 1846562 - RNA, 15 nt, Salmonella typhimurium LT2
agccagggaacucca

SEQ ID NO: 1846563 - RNA, 15 nt, Salmonella typhimurium LT2
agcaucaaacuuuua

SEQ ID NO: 1846564 - RNA, 14 nt, Salmonella typhimurium LT2
agcauauccagcgc

SEQ ID NO: 1846565 - RNA, 17 nt, Salmonella typhimurium LT2
agcauaguaaauuguuu

SEQ ID NO: 1846566 - RNA, 16 nt, Salmonella typhimurium LT2
agcaucaauagcagcu

SEQ ID NO: 1846567 - RNA, 16 nt, Salmonella typhimurium LT2
agcaucaucugccauu

SEQ ID NO: 1846568 - RNA, 15 nt, Salmonella typhimurium LT2
agcaucaucugccau

SEQ ID NO: 1846569 - RNA, 23 nt, Salmonella typhimurium LT2
agcaucauuuuuuaauaucaauu

SEQ ID NO: 1846570 - RNA, 18 nt, Salmonella typhimurium LT2
agcauccacgccacaaua

SEQ ID NO: 1846571 - RNA, 18 nt, Salmonella typhimurium LT2
agcauccgggauauaaaa

SEQ ID NO: 1846572 - RNA, 20 nt, Salmonella typhimurium LT2
agcauccgggauauaaaauu

SEQ ID NO: 1846573 - RNA, 15 nt, Salmonella typhimurium LT2
agcaucgcagcauca

SEQ ID NO: 1846574 - RNA, 22 nt, Salmonella typhimurium LT2
agcaucgcuuuuaggcugaaag

SEQ ID NO: 1846575 - RNA, 17 nt, Salmonella typhimurium LT2
agcaucgcuaaccggcg

SEQ ID NO: 1846576 - RNA, 17 nt, Salmonella typhimurium LT2
agcaucuuaagaaaauu

SEQ ID NO: 1846577 - RNA, 22 nt, Salmonella typhimurium LT2
agcaucucacguacaaacgcuu

SEQ ID NO: 1846578 - RNA, 18 nt, Salmonella typhimurium LT2
agcaucugauagcccauc

SEQ ID NO: 1846579 - RNA, 17 nt, Salmonella typhimurium LT2
agcauaaaaaacaucau

SEQ ID NO: 1846580 - RNA, 16 nt, Salmonella typhimurium LT2
agcauacacauucagg

SEQ ID NO: 1846581 - RNA, 17 nt, Salmonella typhimurium LT2
agcauacgacaucgcca

SEQ ID NO: 1846582 - RNA, 15 nt, Salmonella typhimurium LT2
agcaguugcauuccc

SEQ ID NO: 1846583 - RNA, 14 nt, Salmonella typhimurium LT2
agcaguucagcagc

SEQ ID NO: 1846584 - RNA, 14 nt, Salmonella typhimurium LT2
agcagugggaaaau

SEQ ID NO: 1846585 - RNA, 24 nt, Salmonella typhimurium LT2
agcaguaugcccccuccagccagc

SEQ ID NO: 1846586 - RNA, 14 nt, Salmonella typhimurium LT2
agcagcgcaucaug

SEQ ID NO: 1846587 - RNA, 19 nt, Salmonella typhimurium LT2
agcagcgaugacagcagga

SEQ ID NO: 1846588 - RNA, 17 nt, Salmonella typhimurium LT2
agcagcgaugacagcag

SEQ ID NO: 1846589 - RNA, 15 nt, Salmonella typhimurium LT2
agcagccuggcggcu

SEQ ID NO: 1846590 - RNA, 17 nt, Salmonella typhimurium LT2
agcagccagcccagcgc

SEQ ID NO: 1846591 - RNA, 13 nt, Salmonella typhimurium LT2
agcagcagucucu

SEQ ID NO: 1846592 - RNA, 13 nt, Salmonella typhimurium LT2
agcagcagcacac

SEQ ID NO: 1846593 - RNA, 20 nt, Salmonella typhimurium LT2
agcagcauacgacaucgcca

SEQ ID NO: 1846594 - RNA, 18 nt, Salmonella typhimurium LT2
agcagccagaaaaaggga

SEQ ID NO: 1846595 - RNA, 16 nt, Salmonella typhimurium LT2
agcagccagacccgcg

SEQ ID NO: 1846596 - RNA, 15 nt, Salmonella typhimurium LT2
agcagccagaaaaag

SEQ ID NO: 1846597 - RNA, 11 nt, Salmonella typhimurium LT2
agcagccagcc

SEQ ID NO: 1846598 - RNA, 17 nt, Salmonella typhimurium LT2
agcagccacagaaugcc

SEQ ID NO: 1846599 - RNA, 23 nt, Salmonella typhimurium LT2
agcagcggcgggauacucggcac

SEQ ID NO: 1846600 - RNA, 16 nt, Salmonella typhimurium LT2
agcagcgccagcgaca

SEQ ID NO: 1846601 - RNA, 20 nt, Salmonella typhimurium LT2
agcagcugcuuaacuucugc

SEQ ID NO: 1846602 - RNA, 14 nt, Salmonella typhimurium LT2
agcagcuucaugca

SEQ ID NO: 1846603 - RNA, 18 nt, Salmonella typhimurium LT2
agcagcuccccgccgcgg

SEQ ID NO: 1846604 - RNA, 17 nt, Salmonella typhimurium LT2
agcagcucgauaauccc

SEQ ID NO: 1846605 - RNA, 17 nt, Salmonella typhimurium LT2
agcaggauauccugcgg

SEQ ID NO: 1846606 - RNA, 13 nt, Salmonella typhimurium LT2
agcaggcgggcuu

SEQ ID NO: 1846607 - RNA, 24 nt, Salmonella typhimurium LT2
agcaggcgggacgccauagcguuu

SEQ ID NO: 1846608 - RNA, 13 nt, Salmonella typhimurium LT2
agcaggcaaaaaa

SEQ ID NO: 1846609 - RNA, 20 nt, Salmonella typhimurium LT2
agcaggccaaaaaagccgcu

SEQ ID NO: 1846610 - RNA, 15 nt, Salmonella typhimurium LT2
agcagggucaggaac

SEQ ID NO: 1846611 - RNA, 16 nt, Salmonella typhimurium LT2
agcagguaaacagaca

SEQ ID NO: 1846612 - RNA, 21 nt, Salmonella typhimurium LT2
agcaggugcggacugggcuga

SEQ ID NO: 1846613 - RNA, 14 nt, Salmonella typhimurium LT2
agcagggucaggaa

SEQ ID NO: 1846614 - RNA, 22 nt, Salmonella typhimurium LT2
agcagggucaggaacugcggcc

SEQ ID NO: 1846615 - RNA, 16 nt, Salmonella typhimurium LT2
agcaggcuuacgauau

SEQ ID NO: 1846616 - RNA, 22 nt, Salmonella typhimurium LT2
agcacaacgcauuggcaaugaa

SEQ ID NO: 1846617 - RNA, 20 nt, Salmonella typhimurium LT2
agcacaauaacgaccccaau

SEQ ID NO: 1846618 - RNA, 17 nt, Salmonella typhimurium LT2
agcacaauggucagcgc

SEQ ID NO: 1846619 - RNA, 16 nt, Salmonella typhimurium LT2
agcacaccauuucaca

SEQ ID NO: 1846620 - RNA, 21 nt, Salmonella typhimurium LT2
agcacaccauuucacaaauua

SEQ ID NO: 1846621 - RNA, 19 nt, Salmonella typhimurium LT2
agcaauuccgccaucucau

SEQ ID NO: 1846622 - RNA, 21 nt, Salmonella typhimurium LT2
agcaauuacggacagaaaaaa

SEQ ID NO: 1846623 - RNA, 11 nt, Salmonella typhimurium LT2
agcaauuacua

SEQ ID NO: 1846624 - RNA, 14 nt, Salmonella typhimurium LT2
agcaauuuccucug

SEQ ID NO: 1846625 - RNA, 20 nt, Salmonella typhimurium LT2
agcacaaagugcgcugucag

SEQ ID NO: 1846626 - RNA, 21 nt, Salmonella typhimurium LT2
agcacaaacaauuuacgcagc

SEQ ID NO: 1846627 - RNA, 20 nt, Salmonella typhimurium LT2
agcacaaaaaucaugcucau

SEQ ID NO: 1846628 - RNA, 22 nt, Salmonella typhimurium LT2
agcacauuacaggcaucuucca

SEQ ID NO: 1846629 - RNA, 12 nt, Salmonella typhimurium LT2
agcaccaccugc

SEQ ID NO: 1846630 - RNA, 17 nt, Salmonella typhimurium LT2
agcacagcccaguaaua

SEQ ID NO: 1846631 - RNA, 19 nt, Salmonella typhimurium LT2
agcacagcccauaccagcg

SEQ ID NO: 1846632 - RNA, 14 nt, Salmonella typhimurium LT2
agcacauagcugag

SEQ ID NO: 1846633 - RNA, 20 nt, Salmonella typhimurium LT2
agcaccggauacaagguauc

SEQ ID NO: 1846634 - RNA, 18 nt, Salmonella typhimurium LT2
agcaccgauccaauauua

SEQ ID NO: 1846635 - RNA, 21 nt, Salmonella typhimurium LT2
agcaccucgguauguccugcc

SEQ ID NO: 1846636 - RNA, 18 nt, Salmonella typhimurium LT2
agcaccugcgacgcauga

SEQ ID NO: 1846637 - RNA, 22 nt, Salmonella typhimurium LT2
agcaccgguuaacauaugggca

SEQ ID NO: 1846638 - RNA, 14 nt, Salmonella typhimurium LT2
agcaccgguuuuuc

SEQ ID NO: 1846639 - RNA, 13 nt, Salmonella typhimurium LT2
agcacccagagua

SEQ ID NO: 1846640 - RNA, 14 nt, Salmonella typhimurium LT2
agcaccaggccaac

SEQ ID NO: 1846641 - RNA, 13 nt, Salmonella typhimurium LT2
agcaccaggccaa

SEQ ID NO: 1846642 - RNA, 22 nt, Salmonella typhimurium LT2
agcaccaggauacguucaucuu

SEQ ID NO: 1846643 - RNA, 17 nt, Salmonella typhimurium LT2
agcaccagcgagauaau

SEQ ID NO: 1846644 - RNA, 21 nt, Salmonella typhimurium LT2
agcaccaguacaauuuccugc

SEQ ID NO: 1846645 - RNA, 13 nt, Salmonella typhimurium LT2
agcaccagcaggu

SEQ ID NO: 1846646 - RNA, 13 nt, Salmonella typhimurium LT2
agcaccagcagcg

SEQ ID NO: 1846647 - RNA, 15 nt, Salmonella typhimurium LT2
agcaccagcaggugg

SEQ ID NO: 1846648 - RNA, 21 nt, Salmonella typhimurium LT2
agcaccagauagcguauuaua

SEQ ID NO: 1846649 - RNA, 16 nt, Salmonella typhimurium LT2
agcaccuuauccggcc

SEQ ID NO: 1846650 - RNA, 17 nt, Salmonella typhimurium LT2
agcacgcuuacccagca

SEQ ID NO: 1846651 - RNA, 19 nt, Salmonella typhimurium LT2
agcacgcuucggugaucuc

SEQ ID NO: 1846652 - RNA, 16 nt, Salmonella typhimurium LT2
agcacgccaccgggcu

SEQ ID NO: 1846653 - RNA, 15 nt, Salmonella typhimurium LT2
agcacucggcgccuu

SEQ ID NO: 1846654 - RNA, 19 nt, Salmonella typhimurium LT2
agcacugcuuaaauuuuuu

SEQ ID NO: 1846655 - RNA, 18 nt, Salmonella typhimurium LT2
agcacuacggcaaacaca

SEQ ID NO: 1846656 - RNA, 21 nt, Salmonella typhimurium LT2
agcacuacggauggcccugcc

SEQ ID NO: 1846657 - RNA, 14 nt, Salmonella typhimurium LT2
agcacuaacagcag

SEQ ID NO: 1846658 - RNA, 13 nt, Salmonella typhimurium LT2
agcacguccugga

SEQ ID NO: 1846659 - RNA, 17 nt, Salmonella typhimurium LT2
agcacguaggccagaug

SEQ ID NO: 1846660 - RNA, 15 nt, Salmonella typhimurium LT2
agcagauagccugcc

SEQ ID NO: 1846661 - RNA, 20 nt, Salmonella typhimurium LT2
agcagauaccgaccgugaga

SEQ ID NO: 1846662 - RNA, 20 nt, Salmonella typhimurium LT2
agcagauaccagccuucgga

SEQ ID NO: 1846663 - RNA, 15 nt, Salmonella typhimurium LT2
agcagagcggggaga

SEQ ID NO: 1846664 - RNA, 16 nt, Salmonella typhimurium LT2
agcagcagcagcgcuu

SEQ ID NO: 1846665 - RNA, 21 nt, Salmonella typhimurium LT2
agcagcagcguaauggccacc

SEQ ID NO: 1846666 - RNA, 17 nt, Salmonella typhimurium LT2
agcagcaacccugccgu

SEQ ID NO: 1846667 - RNA, 12 nt, Salmonella typhimurium LT2
agcagcaauaau

SEQ ID NO: 1846668 - RNA, 22 nt, Salmonella typhimurium LT2
agcacuucgcugauaccgcccu

SEQ ID NO: 1846669 - RNA, 13 nt, Salmonella typhimurium LT2
agcacuucuccac

SEQ ID NO: 1846670 - RNA, 14 nt, Salmonella typhimurium LT2
agcacuucccacug

SEQ ID NO: 1846671 - RNA, 15 nt, Salmonella typhimurium LT2
agcacuucccacugu

SEQ ID NO: 1846672 - RNA, 20 nt, Salmonella typhimurium LT2
agcagaagacggaaaccaga

SEQ ID NO: 1846673 - RNA, 18 nt, Salmonella typhimurium LT2
agauuuccggcaccagaa

SEQ ID NO: 1846674 - RNA, 17 nt, Salmonella typhimurium LT2
agauuuaucaauuuuua

SEQ ID NO: 1846675 - RNA, 19 nt, Salmonella typhimurium LT2
agauuucuuaauuccucag

SEQ ID NO: 1846676 - RNA, 13 nt, Salmonella typhimurium LT2
agauuucuuaauu

SEQ ID NO: 1846677 - RNA, 16 nt, Salmonella typhimurium LT2
agauuggugaugcgca

SEQ ID NO: 1846678 - RNA, 15 nt, Salmonella typhimurium LT2
agauaauucucuuug

SEQ ID NO: 1846679 - RNA, 17 nt, Salmonella typhimurium LT2
agauugucaccguaaua

SEQ ID NO: 1846680 - RNA, 20 nt, Salmonella typhimurium LT2
agauaaugcucauuauuugg

SEQ ID NO: 1846681 - RNA, 19 nt, Salmonella typhimurium LT2
agauaaggagaaagaccuu

SEQ ID NO: 1846682 - RNA, 17 nt, Salmonella typhimurium LT2
agauaagcgucugcaau

SEQ ID NO: 1846683 - RNA, 12 nt, Salmonella typhimurium LT2
agauaauagcug

SEQ ID NO: 1846684 - RNA, 20 nt, Salmonella typhimurium LT2
agcaaauccucgucaaggcu

SEQ ID NO: 1846685 - RNA, 18 nt, Salmonella typhimurium LT2
agcaaaucgggaaaauga

SEQ ID NO: 1846686 - RNA, 16 nt, Salmonella typhimurium LT2
agcaaaguaaaacaag

SEQ ID NO: 1846687 - RNA, 21 nt, Salmonella typhimurium LT2
agcaaauaaucgcccaccuga

SEQ ID NO: 1846688 - RNA, 14 nt, Salmonella typhimurium LT2
agcaaauaugaaga

SEQ ID NO: 1846689 - RNA, 18 nt, Salmonella typhimurium LT2
agcaaaccggcaugaaga

SEQ ID NO: 1846690 - RNA, 18 nt, Salmonella typhimurium LT2
agcaaaccgacccaaaaa

SEQ ID NO: 1846691 - RNA, 15 nt, Salmonella typhimurium LT2
agcaaaauggcaauu

SEQ ID NO: 1846692 - RNA, 19 nt, Salmonella typhimurium LT2
agauuuuucugcgccacca

SEQ ID NO: 1846693 - RNA, 19 nt, Salmonella typhimurium LT2
agcaaaaaagcgccuuuag

SEQ ID NO: 1846694 - RNA, 22 nt, Salmonella typhimurium LT2
agcaacccugccgucucaacca

SEQ ID NO: 1846695 - RNA, 16 nt, Salmonella typhimurium LT2
agcaacccaccugcca

SEQ ID NO: 1846696 - RNA, 13 nt, Salmonella typhimurium LT2
agcaaccagaaug

SEQ ID NO: 1846697 - RNA, 14 nt, Salmonella typhimurium LT2
agcaaccagaaugc

SEQ ID NO: 1846698 - RNA, 22 nt, Salmonella typhimurium LT2
agcaacauagccauaucgucau

SEQ ID NO: 1846699 - RNA, 19 nt, Salmonella typhimurium LT2
agcaaccagcuaaccuguu

SEQ ID NO: 1846700 - RNA, 22 nt, Salmonella typhimurium LT2
agcaacacuuugcgcugcgcau

SEQ ID NO: 1846701 - RNA, 22 nt, Salmonella typhimurium LT2
agcaacaaaccgauaaucacca

SEQ ID NO: 1846702 - RNA, 13 nt, Salmonella typhimurium LT2
agcaaauugcuga

SEQ ID NO: 1846703 - RNA, 20 nt, Salmonella typhimurium LT2
agcaacugcgcgcggguuuc

SEQ ID NO: 1846704 - RNA, 22 nt, Salmonella typhimurium LT2
agcaacuguuuuaccaaaucaa

SEQ ID NO: 1846705 - RNA, 19 nt, Salmonella typhimurium LT2
agcaagaacagagcaauua

SEQ ID NO: 1846706 - RNA, 18 nt, Salmonella typhimurium LT2
agcaagaacagagcaauu

SEQ ID NO: 1846707 - RNA, 13 nt, Salmonella typhimurium LT2
agcaagaacagag

SEQ ID NO: 1846708 - RNA, 16 nt, Salmonella typhimurium LT2
agcaacggaagcugac

SEQ ID NO: 1846709 - RNA, 20 nt, Salmonella typhimurium LT2
agcaacguuuguaacagcag

SEQ ID NO: 1846710 - RNA, 23 nt, Salmonella typhimurium LT2
agcaauauggcugcgacaaugaa

SEQ ID NO: 1846711 - RNA, 14 nt, Salmonella typhimurium LT2
agcaaucaguucac

SEQ ID NO: 1846712 - RNA, 14 nt, Salmonella typhimurium LT2
agcaaucaagguug

SEQ ID NO: 1846713 - RNA, 20 nt, Salmonella typhimurium LT2
agcaauuaacaaauaaagcg

SEQ ID NO: 1846714 - RNA, 19 nt, Salmonella typhimurium LT2
agcaauguaagaauaacaa

SEQ ID NO: 1846715 - RNA, 15 nt, Salmonella typhimurium LT2
agcaaugauuuuuag

SEQ ID NO: 1846716 - RNA, 13 nt, Salmonella typhimurium LT2
agcaaugauuuua

SEQ ID NO: 1846717 - RNA, 19 nt, Salmonella typhimurium LT2
agcaauaaugcgccuugag

SEQ ID NO: 1846718 - RNA, 18 nt, Salmonella typhimurium LT2
agcaauaacaggcacagu

SEQ ID NO: 1846719 - RNA, 13 nt, Salmonella typhimurium LT2
agcaaggcggcgg

SEQ ID NO: 1846720 - RNA, 14 nt, Salmonella typhimurium LT2
agcugcucuucuug

SEQ ID NO: 1846721 - RNA, 13 nt, Salmonella typhimurium LT2
agcugauuuuucg

SEQ ID NO: 1846722 - RNA, 19 nt, Salmonella typhimurium LT2
agcugagcuaaucacccac

SEQ ID NO: 1846723 - RNA, 18 nt, Salmonella typhimurium LT2
agcugauugauuuuguaa

SEQ ID NO: 1846724 - RNA, 18 nt, Salmonella typhimurium LT2
agcugauugggauaaaca

SEQ ID NO: 1846725 - RNA, 18 nt, Salmonella typhimurium LT2
agcugaugauuggccucc

SEQ ID NO: 1846726 - RNA, 21 nt, Salmonella typhimurium LT2
agcucgguggcgguaucaaug

SEQ ID NO: 1846727 - RNA, 14 nt, Salmonella typhimurium LT2
agcucuucaugcag

SEQ ID NO: 1846728 - RNA, 14 nt, Salmonella typhimurium LT2
agcucugugugacg

SEQ ID NO: 1846729 - RNA, 15 nt, Salmonella typhimurium LT2
agcucuucgcuuuga

SEQ ID NO: 1846730 - RNA, 22 nt, Salmonella typhimurium LT2
agcucauguagucauauugcgc

SEQ ID NO: 1846731 - RNA, 21 nt, Salmonella typhimurium LT2
agcucauguagucauauugcg

SEQ ID NO: 1846732 - RNA, 15 nt, Salmonella typhimurium LT2
agcucgcccagcacu

SEQ ID NO: 1846733 - RNA, 24 nt, Salmonella typhimurium LT2
agcuccugcgggagcuguucuuau

SEQ ID NO: 1846734 - RNA, 21 nt, Salmonella typhimurium LT2
agcucgcacugauagccgcca

SEQ ID NO: 1846735 - RNA, 18 nt, Salmonella typhimurium LT2
agcguaaugcgccaggca

SEQ ID NO: 1846736 - RNA, 13 nt, Salmonella typhimurium LT2
agcguaauaugca

SEQ ID NO: 1846737 - RNA, 16 nt, Salmonella typhimurium LT2
agcgucaacugcgccu

SEQ ID NO: 1846738 - RNA, 15 nt, Salmonella typhimurium LT2
agcguaauacaggcg

SEQ ID NO: 1846739 - RNA, 16 nt, Salmonella typhimurium LT2
agcgguuucauauggg

SEQ ID NO: 1846740 - RNA, 23 nt, Salmonella typhimurium LT2
agcgguugcaugaaauccuggua

SEQ ID NO: 1846741 - RNA, 20 nt, Salmonella typhimurium LT2
agcguccaguccugccccug

SEQ ID NO: 1846742 - RNA, 12 nt, Salmonella typhimurium LT2
agcgucauacuu

SEQ ID NO: 1846743 - RNA, 16 nt, Salmonella typhimurium LT2
agcgucagcgccaucc

SEQ ID NO: 1846744 - RNA, 13 nt, Salmonella typhimurium LT2
agcgucagcaugg

SEQ ID NO: 1846745 - RNA, 13 nt, Salmonella typhimurium LT2
agcgggucaggaa

SEQ ID NO: 1846746 - RNA, 18 nt, Salmonella typhimurium LT2
agcgggucaggaaacugg

SEQ ID NO: 1846747 - RNA, 18 nt, Salmonella typhimurium LT2
agcgggucccagaagaaa

SEQ ID NO: 1846748 - RNA, 18 nt, Salmonella typhimurium LT2
agcgguuaagauacauau

SEQ ID NO: 1846749 - RNA, 15 nt, Salmonella typhimurium LT2
agcggcaccagcacg

SEQ ID NO: 1846750 - RNA, 19 nt, Salmonella typhimurium LT2
agcggcacguacugcacca

SEQ ID NO: 1846751 - RNA, 15 nt, Salmonella typhimurium LT2
agcggcaaucgccuc

SEQ ID NO: 1846752 - RNA, 14 nt, Salmonella typhimurium LT2
agcggcaagcgcgc

SEQ ID NO: 1846753 - RNA, 14 nt, Salmonella typhimurium LT2
agcggcaacagcac

SEQ ID NO: 1846754 - RNA, 14 nt, Salmonella typhimurium LT2
agcggcaguaaauu

SEQ ID NO: 1846755 - RNA, 19 nt, Salmonella typhimurium LT2
agcggcaggauccccaucc

SEQ ID NO: 1846756 - RNA, 18 nt, Salmonella typhimurium LT2
agcguugcuauugaaaaa

SEQ ID NO: 1846757 - RNA, 20 nt, Salmonella typhimurium LT2
agcgugacgaccggcacggu

SEQ ID NO: 1846758 - RNA, 23 nt, Salmonella typhimurium LT2
agcgucuuuauucugaaagaaaa

SEQ ID NO: 1846759 - RNA, 19 nt, Salmonella typhimurium LT2
agcgucgccaguaacacca

SEQ ID NO: 1846760 - RNA, 14 nt, Salmonella typhimurium LT2
agcgucgccaugcg

SEQ ID NO: 1846761 - RNA, 17 nt, Salmonella typhimurium LT2
agcgugcaacgucauga

SEQ ID NO: 1846762 - RNA, 12 nt, Salmonella typhimurium LT2
agcgugcagaug

SEQ ID NO: 1846763 - RNA, 22 nt, Salmonella typhimurium LT2
agcguuuugauguccagaugcu

SEQ ID NO: 1846764 - RNA, 22 nt, Salmonella typhimurium LT2
agcuacaggucgacgugaacug

SEQ ID NO: 1846765 - RNA, 21 nt, Salmonella typhimurium LT2
agcuacguuugaacagcagcu

SEQ ID NO: 1846766 - RNA, 15 nt, Salmonella typhimurium LT2
agcgcgucagcgccu

SEQ ID NO: 1846767 - RNA, 18 nt, Salmonella typhimurium LT2
agcgcgucagcgccuccg

SEQ ID NO: 1846768 - RNA, 19 nt, Salmonella typhimurium LT2
agcgcgguuucuauuaaau

SEQ ID NO: 1846769 - RNA, 19 nt, Salmonella typhimurium LT2
agcgcguucgccgucacgc

SEQ ID NO: 1846770 - RNA, 14 nt, Salmonella typhimurium LT2
agcgcuaagcaaca

SEQ ID NO: 1846771 - RNA, 13 nt, Salmonella typhimurium LT2
agcgcgaaauuua

SEQ ID NO: 1846772 - RNA, 16 nt, Salmonella typhimurium LT2
agcgcgaacaggcugg

SEQ ID NO: 1846773 - RNA, 15 nt, Salmonella typhimurium LT2
agcgcgaaauaauca

SEQ ID NO: 1846774 - RNA, 17 nt, Salmonella typhimurium LT2
agcgccuguucaacaug

SEQ ID NO: 1846775 - RNA, 20 nt, Salmonella typhimurium LT2
agcgccugugcuuucgccac

SEQ ID NO: 1846776 - RNA, 23 nt, Salmonella typhimurium LT2
agcgccugugcuuucgccaccag

SEQ ID NO: 1846777 - RNA, 23 nt, Salmonella typhimurium LT2
agcgccuucaggcaucagauaaa

SEQ ID NO: 1846778 - RNA, 14 nt, Salmonella typhimurium LT2
agcgcgacauagag

SEQ ID NO: 1846779 - RNA, 15 nt, Salmonella typhimurium LT2
agcgcgaaucgccuc

SEQ ID NO: 1846780 - RNA, 21 nt, Salmonella typhimurium LT2
agcgcgguggcuuuuuccugc

SEQ ID NO: 1846781 - RNA, 11 nt, Salmonella typhimurium LT2
agcgcgguggg

SEQ ID NO: 1846782 - RNA, 23 nt, Salmonella typhimurium LT2
agcgcgaauuuuauuaagcaggc

SEQ ID NO: 1846783 - RNA, 14 nt, Salmonella typhimurium LT2
agcgcgaccgguuu

SEQ ID NO: 1846784 - RNA, 16 nt, Salmonella typhimurium LT2
agcgcuuucuucuuca

SEQ ID NO: 1846785 - RNA, 21 nt, Salmonella typhimurium LT2
agcgcuuuggaggucauuauu

SEQ ID NO: 1846786 - RNA, 23 nt, Salmonella typhimurium LT2
agcgcuucgugaaaaccuaaaua

SEQ ID NO: 1846787 - RNA, 22 nt, Salmonella typhimurium LT2
agcgcuucuaacaaaacagauu

SEQ ID NO: 1846788 - RNA, 16 nt, Salmonella typhimurium LT2
agcgcuucgccugccg

SEQ ID NO: 1846789 - RNA, 18 nt, Salmonella typhimurium LT2
agcgcuccgcacgccggu

SEQ ID NO: 1846790 - RNA, 14 nt, Salmonella typhimurium LT2
agcgcucaggcagc

SEQ ID NO: 1846791 - RNA, 22 nt, Salmonella typhimurium LT2
agcgcuccaccaaccaggcaaa

SEQ ID NO: 1846792 - RNA, 16 nt, Salmonella typhimurium LT2
agcgccgcgccuacca

SEQ ID NO: 1846793 - RNA, 15 nt, Salmonella typhimurium LT2
agcgcccccagcaaa

SEQ ID NO: 1846794 - RNA, 23 nt, Salmonella typhimurium LT2
agcgcccgcuguccgcccaacac

SEQ ID NO: 1846795 - RNA, 22 nt, Salmonella typhimurium LT2
agcgcccgguucaucggcucga

SEQ ID NO: 1846796 - RNA, 16 nt, Salmonella typhimurium LT2
agcgcccguccaugag

SEQ ID NO: 1846797 - RNA, 18 nt, Salmonella typhimurium LT2
agcgccguuaaacugcgc

SEQ ID NO: 1846798 - RNA, 15 nt, Salmonella typhimurium LT2
agcgccgucacuccc

SEQ ID NO: 1846799 - RNA, 19 nt, Salmonella typhimurium LT2
agcgccggaucgggcuucc

SEQ ID NO: 1846800 - RNA, 16 nt, Salmonella typhimurium LT2
agcgccggcaaagcca

SEQ ID NO: 1846801 - RNA, 16 nt, Salmonella typhimurium LT2
agcgccggcaacagcu

SEQ ID NO: 1846802 - RNA, 19 nt, Salmonella typhimurium LT2
agcgccggcaacagcucuu

SEQ ID NO: 1846803 - RNA, 20 nt, Salmonella typhimurium LT2
agcgcaaccugcgcccgcgu

SEQ ID NO: 1846804 - RNA, 17 nt, Salmonella typhimurium LT2
agcgcaaaagcgcgccc

SEQ ID NO: 1846805 - RNA, 19 nt, Salmonella typhimurium LT2
agcgauuuuugaucucuuu

SEQ ID NO: 1846806 - RNA, 14 nt, Salmonella typhimurium LT2
agcgauuuauccac

SEQ ID NO: 1846807 - RNA, 23 nt, Salmonella typhimurium LT2
agcgcacuguuugcugacaaucu

SEQ ID NO: 1846808 - RNA, 18 nt, Salmonella typhimurium LT2
agcgaucgagauaagauc

SEQ ID NO: 1846809 - RNA, 17 nt, Salmonella typhimurium LT2
agcgaucgagauaagau

SEQ ID NO: 1846810 - RNA, 23 nt, Salmonella typhimurium LT2
agcgaugacgccugccagauagu

SEQ ID NO: 1846811 - RNA, 21 nt, Salmonella typhimurium LT2
agcgauacaaggcaaucugau

SEQ ID NO: 1846812 - RNA, 11 nt, Salmonella typhimurium LT2
agcgagucaga

SEQ ID NO: 1846813 - RNA, 17 nt, Salmonella typhimurium LT2
agcgauaaacucagcgc

SEQ ID NO: 1846814 - RNA, 13 nt, Salmonella typhimurium LT2
agcgcauagcugc

SEQ ID NO: 1846815 - RNA, 12 nt, Salmonella typhimurium LT2
agcgcagcgcca

SEQ ID NO: 1846816 - RNA, 16 nt, Salmonella typhimurium LT2
agcgcauugcguccca

SEQ ID NO: 1846817 - RNA, 14 nt, Salmonella typhimurium LT2
agcgcauugcccuu

SEQ ID NO: 1846818 - RNA, 14 nt, Salmonella typhimurium LT2
agcgccaaucacua

SEQ ID NO: 1846819 - RNA, 14 nt, Salmonella typhimurium LT2
agcgccaccacaaa

SEQ ID NO: 1846820 - RNA, 19 nt, Salmonella typhimurium LT2
agcgcauguuucuggugga

SEQ ID NO: 1846821 - RNA, 11 nt, Salmonella typhimurium LT2
agcgccaguaa

SEQ ID NO: 1846822 - RNA, 20 nt, Salmonella typhimurium LT2
agcgccauaucggcacugcu

SEQ ID NO: 1846823 - RNA, 13 nt, Salmonella typhimurium LT2
agcgccaucagca

SEQ ID NO: 1846824 - RNA, 14 nt, Salmonella typhimurium LT2
agcgccauauugcu

SEQ ID NO: 1846825 - RNA, 21 nt, Salmonella typhimurium LT2
agcgccaucaggcaugccaaa

SEQ ID NO: 1846826 - RNA, 17 nt, Salmonella typhimurium LT2
agcgccaucaggcaaug

SEQ ID NO: 1846827 - RNA, 13 nt, Salmonella typhimurium LT2
agcgccagcaugg

SEQ ID NO: 1846828 - RNA, 15 nt, Salmonella typhimurium LT2
agcgccagcgacaga

SEQ ID NO: 1846829 - RNA, 18 nt, Salmonella typhimurium LT2
agcgccagcgacugcuuc

SEQ ID NO: 1846830 - RNA, 13 nt, Salmonella typhimurium LT2
agcgccagcagca

SEQ ID NO: 1846831 - RNA, 12 nt, Salmonella typhimurium LT2
agcgccagcagc

SEQ ID NO: 1846832 - RNA, 16 nt, Salmonella typhimurium LT2
agcgccagauagucac

SEQ ID NO: 1846833 - RNA, 22 nt, Salmonella typhimurium LT2
agcgccagacagauaacaccag

SEQ ID NO: 1846834 - RNA, 16 nt, Salmonella typhimurium LT2
agcgccagaauagcgc

SEQ ID NO: 1846835 - RNA, 17 nt, Salmonella typhimurium LT2
agcgccacggagcauaa

SEQ ID NO: 1846836 - RNA, 17 nt, Salmonella typhimurium LT2
agcgccacccauuuucc

SEQ ID NO: 1846837 - RNA, 23 nt, Salmonella typhimurium LT2
agcccgccagcauacaaagcaga

SEQ ID NO: 1846838 - RNA, 21 nt, Salmonella typhimurium LT2
agccccucgcuaaugcccggc

SEQ ID NO: 1846839 - RNA, 14 nt, Salmonella typhimurium LT2
agcccgaggcgaaa

SEQ ID NO: 1846840 - RNA, 17 nt, Salmonella typhimurium LT2
agcccuauaacagcgcc

SEQ ID NO: 1846841 - RNA, 15 nt, Salmonella typhimurium LT2
agcccggcuucccau

SEQ ID NO: 1846842 - RNA, 17 nt, Salmonella typhimurium LT2
agcccggccacagcgcc

SEQ ID NO: 1846843 - RNA, 18 nt, Salmonella typhimurium LT2
agcccggccacagcgcca

SEQ ID NO: 1846844 - RNA, 22 nt, Salmonella typhimurium LT2
agcccggccacagcgccagaca

SEQ ID NO: 1846845 - RNA, 15 nt, Salmonella typhimurium LT2
agcccaauacgccag

SEQ ID NO: 1846846 - RNA, 14 nt, Salmonella typhimurium LT2
agcccaaaacgcgc

SEQ ID NO: 1846847 - RNA, 19 nt, Salmonella typhimurium LT2
agccauugccgauuucacg

SEQ ID NO: 1846848 - RNA, 17 nt, Salmonella typhimurium LT2
agcccaccguguugcga

SEQ ID NO: 1846849 - RNA, 12 nt, Salmonella typhimurium LT2
agcccagcucag

SEQ ID NO: 1846850 - RNA, 17 nt, Salmonella typhimurium LT2
agcccagcucauaggau

SEQ ID NO: 1846851 - RNA, 14 nt, Salmonella typhimurium LT2
agcccaucccuggg

SEQ ID NO: 1846852 - RNA, 16 nt, Salmonella typhimurium LT2
agcccaucaccgccag

SEQ ID NO: 1846853 - RNA, 14 nt, Salmonella typhimurium LT2
agcccauuucggua

SEQ ID NO: 1846854 - RNA, 13 nt, Salmonella typhimurium LT2
agccccagcacca

SEQ ID NO: 1846855 - RNA, 12 nt, Salmonella typhimurium LT2
agccccagcgcc

SEQ ID NO: 1846856 - RNA, 12 nt, Salmonella typhimurium LT2
agccccaggcua

SEQ ID NO: 1846857 - RNA, 22 nt, Salmonella typhimurium LT2
agccccgaaagucaucugccag

SEQ ID NO: 1846858 - RNA, 18 nt, Salmonella typhimurium LT2
agccccccuaaagcucau

SEQ ID NO: 1846859 - RNA, 14 nt, Salmonella typhimurium LT2
agccgcccacaacc

SEQ ID NO: 1846860 - RNA, 20 nt, Salmonella typhimurium LT2
agccgccaggcaaucagcag

SEQ ID NO: 1846861 - RNA, 16 nt, Salmonella typhimurium LT2
agccgccauccggcac

SEQ ID NO: 1846862 - RNA, 15 nt, Salmonella typhimurium LT2
agccgccaucaggca

SEQ ID NO: 1846863 - RNA, 12 nt, Salmonella typhimurium LT2
agccgccaggca

SEQ ID NO: 1846864 - RNA, 22 nt, Salmonella typhimurium LT2
agccgccaggcaaucagcagcc

SEQ ID NO: 1846865 - RNA, 15 nt, Salmonella typhimurium LT2
agccgcgcugguugg

SEQ ID NO: 1846866 - RNA, 14 nt, Salmonella typhimurium LT2
agccgcgcgccgcc

SEQ ID NO: 1846867 - RNA, 20 nt, Salmonella typhimurium LT2
agccgcgccaucuccuccuc

SEQ ID NO: 1846868 - RNA, 21 nt, Salmonella typhimurium LT2
agccgcgccaucuccuccuca

SEQ ID NO: 1846869 - RNA, 16 nt, Salmonella typhimurium LT2
agccgcgcauagcugg

SEQ ID NO: 1846870 - RNA, 16 nt, Salmonella typhimurium LT2
agccggauggcgaggc

SEQ ID NO: 1846871 - RNA, 16 nt, Salmonella typhimurium LT2
agccgcuuuccgccgc

SEQ ID NO: 1846872 - RNA, 15 nt, Salmonella typhimurium LT2
agccggaacagaagu

SEQ ID NO: 1846873 - RNA, 16 nt, Salmonella typhimurium LT2
agcccuuugcccucaa

SEQ ID NO: 1846874 - RNA, 19 nt, Salmonella typhimurium LT2
agcccuuucauuucugccu

SEQ ID NO: 1846875 - RNA, 20 nt, Salmonella typhimurium LT2
agcccuuucauuucugccug

SEQ ID NO: 1846876 - RNA, 19 nt, Salmonella typhimurium LT2
agcccuuaucgccccagcc

SEQ ID NO: 1846877 - RNA, 19 nt, Salmonella typhimurium LT2
agccgaaguucgcgccgcg

SEQ ID NO: 1846878 - RNA, 21 nt, Salmonella typhimurium LT2
agccgaccaucgcgccgcugg

SEQ ID NO: 1846879 - RNA, 19 nt, Salmonella typhimurium LT2
agccgaccaucgcgccgcu

SEQ ID NO: 1846880 - RNA, 15 nt, Salmonella typhimurium LT2
agccgaccaguaaga

SEQ ID NO: 1846881 - RNA, 13 nt, Salmonella typhimurium LT2
agccgacgcucuu

SEQ ID NO: 1846882 - RNA, 12 nt, Salmonella typhimurium LT2
agccgccacccg

SEQ ID NO: 1846883 - RNA, 16 nt, Salmonella typhimurium LT2
agccgcaucuuccgua

SEQ ID NO: 1846884 - RNA, 17 nt, Salmonella typhimurium LT2
agccgcagccaccccgg

SEQ ID NO: 1846885 - RNA, 15 nt, Salmonella typhimurium LT2
agccgcaaaugccau

SEQ ID NO: 1846886 - RNA, 19 nt, Salmonella typhimurium LT2
agccgauaaacgccacgau

SEQ ID NO: 1846887 - RNA, 13 nt, Salmonella typhimurium LT2
agccuucaacaaa

SEQ ID NO: 1846888 - RNA, 22 nt, Salmonella typhimurium LT2
agccuuccaucgcauccucgcc

SEQ ID NO: 1846889 - RNA, 16 nt, Salmonella typhimurium LT2
agccuguuccagcugc

SEQ ID NO: 1846890 - RNA, 18 nt, Salmonella typhimurium LT2
agccuuaaucaacugcgc

SEQ ID NO: 1846891 - RNA, 21 nt, Salmonella typhimurium LT2
agccuuacuaucccauuuuuu

SEQ ID NO: 1846892 - RNA, 15 nt, Salmonella typhimurium LT2
agccuuagcgggagg

SEQ ID NO: 1846893 - RNA, 20 nt, Salmonella typhimurium LT2
agccuggcggcuuccuguuu

SEQ ID NO: 1846894 - RNA, 14 nt, Salmonella typhimurium LT2
agccugggcaaggc

SEQ ID NO: 1846895 - RNA, 20 nt, Salmonella typhimurium LT2
agccugcuggguacgugcaa

SEQ ID NO: 1846896 - RNA, 17 nt, Salmonella typhimurium LT2
agccuucgccuucacgc

SEQ ID NO: 1846897 - RNA, 23 nt, Salmonella typhimurium LT2
agccuucgccuucacgcauucuu

SEQ ID NO: 1846898 - RNA, 17 nt, Salmonella typhimurium LT2
agcgaaauguucgucca

SEQ ID NO: 1846899 - RNA, 19 nt, Salmonella typhimurium LT2
agcgaaaauaaacgcuuga

SEQ ID NO: 1846900 - RNA, 21 nt, Salmonella typhimurium LT2
agcgaaaccccaccguauuuu

SEQ ID NO: 1846901 - RNA, 20 nt, Salmonella typhimurium LT2
agcgaaacgcgcuaucaacg

SEQ ID NO: 1846902 - RNA, 14 nt, Salmonella typhimurium LT2
agccuuugucgaaa

SEQ ID NO: 1846903 - RNA, 15 nt, Salmonella typhimurium LT2
agccuuuaucgcuga

SEQ ID NO: 1846904 - RNA, 19 nt, Salmonella typhimurium LT2
agcgagauaaucgggaaua

SEQ ID NO: 1846905 - RNA, 22 nt, Salmonella typhimurium LT2
agcgagcgauagagaguuccuc

SEQ ID NO: 1846906 - RNA, 15 nt, Salmonella typhimurium LT2
agcgagccuuccauc

SEQ ID NO: 1846907 - RNA, 19 nt, Salmonella typhimurium LT2
agcgagguucccgccgcca

SEQ ID NO: 1846908 - RNA, 16 nt, Salmonella typhimurium LT2
agcgagguucugguuu

SEQ ID NO: 1846909 - RNA, 17 nt, Salmonella typhimurium LT2
agcgaccaggguuaaaa

SEQ ID NO: 1846910 - RNA, 22 nt, Salmonella typhimurium LT2
agcgaccacgccaccgccgcca

SEQ ID NO: 1846911 - RNA, 12 nt, Salmonella typhimurium LT2
agcgacauuccc

SEQ ID NO: 1846912 - RNA, 18 nt, Salmonella typhimurium LT2
agcgacaucgucacaaua

SEQ ID NO: 1846913 - RNA, 17 nt, Salmonella typhimurium LT2
agcgacacuccgcgcau

SEQ ID NO: 1846914 - RNA, 21 nt, Salmonella typhimurium LT2
agcgaaggcaacugauccugc

SEQ ID NO: 1846915 - RNA, 17 nt, Salmonella typhimurium LT2
agcgaagcggcacugcu

SEQ ID NO: 1846916 - RNA, 22 nt, Salmonella typhimurium LT2
agccguuuuggcagcgcccgcu

SEQ ID NO: 1846917 - RNA, 19 nt, Salmonella typhimurium LT2
agccguuuuggcagcgccc

SEQ ID NO: 1846918 - RNA, 22 nt, Salmonella typhimurium LT2
agccuaaugacggacgcagacc

SEQ ID NO: 1846919 - RNA, 17 nt, Salmonella typhimurium LT2
agccuaaucucgccggu

SEQ ID NO: 1846920 - RNA, 14 nt, Salmonella typhimurium LT2
agccuaccugccgc

SEQ ID NO: 1846921 - RNA, 16 nt, Salmonella typhimurium LT2
agccuaccugccgcca

SEQ ID NO: 1846922 - RNA, 13 nt, Salmonella typhimurium LT2
agccuaaaaacag

SEQ ID NO: 1846923 - RNA, 19 nt, Salmonella typhimurium LT2
agccuacaccguaccugua

SEQ ID NO: 1846924 - RNA, 21 nt, Salmonella typhimurium LT2
agccucauuuuugaguuuguc

SEQ ID NO: 1846925 - RNA, 23 nt, Salmonella typhimurium LT2
agccucauuuuugaguuugucau

SEQ ID NO: 1846926 - RNA, 16 nt, Salmonella typhimurium LT2
agccugagcgccagcg

SEQ ID NO: 1846927 - RNA, 21 nt, Salmonella typhimurium LT2
agccugauaaauaugccggcc

SEQ ID NO: 1846928 - RNA, 15 nt, Salmonella typhimurium LT2
agccugccagcaacc

SEQ ID NO: 1846929 - RNA, 18 nt, Salmonella typhimurium LT2
agccugcgcgccugcugc

SEQ ID NO: 1846930 - RNA, 18 nt, Salmonella typhimurium LT2
agccugaagccagcaauc

SEQ ID NO: 1846931 - RNA, 22 nt, Salmonella typhimurium LT2
agccugaagccagcaaucagcc

SEQ ID NO: 1846932 - RNA, 17 nt, Salmonella typhimurium LT2
agccugacgaauagcgc

SEQ ID NO: 1846933 - RNA, 18 nt, Salmonella typhimurium LT2
agccugaacgccggaacc

SEQ ID NO: 1846934 - RNA, 20 nt, Salmonella typhimurium LT2
agccugaacgccggaacccg

SEQ ID NO: 1846935 - RNA, 18 nt, Salmonella typhimurium LT2
agccucggucgagcuuuu

SEQ ID NO: 1846936 - RNA, 14 nt, Salmonella typhimurium LT2
agccguuucuuguc

SEQ ID NO: 1846937 - RNA, 18 nt, Salmonella typhimurium LT2
agccguuuugcugucugg

SEQ ID NO: 1846938 - RNA, 13 nt, Salmonella typhimurium LT2
agccguucuccag

SEQ ID NO: 1846939 - RNA, 23 nt, Salmonella typhimurium LT2
agccguucaccagccacugcgcc

SEQ ID NO: 1846940 - RNA, 16 nt, Salmonella typhimurium LT2
agccguagcagaagac

SEQ ID NO: 1846941 - RNA, 16 nt, Salmonella typhimurium LT2
agccguaaacggaacc

SEQ ID NO: 1846942 - RNA, 21 nt, Salmonella typhimurium LT2
agccgucgauaaaauccucua

SEQ ID NO: 1846943 - RNA, 14 nt, Salmonella typhimurium LT2
agccgggguaauau

SEQ ID NO: 1846944 - RNA, 13 nt, Salmonella typhimurium LT2
agccgggcaggaa

SEQ ID NO: 1846945 - RNA, 21 nt, Salmonella typhimurium LT2
agccggcgauagcgccccaaa

SEQ ID NO: 1846946 - RNA, 18 nt, Salmonella typhimurium LT2
aguacggcgcgaaucccg

SEQ ID NO: 1846947 - RNA, 19 nt, Salmonella typhimurium LT2
aguacggaacaaaacggaa

SEQ ID NO: 1846948 - RNA, 23 nt, Salmonella typhimurium LT2
aguacgguuugcggauuggauaa

SEQ ID NO: 1846949 - RNA, 14 nt, Salmonella typhimurium LT2
aguacguaaugcga

SEQ ID NO: 1846950 - RNA, 14 nt, Salmonella typhimurium LT2
aguacgccaaaaaa

SEQ ID NO: 1846951 - RNA, 16 nt, Salmonella typhimurium LT2
aguacuggaauaucua

SEQ ID NO: 1846952 - RNA, 15 nt, Salmonella typhimurium LT2
aguacuccaguacug

SEQ ID NO: 1846953 - RNA, 16 nt, Salmonella typhimurium LT2
aguacuucacaaucag

SEQ ID NO: 1846954 - RNA, 16 nt, Salmonella typhimurium LT2
aguacuuucuuuugau

SEQ ID NO: 1846955 - RNA, 14 nt, Salmonella typhimurium LT2
aguagaucaccagc

SEQ ID NO: 1846956 - RNA, 11 nt, Salmonella typhimurium LT2
aguagauggcg

SEQ ID NO: 1846957 - RNA, 14 nt, Salmonella typhimurium LT2
aguagcagagaaaa

SEQ ID NO: 1846958 - RNA, 22 nt, Salmonella typhimurium LT2
aguagcaagguauguauuuuau

SEQ ID NO: 1846959 - RNA, 21 nt, Salmonella typhimurium LT2
aguagcguucucuccaguucu

SEQ ID NO: 1846960 - RNA, 16 nt, Salmonella typhimurium LT2
aguagccugccagcaa

SEQ ID NO: 1846961 - RNA, 19 nt, Salmonella typhimurium LT2
aguagcccugacgaacaga

SEQ ID NO: 1846962 - RNA, 16 nt, Salmonella typhimurium LT2
aguagcugagaguaaa

SEQ ID NO: 1846963 - RNA, 23 nt, Salmonella typhimurium LT2
aguagcugagaguaaauuauuua

SEQ ID NO: 1846964 - RNA, 18 nt, Salmonella typhimurium LT2
aguaguugaauaaccuca

SEQ ID NO: 1846965 - RNA, 16 nt, Salmonella typhimurium LT2
aguaguuccuggagaa

SEQ ID NO: 1846966 - RNA, 12 nt, Salmonella typhimurium LT2
aguaguuggugg

SEQ ID NO: 1846967 - RNA, 13 nt, Salmonella typhimurium LT2
aguaguuaaaaaa

SEQ ID NO: 1846968 - RNA, 15 nt, Salmonella typhimurium LT2
aguaguuccagcaua

SEQ ID NO: 1846969 - RNA, 14 nt, Salmonella typhimurium LT2
aguauaaauaccuu

SEQ ID NO: 1846970 - RNA, 15 nt, Salmonella typhimurium LT2
aguauaagcgccgcu

SEQ ID NO: 1846971 - RNA, 15 nt, Salmonella typhimurium LT2
aguauacagacagca

SEQ ID NO: 1846972 - RNA, 13 nt, Salmonella typhimurium LT2
aguauaugucuga

SEQ ID NO: 1846973 - RNA, 15 nt, Salmonella typhimurium LT2
agucagacaccagcc

SEQ ID NO: 1846974 - RNA, 23 nt, Salmonella typhimurium LT2
agucagacaccagcccuggcugc

SEQ ID NO: 1846975 - RNA, 21 nt, Salmonella typhimurium LT2
agucagacaaguagccugcca

SEQ ID NO: 1846976 - RNA, 20 nt, Salmonella typhimurium LT2
agucacggcucgaucccgac

SEQ ID NO: 1846977 - RNA, 14 nt, Salmonella typhimurium LT2
agucagcaauuaac

SEQ ID NO: 1846978 - RNA, 21 nt, Salmonella typhimurium LT2
agucagcucgguggcgguauc

SEQ ID NO: 1846979 - RNA, 16 nt, Salmonella typhimurium LT2
agucaggcacaaaaaa

SEQ ID NO: 1846980 - RNA, 19 nt, Salmonella typhimurium LT2
agucaggcacaaaaaacaa

SEQ ID NO: 1846981 - RNA, 22 nt, Salmonella typhimurium LT2
agucauaauccuuccuuucauu

SEQ ID NO: 1846982 - RNA, 13 nt, Salmonella typhimurium LT2
agucaguuuucaa

SEQ ID NO: 1846983 - RNA, 16 nt, Salmonella typhimurium LT2
agucaguuuucaauau

SEQ ID NO: 1846984 - RNA, 22 nt, Salmonella typhimurium LT2
agucaaaagauugauuuauuca

SEQ ID NO: 1846985 - RNA, 17 nt, Salmonella typhimurium LT2
agucacagauccagaca

SEQ ID NO: 1846986 - RNA, 17 nt, Salmonella typhimurium LT2
aguaugccgcauaaaau

SEQ ID NO: 1846987 - RNA, 22 nt, Salmonella typhimurium LT2
aguaucggcaggacuuaaaaac

SEQ ID NO: 1846988 - RNA, 19 nt, Salmonella typhimurium LT2
aguaugcgacgguaaaaau

SEQ ID NO: 1846989 - RNA, 23 nt, Salmonella typhimurium LT2
aguaugucuaugauuuuaaagca

SEQ ID NO: 1846990 - RNA, 19 nt, Salmonella typhimurium LT2
aguauggccagaugcgcuu

SEQ ID NO: 1846991 - RNA, 15 nt, Salmonella typhimurium LT2
aguauucaccuggaa

SEQ ID NO: 1846992 - RNA, 20 nt, Salmonella typhimurium LT2
aguauuucccuucccagccc

SEQ ID NO: 1846993 - RNA, 18 nt, Salmonella typhimurium LT2
aguauugacgaaaagaua

SEQ ID NO: 1846994 - RNA, 15 nt, Salmonella typhimurium LT2
aguccuccggcugaa

SEQ ID NO: 1846995 - RNA, 15 nt, Salmonella typhimurium LT2
aguccgccguugaga

SEQ ID NO: 1846996 - RNA, 16 nt, Salmonella typhimurium LT2
aguccucuauuuuuuc

SEQ ID NO: 1846997 - RNA, 21 nt, Salmonella typhimurium LT2
aguccucuauuuuuucaauca

SEQ ID NO: 1846998 - RNA, 16 nt, Salmonella typhimurium LT2
agucccuguucgccac

SEQ ID NO: 1846999 - RNA, 17 nt, Salmonella typhimurium LT2
agucccuccgcuuccac

SEQ ID NO: 1847000 - RNA, 17 nt, Salmonella typhimurium LT2
aguccgaggcaugguua

SEQ ID NO: 1847001 - RNA, 20 nt, Salmonella typhimurium LT2
aguccgaugguuaaauugaa

SEQ ID NO: 1847002 - RNA, 15 nt, Salmonella typhimurium LT2
aguccgcaaagaacc

SEQ ID NO: 1847003 - RNA, 16 nt, Salmonella typhimurium LT2
aguccgcaaagaacca

SEQ ID NO: 1847004 - RNA, 20 nt, Salmonella typhimurium LT2
agucccgcacuuuccagccc

SEQ ID NO: 1847005 - RNA, 17 nt, Salmonella typhimurium LT2
agucgcuuuucauacug

SEQ ID NO: 1847006 - RNA, 24 nt, Salmonella typhimurium LT2
agucgcucagguuguccagcagca

SEQ ID NO: 1847007 - RNA, 19 nt, Salmonella typhimurium LT2
agucgauguggccuuccuc

SEQ ID NO: 1847008 - RNA, 17 nt, Salmonella typhimurium LT2
agucgauaaaucgccac

SEQ ID NO: 1847009 - RNA, 16 nt, Salmonella typhimurium LT2
agucgauaaaugcccg

SEQ ID NO: 1847010 - RNA, 14 nt, Salmonella typhimurium LT2
aguccagcagccau

SEQ ID NO: 1847011 - RNA, 18 nt, Salmonella typhimurium LT2
aguccacaucuaccaggu

SEQ ID NO: 1847012 - RNA, 21 nt, Salmonella typhimurium LT2
aguccauauccguacauaaca

SEQ ID NO: 1847013 - RNA, 17 nt, Salmonella typhimurium LT2
aguccauaccguuucaa

SEQ ID NO: 1847014 - RNA, 21 nt, Salmonella typhimurium LT2
aguccauaccguuucaacugc

SEQ ID NO: 1847015 - RNA, 15 nt, Salmonella typhimurium LT2
aguccccagccgcca

SEQ ID NO: 1847016 - RNA, 19 nt, Salmonella typhimurium LT2
agucauccgguucauaauc

SEQ ID NO: 1847017 - RNA, 18 nt, Salmonella typhimurium LT2
agucaucugccaguuauc

SEQ ID NO: 1847018 - RNA, 16 nt, Salmonella typhimurium LT2
agucaucugccaguua

SEQ ID NO: 1847019 - RNA, 21 nt, Salmonella typhimurium LT2
agucauauuaucgcgcugaau

SEQ ID NO: 1847020 - RNA, 18 nt, Salmonella typhimurium LT2
agucaugaagucuaucug

SEQ ID NO: 1847021 - RNA, 18 nt, Salmonella typhimurium LT2
agucaugagcuauuucag

SEQ ID NO: 1847022 - RNA, 15 nt, Salmonella typhimurium LT2
agucauugacagcaa

SEQ ID NO: 1847023 - RNA, 15 nt, Salmonella typhimurium LT2
agugccgcucacugg

SEQ ID NO: 1847024 - RNA, 12 nt, Salmonella typhimurium LT2
agugcugcgcaa

SEQ ID NO: 1847025 - RNA, 15 nt, Salmonella typhimurium LT2
agugcaaaggccucu

SEQ ID NO: 1847026 - RNA, 22 nt, Salmonella typhimurium LT2
agugcaaacucaccugauuacc

SEQ ID NO: 1847027 - RNA, 18 nt, Salmonella typhimurium LT2
agugcaacagagagcaaa

SEQ ID NO: 1847028 - RNA, 16 nt, Salmonella typhimurium LT2
agugauucacuuucuu

SEQ ID NO: 1847029 - RNA, 16 nt, Salmonella typhimurium LT2
agugauuauaaaucaa

SEQ ID NO: 1847030 - RNA, 20 nt, Salmonella typhimurium LT2
agugauaaagcacagcccca

SEQ ID NO: 1847031 - RNA, 13 nt, Salmonella typhimurium LT2
agugauaaagcac

SEQ ID NO: 1847032 - RNA, 17 nt, Salmonella typhimurium LT2
agugaguacgcaggagg

SEQ ID NO: 1847033 - RNA, 15 nt, Salmonella typhimurium LT2
agugaggcugguugu

SEQ ID NO: 1847034 - RNA, 18 nt, Salmonella typhimurium LT2
agugaguccccaggagca

SEQ ID NO: 1847035 - RNA, 21 nt, Salmonella typhimurium LT2
agugaucccaacauaggccag

SEQ ID NO: 1847036 - RNA, 19 nt, Salmonella typhimurium LT2
agugaacgguugagcuuuu

SEQ ID NO: 1847037 - RNA, 23 nt, Salmonella typhimurium LT2
agugaaucgacggcaauauuaaa

SEQ ID NO: 1847038 - RNA, 20 nt, Salmonella typhimurium LT2
agucuccuguuuacaggcga

SEQ ID NO: 1847039 - RNA, 18 nt, Salmonella typhimurium LT2
agucucgaguucggaagc

SEQ ID NO: 1847040 - RNA, 20 nt, Salmonella typhimurium LT2
agucguaggcucaaaguuac

SEQ ID NO: 1847041 - RNA, 20 nt, Salmonella typhimurium LT2
agucgucgcuaucagacuga

SEQ ID NO: 1847042 - RNA, 20 nt, Salmonella typhimurium LT2
agucuccgccaccugaauaa

SEQ ID NO: 1847043 - RNA, 20 nt, Salmonella typhimurium LT2
agucuccugccgaugaaaua

SEQ ID NO: 1847044 - RNA, 21 nt, Salmonella typhimurium LT2
auaacaaucugcuacugaaua

SEQ ID NO: 1847045 - RNA, 14 nt, Salmonella typhimurium LT2
auaaauuucagugg

SEQ ID NO: 1847046 - RNA, 21 nt, Salmonella typhimurium LT2
auaaauucuuuacgcagcaag

SEQ ID NO: 1847047 - RNA, 20 nt, Salmonella typhimurium LT2
auaaauugcacgcccauaca

SEQ ID NO: 1847048 - RNA, 17 nt, Salmonella typhimurium LT2
auaaccaucgcgcagcc

SEQ ID NO: 1847049 - RNA, 20 nt, Salmonella typhimurium LT2
auaacaucguaaaucaaaug

SEQ ID NO: 1847050 - RNA, 14 nt, Salmonella typhimurium LT2
auaaccagaaaacc

SEQ ID NO: 1847051 - RNA, 13 nt, Salmonella typhimurium LT2
auaaccaauuaaa

SEQ ID NO: 1847052 - RNA, 18 nt, Salmonella typhimurium LT2
auaaccaauuaaauuauu

SEQ ID NO: 1847053 - RNA, 20 nt, Salmonella typhimurium LT2
auaaaucaggaaaaagggaa

SEQ ID NO: 1847054 - RNA, 23 nt, Salmonella typhimurium LT2
auaaaucaguuguacuuguugcu

SEQ ID NO: 1847055 - RNA, 14 nt, Salmonella typhimurium LT2
auaaaucaucaucg

SEQ ID NO: 1847056 - RNA, 18 nt, Salmonella typhimurium LT2
auaaauguacugcaauaa

SEQ ID NO: 1847057 - RNA, 21 nt, Salmonella typhimurium LT2
auaaaugguacuuuucaucca

SEQ ID NO: 1847058 - RNA, 21 nt, Salmonella typhimurium LT2
auaaauggcaggaaggggaaa

SEQ ID NO: 1847059 - RNA, 20 nt, Salmonella typhimurium LT2
auaaaugccgcaauaaacac

SEQ ID NO: 1847060 - RNA, 16 nt, Salmonella typhimurium LT2
auaaaugcuuugcccg

SEQ ID NO: 1847061 - RNA, 15 nt, Salmonella typhimurium LT2
auaaauucgaaauaa

SEQ ID NO: 1847062 - RNA, 13 nt, Salmonella typhimurium LT2
auaaauagccgac

SEQ ID NO: 1847063 - RNA, 22 nt, Salmonella typhimurium LT2
auaaauagcucggcaaagccca

SEQ ID NO: 1847064 - RNA, 17 nt, Salmonella typhimurium LT2
auaaauaccguaaugcc

SEQ ID NO: 1847065 - RNA, 23 nt, Salmonella typhimurium LT2
auaaaguuuauuugaauagucaa

SEQ ID NO: 1847066 - RNA, 15 nt, Salmonella typhimurium LT2
auaaaguguuauuau

SEQ ID NO: 1847067 - RNA, 17 nt, Salmonella typhimurium LT2
auaaaguuauacagcac

SEQ ID NO: 1847068 - RNA, 21 nt, Salmonella typhimurium LT2
auaaagaaaguagaucaccag

SEQ ID NO: 1847069 - RNA, 17 nt, Salmonella typhimurium LT2
auaaacagcguuuucau

SEQ ID NO: 1847070 - RNA, 20 nt, Salmonella typhimurium LT2
auaaacagauaugaaaugag

SEQ ID NO: 1847071 - RNA, 16 nt, Salmonella typhimurium LT2
auaaacgccucauccg

SEQ ID NO: 1847072 - RNA, 21 nt, Salmonella typhimurium LT2
auaaacgcuugacucugaagc

SEQ ID NO: 1847073 - RNA, 15 nt, Salmonella typhimurium LT2
auaaacgacaucaau

SEQ ID NO: 1847074 - RNA, 16 nt, Salmonella typhimurium LT2
auaaacgacaucaaua

SEQ ID NO: 1847075 - RNA, 22 nt, Salmonella typhimurium LT2
auaaacgggcccggcuuucugu

SEQ ID NO: 1847076 - RNA, 20 nt, Salmonella typhimurium LT2
auaaacgguuucagcagcgg

SEQ ID NO: 1847077 - RNA, 23 nt, Salmonella typhimurium LT2
auaaacgucccgacgaauaacaa

SEQ ID NO: 1847078 - RNA, 14 nt, Salmonella typhimurium LT2
auaaaauccucuac

SEQ ID NO: 1847079 - RNA, 15 nt, Salmonella typhimurium LT2
auaaaauauuauuuu

SEQ ID NO: 1847080 - RNA, 17 nt, Salmonella typhimurium LT2
auaaaauauuauuuuuu

SEQ ID NO: 1847081 - RNA, 13 nt, Salmonella typhimurium LT2
auaaaauauuuaa

SEQ ID NO: 1847082 - RNA, 21 nt, Salmonella typhimurium LT2
auaaaauauuuaacuuaaaua

SEQ ID NO: 1847083 - RNA, 21 nt, Salmonella typhimurium LT2
auaaaauauccuccaccucgc

SEQ ID NO: 1847084 - RNA, 18 nt, Salmonella typhimurium LT2
auaaaacugccaucaauu

SEQ ID NO: 1847085 - RNA, 22 nt, Salmonella typhimurium LT2
auaaaacuucgauaauaaaaua

SEQ ID NO: 1847086 - RNA, 21 nt, Salmonella typhimurium LT2
auaaaagccgccauguuuuuu

SEQ ID NO: 1847087 - RNA, 23 nt, Salmonella typhimurium LT2
auaaaagcucuggaaaaauuguu

SEQ ID NO: 1847088 - RNA, 22 nt, Salmonella typhimurium LT2
auaaaagcucgucuguuguucu

SEQ ID NO: 1847089 - RNA, 12 nt, Salmonella typhimurium LT2
auaaaauaacua

SEQ ID NO: 1847090 - RNA, 13 nt, Salmonella typhimurium LT2
auaaaauaagcaa

SEQ ID NO: 1847091 - RNA, 18 nt, Salmonella typhimurium LT2
auaaaacuacaacaauaa

SEQ ID NO: 1847092 - RNA, 15 nt, Salmonella typhimurium LT2
auaaaacauaaagau

SEQ ID NO: 1847093 - RNA, 12 nt, Salmonella typhimurium LT2
auaaaaaucauu

SEQ ID NO: 1847094 - RNA, 11 nt, Salmonella typhimurium LT2
aguucccagcg

SEQ ID NO: 1847095 - RNA, 15 nt, Salmonella typhimurium LT2
aguucauuauuucau

SEQ ID NO: 1847096 - RNA, 15 nt, Salmonella typhimurium LT2
aguucccuacucucg

SEQ ID NO: 1847097 - RNA, 17 nt, Salmonella typhimurium LT2
aguucaggcacgugcau

SEQ ID NO: 1847098 - RNA, 23 nt, Salmonella typhimurium LT2
aguucaggaacaucagcauuggu

SEQ ID NO: 1847099 - RNA, 14 nt, Salmonella typhimurium LT2
aguucauccagcag

SEQ ID NO: 1847100 - RNA, 15 nt, Salmonella typhimurium LT2
aguuccgccacggcg

SEQ ID NO: 1847101 - RNA, 15 nt, Salmonella typhimurium LT2
aguucgcugaggcgu

SEQ ID NO: 1847102 - RNA, 15 nt, Salmonella typhimurium LT2
aguucgccuucuuca

SEQ ID NO: 1847103 - RNA, 14 nt, Salmonella typhimurium LT2
aguucuugcaggca

SEQ ID NO: 1847104 - RNA, 16 nt, Salmonella typhimurium LT2
aguucuuucgccagaa

SEQ ID NO: 1847105 - RNA, 17 nt, Salmonella typhimurium LT2
aguucuuucgccagaac

SEQ ID NO: 1847106 - RNA, 18 nt, Salmonella typhimurium LT2
aguuacaggcuccaggua

SEQ ID NO: 1847107 - RNA, 19 nt, Salmonella typhimurium LT2
aguuauguuauccccacuu

SEQ ID NO: 1847108 - RNA, 15 nt, Salmonella typhimurium LT2
aguuauguauuuaau

SEQ ID NO: 1847109 - RNA, 19 nt, Salmonella typhimurium LT2
aguuauguauuuaauuuuu

SEQ ID NO: 1847110 - RNA, 23 nt, Salmonella typhimurium LT2
aguuauguauuuaauuuuuccuu

SEQ ID NO: 1847111 - RNA, 20 nt, Salmonella typhimurium LT2
aguucacuccuaagagaaaa

SEQ ID NO: 1847112 - RNA, 21 nt, Salmonella typhimurium LT2
aguucaccaguuuuucgccaa

SEQ ID NO: 1847113 - RNA, 15 nt, Salmonella typhimurium LT2
aguucagcagcacca

SEQ ID NO: 1847114 - RNA, 12 nt, Salmonella typhimurium LT2
aguucagccgcc

SEQ ID NO: 1847115 - RNA, 13 nt, Salmonella typhimurium LT2
aguucagcagcac

SEQ ID NO: 1847116 - RNA, 19 nt, Salmonella typhimurium LT2
aguucacgcgccgccugca

SEQ ID NO: 1847117 - RNA, 15 nt, Salmonella typhimurium LT2
aguggcggcaaaaaa

SEQ ID NO: 1847118 - RNA, 14 nt, Salmonella typhimurium LT2
aguggcggcaaaaa

SEQ ID NO: 1847119 - RNA, 20 nt, Salmonella typhimurium LT2
aguggccaucuuccagcauc

SEQ ID NO: 1847120 - RNA, 20 nt, Salmonella typhimurium LT2
aguuaaugccgucaucagca

SEQ ID NO: 1847121 - RNA, 16 nt, Salmonella typhimurium LT2
aguuaagcgcccgcgc

SEQ ID NO: 1847122 - RNA, 22 nt, Salmonella typhimurium LT2
aguuaagcggggguaacaauag

SEQ ID NO: 1847123 - RNA, 23 nt, Salmonella typhimurium LT2
aguuaacgccguuaccagcauca

SEQ ID NO: 1847124 - RNA, 15 nt, Salmonella typhimurium LT2
aguuggugggugaug

SEQ ID NO: 1847125 - RNA, 14 nt, Salmonella typhimurium LT2
aguuggugggugau

SEQ ID NO: 1847126 - RNA, 22 nt, Salmonella typhimurium LT2
aguuguacuuguugcuggcagg

SEQ ID NO: 1847127 - RNA, 16 nt, Salmonella typhimurium LT2
aguugauacauuuuuu

SEQ ID NO: 1847128 - RNA, 22 nt, Salmonella typhimurium LT2
aguugauacauuuuuuggugau

SEQ ID NO: 1847129 - RNA, 14 nt, Salmonella typhimurium LT2
aguugcgccacugc

SEQ ID NO: 1847130 - RNA, 23 nt, Salmonella typhimurium LT2
aguugccccuuguugaaacauca

SEQ ID NO: 1847131 - RNA, 16 nt, Salmonella typhimurium LT2
aguugccgccauaggu

SEQ ID NO: 1847132 - RNA, 14 nt, Salmonella typhimurium LT2
aguugcguucccag

SEQ ID NO: 1847133 - RNA, 22 nt, Salmonella typhimurium LT2
aguugcgcuacuuuauaaauca

SEQ ID NO: 1847134 - RNA, 13 nt, Salmonella typhimurium LT2
auaaaaaauuauc

SEQ ID NO: 1847135 - RNA, 22 nt, Salmonella typhimurium LT2
auaaaaacgcgcucgccagcgc

SEQ ID NO: 1847136 - RNA, 13 nt, Salmonella typhimurium LT2
auaaaaaaggcag

SEQ ID NO: 1847137 - RNA, 11 nt, Salmonella typhimurium LT2
auaaaaaagaa

SEQ ID NO: 1847138 - RNA, 15 nt, Salmonella typhimurium LT2
aguuuuuucaguagc

SEQ ID NO: 1847139 - RNA, 14 nt, Salmonella typhimurium LT2
aguuuuucaaucuu

SEQ ID NO: 1847140 - RNA, 22 nt, Salmonella typhimurium LT2
aguuuuccccccuccaucaaau

SEQ ID NO: 1847141 - RNA, 23 nt, Salmonella typhimurium LT2
aguuuuccccccuccaucaaaua

SEQ ID NO: 1847142 - RNA, 13 nt, Salmonella typhimurium LT2
aguuuuccagccc

SEQ ID NO: 1847143 - RNA, 16 nt, Salmonella typhimurium LT2
aguuugcgcgauuuau

SEQ ID NO: 1847144 - RNA, 20 nt, Salmonella typhimurium LT2
aguuugcgcgauuuauagag

SEQ ID NO: 1847145 - RNA, 21 nt, Salmonella typhimurium LT2
aguuugcgaaguucauauggc

SEQ ID NO: 1847146 - RNA, 14 nt, Salmonella typhimurium LT2
auagaaauagccuu

SEQ ID NO: 1847147 - RNA, 20 nt, Salmonella typhimurium LT2
auagaagcucaugugcagca

SEQ ID NO: 1847148 - RNA, 19 nt, Salmonella typhimurium LT2
auacgcuucggcuccagcg

SEQ ID NO: 1847149 - RNA, 12 nt, Salmonella typhimurium LT2
auacuuaacccu

SEQ ID NO: 1847150 - RNA, 21 nt, Salmonella typhimurium LT2
auacuuaacccugaaccggga

SEQ ID NO: 1847151 - RNA, 20 nt, Salmonella typhimurium LT2
auacuuaucaacuucuucau

SEQ ID NO: 1847152 - RNA, 15 nt, Salmonella typhimurium LT2
auagacggccugcaa

SEQ ID NO: 1847153 - RNA, 18 nt, Salmonella typhimurium LT2
auagacgccggucaugcc

SEQ ID NO: 1847154 - RNA, 22 nt, Salmonella typhimurium LT2
auagacgacaucuuuuccugaa

SEQ ID NO: 1847155 - RNA, 16 nt, Salmonella typhimurium LT2
auagacguaaugauca

SEQ ID NO: 1847156 - RNA, 17 nt, Salmonella typhimurium LT2
auagacguaaugaucag

SEQ ID NO: 1847157 - RNA, 23 nt, Salmonella typhimurium LT2
auagacaugaccggacgugccaa

SEQ ID NO: 1847158 - RNA, 21 nt, Salmonella typhimurium LT2
auagacagcggcuaauuuauu

SEQ ID NO: 1847159 - RNA, 15 nt, Salmonella typhimurium LT2
auagacauccagcau

SEQ ID NO: 1847160 - RNA, 23 nt, Salmonella typhimurium LT2
auagacucguugggugaggcgua

SEQ ID NO: 1847161 - RNA, 16 nt, Salmonella typhimurium LT2
auagaucaggcgacca

SEQ ID NO: 1847162 - RNA, 15 nt, Salmonella typhimurium LT2
auagauaugaaagaa

SEQ ID NO: 1847163 - RNA, 22 nt, Salmonella typhimurium LT2
auagcauggcguguaguaaugc

SEQ ID NO: 1847164 - RNA, 16 nt, Salmonella typhimurium LT2
auagcaucuuccucug

SEQ ID NO: 1847165 - RNA, 13 nt, Salmonella typhimurium LT2
auagcaucaccag

SEQ ID NO: 1847166 - RNA, 17 nt, Salmonella typhimurium LT2
auagcaacguccgcagc

SEQ ID NO: 1847167 - RNA, 13 nt, Salmonella typhimurium LT2
auacgcuuucuga

SEQ ID NO: 1847168 - RNA, 20 nt, Salmonella typhimurium LT2
auacgcuugcgccagcauca

SEQ ID NO: 1847169 - RNA, 18 nt, Salmonella typhimurium LT2
auacggacgccagauaau

SEQ ID NO: 1847170 - RNA, 13 nt, Salmonella typhimurium LT2
auacgcuccagcu

SEQ ID NO: 1847171 - RNA, 19 nt, Salmonella typhimurium LT2
auacgcucccacugccgua

SEQ ID NO: 1847172 - RNA, 14 nt, Salmonella typhimurium LT2
auacgcucaauaua

SEQ ID NO: 1847173 - RNA, 15 nt, Salmonella typhimurium LT2
auacgcguugccauc

SEQ ID NO: 1847174 - RNA, 15 nt, Salmonella typhimurium LT2
auaccguccagcgca

SEQ ID NO: 1847175 - RNA, 19 nt, Salmonella typhimurium LT2
auaccguuuggaucugucg

SEQ ID NO: 1847176 - RNA, 19 nt, Salmonella typhimurium LT2
auaccgugugcagugacag

SEQ ID NO: 1847177 - RNA, 15 nt, Salmonella typhimurium LT2
auaccgaaauccgcu

SEQ ID NO: 1847178 - RNA, 20 nt, Salmonella typhimurium LT2
auacccuuccccaucaaaac

SEQ ID NO: 1847179 - RNA, 12 nt, Salmonella typhimurium LT2
auaccgcauuca

SEQ ID NO: 1847180 - RNA, 21 nt, Salmonella typhimurium LT2
auaccgauagcgcggaauauc

SEQ ID NO: 1847181 - RNA, 12 nt, Salmonella typhimurium LT2
auaccuuuucau

SEQ ID NO: 1847182 - RNA, 16 nt, Salmonella typhimurium LT2
auaccuaacucuuccg

SEQ ID NO: 1847183 - RNA, 21 nt, Salmonella typhimurium LT2
auaccuuuaaccucuuuuuca

SEQ ID NO: 1847184 - RNA, 21 nt, Salmonella typhimurium LT2
auaccuuuaagcgcuucguga

SEQ ID NO: 1847185 - RNA, 19 nt, Salmonella typhimurium LT2
auaccuacuuuauuuuucg

SEQ ID NO: 1847186 - RNA, 14 nt, Salmonella typhimurium LT2
auaccauccccuuu

SEQ ID NO: 1847187 - RNA, 19 nt, Salmonella typhimurium LT2
auaccagggcgaugccccc

SEQ ID NO: 1847188 - RNA, 16 nt, Salmonella typhimurium LT2
auaccaguacaacaau

SEQ ID NO: 1847189 - RNA, 19 nt, Salmonella typhimurium LT2
auaccagcaccugaauaau

SEQ ID NO: 1847190 - RNA, 12 nt, Salmonella typhimurium LT2
auaccaugccgc

SEQ ID NO: 1847191 - RNA, 20 nt, Salmonella typhimurium LT2
auaccaugccgccauuuuau

SEQ ID NO: 1847192 - RNA, 13 nt, Salmonella typhimurium LT2
auacccaaaauaa

SEQ ID NO: 1847193 - RNA, 15 nt, Salmonella typhimurium LT2
auacccaaaauaauu

SEQ ID NO: 1847194 - RNA, 22 nt, Salmonella typhimurium LT2
auacccugcggcaaaacagagu

SEQ ID NO: 1847195 - RNA, 17 nt, Salmonella typhimurium LT2
auacccgcguuuucuca

SEQ ID NO: 1847196 - RNA, 19 nt, Salmonella typhimurium LT2
auaccaccacuucacuauc

SEQ ID NO: 1847197 - RNA, 23 nt, Salmonella typhimurium LT2
auaccaagucucaagagugaaca

SEQ ID NO: 1847198 - RNA, 20 nt, Salmonella typhimurium LT2
auaccagcccucauuaucca

SEQ ID NO: 1847199 - RNA, 20 nt, Salmonella typhimurium LT2
auaccacugcccgccgccac

SEQ ID NO: 1847200 - RNA, 14 nt, Salmonella typhimurium LT2
auaccaaagaacgc

SEQ ID NO: 1847201 - RNA, 13 nt, Salmonella typhimurium LT2
auaccaauauuaa

SEQ ID NO: 1847202 - RNA, 19 nt, Salmonella typhimurium LT2
auaccaauauuaaagaugc

SEQ ID NO: 1847203 - RNA, 13 nt, Salmonella typhimurium LT2
auaccacaaauuu

SEQ ID NO: 1847204 - RNA, 14 nt, Salmonella typhimurium LT2
auaccacaaauuuu

SEQ ID NO: 1847205 - RNA, 15 nt, Salmonella typhimurium LT2
auaccacaacagaau

SEQ ID NO: 1847206 - RNA, 22 nt, Salmonella typhimurium LT2
auaauuaugccugucaucauca

SEQ ID NO: 1847207 - RNA, 19 nt, Salmonella typhimurium LT2
auaauucauaacaccaaua

SEQ ID NO: 1847208 - RNA, 19 nt, Salmonella typhimurium LT2
auaacgccgcccccaugcc

SEQ ID NO: 1847209 - RNA, 17 nt, Salmonella typhimurium LT2
auaacgccgguuccaac

SEQ ID NO: 1847210 - RNA, 19 nt, Salmonella typhimurium LT2
auaacggucguucccuacc

SEQ ID NO: 1847211 - RNA, 12 nt, Salmonella typhimurium LT2
auaaucaucaua

SEQ ID NO: 1847212 - RNA, 15 nt, Salmonella typhimurium LT2
auaaucaucauaauc

SEQ ID NO: 1847213 - RNA, 18 nt, Salmonella typhimurium LT2
auaauccgcuaacgaugu

SEQ ID NO: 1847214 - RNA, 16 nt, Salmonella typhimurium LT2
auaaucccgcagaaaa

SEQ ID NO: 1847215 - RNA, 15 nt, Salmonella typhimurium LT2
auaaugccaaaaugg

SEQ ID NO: 1847216 - RNA, 20 nt, Salmonella typhimurium LT2
auaaugacgcuauucaugcc

SEQ ID NO: 1847217 - RNA, 23 nt, Salmonella typhimurium LT2
auacacgcccucucgccaaauca

SEQ ID NO: 1847218 - RNA, 15 nt, Salmonella typhimurium LT2
auacaccuuugcccg

SEQ ID NO: 1847219 - RNA, 11 nt, Salmonella typhimurium LT2
auacaccuuca

SEQ ID NO: 1847220 - RNA, 17 nt, Salmonella typhimurium LT2
auacagaaaacgccugc

SEQ ID NO: 1847221 - RNA, 13 nt, Salmonella typhimurium LT2
auacaaauauccc

SEQ ID NO: 1847222 - RNA, 14 nt, Salmonella typhimurium LT2
auacaaaacccaua

SEQ ID NO: 1847223 - RNA, 18 nt, Salmonella typhimurium LT2
auacaaaaaagacagcau

SEQ ID NO: 1847224 - RNA, 13 nt, Salmonella typhimurium LT2
auacaaacccagg

SEQ ID NO: 1847225 - RNA, 23 nt, Salmonella typhimurium LT2
auacaggcguguggcauaaauaa

SEQ ID NO: 1847226 - RNA, 14 nt, Salmonella typhimurium LT2
auacaggcuuaaca

SEQ ID NO: 1847227 - RNA, 11 nt, Salmonella typhimurium LT2
auacauaaaau

SEQ ID NO: 1847228 - RNA, 11 nt, Salmonella typhimurium LT2
auacauaaauc

SEQ ID NO: 1847229 - RNA, 14 nt, Salmonella typhimurium LT2
auacagccagcaca

SEQ ID NO: 1847230 - RNA, 15 nt, Salmonella typhimurium LT2
auacagccagcacaa

SEQ ID NO: 1847231 - RNA, 23 nt, Salmonella typhimurium LT2
auacaggccuggccuucaaucag

SEQ ID NO: 1847232 - RNA, 13 nt, Salmonella typhimurium LT2
auacauucuguuu

SEQ ID NO: 1847233 - RNA, 22 nt, Salmonella typhimurium LT2
auacauugaguaaauaaaucag

SEQ ID NO: 1847234 - RNA, 14 nt, Salmonella typhimurium LT2
auacauucucugcc

SEQ ID NO: 1847235 - RNA, 19 nt, Salmonella typhimurium LT2
auacaucucgaguaaucac

SEQ ID NO: 1847236 - RNA, 21 nt, Salmonella typhimurium LT2
auacaugccugcgccauguuc

SEQ ID NO: 1847237 - RNA, 22 nt, Salmonella typhimurium LT2
auacaucugauuaccgguuguu

SEQ ID NO: 1847238 - RNA, 14 nt, Salmonella typhimurium LT2
auacauagcaggcc

SEQ ID NO: 1847239 - RNA, 18 nt, Salmonella typhimurium LT2
auacauauggaugaggau

SEQ ID NO: 1847240 - RNA, 15 nt, Salmonella typhimurium LT2
aucaaaaguaucaac

SEQ ID NO: 1847241 - RNA, 22 nt, Salmonella typhimurium LT2
aucaaaacuggaaacgcaucca

SEQ ID NO: 1847242 - RNA, 20 nt, Salmonella typhimurium LT2
auauuuauuuacgccggaua

SEQ ID NO: 1847243 - RNA, 19 nt, Salmonella typhimurium LT2
auauuuauuuuauaaauua

SEQ ID NO: 1847244 - RNA, 16 nt, Salmonella typhimurium LT2
aucaaaugagaauaga

SEQ ID NO: 1847245 - RNA, 19 nt, Salmonella typhimurium LT2
aucaaauuugcccagcacg

SEQ ID NO: 1847246 - RNA, 21 nt, Salmonella typhimurium LT2
aucaaauacgcuauuuaaaaa

SEQ ID NO: 1847247 - RNA, 17 nt, Salmonella typhimurium LT2
aucaaauaagacaugga

SEQ ID NO: 1847248 - RNA, 19 nt, Salmonella typhimurium LT2
aucaacaaccggcuggcua

SEQ ID NO: 1847249 - RNA, 14 nt, Salmonella typhimurium LT2
aucaacucuccuuu

SEQ ID NO: 1847250 - RNA, 15 nt, Salmonella typhimurium LT2
aucaacucgauacgg

SEQ ID NO: 1847251 - RNA, 24 nt, Salmonella typhimurium LT2
aucaacugggugugaucgccgcga

SEQ ID NO: 1847252 - RNA, 17 nt, Salmonella typhimurium LT2
aucaacgugaccauucc

SEQ ID NO: 1847253 - RNA, 18 nt, Salmonella typhimurium LT2
aucaauaagcgaauugcc

SEQ ID NO: 1847254 - RNA, 20 nt, Salmonella typhimurium LT2
aucaauaacgauaauuuuac

SEQ ID NO: 1847255 - RNA, 19 nt, Salmonella typhimurium LT2
aucaauacagagauauuaa

SEQ ID NO: 1847256 - RNA, 21 nt, Salmonella typhimurium LT2
aucaauacagagauauuaaaa

SEQ ID NO: 1847257 - RNA, 18 nt, Salmonella typhimurium LT2
aucaauaccguccagcgc

SEQ ID NO: 1847258 - RNA, 18 nt, Salmonella typhimurium LT2
aucaaucaccucuucccc

SEQ ID NO: 1847259 - RNA, 12 nt, Salmonella typhimurium LT2
aucaaucaccac

SEQ ID NO: 1847260 - RNA, 14 nt, Salmonella typhimurium LT2
aucaauaaaauuau

SEQ ID NO: 1847261 - RNA, 13 nt, Salmonella typhimurium LT2
aucaagaaaacug

SEQ ID NO: 1847262 - RNA, 19 nt, Salmonella typhimurium LT2
auauuuaacuuaaauaaaa

SEQ ID NO: 1847263 - RNA, 21 nt, Salmonella typhimurium LT2
auauuuaacuuaaauaaaaau

SEQ ID NO: 1847264 - RNA, 22 nt, Salmonella typhimurium LT2
auauucccguuccagcuugaau

SEQ ID NO: 1847265 - RNA, 11 nt, Salmonella typhimurium LT2
auauuccccac

SEQ ID NO: 1847266 - RNA, 18 nt, Salmonella typhimurium LT2
auauuccauauaacagaa

SEQ ID NO: 1847267 - RNA, 18 nt, Salmonella typhimurium LT2
auauuauaaaauaacggu

SEQ ID NO: 1847268 - RNA, 13 nt, Salmonella typhimurium LT2
auauuauauguuu

SEQ ID NO: 1847269 - RNA, 19 nt, Salmonella typhimurium LT2
auauuaucgcgcugaauaa

SEQ ID NO: 1847270 - RNA, 19 nt, Salmonella typhimurium LT2
auauggccguuuucaugca

SEQ ID NO: 1847271 - RNA, 13 nt, Salmonella typhimurium LT2
auauguaaaucgg

SEQ ID NO: 1847272 - RNA, 15 nt, Salmonella typhimurium LT2
auaugguuauccagc

SEQ ID NO: 1847273 - RNA, 24 nt, Salmonella typhimurium LT2
auauguuugauaaacugcgccaug

SEQ ID NO: 1847274 - RNA, 17 nt, Salmonella typhimurium LT2
auauguuucaaaaagag

SEQ ID NO: 1847275 - RNA, 17 nt, Salmonella typhimurium LT2
auauguuugacaagcag

SEQ ID NO: 1847276 - RNA, 19 nt, Salmonella typhimurium LT2
auauguucccgacggcagg

SEQ ID NO: 1847277 - RNA, 17 nt, Salmonella typhimurium LT2
auauguguaucuugcuu

SEQ ID NO: 1847278 - RNA, 17 nt, Salmonella typhimurium LT2
auauguuaccuguuaaa

SEQ ID NO: 1847279 - RNA, 22 nt, Salmonella typhimurium LT2
auauuaccuucgcguaaugcaa

SEQ ID NO: 1847280 - RNA, 22 nt, Salmonella typhimurium LT2
auauuagcgguacucuuuuucc

SEQ ID NO: 1847281 - RNA, 19 nt, Salmonella typhimurium LT2
auauuagcgguacucuuuu

SEQ ID NO: 1847282 - RNA, 12 nt, Salmonella typhimurium LT2
auauuaaaagac

SEQ ID NO: 1847283 - RNA, 18 nt, Salmonella typhimurium LT2
auauuaaauuuauacuca

SEQ ID NO: 1847284 - RNA, 18 nt, Salmonella typhimurium LT2
auauuaacaaugcaaacg

SEQ ID NO: 1847285 - RNA, 16 nt, Salmonella typhimurium LT2
auauagccguggcugg

SEQ ID NO: 1847286 - RNA, 17 nt, Salmonella typhimurium LT2
auauagccguggcuggc

SEQ ID NO: 1847287 - RNA, 14 nt, Salmonella typhimurium LT2
auauagcaaucaua

SEQ ID NO: 1847288 - RNA, 13 nt, Salmonella typhimurium LT2
auauagccuucaa

SEQ ID NO: 1847289 - RNA, 16 nt, Salmonella typhimurium LT2
auauaggggccaagcg

SEQ ID NO: 1847290 - RNA, 16 nt, Salmonella typhimurium LT2
auauaguccugaugaa

SEQ ID NO: 1847291 - RNA, 17 nt, Salmonella typhimurium LT2
auauacccccugcaauu

SEQ ID NO: 1847292 - RNA, 19 nt, Salmonella typhimurium LT2
auauaccgucagcaccagc

SEQ ID NO: 1847293 - RNA, 18 nt, Salmonella typhimurium LT2
auauaaggaucggaagac

SEQ ID NO: 1847294 - RNA, 19 nt, Salmonella typhimurium LT2
auauaagcgccgucauccg

SEQ ID NO: 1847295 - RNA, 19 nt, Salmonella typhimurium LT2
auagucauugacagcaagu

SEQ ID NO: 1847296 - RNA, 16 nt, Salmonella typhimurium LT2
auaguccacuuucugu

SEQ ID NO: 1847297 - RNA, 12 nt, Salmonella typhimurium LT2
auaguccagcag

SEQ ID NO: 1847298 - RNA, 14 nt, Salmonella typhimurium LT2
auaguccagcagcc

SEQ ID NO: 1847299 - RNA, 19 nt, Salmonella typhimurium LT2
auagucaguaauauaacca

SEQ ID NO: 1847300 - RNA, 16 nt, Salmonella typhimurium LT2
auaguauuucccuucc

SEQ ID NO: 1847301 - RNA, 20 nt, Salmonella typhimurium LT2
auaguauuucccuucccagc

SEQ ID NO: 1847302 - RNA, 14 nt, Salmonella typhimurium LT2
auagccugcugggu

SEQ ID NO: 1847303 - RNA, 15 nt, Salmonella typhimurium LT2
auagccugcugggua

SEQ ID NO: 1847304 - RNA, 16 nt, Salmonella typhimurium LT2
auagcgcaguaauuuc

SEQ ID NO: 1847305 - RNA, 13 nt, Salmonella typhimurium LT2
auagcgauacuga

SEQ ID NO: 1847306 - RNA, 13 nt, Salmonella typhimurium LT2
auagcgagaggca

SEQ ID NO: 1847307 - RNA, 18 nt, Salmonella typhimurium LT2
auagcgaggcagcaggau

SEQ ID NO: 1847308 - RNA, 16 nt, Salmonella typhimurium LT2
auaguugagcagcgcg

SEQ ID NO: 1847309 - RNA, 21 nt, Salmonella typhimurium LT2
auaguuauacauuuuuuucuu

SEQ ID NO: 1847310 - RNA, 17 nt, Salmonella typhimurium LT2
auaguuauuaacaucag

SEQ ID NO: 1847311 - RNA, 24 nt, Salmonella typhimurium LT2
auagugaagaugguaauauuaaaa

SEQ ID NO: 1847312 - RNA, 21 nt, Salmonella typhimurium LT2
auagucaaugcccccgccaaa

SEQ ID NO: 1847313 - RNA, 17 nt, Salmonella typhimurium LT2
auagucuccgccaccug

SEQ ID NO: 1847314 - RNA, 14 nt, Salmonella typhimurium LT2
auagucgcuuuuca

SEQ ID NO: 1847315 - RNA, 14 nt, Salmonella typhimurium LT2
auagucguuaaaac

SEQ ID NO: 1847316 - RNA, 16 nt, Salmonella typhimurium LT2
auauccccaucccaga

SEQ ID NO: 1847317 - RNA, 15 nt, Salmonella typhimurium LT2
auauaugcaaaacug

SEQ ID NO: 1847318 - RNA, 12 nt, Salmonella typhimurium LT2
auauaugaaauc

SEQ ID NO: 1847319 - RNA, 19 nt, Salmonella typhimurium LT2
auaucaguuaugacagaca

SEQ ID NO: 1847320 - RNA, 16 nt, Salmonella typhimurium LT2
auauauccuaacuuau

SEQ ID NO: 1847321 - RNA, 20 nt, Salmonella typhimurium LT2
auauauccgcuauuaccagu

SEQ ID NO: 1847322 - RNA, 20 nt, Salmonella typhimurium LT2
auaucgcuggccuccagcac

SEQ ID NO: 1847323 - RNA, 14 nt, Salmonella typhimurium LT2
auaucggcugcugu

SEQ ID NO: 1847324 - RNA, 15 nt, Salmonella typhimurium LT2
auaucgcgagcaauu

SEQ ID NO: 1847325 - RNA, 20 nt, Salmonella typhimurium LT2
auaucgcgagcaauuuccuc

SEQ ID NO: 1847326 - RNA, 22 nt, Salmonella typhimurium LT2
auauccgcugcggucaggaaug

SEQ ID NO: 1847327 - RNA, 20 nt, Salmonella typhimurium LT2
auaucccuucucauggacac

SEQ ID NO: 1847328 - RNA, 23 nt, Salmonella typhimurium LT2
auauccgugcgcaauuccagcaa

SEQ ID NO: 1847329 - RNA, 19 nt, Salmonella typhimurium LT2
auauccucgcauccuccau

SEQ ID NO: 1847330 - RNA, 22 nt, Salmonella typhimurium LT2
auauccugcaccgccugcggca

SEQ ID NO: 1847331 - RNA, 14 nt, Salmonella typhimurium LT2
auaucccgcaagaa

SEQ ID NO: 1847332 - RNA, 13 nt, Salmonella typhimurium LT2
auaugcaauuaau

SEQ ID NO: 1847333 - RNA, 18 nt, Salmonella typhimurium LT2
auaugcaauuaauauauu

SEQ ID NO: 1847334 - RNA, 17 nt, Salmonella typhimurium LT2
auaugaaccaagauaag

SEQ ID NO: 1847335 - RNA, 15 nt, Salmonella typhimurium LT2
auaugaaagagaaau

SEQ ID NO: 1847336 - RNA, 16 nt, Salmonella typhimurium LT2
auaugcagcagccagu

SEQ ID NO: 1847337 - RNA, 14 nt, Salmonella typhimurium LT2
auaugcaggcauaa

SEQ ID NO: 1847338 - RNA, 14 nt, Salmonella typhimurium LT2
auaugccaaguaau

SEQ ID NO: 1847339 - RNA, 22 nt, Salmonella typhimurium LT2
auaugccaaguaauaaagagaa

SEQ ID NO: 1847340 - RNA, 22 nt, Salmonella typhimurium LT2
auaugccaggcuuccugcgcug

SEQ ID NO: 1847341 - RNA, 21 nt, Salmonella typhimurium LT2
auaugccaggggaaauccugg

SEQ ID NO: 1847342 - RNA, 18 nt, Salmonella typhimurium LT2
auaugccccgacaucaga

SEQ ID NO: 1847343 - RNA, 15 nt, Salmonella typhimurium LT2
auaugcgccaacugc

SEQ ID NO: 1847344 - RNA, 14 nt, Salmonella typhimurium LT2
auauggaugaggau

SEQ ID NO: 1847345 - RNA, 19 nt, Salmonella typhimurium LT2
auaugcuugccggaugcaa

SEQ ID NO: 1847346 - RNA, 17 nt, Salmonella typhimurium LT2
auaugcuuguagcagau

SEQ ID NO: 1847347 - RNA, 23 nt, Salmonella typhimurium LT2
aucuuauuuuccguuagccaaug

SEQ ID NO: 1847348 - RNA, 21 nt, Salmonella typhimurium LT2
aucuucaaaaccgcacugcau

SEQ ID NO: 1847349 - RNA, 22 nt, Salmonella typhimurium LT2
aucuucaccgaugcccagcuug

SEQ ID NO: 1847350 - RNA, 18 nt, Salmonella typhimurium LT2
aucuucacuucacaaaca

SEQ ID NO: 1847351 - RNA, 14 nt, Salmonella typhimurium LT2
aucuucaucccauc

SEQ ID NO: 1847352 - RNA, 21 nt, Salmonella typhimurium LT2
aucuucaucguuacgcagaua

SEQ ID NO: 1847353 - RNA, 15 nt, Salmonella typhimurium LT2
aucuguucaaaaaca

SEQ ID NO: 1847354 - RNA, 14 nt, Salmonella typhimurium LT2
aucuguuugagaaa

SEQ ID NO: 1847355 - RNA, 18 nt, Salmonella typhimurium LT2
aucuuagacaucaaaauu

SEQ ID NO: 1847356 - RNA, 15 nt, Salmonella typhimurium LT2
aucuggugauaaagc

SEQ ID NO: 1847357 - RNA, 17 nt, Salmonella typhimurium LT2
aucugguggaaaagaaa

SEQ ID NO: 1847358 - RNA, 18 nt, Salmonella typhimurium LT2
aucuggugauaaagcaga

SEQ ID NO: 1847359 - RNA, 21 nt, Salmonella typhimurium LT2
aucugguucgcuuucauacga

SEQ ID NO: 1847360 - RNA, 12 nt, Salmonella typhimurium LT2
aucugucaacgu

SEQ ID NO: 1847361 - RNA, 13 nt, Salmonella typhimurium LT2
aucugugaaaacg

SEQ ID NO: 1847362 - RNA, 22 nt, Salmonella typhimurium LT2
aucugugugggcacucgaagau

SEQ ID NO: 1847363 - RNA, 20 nt, Salmonella typhimurium LT2
aucuggucggugauauauuc

SEQ ID NO: 1847364 - RNA, 14 nt, Salmonella typhimurium LT2
aucuggacgccaau

SEQ ID NO: 1847365 - RNA, 17 nt, Salmonella typhimurium LT2
aucuacaaacgcggaca

SEQ ID NO: 1847366 - RNA, 15 nt, Salmonella typhimurium LT2
aucuaauuaaaaaga

SEQ ID NO: 1847367 - RNA, 20 nt, Salmonella typhimurium LT2
aucuuccacacuacguugga

SEQ ID NO: 1847368 - RNA, 20 nt, Salmonella typhimurium LT2
aucuucauguucuaacagau

SEQ ID NO: 1847369 - RNA, 14 nt, Salmonella typhimurium LT2
aucuuccaguugcu

SEQ ID NO: 1847370 - RNA, 15 nt, Salmonella typhimurium LT2
aucuuccagguagug

SEQ ID NO: 1847371 - RNA, 16 nt, Salmonella typhimurium LT2
aucuuccuccugugcu

SEQ ID NO: 1847372 - RNA, 20 nt, Salmonella typhimurium LT2
aucuucgccaaacacccagc

SEQ ID NO: 1847373 - RNA, 22 nt, Salmonella typhimurium LT2
aucuucgcgguagauucuaucu

SEQ ID NO: 1847374 - RNA, 13 nt, Salmonella typhimurium LT2
augaaaaauagac

SEQ ID NO: 1847375 - RNA, 10 nt, Salmonella typhimurium LT2
augaaaaaaa

SEQ ID NO: 1847376 - RNA, 21 nt, Salmonella typhimurium LT2
augaaauucuugcccgcugag

SEQ ID NO: 1847377 - RNA, 15 nt, Salmonella typhimurium LT2
aucuuuuaaaaucag

SEQ ID NO: 1847378 - RNA, 19 nt, Salmonella typhimurium LT2
augaccgcuuucgccuggu

SEQ ID NO: 1847379 - RNA, 15 nt, Salmonella typhimurium LT2
augacacuuuauucu

SEQ ID NO: 1847380 - RNA, 14 nt, Salmonella typhimurium LT2
augaccgguuuuuc

SEQ ID NO: 1847381 - RNA, 21 nt, Salmonella typhimurium LT2
augacggcaaagcccacgccc

SEQ ID NO: 1847382 - RNA, 14 nt, Salmonella typhimurium LT2
augacggaagaguu

SEQ ID NO: 1847383 - RNA, 20 nt, Salmonella typhimurium LT2
augacggacgcagaccaaaa

SEQ ID NO: 1847384 - RNA, 13 nt, Salmonella typhimurium LT2
augacgggggcga

SEQ ID NO: 1847385 - RNA, 18 nt, Salmonella typhimurium LT2
augacggcgcguuaucgu

SEQ ID NO: 1847386 - RNA, 23 nt, Salmonella typhimurium LT2
augacgggaucgaaccgccgacc

SEQ ID NO: 1847387 - RNA, 14 nt, Salmonella typhimurium LT2
augacgucagcaag

SEQ ID NO: 1847388 - RNA, 14 nt, Salmonella typhimurium LT2
augacguccaggcc

SEQ ID NO: 1847389 - RNA, 13 nt, Salmonella typhimurium LT2
augacaacauaaa

SEQ ID NO: 1847390 - RNA, 15 nt, Salmonella typhimurium LT2
augacaaacaaaaaa

SEQ ID NO: 1847391 - RNA, 12 nt, Salmonella typhimurium LT2
augacaaauaaa

SEQ ID NO: 1847392 - RNA, 21 nt, Salmonella typhimurium LT2
augaaccauaucaaacaggac

SEQ ID NO: 1847393 - RNA, 18 nt, Salmonella typhimurium LT2
augaaccagaugugcuuu

SEQ ID NO: 1847394 - RNA, 15 nt, Salmonella typhimurium LT2
augaacucaauccau

SEQ ID NO: 1847395 - RNA, 18 nt, Salmonella typhimurium LT2
augagccagauggauaac

SEQ ID NO: 1847396 - RNA, 22 nt, Salmonella typhimurium LT2
augagcgcgaaaucaaagaccu

SEQ ID NO: 1847397 - RNA, 22 nt, Salmonella typhimurium LT2
augagcgcaaucaagcucacca

SEQ ID NO: 1847398 - RNA, 15 nt, Salmonella typhimurium LT2
augacguggccagca

SEQ ID NO: 1847399 - RNA, 19 nt, Salmonella typhimurium LT2
augacgucuaccagcucuc

SEQ ID NO: 1847400 - RNA, 13 nt, Salmonella typhimurium LT2
augacguucaauu

SEQ ID NO: 1847401 - RNA, 19 nt, Salmonella typhimurium LT2
augauaccguuguuauuau

SEQ ID NO: 1847402 - RNA, 16 nt, Salmonella typhimurium LT2
augauauauucaugau

SEQ ID NO: 1847403 - RNA, 22 nt, Salmonella typhimurium LT2
augauaucgcgccaggcuuugg

SEQ ID NO: 1847404 - RNA, 14 nt, Salmonella typhimurium LT2
augauaguguucau

SEQ ID NO: 1847405 - RNA, 23 nt, Salmonella typhimurium LT2
augaggccagaaggcgaacauaa

SEQ ID NO: 1847406 - RNA, 15 nt, Salmonella typhimurium LT2
augaggcaagaggga

SEQ ID NO: 1847407 - RNA, 15 nt, Salmonella typhimurium LT2
augaucauacugccg

SEQ ID NO: 1847408 - RNA, 20 nt, Salmonella typhimurium LT2
augaucacuuccgccaccac

SEQ ID NO: 1847409 - RNA, 21 nt, Salmonella typhimurium LT2
augauaucggccggaugccag

SEQ ID NO: 1847410 - RNA, 20 nt, Salmonella typhimurium LT2
augaucguaugcagccaggc

SEQ ID NO: 1847411 - RNA, 23 nt, Salmonella typhimurium LT2
augaugccuugcgaauggagaag

SEQ ID NO: 1847412 - RNA, 18 nt, Salmonella typhimurium LT2
augaugccaggaccaggu

SEQ ID NO: 1847413 - RNA, 13 nt, Salmonella typhimurium LT2
augaugccacagg

SEQ ID NO: 1847414 - RNA, 12 nt, Salmonella typhimurium LT2
augaugauuaau

SEQ ID NO: 1847415 - RNA, 22 nt, Salmonella typhimurium LT2
augaugaucgcgauagcgcuga

SEQ ID NO: 1847416 - RNA, 15 nt, Salmonella typhimurium LT2
augauuaauuguacc

SEQ ID NO: 1847417 - RNA, 22 nt, Salmonella typhimurium LT2
augauuaauacguacugaaaua

SEQ ID NO: 1847418 - RNA, 15 nt, Salmonella typhimurium LT2
augcaccucgccaaa

SEQ ID NO: 1847419 - RNA, 17 nt, Salmonella typhimurium LT2
augcacugcgaaaagag

SEQ ID NO: 1847420 - RNA, 13 nt, Salmonella typhimurium LT2
augcacugcugau

SEQ ID NO: 1847421 - RNA, 18 nt, Salmonella typhimurium LT2
augcacguuaaagccgac

SEQ ID NO: 1847422 - RNA, 14 nt, Salmonella typhimurium LT2
augcacugcugaua

SEQ ID NO: 1847423 - RNA, 20 nt, Salmonella typhimurium LT2
augcagcaagaagagaaugu

SEQ ID NO: 1847424 - RNA, 14 nt, Salmonella typhimurium LT2
augcauaaugcagc

SEQ ID NO: 1847425 - RNA, 17 nt, Salmonella typhimurium LT2
augcauccgccagauga

SEQ ID NO: 1847426 - RNA, 12 nt, Salmonella typhimurium LT2
augcaucagaac

SEQ ID NO: 1847427 - RNA, 15 nt, Salmonella typhimurium LT2
augcauaugaaugau

SEQ ID NO: 1847428 - RNA, 15 nt, Salmonella typhimurium LT2
augcauaugcacagc

SEQ ID NO: 1847429 - RNA, 16 nt, Salmonella typhimurium LT2
augauuuuuauaaaau

SEQ ID NO: 1847430 - RNA, 12 nt, Salmonella typhimurium LT2
augcaccgccuu

SEQ ID NO: 1847431 - RNA, 16 nt, Salmonella typhimurium LT2
augauuuuaacaucac

SEQ ID NO: 1847432 - RNA, 15 nt, Salmonella typhimurium LT2
augauugagcguuuc

SEQ ID NO: 1847433 - RNA, 20 nt, Salmonella typhimurium LT2
augauucguggcucaaggau

SEQ ID NO: 1847434 - RNA, 15 nt, Salmonella typhimurium LT2
auggcgugaugcuuu

SEQ ID NO: 1847435 - RNA, 23 nt, Salmonella typhimurium LT2
auggcguggauagccaucggcau

SEQ ID NO: 1847436 - RNA, 17 nt, Salmonella typhimurium LT2
auggcgguuccggggaa

SEQ ID NO: 1847437 - RNA, 20 nt, Salmonella typhimurium LT2
auggcgguugccacugccac

SEQ ID NO: 1847438 - RNA, 20 nt, Salmonella typhimurium LT2
auggcggugcuuaaccggga

SEQ ID NO: 1847439 - RNA, 22 nt, Salmonella typhimurium LT2
auggcugcacccggagagaaac

SEQ ID NO: 1847440 - RNA, 18 nt, Salmonella typhimurium LT2
auggcuggaaagcucuuc

SEQ ID NO: 1847441 - RNA, 15 nt, Salmonella typhimurium LT2
auggcgacgaucagc

SEQ ID NO: 1847442 - RNA, 20 nt, Salmonella typhimurium LT2
auggcgacgccuucagucaa

SEQ ID NO: 1847443 - RNA, 13 nt, Salmonella typhimurium LT2
auggcgaggcuaa

SEQ ID NO: 1847444 - RNA, 22 nt, Salmonella typhimurium LT2
auggcgggcgcagguuuuacuu

SEQ ID NO: 1847445 - RNA, 15 nt, Salmonella typhimurium LT2
auggcgguauaacug

SEQ ID NO: 1847446 - RNA, 16 nt, Salmonella typhimurium LT2
auggcgguauaacugc

SEQ ID NO: 1847447 - RNA, 22 nt, Salmonella typhimurium LT2
auggauucaugguacucaacau

SEQ ID NO: 1847448 - RNA, 21 nt, Salmonella typhimurium LT2
auggcaaaagacauucccgcc

SEQ ID NO: 1847449 - RNA, 18 nt, Salmonella typhimurium LT2
auggcaacaaagccugcu

SEQ ID NO: 1847450 - RNA, 12 nt, Salmonella typhimurium LT2
auggcaaagucg

SEQ ID NO: 1847451 - RNA, 17 nt, Salmonella typhimurium LT2
auggcaaguaaaauaac

SEQ ID NO: 1847452 - RNA, 14 nt, Salmonella typhimurium LT2
auggccugaugacg

SEQ ID NO: 1847453 - RNA, 20 nt, Salmonella typhimurium LT2
auggccguuuucaugcacga

SEQ ID NO: 1847454 - RNA, 19 nt, Salmonella typhimurium LT2
auggccccggucaacgcgc

SEQ ID NO: 1847455 - RNA, 14 nt, Salmonella typhimurium LT2
auggcccgccagca

SEQ ID NO: 1847456 - RNA, 12 nt, Salmonella typhimurium LT2
auggccgcagcc

SEQ ID NO: 1847457 - RNA, 22 nt, Salmonella typhimurium LT2
augggguuuguccugcagcgcc

SEQ ID NO: 1847458 - RNA, 23 nt, Salmonella typhimurium LT2
auggguaaaaauauggcgggccu

SEQ ID NO: 1847459 - RNA, 20 nt, Salmonella typhimurium LT2
auggcuuucagauuagccag

SEQ ID NO: 1847460 - RNA, 14 nt, Salmonella typhimurium LT2
auggcuucaaaaag

SEQ ID NO: 1847461 - RNA, 20 nt, Salmonella typhimurium LT2
augggucacauccagacagc

SEQ ID NO: 1847462 - RNA, 15 nt, Salmonella typhimurium LT2
auggguggcagggca

SEQ ID NO: 1847463 - RNA, 16 nt, Salmonella typhimurium LT2
auggucacauucugac

SEQ ID NO: 1847464 - RNA, 19 nt, Salmonella typhimurium LT2
augguuauuaauuacgcug

SEQ ID NO: 1847465 - RNA, 18 nt, Salmonella typhimurium LT2
auguaaacuccauuaaau

SEQ ID NO: 1847466 - RNA, 19 nt, Salmonella typhimurium LT2
auguaaacuccauuaaauu

SEQ ID NO: 1847467 - RNA, 18 nt, Salmonella typhimurium LT2
auggugcagugcacugcc

SEQ ID NO: 1847468 - RNA, 17 nt, Salmonella typhimurium LT2
augguuauccagcaggu

SEQ ID NO: 1847469 - RNA, 22 nt, Salmonella typhimurium LT2
augguggucggcuacgacaggu

SEQ ID NO: 1847470 - RNA, 18 nt, Salmonella typhimurium LT2
augguggagucuaaaaau

SEQ ID NO: 1847471 - RNA, 20 nt, Salmonella typhimurium LT2
auguacacgaaauagcgcag

SEQ ID NO: 1847472 - RNA, 16 nt, Salmonella typhimurium LT2
auguaauucaccaaau

SEQ ID NO: 1847473 - RNA, 17 nt, Salmonella typhimurium LT2
auguaccugcguuaaac

SEQ ID NO: 1847474 - RNA, 22 nt, Salmonella typhimurium LT2
auguacgaaagcgcgaucaauu

SEQ ID NO: 1847475 - RNA, 18 nt, Salmonella typhimurium LT2
auguacggcgguuucaug

SEQ ID NO: 1847476 - RNA, 22 nt, Salmonella typhimurium LT2
auguauucucccgucagcaaca

SEQ ID NO: 1847477 - RNA, 15 nt, Salmonella typhimurium LT2
auguauugguauuuu

SEQ ID NO: 1847478 - RNA, 14 nt, Salmonella typhimurium LT2
augucaucggcuuu

SEQ ID NO: 1847479 - RNA, 16 nt, Salmonella typhimurium LT2
augucauauuugugag

SEQ ID NO: 1847480 - RNA, 17 nt, Salmonella typhimurium LT2
augucgcgucagguuua

SEQ ID NO: 1847481 - RNA, 18 nt, Salmonella typhimurium LT2
augucagcgcaaagccaa

SEQ ID NO: 1847482 - RNA, 16 nt, Salmonella typhimurium LT2
augucagcucaggaag

SEQ ID NO: 1847483 - RNA, 16 nt, Salmonella typhimurium LT2
augucaguaauauauu

SEQ ID NO: 1847484 - RNA, 18 nt, Salmonella typhimurium LT2
augucaagguggugcucu

SEQ ID NO: 1847485 - RNA, 20 nt, Salmonella typhimurium LT2
auguucguccaacacgcugc

SEQ ID NO: 1847486 - RNA, 20 nt, Salmonella typhimurium LT2
auguucgcguucuucuuccc

SEQ ID NO: 1847487 - RNA, 18 nt, Salmonella typhimurium LT2
auguuagcauuauuuuua

SEQ ID NO: 1847488 - RNA, 13 nt, Salmonella typhimurium LT2
augugcgccagcc

SEQ ID NO: 1847489 - RNA, 14 nt, Salmonella typhimurium LT2
augugcaucggcac

SEQ ID NO: 1847490 - RNA, 11 nt, Salmonella typhimurium LT2
augugcugggg

SEQ ID NO: 1847491 - RNA, 16 nt, Salmonella typhimurium LT2
auguguaucuugcuuu

SEQ ID NO: 1847492 - RNA, 18 nt, Salmonella typhimurium LT2
augucuggugcagcaagc

SEQ ID NO: 1847493 - RNA, 14 nt, Salmonella typhimurium LT2
auggagauaagcug

SEQ ID NO: 1847494 - RNA, 20 nt, Salmonella typhimurium LT2
auggaucggcuugccuucau

SEQ ID NO: 1847495 - RNA, 15 nt, Salmonella typhimurium LT2
auggaugugaaugaa

SEQ ID NO: 1847496 - RNA, 22 nt, Salmonella typhimurium LT2
augcuuuccagccaugccagca

SEQ ID NO: 1847497 - RNA, 12 nt, Salmonella typhimurium LT2
augcuuuccggg

SEQ ID NO: 1847498 - RNA, 17 nt, Salmonella typhimurium LT2
augcuuucaauacucca

SEQ ID NO: 1847499 - RNA, 15 nt, Salmonella typhimurium LT2
auggaacaucuccca

SEQ ID NO: 1847500 - RNA, 21 nt, Salmonella typhimurium LT2
auggaacaucucccaggcgau

SEQ ID NO: 1847501 - RNA, 21 nt, Salmonella typhimurium LT2
augcugacggauucuuccucu

SEQ ID NO: 1847502 - RNA, 15 nt, Salmonella typhimurium LT2
augcugauacaaagc

SEQ ID NO: 1847503 - RNA, 16 nt, Salmonella typhimurium LT2
augcugcaucuuacug

SEQ ID NO: 1847504 - RNA, 18 nt, Salmonella typhimurium LT2
augcugacggauucuucc

SEQ ID NO: 1847505 - RNA, 19 nt, Salmonella typhimurium LT2
augcugacgcguuuuuuca

SEQ ID NO: 1847506 - RNA, 20 nt, Salmonella typhimurium LT2
augcugaauagccagccccc

SEQ ID NO: 1847507 - RNA, 15 nt, Salmonella typhimurium LT2
augcugaauagccag

SEQ ID NO: 1847508 - RNA, 13 nt, Salmonella typhimurium LT2
augcugaauagcc

SEQ ID NO: 1847509 - RNA, 14 nt, Salmonella typhimurium LT2
augcugaacagccg

SEQ ID NO: 1847510 - RNA, 21 nt, Salmonella typhimurium LT2
augcugcguacaaucgcguuu

SEQ ID NO: 1847511 - RNA, 12 nt, Salmonella typhimurium LT2
augcugccagca

SEQ ID NO: 1847512 - RNA, 18 nt, Salmonella typhimurium LT2
augcugccagcaugauaa

SEQ ID NO: 1847513 - RNA, 18 nt, Salmonella typhimurium LT2
augcugcgccagccauaa

SEQ ID NO: 1847514 - RNA, 19 nt, Salmonella typhimurium LT2
augcugggcgguaaaaccu

SEQ ID NO: 1847515 - RNA, 17 nt, Salmonella typhimurium LT2
augcuggcggagccaaa

SEQ ID NO: 1847516 - RNA, 15 nt, Salmonella typhimurium LT2
augcuuuaaaugccu

SEQ ID NO: 1847517 - RNA, 21 nt, Salmonella typhimurium LT2
augcuggugaagacgcugcaa

SEQ ID NO: 1847518 - RNA, 15 nt, Salmonella typhimurium LT2
augcuguuguagaau

SEQ ID NO: 1847519 - RNA, 17 nt, Salmonella typhimurium LT2
augcuccaauaaauauu

SEQ ID NO: 1847520 - RNA, 21 nt, Salmonella typhimurium LT2
augcucaguauggccagaugc

SEQ ID NO: 1847521 - RNA, 22 nt, Salmonella typhimurium LT2
augcuauucagcaguucauucg

SEQ ID NO: 1847522 - RNA, 20 nt, Salmonella typhimurium LT2
augcuaacgcccucucuccg

SEQ ID NO: 1847523 - RNA, 13 nt, Salmonella typhimurium LT2
augcucuccagca

SEQ ID NO: 1847524 - RNA, 21 nt, Salmonella typhimurium LT2
augcgucggcaccauucccac

SEQ ID NO: 1847525 - RNA, 17 nt, Salmonella typhimurium LT2
augcgucucaagcuuuu

SEQ ID NO: 1847526 - RNA, 19 nt, Salmonella typhimurium LT2
augcguggcguaucggcag

SEQ ID NO: 1847527 - RNA, 17 nt, Salmonella typhimurium LT2
augcguauuuccaccuu

SEQ ID NO: 1847528 - RNA, 22 nt, Salmonella typhimurium LT2
augcgucagcgcggcuuccagu

SEQ ID NO: 1847529 - RNA, 16 nt, Salmonella typhimurium LT2
augcguccgcccagaa

SEQ ID NO: 1847530 - RNA, 17 nt, Salmonella typhimurium LT2
augcguuguaccguuuu

SEQ ID NO: 1847531 - RNA, 17 nt, Salmonella typhimurium LT2
augcguuucgucgggcg

SEQ ID NO: 1847532 - RNA, 13 nt, Salmonella typhimurium LT2
augcuaaaacaga

SEQ ID NO: 1847533 - RNA, 20 nt, Salmonella typhimurium LT2
augcgggguuugcagaugug

SEQ ID NO: 1847534 - RNA, 21 nt, Salmonella typhimurium LT2
augcggcugacgauacucagc

SEQ ID NO: 1847535 - RNA, 20 nt, Salmonella typhimurium LT2
augcguaauccggccuggcg

SEQ ID NO: 1847536 - RNA, 21 nt, Salmonella typhimurium LT2
augcguaccgcuaucgccaaa

SEQ ID NO: 1847537 - RNA, 22 nt, Salmonella typhimurium LT2
augcgggugacgcuggcggaga

SEQ ID NO: 1847538 - RNA, 16 nt, Salmonella typhimurium LT2
augcaucuugaaugau

SEQ ID NO: 1847539 - RNA, 23 nt, Salmonella typhimurium LT2
augcaucucguaaaucaauuuua

SEQ ID NO: 1847540 - RNA, 19 nt, Salmonella typhimurium LT2
augccaaauagcacgugca

SEQ ID NO: 1847541 - RNA, 14 nt, Salmonella typhimurium LT2
augcgaagguggcg

SEQ ID NO: 1847542 - RNA, 15 nt, Salmonella typhimurium LT2
augcgacugaaaauc

SEQ ID NO: 1847543 - RNA, 16 nt, Salmonella typhimurium LT2
augcgacugcccaaca

SEQ ID NO: 1847544 - RNA, 19 nt, Salmonella typhimurium LT2
augcgacuuugcgccggca

SEQ ID NO: 1847545 - RNA, 16 nt, Salmonella typhimurium LT2
augcgacgcccaacca

SEQ ID NO: 1847546 - RNA, 23 nt, Salmonella typhimurium LT2
augcgacgcgcucaccuccgcca

SEQ ID NO: 1847547 - RNA, 16 nt, Salmonella typhimurium LT2
augcgauaaucggcgu

SEQ ID NO: 1847548 - RNA, 17 nt, Salmonella typhimurium LT2
augcgcugcacaaucgc

SEQ ID NO: 1847549 - RNA, 16 nt, Salmonella typhimurium LT2
augcgcguagcccaca

SEQ ID NO: 1847550 - RNA, 20 nt, Salmonella typhimurium LT2
augcgcgucccggcagugca

SEQ ID NO: 1847551 - RNA, 21 nt, Salmonella typhimurium LT2
augcgcgcgugaccccaggca

SEQ ID NO: 1847552 - RNA, 12 nt, Salmonella typhimurium LT2
augcgcggcugc

SEQ ID NO: 1847553 - RNA, 13 nt, Salmonella typhimurium LT2
augcgccugcaau

SEQ ID NO: 1847554 - RNA, 19 nt, Salmonella typhimurium LT2
augcgccaucccaugcacc

SEQ ID NO: 1847555 - RNA, 12 nt, Salmonella typhimurium LT2
augcgccaggca

SEQ ID NO: 1847556 - RNA, 16 nt, Salmonella typhimurium LT2
augcgccagccagucg

SEQ ID NO: 1847557 - RNA, 15 nt, Salmonella typhimurium LT2
augcgccagccgcuu

SEQ ID NO: 1847558 - RNA, 15 nt, Salmonella typhimurium LT2
augcgccgucaggcu

SEQ ID NO: 1847559 - RNA, 18 nt, Salmonella typhimurium LT2
aucaggaaaucuuccagu

SEQ ID NO: 1847560 - RNA, 17 nt, Salmonella typhimurium LT2
aucaaucgcuaucugac

SEQ ID NO: 1847561 - RNA, 14 nt, Salmonella typhimurium LT2
aucaggaaaugaac

SEQ ID NO: 1847562 - RNA, 22 nt, Salmonella typhimurium LT2
aucaggaaauucucagaaacaa

SEQ ID NO: 1847563 - RNA, 15 nt, Salmonella typhimurium LT2
aucaggaguaaauaa

SEQ ID NO: 1847564 - RNA, 21 nt, Salmonella typhimurium LT2
aucaggaguaaauaacaaaag

SEQ ID NO: 1847565 - RNA, 16 nt, Salmonella typhimurium LT2
aucaggauauggccgc

SEQ ID NO: 1847566 - RNA, 14 nt, Salmonella typhimurium LT2
aucaggaucaaaau

SEQ ID NO: 1847567 - RNA, 13 nt, Salmonella typhimurium LT2
aucaggacaucaa

SEQ ID NO: 1847568 - RNA, 21 nt, Salmonella typhimurium LT2
aucaggaaaaagggaauaaua

SEQ ID NO: 1847569 - RNA, 17 nt, Salmonella typhimurium LT2
aucaggcauguugcgca

SEQ ID NO: 1847570 - RNA, 18 nt, Salmonella typhimurium LT2
aucaggcaugccaaacca

SEQ ID NO: 1847571 - RNA, 19 nt, Salmonella typhimurium LT2
aucaggccgacaaaugacg

SEQ ID NO: 1847572 - RNA, 13 nt, Salmonella typhimurium LT2
aucaggcccagua

SEQ ID NO: 1847573 - RNA, 19 nt, Salmonella typhimurium LT2
aucaggcaggucugauaaa

SEQ ID NO: 1847574 - RNA, 19 nt, Salmonella typhimurium LT2
aucaggcaauaaacaucag

SEQ ID NO: 1847575 - RNA, 17 nt, Salmonella typhimurium LT2
aucaggcaauacgcugc

SEQ ID NO: 1847576 - RNA, 21 nt, Salmonella typhimurium LT2
aucaggcaaaaaucgucauca

SEQ ID NO: 1847577 - RNA, 22 nt, Salmonella typhimurium LT2
aucaggauucgacggccagcgc

SEQ ID NO: 1847578 - RNA, 14 nt, Salmonella typhimurium LT2
aucaggaucuucau

SEQ ID NO: 1847579 - RNA, 21 nt, Salmonella typhimurium LT2
aucaggcguugaccgcuucgc

SEQ ID NO: 1847580 - RNA, 19 nt, Salmonella typhimurium LT2
aucaggccugcaaaccucu

SEQ ID NO: 1847581 - RNA, 17 nt, Salmonella typhimurium LT2
aucaggccuaccagccg

SEQ ID NO: 1847582 - RNA, 15 nt, Salmonella typhimurium LT2
aucaggccuaccagc

SEQ ID NO: 1847583 - RNA, 16 nt, Salmonella typhimurium LT2
aucaggcguucauaaa

SEQ ID NO: 1847584 - RNA, 22 nt, Salmonella typhimurium LT2
aucaguacgaccccgccgagaa

SEQ ID NO: 1847585 - RNA, 20 nt, Salmonella typhimurium LT2
aucaggugaguaaauaaaaa

SEQ ID NO: 1847586 - RNA, 15 nt, Salmonella typhimurium LT2
aucagggugccaggc

SEQ ID NO: 1847587 - RNA, 20 nt, Salmonella typhimurium LT2
aucaguggcggcaaaaaaua

SEQ ID NO: 1847588 - RNA, 22 nt, Salmonella typhimurium LT2
aucagugauggauuucacaauc

SEQ ID NO: 1847589 - RNA, 18 nt, Salmonella typhimurium LT2
aucaguccccacauuacg

SEQ ID NO: 1847590 - RNA, 18 nt, Salmonella typhimurium LT2
aucagugaacacccugcc

SEQ ID NO: 1847591 - RNA, 14 nt, Salmonella typhimurium LT2
aucauaaaaggcau

SEQ ID NO: 1847592 - RNA, 18 nt, Salmonella typhimurium LT2
aucauaaagcgcccggug

SEQ ID NO: 1847593 - RNA, 19 nt, Salmonella typhimurium LT2
aucaguuguacuuguugcu

SEQ ID NO: 1847594 - RNA, 17 nt, Salmonella typhimurium LT2
aucaguucuugcaggca

SEQ ID NO: 1847595 - RNA, 15 nt, Salmonella typhimurium LT2
aucaguucaggaaca

SEQ ID NO: 1847596 - RNA, 12 nt, Salmonella typhimurium LT2
aucauaaaucga

SEQ ID NO: 1847597 - RNA, 14 nt, Salmonella typhimurium LT2
aucauauaaaacag

SEQ ID NO: 1847598 - RNA, 22 nt, Salmonella typhimurium LT2
aucauaugugccgaugacgcuc

SEQ ID NO: 1847599 - RNA, 16 nt, Salmonella typhimurium LT2
aucauccguucccucu

SEQ ID NO: 1847600 - RNA, 16 nt, Salmonella typhimurium LT2
aucauccgcuucggac

SEQ ID NO: 1847601 - RNA, 20 nt, Salmonella typhimurium LT2
aucaucgcuugcccagcaua

SEQ ID NO: 1847602 - RNA, 23 nt, Salmonella typhimurium LT2
aucaucgcaggcggucagcacag

SEQ ID NO: 1847603 - RNA, 12 nt, Salmonella typhimurium LT2
aucaucuucacu

SEQ ID NO: 1847604 - RNA, 14 nt, Salmonella typhimurium LT2
aucaucuucacuuc

SEQ ID NO: 1847605 - RNA, 21 nt, Salmonella typhimurium LT2
aucaucgguuacuccuuauuu

SEQ ID NO: 1847606 - RNA, 15 nt, Salmonella typhimurium LT2
aucaucguaccaaua

SEQ ID NO: 1847607 - RNA, 19 nt, Salmonella typhimurium LT2
aucaucuauagccugcugg

SEQ ID NO: 1847608 - RNA, 15 nt, Salmonella typhimurium LT2
aucaucaccacccgc

SEQ ID NO: 1847609 - RNA, 13 nt, Salmonella typhimurium LT2
aucaucagcagca

SEQ ID NO: 1847610 - RNA, 21 nt, Salmonella typhimurium LT2
aucaucaauaccguccagcgc

SEQ ID NO: 1847611 - RNA, 14 nt, Salmonella typhimurium LT2
aucauauuuucuug

SEQ ID NO: 1847612 - RNA, 18 nt, Salmonella typhimurium LT2
aucaucaaguaccgugaa

SEQ ID NO: 1847613 - RNA, 20 nt, Salmonella typhimurium LT2
aucauccagucagcaauuaa

SEQ ID NO: 1847614 - RNA, 12 nt, Salmonella typhimurium LT2
aucauccagccc

SEQ ID NO: 1847615 - RNA, 17 nt, Salmonella typhimurium LT2
aucauccagucagcaau

SEQ ID NO: 1847616 - RNA, 15 nt, Salmonella typhimurium LT2
aucaucauaguggcg

SEQ ID NO: 1847617 - RNA, 16 nt, Salmonella typhimurium LT2
aucaucauaucccggc

SEQ ID NO: 1847618 - RNA, 20 nt, Salmonella typhimurium LT2
aucaucaucggcacagccag

SEQ ID NO: 1847619 - RNA, 14 nt, Salmonella typhimurium LT2
aucaugcugcaccg

SEQ ID NO: 1847620 - RNA, 20 nt, Salmonella typhimurium LT2
aucaugcugcaccgcaucaa

SEQ ID NO: 1847621 - RNA, 19 nt, Salmonella typhimurium LT2
aucaugggcucaucaaaca

SEQ ID NO: 1847622 - RNA, 19 nt, Salmonella typhimurium LT2
aucauggcucagauugaac

SEQ ID NO: 1847623 - RNA, 21 nt, Salmonella typhimurium LT2
aucaugcccaaaccugagcau

SEQ ID NO: 1847624 - RNA, 11 nt, Salmonella typhimurium LT2
aucaugacacu

SEQ ID NO: 1847625 - RNA, 18 nt, Salmonella typhimurium LT2
aucaucuuuuaccgccug

SEQ ID NO: 1847626 - RNA, 20 nt, Salmonella typhimurium LT2
aucauucaacgcaucaaaua

SEQ ID NO: 1847627 - RNA, 17 nt, Salmonella typhimurium LT2
aucauucaacgcaucaa

SEQ ID NO: 1847628 - RNA, 19 nt, Salmonella typhimurium LT2
aucauuaugucauagcaau

SEQ ID NO: 1847629 - RNA, 17 nt, Salmonella typhimurium LT2
aucaugucacccacgcc

SEQ ID NO: 1847630 - RNA, 16 nt, Salmonella typhimurium LT2
aucaugucaaauucaa

SEQ ID NO: 1847631 - RNA, 20 nt, Salmonella typhimurium LT2
aucaugguugaaaaaagccg

SEQ ID NO: 1847632 - RNA, 13 nt, Salmonella typhimurium LT2
aucauuacaggcg

SEQ ID NO: 1847633 - RNA, 22 nt, Salmonella typhimurium LT2
aucauuaccuacgcgauaaaaa

SEQ ID NO: 1847634 - RNA, 18 nt, Salmonella typhimurium LT2
aucauuaauaaccccagc

SEQ ID NO: 1847635 - RNA, 16 nt, Salmonella typhimurium LT2
aucauguuuuucuccc

SEQ ID NO: 1847636 - RNA, 12 nt, Salmonella typhimurium LT2
aucauucaucuc

SEQ ID NO: 1847637 - RNA, 15 nt, Salmonella typhimurium LT2
aucauucaucucgau

SEQ ID NO: 1847638 - RNA, 22 nt, Salmonella typhimurium LT2
aucauucccguaucuucauguu

SEQ ID NO: 1847639 - RNA, 20 nt, Salmonella typhimurium LT2
aucauucccgcccaguauuc

SEQ ID NO: 1847640 - RNA, 16 nt, Salmonella typhimurium LT2
aucauucccgcccagu

SEQ ID NO: 1847641 - RNA, 22 nt, Salmonella typhimurium LT2
aucauucgcgaauagugcagaa

SEQ ID NO: 1847642 - RNA, 22 nt, Salmonella typhimurium LT2
aucauucgagaugcauaaaaaa

SEQ ID NO: 1847643 - RNA, 15 nt, Salmonella typhimurium LT2
aucauugauacugua

SEQ ID NO: 1847644 - RNA, 14 nt, Salmonella typhimurium LT2
aucauugcugcugu

SEQ ID NO: 1847645 - RNA, 20 nt, Salmonella typhimurium LT2
aucauugcgaugguccccgg

SEQ ID NO: 1847646 - RNA, 16 nt, Salmonella typhimurium LT2
aucauuucaucuacgc

SEQ ID NO: 1847647 - RNA, 22 nt, Salmonella typhimurium LT2
aucauugguuaacucaagcgaa

SEQ ID NO: 1847648 - RNA, 13 nt, Salmonella typhimurium LT2
aucauuggccaga

SEQ ID NO: 1847649 - RNA, 16 nt, Salmonella typhimurium LT2
aucauugguauuacug

SEQ ID NO: 1847650 - RNA, 19 nt, Salmonella typhimurium LT2
aucauuuucuuucaucaaa

SEQ ID NO: 1847651 - RNA, 21 nt, Salmonella typhimurium LT2
aucauuuucuuucaucaaacg

SEQ ID NO: 1847652 - RNA, 13 nt, Salmonella typhimurium LT2
aucauuuucccac

SEQ ID NO: 1847653 - RNA, 16 nt, Salmonella typhimurium LT2
aucauuuucccacuga

SEQ ID NO: 1847654 - RNA, 18 nt, Salmonella typhimurium LT2
aucauuuguacaaaaaau

SEQ ID NO: 1847655 - RNA, 16 nt, Salmonella typhimurium LT2
auccaaaagaaagcgg

SEQ ID NO: 1847656 - RNA, 18 nt, Salmonella typhimurium LT2
aucauuuuuuaauaucaa

SEQ ID NO: 1847657 - RNA, 16 nt, Salmonella typhimurium LT2
auccacacaggccugc

SEQ ID NO: 1847658 - RNA, 15 nt, Salmonella typhimurium LT2
auccaauaauaagaa

SEQ ID NO: 1847659 - RNA, 16 nt, Salmonella typhimurium LT2
auccaaugacagugaa

SEQ ID NO: 1847660 - RNA, 16 nt, Salmonella typhimurium LT2
auccaccgccagcaua

SEQ ID NO: 1847661 - RNA, 17 nt, Salmonella typhimurium LT2
auccaccaccagcauca

SEQ ID NO: 1847662 - RNA, 19 nt, Salmonella typhimurium LT2
auccaccaccagcaucacg

SEQ ID NO: 1847663 - RNA, 14 nt, Salmonella typhimurium LT2
auccaccagcccca

SEQ ID NO: 1847664 - RNA, 16 nt, Salmonella typhimurium LT2
auccacauccaaccgc

SEQ ID NO: 1847665 - RNA, 20 nt, Salmonella typhimurium LT2
auccacauuccagaccugaa

SEQ ID NO: 1847666 - RNA, 16 nt, Salmonella typhimurium LT2
auccacagcgccagaa

SEQ ID NO: 1847667 - RNA, 22 nt, Salmonella typhimurium LT2
auccagacaaacaccgccuggc

SEQ ID NO: 1847668 - RNA, 19 nt, Salmonella typhimurium LT2
auccagaccuauugccuug

SEQ ID NO: 1847669 - RNA, 21 nt, Salmonella typhimurium LT2
auccagaauacgccgccgccc

SEQ ID NO: 1847670 - RNA, 18 nt, Salmonella typhimurium LT2
auccagaaugcguaaaaa

SEQ ID NO: 1847671 - RNA, 23 nt, Salmonella typhimurium LT2
auccagaacugcgaaaucaccga

SEQ ID NO: 1847672 - RNA, 15 nt, Salmonella typhimurium LT2
auccagacuuuuuug

SEQ ID NO: 1847673 - RNA, 12 nt, Salmonella typhimurium LT2
auccagcaaaau

SEQ ID NO: 1847674 - RNA, 18 nt, Salmonella typhimurium LT2
auccacggcaucaauaac

SEQ ID NO: 1847675 - RNA, 18 nt, Salmonella typhimurium LT2
auccaccgguacgcucca

SEQ ID NO: 1847676 - RNA, 18 nt, Salmonella typhimurium LT2
auccacguuccgcaaucg

SEQ ID NO: 1847677 - RNA, 19 nt, Salmonella typhimurium LT2
auccacgcccugcuuuuuc

SEQ ID NO: 1847678 - RNA, 18 nt, Salmonella typhimurium LT2
auccaucagaucgaucuu

SEQ ID NO: 1847679 - RNA, 21 nt, Salmonella typhimurium LT2
auccaucagaucgaucuuguu

SEQ ID NO: 1847680 - RNA, 16 nt, Salmonella typhimurium LT2
auccauguacgcaggc

SEQ ID NO: 1847681 - RNA, 18 nt, Salmonella typhimurium LT2
auccauucucaucagacc

SEQ ID NO: 1847682 - RNA, 18 nt, Salmonella typhimurium LT2
auccauuuccguuuucag

SEQ ID NO: 1847683 - RNA, 21 nt, Salmonella typhimurium LT2
auccauuuaacuaaggggaca

SEQ ID NO: 1847684 - RNA, 14 nt, Salmonella typhimurium LT2
auccauguugccau

SEQ ID NO: 1847685 - RNA, 18 nt, Salmonella typhimurium LT2
auccaugaccguugccau

SEQ ID NO: 1847686 - RNA, 14 nt, Salmonella typhimurium LT2
aucccacugcacgc

SEQ ID NO: 1847687 - RNA, 17 nt, Salmonella typhimurium LT2
aucccaccauaaagcga

SEQ ID NO: 1847688 - RNA, 17 nt, Salmonella typhimurium LT2
aucccacaacuguucuu

SEQ ID NO: 1847689 - RNA, 12 nt, Salmonella typhimurium LT2
aucccaaucagg

SEQ ID NO: 1847690 - RNA, 16 nt, Salmonella typhimurium LT2
aucccaaucagguuug

SEQ ID NO: 1847691 - RNA, 18 nt, Salmonella typhimurium LT2
auccauuucaucaggcag

SEQ ID NO: 1847692 - RNA, 14 nt, Salmonella typhimurium LT2
aucccaaaauuuac

SEQ ID NO: 1847693 - RNA, 14 nt, Salmonella typhimurium LT2
auccaguuucguga

SEQ ID NO: 1847694 - RNA, 22 nt, Salmonella typhimurium LT2
auccauaauacgacucaauaca

SEQ ID NO: 1847695 - RNA, 23 nt, Salmonella typhimurium LT2
auccaguggugaaaaagcggcug

SEQ ID NO: 1847696 - RNA, 20 nt, Salmonella typhimurium LT2
auccaggccgucggcgccag

SEQ ID NO: 1847697 - RNA, 14 nt, Salmonella typhimurium LT2
auccaggcgggcau

SEQ ID NO: 1847698 - RNA, 21 nt, Salmonella typhimurium LT2
auccaggagagcaccuuuuuu

SEQ ID NO: 1847699 - RNA, 12 nt, Salmonella typhimurium LT2
auccaggaggca

SEQ ID NO: 1847700 - RNA, 14 nt, Salmonella typhimurium LT2
auccagguggaucg

SEQ ID NO: 1847701 - RNA, 9 nt, Salmonella typhimurium LT2
auccaguaa

SEQ ID NO: 1847702 - RNA, 12 nt, Salmonella typhimurium LT2
auccagcagcca

SEQ ID NO: 1847703 - RNA, 14 nt, Salmonella typhimurium LT2
auccagcaaaauaa

SEQ ID NO: 1847704 - RNA, 11 nt, Salmonella typhimurium LT2
auccagcacag

SEQ ID NO: 1847705 - RNA, 14 nt, Salmonella typhimurium LT2
auccagcacaggua

SEQ ID NO: 1847706 - RNA, 20 nt, Salmonella typhimurium LT2
auccagcaccucauccccca

SEQ ID NO: 1847707 - RNA, 23 nt, Salmonella typhimurium LT2
auccagccccagcgccagcugcg

SEQ ID NO: 1847708 - RNA, 11 nt, Salmonella typhimurium LT2
auccagcccca

SEQ ID NO: 1847709 - RNA, 18 nt, Salmonella typhimurium LT2
auccagcgguuacuuuug

SEQ ID NO: 1847710 - RNA, 15 nt, Salmonella typhimurium LT2
auccagcucuucuuc

SEQ ID NO: 1847711 - RNA, 16 nt, Salmonella typhimurium LT2
auccaggaaguaaauu

SEQ ID NO: 1847712 - RNA, 22 nt, Salmonella typhimurium LT2
auccagcgauugacgguuuguc

SEQ ID NO: 1847713 - RNA, 15 nt, Salmonella typhimurium LT2
auccagcgucacagg

SEQ ID NO: 1847714 - RNA, 17 nt, Salmonella typhimurium LT2
auccagcgguuacuuuu

SEQ ID NO: 1847715 - RNA, 19 nt, Salmonella typhimurium LT2
auccagcgcguaaauaccu

SEQ ID NO: 1847716 - RNA, 21 nt, Salmonella typhimurium LT2
auccagcgcguaaauaccuuc

SEQ ID NO: 1847717 - RNA, 21 nt, Salmonella typhimurium LT2
aucccgguauuccguuccuuc

SEQ ID NO: 1847718 - RNA, 15 nt, Salmonella typhimurium LT2
aucccgcugaagacu

SEQ ID NO: 1847719 - RNA, 15 nt, Salmonella typhimurium LT2
aucccgguuucccgc

SEQ ID NO: 1847720 - RNA, 17 nt, Salmonella typhimurium LT2
aucccuaauaagguauu

SEQ ID NO: 1847721 - RNA, 18 nt, Salmonella typhimurium LT2
aucccuaacuggucaaac

SEQ ID NO: 1847722 - RNA, 16 nt, Salmonella typhimurium LT2
aucccgcgcugcgccg

SEQ ID NO: 1847723 - RNA, 22 nt, Salmonella typhimurium LT2
aucccgcggcggacagcggcag

SEQ ID NO: 1847724 - RNA, 22 nt, Salmonella typhimurium LT2
aucccggccauaauacgcuugc

SEQ ID NO: 1847725 - RNA, 13 nt, Salmonella typhimurium LT2
aucccgcaucacc

SEQ ID NO: 1847726 - RNA, 21 nt, Salmonella typhimurium LT2
aucccgccaucguccagccau

SEQ ID NO: 1847727 - RNA, 16 nt, Salmonella typhimurium LT2
auccccuucaggaaua

SEQ ID NO: 1847728 - RNA, 13 nt, Salmonella typhimurium LT2
auccccugcuccu

SEQ ID NO: 1847729 - RNA, 15 nt, Salmonella typhimurium LT2
auccccgccgggcuu

SEQ ID NO: 1847730 - RNA, 12 nt, Salmonella typhimurium LT2
auccccauccca

SEQ ID NO: 1847731 - RNA, 16 nt, Salmonella typhimurium LT2
auccgccgagggcauu

SEQ ID NO: 1847732 - RNA, 16 nt, Salmonella typhimurium LT2
auccgccgccagccau

SEQ ID NO: 1847733 - RNA, 15 nt, Salmonella typhimurium LT2
auccgcauacaccuu

SEQ ID NO: 1847734 - RNA, 15 nt, Salmonella typhimurium LT2
auccgccagccagcc

SEQ ID NO: 1847735 - RNA, 23 nt, Salmonella typhimurium LT2
auccgccaccaugaucaccugaa

SEQ ID NO: 1847736 - RNA, 22 nt, Salmonella typhimurium LT2
auccgcguuacccaugagcgaa

SEQ ID NO: 1847737 - RNA, 15 nt, Salmonella typhimurium LT2
auccggaauaagaau

SEQ ID NO: 1847738 - RNA, 14 nt, Salmonella typhimurium LT2
auccggcaagcgcu

SEQ ID NO: 1847739 - RNA, 14 nt, Salmonella typhimurium LT2
auccggcaaaauua

SEQ ID NO: 1847740 - RNA, 17 nt, Salmonella typhimurium LT2
auccgacgccuguucga

SEQ ID NO: 1847741 - RNA, 16 nt, Salmonella typhimurium LT2
auccgacagauagugg

SEQ ID NO: 1847742 - RNA, 13 nt, Salmonella typhimurium LT2
auccgaagaacca

SEQ ID NO: 1847743 - RNA, 16 nt, Salmonella typhimurium LT2
auccguuucagaaaga

SEQ ID NO: 1847744 - RNA, 21 nt, Salmonella typhimurium LT2
auccguuccggauauuuauac

SEQ ID NO: 1847745 - RNA, 19 nt, Salmonella typhimurium LT2
auccguuccaaucucuuuu

SEQ ID NO: 1847746 - RNA, 12 nt, Salmonella typhimurium LT2
auccgguaaaca

SEQ ID NO: 1847747 - RNA, 18 nt, Salmonella typhimurium LT2
auccgucguguagccuuc

SEQ ID NO: 1847748 - RNA, 15 nt, Salmonella typhimurium LT2
auccgguucaaggca

SEQ ID NO: 1847749 - RNA, 19 nt, Salmonella typhimurium LT2
auccggccuccaccaccuc

SEQ ID NO: 1847750 - RNA, 13 nt, Salmonella typhimurium LT2
auccggccugccc

SEQ ID NO: 1847751 - RNA, 22 nt, Salmonella typhimurium LT2
auccggccugcgaaacagggca

SEQ ID NO: 1847752 - RNA, 23 nt, Salmonella typhimurium LT2
auccggcuucuggcuaccgggcg

SEQ ID NO: 1847753 - RNA, 15 nt, Salmonella typhimurium LT2
auccggcuacgggcg

SEQ ID NO: 1847754 - RNA, 15 nt, Salmonella typhimurium LT2
auccggauuguuuuu

SEQ ID NO: 1847755 - RNA, 11 nt, Salmonella typhimurium LT2
auccggcacug

SEQ ID NO: 1847756 - RNA, 14 nt, Salmonella typhimurium LT2
auccggcaaggguc

SEQ ID NO: 1847757 - RNA, 16 nt, Salmonella typhimurium LT2
auccggcacaaaauau

SEQ ID NO: 1847758 - RNA, 17 nt, Salmonella typhimurium LT2
auccggccuacaagccg

SEQ ID NO: 1847759 - RNA, 23 nt, Salmonella typhimurium LT2
auccggcaguuauuuuacgggcg

SEQ ID NO: 1847760 - RNA, 15 nt, Salmonella typhimurium LT2
auccucuccugaagc

SEQ ID NO: 1847761 - RNA, 20 nt, Salmonella typhimurium LT2
auccucuccugaagccagcg

SEQ ID NO: 1847762 - RNA, 14 nt, Salmonella typhimurium LT2
auccuccugcagac

SEQ ID NO: 1847763 - RNA, 17 nt, Salmonella typhimurium LT2
auccugacuauugcuga

SEQ ID NO: 1847764 - RNA, 22 nt, Salmonella typhimurium LT2
auccugauccugcaacagcacc

SEQ ID NO: 1847765 - RNA, 16 nt, Salmonella typhimurium LT2
auccugcaaauagcgc

SEQ ID NO: 1847766 - RNA, 20 nt, Salmonella typhimurium LT2
auccugcaaauagcgcugau

SEQ ID NO: 1847767 - RNA, 22 nt, Salmonella typhimurium LT2
auccugaaggacaagcugcgcc

SEQ ID NO: 1847768 - RNA, 14 nt, Salmonella typhimurium LT2
auccugcacuucca

SEQ ID NO: 1847769 - RNA, 21 nt, Salmonella typhimurium LT2
auccugcaccgccugcggcau

SEQ ID NO: 1847770 - RNA, 20 nt, Salmonella typhimurium LT2
auccuggauacguuccagca

SEQ ID NO: 1847771 - RNA, 23 nt, Salmonella typhimurium LT2
auccuguaacggcgcgauuuuuu

SEQ ID NO: 1847772 - RNA, 13 nt, Salmonella typhimurium LT2
aucguaaaucaaa

SEQ ID NO: 1847773 - RNA, 17 nt, Salmonella typhimurium LT2
aucguaaaaugaaaaac

SEQ ID NO: 1847774 - RNA, 14 nt, Salmonella typhimurium LT2
aucgguuaauugcc

SEQ ID NO: 1847775 - RNA, 14 nt, Salmonella typhimurium LT2
aucgguuacaauau

SEQ ID NO: 1847776 - RNA, 22 nt, Salmonella typhimurium LT2
aucggcuauuagcguuuuuacc

SEQ ID NO: 1847777 - RNA, 16 nt, Salmonella typhimurium LT2
aucggcgcgcuggcgu

SEQ ID NO: 1847778 - RNA, 22 nt, Salmonella typhimurium LT2
aucggcggcaaugcccacgccg

SEQ ID NO: 1847779 - RNA, 15 nt, Salmonella typhimurium LT2
aucggcguugcccau

SEQ ID NO: 1847780 - RNA, 16 nt, Salmonella typhimurium LT2
aucgucaccaggaugc

SEQ ID NO: 1847781 - RNA, 17 nt, Salmonella typhimurium LT2
aucguauaaauuuuuac

SEQ ID NO: 1847782 - RNA, 23 nt, Salmonella typhimurium LT2
aucguauccggcggcaaaggcau

SEQ ID NO: 1847783 - RNA, 16 nt, Salmonella typhimurium LT2
aucguaccaauaccca

SEQ ID NO: 1847784 - RNA, 14 nt, Salmonella typhimurium LT2
aucgucguauuauc

SEQ ID NO: 1847785 - RNA, 16 nt, Salmonella typhimurium LT2
aucgucggucagauua

SEQ ID NO: 1847786 - RNA, 18 nt, Salmonella typhimurium LT2
aucguuggaaagcugcug

SEQ ID NO: 1847787 - RNA, 19 nt, Salmonella typhimurium LT2
aucguuuuuguccauaaaa

SEQ ID NO: 1847788 - RNA, 21 nt, Salmonella typhimurium LT2
aucguuuuuguccauaaaaug

SEQ ID NO: 1847789 - RNA, 15 nt, Salmonella typhimurium LT2
aucgcugccuugagu

SEQ ID NO: 1847790 - RNA, 13 nt, Salmonella typhimurium LT2
aucgcugcgcccg

SEQ ID NO: 1847791 - RNA, 13 nt, Salmonella typhimurium LT2
aucgcugcgccag

SEQ ID NO: 1847792 - RNA, 15 nt, Salmonella typhimurium LT2
aucgcugcgccagca

SEQ ID NO: 1847793 - RNA, 17 nt, Salmonella typhimurium LT2
aucgcugcgccagcagc

SEQ ID NO: 1847794 - RNA, 18 nt, Salmonella typhimurium LT2
aucgcugcgccagcagcg

SEQ ID NO: 1847795 - RNA, 16 nt, Salmonella typhimurium LT2
aucgcugcuaaacgaa

SEQ ID NO: 1847796 - RNA, 23 nt, Salmonella typhimurium LT2
aucgcuaucugacagccaaacug

SEQ ID NO: 1847797 - RNA, 13 nt, Salmonella typhimurium LT2
aucgcucaaaaca

SEQ ID NO: 1847798 - RNA, 15 nt, Salmonella typhimurium LT2
aucgccugcgcgccu

SEQ ID NO: 1847799 - RNA, 17 nt, Salmonella typhimurium LT2
aucgcuuaacggcccag

SEQ ID NO: 1847800 - RNA, 22 nt, Salmonella typhimurium LT2
aucgcuucaaucagcguggcgu

SEQ ID NO: 1847801 - RNA, 22 nt, Salmonella typhimurium LT2
aucgcuuugcagaaaauccuuc

SEQ ID NO: 1847802 - RNA, 13 nt, Salmonella typhimurium LT2
aucggaaaaauag

SEQ ID NO: 1847803 - RNA, 20 nt, Salmonella typhimurium LT2
aucggaaaaauaguggcugg

SEQ ID NO: 1847804 - RNA, 22 nt, Salmonella typhimurium LT2
aucggcaucuuuaaccgccugc

SEQ ID NO: 1847805 - RNA, 17 nt, Salmonella typhimurium LT2
aucgccgcuaugcaauu

SEQ ID NO: 1847806 - RNA, 16 nt, Salmonella typhimurium LT2
aucgccgcugcgagca

SEQ ID NO: 1847807 - RNA, 15 nt, Salmonella typhimurium LT2
aucgccgcugcuggc

SEQ ID NO: 1847808 - RNA, 15 nt, Salmonella typhimurium LT2
aucgccugacugaag

SEQ ID NO: 1847809 - RNA, 15 nt, Salmonella typhimurium LT2
aucgccgcaaucagc

SEQ ID NO: 1847810 - RNA, 20 nt, Salmonella typhimurium LT2
aucgccgauuccugcugggc

SEQ ID NO: 1847811 - RNA, 14 nt, Salmonella typhimurium LT2
aucgccgcaucaua

SEQ ID NO: 1847812 - RNA, 14 nt, Salmonella typhimurium LT2
aucgccagcgccug

SEQ ID NO: 1847813 - RNA, 19 nt, Salmonella typhimurium LT2
aucgccagcguuagcacau

SEQ ID NO: 1847814 - RNA, 17 nt, Salmonella typhimurium LT2
aucgccauauacgccac

SEQ ID NO: 1847815 - RNA, 18 nt, Salmonella typhimurium LT2
aucgccagggcuuccgcu

SEQ ID NO: 1847816 - RNA, 11 nt, Salmonella typhimurium LT2
aucgccaggcg

SEQ ID NO: 1847817 - RNA, 23 nt, Salmonella typhimurium LT2
aucgccaucaacgccauaaucca

SEQ ID NO: 1847818 - RNA, 18 nt, Salmonella typhimurium LT2
aucgccaugaccacaaag

SEQ ID NO: 1847819 - RNA, 23 nt, Salmonella typhimurium LT2
aucgacuggcggaauggcgggcg

SEQ ID NO: 1847820 - RNA, 15 nt, Salmonella typhimurium LT2
aucgacuucgaaggu

SEQ ID NO: 1847821 - RNA, 20 nt, Salmonella typhimurium LT2
aucgacggcgucccugcuuc

SEQ ID NO: 1847822 - RNA, 22 nt, Salmonella typhimurium LT2
aucgccaaagucauugcugcca

SEQ ID NO: 1847823 - RNA, 19 nt, Salmonella typhimurium LT2
aucgccaaagcguaaacag

SEQ ID NO: 1847824 - RNA, 22 nt, Salmonella typhimurium LT2
aucgccaaauuuagugcucagc

SEQ ID NO: 1847825 - RNA, 16 nt, Salmonella typhimurium LT2
aucgccacaugcggca

SEQ ID NO: 1847826 - RNA, 12 nt, Salmonella typhimurium LT2
aucgccaaacca

SEQ ID NO: 1847827 - RNA, 14 nt, Salmonella typhimurium LT2
aucgaugugauaaa

SEQ ID NO: 1847828 - RNA, 18 nt, Salmonella typhimurium LT2
aucgauguuaaaggucag

SEQ ID NO: 1847829 - RNA, 15 nt, Salmonella typhimurium LT2
aucgacagcagcgcu

SEQ ID NO: 1847830 - RNA, 15 nt, Salmonella typhimurium LT2
aucgacacuauuuuu

SEQ ID NO: 1847831 - RNA, 23 nt, Salmonella typhimurium LT2
aucgaccauacuaaugcugccca

SEQ ID NO: 1847832 - RNA, 19 nt, Salmonella typhimurium LT2
aucgacccccaccauguca

SEQ ID NO: 1847833 - RNA, 17 nt, Salmonella typhimurium LT2
aucgaaggcaucuucag

SEQ ID NO: 1847834 - RNA, 15 nt, Salmonella typhimurium LT2
aucgaaguaauaaaa

SEQ ID NO: 1847835 - RNA, 11 nt, Salmonella typhimurium LT2
auccuguccug

SEQ ID NO: 1847836 - RNA, 21 nt, Salmonella typhimurium LT2
auccuguggguucaucgccac

SEQ ID NO: 1847837 - RNA, 18 nt, Salmonella typhimurium LT2
auccuguucaaacaucag

SEQ ID NO: 1847838 - RNA, 11 nt, Salmonella typhimurium LT2
auccuucgccg

SEQ ID NO: 1847839 - RNA, 19 nt, Salmonella typhimurium LT2
auccuuccuccaccaccau

SEQ ID NO: 1847840 - RNA, 22 nt, Salmonella typhimurium LT2
auccuucauucagaucaaaaau

SEQ ID NO: 1847841 - RNA, 21 nt, Salmonella typhimurium LT2
auccuucaaucgguacgccaa

SEQ ID NO: 1847842 - RNA, 11 nt, Salmonella typhimurium LT2
auccuguucca

SEQ ID NO: 1847843 - RNA, 16 nt, Salmonella typhimurium LT2
auccuucuuccauucc

SEQ ID NO: 1847844 - RNA, 12 nt, Salmonella typhimurium LT2
auccuucuucca

SEQ ID NO: 1847845 - RNA, 16 nt, Salmonella typhimurium LT2
auccuugcacgccaaa

SEQ ID NO: 1847846 - RNA, 20 nt, Salmonella typhimurium LT2
auccuugagugcugcgcaaa

SEQ ID NO: 1847847 - RNA, 14 nt, Salmonella typhimurium LT2
caauuccacaggcg

SEQ ID NO: 1847848 - RNA, 19 nt, Salmonella typhimurium LT2
caauuccggcccaggccau

SEQ ID NO: 1847849 - RNA, 16 nt, Salmonella typhimurium LT2
caauucugauuuuuua

SEQ ID NO: 1847850 - RNA, 17 nt, Salmonella typhimurium LT2
caauugccgucagcucc

SEQ ID NO: 1847851 - RNA, 14 nt, Salmonella typhimurium LT2
caauugcaggcagc

SEQ ID NO: 1847852 - RNA, 21 nt, Salmonella typhimurium LT2
caauuuaaaauccggcugccu

SEQ ID NO: 1847853 - RNA, 14 nt, Salmonella typhimurium LT2
caauucaaucacuu

SEQ ID NO: 1847854 - RNA, 23 nt, Salmonella typhimurium LT2
caauuauguauuucucgccgccg

SEQ ID NO: 1847855 - RNA, 12 nt, Salmonella typhimurium LT2
caauuacguugg

SEQ ID NO: 1847856 - RNA, 22 nt, Salmonella typhimurium LT2
caauuacguuggggauaaccag

SEQ ID NO: 1847857 - RNA, 18 nt, Salmonella typhimurium LT2
caauuacggacagaaaaa

SEQ ID NO: 1847858 - RNA, 19 nt, Salmonella typhimurium LT2
caauuacggacagaaaaaa

SEQ ID NO: 1847859 - RNA, 20 nt, Salmonella typhimurium LT2
caauuacggacagaaaaaau

SEQ ID NO: 1847860 - RNA, 19 nt, Salmonella typhimurium LT2
caauuauauucguccuuua

SEQ ID NO: 1847861 - RNA, 14 nt, Salmonella typhimurium LT2
caauuaauauauuu

SEQ ID NO: 1847862 - RNA, 13 nt, Salmonella typhimurium LT2
caaucaguucacg

SEQ ID NO: 1847863 - RNA, 14 nt, Salmonella typhimurium LT2
caauuaacaaauaa

SEQ ID NO: 1847864 - RNA, 17 nt, Salmonella typhimurium LT2
caaucagaugcugacuc

SEQ ID NO: 1847865 - RNA, 22 nt, Salmonella typhimurium LT2
caaucaggaaagagccgcgcag

SEQ ID NO: 1847866 - RNA, 22 nt, Salmonella typhimurium LT2
caaucaggcgcaaacgcgugcu

SEQ ID NO: 1847867 - RNA, 19 nt, Salmonella typhimurium LT2
caauuuugauaagagaaaa

SEQ ID NO: 1847868 - RNA, 21 nt, Salmonella typhimurium LT2
caauuugguuagggaucaucu

SEQ ID NO: 1847869 - RNA, 23 nt, Salmonella typhimurium LT2
caauuugugagacaaaaaagcug

SEQ ID NO: 1847870 - RNA, 20 nt, Salmonella typhimurium LT2
caauuuuaauuuaauaauaa

SEQ ID NO: 1847871 - RNA, 20 nt, Salmonella typhimurium LT2
cacaaaaacacccgcagccg

SEQ ID NO: 1847872 - RNA, 14 nt, Salmonella typhimurium LT2
caauuuaucagaca

SEQ ID NO: 1847873 - RNA, 18 nt, Salmonella typhimurium LT2
caauuugcugcuguuacc

SEQ ID NO: 1847874 - RNA, 20 nt, Salmonella typhimurium LT2
caauuuccgcugaaauagcc

SEQ ID NO: 1847875 - RNA, 14 nt, Salmonella typhimurium LT2
caauuuccucugcc

SEQ ID NO: 1847876 - RNA, 15 nt, Salmonella typhimurium LT2
caauuuccugccaca

SEQ ID NO: 1847877 - RNA, 16 nt, Salmonella typhimurium LT2
caauuuccgcugaaau

SEQ ID NO: 1847878 - RNA, 15 nt, Salmonella typhimurium LT2
caauuuccgcugaaa

SEQ ID NO: 1847879 - RNA, 21 nt, Salmonella typhimurium LT2
caauuucucgcucgcccauca

SEQ ID NO: 1847880 - RNA, 15 nt, Salmonella typhimurium LT2
cacaaacaauuuacg

SEQ ID NO: 1847881 - RNA, 21 nt, Salmonella typhimurium LT2
cacaaacaauuuacgcagccc

SEQ ID NO: 1847882 - RNA, 23 nt, Salmonella typhimurium LT2
cacaaacaauuuacgcagcccca

SEQ ID NO: 1847883 - RNA, 14 nt, Salmonella typhimurium LT2
cacaaacaauuucc

SEQ ID NO: 1847884 - RNA, 20 nt, Salmonella typhimurium LT2
cacaaaaggauacagcgccg

SEQ ID NO: 1847885 - RNA, 17 nt, Salmonella typhimurium LT2
cacaaauuuugauaaaa

SEQ ID NO: 1847886 - RNA, 20 nt, Salmonella typhimurium LT2
cacaaacuccguuauauuuc

SEQ ID NO: 1847887 - RNA, 19 nt, Salmonella typhimurium LT2
cacaaagcguucggccugc

SEQ ID NO: 1847888 - RNA, 13 nt, Salmonella typhimurium LT2
cacaaccuccacg

SEQ ID NO: 1847889 - RNA, 19 nt, Salmonella typhimurium LT2
cacaaccuccacgcccagc

SEQ ID NO: 1847890 - RNA, 16 nt, Salmonella typhimurium LT2
cacaacccaaaggcca

SEQ ID NO: 1847891 - RNA, 16 nt, Salmonella typhimurium LT2
cacaacccacuggccu

SEQ ID NO: 1847892 - RNA, 16 nt, Salmonella typhimurium LT2
cacaacggcgaauaaa

SEQ ID NO: 1847893 - RNA, 14 nt, Salmonella typhimurium LT2
cacaacgcauuggc

SEQ ID NO: 1847894 - RNA, 16 nt, Salmonella typhimurium LT2
cacaacgccuuauucg

SEQ ID NO: 1847895 - RNA, 15 nt, Salmonella typhimurium LT2
cacaacgcaccaacc

SEQ ID NO: 1847896 - RNA, 16 nt, Salmonella typhimurium LT2
cacaacuagcaaaaca

SEQ ID NO: 1847897 - RNA, 19 nt, Salmonella typhimurium LT2
cacaacugaagcauacccu

SEQ ID NO: 1847898 - RNA, 13 nt, Salmonella typhimurium LT2
cacacuuaccgac

SEQ ID NO: 1847899 - RNA, 22 nt, Salmonella typhimurium LT2
cacacuuaccgacgcgugguga

SEQ ID NO: 1847900 - RNA, 22 nt, Salmonella typhimurium LT2
cacacuguuuaaugcuuucaau

SEQ ID NO: 1847901 - RNA, 15 nt, Salmonella typhimurium LT2
cacacuuucaucagc

SEQ ID NO: 1847902 - RNA, 19 nt, Salmonella typhimurium LT2
cacacguauaaacgccgcc

SEQ ID NO: 1847903 - RNA, 18 nt, Salmonella typhimurium LT2
cacacgucugagcagacg

SEQ ID NO: 1847904 - RNA, 17 nt, Salmonella typhimurium LT2
cacacgcuucugguugu

SEQ ID NO: 1847905 - RNA, 14 nt, Salmonella typhimurium LT2
cacacugacaauaa

SEQ ID NO: 1847906 - RNA, 20 nt, Salmonella typhimurium LT2
cacacgaauuccuuuuuccg

SEQ ID NO: 1847907 - RNA, 14 nt, Salmonella typhimurium LT2
cacacgcaaaaaag

SEQ ID NO: 1847908 - RNA, 20 nt, Salmonella typhimurium LT2
cacaccauuucacaaauuaa

SEQ ID NO: 1847909 - RNA, 20 nt, Salmonella typhimurium LT2
cacaccagcaggaaucccau

SEQ ID NO: 1847910 - RNA, 19 nt, Salmonella typhimurium LT2
cacaccccgcgccgcugag

SEQ ID NO: 1847911 - RNA, 20 nt, Salmonella typhimurium LT2
cacaagccccacgcccgcca

SEQ ID NO: 1847912 - RNA, 15 nt, Salmonella typhimurium LT2
cacaagcuguuucuc

SEQ ID NO: 1847913 - RNA, 14 nt, Salmonella typhimurium LT2
cacaagcugugcca

SEQ ID NO: 1847914 - RNA, 23 nt, Salmonella typhimurium LT2
cacaagcugugccauauucucug

SEQ ID NO: 1847915 - RNA, 17 nt, Salmonella typhimurium LT2
cacaagccccacgcccg

SEQ ID NO: 1847916 - RNA, 19 nt, Salmonella typhimurium LT2
cacaagauucacucugaaa

SEQ ID NO: 1847917 - RNA, 12 nt, Salmonella typhimurium LT2
cacaauaaccag

SEQ ID NO: 1847918 - RNA, 21 nt, Salmonella typhimurium LT2
cacaagucaccguuuuucauc

SEQ ID NO: 1847919 - RNA, 13 nt, Salmonella typhimurium LT2
cacaaucacagcg

SEQ ID NO: 1847920 - RNA, 20 nt, Salmonella typhimurium LT2
cacaauaugguuauccagca

SEQ ID NO: 1847921 - RNA, 19 nt, Salmonella typhimurium LT2
cacaaucgucgugccuucc

SEQ ID NO: 1847922 - RNA, 18 nt, Salmonella typhimurium LT2
cacaaucagccacggcaa

SEQ ID NO: 1847923 - RNA, 11 nt, Salmonella typhimurium LT2
cacaaucaucg

SEQ ID NO: 1847924 - RNA, 22 nt, Salmonella typhimurium LT2
cacaaucgcauaaccggcgcca

SEQ ID NO: 1847925 - RNA, 23 nt, Salmonella typhimurium LT2
cacacacuguuuaaugcuuucaa

SEQ ID NO: 1847926 - RNA, 19 nt, Salmonella typhimurium LT2
cacaccaaugucauauuug

SEQ ID NO: 1847927 - RNA, 18 nt, Salmonella typhimurium LT2
cacaccacaugcgagcag

SEQ ID NO: 1847928 - RNA, 17 nt, Salmonella typhimurium LT2
cacaauucugauuuuuu

SEQ ID NO: 1847929 - RNA, 20 nt, Salmonella typhimurium LT2
cacaauugccagcagguauc

SEQ ID NO: 1847930 - RNA, 16 nt, Salmonella typhimurium LT2
cacaauggucagcgcc

SEQ ID NO: 1847931 - RNA, 16 nt, Salmonella typhimurium LT2
cacaaugucaucaaga

SEQ ID NO: 1847932 - RNA, 19 nt, Salmonella typhimurium LT2
cacaaugucaucaagauuu

SEQ ID NO: 1847933 - RNA, 17 nt, Salmonella typhimurium LT2
cacaaugugauaugacc

SEQ ID NO: 1847934 - RNA, 22 nt, Salmonella typhimurium LT2
cacaaugcgacuuaucagaacu

SEQ ID NO: 1847935 - RNA, 18 nt, Salmonella typhimurium LT2
cacaaugccuucugcgcc

SEQ ID NO: 1847936 - RNA, 22 nt, Salmonella typhimurium LT2
cacaggcuucgacaaacagcug

SEQ ID NO: 1847937 - RNA, 18 nt, Salmonella typhimurium LT2
cacagguuuuaguccggu

SEQ ID NO: 1847938 - RNA, 13 nt, Salmonella typhimurium LT2
cacagguaagccu

SEQ ID NO: 1847939 - RNA, 19 nt, Salmonella typhimurium LT2
cacagguaagccuggcaua

SEQ ID NO: 1847940 - RNA, 15 nt, Salmonella typhimurium LT2
cacaggcagccaggu

SEQ ID NO: 1847941 - RNA, 20 nt, Salmonella typhimurium LT2
cacaggcggguauggcgcca

SEQ ID NO: 1847942 - RNA, 15 nt, Salmonella typhimurium LT2
cacaggcgucccggu

SEQ ID NO: 1847943 - RNA, 17 nt, Salmonella typhimurium LT2
cacauaagcacaccauu

SEQ ID NO: 1847944 - RNA, 21 nt, Salmonella typhimurium LT2
cacauaaagcccagaauagug

SEQ ID NO: 1847945 - RNA, 17 nt, Salmonella typhimurium LT2
cacauacagcacuuccc

SEQ ID NO: 1847946 - RNA, 16 nt, Salmonella typhimurium LT2
cacagucaucgcgcca

SEQ ID NO: 1847947 - RNA, 18 nt, Salmonella typhimurium LT2
cacaguauucaccuggaa

SEQ ID NO: 1847948 - RNA, 19 nt, Salmonella typhimurium LT2
cacagccaguaagaacgag

SEQ ID NO: 1847949 - RNA, 23 nt, Salmonella typhimurium LT2
cacagcccggcgcaaacacggcu

SEQ ID NO: 1847950 - RNA, 19 nt, Salmonella typhimurium LT2
cacagccgcauuuuuucuu

SEQ ID NO: 1847951 - RNA, 14 nt, Salmonella typhimurium LT2
cacagccccagcac

SEQ ID NO: 1847952 - RNA, 22 nt, Salmonella typhimurium LT2
cacagcccauaccagcgcggca

SEQ ID NO: 1847953 - RNA, 16 nt, Salmonella typhimurium LT2
cacagccccagcacca

SEQ ID NO: 1847954 - RNA, 17 nt, Salmonella typhimurium LT2
cacagcguacaauggca

SEQ ID NO: 1847955 - RNA, 21 nt, Salmonella typhimurium LT2
cacagcggaaagcaacagcaa

SEQ ID NO: 1847956 - RNA, 14 nt, Salmonella typhimurium LT2
cacagcucaauauc

SEQ ID NO: 1847957 - RNA, 21 nt, Salmonella typhimurium LT2
cacagcggacacccgcagccg

SEQ ID NO: 1847958 - RNA, 13 nt, Salmonella typhimurium LT2
cacagaagcgccu

SEQ ID NO: 1847959 - RNA, 22 nt, Salmonella typhimurium LT2
cacagaacggauauccagaauc

SEQ ID NO: 1847960 - RNA, 17 nt, Salmonella typhimurium LT2
cacagcaaaugaaagga

SEQ ID NO: 1847961 - RNA, 20 nt, Salmonella typhimurium LT2
cacagcaauggacaaguaaa

SEQ ID NO: 1847962 - RNA, 20 nt, Salmonella typhimurium LT2
cacagcacaaugccuucugc

SEQ ID NO: 1847963 - RNA, 15 nt, Salmonella typhimurium LT2
cacaugaccagcgcc

SEQ ID NO: 1847964 - RNA, 17 nt, Salmonella typhimurium LT2
cacaucgcccugauggc

SEQ ID NO: 1847965 - RNA, 15 nt, Salmonella typhimurium LT2
cacaucgccguucca

SEQ ID NO: 1847966 - RNA, 15 nt, Salmonella typhimurium LT2
cacaucgcgcagcag

SEQ ID NO: 1847967 - RNA, 17 nt, Salmonella typhimurium LT2
cacaucguuggccgcca

SEQ ID NO: 1847968 - RNA, 17 nt, Salmonella typhimurium LT2
cacauauugcgcuucac

SEQ ID NO: 1847969 - RNA, 12 nt, Salmonella typhimurium LT2
cacaucaauaaa

SEQ ID NO: 1847970 - RNA, 16 nt, Salmonella typhimurium LT2
cacauccgccagcgcc

SEQ ID NO: 1847971 - RNA, 20 nt, Salmonella typhimurium LT2
cacaucgacaugcagaucgc

SEQ ID NO: 1847972 - RNA, 20 nt, Salmonella typhimurium LT2
cacauccagacagccgacgg

SEQ ID NO: 1847973 - RNA, 16 nt, Salmonella typhimurium LT2
cacauucauaaaagau

SEQ ID NO: 1847974 - RNA, 19 nt, Salmonella typhimurium LT2
cacauucauugccgccagu

SEQ ID NO: 1847975 - RNA, 16 nt, Salmonella typhimurium LT2
cacauugcgguucauu

SEQ ID NO: 1847976 - RNA, 17 nt, Salmonella typhimurium LT2
cacauuggaaaacccca

SEQ ID NO: 1847977 - RNA, 22 nt, Salmonella typhimurium LT2
cacauucugaccgcguuuccac

SEQ ID NO: 1847978 - RNA, 19 nt, Salmonella typhimurium LT2
cacauuggguaauuuuuug

SEQ ID NO: 1847979 - RNA, 23 nt, Salmonella typhimurium LT2
cacauuuuauccggcgucacacc

SEQ ID NO: 1847980 - RNA, 10 nt, Salmonella typhimurium LT2
caccaaaaac

SEQ ID NO: 1847981 - RNA, 18 nt, Salmonella typhimurium LT2
caccaaaaacgcccccag

SEQ ID NO: 1847982 - RNA, 17 nt, Salmonella typhimurium LT2
caccaaaguuaaucagc

SEQ ID NO: 1847983 - RNA, 20 nt, Salmonella typhimurium LT2
caccaaaguuaaucagcgcu

SEQ ID NO: 1847984 - RNA, 18 nt, Salmonella typhimurium LT2
caccaaauccuccagcgg

SEQ ID NO: 1847985 - RNA, 16 nt, Salmonella typhimurium LT2
caccaacgcuggucag

SEQ ID NO: 1847986 - RNA, 22 nt, Salmonella typhimurium LT2
caccaauacgugagcgaaguuc

SEQ ID NO: 1847987 - RNA, 15 nt, Salmonella typhimurium LT2
caccaaucaucacgu

SEQ ID NO: 1847988 - RNA, 21 nt, Salmonella typhimurium LT2
caccacguaaugcgccccggc

SEQ ID NO: 1847989 - RNA, 22 nt, Salmonella typhimurium LT2
caccacguaacucggcagcgcg

SEQ ID NO: 1847990 - RNA, 18 nt, Salmonella typhimurium LT2
caccacguaaugcgcccc

SEQ ID NO: 1847991 - RNA, 23 nt, Salmonella typhimurium LT2
caccacguuaccgcgcaguucaa

SEQ ID NO: 1847992 - RNA, 16 nt, Salmonella typhimurium LT2
caccacgguguacccc

SEQ ID NO: 1847993 - RNA, 15 nt, Salmonella typhimurium LT2
caccacgccuuucac

SEQ ID NO: 1847994 - RNA, 15 nt, Salmonella typhimurium LT2
caccacgcaaaccgc

SEQ ID NO: 1847995 - RNA, 13 nt, Salmonella typhimurium LT2
caccacgcacagu

SEQ ID NO: 1847996 - RNA, 16 nt, Salmonella typhimurium LT2
caccacgcgcacgccc

SEQ ID NO: 1847997 - RNA, 13 nt, Salmonella typhimurium LT2
caccacgaaggaa

SEQ ID NO: 1847998 - RNA, 19 nt, Salmonella typhimurium LT2
caccacgaaggaaacgcca

SEQ ID NO: 1847999 - RNA, 23 nt, Salmonella typhimurium LT2
caccacgaaggaaacgccaggca

SEQ ID NO: 1848000 - RNA, 21 nt, Salmonella typhimurium LT2
caccagacgcuggcacuggca

SEQ ID NO: 1848001 - RNA, 23 nt, Salmonella typhimurium LT2
caccacuggcagcgccugacggc

SEQ ID NO: 1848002 - RNA, 16 nt, Salmonella typhimurium LT2
caccagaauccacucg

SEQ ID NO: 1848003 - RNA, 21 nt, Salmonella typhimurium LT2
caccagaauccacucggcgcu

SEQ ID NO: 1848004 - RNA, 18 nt, Salmonella typhimurium LT2
caccacaaagucgccuuc

SEQ ID NO: 1848005 - RNA, 22 nt, Salmonella typhimurium LT2
caccaaugucauauuugugagc

SEQ ID NO: 1848006 - RNA, 18 nt, Salmonella typhimurium LT2
caccacaguugcgacugg

SEQ ID NO: 1848007 - RNA, 19 nt, Salmonella typhimurium LT2
caccacagucaucgcgcca

SEQ ID NO: 1848008 - RNA, 14 nt, Salmonella typhimurium LT2
caccaccaaaccgc

SEQ ID NO: 1848009 - RNA, 22 nt, Salmonella typhimurium LT2
caccacauuuagcgcaguacgc

SEQ ID NO: 1848010 - RNA, 16 nt, Salmonella typhimurium LT2
caccaccgcaggcagc

SEQ ID NO: 1848011 - RNA, 18 nt, Salmonella typhimurium LT2
caccaccaguacauggca

SEQ ID NO: 1848012 - RNA, 14 nt, Salmonella typhimurium LT2
caccaccucaaacg

SEQ ID NO: 1848013 - RNA, 23 nt, Salmonella typhimurium LT2
caccaccggaugauucaguaaac

SEQ ID NO: 1848014 - RNA, 13 nt, Salmonella typhimurium LT2
caccaucccgcuc

SEQ ID NO: 1848015 - RNA, 15 nt, Salmonella typhimurium LT2
caccaucgccggaga

SEQ ID NO: 1848016 - RNA, 19 nt, Salmonella typhimurium LT2
caccaucgccggagaccug

SEQ ID NO: 1848017 - RNA, 24 nt, Salmonella typhimurium LT2
caccaucgcgaucaucagcacgcc

SEQ ID NO: 1848018 - RNA, 20 nt, Salmonella typhimurium LT2
caccaucgucgccagaccca

SEQ ID NO: 1848019 - RNA, 14 nt, Salmonella typhimurium LT2
caccauccggcgcu

SEQ ID NO: 1848020 - RNA, 13 nt, Salmonella typhimurium LT2
caccauggcgcca

SEQ ID NO: 1848021 - RNA, 16 nt, Salmonella typhimurium LT2
caccauggcgccaagu

SEQ ID NO: 1848022 - RNA, 16 nt, Salmonella typhimurium LT2
caccaucuuuuccggc

SEQ ID NO: 1848023 - RNA, 18 nt, Salmonella typhimurium LT2
caccauggcuauccacgc

SEQ ID NO: 1848024 - RNA, 21 nt, Salmonella typhimurium LT2
caccaucguugccagcggcca

SEQ ID NO: 1848025 - RNA, 13 nt, Salmonella typhimurium LT2
caccaucuuuuug

SEQ ID NO: 1848026 - RNA, 15 nt, Salmonella typhimurium LT2
caccaucuuuuugcu

SEQ ID NO: 1848027 - RNA, 21 nt, Salmonella typhimurium LT2
caccaugacgcagugcaauau

SEQ ID NO: 1848028 - RNA, 12 nt, Salmonella typhimurium LT2
caccauucuuca

SEQ ID NO: 1848029 - RNA, 19 nt, Salmonella typhimurium LT2
caccauucauguuucgaca

SEQ ID NO: 1848030 - RNA, 13 nt, Salmonella typhimurium LT2
caccauucccagc

SEQ ID NO: 1848031 - RNA, 16 nt, Salmonella typhimurium LT2
caccauuaacgggcgu

SEQ ID NO: 1848032 - RNA, 14 nt, Salmonella typhimurium LT2
caccauuucacaaa

SEQ ID NO: 1848033 - RNA, 13 nt, Salmonella typhimurium LT2
cacccacgccgga

SEQ ID NO: 1848034 - RNA, 20 nt, Salmonella typhimurium LT2
cacccagacuucaauauuua

SEQ ID NO: 1848035 - RNA, 12 nt, Salmonella typhimurium LT2
caccccacagca

SEQ ID NO: 1848036 - RNA, 16 nt, Salmonella typhimurium LT2
cacccauugaacccga

SEQ ID NO: 1848037 - RNA, 12 nt, Salmonella typhimurium LT2
cacccagcgcgg

SEQ ID NO: 1848038 - RNA, 22 nt, Salmonella typhimurium LT2
cacccgcagccgcaaucagcgu

SEQ ID NO: 1848039 - RNA, 18 nt, Salmonella typhimurium LT2
caccccgucgaggaucau

SEQ ID NO: 1848040 - RNA, 20 nt, Salmonella typhimurium LT2
caccccgcgccgcugagaaa

SEQ ID NO: 1848041 - RNA, 23 nt, Salmonella typhimurium LT2
caccagcaggaaucccauuaagc

SEQ ID NO: 1848042 - RNA, 12 nt, Salmonella typhimurium LT2
caccagcccauc

SEQ ID NO: 1848043 - RNA, 17 nt, Salmonella typhimurium LT2
caccagccaggccgcca

SEQ ID NO: 1848044 - RNA, 14 nt, Salmonella typhimurium LT2
caccagccguucac

SEQ ID NO: 1848045 - RNA, 21 nt, Salmonella typhimurium LT2
caccagcccggcgcacacccu

SEQ ID NO: 1848046 - RNA, 21 nt, Salmonella typhimurium LT2
caccagcccaucuuucgccag

SEQ ID NO: 1848047 - RNA, 15 nt, Salmonella typhimurium LT2
caccagccccagccc

SEQ ID NO: 1848048 - RNA, 23 nt, Salmonella typhimurium LT2
caccagcaaugauaacggcgcca

SEQ ID NO: 1848049 - RNA, 16 nt, Salmonella typhimurium LT2
caccagcacagcccag

SEQ ID NO: 1848050 - RNA, 15 nt, Salmonella typhimurium LT2
caccagcaccgccag

SEQ ID NO: 1848051 - RNA, 16 nt, Salmonella typhimurium LT2
caccagcaccgccagc

SEQ ID NO: 1848052 - RNA, 13 nt, Salmonella typhimurium LT2
caccagcacagcc

SEQ ID NO: 1848053 - RNA, 14 nt, Salmonella typhimurium LT2
caccagcagcgcgg

SEQ ID NO: 1848054 - RNA, 17 nt, Salmonella typhimurium LT2
caccagcagcgcggcgu

SEQ ID NO: 1848055 - RNA, 17 nt, Salmonella typhimurium LT2
caccagcgcgccgccgc

SEQ ID NO: 1848056 - RNA, 17 nt, Salmonella typhimurium LT2
caccagcgccugcgcug

SEQ ID NO: 1848057 - RNA, 13 nt, Salmonella typhimurium LT2
caccagcgccaga

SEQ ID NO: 1848058 - RNA, 19 nt, Salmonella typhimurium LT2
caccagcgauaaacgccag

SEQ ID NO: 1848059 - RNA, 15 nt, Salmonella typhimurium LT2
caccagcgcaguaaa

SEQ ID NO: 1848060 - RNA, 16 nt, Salmonella typhimurium LT2
caccagcgcaucgccc

SEQ ID NO: 1848061 - RNA, 16 nt, Salmonella typhimurium LT2
caccagcgauccagac

SEQ ID NO: 1848062 - RNA, 20 nt, Salmonella typhimurium LT2
caccagccguucaccagcca

SEQ ID NO: 1848063 - RNA, 15 nt, Salmonella typhimurium LT2
caccagcuuaucuga

SEQ ID NO: 1848064 - RNA, 19 nt, Salmonella typhimurium LT2
caccagcugacgcagcagc

SEQ ID NO: 1848065 - RNA, 20 nt, Salmonella typhimurium LT2
caccagcugacgcagcagcu

SEQ ID NO: 1848066 - RNA, 23 nt, Salmonella typhimurium LT2
caccagcugacgcagcagcuccc

SEQ ID NO: 1848067 - RNA, 20 nt, Salmonella typhimurium LT2
caccagugaucggcuggaca

SEQ ID NO: 1848068 - RNA, 15 nt, Salmonella typhimurium LT2
caccagucccuguuc

SEQ ID NO: 1848069 - RNA, 19 nt, Salmonella typhimurium LT2
caccaguagcgcgacgcca

SEQ ID NO: 1848070 - RNA, 21 nt, Salmonella typhimurium LT2
caccaguacaauuuccugcca

SEQ ID NO: 1848071 - RNA, 18 nt, Salmonella typhimurium LT2
caccagguuaucgguaau

SEQ ID NO: 1848072 - RNA, 17 nt, Salmonella typhimurium LT2
caccagguucagcaacg

SEQ ID NO: 1848073 - RNA, 22 nt, Salmonella typhimurium LT2
caccauaauuaccggcacaccg

SEQ ID NO: 1848074 - RNA, 20 nt, Salmonella typhimurium LT2
caccauaaagcgaauaauua

SEQ ID NO: 1848075 - RNA, 20 nt, Salmonella typhimurium LT2
caccaggaagacuauccagc

SEQ ID NO: 1848076 - RNA, 16 nt, Salmonella typhimurium LT2
caccgguuuuuuccug

SEQ ID NO: 1848077 - RNA, 20 nt, Salmonella typhimurium LT2
caccgguuuuuuccugcaca

SEQ ID NO: 1848078 - RNA, 21 nt, Salmonella typhimurium LT2
caccgguuaacauaugggcaa

SEQ ID NO: 1848079 - RNA, 19 nt, Salmonella typhimurium LT2
caccgucuccggcgcgccg

SEQ ID NO: 1848080 - RNA, 14 nt, Salmonella typhimurium LT2
caccgucuugcugc

SEQ ID NO: 1848081 - RNA, 15 nt, Salmonella typhimurium LT2
caccuaacccaccau

SEQ ID NO: 1848082 - RNA, 16 nt, Salmonella typhimurium LT2
caccuaacccaccaua

SEQ ID NO: 1848083 - RNA, 13 nt, Salmonella typhimurium LT2
caccguuauuucc

SEQ ID NO: 1848084 - RNA, 14 nt, Salmonella typhimurium LT2
caccguuauuucca

SEQ ID NO: 1848085 - RNA, 23 nt, Salmonella typhimurium LT2
caccguggaggacgucugucaga

SEQ ID NO: 1848086 - RNA, 18 nt, Salmonella typhimurium LT2
caccugccaguccgcccg

SEQ ID NO: 1848087 - RNA, 22 nt, Salmonella typhimurium LT2
caccugcauggggaaauacugc

SEQ ID NO: 1848088 - RNA, 19 nt, Salmonella typhimurium LT2
caccugcaucacgcccggc

SEQ ID NO: 1848089 - RNA, 13 nt, Salmonella typhimurium LT2
caccugauuaccu

SEQ ID NO: 1848090 - RNA, 16 nt, Salmonella typhimurium LT2
caccugcaacuccugg

SEQ ID NO: 1848091 - RNA, 12 nt, Salmonella typhimurium LT2
caccugcaauuu

SEQ ID NO: 1848092 - RNA, 15 nt, Salmonella typhimurium LT2
caccugacggcagcc

SEQ ID NO: 1848093 - RNA, 20 nt, Salmonella typhimurium LT2
caccugaccguugaucuccg

SEQ ID NO: 1848094 - RNA, 12 nt, Salmonella typhimurium LT2
caccugaauauc

SEQ ID NO: 1848095 - RNA, 16 nt, Salmonella typhimurium LT2
caccugaauauccuga

SEQ ID NO: 1848096 - RNA, 19 nt, Salmonella typhimurium LT2
caccucugcgggcuccgga

SEQ ID NO: 1848097 - RNA, 18 nt, Salmonella typhimurium LT2
caccucgucacgguuuau

SEQ ID NO: 1848098 - RNA, 21 nt, Salmonella typhimurium LT2
caccuacccucaacgcgccca

SEQ ID NO: 1848099 - RNA, 15 nt, Salmonella typhimurium LT2
caccuccaguucagu

SEQ ID NO: 1848100 - RNA, 17 nt, Salmonella typhimurium LT2
caccuccagcgaggccu

SEQ ID NO: 1848101 - RNA, 21 nt, Salmonella typhimurium LT2
caccuccagcgaggccucucc

SEQ ID NO: 1848102 - RNA, 17 nt, Salmonella typhimurium LT2
cacgagcggucaggcca

SEQ ID NO: 1848103 - RNA, 13 nt, Salmonella typhimurium LT2
cacgacgccgccg

SEQ ID NO: 1848104 - RNA, 15 nt, Salmonella typhimurium LT2
cacgacggugcuaua

SEQ ID NO: 1848105 - RNA, 21 nt, Salmonella typhimurium LT2
cacgaaaaguguguaccagca

SEQ ID NO: 1848106 - RNA, 14 nt, Salmonella typhimurium LT2
cacgaacugcugcc

SEQ ID NO: 1848107 - RNA, 14 nt, Salmonella typhimurium LT2
cacgaacgggauca

SEQ ID NO: 1848108 - RNA, 13 nt, Salmonella typhimurium LT2
cacgacacaaaag

SEQ ID NO: 1848109 - RNA, 17 nt, Salmonella typhimurium LT2
cacgacaugagauaaug

SEQ ID NO: 1848110 - RNA, 22 nt, Salmonella typhimurium LT2
cacgaauuuggucguaagaauu

SEQ ID NO: 1848111 - RNA, 13 nt, Salmonella typhimurium LT2
cacgaaucaggau

SEQ ID NO: 1848112 - RNA, 23 nt, Salmonella typhimurium LT2
caccuuuacuuaauucugcugcc

SEQ ID NO: 1848113 - RNA, 14 nt, Salmonella typhimurium LT2
caccuuucgccgcc

SEQ ID NO: 1848114 - RNA, 21 nt, Salmonella typhimurium LT2
caccuuugaaaaucacaucgc

SEQ ID NO: 1848115 - RNA, 22 nt, Salmonella typhimurium LT2
caccuuugaacgucgcugauag

SEQ ID NO: 1848116 - RNA, 13 nt, Salmonella typhimurium LT2
caccuuccacuuu

SEQ ID NO: 1848117 - RNA, 15 nt, Salmonella typhimurium LT2
caccuuccacuuuca

SEQ ID NO: 1848118 - RNA, 14 nt, Salmonella typhimurium LT2
caccuucacaggug

SEQ ID NO: 1848119 - RNA, 12 nt, Salmonella typhimurium LT2
caccuucaucau

SEQ ID NO: 1848120 - RNA, 15 nt, Salmonella typhimurium LT2
caccuuauccggccu

SEQ ID NO: 1848121 - RNA, 22 nt, Salmonella typhimurium LT2
caccuuacgaauuuuaucuucc

SEQ ID NO: 1848122 - RNA, 17 nt, Salmonella typhimurium LT2
caccuggaugcugccug

SEQ ID NO: 1848123 - RNA, 15 nt, Salmonella typhimurium LT2
caccuuacccggcgu

SEQ ID NO: 1848124 - RNA, 22 nt, Salmonella typhimurium LT2
caccuguaaccgcuaucauacc

SEQ ID NO: 1848125 - RNA, 21 nt, Salmonella typhimurium LT2
caccuggucuauucguucucu

SEQ ID NO: 1848126 - RNA, 23 nt, Salmonella typhimurium LT2
caccuggucuauucguucucuga

SEQ ID NO: 1848127 - RNA, 20 nt, Salmonella typhimurium LT2
caccuggugaaacugaugug

SEQ ID NO: 1848128 - RNA, 20 nt, Salmonella typhimurium LT2
caccgcggcaaccagcccau

SEQ ID NO: 1848129 - RNA, 17 nt, Salmonella typhimurium LT2
caccgcggcgcucgcca

SEQ ID NO: 1848130 - RNA, 13 nt, Salmonella typhimurium LT2
caccgcgaugacc

SEQ ID NO: 1848131 - RNA, 23 nt, Salmonella typhimurium LT2
caccgccguaaagggaaggucau

SEQ ID NO: 1848132 - RNA, 14 nt, Salmonella typhimurium LT2
caccgccagugcau

SEQ ID NO: 1848133 - RNA, 18 nt, Salmonella typhimurium LT2
caccgccgccaccaaaaa

SEQ ID NO: 1848134 - RNA, 16 nt, Salmonella typhimurium LT2
caccgcccgccgggcg

SEQ ID NO: 1848135 - RNA, 21 nt, Salmonella typhimurium LT2
caccgcugcgugcgcgccacc

SEQ ID NO: 1848136 - RNA, 22 nt, Salmonella typhimurium LT2
caccgcgucguuacgcucguca

SEQ ID NO: 1848137 - RNA, 23 nt, Salmonella typhimurium LT2
caccgcuaaucccagcgcgcgcg

SEQ ID NO: 1848138 - RNA, 14 nt, Salmonella typhimurium LT2
caccggauacccag

SEQ ID NO: 1848139 - RNA, 22 nt, Salmonella typhimurium LT2
caccgacucccccagauucuga

SEQ ID NO: 1848140 - RNA, 16 nt, Salmonella typhimurium LT2
caccgauccaauauua

SEQ ID NO: 1848141 - RNA, 14 nt, Salmonella typhimurium LT2
caccgauccgaaga

SEQ ID NO: 1848142 - RNA, 23 nt, Salmonella typhimurium LT2
caccgauccgaagaacagauuca

SEQ ID NO: 1848143 - RNA, 22 nt, Salmonella typhimurium LT2
caccgauacaggacugacugcu

SEQ ID NO: 1848144 - RNA, 13 nt, Salmonella typhimurium LT2
caccgagccagaa

SEQ ID NO: 1848145 - RNA, 23 nt, Salmonella typhimurium LT2
caccgauuucaucgcugaauuug

SEQ ID NO: 1848146 - RNA, 13 nt, Salmonella typhimurium LT2
caccgcaucggca

SEQ ID NO: 1848147 - RNA, 13 nt, Salmonella typhimurium LT2
caccgccagacgc

SEQ ID NO: 1848148 - RNA, 13 nt, Salmonella typhimurium LT2
caccgccagagca

SEQ ID NO: 1848149 - RNA, 15 nt, Salmonella typhimurium LT2
caccgccagagcacg

SEQ ID NO: 1848150 - RNA, 17 nt, Salmonella typhimurium LT2
caccgccagcauaucca

SEQ ID NO: 1848151 - RNA, 16 nt, Salmonella typhimurium LT2
caccgccagcgucugu

SEQ ID NO: 1848152 - RNA, 15 nt, Salmonella typhimurium LT2
cacccuauccgccag

SEQ ID NO: 1848153 - RNA, 10 nt, Salmonella typhimurium LT2
cacccugccc

SEQ ID NO: 1848154 - RNA, 12 nt, Salmonella typhimurium LT2
cacccugccccg

SEQ ID NO: 1848155 - RNA, 17 nt, Salmonella typhimurium LT2
cacccuugcggcuugca

SEQ ID NO: 1848156 - RNA, 22 nt, Salmonella typhimurium LT2
cacccuucuucuggcucagacc

SEQ ID NO: 1848157 - RNA, 22 nt, Salmonella typhimurium LT2
caccgaaagaccaacagaaggc

SEQ ID NO: 1848158 - RNA, 18 nt, Salmonella typhimurium LT2
caccgaagaauuuaucaa

SEQ ID NO: 1848159 - RNA, 18 nt, Salmonella typhimurium LT2
cacccggcugacugccgu

SEQ ID NO: 1848160 - RNA, 16 nt, Salmonella typhimurium LT2
cacccgcgcucagcgu

SEQ ID NO: 1848161 - RNA, 21 nt, Salmonella typhimurium LT2
cacggcucgccuuugcgcccg

SEQ ID NO: 1848162 - RNA, 13 nt, Salmonella typhimurium LT2
cacggcucgccuu

SEQ ID NO: 1848163 - RNA, 17 nt, Salmonella typhimurium LT2
cacggcgugaccaccgc

SEQ ID NO: 1848164 - RNA, 19 nt, Salmonella typhimurium LT2
cacggcucgaucccgaccc

SEQ ID NO: 1848165 - RNA, 20 nt, Salmonella typhimurium LT2
cacggcgucaaauccaccgc

SEQ ID NO: 1848166 - RNA, 13 nt, Salmonella typhimurium LT2
cacggcgcacacg

SEQ ID NO: 1848167 - RNA, 16 nt, Salmonella typhimurium LT2
cacggcgacaaccgga

SEQ ID NO: 1848168 - RNA, 21 nt, Salmonella typhimurium LT2
cacggcgccaugauccagcgg

SEQ ID NO: 1848169 - RNA, 13 nt, Salmonella typhimurium LT2
cacggcauucagu

SEQ ID NO: 1848170 - RNA, 15 nt, Salmonella typhimurium LT2
cacggcaugaagcag

SEQ ID NO: 1848171 - RNA, 15 nt, Salmonella typhimurium LT2
cacggcauguucugc

SEQ ID NO: 1848172 - RNA, 17 nt, Salmonella typhimurium LT2
cacggcauaagccucau

SEQ ID NO: 1848173 - RNA, 16 nt, Salmonella typhimurium LT2
cacggcaguacacgca

SEQ ID NO: 1848174 - RNA, 19 nt, Salmonella typhimurium LT2
cacggaucaucuacccgua

SEQ ID NO: 1848175 - RNA, 20 nt, Salmonella typhimurium LT2
cacgcuucggugaucuccuc

SEQ ID NO: 1848176 - RNA, 18 nt, Salmonella typhimurium LT2
cacgcuuuuacaucgcug

SEQ ID NO: 1848177 - RNA, 23 nt, Salmonella typhimurium LT2
cacgcuuguuagcuuucugccag

SEQ ID NO: 1848178 - RNA, 19 nt, Salmonella typhimurium LT2
cacggagagucgcaccgcg

SEQ ID NO: 1848179 - RNA, 13 nt, Salmonella typhimurium LT2
cacgcgccgccug

SEQ ID NO: 1848180 - RNA, 19 nt, Salmonella typhimurium LT2
cacgcgcgcugcgccugga

SEQ ID NO: 1848181 - RNA, 22 nt, Salmonella typhimurium LT2
cacgcggaaucgucacagaccc

SEQ ID NO: 1848182 - RNA, 22 nt, Salmonella typhimurium LT2
cacgcgaauagccagacagccc

SEQ ID NO: 1848183 - RNA, 17 nt, Salmonella typhimurium LT2
cacgccugcauaaagga

SEQ ID NO: 1848184 - RNA, 19 nt, Salmonella typhimurium LT2
cacgcucuccuacaccacc

SEQ ID NO: 1848185 - RNA, 17 nt, Salmonella typhimurium LT2
cacgcuaaagucagcau

SEQ ID NO: 1848186 - RNA, 15 nt, Salmonella typhimurium LT2
cacgcuggcaucaau

SEQ ID NO: 1848187 - RNA, 17 nt, Salmonella typhimurium LT2
cacgcugaggcgccguc

SEQ ID NO: 1848188 - RNA, 19 nt, Salmonella typhimurium LT2
cacgcugaccacgccgccg

SEQ ID NO: 1848189 - RNA, 18 nt, Salmonella typhimurium LT2
cacgcugaccacgccgcc

SEQ ID NO: 1848190 - RNA, 16 nt, Salmonella typhimurium LT2
cacgcccuccuguuga

SEQ ID NO: 1848191 - RNA, 17 nt, Salmonella typhimurium LT2
cacgccccuaaggcagc

SEQ ID NO: 1848192 - RNA, 18 nt, Salmonella typhimurium LT2
cacgcccggaugcgcaau

SEQ ID NO: 1848193 - RNA, 18 nt, Salmonella typhimurium LT2
cacgccgacgacaggcag

SEQ ID NO: 1848194 - RNA, 17 nt, Salmonella typhimurium LT2
cacgccggcaaucccuu

SEQ ID NO: 1848195 - RNA, 16 nt, Salmonella typhimurium LT2
cacgccgcuacugccg

SEQ ID NO: 1848196 - RNA, 21 nt, Salmonella typhimurium LT2
cacgccgcuaucgaccagcac

SEQ ID NO: 1848197 - RNA, 16 nt, Salmonella typhimurium LT2
cacgccgccgccgacc

SEQ ID NO: 1848198 - RNA, 20 nt, Salmonella typhimurium LT2
cacgccguccagcaccaccu

SEQ ID NO: 1848199 - RNA, 14 nt, Salmonella typhimurium LT2
cacgccguccagca

SEQ ID NO: 1848200 - RNA, 15 nt, Salmonella typhimurium LT2
cacgccgucgaugau

SEQ ID NO: 1848201 - RNA, 19 nt, Salmonella typhimurium LT2
cacgccagauaaaucagcc

SEQ ID NO: 1848202 - RNA, 17 nt, Salmonella typhimurium LT2
cacgcauggaaauaaag

SEQ ID NO: 1848203 - RNA, 17 nt, Salmonella typhimurium LT2
cacgcauggcacuggcg

SEQ ID NO: 1848204 - RNA, 16 nt, Salmonella typhimurium LT2
cacgccaucgccugau

SEQ ID NO: 1848205 - RNA, 20 nt, Salmonella typhimurium LT2
cacgccaucgacaaaggcaa

SEQ ID NO: 1848206 - RNA, 14 nt, Salmonella typhimurium LT2
cacgccaucggcua

SEQ ID NO: 1848207 - RNA, 17 nt, Salmonella typhimurium LT2
cacgccauggccgcagc

SEQ ID NO: 1848208 - RNA, 14 nt, Salmonella typhimurium LT2
cacgccaucaacag

SEQ ID NO: 1848209 - RNA, 14 nt, Salmonella typhimurium LT2
cacgccaguucaug

SEQ ID NO: 1848210 - RNA, 21 nt, Salmonella typhimurium LT2
cacgccauaauggcccagcgu

SEQ ID NO: 1848211 - RNA, 16 nt, Salmonella typhimurium LT2
cacgaucgaugcccug

SEQ ID NO: 1848212 - RNA, 22 nt, Salmonella typhimurium LT2
cacgaucgaugcccugugcaau

SEQ ID NO: 1848213 - RNA, 20 nt, Salmonella typhimurium LT2
cacgauacuguugcaguuua

SEQ ID NO: 1848214 - RNA, 12 nt, Salmonella typhimurium LT2
cacgauggcaaa

SEQ ID NO: 1848215 - RNA, 16 nt, Salmonella typhimurium LT2
cacgcaguccaacaag

SEQ ID NO: 1848216 - RNA, 19 nt, Salmonella typhimurium LT2
cacgcagggggucgcgggu

SEQ ID NO: 1848217 - RNA, 17 nt, Salmonella typhimurium LT2
cacgcagccauguaaaa

SEQ ID NO: 1848218 - RNA, 24 nt, Salmonella typhimurium LT2
cacgcagacgccgcgguugacggc

SEQ ID NO: 1848219 - RNA, 17 nt, Salmonella typhimurium LT2
cacgcaacaacaggcca

SEQ ID NO: 1848220 - RNA, 21 nt, Salmonella typhimurium LT2
cacgcaaaaaagcccguccgu

SEQ ID NO: 1848221 - RNA, 20 nt, Salmonella typhimurium LT2
cacgggcaucauaagagaga

SEQ ID NO: 1848222 - RNA, 16 nt, Salmonella typhimurium LT2
cacgguaaaacacgcc

SEQ ID NO: 1848223 - RNA, 15 nt, Salmonella typhimurium LT2
cacggucgcuuccca

SEQ ID NO: 1848224 - RNA, 19 nt, Salmonella typhimurium LT2
cacgucggcgaccauugcg

SEQ ID NO: 1848225 - RNA, 15 nt, Salmonella typhimurium LT2
cacgucgauuuuccc

SEQ ID NO: 1848226 - RNA, 23 nt, Salmonella typhimurium LT2
cacgguuuauccccgcuggcgcg

SEQ ID NO: 1848227 - RNA, 16 nt, Salmonella typhimurium LT2
cacgguuuccggcgca

SEQ ID NO: 1848228 - RNA, 21 nt, Salmonella typhimurium LT2
cacguaaauagagaaaucaac

SEQ ID NO: 1848229 - RNA, 17 nt, Salmonella typhimurium LT2
cacguaacucggcagcg

SEQ ID NO: 1848230 - RNA, 15 nt, Salmonella typhimurium LT2
cacguaguaaugcau

SEQ ID NO: 1848231 - RNA, 19 nt, Salmonella typhimurium LT2
cacguacccaaauaucaaa

SEQ ID NO: 1848232 - RNA, 22 nt, Salmonella typhimurium LT2
cacguuaccgcgcaguucaaua

SEQ ID NO: 1848233 - RNA, 16 nt, Salmonella typhimurium LT2
cacguuagccucgguc

SEQ ID NO: 1848234 - RNA, 17 nt, Salmonella typhimurium LT2
cacguuauaccacuggu

SEQ ID NO: 1848235 - RNA, 13 nt, Salmonella typhimurium LT2
cacguuuuuacuc

SEQ ID NO: 1848236 - RNA, 15 nt, Salmonella typhimurium LT2
cacgucuacccaggu

SEQ ID NO: 1848237 - RNA, 14 nt, Salmonella typhimurium LT2
cacgucguucgggc

SEQ ID NO: 1848238 - RNA, 14 nt, Salmonella typhimurium LT2
cacguuaauuauuc

SEQ ID NO: 1848239 - RNA, 22 nt, Salmonella typhimurium LT2
cacguuuuuuacgucagcaaua

SEQ ID NO: 1848240 - RNA, 14 nt, Salmonella typhimurium LT2
cacuaaaaacaggc

SEQ ID NO: 1848241 - RNA, 20 nt, Salmonella typhimurium LT2
cacuaaaccagcuauccagc

SEQ ID NO: 1848242 - RNA, 22 nt, Salmonella typhimurium LT2
cacuaccauuuccggcgcgccu

SEQ ID NO: 1848243 - RNA, 13 nt, Salmonella typhimurium LT2
cacuaccgccacu

SEQ ID NO: 1848244 - RNA, 14 nt, Salmonella typhimurium LT2
cacuaauuugaguc

SEQ ID NO: 1848245 - RNA, 19 nt, Salmonella typhimurium LT2
cacuaauccccauuuuuuu

SEQ ID NO: 1848246 - RNA, 22 nt, Salmonella typhimurium LT2
cacuacgguccaguugcccucu

SEQ ID NO: 1848247 - RNA, 17 nt, Salmonella typhimurium LT2
cacuacugcgucaauga

SEQ ID NO: 1848248 - RNA, 13 nt, Salmonella typhimurium LT2
cacuagcgccgcc

SEQ ID NO: 1848249 - RNA, 19 nt, Salmonella typhimurium LT2
cacucaaucauugucauua

SEQ ID NO: 1848250 - RNA, 21 nt, Salmonella typhimurium LT2
cacucacauucauugccgcca

SEQ ID NO: 1848251 - RNA, 12 nt, Salmonella typhimurium LT2
cacuccagaccu

SEQ ID NO: 1848252 - RNA, 15 nt, Salmonella typhimurium LT2
cacucauccagacca

SEQ ID NO: 1848253 - RNA, 14 nt, Salmonella typhimurium LT2
cacucuuuuuggcu

SEQ ID NO: 1848254 - RNA, 22 nt, Salmonella typhimurium LT2
cacugaaaaauaauuacuaucu

SEQ ID NO: 1848255 - RNA, 15 nt, Salmonella typhimurium LT2
cacucuuccacuuca

SEQ ID NO: 1848256 - RNA, 20 nt, Salmonella typhimurium LT2
cacucuucgggaauggggaa

SEQ ID NO: 1848257 - RNA, 16 nt, Salmonella typhimurium LT2
cacucuuacggcgccc

SEQ ID NO: 1848258 - RNA, 19 nt, Salmonella typhimurium LT2
cacucugaaaaauuuuccu

SEQ ID NO: 1848259 - RNA, 23 nt, Salmonella typhimurium LT2
cacugacauuuaaggcgcggccu

SEQ ID NO: 1848260 - RNA, 18 nt, Salmonella typhimurium LT2
cacugacuauccacagcg

SEQ ID NO: 1848261 - RNA, 15 nt, Salmonella typhimurium LT2
cacuccuaagagaaa

SEQ ID NO: 1848262 - RNA, 19 nt, Salmonella typhimurium LT2
cacuccggcugcaccagcg

SEQ ID NO: 1848263 - RNA, 13 nt, Salmonella typhimurium LT2
cacucccugcguc

SEQ ID NO: 1848264 - RNA, 21 nt, Salmonella typhimurium LT2
cacucgauggcuuucuaccug

SEQ ID NO: 1848265 - RNA, 18 nt, Salmonella typhimurium LT2
cacucucggguacacaac

SEQ ID NO: 1848266 - RNA, 22 nt, Salmonella typhimurium LT2
cacucuccaccaaaucccccaa

SEQ ID NO: 1848267 - RNA, 16 nt, Salmonella typhimurium LT2
cacucgccggguuuug

SEQ ID NO: 1848268 - RNA, 14 nt, Salmonella typhimurium LT2
cacucgcccauuug

SEQ ID NO: 1848269 - RNA, 15 nt, Salmonella typhimurium LT2
auucugccaguucac

SEQ ID NO: 1848270 - RNA, 22 nt, Salmonella typhimurium LT2
auucugcauggcgcuaaacauc

SEQ ID NO: 1848271 - RNA, 16 nt, Salmonella typhimurium LT2
auucugcgccagccag

SEQ ID NO: 1848272 - RNA, 14 nt, Salmonella typhimurium LT2
auucuucuccucuu

SEQ ID NO: 1848273 - RNA, 15 nt, Salmonella typhimurium LT2
auucuucuccucuuc

SEQ ID NO: 1848274 - RNA, 12 nt, Salmonella typhimurium LT2
auucuugcgccg

SEQ ID NO: 1848275 - RNA, 19 nt, Salmonella typhimurium LT2
auucuuuaauuugugccag

SEQ ID NO: 1848276 - RNA, 17 nt, Salmonella typhimurium LT2
auucuuucgucacuaac

SEQ ID NO: 1848277 - RNA, 14 nt, Salmonella typhimurium LT2
auugaacauuuuuu

SEQ ID NO: 1848278 - RNA, 21 nt, Salmonella typhimurium LT2
auugaacgcuggcggcaggcc

SEQ ID NO: 1848279 - RNA, 21 nt, Salmonella typhimurium LT2
auugaacauuuuuucagccug

SEQ ID NO: 1848280 - RNA, 15 nt, Salmonella typhimurium LT2
auucgucuucaucuu

SEQ ID NO: 1848281 - RNA, 17 nt, Salmonella typhimurium LT2
auucguccuuuaucaga

SEQ ID NO: 1848282 - RNA, 18 nt, Salmonella typhimurium LT2
auucggucagauaaauaa

SEQ ID NO: 1848283 - RNA, 14 nt, Salmonella typhimurium LT2
auucgguuuauccc

SEQ ID NO: 1848284 - RNA, 15 nt, Salmonella typhimurium LT2
auucguauugacaac

SEQ ID NO: 1848285 - RNA, 19 nt, Salmonella typhimurium LT2
auucuaacauaaugaaucc

SEQ ID NO: 1848286 - RNA, 14 nt, Salmonella typhimurium LT2
auucucccaaauuu

SEQ ID NO: 1848287 - RNA, 22 nt, Salmonella typhimurium LT2
auucugaaaaggggauaacaac

SEQ ID NO: 1848288 - RNA, 13 nt, Salmonella typhimurium LT2
auucucuucuucu

SEQ ID NO: 1848289 - RNA, 18 nt, Salmonella typhimurium LT2
auucugaaagaaaagaug

SEQ ID NO: 1848290 - RNA, 22 nt, Salmonella typhimurium LT2
auucuacaguuugucaucaguc

SEQ ID NO: 1848291 - RNA, 19 nt, Salmonella typhimurium LT2
auucuacaguuugucauca

SEQ ID NO: 1848292 - RNA, 22 nt, Salmonella typhimurium LT2
auucucaacccggacauccauc

SEQ ID NO: 1848293 - RNA, 21 nt, Salmonella typhimurium LT2
auucucaucagaccguggaua

SEQ ID NO: 1848294 - RNA, 15 nt, Salmonella typhimurium LT2
auugcugaagauaaa

SEQ ID NO: 1848295 - RNA, 22 nt, Salmonella typhimurium LT2
auugcguaucguaagccacugc

SEQ ID NO: 1848296 - RNA, 17 nt, Salmonella typhimurium LT2
auugcgucccagcacaa

SEQ ID NO: 1848297 - RNA, 13 nt, Salmonella typhimurium LT2
auugcgccaccuu

SEQ ID NO: 1848298 - RNA, 16 nt, Salmonella typhimurium LT2
auugcgcgcuauguuc

SEQ ID NO: 1848299 - RNA, 15 nt, Salmonella typhimurium LT2
auugccaugaugagc

SEQ ID NO: 1848300 - RNA, 18 nt, Salmonella typhimurium LT2
auugccauguuaauacca

SEQ ID NO: 1848301 - RNA, 15 nt, Salmonella typhimurium LT2
auugcauaggggcaa

SEQ ID NO: 1848302 - RNA, 13 nt, Salmonella typhimurium LT2
auugcauccaacu

SEQ ID NO: 1848303 - RNA, 15 nt, Salmonella typhimurium LT2
auuggcgagcaggaa

SEQ ID NO: 1848304 - RNA, 17 nt, Salmonella typhimurium LT2
auuggaaaaccccaucc

SEQ ID NO: 1848305 - RNA, 20 nt, Salmonella typhimurium LT2
auugauauagaguccagcca

SEQ ID NO: 1848306 - RNA, 16 nt, Salmonella typhimurium LT2
auugaccagugcaaac

SEQ ID NO: 1848307 - RNA, 16 nt, Salmonella typhimurium LT2
auugacccucccugcg

SEQ ID NO: 1848308 - RNA, 21 nt, Salmonella typhimurium LT2
auugaugacgcuuacgaagau

SEQ ID NO: 1848309 - RNA, 17 nt, Salmonella typhimurium LT2
auugcagcgaccuggga

SEQ ID NO: 1848310 - RNA, 17 nt, Salmonella typhimurium LT2
auugcagcgcagcggca

SEQ ID NO: 1848311 - RNA, 20 nt, Salmonella typhimurium LT2
auugcagauaauuuugcaua

SEQ ID NO: 1848312 - RNA, 14 nt, Salmonella typhimurium LT2
auucauuauaaaac

SEQ ID NO: 1848313 - RNA, 18 nt, Salmonella typhimurium LT2
auucauugucuuuuucuc

SEQ ID NO: 1848314 - RNA, 13 nt, Salmonella typhimurium LT2
auuccaucggcau

SEQ ID NO: 1848315 - RNA, 20 nt, Salmonella typhimurium LT2
auuccauauaacagaauaag

SEQ ID NO: 1848316 - RNA, 23 nt, Salmonella typhimurium LT2
auuccagggcauuuuuuccagua

SEQ ID NO: 1848317 - RNA, 20 nt, Salmonella typhimurium LT2
auuccauuagcauucccuua

SEQ ID NO: 1848318 - RNA, 21 nt, Salmonella typhimurium LT2
auuccagaagcgcuuugccaa

SEQ ID NO: 1848319 - RNA, 15 nt, Salmonella typhimurium LT2
auuccagaaucuggc

SEQ ID NO: 1848320 - RNA, 19 nt, Salmonella typhimurium LT2
auuccagaugucaguaaca

SEQ ID NO: 1848321 - RNA, 22 nt, Salmonella typhimurium LT2
auuccagccgguguuaaccaga

SEQ ID NO: 1848322 - RNA, 22 nt, Salmonella typhimurium LT2
auuccagggcauuuuuuccagu

SEQ ID NO: 1848323 - RNA, 18 nt, Salmonella typhimurium LT2
auuccagggcauuuuuuc

SEQ ID NO: 1848324 - RNA, 16 nt, Salmonella typhimurium LT2
auucaguaagagggug

SEQ ID NO: 1848325 - RNA, 21 nt, Salmonella typhimurium LT2
auguucuccucugaaaaauau

SEQ ID NO: 1848326 - RNA, 17 nt, Salmonella typhimurium LT2
auucauaacaccaauac

SEQ ID NO: 1848327 - RNA, 14 nt, Salmonella typhimurium LT2
auucauaaaagauc

SEQ ID NO: 1848328 - RNA, 14 nt, Salmonella typhimurium LT2
auucaguuugcaac

SEQ ID NO: 1848329 - RNA, 24 nt, Salmonella typhimurium LT2
auucauagagcgcguccagacguu

SEQ ID NO: 1848330 - RNA, 16 nt, Salmonella typhimurium LT2
auucauaccuuuaagc

SEQ ID NO: 1848331 - RNA, 18 nt, Salmonella typhimurium LT2
auucaucgacaaauacua

SEQ ID NO: 1848332 - RNA, 16 nt, Salmonella typhimurium LT2
auucaucaucuugucc

SEQ ID NO: 1848333 - RNA, 14 nt, Salmonella typhimurium LT2
auucauccagaccu

SEQ ID NO: 1848334 - RNA, 20 nt, Salmonella typhimurium LT2
auucauccagaccugagccu

SEQ ID NO: 1848335 - RNA, 12 nt, Salmonella typhimurium LT2
auucauauugcc

SEQ ID NO: 1848336 - RNA, 19 nt, Salmonella typhimurium LT2
auucaugguacucaacauc

SEQ ID NO: 1848337 - RNA, 20 nt, Salmonella typhimurium LT2
auucaugguacucaacauca

SEQ ID NO: 1848338 - RNA, 16 nt, Salmonella typhimurium LT2
auucauuaaaccacuu

SEQ ID NO: 1848339 - RNA, 19 nt, Salmonella typhimurium LT2
auucgcuggccguuaugca

SEQ ID NO: 1848340 - RNA, 20 nt, Salmonella typhimurium LT2
auucggaaugaugugcuauu

SEQ ID NO: 1848341 - RNA, 22 nt, Salmonella typhimurium LT2
auucggcgcuucgcagcgauau

SEQ ID NO: 1848342 - RNA, 14 nt, Salmonella typhimurium LT2
auucggcccugcgc

SEQ ID NO: 1848343 - RNA, 23 nt, Salmonella typhimurium LT2
auucgggacaaacccccagccau

SEQ ID NO: 1848344 - RNA, 22 nt, Salmonella typhimurium LT2
auucgggacaaacccccagcca

SEQ ID NO: 1848345 - RNA, 14 nt, Salmonella typhimurium LT2
auucgccgcgauaa

SEQ ID NO: 1848346 - RNA, 14 nt, Salmonella typhimurium LT2
auucgcuaauaaau

SEQ ID NO: 1848347 - RNA, 15 nt, Salmonella typhimurium LT2
auucgccccagcaua

SEQ ID NO: 1848348 - RNA, 16 nt, Salmonella typhimurium LT2
auucgagaugcauaaa

SEQ ID NO: 1848349 - RNA, 21 nt, Salmonella typhimurium LT2
auuccuuuuuccgccaccugu

SEQ ID NO: 1848350 - RNA, 12 nt, Salmonella typhimurium LT2
auuccuucggug

SEQ ID NO: 1848351 - RNA, 20 nt, Salmonella typhimurium LT2
auuccuggcguaugcuuuca

SEQ ID NO: 1848352 - RNA, 14 nt, Salmonella typhimurium LT2
auuccuggauuaaa

SEQ ID NO: 1848353 - RNA, 16 nt, Salmonella typhimurium LT2
auuccugacgcacagu

SEQ ID NO: 1848354 - RNA, 14 nt, Salmonella typhimurium LT2
auuccugccgccgc

SEQ ID NO: 1848355 - RNA, 20 nt, Salmonella typhimurium LT2
auuccugccgccgcaccacu

SEQ ID NO: 1848356 - RNA, 17 nt, Salmonella typhimurium LT2
auucccguaucuucaug

SEQ ID NO: 1848357 - RNA, 15 nt, Salmonella typhimurium LT2
auucccguaaaagaa

SEQ ID NO: 1848358 - RNA, 21 nt, Salmonella typhimurium LT2
auucccguaucuucauguucu

SEQ ID NO: 1848359 - RNA, 12 nt, Salmonella typhimurium LT2
auucccgccugc

SEQ ID NO: 1848360 - RNA, 21 nt, Salmonella typhimurium LT2
auucccugguucgaauccagg

SEQ ID NO: 1848361 - RNA, 19 nt, Salmonella typhimurium LT2
auucccugguucgaaucca

SEQ ID NO: 1848362 - RNA, 17 nt, Salmonella typhimurium LT2
auuccccaaucccacca

SEQ ID NO: 1848363 - RNA, 12 nt, Salmonella typhimurium LT2
auucccaggcaa

SEQ ID NO: 1848364 - RNA, 16 nt, Salmonella typhimurium LT2
auuccgcuucuuccau

SEQ ID NO: 1848365 - RNA, 15 nt, Salmonella typhimurium LT2
auuccgcagaagccg

SEQ ID NO: 1848366 - RNA, 20 nt, Salmonella typhimurium LT2
auuccgcagaagccggucau

SEQ ID NO: 1848367 - RNA, 21 nt, Salmonella typhimurium LT2
auuccgcgcuaucgguaucau

SEQ ID NO: 1848368 - RNA, 15 nt, Salmonella typhimurium LT2
auuccguaauccaau

SEQ ID NO: 1848369 - RNA, 16 nt, Salmonella typhimurium LT2
auuccucagaauccgu

SEQ ID NO: 1848370 - RNA, 23 nt, Salmonella typhimurium LT2
auuccgucucagagcuauguacu

SEQ ID NO: 1848371 - RNA, 17 nt, Salmonella typhimurium LT2
auuccgugucugaauga

SEQ ID NO: 1848372 - RNA, 19 nt, Salmonella typhimurium LT2
auuccgugucugaaugagu

SEQ ID NO: 1848373 - RNA, 14 nt, Salmonella typhimurium LT2
auuuaugccgccau

SEQ ID NO: 1848374 - RNA, 20 nt, Salmonella typhimurium LT2
auuuaugauuuuaacaucac

SEQ ID NO: 1848375 - RNA, 17 nt, Salmonella typhimurium LT2
auuuaugcgccagccgc

SEQ ID NO: 1848376 - RNA, 16 nt, Salmonella typhimurium LT2
auuucaccgccaauaa

SEQ ID NO: 1848377 - RNA, 14 nt, Salmonella typhimurium LT2
auuucacuucauca

SEQ ID NO: 1848378 - RNA, 15 nt, Salmonella typhimurium LT2
auuucacuucaucau

SEQ ID NO: 1848379 - RNA, 20 nt, Salmonella typhimurium LT2
auuucacuggccguuuuccc

SEQ ID NO: 1848380 - RNA, 18 nt, Salmonella typhimurium LT2
auuucacgcugcaguuua

SEQ ID NO: 1848381 - RNA, 21 nt, Salmonella typhimurium LT2
auuucaguacagccaaaaaua

SEQ ID NO: 1848382 - RNA, 13 nt, Salmonella typhimurium LT2
auuucaguauuac

SEQ ID NO: 1848383 - RNA, 15 nt, Salmonella typhimurium LT2
auuuccaauguaaau

SEQ ID NO: 1848384 - RNA, 19 nt, Salmonella typhimurium LT2
auuuccaauguaaauuaau

SEQ ID NO: 1848385 - RNA, 21 nt, Salmonella typhimurium LT2
auuuccgguuccagcggccgc

SEQ ID NO: 1848386 - RNA, 18 nt, Salmonella typhimurium LT2
auuuccgccgccuucugc

SEQ ID NO: 1848387 - RNA, 21 nt, Salmonella typhimurium LT2
auuuccggaccguuaucaaaa

SEQ ID NO: 1848388 - RNA, 16 nt, Salmonella typhimurium LT2
auuuccgccauuuuuc

SEQ ID NO: 1848389 - RNA, 12 nt, Salmonella typhimurium LT2
auuuccgcagcc

SEQ ID NO: 1848390 - RNA, 21 nt, Salmonella typhimurium LT2
auuucccuuccccuuucacca

SEQ ID NO: 1848391 - RNA, 17 nt, Salmonella typhimurium LT2
auuuccccaguuauccu

SEQ ID NO: 1848392 - RNA, 22 nt, Salmonella typhimurium LT2
auuucgaccucuucguucaucc

SEQ ID NO: 1848393 - RNA, 21 nt, Salmonella typhimurium LT2
auuucgcuccacuggcccccu

SEQ ID NO: 1848394 - RNA, 17 nt, Salmonella typhimurium LT2
auuucgcuacucagcgu

SEQ ID NO: 1848395 - RNA, 17 nt, Salmonella typhimurium LT2
auuucgcauugucauaa

SEQ ID NO: 1848396 - RNA, 13 nt, Salmonella typhimurium LT2
auuucgcaacagc

SEQ ID NO: 1848397 - RNA, 14 nt, Salmonella typhimurium LT2
auuuccguuuucag

SEQ ID NO: 1848398 - RNA, 15 nt, Salmonella typhimurium LT2
auuuacgcagcccca

SEQ ID NO: 1848399 - RNA, 20 nt, Salmonella typhimurium LT2
auuuaggcguacgacaggua

SEQ ID NO: 1848400 - RNA, 15 nt, Salmonella typhimurium LT2
auuuaggucuuguca

SEQ ID NO: 1848401 - RNA, 16 nt, Salmonella typhimurium LT2
auuuauauugugccuc

SEQ ID NO: 1848402 - RNA, 15 nt, Salmonella typhimurium LT2
auugguagacgcacc

SEQ ID NO: 1848403 - RNA, 19 nt, Salmonella typhimurium LT2
auugguagacgcgcuagcu

SEQ ID NO: 1848404 - RNA, 14 nt, Salmonella typhimurium LT2
auuggucagcagcc

SEQ ID NO: 1848405 - RNA, 14 nt, Salmonella typhimurium LT2
auuggucugauuca

SEQ ID NO: 1848406 - RNA, 20 nt, Salmonella typhimurium LT2
auuggucuggauugcagaga

SEQ ID NO: 1848407 - RNA, 13 nt, Salmonella typhimurium LT2
auuuaauuuuucc

SEQ ID NO: 1848408 - RNA, 14 nt, Salmonella typhimurium LT2
auuuaacuuaaaua

SEQ ID NO: 1848409 - RNA, 17 nt, Salmonella typhimurium LT2
auuuaacuuaaauaaaa

SEQ ID NO: 1848410 - RNA, 21 nt, Salmonella typhimurium LT2
auuuaacuuaaauaaaaauga

SEQ ID NO: 1848411 - RNA, 20 nt, Salmonella typhimurium LT2
auuucugaaucauauuuuau

SEQ ID NO: 1848412 - RNA, 16 nt, Salmonella typhimurium LT2
auuucggcauuuuuaa

SEQ ID NO: 1848413 - RNA, 15 nt, Salmonella typhimurium LT2
auuucugcuggacgu

SEQ ID NO: 1848414 - RNA, 17 nt, Salmonella typhimurium LT2
auuucugccugcuucag

SEQ ID NO: 1848415 - RNA, 22 nt, Salmonella typhimurium LT2
auuucugccugcuucagacaac

SEQ ID NO: 1848416 - RNA, 13 nt, Salmonella typhimurium LT2
auuucuuaccaaa

SEQ ID NO: 1848417 - RNA, 17 nt, Salmonella typhimurium LT2
auuucuugcaauagcgc

SEQ ID NO: 1848418 - RNA, 20 nt, Salmonella typhimurium LT2
auuucuugcaucaggcagug

SEQ ID NO: 1848419 - RNA, 15 nt, Salmonella typhimurium LT2
auuugcugcauuucu

SEQ ID NO: 1848420 - RNA, 22 nt, Salmonella typhimurium LT2
auuugcugcauuucuuguugac

SEQ ID NO: 1848421 - RNA, 13 nt, Salmonella typhimurium LT2
auuugcccagcac

SEQ ID NO: 1848422 - RNA, 16 nt, Salmonella typhimurium LT2
auuucuuugucaccaa

SEQ ID NO: 1848423 - RNA, 17 nt, Salmonella typhimurium LT2
auuugaaucugcaguuu

SEQ ID NO: 1848424 - RNA, 13 nt, Salmonella typhimurium LT2
auuuugccuucaa

SEQ ID NO: 1848425 - RNA, 13 nt, Salmonella typhimurium LT2
auuuugcauaaau

SEQ ID NO: 1848426 - RNA, 15 nt, Salmonella typhimurium LT2
auuuugcgguuuuaa

SEQ ID NO: 1848427 - RNA, 20 nt, Salmonella typhimurium LT2
auuuucuuucaucaaacgga

SEQ ID NO: 1848428 - RNA, 15 nt, Salmonella typhimurium LT2
auuuucuuucaucaa

SEQ ID NO: 1848429 - RNA, 17 nt, Salmonella typhimurium LT2
auuuucuuucaucaaac

SEQ ID NO: 1848430 - RNA, 15 nt, Salmonella typhimurium LT2
auuuugaaacugaau

SEQ ID NO: 1848431 - RNA, 23 nt, Salmonella typhimurium LT2
auuuugaaacugaaucaauagcu

SEQ ID NO: 1848432 - RNA, 20 nt, Salmonella typhimurium LT2
auuuucucgcgcagccagua

SEQ ID NO: 1848433 - RNA, 18 nt, Salmonella typhimurium LT2
auuuucuaugugcgccag

SEQ ID NO: 1848434 - RNA, 16 nt, Salmonella typhimurium LT2
auuuuccccgaugcca

SEQ ID NO: 1848435 - RNA, 19 nt, Salmonella typhimurium LT2
auuuuccccgaugccauuu

SEQ ID NO: 1848436 - RNA, 18 nt, Salmonella typhimurium LT2
auuuuauuuccaauguaa

SEQ ID NO: 1848437 - RNA, 20 nt, Salmonella typhimurium LT2
auuuucaaccggguuaagcu

SEQ ID NO: 1848438 - RNA, 22 nt, Salmonella typhimurium LT2
auuuucaacggcaucaauaauu

SEQ ID NO: 1848439 - RNA, 22 nt, Salmonella typhimurium LT2
auuuuaucgacacuauuuuuca

SEQ ID NO: 1848440 - RNA, 23 nt, Salmonella typhimurium LT2
auuuuaccuucgcguuuaucacc

SEQ ID NO: 1848441 - RNA, 21 nt, Salmonella typhimurium LT2
auuuuacccgcgcaucccaca

SEQ ID NO: 1848442 - RNA, 18 nt, Salmonella typhimurium LT2
auuuuaggcacaucaaua

SEQ ID NO: 1848443 - RNA, 21 nt, Salmonella typhimurium LT2
auuuuagcuucuucauauugu

SEQ ID NO: 1848444 - RNA, 19 nt, Salmonella typhimurium LT2
caacgguaaaauggcucug

SEQ ID NO: 1848445 - RNA, 16 nt, Salmonella typhimurium LT2
caacgggcaaugccac

SEQ ID NO: 1848446 - RNA, 17 nt, Salmonella typhimurium LT2
caacgggacggcggcca

SEQ ID NO: 1848447 - RNA, 15 nt, Salmonella typhimurium LT2
caacggcuugugagc

SEQ ID NO: 1848448 - RNA, 23 nt, Salmonella typhimurium LT2
caacgggaaaaaauuacugccug

SEQ ID NO: 1848449 - RNA, 22 nt, Salmonella typhimurium LT2
caacgccuuccugccagcacag

SEQ ID NO: 1848450 - RNA, 16 nt, Salmonella typhimurium LT2
caacgcgaagcagcuu

SEQ ID NO: 1848451 - RNA, 14 nt, Salmonella typhimurium LT2
caacgccuccaggc

SEQ ID NO: 1848452 - RNA, 14 nt, Salmonella typhimurium LT2
caacgcgaucuuca

SEQ ID NO: 1848453 - RNA, 14 nt, Salmonella typhimurium LT2
caacgcgccgccaa

SEQ ID NO: 1848454 - RNA, 14 nt, Salmonella typhimurium LT2
caacgccgccuggc

SEQ ID NO: 1848455 - RNA, 15 nt, Salmonella typhimurium LT2
caacgcagucaaaac

SEQ ID NO: 1848456 - RNA, 22 nt, Salmonella typhimurium LT2
caacguuucuuucaucagauca

SEQ ID NO: 1848457 - RNA, 19 nt, Salmonella typhimurium LT2
caacguuucuuucaucaga

SEQ ID NO: 1848458 - RNA, 23 nt, Salmonella typhimurium LT2
caacguuuccggaaugagaugca

SEQ ID NO: 1848459 - RNA, 16 nt, Salmonella typhimurium LT2
caacgugccagaaaca

SEQ ID NO: 1848460 - RNA, 13 nt, Salmonella typhimurium LT2
caacuccgccggc

SEQ ID NO: 1848461 - RNA, 19 nt, Salmonella typhimurium LT2
caacucacacuaacgugaa

SEQ ID NO: 1848462 - RNA, 19 nt, Salmonella typhimurium LT2
caacaucagcgcuaccagc

SEQ ID NO: 1848463 - RNA, 16 nt, Salmonella typhimurium LT2
caacaucaguucagaa

SEQ ID NO: 1848464 - RNA, 18 nt, Salmonella typhimurium LT2
caacaucauguccccagg

SEQ ID NO: 1848465 - RNA, 17 nt, Salmonella typhimurium LT2
caacauauuuuucacac

SEQ ID NO: 1848466 - RNA, 20 nt, Salmonella typhimurium LT2
caacauauuuuucacacaua

SEQ ID NO: 1848467 - RNA, 22 nt, Salmonella typhimurium LT2
caacauaggccagccgacgcuc

SEQ ID NO: 1848468 - RNA, 20 nt, Salmonella typhimurium LT2
caacgcacuguaacgcacug

SEQ ID NO: 1848469 - RNA, 23 nt, Salmonella typhimurium LT2
caacgcaaugcgauaagcgucuu

SEQ ID NO: 1848470 - RNA, 15 nt, Salmonella typhimurium LT2
caacgcaacacaggc

SEQ ID NO: 1848471 - RNA, 17 nt, Salmonella typhimurium LT2
caacgacccccaccaug

SEQ ID NO: 1848472 - RNA, 23 nt, Salmonella typhimurium LT2
caacgacgucuuucuucgcugca

SEQ ID NO: 1848473 - RNA, 21 nt, Salmonella typhimurium LT2
caagacgguuguuuuucagau

SEQ ID NO: 1848474 - RNA, 19 nt, Salmonella typhimurium LT2
caagagcagcaacccugcc

SEQ ID NO: 1848475 - RNA, 16 nt, Salmonella typhimurium LT2
caagaauuuaucgcaa

SEQ ID NO: 1848476 - RNA, 19 nt, Salmonella typhimurium LT2
caagaauuacaucaauaaa

SEQ ID NO: 1848477 - RNA, 17 nt, Salmonella typhimurium LT2
caagacccgaaccugcg

SEQ ID NO: 1848478 - RNA, 23 nt, Salmonella typhimurium LT2
caagacccgacaguaaaacccaa

SEQ ID NO: 1848479 - RNA, 16 nt, Salmonella typhimurium LT2
caagacagguguuaau

SEQ ID NO: 1848480 - RNA, 15 nt, Salmonella typhimurium LT2
caagagugaacacgu

SEQ ID NO: 1848481 - RNA, 23 nt, Salmonella typhimurium LT2
caagaucauccggguuaaaccag

SEQ ID NO: 1848482 - RNA, 20 nt, Salmonella typhimurium LT2
caagaucacauacaaagaga

SEQ ID NO: 1848483 - RNA, 18 nt, Salmonella typhimurium LT2
caagaucgcgcagcaggc

SEQ ID NO: 1848484 - RNA, 19 nt, Salmonella typhimurium LT2
caacucuauuaaaauaaau

SEQ ID NO: 1848485 - RNA, 19 nt, Salmonella typhimurium LT2
caacuugucuggagucaag

SEQ ID NO: 1848486 - RNA, 20 nt, Salmonella typhimurium LT2
caacuuuuacuuucaagaca

SEQ ID NO: 1848487 - RNA, 18 nt, Salmonella typhimurium LT2
caagaacagagcaauuac

SEQ ID NO: 1848488 - RNA, 18 nt, Salmonella typhimurium LT2
caagaaaaucggccagcg

SEQ ID NO: 1848489 - RNA, 16 nt, Salmonella typhimurium LT2
caagaauaugagauug

SEQ ID NO: 1848490 - RNA, 21 nt, Salmonella typhimurium LT2
caaucacccacgucaguaaga

SEQ ID NO: 1848491 - RNA, 14 nt, Salmonella typhimurium LT2
caaucaccccaggu

SEQ ID NO: 1848492 - RNA, 13 nt, Salmonella typhimurium LT2
caauauuaaauga

SEQ ID NO: 1848493 - RNA, 19 nt, Salmonella typhimurium LT2
caauauuaaagaugccuga

SEQ ID NO: 1848494 - RNA, 16 nt, Salmonella typhimurium LT2
caaucaacuccauaau

SEQ ID NO: 1848495 - RNA, 22 nt, Salmonella typhimurium LT2
caauaugguauucgugcaucag

SEQ ID NO: 1848496 - RNA, 18 nt, Salmonella typhimurium LT2
caauaugucuuaaacagc

SEQ ID NO: 1848497 - RNA, 23 nt, Salmonella typhimurium LT2
caauaccugagccucuaaauguu

SEQ ID NO: 1848498 - RNA, 17 nt, Salmonella typhimurium LT2
caauagcaaucuguaac

SEQ ID NO: 1848499 - RNA, 22 nt, Salmonella typhimurium LT2
caauagcagcuucacgcgcugu

SEQ ID NO: 1848500 - RNA, 22 nt, Salmonella typhimurium LT2
caauagaucuuaauuugcagaa

SEQ ID NO: 1848501 - RNA, 20 nt, Salmonella typhimurium LT2
caauauaccgucagcaccag

SEQ ID NO: 1848502 - RNA, 20 nt, Salmonella typhimurium LT2
caauauacucccgaauggcu

SEQ ID NO: 1848503 - RNA, 20 nt, Salmonella typhimurium LT2
caauaucagccauuaaccag

SEQ ID NO: 1848504 - RNA, 19 nt, Salmonella typhimurium LT2
caauauauugcuccaucau

SEQ ID NO: 1848505 - RNA, 21 nt, Salmonella typhimurium LT2
caauauaguugagccauucca

SEQ ID NO: 1848506 - RNA, 15 nt, Salmonella typhimurium LT2
caauauaguuuuuac

SEQ ID NO: 1848507 - RNA, 15 nt, Salmonella typhimurium LT2
caauacccagcgcca

SEQ ID NO: 1848508 - RNA, 16 nt, Salmonella typhimurium LT2
caauaccguccagcgc

SEQ ID NO: 1848509 - RNA, 18 nt, Salmonella typhimurium LT2
caauaccacaaccggaau

SEQ ID NO: 1848510 - RNA, 14 nt, Salmonella typhimurium LT2
caauaccacgcccg

SEQ ID NO: 1848511 - RNA, 19 nt, Salmonella typhimurium LT2
caauaaugcaaauuauuuu

SEQ ID NO: 1848512 - RNA, 15 nt, Salmonella typhimurium LT2
caauaaugcaggcua

SEQ ID NO: 1848513 - RNA, 18 nt, Salmonella typhimurium LT2
caauaaucgcgagaaaau

SEQ ID NO: 1848514 - RNA, 22 nt, Salmonella typhimurium LT2
caauaacgccgauaaccagcgc

SEQ ID NO: 1848515 - RNA, 12 nt, Salmonella typhimurium LT2
caauaaucagau

SEQ ID NO: 1848516 - RNA, 18 nt, Salmonella typhimurium LT2
caauaaucccuucuuuua

SEQ ID NO: 1848517 - RNA, 13 nt, Salmonella typhimurium LT2
caauaagaacuuu

SEQ ID NO: 1848518 - RNA, 21 nt, Salmonella typhimurium LT2
caaguccgccgcuauuacccc

SEQ ID NO: 1848519 - RNA, 22 nt, Salmonella typhimurium LT2
caagugucgauaaccuggauga

SEQ ID NO: 1848520 - RNA, 19 nt, Salmonella typhimurium LT2
caagugugggaagggcgaa

SEQ ID NO: 1848521 - RNA, 23 nt, Salmonella typhimurium LT2
caaggcgucgcuggucugacgga

SEQ ID NO: 1848522 - RNA, 19 nt, Salmonella typhimurium LT2
caaggcuauuagccaaagc

SEQ ID NO: 1848523 - RNA, 12 nt, Salmonella typhimurium LT2
caagggcaaggg

SEQ ID NO: 1848524 - RNA, 14 nt, Salmonella typhimurium LT2
caagggcaagggca

SEQ ID NO: 1848525 - RNA, 17 nt, Salmonella typhimurium LT2
caagggcaagggcaagg

SEQ ID NO: 1848526 - RNA, 14 nt, Salmonella typhimurium LT2
caagggaagagauu

SEQ ID NO: 1848527 - RNA, 14 nt, Salmonella typhimurium LT2
caaguaauaaagag

SEQ ID NO: 1848528 - RNA, 13 nt, Salmonella typhimurium LT2
caaguaaaauaac

SEQ ID NO: 1848529 - RNA, 17 nt, Salmonella typhimurium LT2
caagguuuggcucaaua

SEQ ID NO: 1848530 - RNA, 15 nt, Salmonella typhimurium LT2
caagcgccaguaaug

SEQ ID NO: 1848531 - RNA, 18 nt, Salmonella typhimurium LT2
caagcgccucgcugacgc

SEQ ID NO: 1848532 - RNA, 16 nt, Salmonella typhimurium LT2
caagcgcuaagcaaca

SEQ ID NO: 1848533 - RNA, 14 nt, Salmonella typhimurium LT2
caagcgcggcagca

SEQ ID NO: 1848534 - RNA, 18 nt, Salmonella typhimurium LT2
caagcgcggacagcagaa

SEQ ID NO: 1848535 - RNA, 19 nt, Salmonella typhimurium LT2
caagcaacuguagaaugcu

SEQ ID NO: 1848536 - RNA, 14 nt, Salmonella typhimurium LT2
caagauuugcaaua

SEQ ID NO: 1848537 - RNA, 12 nt, Salmonella typhimurium LT2
caagccugcaug

SEQ ID NO: 1848538 - RNA, 13 nt, Salmonella typhimurium LT2
caagcaauaccag

SEQ ID NO: 1848539 - RNA, 17 nt, Salmonella typhimurium LT2
caagcaauaccagaaau

SEQ ID NO: 1848540 - RNA, 14 nt, Salmonella typhimurium LT2
caagcugcuuuuug

SEQ ID NO: 1848541 - RNA, 19 nt, Salmonella typhimurium LT2
caagcugugccauauucuc

SEQ ID NO: 1848542 - RNA, 17 nt, Salmonella typhimurium LT2
caagcucauuucccaau

SEQ ID NO: 1848543 - RNA, 13 nt, Salmonella typhimurium LT2
caagcucauuucc

SEQ ID NO: 1848544 - RNA, 15 nt, Salmonella typhimurium LT2
caagcugauuuuucg

SEQ ID NO: 1848545 - RNA, 21 nt, Salmonella typhimurium LT2
caaggcauuggacgggaucuc

SEQ ID NO: 1848546 - RNA, 21 nt, Salmonella typhimurium LT2
caaggcaucuaucagagggga

SEQ ID NO: 1848547 - RNA, 21 nt, Salmonella typhimurium LT2
caacagguaccccgccaccgc

SEQ ID NO: 1848548 - RNA, 15 nt, Salmonella typhimurium LT2
caacagcgagcuaug

SEQ ID NO: 1848549 - RNA, 20 nt, Salmonella typhimurium LT2
caacagcgcggcaggccggc

SEQ ID NO: 1848550 - RNA, 15 nt, Salmonella typhimurium LT2
caacagcggagagac

SEQ ID NO: 1848551 - RNA, 14 nt, Salmonella typhimurium LT2
caacagccgccugu

SEQ ID NO: 1848552 - RNA, 12 nt, Salmonella typhimurium LT2
caacagcaaugu

SEQ ID NO: 1848553 - RNA, 14 nt, Salmonella typhimurium LT2
caacagcaauguuu

SEQ ID NO: 1848554 - RNA, 12 nt, Salmonella typhimurium LT2
caacagcaccag

SEQ ID NO: 1848555 - RNA, 16 nt, Salmonella typhimurium LT2
caacagauaagcaccu

SEQ ID NO: 1848556 - RNA, 16 nt, Salmonella typhimurium LT2
caacauaaauaaacag

SEQ ID NO: 1848557 - RNA, 15 nt, Salmonella typhimurium LT2
caacauaauaaagcc

SEQ ID NO: 1848558 - RNA, 19 nt, Salmonella typhimurium LT2
caacaaccucuuuuuccgc

SEQ ID NO: 1848559 - RNA, 15 nt, Salmonella typhimurium LT2
caacaaccggcuggc

SEQ ID NO: 1848560 - RNA, 16 nt, Salmonella typhimurium LT2
caacaccguaaaagga

SEQ ID NO: 1848561 - RNA, 15 nt, Salmonella typhimurium LT2
caacacccacaccau

SEQ ID NO: 1848562 - RNA, 21 nt, Salmonella typhimurium LT2
caaaugcugugucggauacca

SEQ ID NO: 1848563 - RNA, 14 nt, Salmonella typhimurium LT2
caaauuauuuuaug

SEQ ID NO: 1848564 - RNA, 16 nt, Salmonella typhimurium LT2
caaauguuguuugaaa

SEQ ID NO: 1848565 - RNA, 20 nt, Salmonella typhimurium LT2
caaaucugccgggagcagau

SEQ ID NO: 1848566 - RNA, 23 nt, Salmonella typhimurium LT2
caaauccuccagcggcauauggc

SEQ ID NO: 1848567 - RNA, 21 nt, Salmonella typhimurium LT2
caaauccgcauuucgcccucg

SEQ ID NO: 1848568 - RNA, 17 nt, Salmonella typhimurium LT2
caaauuuugauaaaaac

SEQ ID NO: 1848569 - RNA, 13 nt, Salmonella typhimurium LT2
caaauuuggcuca

SEQ ID NO: 1848570 - RNA, 15 nt, Salmonella typhimurium LT2
caaauuuggcucaau

SEQ ID NO: 1848571 - RNA, 12 nt, Salmonella typhimurium LT2
caacaaacauaa

SEQ ID NO: 1848572 - RNA, 15 nt, Salmonella typhimurium LT2
caacaaacuuaauua

SEQ ID NO: 1848573 - RNA, 16 nt, Salmonella typhimurium LT2
caaagggagcagacug

SEQ ID NO: 1848574 - RNA, 14 nt, Salmonella typhimurium LT2
caaagggagcagac

SEQ ID NO: 1848575 - RNA, 19 nt, Salmonella typhimurium LT2
caaaggcaaaauggguucu

SEQ ID NO: 1848576 - RNA, 19 nt, Salmonella typhimurium LT2
caaaggaucauuggccaga

SEQ ID NO: 1848577 - RNA, 21 nt, Salmonella typhimurium LT2
caaauaaauccaugagaagaa

SEQ ID NO: 1848578 - RNA, 17 nt, Salmonella typhimurium LT2
caaauaaauccaugaga

SEQ ID NO: 1848579 - RNA, 22 nt, Salmonella typhimurium LT2
caaagguaaacgcgaccagcgc

SEQ ID NO: 1848580 - RNA, 17 nt, Salmonella typhimurium LT2
caaauaaagccagaugc

SEQ ID NO: 1848581 - RNA, 18 nt, Salmonella typhimurium LT2
caaauaaagccagaugcg

SEQ ID NO: 1848582 - RNA, 15 nt, Salmonella typhimurium LT2
caaauacugcuuuuc

SEQ ID NO: 1848583 - RNA, 17 nt, Salmonella typhimurium LT2
caaauaugauaugugua

SEQ ID NO: 1848584 - RNA, 22 nt, Salmonella typhimurium LT2
caaauauccuaccacgccgcua

SEQ ID NO: 1848585 - RNA, 20 nt, Salmonella typhimurium LT2
caaaucccugaucggccaga

SEQ ID NO: 1848586 - RNA, 15 nt, Salmonella typhimurium LT2
caaaucccggacaca

SEQ ID NO: 1848587 - RNA, 21 nt, Salmonella typhimurium LT2
caaauccacuggucgucugaa

SEQ ID NO: 1848588 - RNA, 19 nt, Salmonella typhimurium LT2
caaauccaacucaguuucc

SEQ ID NO: 1848589 - RNA, 19 nt, Salmonella typhimurium LT2
caaaucaugagcgcaauca

SEQ ID NO: 1848590 - RNA, 20 nt, Salmonella typhimurium LT2
caaaucaugagcgcaaucaa

SEQ ID NO: 1848591 - RNA, 14 nt, Salmonella typhimurium LT2
caaaucaaaaggca

SEQ ID NO: 1848592 - RNA, 14 nt, Salmonella typhimurium LT2
caaauauuucuuug

SEQ ID NO: 1848593 - RNA, 16 nt, Salmonella typhimurium LT2
caaacuggccacagca

SEQ ID NO: 1848594 - RNA, 16 nt, Salmonella typhimurium LT2
caaacugcgcgccgcc

SEQ ID NO: 1848595 - RNA, 20 nt, Salmonella typhimurium LT2
caaacuguguacgccaagcu

SEQ ID NO: 1848596 - RNA, 23 nt, Salmonella typhimurium LT2
caaacuguguacgccaagcugca

SEQ ID NO: 1848597 - RNA, 20 nt, Salmonella typhimurium LT2
caaacugguucaacaucagc

SEQ ID NO: 1848598 - RNA, 18 nt, Salmonella typhimurium LT2
caaacuucaucgccacgc

SEQ ID NO: 1848599 - RNA, 18 nt, Salmonella typhimurium LT2
caaagagugccagaaaca

SEQ ID NO: 1848600 - RNA, 20 nt, Salmonella typhimurium LT2
caaagagugccagaaacauc

SEQ ID NO: 1848601 - RNA, 13 nt, Salmonella typhimurium LT2
caaagaguuccug

SEQ ID NO: 1848602 - RNA, 15 nt, Salmonella typhimurium LT2
caaagcucaacgcag

SEQ ID NO: 1848603 - RNA, 16 nt, Salmonella typhimurium LT2
caaagcucaccugcuc

SEQ ID NO: 1848604 - RNA, 22 nt, Salmonella typhimurium LT2
caaagcgggcgacgauggggaa

SEQ ID NO: 1848605 - RNA, 21 nt, Salmonella typhimurium LT2
caaagcguucggccugcugca

SEQ ID NO: 1848606 - RNA, 24 nt, Salmonella typhimurium LT2
caaagcgucauguaaugcuugcug

SEQ ID NO: 1848607 - RNA, 18 nt, Salmonella typhimurium LT2
caaagcgucgcgucagca

SEQ ID NO: 1848608 - RNA, 22 nt, Salmonella typhimurium LT2
caaagcguuauuugcauuuucg

SEQ ID NO: 1848609 - RNA, 16 nt, Salmonella typhimurium LT2
caaagcgguaaaucgc

SEQ ID NO: 1848610 - RNA, 17 nt, Salmonella typhimurium LT2
caaacacaaucacaacg

SEQ ID NO: 1848611 - RNA, 18 nt, Salmonella typhimurium LT2
caaacacaaucacaccca

SEQ ID NO: 1848612 - RNA, 12 nt, Salmonella typhimurium LT2
caaacaccacca

SEQ ID NO: 1848613 - RNA, 14 nt, Salmonella typhimurium LT2
caaacaccagauca

SEQ ID NO: 1848614 - RNA, 14 nt, Salmonella typhimurium LT2
caaacaccaccagu

SEQ ID NO: 1848615 - RNA, 12 nt, Salmonella typhimurium LT2
caaacagcagaa

SEQ ID NO: 1848616 - RNA, 19 nt, Salmonella typhimurium LT2
caaacagcagaacaaccag

SEQ ID NO: 1848617 - RNA, 17 nt, Salmonella typhimurium LT2
caaacagcacuacagcc

SEQ ID NO: 1848618 - RNA, 18 nt, Salmonella typhimurium LT2
caaacaccgagccagaaa

SEQ ID NO: 1848619 - RNA, 13 nt, Salmonella typhimurium LT2
caaacaccgccug

SEQ ID NO: 1848620 - RNA, 22 nt, Salmonella typhimurium LT2
caaacacuaccgggcagcaucu

SEQ ID NO: 1848621 - RNA, 17 nt, Salmonella typhimurium LT2
caaacagcgugggaagc

SEQ ID NO: 1848622 - RNA, 21 nt, Salmonella typhimurium LT2
caaacagcgugggaagcagca

SEQ ID NO: 1848623 - RNA, 17 nt, Salmonella typhimurium LT2
caaacagguuguugaug

SEQ ID NO: 1848624 - RNA, 16 nt, Salmonella typhimurium LT2
caaacagggggaagca

SEQ ID NO: 1848625 - RNA, 14 nt, Salmonella typhimurium LT2
caaacauaagcaaa

SEQ ID NO: 1848626 - RNA, 12 nt, Salmonella typhimurium LT2
caaaccauguac

SEQ ID NO: 1848627 - RNA, 10 nt, Salmonella typhimurium LT2
caaacccauc

SEQ ID NO: 1848628 - RNA, 21 nt, Salmonella typhimurium LT2
caaaccccagauuacugcccu

SEQ ID NO: 1848629 - RNA, 18 nt, Salmonella typhimurium LT2
caaaccgaauucguccac

SEQ ID NO: 1848630 - RNA, 20 nt, Salmonella typhimurium LT2
caaacccgaccucuucuuug

SEQ ID NO: 1848631 - RNA, 15 nt, Salmonella typhimurium LT2
caaacccgccacagg

SEQ ID NO: 1848632 - RNA, 19 nt, Salmonella typhimurium LT2
caaacccgccacaggccaa

SEQ ID NO: 1848633 - RNA, 12 nt, Salmonella typhimurium LT2
caaaccacugcu

SEQ ID NO: 1848634 - RNA, 15 nt, Salmonella typhimurium LT2
caaaccaccccaggu

SEQ ID NO: 1848635 - RNA, 14 nt, Salmonella typhimurium LT2
caaacaucgcgcuc

SEQ ID NO: 1848636 - RNA, 15 nt, Salmonella typhimurium LT2
caaacgauaaaagcu

SEQ ID NO: 1848637 - RNA, 16 nt, Salmonella typhimurium LT2
caaacgauaaaagcuc

SEQ ID NO: 1848638 - RNA, 15 nt, Salmonella typhimurium LT2
caaacgaccgcgcuc

SEQ ID NO: 1848639 - RNA, 22 nt, Salmonella typhimurium LT2
caaaccgauaaucaccagcccg

SEQ ID NO: 1848640 - RNA, 18 nt, Salmonella typhimurium LT2
caaaccgccgauggccca

SEQ ID NO: 1848641 - RNA, 17 nt, Salmonella typhimurium LT2
caaaccgcuuucaucau

SEQ ID NO: 1848642 - RNA, 12 nt, Salmonella typhimurium LT2
caaacgccaccg

SEQ ID NO: 1848643 - RNA, 19 nt, Salmonella typhimurium LT2
caaacgccugcaucaacag

SEQ ID NO: 1848644 - RNA, 17 nt, Salmonella typhimurium LT2
caaacugauaagggccu

SEQ ID NO: 1848645 - RNA, 19 nt, Salmonella typhimurium LT2
caaacugaaaaucaaauaa

SEQ ID NO: 1848646 - RNA, 19 nt, Salmonella typhimurium LT2
caaacucuuuuucaauaaa

SEQ ID NO: 1848647 - RNA, 21 nt, Salmonella typhimurium LT2
caaacuccagcacguccugga

SEQ ID NO: 1848648 - RNA, 21 nt, Salmonella typhimurium LT2
caaacucaggagcuaaauauc

SEQ ID NO: 1848649 - RNA, 22 nt, Salmonella typhimurium LT2
caaacuccgcgcuggcaauaaa

SEQ ID NO: 1848650 - RNA, 17 nt, Salmonella typhimurium LT2
caaacgucguaaaaccu

SEQ ID NO: 1848651 - RNA, 15 nt, Salmonella typhimurium LT2
caaacggcgccagcu

SEQ ID NO: 1848652 - RNA, 15 nt, Salmonella typhimurium LT2
caaacuauuuuuagc

SEQ ID NO: 1848653 - RNA, 17 nt, Salmonella typhimurium LT2
auuuuuauucccgccgc

SEQ ID NO: 1848654 - RNA, 13 nt, Salmonella typhimurium LT2
auuuuuauuaaaa

SEQ ID NO: 1848655 - RNA, 13 nt, Salmonella typhimurium LT2
auuuuuauaaaau

SEQ ID NO: 1848656 - RNA, 15 nt, Salmonella typhimurium LT2
auuuuuauaaaauuu

SEQ ID NO: 1848657 - RNA, 13 nt, Salmonella typhimurium LT2
auuuuucacaugc

SEQ ID NO: 1848658 - RNA, 18 nt, Salmonella typhimurium LT2
caaaaguaucaacgggaa

SEQ ID NO: 1848659 - RNA, 20 nt, Salmonella typhimurium LT2
caaaauaaaauuauauucua

SEQ ID NO: 1848660 - RNA, 20 nt, Salmonella typhimurium LT2
caaaaucacgcacacgucug

SEQ ID NO: 1848661 - RNA, 18 nt, Salmonella typhimurium LT2
caaaauauauaauuuaua

SEQ ID NO: 1848662 - RNA, 19 nt, Salmonella typhimurium LT2
caaaauaauacguuuauuc

SEQ ID NO: 1848663 - RNA, 16 nt, Salmonella typhimurium LT2
caaaauaauacguuua

SEQ ID NO: 1848664 - RNA, 14 nt, Salmonella typhimurium LT2
caaaauaagcaccg

SEQ ID NO: 1848665 - RNA, 14 nt, Salmonella typhimurium LT2
caaaauuuucaaua

SEQ ID NO: 1848666 - RNA, 16 nt, Salmonella typhimurium LT2
caaacaaauaaaucca

SEQ ID NO: 1848667 - RNA, 22 nt, Salmonella typhimurium LT2
caaaaugugcaaucacacuaca

SEQ ID NO: 1848668 - RNA, 16 nt, Salmonella typhimurium LT2
caaaaugauguccaca

SEQ ID NO: 1848669 - RNA, 19 nt, Salmonella typhimurium LT2
caaaaucccggcuggguuc

SEQ ID NO: 1848670 - RNA, 13 nt, Salmonella typhimurium LT2
caaaaucauucga

SEQ ID NO: 1848671 - RNA, 23 nt, Salmonella typhimurium LT2
caaaaucauucgagaugcauaaa

SEQ ID NO: 1848672 - RNA, 15 nt, Salmonella typhimurium LT2
caaaaucgcccaggu

SEQ ID NO: 1848673 - RNA, 16 nt, Salmonella typhimurium LT2
caaaauccgccaccgc

SEQ ID NO: 1848674 - RNA, 18 nt, Salmonella typhimurium LT2
cauccaguuguuuauucc

SEQ ID NO: 1848675 - RNA, 18 nt, Salmonella typhimurium LT2
cauccaguggugaaaaag

SEQ ID NO: 1848676 - RNA, 15 nt, Salmonella typhimurium LT2
cauccaucacuccuu

SEQ ID NO: 1848677 - RNA, 21 nt, Salmonella typhimurium LT2
cauccagcuugccgucgcagg

SEQ ID NO: 1848678 - RNA, 16 nt, Salmonella typhimurium LT2
cauccagcgcgcggca

SEQ ID NO: 1848679 - RNA, 22 nt, Salmonella typhimurium LT2
cauccagcacagguacaggccg

SEQ ID NO: 1848680 - RNA, 14 nt, Salmonella typhimurium LT2
cauccaacugcgcc

SEQ ID NO: 1848681 - RNA, 23 nt, Salmonella typhimurium LT2
caucauuaccuuuuccggcggca

SEQ ID NO: 1848682 - RNA, 18 nt, Salmonella typhimurium LT2
caucauuaauauaauccu

SEQ ID NO: 1848683 - RNA, 19 nt, Salmonella typhimurium LT2
caucauucaacgcaucaaa

SEQ ID NO: 1848684 - RNA, 15 nt, Salmonella typhimurium LT2
caucauucaacgcau

SEQ ID NO: 1848685 - RNA, 15 nt, Salmonella typhimurium LT2
caucauucauccaga

SEQ ID NO: 1848686 - RNA, 20 nt, Salmonella typhimurium LT2
caucaggaucuucaucccau

SEQ ID NO: 1848687 - RNA, 20 nt, Salmonella typhimurium LT2
caucagcgggcuaugcugaa

SEQ ID NO: 1848688 - RNA, 16 nt, Salmonella typhimurium LT2
caucauggcauacagc

SEQ ID NO: 1848689 - RNA, 12 nt, Salmonella typhimurium LT2
caucaggcaacc

SEQ ID NO: 1848690 - RNA, 17 nt, Salmonella typhimurium LT2
cauccugcaacucaaaa

SEQ ID NO: 1848691 - RNA, 21 nt, Salmonella typhimurium LT2
cauccugcgccauugcgggag

SEQ ID NO: 1848692 - RNA, 15 nt, Salmonella typhimurium LT2
cauccggcauuuuuu

SEQ ID NO: 1848693 - RNA, 20 nt, Salmonella typhimurium LT2
cauccggcaaaaugcccggc

SEQ ID NO: 1848694 - RNA, 17 nt, Salmonella typhimurium LT2
cauccggcaauuuauac

SEQ ID NO: 1848695 - RNA, 13 nt, Salmonella typhimurium LT2
cauccggcacagu

SEQ ID NO: 1848696 - RNA, 13 nt, Salmonella typhimurium LT2
cauccggcaucuc

SEQ ID NO: 1848697 - RNA, 15 nt, Salmonella typhimurium LT2
caucccuuucauuuu

SEQ ID NO: 1848698 - RNA, 19 nt, Salmonella typhimurium LT2
cauccgcaagacacgcuuc

SEQ ID NO: 1848699 - RNA, 13 nt, Salmonella typhimurium LT2
cauccgagaccag

SEQ ID NO: 1848700 - RNA, 14 nt, Salmonella typhimurium LT2
caucccugauuuau

SEQ ID NO: 1848701 - RNA, 18 nt, Salmonella typhimurium LT2
caucccaggagauaucaa

SEQ ID NO: 1848702 - RNA, 22 nt, Salmonella typhimurium LT2
cauccccacaggaucaccgcca

SEQ ID NO: 1848703 - RNA, 16 nt, Salmonella typhimurium LT2
caucccauccgggcca

SEQ ID NO: 1848704 - RNA, 20 nt, Salmonella typhimurium LT2
caucccaugcaccagcccca

SEQ ID NO: 1848705 - RNA, 10 nt, Salmonella typhimurium LT2
caucccagac

SEQ ID NO: 1848706 - RNA, 12 nt, Salmonella typhimurium LT2
caucccccagcc

SEQ ID NO: 1848707 - RNA, 19 nt, Salmonella typhimurium LT2
cauccccgcguuaagcccc

SEQ ID NO: 1848708 - RNA, 21 nt, Salmonella typhimurium LT2
caucccgauuucgcuccacug

SEQ ID NO: 1848709 - RNA, 23 nt, Salmonella typhimurium LT2
caucccgauuucgcuccacuggc

SEQ ID NO: 1848710 - RNA, 21 nt, Salmonella typhimurium LT2
caucgcuuuuaggcugaaagc

SEQ ID NO: 1848711 - RNA, 12 nt, Salmonella typhimurium LT2
caucggaaaaau

SEQ ID NO: 1848712 - RNA, 18 nt, Salmonella typhimurium LT2
caucgcuucuacagccac

SEQ ID NO: 1848713 - RNA, 19 nt, Salmonella typhimurium LT2
caucgcuucuacagccacc

SEQ ID NO: 1848714 - RNA, 16 nt, Salmonella typhimurium LT2
caucgcuuucagcuuu

SEQ ID NO: 1848715 - RNA, 20 nt, Salmonella typhimurium LT2
caucgcuggucgcuaccaca

SEQ ID NO: 1848716 - RNA, 15 nt, Salmonella typhimurium LT2
caucgcucgcaccuc

SEQ ID NO: 1848717 - RNA, 20 nt, Salmonella typhimurium LT2
caucgccggagccgccuggc

SEQ ID NO: 1848718 - RNA, 21 nt, Salmonella typhimurium LT2
caucgccgugaucgaggcgcu

SEQ ID NO: 1848719 - RNA, 14 nt, Salmonella typhimurium LT2
caucgccgccucgc

SEQ ID NO: 1848720 - RNA, 14 nt, Salmonella typhimurium LT2
caucgccgcgccgu

SEQ ID NO: 1848721 - RNA, 20 nt, Salmonella typhimurium LT2
caucgccgauuucuucuggc

SEQ ID NO: 1848722 - RNA, 19 nt, Salmonella typhimurium LT2
caucgccgcaaugaccaca

SEQ ID NO: 1848723 - RNA, 16 nt, Salmonella typhimurium LT2
caucgcacucuccggc

SEQ ID NO: 1848724 - RNA, 17 nt, Salmonella typhimurium LT2
caucgauuuccugauga

SEQ ID NO: 1848725 - RNA, 18 nt, Salmonella typhimurium LT2
caucgauuuccugaugac

SEQ ID NO: 1848726 - RNA, 18 nt, Salmonella typhimurium LT2
caucgccaccgcauggaa

SEQ ID NO: 1848727 - RNA, 19 nt, Salmonella typhimurium LT2
caucgccacagacgaagag

SEQ ID NO: 1848728 - RNA, 18 nt, Salmonella typhimurium LT2
caucgcauuaacguccau

SEQ ID NO: 1848729 - RNA, 22 nt, Salmonella typhimurium LT2
caucguauauacccaaaauaau

SEQ ID NO: 1848730 - RNA, 23 nt, Salmonella typhimurium LT2
caucguauauacccaaaauaauu

SEQ ID NO: 1848731 - RNA, 13 nt, Salmonella typhimurium LT2
caucggcaucaaa

SEQ ID NO: 1848732 - RNA, 21 nt, Salmonella typhimurium LT2
caucggcacguaguaaugcau

SEQ ID NO: 1848733 - RNA, 17 nt, Salmonella typhimurium LT2
caucguuugcaguuccg

SEQ ID NO: 1848734 - RNA, 23 nt, Salmonella typhimurium LT2
caucgugauagacggcugaaugu

SEQ ID NO: 1848735 - RNA, 21 nt, Salmonella typhimurium LT2
caucgugccagacucuugcuc

SEQ ID NO: 1848736 - RNA, 16 nt, Salmonella typhimurium LT2
caucgugagcgcguca

SEQ ID NO: 1848737 - RNA, 20 nt, Salmonella typhimurium LT2
caucuaacacaaauucgcua

SEQ ID NO: 1848738 - RNA, 12 nt, Salmonella typhimurium LT2
caucucaucuug

SEQ ID NO: 1848739 - RNA, 18 nt, Salmonella typhimurium LT2
caucucgguuaugaccaa

SEQ ID NO: 1848740 - RNA, 19 nt, Salmonella typhimurium LT2
caucucguaaaucaauuuu

SEQ ID NO: 1848741 - RNA, 14 nt, Salmonella typhimurium LT2
caucuccagcgcau

SEQ ID NO: 1848742 - RNA, 15 nt, Salmonella typhimurium LT2
caucacuuuuggcga

SEQ ID NO: 1848743 - RNA, 21 nt, Salmonella typhimurium LT2
caucagaaaaaagccaagcac

SEQ ID NO: 1848744 - RNA, 16 nt, Salmonella typhimurium LT2
caucagaagugccagu

SEQ ID NO: 1848745 - RNA, 17 nt, Salmonella typhimurium LT2
caucagaaugcugguca

SEQ ID NO: 1848746 - RNA, 18 nt, Salmonella typhimurium LT2
caucagaccgauaaauac

SEQ ID NO: 1848747 - RNA, 21 nt, Salmonella typhimurium LT2
caucagaccgagacccagcgc

SEQ ID NO: 1848748 - RNA, 23 nt, Salmonella typhimurium LT2
caucagcaauuucucgcccgcca

SEQ ID NO: 1848749 - RNA, 18 nt, Salmonella typhimurium LT2
caucagcacaaaauccca

SEQ ID NO: 1848750 - RNA, 15 nt, Salmonella typhimurium LT2
caucagacuguaugu

SEQ ID NO: 1848751 - RNA, 21 nt, Salmonella typhimurium LT2
caucagcgcuaccagcgcggc

SEQ ID NO: 1848752 - RNA, 14 nt, Salmonella typhimurium LT2
caucagcgcgugcc

SEQ ID NO: 1848753 - RNA, 19 nt, Salmonella typhimurium LT2
caucacagccacacugcug

SEQ ID NO: 1848754 - RNA, 14 nt, Salmonella typhimurium LT2
caucacaucccagc

SEQ ID NO: 1848755 - RNA, 18 nt, Salmonella typhimurium LT2
caucacaucccagcagag

SEQ ID NO: 1848756 - RNA, 19 nt, Salmonella typhimurium LT2
caucacauguagcgcggca

SEQ ID NO: 1848757 - RNA, 22 nt, Salmonella typhimurium LT2
caucaaugcccagcgcaaucac

SEQ ID NO: 1848758 - RNA, 20 nt, Salmonella typhimurium LT2
caucaauucuuuaauuugug

SEQ ID NO: 1848759 - RNA, 20 nt, Salmonella typhimurium LT2
caucacaaaaucauugcguu

SEQ ID NO: 1848760 - RNA, 22 nt, Salmonella typhimurium LT2
caucaccaguugcgaagccacu

SEQ ID NO: 1848761 - RNA, 18 nt, Salmonella typhimurium LT2
caucaccaguugaccaaa

SEQ ID NO: 1848762 - RNA, 19 nt, Salmonella typhimurium LT2
caucacguucgcgcauacc

SEQ ID NO: 1848763 - RNA, 19 nt, Salmonella typhimurium LT2
caucacuaccauuuccggc

SEQ ID NO: 1848764 - RNA, 23 nt, Salmonella typhimurium LT2
caucaccagaucggcaucuuuaa

SEQ ID NO: 1848765 - RNA, 11 nt, Salmonella typhimurium LT2
caucaauagca

SEQ ID NO: 1848766 - RNA, 20 nt, Salmonella typhimurium LT2
caucaauacguuaugcaguc

SEQ ID NO: 1848767 - RNA, 16 nt, Salmonella typhimurium LT2
caucaauaccguccag

SEQ ID NO: 1848768 - RNA, 18 nt, Salmonella typhimurium LT2
caucaauacccggccccu

SEQ ID NO: 1848769 - RNA, 17 nt, Salmonella typhimurium LT2
caucaauagcaagggca

SEQ ID NO: 1848770 - RNA, 15 nt, Salmonella typhimurium LT2
caucaaugcccagcg

SEQ ID NO: 1848771 - RNA, 14 nt, Salmonella typhimurium LT2
caucaauauuggug

SEQ ID NO: 1848772 - RNA, 15 nt, Salmonella typhimurium LT2
caucaaauaauacgc

SEQ ID NO: 1848773 - RNA, 23 nt, Salmonella typhimurium LT2
caucaaauacgcgcgccgccugc

SEQ ID NO: 1848774 - RNA, 18 nt, Salmonella typhimurium LT2
caucaaauagguauguaa

SEQ ID NO: 1848775 - RNA, 15 nt, Salmonella typhimurium LT2
caucaaagaaaacca

SEQ ID NO: 1848776 - RNA, 17 nt, Salmonella typhimurium LT2
cauauuucgaucggcca

SEQ ID NO: 1848777 - RNA, 19 nt, Salmonella typhimurium LT2
caucaaagaaauacccuuc

SEQ ID NO: 1848778 - RNA, 17 nt, Salmonella typhimurium LT2
cauauuguaccugccgc

SEQ ID NO: 1848779 - RNA, 19 nt, Salmonella typhimurium LT2
cauauuguagguuuuccuc

SEQ ID NO: 1848780 - RNA, 22 nt, Salmonella typhimurium LT2
cauauuuaaauaucggcucaau

SEQ ID NO: 1848781 - RNA, 14 nt, Salmonella typhimurium LT2
cauauugcgccgca

SEQ ID NO: 1848782 - RNA, 21 nt, Salmonella typhimurium LT2
cauauugacauuugcucccuu

SEQ ID NO: 1848783 - RNA, 13 nt, Salmonella typhimurium LT2
cauauccagcgcc

SEQ ID NO: 1848784 - RNA, 16 nt, Salmonella typhimurium LT2
cauauccaagccccuc

SEQ ID NO: 1848785 - RNA, 15 nt, Salmonella typhimurium LT2
cauauccaccaccag

SEQ ID NO: 1848786 - RNA, 13 nt, Salmonella typhimurium LT2
cauauucaugguu

SEQ ID NO: 1848787 - RNA, 20 nt, Salmonella typhimurium LT2
cauauucauaucgaagccca

SEQ ID NO: 1848788 - RNA, 20 nt, Salmonella typhimurium LT2
cauauuccagaagcgcuuug

SEQ ID NO: 1848789 - RNA, 15 nt, Salmonella typhimurium LT2
cauauucgccaccgc

SEQ ID NO: 1848790 - RNA, 15 nt, Salmonella typhimurium LT2
cauaguuugcauaac

SEQ ID NO: 1848791 - RNA, 15 nt, Salmonella typhimurium LT2
cauaguuuuccagcc

SEQ ID NO: 1848792 - RNA, 22 nt, Salmonella typhimurium LT2
cauagucgcuccccauaaaaau

SEQ ID NO: 1848793 - RNA, 21 nt, Salmonella typhimurium LT2
cauagugagcgacuucaaaaa

SEQ ID NO: 1848794 - RNA, 22 nt, Salmonella typhimurium LT2
cauauacgccacggccagcagc

SEQ ID NO: 1848795 - RNA, 13 nt, Salmonella typhimurium LT2
cauaucaguugcc

SEQ ID NO: 1848796 - RNA, 22 nt, Salmonella typhimurium LT2
cauaucaguggggccuuuuuaa

SEQ ID NO: 1848797 - RNA, 20 nt, Salmonella typhimurium LT2
cauaucaguuaugacagaca

SEQ ID NO: 1848798 - RNA, 21 nt, Salmonella typhimurium LT2
cauagcuuacuuuuagaacua

SEQ ID NO: 1848799 - RNA, 21 nt, Salmonella typhimurium LT2
cauagcguuuaaaaagcugca

SEQ ID NO: 1848800 - RNA, 18 nt, Salmonella typhimurium LT2
cauagcgucaucaacaua

SEQ ID NO: 1848801 - RNA, 19 nt, Salmonella typhimurium LT2
cauagcgggcagcauugac

SEQ ID NO: 1848802 - RNA, 14 nt, Salmonella typhimurium LT2
cauaguaaauuguu

SEQ ID NO: 1848803 - RNA, 17 nt, Salmonella typhimurium LT2
cauagaaaucagcaggu

SEQ ID NO: 1848804 - RNA, 20 nt, Salmonella typhimurium LT2
cauacacauucaggcuggca

SEQ ID NO: 1848805 - RNA, 13 nt, Salmonella typhimurium LT2
cauagaauuucag

SEQ ID NO: 1848806 - RNA, 20 nt, Salmonella typhimurium LT2
cauaauugcugcccgccgcc

SEQ ID NO: 1848807 - RNA, 21 nt, Salmonella typhimurium LT2
cauaauugcugcccgccgcca

SEQ ID NO: 1848808 - RNA, 22 nt, Salmonella typhimurium LT2
cauaauggaacugccuggcuca

SEQ ID NO: 1848809 - RNA, 18 nt, Salmonella typhimurium LT2
cauaaugucccugccacg

SEQ ID NO: 1848810 - RNA, 17 nt, Salmonella typhimurium LT2
cauaaugguggaaugcc

SEQ ID NO: 1848811 - RNA, 22 nt, Salmonella typhimurium LT2
cauagccggcgauagcgcccca

SEQ ID NO: 1848812 - RNA, 13 nt, Salmonella typhimurium LT2
cauagccuaauga

SEQ ID NO: 1848813 - RNA, 18 nt, Salmonella typhimurium LT2
cauagcgcacaacgucag

SEQ ID NO: 1848814 - RNA, 15 nt, Salmonella typhimurium LT2
cauagccgcgcguca

SEQ ID NO: 1848815 - RNA, 16 nt, Salmonella typhimurium LT2
cauagccaguggaaca

SEQ ID NO: 1848816 - RNA, 17 nt, Salmonella typhimurium LT2
cauagauaccuucuuca

SEQ ID NO: 1848817 - RNA, 19 nt, Salmonella typhimurium LT2
cauagaugguugcaugauu

SEQ ID NO: 1848818 - RNA, 20 nt, Salmonella typhimurium LT2
cauagauaacuaugugcccg

SEQ ID NO: 1848819 - RNA, 15 nt, Salmonella typhimurium LT2
cauagauaccuucuu

SEQ ID NO: 1848820 - RNA, 14 nt, Salmonella typhimurium LT2
cauucauaaaagau

SEQ ID NO: 1848821 - RNA, 14 nt, Salmonella typhimurium LT2
cauucacggcgacc

SEQ ID NO: 1848822 - RNA, 15 nt, Salmonella typhimurium LT2
cauucacgccgccau

SEQ ID NO: 1848823 - RNA, 12 nt, Salmonella typhimurium LT2
cauuccagccgg

SEQ ID NO: 1848824 - RNA, 12 nt, Salmonella typhimurium LT2
cauuccagaccu

SEQ ID NO: 1848825 - RNA, 12 nt, Salmonella typhimurium LT2
cauuccagaccc

SEQ ID NO: 1848826 - RNA, 16 nt, Salmonella typhimurium LT2
cauucauugccgccag

SEQ ID NO: 1848827 - RNA, 19 nt, Salmonella typhimurium LT2
cauucauugucuuuuucuc

SEQ ID NO: 1848828 - RNA, 22 nt, Salmonella typhimurium LT2
cauuccgcgcaaauacugaaau

SEQ ID NO: 1848829 - RNA, 16 nt, Salmonella typhimurium LT2
cauucccgccaauaac

SEQ ID NO: 1848830 - RNA, 18 nt, Salmonella typhimurium LT2
cauucccgccaauaacca

SEQ ID NO: 1848831 - RNA, 15 nt, Salmonella typhimurium LT2
cauucccgccgagaa

SEQ ID NO: 1848832 - RNA, 17 nt, Salmonella typhimurium LT2
cauucccgccgagaaaa

SEQ ID NO: 1848833 - RNA, 14 nt, Salmonella typhimurium LT2
cauucccagcgccc

SEQ ID NO: 1848834 - RNA, 17 nt, Salmonella typhimurium LT2
cauucccguaaaagaag

SEQ ID NO: 1848835 - RNA, 19 nt, Salmonella typhimurium LT2
cauucccgaauaccacaaa

SEQ ID NO: 1848836 - RNA, 20 nt, Salmonella typhimurium LT2
cauucgcgcauacucuuccg

SEQ ID NO: 1848837 - RNA, 13 nt, Salmonella typhimurium LT2
cauucgccccagc

SEQ ID NO: 1848838 - RNA, 15 nt, Salmonella typhimurium LT2
cauucgccccagcau

SEQ ID NO: 1848839 - RNA, 22 nt, Salmonella typhimurium LT2
cauucgccaccaggcucaaauu

SEQ ID NO: 1848840 - RNA, 16 nt, Salmonella typhimurium LT2
cauucgcacuccaggc

SEQ ID NO: 1848841 - RNA, 17 nt, Salmonella typhimurium LT2
cauuccuuuagcuucca

SEQ ID NO: 1848842 - RNA, 16 nt, Salmonella typhimurium LT2
cauucgaauccuccug

SEQ ID NO: 1848843 - RNA, 14 nt, Salmonella typhimurium LT2
cauucgaauucuga

SEQ ID NO: 1848844 - RNA, 15 nt, Salmonella typhimurium LT2
cauucgaauucugau

SEQ ID NO: 1848845 - RNA, 19 nt, Salmonella typhimurium LT2
cauucgaccacaacccacu

SEQ ID NO: 1848846 - RNA, 19 nt, Salmonella typhimurium LT2
cauucgagaugcauaaaaa

SEQ ID NO: 1848847 - RNA, 21 nt, Salmonella typhimurium LT2
cauucgagaugcauaaaaaaa

SEQ ID NO: 1848848 - RNA, 19 nt, Salmonella typhimurium LT2
cauucaacgcaucaaauac

SEQ ID NO: 1848849 - RNA, 13 nt, Salmonella typhimurium LT2
cauuauucggcuu

SEQ ID NO: 1848850 - RNA, 17 nt, Salmonella typhimurium LT2
cauuauacgccuauuuu

SEQ ID NO: 1848851 - RNA, 23 nt, Salmonella typhimurium LT2
cauuaugggcaaugauauagccu

SEQ ID NO: 1848852 - RNA, 16 nt, Salmonella typhimurium LT2
cauuauguaauaacug

SEQ ID NO: 1848853 - RNA, 13 nt, Salmonella typhimurium LT2
cauuaccuuuucc

SEQ ID NO: 1848854 - RNA, 14 nt, Salmonella typhimurium LT2
cauuacucgccugc

SEQ ID NO: 1848855 - RNA, 14 nt, Salmonella typhimurium LT2
cauuacucguccuu

SEQ ID NO: 1848856 - RNA, 23 nt, Salmonella typhimurium LT2
cauucuuugcuuuguaaagcgcc

SEQ ID NO: 1848857 - RNA, 19 nt, Salmonella typhimurium LT2
cauucuugcgccgcaaacu

SEQ ID NO: 1848858 - RNA, 19 nt, Salmonella typhimurium LT2
cauucgguacggcgcugcu

SEQ ID NO: 1848859 - RNA, 22 nt, Salmonella typhimurium LT2
cauucgggacaaacccccagcc

SEQ ID NO: 1848860 - RNA, 23 nt, Salmonella typhimurium LT2
cauucgggacaaacccccagcca

SEQ ID NO: 1848861 - RNA, 23 nt, Salmonella typhimurium LT2
cauugcccgcugcgcacggcaau

SEQ ID NO: 1848862 - RNA, 19 nt, Salmonella typhimurium LT2
cauugguggggcuaaguga

SEQ ID NO: 1848863 - RNA, 16 nt, Salmonella typhimurium LT2
cauuggguaauuuuuu

SEQ ID NO: 1848864 - RNA, 23 nt, Salmonella typhimurium LT2
cauuggguaauuuuuugauauua

SEQ ID NO: 1848865 - RNA, 21 nt, Salmonella typhimurium LT2
cauuggggacgcgcaaacgcu

SEQ ID NO: 1848866 - RNA, 15 nt, Salmonella typhimurium LT2
cauugggccagcagc

SEQ ID NO: 1848867 - RNA, 20 nt, Salmonella typhimurium LT2
cauugggauggauaaauagg

SEQ ID NO: 1848868 - RNA, 22 nt, Salmonella typhimurium LT2
cauugcgcucuaucgccgcccg

SEQ ID NO: 1848869 - RNA, 18 nt, Salmonella typhimurium LT2
cauugcucauaccgccgc

SEQ ID NO: 1848870 - RNA, 20 nt, Salmonella typhimurium LT2
cauugcucauaccgccgccc

SEQ ID NO: 1848871 - RNA, 17 nt, Salmonella typhimurium LT2
cauuggcccggcgcgcg

SEQ ID NO: 1848872 - RNA, 13 nt, Salmonella typhimurium LT2
cauuucaaucgcc

SEQ ID NO: 1848873 - RNA, 23 nt, Salmonella typhimurium LT2
cauuucaaucgccaccacauuca

SEQ ID NO: 1848874 - RNA, 13 nt, Salmonella typhimurium LT2
cauuucaaugcau

SEQ ID NO: 1848875 - RNA, 16 nt, Salmonella typhimurium LT2
cauuucacaaauuaaa

SEQ ID NO: 1848876 - RNA, 22 nt, Salmonella typhimurium LT2
cauuucaaagcguucugaacug

SEQ ID NO: 1848877 - RNA, 20 nt, Salmonella typhimurium LT2
cauuucacgauacuguugca

SEQ ID NO: 1848878 - RNA, 18 nt, Salmonella typhimurium LT2
cauuucaggcaaaggaau

SEQ ID NO: 1848879 - RNA, 17 nt, Salmonella typhimurium LT2
cauuucaggcacuggcu

SEQ ID NO: 1848880 - RNA, 16 nt, Salmonella typhimurium LT2
cauuucaggcaaaaaa

SEQ ID NO: 1848881 - RNA, 17 nt, Salmonella typhimurium LT2
cauuucaggcaaaaaaa

SEQ ID NO: 1848882 - RNA, 11 nt, Salmonella typhimurium LT2
cauuucaucag

SEQ ID NO: 1848883 - RNA, 18 nt, Salmonella typhimurium LT2
cauuuccgccgccuucug

SEQ ID NO: 1848884 - RNA, 13 nt, Salmonella typhimurium LT2
cauuucccuuccc

SEQ ID NO: 1848885 - RNA, 23 nt, Salmonella typhimurium LT2
cauuucccuuccccuuucaccag

SEQ ID NO: 1848886 - RNA, 23 nt, Salmonella typhimurium LT2
cauuuccggcgcgccuaaaccaa

SEQ ID NO: 1848887 - RNA, 18 nt, Salmonella typhimurium LT2
cauuucccaauaguuuau

SEQ ID NO: 1848888 - RNA, 17 nt, Salmonella typhimurium LT2
cauuuccugcauuaacg

SEQ ID NO: 1848889 - RNA, 19 nt, Salmonella typhimurium LT2
caugaaauggcaugagcag

SEQ ID NO: 1848890 - RNA, 14 nt, Salmonella typhimurium LT2
caugaagaaaauac

SEQ ID NO: 1848891 - RNA, 18 nt, Salmonella typhimurium LT2
caugaaucaucacaauua

SEQ ID NO: 1848892 - RNA, 18 nt, Salmonella typhimurium LT2
caugaaucgcgcgcgcca

SEQ ID NO: 1848893 - RNA, 20 nt, Salmonella typhimurium LT2
caugaauuacagcucauaaa

SEQ ID NO: 1848894 - RNA, 22 nt, Salmonella typhimurium LT2
caugacgggggcgaucagcagg

SEQ ID NO: 1848895 - RNA, 18 nt, Salmonella typhimurium LT2
caugaccauccacgggcu

SEQ ID NO: 1848896 - RNA, 20 nt, Salmonella typhimurium LT2
caugacgcaggcgcaaaaaa

SEQ ID NO: 1848897 - RNA, 21 nt, Salmonella typhimurium LT2
caugacgccaagcugcagaau

SEQ ID NO: 1848898 - RNA, 17 nt, Salmonella typhimurium LT2
caugacacuuuauucuc

SEQ ID NO: 1848899 - RNA, 19 nt, Salmonella typhimurium LT2
caugaauucaacgcccccu

SEQ ID NO: 1848900 - RNA, 16 nt, Salmonella typhimurium LT2
caugaccagcgccgcg

SEQ ID NO: 1848901 - RNA, 14 nt, Salmonella typhimurium LT2
caugaccaccagcg

SEQ ID NO: 1848902 - RNA, 14 nt, Salmonella typhimurium LT2
caugacauccauga

SEQ ID NO: 1848903 - RNA, 15 nt, Salmonella typhimurium LT2
caugacaucagaagu

SEQ ID NO: 1848904 - RNA, 17 nt, Salmonella typhimurium LT2
caugauucguggcucaa

SEQ ID NO: 1848905 - RNA, 17 nt, Salmonella typhimurium LT2
caugauggugaacagaa

SEQ ID NO: 1848906 - RNA, 18 nt, Salmonella typhimurium LT2
caugauggcgaacagccc

SEQ ID NO: 1848907 - RNA, 13 nt, Salmonella typhimurium LT2
caugaugccaaau

SEQ ID NO: 1848908 - RNA, 15 nt, Salmonella typhimurium LT2
caugaugaucuucag

SEQ ID NO: 1848909 - RNA, 20 nt, Salmonella typhimurium LT2
caugcaggacggcggcgagc

SEQ ID NO: 1848910 - RNA, 17 nt, Salmonella typhimurium LT2
caugcagcucaagcgcc

SEQ ID NO: 1848911 - RNA, 22 nt, Salmonella typhimurium LT2
caugcagcgcaaacucagagag

SEQ ID NO: 1848912 - RNA, 11 nt, Salmonella typhimurium LT2
caugcagcgcg

SEQ ID NO: 1848913 - RNA, 22 nt, Salmonella typhimurium LT2
caugcagagcaacgagaaccca

SEQ ID NO: 1848914 - RNA, 14 nt, Salmonella typhimurium LT2
caugcaucaauggc

SEQ ID NO: 1848915 - RNA, 23 nt, Salmonella typhimurium LT2
caugaucuuuccuuuuucaggca

SEQ ID NO: 1848916 - RNA, 16 nt, Salmonella typhimurium LT2
caugaucgccgccauc

SEQ ID NO: 1848917 - RNA, 20 nt, Salmonella typhimurium LT2
caugaucuauccaauaauaa

SEQ ID NO: 1848918 - RNA, 14 nt, Salmonella typhimurium LT2
caugaucgccgcca

SEQ ID NO: 1848919 - RNA, 18 nt, Salmonella typhimurium LT2
caugauacccagcguccc

SEQ ID NO: 1848920 - RNA, 18 nt, Salmonella typhimurium LT2
caugauaauggcauauaa

SEQ ID NO: 1848921 - RNA, 19 nt, Salmonella typhimurium LT2
caugauaguaucgcugcua

SEQ ID NO: 1848922 - RNA, 15 nt, Salmonella typhimurium LT2
caugcccacaggcag

SEQ ID NO: 1848923 - RNA, 22 nt, Salmonella typhimurium LT2
caugccgaagacuccccugcag

SEQ ID NO: 1848924 - RNA, 22 nt, Salmonella typhimurium LT2
caugccagcaguuuuucaaucu

SEQ ID NO: 1848925 - RNA, 13 nt, Salmonella typhimurium LT2
caugccacugggu

SEQ ID NO: 1848926 - RNA, 15 nt, Salmonella typhimurium LT2
caugcuauucagcag

SEQ ID NO: 1848927 - RNA, 13 nt, Salmonella typhimurium LT2
caugcuauauuuu

SEQ ID NO: 1848928 - RNA, 19 nt, Salmonella typhimurium LT2
caugcuauucagcaguuca

SEQ ID NO: 1848929 - RNA, 16 nt, Salmonella typhimurium LT2
caugcucauaauggac

SEQ ID NO: 1848930 - RNA, 16 nt, Salmonella typhimurium LT2
caugccgccauuuuau

SEQ ID NO: 1848931 - RNA, 18 nt, Salmonella typhimurium LT2
caugccggcuuuccgcac

SEQ ID NO: 1848932 - RNA, 23 nt, Salmonella typhimurium LT2
caugcucgcuuuccauuacgcuu

SEQ ID NO: 1848933 - RNA, 17 nt, Salmonella typhimurium LT2
caugcuccgccccgccu

SEQ ID NO: 1848934 - RNA, 23 nt, Salmonella typhimurium LT2
caugcugauaacuaauggcauuu

SEQ ID NO: 1848935 - RNA, 12 nt, Salmonella typhimurium LT2
caugcugcaccg

SEQ ID NO: 1848936 - RNA, 12 nt, Salmonella typhimurium LT2
caugcugguugg

SEQ ID NO: 1848937 - RNA, 21 nt, Salmonella typhimurium LT2
caugcugcaccgcaucaaacu

SEQ ID NO: 1848938 - RNA, 15 nt, Salmonella typhimurium LT2
caugcuucucaaaga

SEQ ID NO: 1848939 - RNA, 15 nt, Salmonella typhimurium LT2
caugcuuaucgccaa

SEQ ID NO: 1848940 - RNA, 13 nt, Salmonella typhimurium LT2
cauggcccaaaag

SEQ ID NO: 1848941 - RNA, 13 nt, Salmonella typhimurium LT2
cauggcgccacca

SEQ ID NO: 1848942 - RNA, 15 nt, Salmonella typhimurium LT2
cauggcgccaccagc

SEQ ID NO: 1848943 - RNA, 17 nt, Salmonella typhimurium LT2
cauggcgcgacauggcg

SEQ ID NO: 1848944 - RNA, 17 nt, Salmonella typhimurium LT2
cauggcgauuacccagu

SEQ ID NO: 1848945 - RNA, 21 nt, Salmonella typhimurium LT2
cauggccggucuuaugcugcc

SEQ ID NO: 1848946 - RNA, 21 nt, Salmonella typhimurium LT2
cauggcgaacucuuccagauc

SEQ ID NO: 1848947 - RNA, 17 nt, Salmonella typhimurium LT2
cauggcgaagugcagcg

SEQ ID NO: 1848948 - RNA, 16 nt, Salmonella typhimurium LT2
caugugguaggcuuca

SEQ ID NO: 1848949 - RNA, 23 nt, Salmonella typhimurium LT2
caugucggccuuuuugcgccgcg

SEQ ID NO: 1848950 - RNA, 23 nt, Salmonella typhimurium LT2
cauguccggcgacuccagaauau

SEQ ID NO: 1848951 - RNA, 17 nt, Salmonella typhimurium LT2
cauguccggcgacucca

SEQ ID NO: 1848952 - RNA, 14 nt, Salmonella typhimurium LT2
cauguccccaggug

SEQ ID NO: 1848953 - RNA, 21 nt, Salmonella typhimurium LT2
cauguagcgcggcagcgcgca

SEQ ID NO: 1848954 - RNA, 19 nt, Salmonella typhimurium LT2
cauguagcgcggcagcgcg

SEQ ID NO: 1848955 - RNA, 11 nt, Salmonella typhimurium LT2
caugucaaggu

SEQ ID NO: 1848956 - RNA, 17 nt, Salmonella typhimurium LT2
caugucaagguggugcu

SEQ ID NO: 1848957 - RNA, 20 nt, Salmonella typhimurium LT2
cauggcuauuccacccgacc

SEQ ID NO: 1848958 - RNA, 20 nt, Salmonella typhimurium LT2
cauggcgucggcgacuuuca

SEQ ID NO: 1848959 - RNA, 23 nt, Salmonella typhimurium LT2
cauggcgucuuuuagucacucca

SEQ ID NO: 1848960 - RNA, 16 nt, Salmonella typhimurium LT2
cauggcgcgcgccgcc

SEQ ID NO: 1848961 - RNA, 13 nt, Salmonella typhimurium LT2
cauggcggccaga

SEQ ID NO: 1848962 - RNA, 21 nt, Salmonella typhimurium LT2
cauggcggacggcaaccgucc

SEQ ID NO: 1848963 - RNA, 21 nt, Salmonella typhimurium LT2
cauguaagcuggaaccugagu

SEQ ID NO: 1848964 - RNA, 20 nt, Salmonella typhimurium LT2
cauguaaccaaagcaccauu

SEQ ID NO: 1848965 - RNA, 23 nt, Salmonella typhimurium LT2
cauguacgaaagcgcgaucaauu

SEQ ID NO: 1848966 - RNA, 20 nt, Salmonella typhimurium LT2
cauguacgcaggcggcuggc

SEQ ID NO: 1848967 - RNA, 15 nt, Salmonella typhimurium LT2
cagcgugacccagac

SEQ ID NO: 1848968 - RNA, 21 nt, Salmonella typhimurium LT2
cagcgugacguucaucauuuu

SEQ ID NO: 1848969 - RNA, 15 nt, Salmonella typhimurium LT2
cagcgugcagauggu

SEQ ID NO: 1848970 - RNA, 20 nt, Salmonella typhimurium LT2
cagcgugcguaugacgcaca

SEQ ID NO: 1848971 - RNA, 16 nt, Salmonella typhimurium LT2
cagcguggaugaacuc

SEQ ID NO: 1848972 - RNA, 14 nt, Salmonella typhimurium LT2
cagcgucuguuuca

SEQ ID NO: 1848973 - RNA, 18 nt, Salmonella typhimurium LT2
cagcgucugcccuccuga

SEQ ID NO: 1848974 - RNA, 12 nt, Salmonella typhimurium LT2
cagcgucugccc

SEQ ID NO: 1848975 - RNA, 16 nt, Salmonella typhimurium LT2
cagcgucucagcaggc

SEQ ID NO: 1848976 - RNA, 15 nt, Salmonella typhimurium LT2
cagcgucguccagcc

SEQ ID NO: 1848977 - RNA, 15 nt, Salmonella typhimurium LT2
cagcgucgcuaccag

SEQ ID NO: 1848978 - RNA, 18 nt, Salmonella typhimurium LT2
cagcguuucuggaaguag

SEQ ID NO: 1848979 - RNA, 22 nt, Salmonella typhimurium LT2
cagcguuaccucuuucgccgcu

SEQ ID NO: 1848980 - RNA, 22 nt, Salmonella typhimurium LT2
cagcguugcguguuguacagca

SEQ ID NO: 1848981 - RNA, 14 nt, Salmonella typhimurium LT2
cagcguuggccgcc

SEQ ID NO: 1848982 - RNA, 16 nt, Salmonella typhimurium LT2
cagcguuggccgccuc

SEQ ID NO: 1848983 - RNA, 17 nt, Salmonella typhimurium LT2
cagcguuggugccgcca

SEQ ID NO: 1848984 - RNA, 17 nt, Salmonella typhimurium LT2
cagcguaccacgccgca

SEQ ID NO: 1848985 - RNA, 21 nt, Salmonella typhimurium LT2
cagcguaguuuauucuucucc

SEQ ID NO: 1848986 - RNA, 23 nt, Salmonella typhimurium LT2
cagcguaguuuauucuucuccuc

SEQ ID NO: 1848987 - RNA, 22 nt, Salmonella typhimurium LT2
cagcguaaugcgccaggcagca

SEQ ID NO: 1848988 - RNA, 18 nt, Salmonella typhimurium LT2
cagcguaauggccaccag

SEQ ID NO: 1848989 - RNA, 21 nt, Salmonella typhimurium LT2
cagcguaacuguugccccgcu

SEQ ID NO: 1848990 - RNA, 17 nt, Salmonella typhimurium LT2
cagcgguuucaggccag

SEQ ID NO: 1848991 - RNA, 22 nt, Salmonella typhimurium LT2
cagcgguuacuuuugaacauaa

SEQ ID NO: 1848992 - RNA, 13 nt, Salmonella typhimurium LT2
cagcggugcgcca

SEQ ID NO: 1848993 - RNA, 14 nt, Salmonella typhimurium LT2
cagcggugcgcggu

SEQ ID NO: 1848994 - RNA, 22 nt, Salmonella typhimurium LT2
cagcgucacucuuacggcgccc

SEQ ID NO: 1848995 - RNA, 15 nt, Salmonella typhimurium LT2
cagcgucacuggcca

SEQ ID NO: 1848996 - RNA, 16 nt, Salmonella typhimurium LT2
cagcgucagcgggcca

SEQ ID NO: 1848997 - RNA, 17 nt, Salmonella typhimurium LT2
cacugagcgcgccauga

SEQ ID NO: 1848998 - RNA, 17 nt, Salmonella typhimurium LT2
cacugaguuucaccgcc

SEQ ID NO: 1848999 - RNA, 18 nt, Salmonella typhimurium LT2
cacugauaccccagcgau

SEQ ID NO: 1849000 - RNA, 21 nt, Salmonella typhimurium LT2
cacugauacggcguuggcugc

SEQ ID NO: 1849001 - RNA, 20 nt, Salmonella typhimurium LT2
cagcucuucgccguuaucgg

SEQ ID NO: 1849002 - RNA, 17 nt, Salmonella typhimurium LT2
cagcucuuucaacuucc

SEQ ID NO: 1849003 - RNA, 13 nt, Salmonella typhimurium LT2
cagcucuuuucug

SEQ ID NO: 1849004 - RNA, 15 nt, Salmonella typhimurium LT2
cagcugauugggaua

SEQ ID NO: 1849005 - RNA, 18 nt, Salmonella typhimurium LT2
cagcucgacgccucccga

SEQ ID NO: 1849006 - RNA, 20 nt, Salmonella typhimurium LT2
cagcucacggauauugcccg

SEQ ID NO: 1849007 - RNA, 19 nt, Salmonella typhimurium LT2
cagcucagcgccccagcca

SEQ ID NO: 1849008 - RNA, 20 nt, Salmonella typhimurium LT2
cagcucauacccuuccaguu

SEQ ID NO: 1849009 - RNA, 17 nt, Salmonella typhimurium LT2
cagcuugccuuguuucg

SEQ ID NO: 1849010 - RNA, 15 nt, Salmonella typhimurium LT2
cagcuugcuggccgc

SEQ ID NO: 1849011 - RNA, 17 nt, Salmonella typhimurium LT2
cagcuucgccagaugca

SEQ ID NO: 1849012 - RNA, 12 nt, Salmonella typhimurium LT2
cagcuuccugua

SEQ ID NO: 1849013 - RNA, 21 nt, Salmonella typhimurium LT2
cagcuuccuguacgccugcuu

SEQ ID NO: 1849014 - RNA, 14 nt, Salmonella typhimurium LT2
cagcuuguggaaau

SEQ ID NO: 1849015 - RNA, 21 nt, Salmonella typhimurium LT2
caggaaaccgguaaaggcgac

SEQ ID NO: 1849016 - RNA, 22 nt, Salmonella typhimurium LT2
caggaaagagccgcgcagcgca

SEQ ID NO: 1849017 - RNA, 12 nt, Salmonella typhimurium LT2
caggaaacuggc

SEQ ID NO: 1849018 - RNA, 18 nt, Salmonella typhimurium LT2
caggccaaacagcggcuc

SEQ ID NO: 1849019 - RNA, 14 nt, Salmonella typhimurium LT2
caggccaacauagc

SEQ ID NO: 1849020 - RNA, 16 nt, Salmonella typhimurium LT2
caggccaagcagcgcc

SEQ ID NO: 1849021 - RNA, 18 nt, Salmonella typhimurium LT2
caggccaauuccgccaua

SEQ ID NO: 1849022 - RNA, 14 nt, Salmonella typhimurium LT2
caggccagccugau

SEQ ID NO: 1849023 - RNA, 23 nt, Salmonella typhimurium LT2
caggccagauauugccgaccauu

SEQ ID NO: 1849024 - RNA, 14 nt, Salmonella typhimurium LT2
caggccagaauaac

SEQ ID NO: 1849025 - RNA, 23 nt, Salmonella typhimurium LT2
caggcauagaaaaagaacugcaa

SEQ ID NO: 1849026 - RNA, 17 nt, Salmonella typhimurium LT2
caggcauagagaggcau

SEQ ID NO: 1849027 - RNA, 17 nt, Salmonella typhimurium LT2
caggcauccgugaccug

SEQ ID NO: 1849028 - RNA, 16 nt, Salmonella typhimurium LT2
caggcaucgacgccag

SEQ ID NO: 1849029 - RNA, 18 nt, Salmonella typhimurium LT2
caggcaucgacgccagcg

SEQ ID NO: 1849030 - RNA, 19 nt, Salmonella typhimurium LT2
caggcauccgugaccugcu

SEQ ID NO: 1849031 - RNA, 18 nt, Salmonella typhimurium LT2
caggcaucguacgggcaa

SEQ ID NO: 1849032 - RNA, 12 nt, Salmonella typhimurium LT2
caggcauuuucu

SEQ ID NO: 1849033 - RNA, 20 nt, Salmonella typhimurium LT2
caggcauugauaaagcgcuc

SEQ ID NO: 1849034 - RNA, 20 nt, Salmonella typhimurium LT2
caggcaucuuccagcgucgg

SEQ ID NO: 1849035 - RNA, 17 nt, Salmonella typhimurium LT2
caggcauggcagcaggg

SEQ ID NO: 1849036 - RNA, 20 nt, Salmonella typhimurium LT2
caggcauguugcgcaaucac

SEQ ID NO: 1849037 - RNA, 15 nt, Salmonella typhimurium LT2
caggcauuaaaaaaa

SEQ ID NO: 1849038 - RNA, 21 nt, Salmonella typhimurium LT2
caggccaugcuuuugcaggua

SEQ ID NO: 1849039 - RNA, 20 nt, Salmonella typhimurium LT2
caggccauuuuuucgaugau

SEQ ID NO: 1849040 - RNA, 19 nt, Salmonella typhimurium LT2
caggccaucauugauacug

SEQ ID NO: 1849041 - RNA, 16 nt, Salmonella typhimurium LT2
caggccaugcgcaagc

SEQ ID NO: 1849042 - RNA, 22 nt, Salmonella typhimurium LT2
caggcccccuucaucguuuauu

SEQ ID NO: 1849043 - RNA, 19 nt, Salmonella typhimurium LT2
caggcccgauaagcgccgc

SEQ ID NO: 1849044 - RNA, 20 nt, Salmonella typhimurium LT2
caggcccgauaagcgccgcg

SEQ ID NO: 1849045 - RNA, 18 nt, Salmonella typhimurium LT2
caggcaaaaggccuuuuu

SEQ ID NO: 1849046 - RNA, 17 nt, Salmonella typhimurium LT2
caggcaaaucuggugau

SEQ ID NO: 1849047 - RNA, 17 nt, Salmonella typhimurium LT2
caggcaagacgcaugac

SEQ ID NO: 1849048 - RNA, 22 nt, Salmonella typhimurium LT2
caggcaagacacagcgucgcgc

SEQ ID NO: 1849049 - RNA, 14 nt, Salmonella typhimurium LT2
caggcaacguccug

SEQ ID NO: 1849050 - RNA, 15 nt, Salmonella typhimurium LT2
caggcaaauucuuug

SEQ ID NO: 1849051 - RNA, 16 nt, Salmonella typhimurium LT2
caggcaaaggaaugcu

SEQ ID NO: 1849052 - RNA, 17 nt, Salmonella typhimurium LT2
caggaugggcuucuuca

SEQ ID NO: 1849053 - RNA, 14 nt, Salmonella typhimurium LT2
caggauggcggcca

SEQ ID NO: 1849054 - RNA, 16 nt, Salmonella typhimurium LT2
caggauggcggccaaa

SEQ ID NO: 1849055 - RNA, 18 nt, Salmonella typhimurium LT2
caggcacagaagcgccug

SEQ ID NO: 1849056 - RNA, 19 nt, Salmonella typhimurium LT2
caggcacagaagcgccugu

SEQ ID NO: 1849057 - RNA, 14 nt, Salmonella typhimurium LT2
caggcaaucggcca

SEQ ID NO: 1849058 - RNA, 20 nt, Salmonella typhimurium LT2
caggcaauaaaaaaggcaga

SEQ ID NO: 1849059 - RNA, 23 nt, Salmonella typhimurium LT2
caggcaauauaccgucagcacca

SEQ ID NO: 1849060 - RNA, 13 nt, Salmonella typhimurium LT2
caggcaaggcauc

SEQ ID NO: 1849061 - RNA, 13 nt, Salmonella typhimurium LT2
caggcacgccugu

SEQ ID NO: 1849062 - RNA, 16 nt, Salmonella typhimurium LT2
caggcacgccggcaau

SEQ ID NO: 1849063 - RNA, 16 nt, Salmonella typhimurium LT2
caggcauaauggaacu

SEQ ID NO: 1849064 - RNA, 21 nt, Salmonella typhimurium LT2
caggcauaauggaacugccug

SEQ ID NO: 1849065 - RNA, 18 nt, Salmonella typhimurium LT2
caggcacaguagacaacc

SEQ ID NO: 1849066 - RNA, 20 nt, Salmonella typhimurium LT2
caggaaauccagcagaauaa

SEQ ID NO: 1849067 - RNA, 14 nt, Salmonella typhimurium LT2
caggaacagauacu

SEQ ID NO: 1849068 - RNA, 21 nt, Salmonella typhimurium LT2
caggaaauccagcagaauaac

SEQ ID NO: 1849069 - RNA, 19 nt, Salmonella typhimurium LT2
caggauacguucaucuucc

SEQ ID NO: 1849070 - RNA, 15 nt, Salmonella typhimurium LT2
caggauaauuucacc

SEQ ID NO: 1849071 - RNA, 19 nt, Salmonella typhimurium LT2
caggauaaaggccgggaaa

SEQ ID NO: 1849072 - RNA, 20 nt, Salmonella typhimurium LT2
caggaacagauacuggaagu

SEQ ID NO: 1849073 - RNA, 15 nt, Salmonella typhimurium LT2
caggaacaucagcau

SEQ ID NO: 1849074 - RNA, 19 nt, Salmonella typhimurium LT2
caggaacaucagcauuggu

SEQ ID NO: 1849075 - RNA, 16 nt, Salmonella typhimurium LT2
caggaucaccgccacg

SEQ ID NO: 1849076 - RNA, 18 nt, Salmonella typhimurium LT2
caggaugaaugacugucc

SEQ ID NO: 1849077 - RNA, 21 nt, Salmonella typhimurium LT2
caggcuuuaaauucagcaccc

SEQ ID NO: 1849078 - RNA, 16 nt, Salmonella typhimurium LT2
caggcuuuccacguuc

SEQ ID NO: 1849079 - RNA, 21 nt, Salmonella typhimurium LT2
caggcuuuucaggcugugacu

SEQ ID NO: 1849080 - RNA, 20 nt, Salmonella typhimurium LT2
caggcuuucuuugcggaaca

SEQ ID NO: 1849081 - RNA, 16 nt, Salmonella typhimurium LT2
caggcuguccaaccag

SEQ ID NO: 1849082 - RNA, 21 nt, Salmonella typhimurium LT2
caggcuugccaaagcgggcaa

SEQ ID NO: 1849083 - RNA, 21 nt, Salmonella typhimurium LT2
caggcuucgguugccugcguc

SEQ ID NO: 1849084 - RNA, 21 nt, Salmonella typhimurium LT2
caggcuucugauaagcgcagc

SEQ ID NO: 1849085 - RNA, 14 nt, Salmonella typhimurium LT2
caggcuggcaaagc

SEQ ID NO: 1849086 - RNA, 17 nt, Salmonella typhimurium LT2
caggcuggcgcagccgc

SEQ ID NO: 1849087 - RNA, 18 nt, Salmonella typhimurium LT2
caggcuggcgcagccgcu

SEQ ID NO: 1849088 - RNA, 16 nt, Salmonella typhimurium LT2
caggcgucauagccgc

SEQ ID NO: 1849089 - RNA, 22 nt, Salmonella typhimurium LT2
caggcgucauagccgcgcguca

SEQ ID NO: 1849090 - RNA, 21 nt, Salmonella typhimurium LT2
caggcgucaaaacaggucugu

SEQ ID NO: 1849091 - RNA, 21 nt, Salmonella typhimurium LT2
caggcgucacggcgacggcca

SEQ ID NO: 1849092 - RNA, 19 nt, Salmonella typhimurium LT2
caggcgucccggucggcgc

SEQ ID NO: 1849093 - RNA, 19 nt, Salmonella typhimurium LT2
caggcucgucguuugucca

SEQ ID NO: 1849094 - RNA, 18 nt, Salmonella typhimurium LT2
caggcguaagaucccagg

SEQ ID NO: 1849095 - RNA, 23 nt, Salmonella typhimurium LT2
caggcguaauacuucgcucucuu

SEQ ID NO: 1849096 - RNA, 17 nt, Salmonella typhimurium LT2
caggcguaagaucccag

SEQ ID NO: 1849097 - RNA, 20 nt, Salmonella typhimurium LT2
caggcggugcucuuuuguca

SEQ ID NO: 1849098 - RNA, 19 nt, Salmonella typhimurium LT2
caggcggaugaaacagucc

SEQ ID NO: 1849099 - RNA, 14 nt, Salmonella typhimurium LT2
caggcggcaugggu

SEQ ID NO: 1849100 - RNA, 19 nt, Salmonella typhimurium LT2
caggcgcaaacgcgugcug

SEQ ID NO: 1849101 - RNA, 14 nt, Salmonella typhimurium LT2
caggcgauggcgca

SEQ ID NO: 1849102 - RNA, 19 nt, Salmonella typhimurium LT2
caggcgauagccguccaug

SEQ ID NO: 1849103 - RNA, 18 nt, Salmonella typhimurium LT2
caggcgauccuguucaaa

SEQ ID NO: 1849104 - RNA, 17 nt, Salmonella typhimurium LT2
caggcgacgccgccauc

SEQ ID NO: 1849105 - RNA, 20 nt, Salmonella typhimurium LT2
caggcgacgaaccgcguaac

SEQ ID NO: 1849106 - RNA, 21 nt, Salmonella typhimurium LT2
caggcgacucauuacgccacg

SEQ ID NO: 1849107 - RNA, 13 nt, Salmonella typhimurium LT2
caggcgaaaucaa

SEQ ID NO: 1849108 - RNA, 16 nt, Salmonella typhimurium LT2
caggcgaaaucaaaag

SEQ ID NO: 1849109 - RNA, 14 nt, Salmonella typhimurium LT2
caggcgaaggagga

SEQ ID NO: 1849110 - RNA, 18 nt, Salmonella typhimurium LT2
caggcgaauagcgcgcua

SEQ ID NO: 1849111 - RNA, 13 nt, Salmonella typhimurium LT2
caggcgacgccgc

SEQ ID NO: 1849112 - RNA, 16 nt, Salmonella typhimurium LT2
caggcgacgccgccau

SEQ ID NO: 1849113 - RNA, 16 nt, Salmonella typhimurium LT2
caggcgaccgggcaga

SEQ ID NO: 1849114 - RNA, 16 nt, Salmonella typhimurium LT2
caggccuguaaaccgc

SEQ ID NO: 1849115 - RNA, 23 nt, Salmonella typhimurium LT2
caggccugugacguuaacgcagc

SEQ ID NO: 1849116 - RNA, 16 nt, Salmonella typhimurium LT2
caggccuguggugugu

SEQ ID NO: 1849117 - RNA, 19 nt, Salmonella typhimurium LT2
caggcccgguggcgccgcg

SEQ ID NO: 1849118 - RNA, 14 nt, Salmonella typhimurium LT2
caggcccggcaggc

SEQ ID NO: 1849119 - RNA, 17 nt, Salmonella typhimurium LT2
caguucauccacgcggg

SEQ ID NO: 1849120 - RNA, 21 nt, Salmonella typhimurium LT2
caguuccgcacgaacggucag

SEQ ID NO: 1849121 - RNA, 20 nt, Salmonella typhimurium LT2
caguuccgccagacucagcc

SEQ ID NO: 1849122 - RNA, 18 nt, Salmonella typhimurium LT2
caguucgccuucuucauc

SEQ ID NO: 1849123 - RNA, 20 nt, Salmonella typhimurium LT2
caguuaccgcacacgcaaaa

SEQ ID NO: 1849124 - RNA, 18 nt, Salmonella typhimurium LT2
caguuacguuugcagcgg

SEQ ID NO: 1849125 - RNA, 21 nt, Salmonella typhimurium LT2
caguuacguuugcagcggaag

SEQ ID NO: 1849126 - RNA, 16 nt, Salmonella typhimurium LT2
caguuagcgaaacagu

SEQ ID NO: 1849127 - RNA, 17 nt, Salmonella typhimurium LT2
caguuagcuucagcaaa

SEQ ID NO: 1849128 - RNA, 22 nt, Salmonella typhimurium LT2
caguuauuaaucaagcccagcu

SEQ ID NO: 1849129 - RNA, 23 nt, Salmonella typhimurium LT2
caguuauagcgcagauugaggcu

SEQ ID NO: 1849130 - RNA, 16 nt, Salmonella typhimurium LT2
caguucacgcgccgcc

SEQ ID NO: 1849131 - RNA, 20 nt, Salmonella typhimurium LT2
caguucacgcgccgccugca

SEQ ID NO: 1849132 - RNA, 21 nt, Salmonella typhimurium LT2
caguucaaugugcggagaaga

SEQ ID NO: 1849133 - RNA, 16 nt, Salmonella typhimurium LT2
caguucaaucagguua

SEQ ID NO: 1849134 - RNA, 14 nt, Salmonella typhimurium LT2
caguucagccgcca

SEQ ID NO: 1849135 - RNA, 23 nt, Salmonella typhimurium LT2
caguucagcagcaccacucccca

SEQ ID NO: 1849136 - RNA, 14 nt, Salmonella typhimurium LT2
caguucagaaacgg

SEQ ID NO: 1849137 - RNA, 15 nt, Salmonella typhimurium LT2
caguucauccagcag

SEQ ID NO: 1849138 - RNA, 17 nt, Salmonella typhimurium LT2
caguucauccagcagca

SEQ ID NO: 1849139 - RNA, 23 nt, Salmonella typhimurium LT2
caguucauauuugcuggcuugcu

SEQ ID NO: 1849140 - RNA, 17 nt, Salmonella typhimurium LT2
caguucauucgccacca

SEQ ID NO: 1849141 - RNA, 18 nt, Salmonella typhimurium LT2
cagugcggcaaccaccag

SEQ ID NO: 1849142 - RNA, 23 nt, Salmonella typhimurium LT2
cagugccgccagaaucaccucuu

SEQ ID NO: 1849143 - RNA, 19 nt, Salmonella typhimurium LT2
caguggcgcgccgcugucu

SEQ ID NO: 1849144 - RNA, 13 nt, Salmonella typhimurium LT2
cagugggaaaauu

SEQ ID NO: 1849145 - RNA, 19 nt, Salmonella typhimurium LT2
cagugauggauuucacaau

SEQ ID NO: 1849146 - RNA, 23 nt, Salmonella typhimurium LT2
cagugauggauuucacaaucauc

SEQ ID NO: 1849147 - RNA, 16 nt, Salmonella typhimurium LT2
cagugcaacagagagc

SEQ ID NO: 1849148 - RNA, 24 nt, Salmonella typhimurium LT2
cagugauuacaaaaugugcaauca

SEQ ID NO: 1849149 - RNA, 22 nt, Salmonella typhimurium LT2
caguccuccggcugaagcccca

SEQ ID NO: 1849150 - RNA, 16 nt, Salmonella typhimurium LT2
cagucccugaagaaaa

SEQ ID NO: 1849151 - RNA, 18 nt, Salmonella typhimurium LT2
cagucccuguucgccacc

SEQ ID NO: 1849152 - RNA, 19 nt, Salmonella typhimurium LT2
cagucccuguucgccaccc

SEQ ID NO: 1849153 - RNA, 16 nt, Salmonella typhimurium LT2
caguccgcacgccugc

SEQ ID NO: 1849154 - RNA, 19 nt, Salmonella typhimurium LT2
caguccgcgcgcuuuuuug

SEQ ID NO: 1849155 - RNA, 14 nt, Salmonella typhimurium LT2
cauaagcgcggcgg

SEQ ID NO: 1849156 - RNA, 16 nt, Salmonella typhimurium LT2
cauaagguacggcccg

SEQ ID NO: 1849157 - RNA, 14 nt, Salmonella typhimurium LT2
cauaagcacagaua

SEQ ID NO: 1849158 - RNA, 14 nt, Salmonella typhimurium LT2
cauaagcaauaggu

SEQ ID NO: 1849159 - RNA, 17 nt, Salmonella typhimurium LT2
cauaaaguagccaaugc

SEQ ID NO: 1849160 - RNA, 14 nt, Salmonella typhimurium LT2
cauaagaguccauu

SEQ ID NO: 1849161 - RNA, 17 nt, Salmonella typhimurium LT2
cauaauaaacugcaucc

SEQ ID NO: 1849162 - RNA, 14 nt, Salmonella typhimurium LT2
cauaauaaaaauac

SEQ ID NO: 1849163 - RNA, 23 nt, Salmonella typhimurium LT2
cauaauaagcgcucaggcagcca

SEQ ID NO: 1849164 - RNA, 14 nt, Salmonella typhimurium LT2
cauaauauccugca

SEQ ID NO: 1849165 - RNA, 14 nt, Salmonella typhimurium LT2
cauaaugcugccag

SEQ ID NO: 1849166 - RNA, 23 nt, Salmonella typhimurium LT2
cauaaugcugccagcaugauaau

SEQ ID NO: 1849167 - RNA, 12 nt, Salmonella typhimurium LT2
cauaaaaccauu

SEQ ID NO: 1849168 - RNA, 12 nt, Salmonella typhimurium LT2
cauaaaaaaacg

SEQ ID NO: 1849169 - RNA, 22 nt, Salmonella typhimurium LT2
caguuuuuucaguagccgccgc

SEQ ID NO: 1849170 - RNA, 13 nt, Salmonella typhimurium LT2
caguuuuuuccag

SEQ ID NO: 1849171 - RNA, 11 nt, Salmonella typhimurium LT2
caguuuuccuu

SEQ ID NO: 1849172 - RNA, 14 nt, Salmonella typhimurium LT2
caguuuuccagcgc

SEQ ID NO: 1849173 - RNA, 19 nt, Salmonella typhimurium LT2
caguuuuccagcgccucgu

SEQ ID NO: 1849174 - RNA, 15 nt, Salmonella typhimurium LT2
caguuuuuauaacua

SEQ ID NO: 1849175 - RNA, 12 nt, Salmonella typhimurium LT2
cauaaagcgaau

SEQ ID NO: 1849176 - RNA, 16 nt, Salmonella typhimurium LT2
cauaaagcgaauaauu

SEQ ID NO: 1849177 - RNA, 12 nt, Salmonella typhimurium LT2
cauaaagccuuu

SEQ ID NO: 1849178 - RNA, 16 nt, Salmonella typhimurium LT2
cauaaaauguuccaua

SEQ ID NO: 1849179 - RNA, 18 nt, Salmonella typhimurium LT2
caguuuguaaccaacaaa

SEQ ID NO: 1849180 - RNA, 13 nt, Salmonella typhimurium LT2
caguuugucauca

SEQ ID NO: 1849181 - RNA, 18 nt, Salmonella typhimurium LT2
caguuuucaauauucugu

SEQ ID NO: 1849182 - RNA, 16 nt, Salmonella typhimurium LT2
caguucguucugcguc

SEQ ID NO: 1849183 - RNA, 15 nt, Salmonella typhimurium LT2
caguucguaauuuaa

SEQ ID NO: 1849184 - RNA, 17 nt, Salmonella typhimurium LT2
caguucguacuccugca

SEQ ID NO: 1849185 - RNA, 14 nt, Salmonella typhimurium LT2
caguuucaucaucg

SEQ ID NO: 1849186 - RNA, 17 nt, Salmonella typhimurium LT2
caguuuaucugcgugau

SEQ ID NO: 1849187 - RNA, 19 nt, Salmonella typhimurium LT2
caguauuaagcauuacccc

SEQ ID NO: 1849188 - RNA, 21 nt, Salmonella typhimurium LT2
caguauucaccuggaaaggcu

SEQ ID NO: 1849189 - RNA, 12 nt, Salmonella typhimurium LT2
caguccagaugc

SEQ ID NO: 1849190 - RNA, 19 nt, Salmonella typhimurium LT2
caguccaccuguaaccgcu

SEQ ID NO: 1849191 - RNA, 19 nt, Salmonella typhimurium LT2
cagucccaaugcggaaacc

SEQ ID NO: 1849192 - RNA, 22 nt, Salmonella typhimurium LT2
cagucccaaugcggaaaccagu

SEQ ID NO: 1849193 - RNA, 21 nt, Salmonella typhimurium LT2
caguccccagcguaccacgcc

SEQ ID NO: 1849194 - RNA, 18 nt, Salmonella typhimurium LT2
caguacaauuucuggccc

SEQ ID NO: 1849195 - RNA, 21 nt, Salmonella typhimurium LT2
caguacaaacaaauaaaucca

SEQ ID NO: 1849196 - RNA, 23 nt, Salmonella typhimurium LT2
caguacaaacaaauaaauccaug

SEQ ID NO: 1849197 - RNA, 18 nt, Salmonella typhimurium LT2
caguacaaacgcaccgcc

SEQ ID NO: 1849198 - RNA, 23 nt, Salmonella typhimurium LT2
caguaauuuuucucccagcagac

SEQ ID NO: 1849199 - RNA, 17 nt, Salmonella typhimurium LT2
caguacaaacaaauaaa

SEQ ID NO: 1849200 - RNA, 21 nt, Salmonella typhimurium LT2
caguacgcccgugacgccagg

SEQ ID NO: 1849201 - RNA, 14 nt, Salmonella typhimurium LT2
caguacgccaaaaa

SEQ ID NO: 1849202 - RNA, 17 nt, Salmonella typhimurium LT2
caguacgcggccgccgc

SEQ ID NO: 1849203 - RNA, 23 nt, Salmonella typhimurium LT2
cagguugaggcggguaauuugcg

SEQ ID NO: 1849204 - RNA, 20 nt, Salmonella typhimurium LT2
cagguuacucuuccaccauu

SEQ ID NO: 1849205 - RNA, 19 nt, Salmonella typhimurium LT2
cagguuacgcacuacauca

SEQ ID NO: 1849206 - RNA, 17 nt, Salmonella typhimurium LT2
cagguuauuguugcuac

SEQ ID NO: 1849207 - RNA, 19 nt, Salmonella typhimurium LT2
cagguuaggcgcgauaaua

SEQ ID NO: 1849208 - RNA, 15 nt, Salmonella typhimurium LT2
caguaauccggcaac

SEQ ID NO: 1849209 - RNA, 22 nt, Salmonella typhimurium LT2
caguaauuuuucucccagcaga

SEQ ID NO: 1849210 - RNA, 13 nt, Salmonella typhimurium LT2
caguaauuuuucc

SEQ ID NO: 1849211 - RNA, 18 nt, Salmonella typhimurium LT2
caguaauuuuuccgccuc

SEQ ID NO: 1849212 - RNA, 17 nt, Salmonella typhimurium LT2
caguaauaugaauugau

SEQ ID NO: 1849213 - RNA, 15 nt, Salmonella typhimurium LT2
caguaacgcgcccca

SEQ ID NO: 1849214 - RNA, 15 nt, Salmonella typhimurium LT2
caguaacgcguccaa

SEQ ID NO: 1849215 - RNA, 16 nt, Salmonella typhimurium LT2
caguaaccgccacagc

SEQ ID NO: 1849216 - RNA, 18 nt, Salmonella typhimurium LT2
caguaaccgccacagcau

SEQ ID NO: 1849217 - RNA, 22 nt, Salmonella typhimurium LT2
cagguuuacguagcagcgcgcg

SEQ ID NO: 1849218 - RNA, 23 nt, Salmonella typhimurium LT2
cagguuucaucgccgauuccugc

SEQ ID NO: 1849219 - RNA, 19 nt, Salmonella typhimurium LT2
cagguuuaaacgaacgaga

SEQ ID NO: 1849220 - RNA, 14 nt, Salmonella typhimurium LT2
caggucgccgaugu

SEQ ID NO: 1849221 - RNA, 15 nt, Salmonella typhimurium LT2
caggucgaugauuuu

SEQ ID NO: 1849222 - RNA, 16 nt, Salmonella typhimurium LT2
caggucugaugagcgc

SEQ ID NO: 1849223 - RNA, 15 nt, Salmonella typhimurium LT2
caggucuccgcccag

SEQ ID NO: 1849224 - RNA, 21 nt, Salmonella typhimurium LT2
caggucguccguugccaccca

SEQ ID NO: 1849225 - RNA, 16 nt, Salmonella typhimurium LT2
caggugaguaaauaaa

SEQ ID NO: 1849226 - RNA, 17 nt, Salmonella typhimurium LT2
caggugaguaaauaaaa

SEQ ID NO: 1849227 - RNA, 17 nt, Salmonella typhimurium LT2
caggugaucuguucaaa

SEQ ID NO: 1849228 - RNA, 20 nt, Salmonella typhimurium LT2
cagguauuuagccacgccgu

SEQ ID NO: 1849229 - RNA, 15 nt, Salmonella typhimurium LT2
cagguauucguuaaa

SEQ ID NO: 1849230 - RNA, 19 nt, Salmonella typhimurium LT2
caggucaacuccccgcccc

SEQ ID NO: 1849231 - RNA, 17 nt, Salmonella typhimurium LT2
caggucaucggccugcu

SEQ ID NO: 1849232 - RNA, 18 nt, Salmonella typhimurium LT2
caggucaucggccugcuu

SEQ ID NO: 1849233 - RNA, 14 nt, Salmonella typhimurium LT2
caggucaugcagga

SEQ ID NO: 1849234 - RNA, 13 nt, Salmonella typhimurium LT2
cagguauuaaaua

SEQ ID NO: 1849235 - RNA, 16 nt, Salmonella typhimurium LT2
cagguauuaaauacag

SEQ ID NO: 1849236 - RNA, 21 nt, Salmonella typhimurium LT2
cagguaguuaccguauucugc

SEQ ID NO: 1849237 - RNA, 23 nt, Salmonella typhimurium LT2
cagguacuuacgcagccggucag

SEQ ID NO: 1849238 - RNA, 17 nt, Salmonella typhimurium LT2
cagguaccccgccaccg

SEQ ID NO: 1849239 - RNA, 20 nt, Salmonella typhimurium LT2
cagguaccccgccaccgccg

SEQ ID NO: 1849240 - RNA, 22 nt, Salmonella typhimurium LT2
cagguacgcguuucacaaccuc

SEQ ID NO: 1849241 - RNA, 21 nt, Salmonella typhimurium LT2
cagguaccccagccauauuuc

SEQ ID NO: 1849242 - RNA, 13 nt, Salmonella typhimurium LT2
cagguaagcccuu

SEQ ID NO: 1849243 - RNA, 20 nt, Salmonella typhimurium LT2
cagguaagcccuuacaaaaa

SEQ ID NO: 1849244 - RNA, 19 nt, Salmonella typhimurium LT2
cagggauuuugcuuuuucg

SEQ ID NO: 1849245 - RNA, 20 nt, Salmonella typhimurium LT2
ccaaaauccagggaaaccau

SEQ ID NO: 1849246 - RNA, 17 nt, Salmonella typhimurium LT2
ccaaaaugcggcauccg

SEQ ID NO: 1849247 - RNA, 23 nt, Salmonella typhimurium LT2
ccaaaauggcaaguaaaauaacc

SEQ ID NO: 1849248 - RNA, 22 nt, Salmonella typhimurium LT2
ccaaaccacugauggaguuuca

SEQ ID NO: 1849249 - RNA, 20 nt, Salmonella typhimurium LT2
ccaaaccugagcauauaaau

SEQ ID NO: 1849250 - RNA, 19 nt, Salmonella typhimurium LT2
ccaaacaucgcucgcgcca

SEQ ID NO: 1849251 - RNA, 14 nt, Salmonella typhimurium LT2
ccaaaaauaaaagg

SEQ ID NO: 1849252 - RNA, 16 nt, Salmonella typhimurium LT2
cauuucugccugcuuc

SEQ ID NO: 1849253 - RNA, 18 nt, Salmonella typhimurium LT2
ccaaagcccgcaaacaga

SEQ ID NO: 1849254 - RNA, 17 nt, Salmonella typhimurium LT2
ccaaagcgcugcugcuc

SEQ ID NO: 1849255 - RNA, 15 nt, Salmonella typhimurium LT2
ccaaagcgcugcugc

SEQ ID NO: 1849256 - RNA, 19 nt, Salmonella typhimurium LT2
ccaaagggagcagacugua

SEQ ID NO: 1849257 - RNA, 17 nt, Salmonella typhimurium LT2
ccaaagcgguaauuaau

SEQ ID NO: 1849258 - RNA, 15 nt, Salmonella typhimurium LT2
ccaaagcguaaacag

SEQ ID NO: 1849259 - RNA, 14 nt, Salmonella typhimurium LT2
ccaaagcagcugcu

SEQ ID NO: 1849260 - RNA, 23 nt, Salmonella typhimurium LT2
ccaaagcaccauucuucaacaau

SEQ ID NO: 1849261 - RNA, 19 nt, Salmonella typhimurium LT2
ccaaagcaaucgccagcgc

SEQ ID NO: 1849262 - RNA, 23 nt, Salmonella typhimurium LT2
ccaaacugcggaauuuuauccug

SEQ ID NO: 1849263 - RNA, 19 nt, Salmonella typhimurium LT2
ccaaagauaaacgacagcg

SEQ ID NO: 1849264 - RNA, 20 nt, Salmonella typhimurium LT2
ccaaauaaaagccgccaugu

SEQ ID NO: 1849265 - RNA, 23 nt, Salmonella typhimurium LT2
ccaaauaaucccgcauauuuuuc

SEQ ID NO: 1849266 - RNA, 20 nt, Salmonella typhimurium LT2
ccaaauaguccagcagccau

SEQ ID NO: 1849267 - RNA, 12 nt, Salmonella typhimurium LT2
ccaaauauuucu

SEQ ID NO: 1849268 - RNA, 14 nt, Salmonella typhimurium LT2
ccaacgccaacaua

SEQ ID NO: 1849269 - RNA, 21 nt, Salmonella typhimurium LT2
ccaacgccaaccggcugacgu

SEQ ID NO: 1849270 - RNA, 15 nt, Salmonella typhimurium LT2
ccaacgcagucaaaa

SEQ ID NO: 1849271 - RNA, 13 nt, Salmonella typhimurium LT2
ccaacgcaaugcg

SEQ ID NO: 1849272 - RNA, 15 nt, Salmonella typhimurium LT2
ccaacgcccaacugu

SEQ ID NO: 1849273 - RNA, 12 nt, Salmonella typhimurium LT2
ccaacgccgccc

SEQ ID NO: 1849274 - RNA, 17 nt, Salmonella typhimurium LT2
ccaacgauauucgcugg

SEQ ID NO: 1849275 - RNA, 16 nt, Salmonella typhimurium LT2
ccaaccguuuugcaau

SEQ ID NO: 1849276 - RNA, 18 nt, Salmonella typhimurium LT2
ccaaccguuuugcaaugc

SEQ ID NO: 1849277 - RNA, 22 nt, Salmonella typhimurium LT2
ccaacggcgacgcccgccaucu

SEQ ID NO: 1849278 - RNA, 12 nt, Salmonella typhimurium LT2
ccaacguugugc

SEQ ID NO: 1849279 - RNA, 24 nt, Salmonella typhimurium LT2
ccaacuuuacuuaguaucauauuu

SEQ ID NO: 1849280 - RNA, 21 nt, Salmonella typhimurium LT2
ccaagaaacgcaguugccccu

SEQ ID NO: 1849281 - RNA, 17 nt, Salmonella typhimurium LT2
ccaacuuaugaaaaccu

SEQ ID NO: 1849282 - RNA, 17 nt, Salmonella typhimurium LT2
ccaacugcgccugaaga

SEQ ID NO: 1849283 - RNA, 16 nt, Salmonella typhimurium LT2
ccaacugccaaaccac

SEQ ID NO: 1849284 - RNA, 14 nt, Salmonella typhimurium LT2
ccaacugccagcgg

SEQ ID NO: 1849285 - RNA, 21 nt, Salmonella typhimurium LT2
ccaacguugaagagcuacucu

SEQ ID NO: 1849286 - RNA, 14 nt, Salmonella typhimurium LT2
ccaacaacccauuc

SEQ ID NO: 1849287 - RNA, 15 nt, Salmonella typhimurium LT2
ccaacaaaguggauu

SEQ ID NO: 1849288 - RNA, 17 nt, Salmonella typhimurium LT2
ccaaauuacgcacacuu

SEQ ID NO: 1849289 - RNA, 19 nt, Salmonella typhimurium LT2
ccaacaaugccacgccccu

SEQ ID NO: 1849290 - RNA, 20 nt, Salmonella typhimurium LT2
ccaacaaugccacgccccua

SEQ ID NO: 1849291 - RNA, 18 nt, Salmonella typhimurium LT2
ccaacagcaauguuucaa

SEQ ID NO: 1849292 - RNA, 17 nt, Salmonella typhimurium LT2
ccaacagaagauccuca

SEQ ID NO: 1849293 - RNA, 18 nt, Salmonella typhimurium LT2
ccaacacggcgcucagga

SEQ ID NO: 1849294 - RNA, 23 nt, Salmonella typhimurium LT2
ccaaccgcgacggggcgcagaaa

SEQ ID NO: 1849295 - RNA, 15 nt, Salmonella typhimurium LT2
ccaaccgaacaauau

SEQ ID NO: 1849296 - RNA, 17 nt, Salmonella typhimurium LT2
ccaacaucaugucccca

SEQ ID NO: 1849297 - RNA, 21 nt, Salmonella typhimurium LT2
ccaacagggcggccuccuggc

SEQ ID NO: 1849298 - RNA, 15 nt, Salmonella typhimurium LT2
ccaacaguauagaaa

SEQ ID NO: 1849299 - RNA, 22 nt, Salmonella typhimurium LT2
ccaaggcaaaguaucccuuccu

SEQ ID NO: 1849300 - RNA, 14 nt, Salmonella typhimurium LT2
ccaagcacaaaaag

SEQ ID NO: 1849301 - RNA, 16 nt, Salmonella typhimurium LT2
ccaagcaggaaccccu

SEQ ID NO: 1849302 - RNA, 14 nt, Salmonella typhimurium LT2
ccaagcggcaauaa

SEQ ID NO: 1849303 - RNA, 16 nt, Salmonella typhimurium LT2
ccaagcgccucgcuga

SEQ ID NO: 1849304 - RNA, 17 nt, Salmonella typhimurium LT2
ccaagcgucagcauggu

SEQ ID NO: 1849305 - RNA, 15 nt, Salmonella typhimurium LT2
ccaagcguaguacgu

SEQ ID NO: 1849306 - RNA, 21 nt, Salmonella typhimurium LT2
ccaagauaagaaguaaacaga

SEQ ID NO: 1849307 - RNA, 14 nt, Salmonella typhimurium LT2
ccaagauccagcgg

SEQ ID NO: 1849308 - RNA, 21 nt, Salmonella typhimurium LT2
ccaagaucgccaagcugugau

SEQ ID NO: 1849309 - RNA, 21 nt, Salmonella typhimurium LT2
ccaagaucggagauauaaacc

SEQ ID NO: 1849310 - RNA, 14 nt, Salmonella typhimurium LT2
ccaaucugacacag

SEQ ID NO: 1849311 - RNA, 19 nt, Salmonella typhimurium LT2
ccaaucgagaagccaucaa

SEQ ID NO: 1849312 - RNA, 17 nt, Salmonella typhimurium LT2
ccaaucagcggguauug

SEQ ID NO: 1849313 - RNA, 17 nt, Salmonella typhimurium LT2
ccaaucaacgccgccag

SEQ ID NO: 1849314 - RNA, 16 nt, Salmonella typhimurium LT2
ccaaucaacgccgcca

SEQ ID NO: 1849315 - RNA, 19 nt, Salmonella typhimurium LT2
ccaauauuaauguauuauu

SEQ ID NO: 1849316 - RNA, 19 nt, Salmonella typhimurium LT2
ccaauaaugccgccgucgc

SEQ ID NO: 1849317 - RNA, 12 nt, Salmonella typhimurium LT2
ccaauacccagc

SEQ ID NO: 1849318 - RNA, 13 nt, Salmonella typhimurium LT2
ccacacugcugug

SEQ ID NO: 1849319 - RNA, 21 nt, Salmonella typhimurium LT2
ccacaccugaugguuauuuuc

SEQ ID NO: 1849320 - RNA, 20 nt, Salmonella typhimurium LT2
ccacaccgguucgcggcaga

SEQ ID NO: 1849321 - RNA, 22 nt, Salmonella typhimurium LT2
ccacaauguugauggcgcugcc

SEQ ID NO: 1849322 - RNA, 22 nt, Salmonella typhimurium LT2
ccacagcauaccgugugcagug

SEQ ID NO: 1849323 - RNA, 17 nt, Salmonella typhimurium LT2
ccacagccgcauuuuuu

SEQ ID NO: 1849324 - RNA, 20 nt, Salmonella typhimurium LT2
ccacagccgcauuuuuucuu

SEQ ID NO: 1849325 - RNA, 23 nt, Salmonella typhimurium LT2
ccacaggaccacguucccgauuc

SEQ ID NO: 1849326 - RNA, 17 nt, Salmonella typhimurium LT2
ccacagcgccagacacu

SEQ ID NO: 1849327 - RNA, 22 nt, Salmonella typhimurium LT2
ccacagguaaaauugccgccaa

SEQ ID NO: 1849328 - RNA, 9 nt, Salmonella typhimurium LT2
ccacaggcu

SEQ ID NO: 1849329 - RNA, 23 nt, Salmonella typhimurium LT2
ccacaggaaccgguagccaggcg

SEQ ID NO: 1849330 - RNA, 18 nt, Salmonella typhimurium LT2
ccacaggaucaccgccac

SEQ ID NO: 1849331 - RNA, 16 nt, Salmonella typhimurium LT2
ccacaggccaacauag

SEQ ID NO: 1849332 - RNA, 15 nt, Salmonella typhimurium LT2
ccacaggccaacaua

SEQ ID NO: 1849333 - RNA, 21 nt, Salmonella typhimurium LT2
ccacaggccguucauucgccc

SEQ ID NO: 1849334 - RNA, 17 nt, Salmonella typhimurium LT2
ccaauguacacgaaaua

SEQ ID NO: 1849335 - RNA, 22 nt, Salmonella typhimurium LT2
ccaaugcuuagucagccuuaau

SEQ ID NO: 1849336 - RNA, 14 nt, Salmonella typhimurium LT2
ccaaugcgaaaaua

SEQ ID NO: 1849337 - RNA, 16 nt, Salmonella typhimurium LT2
ccaauucccagacccg

SEQ ID NO: 1849338 - RNA, 22 nt, Salmonella typhimurium LT2
ccacaagagcagcaacccugcc

SEQ ID NO: 1849339 - RNA, 19 nt, Salmonella typhimurium LT2
ccacaauggcaggcagcag

SEQ ID NO: 1849340 - RNA, 18 nt, Salmonella typhimurium LT2
ccacaauugccagcaggu

SEQ ID NO: 1849341 - RNA, 14 nt, Salmonella typhimurium LT2
ccacaagcugugcc

SEQ ID NO: 1849342 - RNA, 21 nt, Salmonella typhimurium LT2
ccaauugccacauagcaucca

SEQ ID NO: 1849343 - RNA, 21 nt, Salmonella typhimurium LT2
ccacaaauuuugauaaaaaca

SEQ ID NO: 1849344 - RNA, 14 nt, Salmonella typhimurium LT2
ccacaaauuuugau

SEQ ID NO: 1849345 - RNA, 16 nt, Salmonella typhimurium LT2
ccaccaugcugguugg

SEQ ID NO: 1849346 - RNA, 13 nt, Salmonella typhimurium LT2
ccaccccacagca

SEQ ID NO: 1849347 - RNA, 21 nt, Salmonella typhimurium LT2
ccaccaucuccugacugccgc

SEQ ID NO: 1849348 - RNA, 17 nt, Salmonella typhimurium LT2
ccaccaucagacccgau

SEQ ID NO: 1849349 - RNA, 15 nt, Salmonella typhimurium LT2
ccaccauaggccagc

SEQ ID NO: 1849350 - RNA, 14 nt, Salmonella typhimurium LT2
ccaccauaguuucg

SEQ ID NO: 1849351 - RNA, 22 nt, Salmonella typhimurium LT2
ccaccauaucgcagaccaucca

SEQ ID NO: 1849352 - RNA, 15 nt, Salmonella typhimurium LT2
ccaccagguucagca

SEQ ID NO: 1849353 - RNA, 21 nt, Salmonella typhimurium LT2
ccaccagcgguuggaucucac

SEQ ID NO: 1849354 - RNA, 16 nt, Salmonella typhimurium LT2
ccaccagcuuaucuga

SEQ ID NO: 1849355 - RNA, 18 nt, Salmonella typhimurium LT2
ccaccagcgccagcgacu

SEQ ID NO: 1849356 - RNA, 12 nt, Salmonella typhimurium LT2
ccaccagcgcca

SEQ ID NO: 1849357 - RNA, 23 nt, Salmonella typhimurium LT2
ccaccagccgauaacucuucauc

SEQ ID NO: 1849358 - RNA, 23 nt, Salmonella typhimurium LT2
ccaccagcccaucuuucgccagc

SEQ ID NO: 1849359 - RNA, 18 nt, Salmonella typhimurium LT2
ccaccagccuaaaaacag

SEQ ID NO: 1849360 - RNA, 18 nt, Salmonella typhimurium LT2
ccaccacguaaugcgccc

SEQ ID NO: 1849361 - RNA, 12 nt, Salmonella typhimurium LT2
ccaccagaaccu

SEQ ID NO: 1849362 - RNA, 23 nt, Salmonella typhimurium LT2
ccacaugccggugcgagaaaaag

SEQ ID NO: 1849363 - RNA, 17 nt, Salmonella typhimurium LT2
ccacaucguuacccauc

SEQ ID NO: 1849364 - RNA, 13 nt, Salmonella typhimurium LT2
ccacaugaccagc

SEQ ID NO: 1849365 - RNA, 22 nt, Salmonella typhimurium LT2
ccacaguugguucugcucaaug

SEQ ID NO: 1849366 - RNA, 19 nt, Salmonella typhimurium LT2
ccacauauaaguaacuggu

SEQ ID NO: 1849367 - RNA, 22 nt, Salmonella typhimurium LT2
ccacaucagaccgccaagcgcg

SEQ ID NO: 1849368 - RNA, 22 nt, Salmonella typhimurium LT2
ccacauauugagcugauaacgu

SEQ ID NO: 1849369 - RNA, 15 nt, Salmonella typhimurium LT2
ccacauugaccccau

SEQ ID NO: 1849370 - RNA, 16 nt, Salmonella typhimurium LT2
ccacauuccagaccug

SEQ ID NO: 1849371 - RNA, 11 nt, Salmonella typhimurium LT2
ccacauuucaa

SEQ ID NO: 1849372 - RNA, 21 nt, Salmonella typhimurium LT2
ccaccacccagugccaccagc

SEQ ID NO: 1849373 - RNA, 11 nt, Salmonella typhimurium LT2
ccaccaccauc

SEQ ID NO: 1849374 - RNA, 11 nt, Salmonella typhimurium LT2
ccaccacaaac

SEQ ID NO: 1849375 - RNA, 14 nt, Salmonella typhimurium LT2
ccaccaccuccugc

SEQ ID NO: 1849376 - RNA, 17 nt, Salmonella typhimurium LT2
ccacgauaaccagaccc

SEQ ID NO: 1849377 - RNA, 23 nt, Salmonella typhimurium LT2
ccacgauaaucccggcuuucucc

SEQ ID NO: 1849378 - RNA, 16 nt, Salmonella typhimurium LT2
ccacgaaagucuguuc

SEQ ID NO: 1849379 - RNA, 17 nt, Salmonella typhimurium LT2
ccacgaacaguucgguc

SEQ ID NO: 1849380 - RNA, 23 nt, Salmonella typhimurium LT2
ccaccuuugaaaaucacaucgcc

SEQ ID NO: 1849381 - RNA, 17 nt, Salmonella typhimurium LT2
ccaccuuugacgccugc

SEQ ID NO: 1849382 - RNA, 21 nt, Salmonella typhimurium LT2
ccaccuuaaucgacuucaugc

SEQ ID NO: 1849383 - RNA, 19 nt, Salmonella typhimurium LT2
ccaccuucucuuuaugcgu

SEQ ID NO: 1849384 - RNA, 13 nt, Salmonella typhimurium LT2
ccaccuuccaggg

SEQ ID NO: 1849385 - RNA, 11 nt, Salmonella typhimurium LT2
ccaccgaauuc

SEQ ID NO: 1849386 - RNA, 23 nt, Salmonella typhimurium LT2
ccacccuacaucuccuuaacaca

SEQ ID NO: 1849387 - RNA, 21 nt, Salmonella typhimurium LT2
ccaccguaugugcgccgugca

SEQ ID NO: 1849388 - RNA, 13 nt, Salmonella typhimurium LT2
ccaccguauuuuu

SEQ ID NO: 1849389 - RNA, 21 nt, Salmonella typhimurium LT2
ccaccgguuuuuuccugcaca

SEQ ID NO: 1849390 - RNA, 15 nt, Salmonella typhimurium LT2
ccaccguaacuaaaa

SEQ ID NO: 1849391 - RNA, 14 nt, Salmonella typhimurium LT2
ccaccgucuugcug

SEQ ID NO: 1849392 - RNA, 19 nt, Salmonella typhimurium LT2
ccacggauggccucugcca

SEQ ID NO: 1849393 - RNA, 22 nt, Salmonella typhimurium LT2
ccacgcugauacguaacaugac

SEQ ID NO: 1849394 - RNA, 14 nt, Salmonella typhimurium LT2
ccacgcuuuuccuu

SEQ ID NO: 1849395 - RNA, 19 nt, Salmonella typhimurium LT2
ccacgcuuuuuaccggcga

SEQ ID NO: 1849396 - RNA, 15 nt, Salmonella typhimurium LT2
ccacgccaccgccgc

SEQ ID NO: 1849397 - RNA, 18 nt, Salmonella typhimurium LT2
ccacgccaccgccgccac

SEQ ID NO: 1849398 - RNA, 17 nt, Salmonella typhimurium LT2
ccacgccagccagccag

SEQ ID NO: 1849399 - RNA, 18 nt, Salmonella typhimurium LT2
ccacgccagccagccagu

SEQ ID NO: 1849400 - RNA, 13 nt, Salmonella typhimurium LT2
ccacgcccgccgc

SEQ ID NO: 1849401 - RNA, 15 nt, Salmonella typhimurium LT2
ccacgguguaccccg

SEQ ID NO: 1849402 - RNA, 20 nt, Salmonella typhimurium LT2
ccacgguaauuuacaaccgu

SEQ ID NO: 1849403 - RNA, 18 nt, Salmonella typhimurium LT2
ccacggcauguucugccg

SEQ ID NO: 1849404 - RNA, 21 nt, Salmonella typhimurium LT2
ccagcagccaugccagcgcgg

SEQ ID NO: 1849405 - RNA, 18 nt, Salmonella typhimurium LT2
ccagcaucaauagcagcu

SEQ ID NO: 1849406 - RNA, 20 nt, Salmonella typhimurium LT2
ccagcauauuaacagugagu

SEQ ID NO: 1849407 - RNA, 22 nt, Salmonella typhimurium LT2
ccagcagcgccaguuuuucccg

SEQ ID NO: 1849408 - RNA, 15 nt, Salmonella typhimurium LT2
ccagcagcgcggcgu

SEQ ID NO: 1849409 - RNA, 22 nt, Salmonella typhimurium LT2
ccagcauggcgucggcgacuuu

SEQ ID NO: 1849410 - RNA, 20 nt, Salmonella typhimurium LT2
ccagcauggucuccagcaaa

SEQ ID NO: 1849411 - RNA, 16 nt, Salmonella typhimurium LT2
ccagcaugagccagcc

SEQ ID NO: 1849412 - RNA, 17 nt, Salmonella typhimurium LT2
ccagcaugagccagccc

SEQ ID NO: 1849413 - RNA, 21 nt, Salmonella typhimurium LT2
ccagcaucgguagaaugaaug

SEQ ID NO: 1849414 - RNA, 17 nt, Salmonella typhimurium LT2
ccagcaucgaccaggau

SEQ ID NO: 1849415 - RNA, 13 nt, Salmonella typhimurium LT2
ccagcaucgacca

SEQ ID NO: 1849416 - RNA, 13 nt, Salmonella typhimurium LT2
ccagccccagccc

SEQ ID NO: 1849417 - RNA, 14 nt, Salmonella typhimurium LT2
ccagccccagcccu

SEQ ID NO: 1849418 - RNA, 17 nt, Salmonella typhimurium LT2
ccagccauaaaugcuga

SEQ ID NO: 1849419 - RNA, 22 nt, Salmonella typhimurium LT2
ccagccaguccgugugcggcgu

SEQ ID NO: 1849420 - RNA, 21 nt, Salmonella typhimurium LT2
ccagccaguuagcgaccgcgc

SEQ ID NO: 1849421 - RNA, 9 nt, Salmonella typhimurium LT2
ccagccaaa

SEQ ID NO: 1849422 - RNA, 15 nt, Salmonella typhimurium LT2
ccagcauuaccagca

SEQ ID NO: 1849423 - RNA, 18 nt, Salmonella typhimurium LT2
ccagccacaagagcagca

SEQ ID NO: 1849424 - RNA, 15 nt, Salmonella typhimurium LT2
ccagcaccaucuuuu

SEQ ID NO: 1849425 - RNA, 13 nt, Salmonella typhimurium LT2
ccagcaccaggcg

SEQ ID NO: 1849426 - RNA, 19 nt, Salmonella typhimurium LT2
ccagcaaugcacugcgaaa

SEQ ID NO: 1849427 - RNA, 18 nt, Salmonella typhimurium LT2
ccagcaaugccgccgcca

SEQ ID NO: 1849428 - RNA, 13 nt, Salmonella typhimurium LT2
ccagcaccauggc

SEQ ID NO: 1849429 - RNA, 14 nt, Salmonella typhimurium LT2
ccagcaccauggcu

SEQ ID NO: 1849430 - RNA, 19 nt, Salmonella typhimurium LT2
ccagcacuaacagcagcaa

SEQ ID NO: 1849431 - RNA, 19 nt, Salmonella typhimurium LT2
ccagcaaggcugccgccag

SEQ ID NO: 1849432 - RNA, 16 nt, Salmonella typhimurium LT2
ccagcaauaacaggca

SEQ ID NO: 1849433 - RNA, 15 nt, Salmonella typhimurium LT2
ccagcaauaacacag

SEQ ID NO: 1849434 - RNA, 22 nt, Salmonella typhimurium LT2
ccagcaauaacacaggcggcgc

SEQ ID NO: 1849435 - RNA, 16 nt, Salmonella typhimurium LT2
ccagcaacugaccauc

SEQ ID NO: 1849436 - RNA, 13 nt, Salmonella typhimurium LT2
ccagcaacgccag

SEQ ID NO: 1849437 - RNA, 13 nt, Salmonella typhimurium LT2
ccagcaacgccgc

SEQ ID NO: 1849438 - RNA, 22 nt, Salmonella typhimurium LT2
ccagcaacguauuccacggaau

SEQ ID NO: 1849439 - RNA, 16 nt, Salmonella typhimurium LT2
ccagaucuucccaguu

SEQ ID NO: 1849440 - RNA, 15 nt, Salmonella typhimurium LT2
ccagaucucacaaga

SEQ ID NO: 1849441 - RNA, 17 nt, Salmonella typhimurium LT2
ccagaucucacaagauu

SEQ ID NO: 1849442 - RNA, 18 nt, Salmonella typhimurium LT2
ccagcaacgagccgucgc

SEQ ID NO: 1849443 - RNA, 17 nt, Salmonella typhimurium LT2
ccagcaacccaccugcc

SEQ ID NO: 1849444 - RNA, 23 nt, Salmonella typhimurium LT2
ccagaugacacuaucuccuuccg

SEQ ID NO: 1849445 - RNA, 18 nt, Salmonella typhimurium LT2
ccagacagucgccgcuuc

SEQ ID NO: 1849446 - RNA, 19 nt, Salmonella typhimurium LT2
ccagacagauaacaccagc

SEQ ID NO: 1849447 - RNA, 18 nt, Salmonella typhimurium LT2
ccagacagauaacaccag

SEQ ID NO: 1849448 - RNA, 21 nt, Salmonella typhimurium LT2
ccagaccggauugcccgcggc

SEQ ID NO: 1849449 - RNA, 19 nt, Salmonella typhimurium LT2
ccagaccauucaaccagcc

SEQ ID NO: 1849450 - RNA, 19 nt, Salmonella typhimurium LT2
ccagacccgauaguguaaa

SEQ ID NO: 1849451 - RNA, 23 nt, Salmonella typhimurium LT2
ccagaccaccgggacugguggca

SEQ ID NO: 1849452 - RNA, 20 nt, Salmonella typhimurium LT2
ccagaccguagauaagcgcc

SEQ ID NO: 1849453 - RNA, 18 nt, Salmonella typhimurium LT2
ccagaccguaugccagcc

SEQ ID NO: 1849454 - RNA, 23 nt, Salmonella typhimurium LT2
ccagaccugaauauucggcucca

SEQ ID NO: 1849455 - RNA, 14 nt, Salmonella typhimurium LT2
ccagacgaauaauc

SEQ ID NO: 1849456 - RNA, 22 nt, Salmonella typhimurium LT2
ccagacggcgcccagccugccc

SEQ ID NO: 1849457 - RNA, 17 nt, Salmonella typhimurium LT2
ccagacgcguaaccccu

SEQ ID NO: 1849458 - RNA, 14 nt, Salmonella typhimurium LT2
ccagacgccgcgcc

SEQ ID NO: 1849459 - RNA, 17 nt, Salmonella typhimurium LT2
ccagagcgcgcuggcaa

SEQ ID NO: 1849460 - RNA, 18 nt, Salmonella typhimurium LT2
ccagagcgcggccuuugc

SEQ ID NO: 1849461 - RNA, 21 nt, Salmonella typhimurium LT2
ccagagcaagcucuguucaaa

SEQ ID NO: 1849462 - RNA, 15 nt, Salmonella typhimurium LT2
ccagagucaccagca

SEQ ID NO: 1849463 - RNA, 19 nt, Salmonella typhimurium LT2
ccagaggguaauuucuucc

SEQ ID NO: 1849464 - RNA, 22 nt, Salmonella typhimurium LT2
ccagacugagcaaacucaauga

SEQ ID NO: 1849465 - RNA, 16 nt, Salmonella typhimurium LT2
ccagacucagccaggu

SEQ ID NO: 1849466 - RNA, 13 nt, Salmonella typhimurium LT2
ccagacuaaucca

SEQ ID NO: 1849467 - RNA, 16 nt, Salmonella typhimurium LT2
ccagacgguuuauccc

SEQ ID NO: 1849468 - RNA, 20 nt, Salmonella typhimurium LT2
ccagacgguuuauccccgcu

SEQ ID NO: 1849469 - RNA, 16 nt, Salmonella typhimurium LT2
ccagacugugauggcg

SEQ ID NO: 1849470 - RNA, 18 nt, Salmonella typhimurium LT2
ccacgugcggacguagcg

SEQ ID NO: 1849471 - RNA, 12 nt, Salmonella typhimurium LT2
ccacuuugcgcu

SEQ ID NO: 1849472 - RNA, 16 nt, Salmonella typhimurium LT2
ccagaaaaagggaaaa

SEQ ID NO: 1849473 - RNA, 16 nt, Salmonella typhimurium LT2
ccagaaaaaaaagcgc

SEQ ID NO: 1849474 - RNA, 20 nt, Salmonella typhimurium LT2
ccagaaaaccgacagcaaua

SEQ ID NO: 1849475 - RNA, 21 nt, Salmonella typhimurium LT2
ccacuuucucggcuuuccagc

SEQ ID NO: 1849476 - RNA, 15 nt, Salmonella typhimurium LT2
ccacuuugggccgaa

SEQ ID NO: 1849477 - RNA, 13 nt, Salmonella typhimurium LT2
ccacuuugcgcuc

SEQ ID NO: 1849478 - RNA, 12 nt, Salmonella typhimurium LT2
ccagaagaaaau

SEQ ID NO: 1849479 - RNA, 21 nt, Salmonella typhimurium LT2
ccagaacugcgaaaucaccga

SEQ ID NO: 1849480 - RNA, 13 nt, Salmonella typhimurium LT2
ccagaacugcgua

SEQ ID NO: 1849481 - RNA, 17 nt, Salmonella typhimurium LT2
ccagaagcacuucucca

SEQ ID NO: 1849482 - RNA, 14 nt, Salmonella typhimurium LT2
ccagaacucaucuu

SEQ ID NO: 1849483 - RNA, 15 nt, Salmonella typhimurium LT2
ccagaaagaucagca

SEQ ID NO: 1849484 - RNA, 11 nt, Salmonella typhimurium LT2
ccagaaacugu

SEQ ID NO: 1849485 - RNA, 15 nt, Salmonella typhimurium LT2
ccagaaacugugaug

SEQ ID NO: 1849486 - RNA, 15 nt, Salmonella typhimurium LT2
ccagaagagaagcuu

SEQ ID NO: 1849487 - RNA, 18 nt, Salmonella typhimurium LT2
ccagaaugcccagcaagg

SEQ ID NO: 1849488 - RNA, 21 nt, Salmonella typhimurium LT2
ccagaaugcccugcuguucca

SEQ ID NO: 1849489 - RNA, 15 nt, Salmonella typhimurium LT2
ccaguaagggcagcc

SEQ ID NO: 1849490 - RNA, 17 nt, Salmonella typhimurium LT2
ccaguaaugccgugccg

SEQ ID NO: 1849491 - RNA, 15 nt, Salmonella typhimurium LT2
ccaguaacgcuggaa

SEQ ID NO: 1849492 - RNA, 22 nt, Salmonella typhimurium LT2
ccaguaaaaucgggccuccgcg

SEQ ID NO: 1849493 - RNA, 14 nt, Salmonella typhimurium LT2
ccaguaaccaccac

SEQ ID NO: 1849494 - RNA, 12 nt, Salmonella typhimurium LT2
ccagguucagca

SEQ ID NO: 1849495 - RNA, 22 nt, Salmonella typhimurium LT2
ccagguuauagaccuguuccau

SEQ ID NO: 1849496 - RNA, 16 nt, Salmonella typhimurium LT2
ccagguggugcaggcu

SEQ ID NO: 1849497 - RNA, 18 nt, Salmonella typhimurium LT2
ccagggcugcuggccuuc

SEQ ID NO: 1849498 - RNA, 16 nt, Salmonella typhimurium LT2
ccagguggggugggcg

SEQ ID NO: 1849499 - RNA, 19 nt, Salmonella typhimurium LT2
ccagguacuuacgcagccg

SEQ ID NO: 1849500 - RNA, 21 nt, Salmonella typhimurium LT2
ccaggccgucggcgccagcca

SEQ ID NO: 1849501 - RNA, 20 nt, Salmonella typhimurium LT2
ccaggccgucggcgccagcc

SEQ ID NO: 1849502 - RNA, 19 nt, Salmonella typhimurium LT2
ccaggcagauccaaauggc

SEQ ID NO: 1849503 - RNA, 16 nt, Salmonella typhimurium LT2
ccaggcacuugagaaa

SEQ ID NO: 1849504 - RNA, 17 nt, Salmonella typhimurium LT2
ccaggcgaccagaugca

SEQ ID NO: 1849505 - RNA, 14 nt, Salmonella typhimurium LT2
ccaggcgcgcaccg

SEQ ID NO: 1849506 - RNA, 17 nt, Salmonella typhimurium LT2
ccagggcgaugccccca

SEQ ID NO: 1849507 - RNA, 19 nt, Salmonella typhimurium LT2
ccagggcgaugcccccaga

SEQ ID NO: 1849508 - RNA, 15 nt, Salmonella typhimurium LT2
ccaggcuucgcgcag

SEQ ID NO: 1849509 - RNA, 15 nt, Salmonella typhimurium LT2
ccagcucauuuuuac

SEQ ID NO: 1849510 - RNA, 23 nt, Salmonella typhimurium LT2
ccagcucaccgagacugcccggc

SEQ ID NO: 1849511 - RNA, 14 nt, Salmonella typhimurium LT2
ccagcucaccagcc

SEQ ID NO: 1849512 - RNA, 18 nt, Salmonella typhimurium LT2
ccagcucaggguccccau

SEQ ID NO: 1849513 - RNA, 16 nt, Salmonella typhimurium LT2
ccagcucuacaucgcc

SEQ ID NO: 1849514 - RNA, 19 nt, Salmonella typhimurium LT2
ccagcucuacaucgccgcg

SEQ ID NO: 1849515 - RNA, 20 nt, Salmonella typhimurium LT2
ccagcucuacaucgccgcga

SEQ ID NO: 1849516 - RNA, 15 nt, Salmonella typhimurium LT2
ccagcucguuauuuc

SEQ ID NO: 1849517 - RNA, 19 nt, Salmonella typhimurium LT2
ccagcgugacccagacaaa

SEQ ID NO: 1849518 - RNA, 16 nt, Salmonella typhimurium LT2
ccagcgucaacugcgc

SEQ ID NO: 1849519 - RNA, 17 nt, Salmonella typhimurium LT2
ccagcgucaacugcgcc

SEQ ID NO: 1849520 - RNA, 20 nt, Salmonella typhimurium LT2
ccagcguaucgcucugcuuc

SEQ ID NO: 1849521 - RNA, 15 nt, Salmonella typhimurium LT2
ccagcguaguuucac

SEQ ID NO: 1849522 - RNA, 17 nt, Salmonella typhimurium LT2
ccagcgugacccagaca

SEQ ID NO: 1849523 - RNA, 17 nt, Salmonella typhimurium LT2
ccagcguaccacgccgc

SEQ ID NO: 1849524 - RNA, 21 nt, Salmonella typhimurium LT2
ccagcguacguaacuucuugg

SEQ ID NO: 1849525 - RNA, 19 nt, Salmonella typhimurium LT2
ccagcggcgccaucaccau

SEQ ID NO: 1849526 - RNA, 15 nt, Salmonella typhimurium LT2
ccagcccccugccag

SEQ ID NO: 1849527 - RNA, 15 nt, Salmonella typhimurium LT2
ccagcuucaucauca

SEQ ID NO: 1849528 - RNA, 13 nt, Salmonella typhimurium LT2
ccagcuuaucuga

SEQ ID NO: 1849529 - RNA, 14 nt, Salmonella typhimurium LT2
ccagcuugccgucg

SEQ ID NO: 1849530 - RNA, 14 nt, Salmonella typhimurium LT2
ccagcucuucuucg

SEQ ID NO: 1849531 - RNA, 19 nt, Salmonella typhimurium LT2
ccagcugacgcagcagcuc

SEQ ID NO: 1849532 - RNA, 20 nt, Salmonella typhimurium LT2
ccagcugacgcagcagcucc

SEQ ID NO: 1849533 - RNA, 14 nt, Salmonella typhimurium LT2
ccagcucuuucaau

SEQ ID NO: 1849534 - RNA, 14 nt, Salmonella typhimurium LT2
ccagcucuuuucug

SEQ ID NO: 1849535 - RNA, 21 nt, Salmonella typhimurium LT2
ccagcucuuuaggcaggaaau

SEQ ID NO: 1849536 - RNA, 19 nt, Salmonella typhimurium LT2
ccaggcaaugccccgccgc

SEQ ID NO: 1849537 - RNA, 13 nt, Salmonella typhimurium LT2
ccaggaucgccgc

SEQ ID NO: 1849538 - RNA, 14 nt, Salmonella typhimurium LT2
ccaggaucgccgcu

SEQ ID NO: 1849539 - RNA, 19 nt, Salmonella typhimurium LT2
ccaggauaauggugucuuu

SEQ ID NO: 1849540 - RNA, 14 nt, Salmonella typhimurium LT2
ccaggauacacaug

SEQ ID NO: 1849541 - RNA, 15 nt, Salmonella typhimurium LT2
ccaggagcaaaccga

SEQ ID NO: 1849542 - RNA, 15 nt, Salmonella typhimurium LT2
ccaggagagcaccuu

SEQ ID NO: 1849543 - RNA, 19 nt, Salmonella typhimurium LT2
ccagcuuggguauagagca

SEQ ID NO: 1849544 - RNA, 15 nt, Salmonella typhimurium LT2
ccaggaaagagggca

SEQ ID NO: 1849545 - RNA, 19 nt, Salmonella typhimurium LT2
ccaggaagaguaucucucu

SEQ ID NO: 1849546 - RNA, 21 nt, Salmonella typhimurium LT2
ccaggaagaguaucucucugg

SEQ ID NO: 1849547 - RNA, 12 nt, Salmonella typhimurium LT2
ccauaauaaugc

SEQ ID NO: 1849548 - RNA, 18 nt, Salmonella typhimurium LT2
ccauaauaaugccaaaau

SEQ ID NO: 1849549 - RNA, 20 nt, Salmonella typhimurium LT2
ccaguuugcguucacagcac

SEQ ID NO: 1849550 - RNA, 13 nt, Salmonella typhimurium LT2
ccaguuccgccac

SEQ ID NO: 1849551 - RNA, 20 nt, Salmonella typhimurium LT2
ccaguuucgccagcggcagc

SEQ ID NO: 1849552 - RNA, 14 nt, Salmonella typhimurium LT2
ccaguucacgguaa

SEQ ID NO: 1849553 - RNA, 12 nt, Salmonella typhimurium LT2
ccaguucacucc

SEQ ID NO: 1849554 - RNA, 14 nt, Salmonella typhimurium LT2
ccaguuaauucguc

SEQ ID NO: 1849555 - RNA, 12 nt, Salmonella typhimurium LT2
ccaguuccccau

SEQ ID NO: 1849556 - RNA, 22 nt, Salmonella typhimurium LT2
ccaguuccaucuccggcgacca

SEQ ID NO: 1849557 - RNA, 18 nt, Salmonella typhimurium LT2
ccagugguaaaaaaguga

SEQ ID NO: 1849558 - RNA, 15 nt, Salmonella typhimurium LT2
ccaguacuuuggccu

SEQ ID NO: 1849559 - RNA, 15 nt, Salmonella typhimurium LT2
ccaguguuguucucu

SEQ ID NO: 1849560 - RNA, 19 nt, Salmonella typhimurium LT2
ccaguuaacagaaugcuga

SEQ ID NO: 1849561 - RNA, 17 nt, Salmonella typhimurium LT2
ccaguuauccuuaauau

SEQ ID NO: 1849562 - RNA, 19 nt, Salmonella typhimurium LT2
ccaguuauccuuaauaugu

SEQ ID NO: 1849563 - RNA, 19 nt, Salmonella typhimurium LT2
ccaguuagcgaccgcgccg

SEQ ID NO: 1849564 - RNA, 15 nt, Salmonella typhimurium LT2
ccaguaccgccgccg

SEQ ID NO: 1849565 - RNA, 13 nt, Salmonella typhimurium LT2
ccaguaccgccgc

SEQ ID NO: 1849566 - RNA, 21 nt, Salmonella typhimurium LT2
ccaguacgucaacaaugcuuu

SEQ ID NO: 1849567 - RNA, 22 nt, Salmonella typhimurium LT2
ccaguacaaacaaauaaaucca

SEQ ID NO: 1849568 - RNA, 16 nt, Salmonella typhimurium LT2
ccaguacaagcaggcu

SEQ ID NO: 1849569 - RNA, 15 nt, Salmonella typhimurium LT2
ccaguaauuuuuccg

SEQ ID NO: 1849570 - RNA, 14 nt, Salmonella typhimurium LT2
ccaguaauuuuucu

SEQ ID NO: 1849571 - RNA, 11 nt, Salmonella typhimurium LT2
ccauauuuucc

SEQ ID NO: 1849572 - RNA, 23 nt, Salmonella typhimurium LT2
ccauagcguuuaaaaagcugcau

SEQ ID NO: 1849573 - RNA, 15 nt, Salmonella typhimurium LT2
ccauaggucagcgcu

SEQ ID NO: 1849574 - RNA, 19 nt, Salmonella typhimurium LT2
ccauaccggacuccaggca

SEQ ID NO: 1849575 - RNA, 20 nt, Salmonella typhimurium LT2
ccauacuauccaacagaagg

SEQ ID NO: 1849576 - RNA, 20 nt, Salmonella typhimurium LT2
ccauaaugauccacacuggc

SEQ ID NO: 1849577 - RNA, 12 nt, Salmonella typhimurium LT2
ccauaaugacgc

SEQ ID NO: 1849578 - RNA, 23 nt, Salmonella typhimurium LT2
ccauaaugacccagucgggaaac

SEQ ID NO: 1849579 - RNA, 15 nt, Salmonella typhimurium LT2
ccauacccggcuccc

SEQ ID NO: 1849580 - RNA, 19 nt, Salmonella typhimurium LT2
ccauacccuguucagcacc

SEQ ID NO: 1849581 - RNA, 16 nt, Salmonella typhimurium LT2
ccauacccuguuugau

SEQ ID NO: 1849582 - RNA, 20 nt, Salmonella typhimurium LT2
ccauagcgcuaugcgcucca

SEQ ID NO: 1849583 - RNA, 22 nt, Salmonella typhimurium LT2
ccauagcguuuaaaaagcugca

SEQ ID NO: 1849584 - RNA, 16 nt, Salmonella typhimurium LT2
ccauagauuuuuucga

SEQ ID NO: 1849585 - RNA, 14 nt, Salmonella typhimurium LT2
ccauagacaguacg

SEQ ID NO: 1849586 - RNA, 20 nt, Salmonella typhimurium LT2
ccauagauaccuucuucacu

SEQ ID NO: 1849587 - RNA, 19 nt, Salmonella typhimurium LT2
ccauccagacaugcacaug

SEQ ID NO: 1849588 - RNA, 13 nt, Salmonella typhimurium LT2
ccauccaccagaa

SEQ ID NO: 1849589 - RNA, 18 nt, Salmonella typhimurium LT2
ccaucgacccccaccaug

SEQ ID NO: 1849590 - RNA, 20 nt, Salmonella typhimurium LT2
ccauccggcacacagaauua

SEQ ID NO: 1849591 - RNA, 22 nt, Salmonella typhimurium LT2
ccauccggcacggucaaucauc

SEQ ID NO: 1849592 - RNA, 19 nt, Salmonella typhimurium LT2
ccauccgggccacucucca

SEQ ID NO: 1849593 - RNA, 16 nt, Salmonella typhimurium LT2
ccauccggcauuuuuu

SEQ ID NO: 1849594 - RNA, 18 nt, Salmonella typhimurium LT2
ccaucucuuuaaaaauaa

SEQ ID NO: 1849595 - RNA, 19 nt, Salmonella typhimurium LT2
ccaucucauucgccagcgg

SEQ ID NO: 1849596 - RNA, 22 nt, Salmonella typhimurium LT2
ccaucuccugacugccgccggc

SEQ ID NO: 1849597 - RNA, 13 nt, Salmonella typhimurium LT2
ccaucgccgccau

SEQ ID NO: 1849598 - RNA, 23 nt, Salmonella typhimurium LT2
ccaucgcgaauuucaaucgccag

SEQ ID NO: 1849599 - RNA, 14 nt, Salmonella typhimurium LT2
ccaucgcgccgcug

SEQ ID NO: 1849600 - RNA, 13 nt, Salmonella typhimurium LT2
ccaucgcgcagcc

SEQ ID NO: 1849601 - RNA, 19 nt, Salmonella typhimurium LT2
ccaucgcuuucagcuuuuu

SEQ ID NO: 1849602 - RNA, 22 nt, Salmonella typhimurium LT2
ccaucggaaacuauccuggccu

SEQ ID NO: 1849603 - RNA, 14 nt, Salmonella typhimurium LT2
ccaugauucauccc

SEQ ID NO: 1849604 - RNA, 22 nt, Salmonella typhimurium LT2
ccaugaugggcaagcguagucc

SEQ ID NO: 1849605 - RNA, 13 nt, Salmonella typhimurium LT2
ccaugccagcagu

SEQ ID NO: 1849606 - RNA, 19 nt, Salmonella typhimurium LT2
ccaugcaugacgcaggcgc

SEQ ID NO: 1849607 - RNA, 17 nt, Salmonella typhimurium LT2
ccaugcauaaugcagcc

SEQ ID NO: 1849608 - RNA, 16 nt, Salmonella typhimurium LT2
ccaugcaccagcccca

SEQ ID NO: 1849609 - RNA, 22 nt, Salmonella typhimurium LT2
ccaugccggcuuuccgcaccgc

SEQ ID NO: 1849610 - RNA, 12 nt, Salmonella typhimurium LT2
ccaugcccggcg

SEQ ID NO: 1849611 - RNA, 22 nt, Salmonella typhimurium LT2
ccaugccgaagacuccccugca

SEQ ID NO: 1849612 - RNA, 12 nt, Salmonella typhimurium LT2
ccaugccgcgcc

SEQ ID NO: 1849613 - RNA, 21 nt, Salmonella typhimurium LT2
ccaucuggcguugccugcuau

SEQ ID NO: 1849614 - RNA, 15 nt, Salmonella typhimurium LT2
ccaucuuccagcauc

SEQ ID NO: 1849615 - RNA, 13 nt, Salmonella typhimurium LT2
ccaugaaaaaaac

SEQ ID NO: 1849616 - RNA, 13 nt, Salmonella typhimurium LT2
ccaucuucacgca

SEQ ID NO: 1849617 - RNA, 13 nt, Salmonella typhimurium LT2
ccaucuucaagcu

SEQ ID NO: 1849618 - RNA, 14 nt, Salmonella typhimurium LT2
ccaucuucaagcuu

SEQ ID NO: 1849619 - RNA, 21 nt, Salmonella typhimurium LT2
ccaugaagcgauuuauccacc

SEQ ID NO: 1849620 - RNA, 14 nt, Salmonella typhimurium LT2
ccaugaacgacccg

SEQ ID NO: 1849621 - RNA, 14 nt, Salmonella typhimurium LT2
ccaugaucgucagg

SEQ ID NO: 1849622 - RNA, 23 nt, Salmonella typhimurium LT2
ccaugaguuggccuaccauuuga

SEQ ID NO: 1849623 - RNA, 14 nt, Salmonella typhimurium LT2
ccaugaccacaaag

SEQ ID NO: 1849624 - RNA, 15 nt, Salmonella typhimurium LT2
ccaugaccacaaaga

SEQ ID NO: 1849625 - RNA, 19 nt, Salmonella typhimurium LT2
ccccgaaagucaucugcca

SEQ ID NO: 1849626 - RNA, 20 nt, Salmonella typhimurium LT2
ccccgcuuucagcguugcag

SEQ ID NO: 1849627 - RNA, 13 nt, Salmonella typhimurium LT2
ccccggcuugcgg

SEQ ID NO: 1849628 - RNA, 17 nt, Salmonella typhimurium LT2
ccccggcgcccggaggg

SEQ ID NO: 1849629 - RNA, 23 nt, Salmonella typhimurium LT2
ccccggcgggguuuuuuuaugcg

SEQ ID NO: 1849630 - RNA, 15 nt, Salmonella typhimurium LT2
ccccggcgaaagaaa

SEQ ID NO: 1849631 - RNA, 18 nt, Salmonella typhimurium LT2
ccccggucaacgcgccgc

SEQ ID NO: 1849632 - RNA, 16 nt, Salmonella typhimurium LT2
ccccggugagcgccgc

SEQ ID NO: 1849633 - RNA, 19 nt, Salmonella typhimurium LT2
ccccgugauucacccgcgu

SEQ ID NO: 1849634 - RNA, 16 nt, Salmonella typhimurium LT2
ccccgugacuuuccag

SEQ ID NO: 1849635 - RNA, 23 nt, Salmonella typhimurium LT2
cccauuguucuuucauuuuaccu

SEQ ID NO: 1849636 - RNA, 20 nt, Salmonella typhimurium LT2
cccauugcuauagcccacgc

SEQ ID NO: 1849637 - RNA, 18 nt, Salmonella typhimurium LT2
cccauugaugccugcccg

SEQ ID NO: 1849638 - RNA, 17 nt, Salmonella typhimurium LT2
ccccagcguaccacgcc

SEQ ID NO: 1849639 - RNA, 16 nt, Salmonella typhimurium LT2
ccccaucgccagcacu

SEQ ID NO: 1849640 - RNA, 19 nt, Salmonella typhimurium LT2
ccccauauugaucgggauu

SEQ ID NO: 1849641 - RNA, 17 nt, Salmonella typhimurium LT2
cccccuccauacccuau

SEQ ID NO: 1849642 - RNA, 17 nt, Salmonella typhimurium LT2
cccccguuuucuggaac

SEQ ID NO: 1849643 - RNA, 21 nt, Salmonella typhimurium LT2
cccauccgggccacucuccag

SEQ ID NO: 1849644 - RNA, 22 nt, Salmonella typhimurium LT2
cccaucgaugggccgaguaauc

SEQ ID NO: 1849645 - RNA, 16 nt, Salmonella typhimurium LT2
cccauccgugcgauaa

SEQ ID NO: 1849646 - RNA, 14 nt, Salmonella typhimurium LT2
cccaucauugacuu

SEQ ID NO: 1849647 - RNA, 14 nt, Salmonella typhimurium LT2
cccauccagcacag

SEQ ID NO: 1849648 - RNA, 13 nt, Salmonella typhimurium LT2
cccaucaccugac

SEQ ID NO: 1849649 - RNA, 20 nt, Salmonella typhimurium LT2
cccaucgcuuugcagaaaau

SEQ ID NO: 1849650 - RNA, 16 nt, Salmonella typhimurium LT2
cccauaaaaaagcccu

SEQ ID NO: 1849651 - RNA, 20 nt, Salmonella typhimurium LT2
cccauauugauggccacauc

SEQ ID NO: 1849652 - RNA, 11 nt, Salmonella typhimurium LT2
cccauaaucac

SEQ ID NO: 1849653 - RNA, 14 nt, Salmonella typhimurium LT2
cccauacacaccag

SEQ ID NO: 1849654 - RNA, 20 nt, Salmonella typhimurium LT2
cccauacacaccagcaggaa

SEQ ID NO: 1849655 - RNA, 13 nt, Salmonella typhimurium LT2
cccagccacgcgu

SEQ ID NO: 1849656 - RNA, 13 nt, Salmonella typhimurium LT2
cccagcugacugg

SEQ ID NO: 1849657 - RNA, 18 nt, Salmonella typhimurium LT2
cccaggcgauaccgcgcu

SEQ ID NO: 1849658 - RNA, 12 nt, Salmonella typhimurium LT2
cccaggcgcgca

SEQ ID NO: 1849659 - RNA, 19 nt, Salmonella typhimurium LT2
cccaggcgcgcagcugcca

SEQ ID NO: 1849660 - RNA, 23 nt, Salmonella typhimurium LT2
cccaggagauaucaaaaguauca

SEQ ID NO: 1849661 - RNA, 19 nt, Salmonella typhimurium LT2
cccagcuugcccagauccu

SEQ ID NO: 1849662 - RNA, 17 nt, Salmonella typhimurium LT2
cccagugccaccagccg

SEQ ID NO: 1849663 - RNA, 18 nt, Salmonella typhimurium LT2
cccagucuuccugcggua

SEQ ID NO: 1849664 - RNA, 21 nt, Salmonella typhimurium LT2
cccaguccuuccggcgagaga

SEQ ID NO: 1849665 - RNA, 19 nt, Salmonella typhimurium LT2
cccaguccacguuuuacuu

SEQ ID NO: 1849666 - RNA, 19 nt, Salmonella typhimurium LT2
cccagguuauucaggugga

SEQ ID NO: 1849667 - RNA, 18 nt, Salmonella typhimurium LT2
cccagguuagcagccaca

SEQ ID NO: 1849668 - RNA, 19 nt, Salmonella typhimurium LT2
cccaguaaauuaacgcgaa

SEQ ID NO: 1849669 - RNA, 21 nt, Salmonella typhimurium LT2
cccagguuugaggcuugcagc

SEQ ID NO: 1849670 - RNA, 13 nt, Salmonella typhimurium LT2
cccaggcguccag

SEQ ID NO: 1849671 - RNA, 13 nt, Salmonella typhimurium LT2
ccaugcugguugg

SEQ ID NO: 1849672 - RNA, 15 nt, Salmonella typhimurium LT2
ccauggccgcagccc

SEQ ID NO: 1849673 - RNA, 16 nt, Salmonella typhimurium LT2
ccauggcaggcagcac

SEQ ID NO: 1849674 - RNA, 18 nt, Salmonella typhimurium LT2
ccauggccgcagcccgcc

SEQ ID NO: 1849675 - RNA, 17 nt, Salmonella typhimurium LT2
ccauggcgccaaguucg

SEQ ID NO: 1849676 - RNA, 16 nt, Salmonella typhimurium LT2
ccauguacgcaggcgg

SEQ ID NO: 1849677 - RNA, 21 nt, Salmonella typhimurium LT2
ccaugggcgcguuaaugcauu

SEQ ID NO: 1849678 - RNA, 21 nt, Salmonella typhimurium LT2
ccauggguuauccucuccuga

SEQ ID NO: 1849679 - RNA, 13 nt, Salmonella typhimurium LT2
ccauguucaguuc

SEQ ID NO: 1849680 - RNA, 15 nt, Salmonella typhimurium LT2
ccauguucauaaagu

SEQ ID NO: 1849681 - RNA, 22 nt, Salmonella typhimurium LT2
ccauguugaucguaaaaugaaa

SEQ ID NO: 1849682 - RNA, 14 nt, Salmonella typhimurium LT2
ccauguugccauga

SEQ ID NO: 1849683 - RNA, 14 nt, Salmonella typhimurium LT2
ccauguugagcgcu

SEQ ID NO: 1849684 - RNA, 18 nt, Salmonella typhimurium LT2
ccaugucagcgcaaagcc

SEQ ID NO: 1849685 - RNA, 20 nt, Salmonella typhimurium LT2
ccaugucuugcuaucaaacu

SEQ ID NO: 1849686 - RNA, 23 nt, Salmonella typhimurium LT2
ccauguuuuauacucaaaaaauc

SEQ ID NO: 1849687 - RNA, 18 nt, Salmonella typhimurium LT2
ccauguugcguaaauaaa

SEQ ID NO: 1849688 - RNA, 15 nt, Salmonella typhimurium LT2
ccauucaacacauuc

SEQ ID NO: 1849689 - RNA, 16 nt, Salmonella typhimurium LT2
ccauuauuuauuuuca

SEQ ID NO: 1849690 - RNA, 15 nt, Salmonella typhimurium LT2
ccauuggucaucauc

SEQ ID NO: 1849691 - RNA, 22 nt, Salmonella typhimurium LT2
ccauuggucuggauugcagaga

SEQ ID NO: 1849692 - RNA, 13 nt, Salmonella typhimurium LT2
ccauucuucaaca

SEQ ID NO: 1849693 - RNA, 15 nt, Salmonella typhimurium LT2
ccauuccuauuuucu

SEQ ID NO: 1849694 - RNA, 15 nt, Salmonella typhimurium LT2
ccauucgcccaguca

SEQ ID NO: 1849695 - RNA, 18 nt, Salmonella typhimurium LT2
ccauucgcucgauaauau

SEQ ID NO: 1849696 - RNA, 22 nt, Salmonella typhimurium LT2
ccauucguaauagcgucuaaau

SEQ ID NO: 1849697 - RNA, 21 nt, Salmonella typhimurium LT2
ccauucccagcgcccccagca

SEQ ID NO: 1849698 - RNA, 14 nt, Salmonella typhimurium LT2
ccauucccguaaaa

SEQ ID NO: 1849699 - RNA, 15 nt, Salmonella typhimurium LT2
ccauuccccacgcca

SEQ ID NO: 1849700 - RNA, 22 nt, Salmonella typhimurium LT2
cccaaucuugcguaccacguua

SEQ ID NO: 1849701 - RNA, 16 nt, Salmonella typhimurium LT2
cccacaacgcaccaac

SEQ ID NO: 1849702 - RNA, 18 nt, Salmonella typhimurium LT2
cccacccuuugcagcgcg

SEQ ID NO: 1849703 - RNA, 12 nt, Salmonella typhimurium LT2
cccacccagcaa

SEQ ID NO: 1849704 - RNA, 22 nt, Salmonella typhimurium LT2
cccacccagcaauacagccagc

SEQ ID NO: 1849705 - RNA, 12 nt, Salmonella typhimurium LT2
cccaccauguca

SEQ ID NO: 1849706 - RNA, 15 nt, Salmonella typhimurium LT2
cccaauaccacaacc

SEQ ID NO: 1849707 - RNA, 20 nt, Salmonella typhimurium LT2
cccaauaugaugcuugcucg

SEQ ID NO: 1849708 - RNA, 14 nt, Salmonella typhimurium LT2
cccaaucccaccac

SEQ ID NO: 1849709 - RNA, 22 nt, Salmonella typhimurium LT2
cccaacggaugcgccaucccau

SEQ ID NO: 1849710 - RNA, 20 nt, Salmonella typhimurium LT2
cccaacgagagcacuacgcu

SEQ ID NO: 1849711 - RNA, 21 nt, Salmonella typhimurium LT2
cccacuuggcgaucaccagca

SEQ ID NO: 1849712 - RNA, 22 nt, Salmonella typhimurium LT2
cccacuuguaccaacugcugcg

SEQ ID NO: 1849713 - RNA, 19 nt, Salmonella typhimurium LT2
cccagaaagaucagcagaa

SEQ ID NO: 1849714 - RNA, 19 nt, Salmonella typhimurium LT2
cccagaaaauuaacgacaa

SEQ ID NO: 1849715 - RNA, 21 nt, Salmonella typhimurium LT2
cccagaaaccgccccuggcaa

SEQ ID NO: 1849716 - RNA, 16 nt, Salmonella typhimurium LT2
cccacuuucagcuccg

SEQ ID NO: 1849717 - RNA, 20 nt, Salmonella typhimurium LT2
cccagaaaaugcucaguaug

SEQ ID NO: 1849718 - RNA, 22 nt, Salmonella typhimurium LT2
cccagagcuuuggcgacuuuuu

SEQ ID NO: 1849719 - RNA, 23 nt, Salmonella typhimurium LT2
cccagacgcguuguccaacuguc

SEQ ID NO: 1849720 - RNA, 12 nt, Salmonella typhimurium LT2
cccagacacaga

SEQ ID NO: 1849721 - RNA, 16 nt, Salmonella typhimurium LT2
cccagaaucguggcgc

SEQ ID NO: 1849722 - RNA, 18 nt, Salmonella typhimurium LT2
cccagaaucccgccuugc

SEQ ID NO: 1849723 - RNA, 19 nt, Salmonella typhimurium LT2
cccagauguugauacagaa

SEQ ID NO: 1849724 - RNA, 17 nt, Salmonella typhimurium LT2
cccagagucaccagcac

SEQ ID NO: 1849725 - RNA, 20 nt, Salmonella typhimurium LT2
cccagagucaccagcacuac

SEQ ID NO: 1849726 - RNA, 19 nt, Salmonella typhimurium LT2
cccagauauccgcgcucaa

SEQ ID NO: 1849727 - RNA, 23 nt, Salmonella typhimurium LT2
cccagauaucaggauugaugguc

SEQ ID NO: 1849728 - RNA, 20 nt, Salmonella typhimurium LT2
cccagaugaaaaaucggcaa

SEQ ID NO: 1849729 - RNA, 17 nt, Salmonella typhimurium LT2
cgaccgcucggaagugc

SEQ ID NO: 1849730 - RNA, 18 nt, Salmonella typhimurium LT2
cgaccggcacgguuaaug

SEQ ID NO: 1849731 - RNA, 11 nt, Salmonella typhimurium LT2
cgaccggcucg

SEQ ID NO: 1849732 - RNA, 22 nt, Salmonella typhimurium LT2
cgaccggcucgcuguucgccag

SEQ ID NO: 1849733 - RNA, 21 nt, Salmonella typhimurium LT2
cgaccgucgggccauucccca

SEQ ID NO: 1849734 - RNA, 16 nt, Salmonella typhimurium LT2
cgaccuggugcucaau

SEQ ID NO: 1849735 - RNA, 17 nt, Salmonella typhimurium LT2
cgaccugcauauuuuuc

SEQ ID NO: 1849736 - RNA, 14 nt, Salmonella typhimurium LT2
cgacgcacuccaga

SEQ ID NO: 1849737 - RNA, 14 nt, Salmonella typhimurium LT2
cgacgaccgccaga

SEQ ID NO: 1849738 - RNA, 20 nt, Salmonella typhimurium LT2
cgacgaccggcgcagcgccc

SEQ ID NO: 1849739 - RNA, 14 nt, Salmonella typhimurium LT2
cgaccuucacgccg

SEQ ID NO: 1849740 - RNA, 17 nt, Salmonella typhimurium LT2
cgaccuucacgccgcca

SEQ ID NO: 1849741 - RNA, 13 nt, Salmonella typhimurium LT2
cgaccuuaauuuc

SEQ ID NO: 1849742 - RNA, 17 nt, Salmonella typhimurium LT2
cgaccagcgcaccaaag

SEQ ID NO: 1849743 - RNA, 19 nt, Salmonella typhimurium LT2
cgaccagcguuaaacuggc

SEQ ID NO: 1849744 - RNA, 23 nt, Salmonella typhimurium LT2
cgaccagcaaaaagaaucgccag

SEQ ID NO: 1849745 - RNA, 16 nt, Salmonella typhimurium LT2
cgaccacccgcggcca

SEQ ID NO: 1849746 - RNA, 17 nt, Salmonella typhimurium LT2
cgaccacgccaccgccg

SEQ ID NO: 1849747 - RNA, 21 nt, Salmonella typhimurium LT2
cgaccacuucaacgccgcgcu

SEQ ID NO: 1849748 - RNA, 22 nt, Salmonella typhimurium LT2
cgaccacuucaacgccgcgcuu

SEQ ID NO: 1849749 - RNA, 21 nt, Salmonella typhimurium LT2
cgaccauaaauagccgaccgc

SEQ ID NO: 1849750 - RNA, 19 nt, Salmonella typhimurium LT2
cgaccaguuuagcuaaauc

SEQ ID NO: 1849751 - RNA, 21 nt, Salmonella typhimurium LT2
cgaccagugcaacagagagca

SEQ ID NO: 1849752 - RNA, 13 nt, Salmonella typhimurium LT2
cgaccaggaucag

SEQ ID NO: 1849753 - RNA, 13 nt, Salmonella typhimurium LT2
cgaccauucuuuc

SEQ ID NO: 1849754 - RNA, 12 nt, Salmonella typhimurium LT2
cgacaucgccaa

SEQ ID NO: 1849755 - RNA, 16 nt, Salmonella typhimurium LT2
cgacaucgccaaccgc

SEQ ID NO: 1849756 - RNA, 12 nt, Salmonella typhimurium LT2
cgacaucgccag

SEQ ID NO: 1849757 - RNA, 12 nt, Salmonella typhimurium LT2
cgacaucagcca

SEQ ID NO: 1849758 - RNA, 14 nt, Salmonella typhimurium LT2
cgacaucacgcaaa

SEQ ID NO: 1849759 - RNA, 14 nt, Salmonella typhimurium LT2
cgacauagcugaac

SEQ ID NO: 1849760 - RNA, 19 nt, Salmonella typhimurium LT2
cgaccaaacaagaucgccg

SEQ ID NO: 1849761 - RNA, 16 nt, Salmonella typhimurium LT2
cgacauggcugagaau

SEQ ID NO: 1849762 - RNA, 21 nt, Salmonella typhimurium LT2
cgacaucucaggcaagacaca

SEQ ID NO: 1849763 - RNA, 15 nt, Salmonella typhimurium LT2
cgacaucucaggcaa

SEQ ID NO: 1849764 - RNA, 12 nt, Salmonella typhimurium LT2
cgacagcgcgcc

SEQ ID NO: 1849765 - RNA, 16 nt, Salmonella typhimurium LT2
cgacagcgccaucagc

SEQ ID NO: 1849766 - RNA, 20 nt, Salmonella typhimurium LT2
cgacagcgcuauccggccca

SEQ ID NO: 1849767 - RNA, 13 nt, Salmonella typhimurium LT2
cgacagcgcuggc

SEQ ID NO: 1849768 - RNA, 16 nt, Salmonella typhimurium LT2
cgacagccaggagucu

SEQ ID NO: 1849769 - RNA, 21 nt, Salmonella typhimurium LT2
cgacagccgcguuuugccgcu

SEQ ID NO: 1849770 - RNA, 15 nt, Salmonella typhimurium LT2
cgacagcccgccagc

SEQ ID NO: 1849771 - RNA, 16 nt, Salmonella typhimurium LT2
cgacagcccgccagca

SEQ ID NO: 1849772 - RNA, 22 nt, Salmonella typhimurium LT2
cgacagggcgugaaccagcauc

SEQ ID NO: 1849773 - RNA, 22 nt, Salmonella typhimurium LT2
cgacaggguuugccagcaccag

SEQ ID NO: 1849774 - RNA, 15 nt, Salmonella typhimurium LT2
cgacaggcggcagcu

SEQ ID NO: 1849775 - RNA, 12 nt, Salmonella typhimurium LT2
cgacaggcugcc

SEQ ID NO: 1849776 - RNA, 16 nt, Salmonella typhimurium LT2
cgacauaaccggcaac

SEQ ID NO: 1849777 - RNA, 16 nt, Salmonella typhimurium LT2
cgacaguaacugcaaa

SEQ ID NO: 1849778 - RNA, 12 nt, Salmonella typhimurium LT2
cgacaguaccag

SEQ ID NO: 1849779 - RNA, 16 nt, Salmonella typhimurium LT2
cgacaguaaaacccaa

SEQ ID NO: 1849780 - RNA, 13 nt, Salmonella typhimurium LT2
cgacaguaacugc

SEQ ID NO: 1849781 - RNA, 16 nt, Salmonella typhimurium LT2
cgaaugcugcaucuua

SEQ ID NO: 1849782 - RNA, 22 nt, Salmonella typhimurium LT2
cgaaucgccuguaccgggcaga

SEQ ID NO: 1849783 - RNA, 17 nt, Salmonella typhimurium LT2
cgaaucgccgcuuuuuc

SEQ ID NO: 1849784 - RNA, 19 nt, Salmonella typhimurium LT2
cgaauaagcgguucaggcc

SEQ ID NO: 1849785 - RNA, 17 nt, Salmonella typhimurium LT2
cgaauacuguuccaggc

SEQ ID NO: 1849786 - RNA, 15 nt, Salmonella typhimurium LT2
cgaauauccagacug

SEQ ID NO: 1849787 - RNA, 12 nt, Salmonella typhimurium LT2
cgaauccggggg

SEQ ID NO: 1849788 - RNA, 18 nt, Salmonella typhimurium LT2
cgaauccccaucuccaga

SEQ ID NO: 1849789 - RNA, 13 nt, Salmonella typhimurium LT2
cgaauccuccugu

SEQ ID NO: 1849790 - RNA, 12 nt, Salmonella typhimurium LT2
cgaauccuccug

SEQ ID NO: 1849791 - RNA, 21 nt, Salmonella typhimurium LT2
cgacagauuggucagcagccc

SEQ ID NO: 1849792 - RNA, 16 nt, Salmonella typhimurium LT2
cgacagagccaacaga

SEQ ID NO: 1849793 - RNA, 23 nt, Salmonella typhimurium LT2
cgacaccagcgauaaacgccagc

SEQ ID NO: 1849794 - RNA, 21 nt, Salmonella typhimurium LT2
cgacaauuuugauaagagaaa

SEQ ID NO: 1849795 - RNA, 21 nt, Salmonella typhimurium LT2
cgacacauucaggcuuuccac

SEQ ID NO: 1849796 - RNA, 13 nt, Salmonella typhimurium LT2
cgacacaucaucg

SEQ ID NO: 1849797 - RNA, 15 nt, Salmonella typhimurium LT2
cgacaaacagcgccc

SEQ ID NO: 1849798 - RNA, 13 nt, Salmonella typhimurium LT2
cgacaaagccaac

SEQ ID NO: 1849799 - RNA, 15 nt, Salmonella typhimurium LT2
cgacaaaagccagau

SEQ ID NO: 1849800 - RNA, 18 nt, Salmonella typhimurium LT2
cgaauuuacugugaucca

SEQ ID NO: 1849801 - RNA, 14 nt, Salmonella typhimurium LT2
cgaauugucgguuu

SEQ ID NO: 1849802 - RNA, 23 nt, Salmonella typhimurium LT2
cgacaagaagauuucuuaauucc

SEQ ID NO: 1849803 - RNA, 19 nt, Salmonella typhimurium LT2
cgacaagcuaauccccagc

SEQ ID NO: 1849804 - RNA, 21 nt, Salmonella typhimurium LT2
cgacaacuucuaauuuuucca

SEQ ID NO: 1849805 - RNA, 23 nt, Salmonella typhimurium LT2
cgacaacuucuaauuuuuccagc

SEQ ID NO: 1849806 - RNA, 19 nt, Salmonella typhimurium LT2
cgacaaucagaugcugacu

SEQ ID NO: 1849807 - RNA, 17 nt, Salmonella typhimurium LT2
cgacaauauguaacacg

SEQ ID NO: 1849808 - RNA, 13 nt, Salmonella typhimurium LT2
cgacaaaugaagc

SEQ ID NO: 1849809 - RNA, 16 nt, Salmonella typhimurium LT2
cgacaaccagcgaaau

SEQ ID NO: 1849810 - RNA, 15 nt, Salmonella typhimurium LT2
cgaagaucagugaga

SEQ ID NO: 1849811 - RNA, 22 nt, Salmonella typhimurium LT2
cgaagaucaggaguaaauaaca

SEQ ID NO: 1849812 - RNA, 18 nt, Salmonella typhimurium LT2
cgaagacuccccugcaga

SEQ ID NO: 1849813 - RNA, 23 nt, Salmonella typhimurium LT2
cgaacgugcuggauagccucguu

SEQ ID NO: 1849814 - RNA, 18 nt, Salmonella typhimurium LT2
cgaacggcuuuccagcag

SEQ ID NO: 1849815 - RNA, 12 nt, Salmonella typhimurium LT2
cgaacggccuga

SEQ ID NO: 1849816 - RNA, 18 nt, Salmonella typhimurium LT2
cgaacugauggcgcuaag

SEQ ID NO: 1849817 - RNA, 22 nt, Salmonella typhimurium LT2
cgaacugauggcgcuaagccag

SEQ ID NO: 1849818 - RNA, 13 nt, Salmonella typhimurium LT2
cgaacugauggcg

SEQ ID NO: 1849819 - RNA, 14 nt, Salmonella typhimurium LT2
cgaacucuuccaga

SEQ ID NO: 1849820 - RNA, 17 nt, Salmonella typhimurium LT2
cgaacugacccgccagu

SEQ ID NO: 1849821 - RNA, 20 nt, Salmonella typhimurium LT2
cgaacuucgcgguugcgccc

SEQ ID NO: 1849822 - RNA, 19 nt, Salmonella typhimurium LT2
cgaacuucauccacgccga

SEQ ID NO: 1849823 - RNA, 18 nt, Salmonella typhimurium LT2
cgaacuuacggcgcgcca

SEQ ID NO: 1849824 - RNA, 23 nt, Salmonella typhimurium LT2
cgaacuuacggcgcgccaccauc

SEQ ID NO: 1849825 - RNA, 19 nt, Salmonella typhimurium LT2
cgaagcgucauccggcaau

SEQ ID NO: 1849826 - RNA, 23 nt, Salmonella typhimurium LT2
cgaagcucagccaggcgcggcgc

SEQ ID NO: 1849827 - RNA, 15 nt, Salmonella typhimurium LT2
cgaagcugaccagac

SEQ ID NO: 1849828 - RNA, 16 nt, Salmonella typhimurium LT2
cgaaggccagcaccag

SEQ ID NO: 1849829 - RNA, 14 nt, Salmonella typhimurium LT2
cgaaggaaacgcca

SEQ ID NO: 1849830 - RNA, 23 nt, Salmonella typhimurium LT2
cgaagccgccacccgguuuuuuu

SEQ ID NO: 1849831 - RNA, 13 nt, Salmonella typhimurium LT2
cgaaguucucaau

SEQ ID NO: 1849832 - RNA, 13 nt, Salmonella typhimurium LT2
cgaauaacaaaau

SEQ ID NO: 1849833 - RNA, 15 nt, Salmonella typhimurium LT2
cgaauaacaaaauga

SEQ ID NO: 1849834 - RNA, 22 nt, Salmonella typhimurium LT2
cgaagugcagcguuuccagcca

SEQ ID NO: 1849835 - RNA, 15 nt, Salmonella typhimurium LT2
cgaagucgccacccg

SEQ ID NO: 1849836 - RNA, 15 nt, Salmonella typhimurium LT2
cgaagguggcggaau

SEQ ID NO: 1849837 - RNA, 21 nt, Salmonella typhimurium LT2
cgaagguggcggaauugguag

SEQ ID NO: 1849838 - RNA, 23 nt, Salmonella typhimurium LT2
cgaaggguagggauagcaucuuc

SEQ ID NO: 1849839 - RNA, 14 nt, Salmonella typhimurium LT2
ccuucggugccaua

SEQ ID NO: 1849840 - RNA, 17 nt, Salmonella typhimurium LT2
ccuucgguuuuauauuc

SEQ ID NO: 1849841 - RNA, 19 nt, Salmonella typhimurium LT2
ccuucugguagccagacau

SEQ ID NO: 1849842 - RNA, 11 nt, Salmonella typhimurium LT2
ccuucuucaua

SEQ ID NO: 1849843 - RNA, 12 nt, Salmonella typhimurium LT2
ccuucuuuuacu

SEQ ID NO: 1849844 - RNA, 21 nt, Salmonella typhimurium LT2
ccuucuuuauucacuuuuucu

SEQ ID NO: 1849845 - RNA, 20 nt, Salmonella typhimurium LT2
ccuucuuuauucacuuuuuc

SEQ ID NO: 1849846 - RNA, 18 nt, Salmonella typhimurium LT2
ccuucuugcucaaaaagc

SEQ ID NO: 1849847 - RNA, 15 nt, Salmonella typhimurium LT2
ccuucuucacccacu

SEQ ID NO: 1849848 - RNA, 17 nt, Salmonella typhimurium LT2
ccuucuucgccgucaua

SEQ ID NO: 1849849 - RNA, 15 nt, Salmonella typhimurium LT2
ccuuccccggcagcc

SEQ ID NO: 1849850 - RNA, 16 nt, Salmonella typhimurium LT2
ccuuccccggcagccc

SEQ ID NO: 1849851 - RNA, 18 nt, Salmonella typhimurium LT2
ccuuccccggcagcccca

SEQ ID NO: 1849852 - RNA, 15 nt, Salmonella typhimurium LT2
ccuucccccaccacc

SEQ ID NO: 1849853 - RNA, 18 nt, Salmonella typhimurium LT2
ccuuccccaucaaaacug

SEQ ID NO: 1849854 - RNA, 19 nt, Salmonella typhimurium LT2
ccuucccccaaaaugccgc

SEQ ID NO: 1849855 - RNA, 17 nt, Salmonella typhimurium LT2
ccuuccggccacuccgc

SEQ ID NO: 1849856 - RNA, 15 nt, Salmonella typhimurium LT2
ccuuccuccaccacc

SEQ ID NO: 1849857 - RNA, 20 nt, Salmonella typhimurium LT2
ccuuccucgucggcaagaau

SEQ ID NO: 1849858 - RNA, 17 nt, Salmonella typhimurium LT2
ccuuccugccagcacag

SEQ ID NO: 1849859 - RNA, 14 nt, Salmonella typhimurium LT2
ccuuccgccaccag

SEQ ID NO: 1849860 - RNA, 13 nt, Salmonella typhimurium LT2
ccuuccgccgcaa

SEQ ID NO: 1849861 - RNA, 19 nt, Salmonella typhimurium LT2
ccuuccucauuauugccca

SEQ ID NO: 1849862 - RNA, 17 nt, Salmonella typhimurium LT2
ccuuccggcgccuccag

SEQ ID NO: 1849863 - RNA, 13 nt, Salmonella typhimurium LT2
ccuuccggcgucc

SEQ ID NO: 1849864 - RNA, 22 nt, Salmonella typhimurium LT2
ccugugucguuucauccugaca

SEQ ID NO: 1849865 - RNA, 22 nt, Salmonella typhimurium LT2
ccuuccacugguaggcauccag

SEQ ID NO: 1849866 - RNA, 12 nt, Salmonella typhimurium LT2
ccuucccagccc

SEQ ID NO: 1849867 - RNA, 19 nt, Salmonella typhimurium LT2
ccuucgcggugaucccagg

SEQ ID NO: 1849868 - RNA, 13 nt, Salmonella typhimurium LT2
ccuucgccuucac

SEQ ID NO: 1849869 - RNA, 14 nt, Salmonella typhimurium LT2
ccuucgccuucacg

SEQ ID NO: 1849870 - RNA, 18 nt, Salmonella typhimurium LT2
ccuucgccuuccagugcg

SEQ ID NO: 1849871 - RNA, 12 nt, Salmonella typhimurium LT2
ccuucgccgccg

SEQ ID NO: 1849872 - RNA, 20 nt, Salmonella typhimurium LT2
ccuucgcggugaucccaggc

SEQ ID NO: 1849873 - RNA, 18 nt, Salmonella typhimurium LT2
ccuucgcguaaugcaauc

SEQ ID NO: 1849874 - RNA, 13 nt, Salmonella typhimurium LT2
ccuucgccgccca

SEQ ID NO: 1849875 - RNA, 17 nt, Salmonella typhimurium LT2
ccuucgaugaucaugcg

SEQ ID NO: 1849876 - RNA, 20 nt, Salmonella typhimurium LT2
ccuucgaugagcgcgaaauc

SEQ ID NO: 1849877 - RNA, 24 nt, Salmonella typhimurium LT2
ccuucgauaguccauuuuccuaug

SEQ ID NO: 1849878 - RNA, 18 nt, Salmonella typhimurium LT2
ccuucgaucaugccuuua

SEQ ID NO: 1849879 - RNA, 12 nt, Salmonella typhimurium LT2
ccuuguaucauu

SEQ ID NO: 1849880 - RNA, 22 nt, Salmonella typhimurium LT2
ccuuguccauguaaacuccauu

SEQ ID NO: 1849881 - RNA, 19 nt, Salmonella typhimurium LT2
ccuuuaaccucuuuuucau

SEQ ID NO: 1849882 - RNA, 18 nt, Salmonella typhimurium LT2
ccuuuaaccucuuuuuca

SEQ ID NO: 1849883 - RNA, 12 nt, Salmonella typhimurium LT2
ccuuguuuuaac

SEQ ID NO: 1849884 - RNA, 18 nt, Salmonella typhimurium LT2
ccuuuacugacaauaagu

SEQ ID NO: 1849885 - RNA, 19 nt, Salmonella typhimurium LT2
ccuuuaaucgagccuuuca

SEQ ID NO: 1849886 - RNA, 18 nt, Salmonella typhimurium LT2
ccuuuacaugaaaaauag

SEQ ID NO: 1849887 - RNA, 12 nt, Salmonella typhimurium LT2
ccuuuaagcuga

SEQ ID NO: 1849888 - RNA, 17 nt, Salmonella typhimurium LT2
ccuugccagugaaaaaa

SEQ ID NO: 1849889 - RNA, 16 nt, Salmonella typhimurium LT2
ccuugagcaaaacaca

SEQ ID NO: 1849890 - RNA, 20 nt, Salmonella typhimurium LT2
ccuugagcgccuggacccac

SEQ ID NO: 1849891 - RNA, 22 nt, Salmonella typhimurium LT2
ccuugaucaggaaaucuuccag

SEQ ID NO: 1849892 - RNA, 17 nt, Salmonella typhimurium LT2
ccuugcuuaacagaauu

SEQ ID NO: 1849893 - RNA, 20 nt, Salmonella typhimurium LT2
ccuugcccguauugaagcga

SEQ ID NO: 1849894 - RNA, 23 nt, Salmonella typhimurium LT2
ccuuucagagcgucuuuuauccc

SEQ ID NO: 1849895 - RNA, 11 nt, Salmonella typhimurium LT2
ccuuucauuuu

SEQ ID NO: 1849896 - RNA, 23 nt, Salmonella typhimurium LT2
ccuuucauuucugccugcuucag

SEQ ID NO: 1849897 - RNA, 23 nt, Salmonella typhimurium LT2
ccuuucaccagaaugagcggaac

SEQ ID NO: 1849898 - RNA, 20 nt, Salmonella typhimurium LT2
ccuuuaucuugaccugacug

SEQ ID NO: 1849899 - RNA, 14 nt, Salmonella typhimurium LT2
ccuuuaucugcccu

SEQ ID NO: 1849900 - RNA, 20 nt, Salmonella typhimurium LT2
ccuuuaggcggcgccgcgcc

SEQ ID NO: 1849901 - RNA, 21 nt, Salmonella typhimurium LT2
ccuuucguaguuggcaacccg

SEQ ID NO: 1849902 - RNA, 21 nt, Salmonella typhimurium LT2
ccuuucucugguuucccugcc

SEQ ID NO: 1849903 - RNA, 16 nt, Salmonella typhimurium LT2
ccuuucuuauuuuuuu

SEQ ID NO: 1849904 - RNA, 14 nt, Salmonella typhimurium LT2
ccuuugcccucaaa

SEQ ID NO: 1849905 - RNA, 14 nt, Salmonella typhimurium LT2
ccuuugagaaagcu

SEQ ID NO: 1849906 - RNA, 21 nt, Salmonella typhimurium LT2
ccuuuuagcgcguuaccgcuc

SEQ ID NO: 1849907 - RNA, 23 nt, Salmonella typhimurium LT2
ccuuugggaaaauaaaugcuuug

SEQ ID NO: 1849908 - RNA, 17 nt, Salmonella typhimurium LT2
ccuuugguggaguuuuc

SEQ ID NO: 1849909 - RNA, 13 nt, Salmonella typhimurium LT2
ccuuuguggcagg

SEQ ID NO: 1849910 - RNA, 21 nt, Salmonella typhimurium LT2
ccuuugcgcgcgauauccacc

SEQ ID NO: 1849911 - RNA, 21 nt, Salmonella typhimurium LT2
ccuuuggcaccguuagugauu

SEQ ID NO: 1849912 - RNA, 22 nt, Salmonella typhimurium LT2
cgaaaaccaagcgcaugguaga

SEQ ID NO: 1849913 - RNA, 16 nt, Salmonella typhimurium LT2
cgaaaaaccaggcaac

SEQ ID NO: 1849914 - RNA, 13 nt, Salmonella typhimurium LT2
cgaaaauauauuc

SEQ ID NO: 1849915 - RNA, 19 nt, Salmonella typhimurium LT2
cgaaaauaaacgcuugacu

SEQ ID NO: 1849916 - RNA, 15 nt, Salmonella typhimurium LT2
cgaaacaggcggcag

SEQ ID NO: 1849917 - RNA, 19 nt, Salmonella typhimurium LT2
cgaaacacgaauaauucuc

SEQ ID NO: 1849918 - RNA, 20 nt, Salmonella typhimurium LT2
cgaaacacgaauaauucuca

SEQ ID NO: 1849919 - RNA, 20 nt, Salmonella typhimurium LT2
ccuuuuuugguuauccagca

SEQ ID NO: 1849920 - RNA, 13 nt, Salmonella typhimurium LT2
ccuuuuuuguauu

SEQ ID NO: 1849921 - RNA, 13 nt, Salmonella typhimurium LT2
ccuuuuuugugaa

SEQ ID NO: 1849922 - RNA, 17 nt, Salmonella typhimurium LT2
ccuuuuuugugaauauc

SEQ ID NO: 1849923 - RNA, 22 nt, Salmonella typhimurium LT2
ccuuuuuucaccggcacccagu

SEQ ID NO: 1849924 - RNA, 12 nt, Salmonella typhimurium LT2
cgaaaaaaagau

SEQ ID NO: 1849925 - RNA, 13 nt, Salmonella typhimurium LT2
cgaaaaaaagaug

SEQ ID NO: 1849926 - RNA, 13 nt, Salmonella typhimurium LT2
ccuuuuucaauuu

SEQ ID NO: 1849927 - RNA, 22 nt, Salmonella typhimurium LT2
ccuuuuugauccguuucagaaa

SEQ ID NO: 1849928 - RNA, 19 nt, Salmonella typhimurium LT2
ccuuuuugaccgucaucca

SEQ ID NO: 1849929 - RNA, 15 nt, Salmonella typhimurium LT2
ccuuuuugcagcgcg

SEQ ID NO: 1849930 - RNA, 19 nt, Salmonella typhimurium LT2
ccuuuuugcauucgcuccu

SEQ ID NO: 1849931 - RNA, 14 nt, Salmonella typhimurium LT2
ccuuuugacgcuuc

SEQ ID NO: 1849932 - RNA, 19 nt, Salmonella typhimurium LT2
ccuuuucgcagcaauucug

SEQ ID NO: 1849933 - RNA, 15 nt, Salmonella typhimurium LT2
ccuuuuccggcggca

SEQ ID NO: 1849934 - RNA, 20 nt, Salmonella typhimurium LT2
ccuuuuucaauuuccaguuu

SEQ ID NO: 1849935 - RNA, 19 nt, Salmonella typhimurium LT2
ccuuuuuauggcccgccag

SEQ ID NO: 1849936 - RNA, 20 nt, Salmonella typhimurium LT2
cgaacagguuauuguugcua

SEQ ID NO: 1849937 - RNA, 17 nt, Salmonella typhimurium LT2
cgaacagcgcuccacgc

SEQ ID NO: 1849938 - RNA, 12 nt, Salmonella typhimurium LT2
cgaacagccagg

SEQ ID NO: 1849939 - RNA, 13 nt, Salmonella typhimurium LT2
cgaacauuucagc

SEQ ID NO: 1849940 - RNA, 12 nt, Salmonella typhimurium LT2
cgaacauuggaa

SEQ ID NO: 1849941 - RNA, 22 nt, Salmonella typhimurium LT2
cgaacauccuugcacgccaaaa

SEQ ID NO: 1849942 - RNA, 21 nt, Salmonella typhimurium LT2
cgaaccacggcuucagcggcg

SEQ ID NO: 1849943 - RNA, 13 nt, Salmonella typhimurium LT2
cgaaccaccagcc

SEQ ID NO: 1849944 - RNA, 18 nt, Salmonella typhimurium LT2
cgaaccguaaacgccugc

SEQ ID NO: 1849945 - RNA, 21 nt, Salmonella typhimurium LT2
cgaaccggaccagcacaaaaa

SEQ ID NO: 1849946 - RNA, 17 nt, Salmonella typhimurium LT2
cgaacccaucagggaaa

SEQ ID NO: 1849947 - RNA, 22 nt, Salmonella typhimurium LT2
cgaaccaucgacccccaccaug

SEQ ID NO: 1849948 - RNA, 20 nt, Salmonella typhimurium LT2
cgaaccugguacaccagacg

SEQ ID NO: 1849949 - RNA, 15 nt, Salmonella typhimurium LT2
cgaacgcuaugcgcc

SEQ ID NO: 1849950 - RNA, 15 nt, Salmonella typhimurium LT2
cgaacgcuccacugc

SEQ ID NO: 1849951 - RNA, 16 nt, Salmonella typhimurium LT2
cgaacgcuggcugggu

SEQ ID NO: 1849952 - RNA, 17 nt, Salmonella typhimurium LT2
cgaacggauaaacggcg

SEQ ID NO: 1849953 - RNA, 23 nt, Salmonella typhimurium LT2
cgaaacgcgcgcgaauauguucu

SEQ ID NO: 1849954 - RNA, 21 nt, Salmonella typhimurium LT2
cgaaacgcauacgcagcacuu

SEQ ID NO: 1849955 - RNA, 23 nt, Salmonella typhimurium LT2
cgaaacgaaucucaucagacugu

SEQ ID NO: 1849956 - RNA, 20 nt, Salmonella typhimurium LT2
cgaaaccggcggcgacuggc

SEQ ID NO: 1849957 - RNA, 15 nt, Salmonella typhimurium LT2
cgaaaccgauuuucu

SEQ ID NO: 1849958 - RNA, 18 nt, Salmonella typhimurium LT2
cgaaagucaucugccagu

SEQ ID NO: 1849959 - RNA, 14 nt, Salmonella typhimurium LT2
cgaaacguugcuua

SEQ ID NO: 1849960 - RNA, 18 nt, Salmonella typhimurium LT2
cgaaauuggccaucaggu

SEQ ID NO: 1849961 - RNA, 17 nt, Salmonella typhimurium LT2
cgaaauggccauccauu

SEQ ID NO: 1849962 - RNA, 18 nt, Salmonella typhimurium LT2
cgaaauuaacgacauuuu

SEQ ID NO: 1849963 - RNA, 20 nt, Salmonella typhimurium LT2
cgaaauagacguuuccguug

SEQ ID NO: 1849964 - RNA, 14 nt, Salmonella typhimurium LT2
cgauggcaaauaau

SEQ ID NO: 1849965 - RNA, 16 nt, Salmonella typhimurium LT2
cgauggcaaauaauac

SEQ ID NO: 1849966 - RNA, 13 nt, Salmonella typhimurium LT2
cgauggaaagaac

SEQ ID NO: 1849967 - RNA, 14 nt, Salmonella typhimurium LT2
cgauggagugcaau

SEQ ID NO: 1849968 - RNA, 19 nt, Salmonella typhimurium LT2
cgaugccguuuuaacguca

SEQ ID NO: 1849969 - RNA, 15 nt, Salmonella typhimurium LT2
cgaucaccagcaccg

SEQ ID NO: 1849970 - RNA, 12 nt, Salmonella typhimurium LT2
cgaucaccagca

SEQ ID NO: 1849971 - RNA, 17 nt, Salmonella typhimurium LT2
cgauuccgugucugaau

SEQ ID NO: 1849972 - RNA, 15 nt, Salmonella typhimurium LT2
cgauucugaauaaua

SEQ ID NO: 1849973 - RNA, 14 nt, Salmonella typhimurium LT2
cgauucguuucucu

SEQ ID NO: 1849974 - RNA, 20 nt, Salmonella typhimurium LT2
cgauucucugaggguguuca

SEQ ID NO: 1849975 - RNA, 16 nt, Salmonella typhimurium LT2
cgauucccgaucuuca

SEQ ID NO: 1849976 - RNA, 21 nt, Salmonella typhimurium LT2
cgauuggccgucucuuucaug

SEQ ID NO: 1849977 - RNA, 15 nt, Salmonella typhimurium LT2
cgauugacccgccgc

SEQ ID NO: 1849978 - RNA, 15 nt, Salmonella typhimurium LT2
cgauuggucaauaag

SEQ ID NO: 1849979 - RNA, 21 nt, Salmonella typhimurium LT2
cgauuuaccucucaccaguag

SEQ ID NO: 1849980 - RNA, 22 nt, Salmonella typhimurium LT2
cgauuuugacaaugaugguuaa

SEQ ID NO: 1849981 - RNA, 13 nt, Salmonella typhimurium LT2
cgauuuggucagu

SEQ ID NO: 1849982 - RNA, 21 nt, Salmonella typhimurium LT2
cgauuuauucuuugucugucg

SEQ ID NO: 1849983 - RNA, 22 nt, Salmonella typhimurium LT2
cgauuucguucuuucugccauc

SEQ ID NO: 1849984 - RNA, 14 nt, Salmonella typhimurium LT2
cgcacgccagcggu

SEQ ID NO: 1849985 - RNA, 12 nt, Salmonella typhimurium LT2
cgcacgccgcuc

SEQ ID NO: 1849986 - RNA, 17 nt, Salmonella typhimurium LT2
cgcaccguugccauacg

SEQ ID NO: 1849987 - RNA, 19 nt, Salmonella typhimurium LT2
cgcacgacaacgcgccgcg

SEQ ID NO: 1849988 - RNA, 21 nt, Salmonella typhimurium LT2
cgcagaguaaaaaaaccggcg

SEQ ID NO: 1849989 - RNA, 15 nt, Salmonella typhimurium LT2
cgcagagucgcagcg

SEQ ID NO: 1849990 - RNA, 16 nt, Salmonella typhimurium LT2
cgcagagcccagcgcg

SEQ ID NO: 1849991 - RNA, 19 nt, Salmonella typhimurium LT2
cgcagauaucuuccagcgc

SEQ ID NO: 1849992 - RNA, 24 nt, Salmonella typhimurium LT2
cgcagauaucuuccagcgcgucca

SEQ ID NO: 1849993 - RNA, 16 nt, Salmonella typhimurium LT2
cgcagauauuuccggc

SEQ ID NO: 1849994 - RNA, 18 nt, Salmonella typhimurium LT2
cgcagauauuuccggcaa

SEQ ID NO: 1849995 - RNA, 20 nt, Salmonella typhimurium LT2
cgcagacuugaaucugucaa

SEQ ID NO: 1849996 - RNA, 14 nt, Salmonella typhimurium LT2
cgcagagcccagcg

SEQ ID NO: 1849997 - RNA, 15 nt, Salmonella typhimurium LT2
cgcagagcccagcgc

SEQ ID NO: 1849998 - RNA, 16 nt, Salmonella typhimurium LT2
cgcagacgucaacacc

SEQ ID NO: 1849999 - RNA, 20 nt, Salmonella typhimurium LT2
cgcagacgucaacaccucca

SEQ ID NO: 1850000 - RNA, 21 nt, Salmonella typhimurium LT2
cgcacuaccagaaacaacacg

SEQ ID NO: 1850001 - RNA, 13 nt, Salmonella typhimurium LT2
cgcagaaccgccg

SEQ ID NO: 1850002 - RNA, 14 nt, Salmonella typhimurium LT2
cgcagacacugcca

SEQ ID NO: 1850003 - RNA, 14 nt, Salmonella typhimurium LT2
cgcaaucaucacca

SEQ ID NO: 1850004 - RNA, 19 nt, Salmonella typhimurium LT2
cgcaaucucgcaagauucc

SEQ ID NO: 1850005 - RNA, 17 nt, Salmonella typhimurium LT2
cgcaaucccgcgcugcg

SEQ ID NO: 1850006 - RNA, 13 nt, Salmonella typhimurium LT2
cgcaauuaauuua

SEQ ID NO: 1850007 - RNA, 20 nt, Salmonella typhimurium LT2
cgcaauuaccgaaaaucuuc

SEQ ID NO: 1850008 - RNA, 17 nt, Salmonella typhimurium LT2
cgcaauuacucuuugug

SEQ ID NO: 1850009 - RNA, 18 nt, Salmonella typhimurium LT2
cgcaauguggacaaucag

SEQ ID NO: 1850010 - RNA, 14 nt, Salmonella typhimurium LT2
cgcacaagccugca

SEQ ID NO: 1850011 - RNA, 18 nt, Salmonella typhimurium LT2
cgcacaguuuuccccccu

SEQ ID NO: 1850012 - RNA, 19 nt, Salmonella typhimurium LT2
cgcaaccauuaccgccaac

SEQ ID NO: 1850013 - RNA, 20 nt, Salmonella typhimurium LT2
cgcaaaaucgcaaacgccag

SEQ ID NO: 1850014 - RNA, 18 nt, Salmonella typhimurium LT2
cgcaagauuccagauagc

SEQ ID NO: 1850015 - RNA, 11 nt, Salmonella typhimurium LT2
cgcaagaaaag

SEQ ID NO: 1850016 - RNA, 22 nt, Salmonella typhimurium LT2
cgcaaucacauacagcacuucc

SEQ ID NO: 1850017 - RNA, 14 nt, Salmonella typhimurium LT2
cgccagacccagcg

SEQ ID NO: 1850018 - RNA, 23 nt, Salmonella typhimurium LT2
cgccagacccacuaacugccgcu

SEQ ID NO: 1850019 - RNA, 16 nt, Salmonella typhimurium LT2
cgccagacucagccag

SEQ ID NO: 1850020 - RNA, 14 nt, Salmonella typhimurium LT2
cgccagaaacugug

SEQ ID NO: 1850021 - RNA, 14 nt, Salmonella typhimurium LT2
cgccacuuccagcg

SEQ ID NO: 1850022 - RNA, 15 nt, Salmonella typhimurium LT2
cgccacuuccagcgc

SEQ ID NO: 1850023 - RNA, 21 nt, Salmonella typhimurium LT2
cgccacugugauacacgccgu

SEQ ID NO: 1850024 - RNA, 15 nt, Salmonella typhimurium LT2
cgccacgcuccuucu

SEQ ID NO: 1850025 - RNA, 17 nt, Salmonella typhimurium LT2
cgccacggauggccucu

SEQ ID NO: 1850026 - RNA, 15 nt, Salmonella typhimurium LT2
cgccacgccgcccgc

SEQ ID NO: 1850027 - RNA, 17 nt, Salmonella typhimurium LT2
cgccacgcgccaggucu

SEQ ID NO: 1850028 - RNA, 21 nt, Salmonella typhimurium LT2
cgccacccgccugcgccuuga

SEQ ID NO: 1850029 - RNA, 13 nt, Salmonella typhimurium LT2
cgccaagcgcgga

SEQ ID NO: 1850030 - RNA, 15 nt, Salmonella typhimurium LT2
cgccaaguacgccuu

SEQ ID NO: 1850031 - RNA, 15 nt, Salmonella typhimurium LT2
cgccaauccaugccg

SEQ ID NO: 1850032 - RNA, 20 nt, Salmonella typhimurium LT2
cgccaaucaacgccgccagg

SEQ ID NO: 1850033 - RNA, 12 nt, Salmonella typhimurium LT2
cgccaauaccaa

SEQ ID NO: 1850034 - RNA, 19 nt, Salmonella typhimurium LT2
cgccaaacugcgcgccgcc

SEQ ID NO: 1850035 - RNA, 18 nt, Salmonella typhimurium LT2
cgccaaagaaacgcugau

SEQ ID NO: 1850036 - RNA, 19 nt, Salmonella typhimurium LT2
cgccaaacccgccacaggc

SEQ ID NO: 1850037 - RNA, 16 nt, Salmonella typhimurium LT2
cgccaaaagaggcagc

SEQ ID NO: 1850038 - RNA, 16 nt, Salmonella typhimurium LT2
cgccaaaccagacccg

SEQ ID NO: 1850039 - RNA, 18 nt, Salmonella typhimurium LT2
cgccaaagcagcugcugg

SEQ ID NO: 1850040 - RNA, 23 nt, Salmonella typhimurium LT2
cgccaaagcagugaauccccaga

SEQ ID NO: 1850041 - RNA, 19 nt, Salmonella typhimurium LT2
cgccaaagcgguccggcau

SEQ ID NO: 1850042 - RNA, 16 nt, Salmonella typhimurium LT2
cgccaaagcguaaaca

SEQ ID NO: 1850043 - RNA, 20 nt, Salmonella typhimurium LT2
cgccaaagggauaagaaaga

SEQ ID NO: 1850044 - RNA, 18 nt, Salmonella typhimurium LT2
cgccaaagcgcugcugcu

SEQ ID NO: 1850045 - RNA, 20 nt, Salmonella typhimurium LT2
cgccaaaucuguucugucca

SEQ ID NO: 1850046 - RNA, 15 nt, Salmonella typhimurium LT2
cgccaaccugcuggu

SEQ ID NO: 1850047 - RNA, 14 nt, Salmonella typhimurium LT2
cgccaaccucccaa

SEQ ID NO: 1850048 - RNA, 18 nt, Salmonella typhimurium LT2
cgccaacgccacugccau

SEQ ID NO: 1850049 - RNA, 13 nt, Salmonella typhimurium LT2
cgccaaccgccau

SEQ ID NO: 1850050 - RNA, 12 nt, Salmonella typhimurium LT2
cgccaaccggcu

SEQ ID NO: 1850051 - RNA, 16 nt, Salmonella typhimurium LT2
cgccaacuuuuugcgc

SEQ ID NO: 1850052 - RNA, 20 nt, Salmonella typhimurium LT2
cgccaagaccgccuaacagc

SEQ ID NO: 1850053 - RNA, 15 nt, Salmonella typhimurium LT2
cgcauuaaaaugaug

SEQ ID NO: 1850054 - RNA, 21 nt, Salmonella typhimurium LT2
cgcauuauauuggcuggccug

SEQ ID NO: 1850055 - RNA, 14 nt, Salmonella typhimurium LT2
cgcauuauucggcu

SEQ ID NO: 1850056 - RNA, 16 nt, Salmonella typhimurium LT2
cgcauggcggccagau

SEQ ID NO: 1850057 - RNA, 17 nt, Salmonella typhimurium LT2
cgcauugcgucccagca

SEQ ID NO: 1850058 - RNA, 19 nt, Salmonella typhimurium LT2
cgcauugcgucccagcaca

SEQ ID NO: 1850059 - RNA, 16 nt, Salmonella typhimurium LT2
cgccaaaaaaggcagc

SEQ ID NO: 1850060 - RNA, 20 nt, Salmonella typhimurium LT2
cgccaaaaaaggcagccagg

SEQ ID NO: 1850061 - RNA, 22 nt, Salmonella typhimurium LT2
cgcagcugccacaccacaugcg

SEQ ID NO: 1850062 - RNA, 19 nt, Salmonella typhimurium LT2
cgcagcugccacaccacau

SEQ ID NO: 1850063 - RNA, 16 nt, Salmonella typhimurium LT2
cgcagcuccagcucag

SEQ ID NO: 1850064 - RNA, 17 nt, Salmonella typhimurium LT2
cgcagcacaugcaauuu

SEQ ID NO: 1850065 - RNA, 23 nt, Salmonella typhimurium LT2
cgcagaucguauccggcggcaaa

SEQ ID NO: 1850066 - RNA, 12 nt, Salmonella typhimurium LT2
cgcaggccaaac

SEQ ID NO: 1850067 - RNA, 17 nt, Salmonella typhimurium LT2
cgcaggcccggcaggca

SEQ ID NO: 1850068 - RNA, 16 nt, Salmonella typhimurium LT2
cgcagugaccagcauc

SEQ ID NO: 1850069 - RNA, 16 nt, Salmonella typhimurium LT2
cgcaggggggaaauga

SEQ ID NO: 1850070 - RNA, 22 nt, Salmonella typhimurium LT2
cgcaucguggccgauauugccu

SEQ ID NO: 1850071 - RNA, 20 nt, Salmonella typhimurium LT2
cgcaucugacaucagaaaau

SEQ ID NO: 1850072 - RNA, 14 nt, Salmonella typhimurium LT2
cgcaucuuuuuccc

SEQ ID NO: 1850073 - RNA, 14 nt, Salmonella typhimurium LT2
cgcaucgcccgccc

SEQ ID NO: 1850074 - RNA, 15 nt, Salmonella typhimurium LT2
cgcaucgcccugcca

SEQ ID NO: 1850075 - RNA, 14 nt, Salmonella typhimurium LT2
cgcauccggccagc

SEQ ID NO: 1850076 - RNA, 16 nt, Salmonella typhimurium LT2
cgcauccgucaaaaug

SEQ ID NO: 1850077 - RNA, 16 nt, Salmonella typhimurium LT2
cgcauccacguaaaua

SEQ ID NO: 1850078 - RNA, 15 nt, Salmonella typhimurium LT2
cgcaucauucaucuc

SEQ ID NO: 1850079 - RNA, 20 nt, Salmonella typhimurium LT2
cgcaucaaauacgcgcgccg

SEQ ID NO: 1850080 - RNA, 12 nt, Salmonella typhimurium LT2
cgcaucaauguc

SEQ ID NO: 1850081 - RNA, 13 nt, Salmonella typhimurium LT2
cgcauauuuuuua

SEQ ID NO: 1850082 - RNA, 19 nt, Salmonella typhimurium LT2
cgcauacucuuggagagca

SEQ ID NO: 1850083 - RNA, 17 nt, Salmonella typhimurium LT2
cgcauaccuucaugcau

SEQ ID NO: 1850084 - RNA, 15 nt, Salmonella typhimurium LT2
cgagcaggaaccaca

SEQ ID NO: 1850085 - RNA, 19 nt, Salmonella typhimurium LT2
cgagcaauuuccucugccg

SEQ ID NO: 1850086 - RNA, 20 nt, Salmonella typhimurium LT2
cgagauaaccaucgcgcagc

SEQ ID NO: 1850087 - RNA, 20 nt, Salmonella typhimurium LT2
cgagauacugcaacgccaga

SEQ ID NO: 1850088 - RNA, 23 nt, Salmonella typhimurium LT2
cgagagaauuaacagcgcgacca

SEQ ID NO: 1850089 - RNA, 13 nt, Salmonella typhimurium LT2
cgagagaaaaaaa

SEQ ID NO: 1850090 - RNA, 15 nt, Salmonella typhimurium LT2
cgagaucgccaccgc

SEQ ID NO: 1850091 - RNA, 17 nt, Salmonella typhimurium LT2
cgagaugcauaaaaaaa

SEQ ID NO: 1850092 - RNA, 23 nt, Salmonella typhimurium LT2
cgagauuuuucugcgccaccagc

SEQ ID NO: 1850093 - RNA, 14 nt, Salmonella typhimurium LT2
cgagauucaauaac

SEQ ID NO: 1850094 - RNA, 17 nt, Salmonella typhimurium LT2
cgagacugcccggcaua

SEQ ID NO: 1850095 - RNA, 14 nt, Salmonella typhimurium LT2
cgagacccagcgcg

SEQ ID NO: 1850096 - RNA, 22 nt, Salmonella typhimurium LT2
cgagaccaccguuauuuccaaa

SEQ ID NO: 1850097 - RNA, 17 nt, Salmonella typhimurium LT2
cgagaaugucgccaugu

SEQ ID NO: 1850098 - RNA, 14 nt, Salmonella typhimurium LT2
cgagaaacaccaga

SEQ ID NO: 1850099 - RNA, 22 nt, Salmonella typhimurium LT2
cgacgggaugcgauguaaaaau

SEQ ID NO: 1850100 - RNA, 22 nt, Salmonella typhimurium LT2
cgacgguacaaaccccacccgc

SEQ ID NO: 1850101 - RNA, 23 nt, Salmonella typhimurium LT2
cgacggcuucuucacgcagcgcc

SEQ ID NO: 1850102 - RNA, 17 nt, Salmonella typhimurium LT2
cgacguccacaccuucc

SEQ ID NO: 1850103 - RNA, 17 nt, Salmonella typhimurium LT2
cgacgcucuuccucaau

SEQ ID NO: 1850104 - RNA, 17 nt, Salmonella typhimurium LT2
cgacgcguggcaucuua

SEQ ID NO: 1850105 - RNA, 17 nt, Salmonella typhimurium LT2
cgacgcggcuccggcuu

SEQ ID NO: 1850106 - RNA, 13 nt, Salmonella typhimurium LT2
cgacgcugccaca

SEQ ID NO: 1850107 - RNA, 13 nt, Salmonella typhimurium LT2
cgacgcugucaau

SEQ ID NO: 1850108 - RNA, 23 nt, Salmonella typhimurium LT2
cgacggagauuaacagcgcgacc

SEQ ID NO: 1850109 - RNA, 18 nt, Salmonella typhimurium LT2
cgacggccaguugcgcag

SEQ ID NO: 1850110 - RNA, 16 nt, Salmonella typhimurium LT2
cgacuggauacaggcg

SEQ ID NO: 1850111 - RNA, 15 nt, Salmonella typhimurium LT2
cgacugaccagaccg

SEQ ID NO: 1850112 - RNA, 15 nt, Salmonella typhimurium LT2
cgacuucgcuuccug

SEQ ID NO: 1850113 - RNA, 14 nt, Salmonella typhimurium LT2
cgacuucacgcugc

SEQ ID NO: 1850114 - RNA, 20 nt, Salmonella typhimurium LT2
cgacuucacgggucauuaag

SEQ ID NO: 1850115 - RNA, 13 nt, Salmonella typhimurium LT2
cgacuuaucuucc

SEQ ID NO: 1850116 - RNA, 16 nt, Salmonella typhimurium LT2
cgacuuaucuuccacg

SEQ ID NO: 1850117 - RNA, 23 nt, Salmonella typhimurium LT2
cgacuuuuggcacgacuuuuccu

SEQ ID NO: 1850118 - RNA, 23 nt, Salmonella typhimurium LT2
cgagaaaaucccauugcccgcug

SEQ ID NO: 1850119 - RNA, 19 nt, Salmonella typhimurium LT2
cgacuaucagaaaaaauua

SEQ ID NO: 1850120 - RNA, 14 nt, Salmonella typhimurium LT2
cgacucacgcgcgc

SEQ ID NO: 1850121 - RNA, 19 nt, Salmonella typhimurium LT2
cgacucaucuuuuacaggc

SEQ ID NO: 1850122 - RNA, 15 nt, Salmonella typhimurium LT2
cgacucauuacgcca

SEQ ID NO: 1850123 - RNA, 12 nt, Salmonella typhimurium LT2
cgacucccaggc

SEQ ID NO: 1850124 - RNA, 20 nt, Salmonella typhimurium LT2
cgacucccccagauucugau

SEQ ID NO: 1850125 - RNA, 13 nt, Salmonella typhimurium LT2
cgacgucuuucuu

SEQ ID NO: 1850126 - RNA, 17 nt, Salmonella typhimurium LT2
cgacguuaacgccgcca

SEQ ID NO: 1850127 - RNA, 19 nt, Salmonella typhimurium LT2
cgagugcguucuuccacuu

SEQ ID NO: 1850128 - RNA, 21 nt, Salmonella typhimurium LT2
cgaguggcgcggaaagccuuc

SEQ ID NO: 1850129 - RNA, 22 nt, Salmonella typhimurium LT2
cgagugaggaccguacucagau

SEQ ID NO: 1850130 - RNA, 13 nt, Salmonella typhimurium LT2
cgagucgccgcuu

SEQ ID NO: 1850131 - RNA, 16 nt, Salmonella typhimurium LT2
cgaguagcgaaacccc

SEQ ID NO: 1850132 - RNA, 17 nt, Salmonella typhimurium LT2
cgaggugaauaaauccu

SEQ ID NO: 1850133 - RNA, 15 nt, Salmonella typhimurium LT2
cgauacaccuucaca

SEQ ID NO: 1850134 - RNA, 21 nt, Salmonella typhimurium LT2
cgauacaggacugacugcugu

SEQ ID NO: 1850135 - RNA, 15 nt, Salmonella typhimurium LT2
cgauacccaccagcg

SEQ ID NO: 1850136 - RNA, 14 nt, Salmonella typhimurium LT2
cgauacccaccagc

SEQ ID NO: 1850137 - RNA, 19 nt, Salmonella typhimurium LT2
cgauacccgcccagaucag

SEQ ID NO: 1850138 - RNA, 16 nt, Salmonella typhimurium LT2
cgauagagaguuccuc

SEQ ID NO: 1850139 - RNA, 19 nt, Salmonella typhimurium LT2
cgauagagaguuccuccug

SEQ ID NO: 1850140 - RNA, 17 nt, Salmonella typhimurium LT2
cgauagagcgcggucag

SEQ ID NO: 1850141 - RNA, 23 nt, Salmonella typhimurium LT2
cgauagcccggcauguccaucag

SEQ ID NO: 1850142 - RNA, 23 nt, Salmonella typhimurium LT2
cgauaugaauaauuucggcggcg

SEQ ID NO: 1850143 - RNA, 15 nt, Salmonella typhimurium LT2
cgauagcgaacggcg

SEQ ID NO: 1850144 - RNA, 18 nt, Salmonella typhimurium LT2
cgauaguccauuuuccua

SEQ ID NO: 1850145 - RNA, 17 nt, Salmonella typhimurium LT2
cgaguuaagcgcccgcg

SEQ ID NO: 1850146 - RNA, 12 nt, Salmonella typhimurium LT2
cgaguucaaguc

SEQ ID NO: 1850147 - RNA, 15 nt, Salmonella typhimurium LT2
cgaguuccaguccac

SEQ ID NO: 1850148 - RNA, 14 nt, Salmonella typhimurium LT2
cgauaaucaccagc

SEQ ID NO: 1850149 - RNA, 21 nt, Salmonella typhimurium LT2
cgauaauauccgacgccuguu

SEQ ID NO: 1850150 - RNA, 15 nt, Salmonella typhimurium LT2
cgauaaucaccagcc

SEQ ID NO: 1850151 - RNA, 19 nt, Salmonella typhimurium LT2
cgauaacguuaccgcagcg

SEQ ID NO: 1850152 - RNA, 15 nt, Salmonella typhimurium LT2
cgauaacucuucauc

SEQ ID NO: 1850153 - RNA, 20 nt, Salmonella typhimurium LT2
cgauaaggucgcuauccagc

SEQ ID NO: 1850154 - RNA, 14 nt, Salmonella typhimurium LT2
cgauaauaaaauau

SEQ ID NO: 1850155 - RNA, 18 nt, Salmonella typhimurium LT2
cgagccgucgccggccug

SEQ ID NO: 1850156 - RNA, 13 nt, Salmonella typhimurium LT2
cgagcgauagaga

SEQ ID NO: 1850157 - RNA, 15 nt, Salmonella typhimurium LT2
cgagcgaugcugcuu

SEQ ID NO: 1850158 - RNA, 21 nt, Salmonella typhimurium LT2
cgagcucaguccagccgccgc

SEQ ID NO: 1850159 - RNA, 18 nt, Salmonella typhimurium LT2
cgagcgcgucagcgccuc

SEQ ID NO: 1850160 - RNA, 17 nt, Salmonella typhimurium LT2
cgagcgcgucagcgccu

SEQ ID NO: 1850161 - RNA, 20 nt, Salmonella typhimurium LT2
cgagcgcuccgcacgccggu

SEQ ID NO: 1850162 - RNA, 18 nt, Salmonella typhimurium LT2
cgaggaacaucagccagc

SEQ ID NO: 1850163 - RNA, 15 nt, Salmonella typhimurium LT2
cgaggaacgcgcagu

SEQ ID NO: 1850164 - RNA, 20 nt, Salmonella typhimurium LT2
cgaggaacuguucagccagc

SEQ ID NO: 1850165 - RNA, 20 nt, Salmonella typhimurium LT2
cgagcuuugacgacccgcuu

SEQ ID NO: 1850166 - RNA, 13 nt, Salmonella typhimurium LT2
cgagcuuacgcac

SEQ ID NO: 1850167 - RNA, 18 nt, Salmonella typhimurium LT2
cgagcugguuucaaugcu

SEQ ID NO: 1850168 - RNA, 22 nt, Salmonella typhimurium LT2
cgaggaguaguuaaaaaagguc

SEQ ID NO: 1850169 - RNA, 17 nt, Salmonella typhimurium LT2
cgaggaucaguaacagg

SEQ ID NO: 1850170 - RNA, 16 nt, Salmonella typhimurium LT2
cgaggcaacagauacg

SEQ ID NO: 1850171 - RNA, 18 nt, Salmonella typhimurium LT2
ccggcucgccacggccaa

SEQ ID NO: 1850172 - RNA, 19 nt, Salmonella typhimurium LT2
ccggcuaugccggaggaua

SEQ ID NO: 1850173 - RNA, 18 nt, Salmonella typhimurium LT2
ccggcguucucccgggcc

SEQ ID NO: 1850174 - RNA, 19 nt, Salmonella typhimurium LT2
ccggcuucuccaccauauc

SEQ ID NO: 1850175 - RNA, 17 nt, Salmonella typhimurium LT2
ccggcuucuuccggccc

SEQ ID NO: 1850176 - RNA, 19 nt, Salmonella typhimurium LT2
ccggcuucuuccggccccg

SEQ ID NO: 1850177 - RNA, 17 nt, Salmonella typhimurium LT2
ccggcuguuuugcuucu

SEQ ID NO: 1850178 - RNA, 23 nt, Salmonella typhimurium LT2
ccggcuguucgacgaauggcggc

SEQ ID NO: 1850179 - RNA, 20 nt, Salmonella typhimurium LT2
ccggcuuaaugcccggcccg

SEQ ID NO: 1850180 - RNA, 19 nt, Salmonella typhimurium LT2
ccggcuuaaugcccggccc

SEQ ID NO: 1850181 - RNA, 11 nt, Salmonella typhimurium LT2
ccggcuucagc

SEQ ID NO: 1850182 - RNA, 18 nt, Salmonella typhimurium LT2
ccggcugauaucauucug

SEQ ID NO: 1850183 - RNA, 14 nt, Salmonella typhimurium LT2
ccggcugacugccg

SEQ ID NO: 1850184 - RNA, 18 nt, Salmonella typhimurium LT2
ccggcucgccuugcgguu

SEQ ID NO: 1850185 - RNA, 23 nt, Salmonella typhimurium LT2
ccggcggcaaaggcauggcaggu

SEQ ID NO: 1850186 - RNA, 13 nt, Salmonella typhimurium LT2
ccggcggcagccg

SEQ ID NO: 1850187 - RNA, 14 nt, Salmonella typhimurium LT2
ccggcggcagaugc

SEQ ID NO: 1850188 - RNA, 15 nt, Salmonella typhimurium LT2
ccggccaccgccugc

SEQ ID NO: 1850189 - RNA, 20 nt, Salmonella typhimurium LT2
ccggcggucaugcuggcgau

SEQ ID NO: 1850190 - RNA, 21 nt, Salmonella typhimurium LT2
ccggcgggcaaccuucaaguu

SEQ ID NO: 1850191 - RNA, 20 nt, Salmonella typhimurium LT2
ccggcggucgauuuugccuu

SEQ ID NO: 1850192 - RNA, 23 nt, Salmonella typhimurium LT2
ccggcggucgauuuugccuucaa

SEQ ID NO: 1850193 - RNA, 17 nt, Salmonella typhimurium LT2
ccggcguaauugcgccu

SEQ ID NO: 1850194 - RNA, 15 nt, Salmonella typhimurium LT2
ccggcguaauccagc

SEQ ID NO: 1850195 - RNA, 18 nt, Salmonella typhimurium LT2
ccggcgucauacugccaa

SEQ ID NO: 1850196 - RNA, 20 nt, Salmonella typhimurium LT2
ccggcgucagcauggugugu

SEQ ID NO: 1850197 - RNA, 18 nt, Salmonella typhimurium LT2
ccggcgucacaccauauc

SEQ ID NO: 1850198 - RNA, 17 nt, Salmonella typhimurium LT2
ccggcguccggcgccug

SEQ ID NO: 1850199 - RNA, 18 nt, Salmonella typhimurium LT2
ccggggaucguucugcug

SEQ ID NO: 1850200 - RNA, 19 nt, Salmonella typhimurium LT2
ccgggcuccauagggcagg

SEQ ID NO: 1850201 - RNA, 23 nt, Salmonella typhimurium LT2
ccggcuuuauuauuucuucuucg

SEQ ID NO: 1850202 - RNA, 19 nt, Salmonella typhimurium LT2
ccggcuuuaacccugugga

SEQ ID NO: 1850203 - RNA, 16 nt, Salmonella typhimurium LT2
ccggcuuuccgcaccg

SEQ ID NO: 1850204 - RNA, 17 nt, Salmonella typhimurium LT2
ccggcuuuccgcaccgc

SEQ ID NO: 1850205 - RNA, 20 nt, Salmonella typhimurium LT2
ccgggaaaucuucuacuuca

SEQ ID NO: 1850206 - RNA, 13 nt, Salmonella typhimurium LT2
ccgggaagcccuu

SEQ ID NO: 1850207 - RNA, 17 nt, Salmonella typhimurium LT2
ccgggccacucuccagc

SEQ ID NO: 1850208 - RNA, 20 nt, Salmonella typhimurium LT2
ccgggccaucuuuuuucacu

SEQ ID NO: 1850209 - RNA, 19 nt, Salmonella typhimurium LT2
ccgggagaaaacgcggccu

SEQ ID NO: 1850210 - RNA, 23 nt, Salmonella typhimurium LT2
ccgggagaaaacgcggccuggaa

SEQ ID NO: 1850211 - RNA, 22 nt, Salmonella typhimurium LT2
ccgggagaacgccgggccugcc

SEQ ID NO: 1850212 - RNA, 16 nt, Salmonella typhimurium LT2
ccgguaacgccguagg

SEQ ID NO: 1850213 - RNA, 20 nt, Salmonella typhimurium LT2
ccgguaaaucaacaaccggc

SEQ ID NO: 1850214 - RNA, 19 nt, Salmonella typhimurium LT2
ccgguaaagcagugcagua

SEQ ID NO: 1850215 - RNA, 14 nt, Salmonella typhimurium LT2
ccggguucgcggca

SEQ ID NO: 1850216 - RNA, 20 nt, Salmonella typhimurium LT2
ccggguucagcgacaggcug

SEQ ID NO: 1850217 - RNA, 17 nt, Salmonella typhimurium LT2
ccggguaaacgcagcgu

SEQ ID NO: 1850218 - RNA, 17 nt, Salmonella typhimurium LT2
ccggguauucaucggca

SEQ ID NO: 1850219 - RNA, 20 nt, Salmonella typhimurium LT2
ccgggguucgaauccccgcc

SEQ ID NO: 1850220 - RNA, 18 nt, Salmonella typhimurium LT2
ccgguauuuuucaccuca

SEQ ID NO: 1850221 - RNA, 14 nt, Salmonella typhimurium LT2
ccggucgcgccagc

SEQ ID NO: 1850222 - RNA, 19 nt, Salmonella typhimurium LT2
ccggugaaaaacaucggca

SEQ ID NO: 1850223 - RNA, 21 nt, Salmonella typhimurium LT2
ccgucgagaaaccgcucgccg

SEQ ID NO: 1850224 - RNA, 16 nt, Salmonella typhimurium LT2
ccgucgacaaagccaa

SEQ ID NO: 1850225 - RNA, 23 nt, Salmonella typhimurium LT2
ccgucaggcuugccgcgccagac

SEQ ID NO: 1850226 - RNA, 12 nt, Salmonella typhimurium LT2
ccgucagccacu

SEQ ID NO: 1850227 - RNA, 18 nt, Salmonella typhimurium LT2
ccgucagcaccagcgaga

SEQ ID NO: 1850228 - RNA, 17 nt, Salmonella typhimurium LT2
ccgucgaugauggcggc

SEQ ID NO: 1850229 - RNA, 17 nt, Salmonella typhimurium LT2
ccgucggcgccagccac

SEQ ID NO: 1850230 - RNA, 18 nt, Salmonella typhimurium LT2
ccgucggcagccagaccu

SEQ ID NO: 1850231 - RNA, 19 nt, Salmonella typhimurium LT2
ccgucucaaccagcaauga

SEQ ID NO: 1850232 - RNA, 15 nt, Salmonella typhimurium LT2
ccgucucaaccagca

SEQ ID NO: 1850233 - RNA, 19 nt, Salmonella typhimurium LT2
ccgucgucaccgccgcgcu

SEQ ID NO: 1850234 - RNA, 14 nt, Salmonella typhimurium LT2
ccggugagcgccgc

SEQ ID NO: 1850235 - RNA, 13 nt, Salmonella typhimurium LT2
ccgguuuuuuaau

SEQ ID NO: 1850236 - RNA, 22 nt, Salmonella typhimurium LT2
ccgguuuuuuuugccugaaaug

SEQ ID NO: 1850237 - RNA, 18 nt, Salmonella typhimurium LT2
ccguaaacgccugcacca

SEQ ID NO: 1850238 - RNA, 14 nt, Salmonella typhimurium LT2
ccguaaaccgcguu

SEQ ID NO: 1850239 - RNA, 13 nt, Salmonella typhimurium LT2
ccguaaaguuccc

SEQ ID NO: 1850240 - RNA, 16 nt, Salmonella typhimurium LT2
ccguagcugcgcgccg

SEQ ID NO: 1850241 - RNA, 19 nt, Salmonella typhimurium LT2
ccguagcguacuuucaaac

SEQ ID NO: 1850242 - RNA, 23 nt, Salmonella typhimurium LT2
ccguagccaacacaucagcaacu

SEQ ID NO: 1850243 - RNA, 17 nt, Salmonella typhimurium LT2
ccgucagauucugcggu

SEQ ID NO: 1850244 - RNA, 16 nt, Salmonella typhimurium LT2
ccguaguagguaucca

SEQ ID NO: 1850245 - RNA, 18 nt, Salmonella typhimurium LT2
ccuacagguugucgcaac

SEQ ID NO: 1850246 - RNA, 22 nt, Salmonella typhimurium LT2
ccuacagguugucgcaacgugu

SEQ ID NO: 1850247 - RNA, 15 nt, Salmonella typhimurium LT2
ccuaacuggaaaaag

SEQ ID NO: 1850248 - RNA, 15 nt, Salmonella typhimurium LT2
ccuaacacaugcaag

SEQ ID NO: 1850249 - RNA, 17 nt, Salmonella typhimurium LT2
ccguuuuagguucuuca

SEQ ID NO: 1850250 - RNA, 12 nt, Salmonella typhimurium LT2
ccguuuucaaac

SEQ ID NO: 1850251 - RNA, 19 nt, Salmonella typhimurium LT2
ccguuuuacacggcgugac

SEQ ID NO: 1850252 - RNA, 19 nt, Salmonella typhimurium LT2
ccguuuguaacauauuuuu

SEQ ID NO: 1850253 - RNA, 17 nt, Salmonella typhimurium LT2
ccguuuucgucaacaua

SEQ ID NO: 1850254 - RNA, 13 nt, Salmonella typhimurium LT2
ccguuucccaggu

SEQ ID NO: 1850255 - RNA, 17 nt, Salmonella typhimurium LT2
ccguugcgcccaucauc

SEQ ID NO: 1850256 - RNA, 20 nt, Salmonella typhimurium LT2
ccguucccucugagaacuau

SEQ ID NO: 1850257 - RNA, 20 nt, Salmonella typhimurium LT2
ccguugcaauauaguugagc

SEQ ID NO: 1850258 - RNA, 14 nt, Salmonella typhimurium LT2
ccgugccgccgcga

SEQ ID NO: 1850259 - RNA, 13 nt, Salmonella typhimurium LT2
ccgugcccagcau

SEQ ID NO: 1850260 - RNA, 21 nt, Salmonella typhimurium LT2
ccgugaaagcauaccuucaca

SEQ ID NO: 1850261 - RNA, 20 nt, Salmonella typhimurium LT2
ccguggaagcggaacugaug

SEQ ID NO: 1850262 - RNA, 19 nt, Salmonella typhimurium LT2
ccguguaagagcuggucgg

SEQ ID NO: 1850263 - RNA, 20 nt, Salmonella typhimurium LT2
ccguguccaugcaugacgca

SEQ ID NO: 1850264 - RNA, 15 nt, Salmonella typhimurium LT2
ccguucauuugcaau

SEQ ID NO: 1850265 - RNA, 17 nt, Salmonella typhimurium LT2
ccguuccaaucucuuuu

SEQ ID NO: 1850266 - RNA, 13 nt, Salmonella typhimurium LT2
ccguucaggcaaa

SEQ ID NO: 1850267 - RNA, 20 nt, Salmonella typhimurium LT2
ccguucaggcaaaguuguuu

SEQ ID NO: 1850268 - RNA, 18 nt, Salmonella typhimurium LT2
ccuccccaggcgcuauuc

SEQ ID NO: 1850269 - RNA, 13 nt, Salmonella typhimurium LT2
ccucccaguuccc

SEQ ID NO: 1850270 - RNA, 17 nt, Salmonella typhimurium LT2
ccuccauggcuugucgc

SEQ ID NO: 1850271 - RNA, 14 nt, Salmonella typhimurium LT2
ccuccauccaggua

SEQ ID NO: 1850272 - RNA, 11 nt, Salmonella typhimurium LT2
ccucccuuucu

SEQ ID NO: 1850273 - RNA, 16 nt, Salmonella typhimurium LT2
ccuccgcagcuucauc

SEQ ID NO: 1850274 - RNA, 13 nt, Salmonella typhimurium LT2
ccuccgccaccag

SEQ ID NO: 1850275 - RNA, 14 nt, Salmonella typhimurium LT2
ccuccgccaccagc

SEQ ID NO: 1850276 - RNA, 21 nt, Salmonella typhimurium LT2
ccuccgcguagcccagcgccg

SEQ ID NO: 1850277 - RNA, 22 nt, Salmonella typhimurium LT2
ccuccgcguagcccagcgccgc

SEQ ID NO: 1850278 - RNA, 23 nt, Salmonella typhimurium LT2
ccuccugauaaccuauuuugcaa

SEQ ID NO: 1850279 - RNA, 12 nt, Salmonella typhimurium LT2
ccuccucucuuc

SEQ ID NO: 1850280 - RNA, 18 nt, Salmonella typhimurium LT2
ccuccucucuuccuccug

SEQ ID NO: 1850281 - RNA, 18 nt, Salmonella typhimurium LT2
ccuccucgacguuuucca

SEQ ID NO: 1850282 - RNA, 17 nt, Salmonella typhimurium LT2
ccuccucauucagcggc

SEQ ID NO: 1850283 - RNA, 19 nt, Salmonella typhimurium LT2
ccuccggugaagguaauuu

SEQ ID NO: 1850284 - RNA, 13 nt, Salmonella typhimurium LT2
ccuccggcuucag

SEQ ID NO: 1850285 - RNA, 20 nt, Salmonella typhimurium LT2
ccuccaguaauucccggcag

SEQ ID NO: 1850286 - RNA, 19 nt, Salmonella typhimurium LT2
ccuccaggcuacccacccc

SEQ ID NO: 1850287 - RNA, 17 nt, Salmonella typhimurium LT2
ccuccagcuccgcguau

SEQ ID NO: 1850288 - RNA, 14 nt, Salmonella typhimurium LT2
ccuccagcgacccu

SEQ ID NO: 1850289 - RNA, 12 nt, Salmonella typhimurium LT2
ccuccagcgagg

SEQ ID NO: 1850290 - RNA, 20 nt, Salmonella typhimurium LT2
ccuccagcgaggccucuccu

SEQ ID NO: 1850291 - RNA, 18 nt, Salmonella typhimurium LT2
ccuaccggcggcacccgu

SEQ ID NO: 1850292 - RNA, 15 nt, Salmonella typhimurium LT2
ccuaccugccgccau

SEQ ID NO: 1850293 - RNA, 13 nt, Salmonella typhimurium LT2
ccuaccgaggcag

SEQ ID NO: 1850294 - RNA, 16 nt, Salmonella typhimurium LT2
ccuaccgaggcagggg

SEQ ID NO: 1850295 - RNA, 11 nt, Salmonella typhimurium LT2
ccuacccgcgu

SEQ ID NO: 1850296 - RNA, 15 nt, Salmonella typhimurium LT2
ccucaucggcaaaca

SEQ ID NO: 1850297 - RNA, 18 nt, Salmonella typhimurium LT2
ccucaucccguagcguca

SEQ ID NO: 1850298 - RNA, 20 nt, Salmonella typhimurium LT2
ccucauucagcggcugcgcc

SEQ ID NO: 1850299 - RNA, 23 nt, Salmonella typhimurium LT2
ccucaugcuuaucgccaaaccag

SEQ ID NO: 1850300 - RNA, 20 nt, Salmonella typhimurium LT2
ccucauggaacuuauccaca

SEQ ID NO: 1850301 - RNA, 18 nt, Salmonella typhimurium LT2
ccuacggugugccugcgu

SEQ ID NO: 1850302 - RNA, 16 nt, Salmonella typhimurium LT2
ccucgcgcaccccggc

SEQ ID NO: 1850303 - RNA, 19 nt, Salmonella typhimurium LT2
ccuccuugugggcagcgaa

SEQ ID NO: 1850304 - RNA, 14 nt, Salmonella typhimurium LT2
ccucgaaguauuac

SEQ ID NO: 1850305 - RNA, 13 nt, Salmonella typhimurium LT2
ccucgaaugcugg

SEQ ID NO: 1850306 - RNA, 20 nt, Salmonella typhimurium LT2
ccucgguauguccugccgca

SEQ ID NO: 1850307 - RNA, 13 nt, Salmonella typhimurium LT2
ccucgcucaccgg

SEQ ID NO: 1850308 - RNA, 14 nt, Salmonella typhimurium LT2
ccucgcucaccggc

SEQ ID NO: 1850309 - RNA, 22 nt, Salmonella typhimurium LT2
ccucguguaccauuguuuacuu

SEQ ID NO: 1850310 - RNA, 20 nt, Salmonella typhimurium LT2
ccucguuugcugagcagcca

SEQ ID NO: 1850311 - RNA, 23 nt, Salmonella typhimurium LT2
ccucguuugcugagcagccagcc

SEQ ID NO: 1850312 - RNA, 22 nt, Salmonella typhimurium LT2
ccucuccugaagccagcgcccg

SEQ ID NO: 1850313 - RNA, 23 nt, Salmonella typhimurium LT2
ccucucaccgugguuaccgccag

SEQ ID NO: 1850314 - RNA, 12 nt, Salmonella typhimurium LT2
ccucucacugga

SEQ ID NO: 1850315 - RNA, 12 nt, Salmonella typhimurium LT2
ccucucuuccuc

SEQ ID NO: 1850316 - RNA, 14 nt, Salmonella typhimurium LT2
ccucucuuccuccu

SEQ ID NO: 1850317 - RNA, 14 nt, Salmonella typhimurium LT2
ccucucuucucgcu

SEQ ID NO: 1850318 - RNA, 18 nt, Salmonella typhimurium LT2
ccucucuccgccugcggu

SEQ ID NO: 1850319 - RNA, 20 nt, Salmonella typhimurium LT2
ccucuucuuuuaauugccag

SEQ ID NO: 1850320 - RNA, 13 nt, Salmonella typhimurium LT2
ccugaaaccgccg

SEQ ID NO: 1850321 - RNA, 15 nt, Salmonella typhimurium LT2
ccugaaaccaggcgc

SEQ ID NO: 1850322 - RNA, 13 nt, Salmonella typhimurium LT2
ccugaaacgcggc

SEQ ID NO: 1850323 - RNA, 15 nt, Salmonella typhimurium LT2
ccucuuucgccgcuu

SEQ ID NO: 1850324 - RNA, 22 nt, Salmonella typhimurium LT2
ccucuuuuucaacguccaccag

SEQ ID NO: 1850325 - RNA, 17 nt, Salmonella typhimurium LT2
ccucuuucaugcggucu

SEQ ID NO: 1850326 - RNA, 15 nt, Salmonella typhimurium LT2
ccucuuucugauaac

SEQ ID NO: 1850327 - RNA, 16 nt, Salmonella typhimurium LT2
ccucuuucagccggcu

SEQ ID NO: 1850328 - RNA, 18 nt, Salmonella typhimurium LT2
ccucuugucaggcaaaaa

SEQ ID NO: 1850329 - RNA, 11 nt, Salmonella typhimurium LT2
ccugaacaggg

SEQ ID NO: 1850330 - RNA, 23 nt, Salmonella typhimurium LT2
ccugaaauccggcuuugacaaaa

SEQ ID NO: 1850331 - RNA, 14 nt, Salmonella typhimurium LT2
ccugaaccagcggc

SEQ ID NO: 1850332 - RNA, 18 nt, Salmonella typhimurium LT2
ccugaaccagcggcacca

SEQ ID NO: 1850333 - RNA, 17 nt, Salmonella typhimurium LT2
ccugaacgccuaccgcu

SEQ ID NO: 1850334 - RNA, 15 nt, Salmonella typhimurium LT2
ccugaaggacaagcu

SEQ ID NO: 1850335 - RNA, 18 nt, Salmonella typhimurium LT2
ccugaaggacaagcugcg

SEQ ID NO: 1850336 - RNA, 15 nt, Salmonella typhimurium LT2
ccugccguuuuuaac

SEQ ID NO: 1850337 - RNA, 17 nt, Salmonella typhimurium LT2
ccugccguuuauuauuu

SEQ ID NO: 1850338 - RNA, 15 nt, Salmonella typhimurium LT2
ccugccggacugaua

SEQ ID NO: 1850339 - RNA, 22 nt, Salmonella typhimurium LT2
ccugccggauuuuucauagcag

SEQ ID NO: 1850340 - RNA, 18 nt, Salmonella typhimurium LT2
ccugccggauggcggcgc

SEQ ID NO: 1850341 - RNA, 23 nt, Salmonella typhimurium LT2
ccugccugaagcgcaguguuaau

SEQ ID NO: 1850342 - RNA, 20 nt, Salmonella typhimurium LT2
ccugcgagcuguagcgaagg

SEQ ID NO: 1850343 - RNA, 14 nt, Salmonella typhimurium LT2
ccugcgccagccgg

SEQ ID NO: 1850344 - RNA, 15 nt, Salmonella typhimurium LT2
ccugcgcuuugacau

SEQ ID NO: 1850345 - RNA, 23 nt, Salmonella typhimurium LT2
ccugcgcuuuggguuaaugccag

SEQ ID NO: 1850346 - RNA, 19 nt, Salmonella typhimurium LT2
ccugcgcucauauacccug

SEQ ID NO: 1850347 - RNA, 22 nt, Salmonella typhimurium LT2
ccugcgcguucggguuuuccug

SEQ ID NO: 1850348 - RNA, 23 nt, Salmonella typhimurium LT2
ccugcgcgacgcccaccaguccc

SEQ ID NO: 1850349 - RNA, 24 nt, Salmonella typhimurium LT2
ccugcgcgacgcccaccagucccu

SEQ ID NO: 1850350 - RNA, 17 nt, Salmonella typhimurium LT2
ccugcgccuuaaaaaga

SEQ ID NO: 1850351 - RNA, 16 nt, Salmonella typhimurium LT2
ccugcgucgccccaau

SEQ ID NO: 1850352 - RNA, 14 nt, Salmonella typhimurium LT2
ccugcgggagcugu

SEQ ID NO: 1850353 - RNA, 20 nt, Salmonella typhimurium LT2
ccugcggccaugaucgccgc

SEQ ID NO: 1850354 - RNA, 16 nt, Salmonella typhimurium LT2
ccugcggcguggaaaa

SEQ ID NO: 1850355 - RNA, 20 nt, Salmonella typhimurium LT2
ccugcauuaugggcaaugau

SEQ ID NO: 1850356 - RNA, 15 nt, Salmonella typhimurium LT2
ccugcaucguuuugg

SEQ ID NO: 1850357 - RNA, 17 nt, Salmonella typhimurium LT2
ccugcaucacgcccggc

SEQ ID NO: 1850358 - RNA, 23 nt, Salmonella typhimurium LT2
ccugcauauauccuaacuuauua

SEQ ID NO: 1850359 - RNA, 14 nt, Salmonella typhimurium LT2
ccugcagaugcugc

SEQ ID NO: 1850360 - RNA, 12 nt, Salmonella typhimurium LT2
ccugcccuuuca

SEQ ID NO: 1850361 - RNA, 15 nt, Salmonella typhimurium LT2
ccugccgcauguccc

SEQ ID NO: 1850362 - RNA, 22 nt, Salmonella typhimurium LT2
ccugccgcgcccaguuucuuca

SEQ ID NO: 1850363 - RNA, 15 nt, Salmonella typhimurium LT2
ccugccgcgccgccg

SEQ ID NO: 1850364 - RNA, 14 nt, Salmonella typhimurium LT2
ccugccgccuccag

SEQ ID NO: 1850365 - RNA, 22 nt, Salmonella typhimurium LT2
ccugcaacuccugggcaaaaua

SEQ ID NO: 1850366 - RNA, 21 nt, Salmonella typhimurium LT2
ccugaauuucaauaaucccuu

SEQ ID NO: 1850367 - RNA, 20 nt, Salmonella typhimurium LT2
ccugcaacgcuuuagugccg

SEQ ID NO: 1850368 - RNA, 23 nt, Salmonella typhimurium LT2
ccugcaauuccggcgaaaaacca

SEQ ID NO: 1850369 - RNA, 23 nt, Salmonella typhimurium LT2
ccugaauaacccgcagcccugcg

SEQ ID NO: 1850370 - RNA, 22 nt, Salmonella typhimurium LT2
ccugaaugcagaccucugcuuu

SEQ ID NO: 1850371 - RNA, 19 nt, Salmonella typhimurium LT2
ccugaaugcucucauauuc

SEQ ID NO: 1850372 - RNA, 20 nt, Salmonella typhimurium LT2
ccugcacggcgucauccaca

SEQ ID NO: 1850373 - RNA, 15 nt, Salmonella typhimurium LT2
ccugcagaauaagcu

SEQ ID NO: 1850374 - RNA, 18 nt, Salmonella typhimurium LT2
ccugcagacccacuuuca

SEQ ID NO: 1850375 - RNA, 15 nt, Salmonella typhimurium LT2
ccuguccauugcgag

SEQ ID NO: 1850376 - RNA, 13 nt, Salmonella typhimurium LT2
ccuguauuuuuuc

SEQ ID NO: 1850377 - RNA, 20 nt, Salmonella typhimurium LT2
ccugugcuuucgccaccagc

SEQ ID NO: 1850378 - RNA, 20 nt, Salmonella typhimurium LT2
ccuguggaaucagucgggua

SEQ ID NO: 1850379 - RNA, 15 nt, Salmonella typhimurium LT2
ccugucgucaccagc

SEQ ID NO: 1850380 - RNA, 16 nt, Salmonella typhimurium LT2
ccugucgaucauccac

SEQ ID NO: 1850381 - RNA, 14 nt, Salmonella typhimurium LT2
ccugucgcccaggc

SEQ ID NO: 1850382 - RNA, 19 nt, Salmonella typhimurium LT2
ccugucgccgucaauguca

SEQ ID NO: 1850383 - RNA, 13 nt, Salmonella typhimurium LT2
ccuguaacagggg

SEQ ID NO: 1850384 - RNA, 19 nt, Salmonella typhimurium LT2
ccuguaaccuuaaaaggcg

SEQ ID NO: 1850385 - RNA, 14 nt, Salmonella typhimurium LT2
ccuguaacacacug

SEQ ID NO: 1850386 - RNA, 21 nt, Salmonella typhimurium LT2
ccuguaacaacuguuuuucac

SEQ ID NO: 1850387 - RNA, 17 nt, Salmonella typhimurium LT2
ccuguaaaccgccucca

SEQ ID NO: 1850388 - RNA, 17 nt, Salmonella typhimurium LT2
ccuguacuugcgccgcc

SEQ ID NO: 1850389 - RNA, 14 nt, Salmonella typhimurium LT2
ccuguaccaccacg

SEQ ID NO: 1850390 - RNA, 15 nt, Salmonella typhimurium LT2
ccuguaccaccacgc

SEQ ID NO: 1850391 - RNA, 19 nt, Salmonella typhimurium LT2
ccuguaaugucuggugcag

SEQ ID NO: 1850392 - RNA, 15 nt, Salmonella typhimurium LT2
ccuguaaugccgccu

SEQ ID NO: 1850393 - RNA, 17 nt, Salmonella typhimurium LT2
ccuggcaguucagucgg

SEQ ID NO: 1850394 - RNA, 20 nt, Salmonella typhimurium LT2
ccuggcaguucccuacucuc

SEQ ID NO: 1850395 - RNA, 14 nt, Salmonella typhimurium LT2
ccuggauuuuaccu

SEQ ID NO: 1850396 - RNA, 13 nt, Salmonella typhimurium LT2
ccuggcaagaccc

SEQ ID NO: 1850397 - RNA, 16 nt, Salmonella typhimurium LT2
ccuggcguaugcuuuc

SEQ ID NO: 1850398 - RNA, 19 nt, Salmonella typhimurium LT2
ccugggcgaaaacgcccgc

SEQ ID NO: 1850399 - RNA, 21 nt, Salmonella typhimurium LT2
ccuggcgugcgauuugcucaa

SEQ ID NO: 1850400 - RNA, 17 nt, Salmonella typhimurium LT2
ccuggcguguccccacc

SEQ ID NO: 1850401 - RNA, 14 nt, Salmonella typhimurium LT2
ccuggaugcuuaaa

SEQ ID NO: 1850402 - RNA, 19 nt, Salmonella typhimurium LT2
ccuggaugcuuaaaauccc

SEQ ID NO: 1850403 - RNA, 15 nt, Salmonella typhimurium LT2
ccuggaugacacagg

SEQ ID NO: 1850404 - RNA, 15 nt, Salmonella typhimurium LT2
ccuggaggaacagcg

SEQ ID NO: 1850405 - RNA, 16 nt, Salmonella typhimurium LT2
ccuggagagcagcgcc

SEQ ID NO: 1850406 - RNA, 20 nt, Salmonella typhimurium LT2
ccugcugccagccgccgccg

SEQ ID NO: 1850407 - RNA, 18 nt, Salmonella typhimurium LT2
ccugcugccagccgccgc

SEQ ID NO: 1850408 - RNA, 20 nt, Salmonella typhimurium LT2
ccugcugcaacgucgcgccc

SEQ ID NO: 1850409 - RNA, 21 nt, Salmonella typhimurium LT2
ccugcugacuacgguugccuu

SEQ ID NO: 1850410 - RNA, 14 nt, Salmonella typhimurium LT2
ccugcucaaucgca

SEQ ID NO: 1850411 - RNA, 18 nt, Salmonella typhimurium LT2
ccgccgcuggucaacacg

SEQ ID NO: 1850412 - RNA, 15 nt, Salmonella typhimurium LT2
ccgccggauggcggc

SEQ ID NO: 1850413 - RNA, 20 nt, Salmonella typhimurium LT2
ccgccgggaucagcggcugc

SEQ ID NO: 1850414 - RNA, 18 nt, Salmonella typhimurium LT2
ccgccgcaggccaucaua

SEQ ID NO: 1850415 - RNA, 15 nt, Salmonella typhimurium LT2
ccgccgccaucacca

SEQ ID NO: 1850416 - RNA, 13 nt, Salmonella typhimurium LT2
ccgccgccagccu

SEQ ID NO: 1850417 - RNA, 14 nt, Salmonella typhimurium LT2
ccgccgccagccug

SEQ ID NO: 1850418 - RNA, 13 nt, Salmonella typhimurium LT2
ccgccgcgaaaac

SEQ ID NO: 1850419 - RNA, 18 nt, Salmonella typhimurium LT2
ccgccgcgggcagcagca

SEQ ID NO: 1850420 - RNA, 20 nt, Salmonella typhimurium LT2
ccgccgcgucugaccgccgc

SEQ ID NO: 1850421 - RNA, 18 nt, Salmonella typhimurium LT2
ccgccgcuauuaccccgc

SEQ ID NO: 1850422 - RNA, 14 nt, Salmonella typhimurium LT2
ccgcccauccaggg

SEQ ID NO: 1850423 - RNA, 23 nt, Salmonella typhimurium LT2
ccgccccagcgguaccaccagcg

SEQ ID NO: 1850424 - RNA, 16 nt, Salmonella typhimurium LT2
ccgccccagcagcagc

SEQ ID NO: 1850425 - RNA, 13 nt, Salmonella typhimurium LT2
ccgcccagucacg

SEQ ID NO: 1850426 - RNA, 20 nt, Salmonella typhimurium LT2
ccgcccaggauacagccgaa

SEQ ID NO: 1850427 - RNA, 16 nt, Salmonella typhimurium LT2
ccgccaugacgcaccg

SEQ ID NO: 1850428 - RNA, 16 nt, Salmonella typhimurium LT2
ccgccaucguccagcc

SEQ ID NO: 1850429 - RNA, 20 nt, Salmonella typhimurium LT2
ccgccaucucauucgccagc

SEQ ID NO: 1850430 - RNA, 18 nt, Salmonella typhimurium LT2
ccgcauaccgaacagaaa

SEQ ID NO: 1850431 - RNA, 15 nt, Salmonella typhimurium LT2
ccgcaguuuuccagc

SEQ ID NO: 1850432 - RNA, 22 nt, Salmonella typhimurium LT2
ccgccccuguggaaucagucgg

SEQ ID NO: 1850433 - RNA, 23 nt, Salmonella typhimurium LT2
ccgcccguacagacaucaucgaa

SEQ ID NO: 1850434 - RNA, 14 nt, Salmonella typhimurium LT2
ccgccgacaaccag

SEQ ID NO: 1850435 - RNA, 16 nt, Salmonella typhimurium LT2
ccgcgccauccacccc

SEQ ID NO: 1850436 - RNA, 11 nt, Salmonella typhimurium LT2
ccgcgccgccc

SEQ ID NO: 1850437 - RNA, 16 nt, Salmonella typhimurium LT2
ccgcgccgcugagaaa

SEQ ID NO: 1850438 - RNA, 15 nt, Salmonella typhimurium LT2
ccgccuugcggcggc

SEQ ID NO: 1850439 - RNA, 12 nt, Salmonella typhimurium LT2
ccgccuugcugc

SEQ ID NO: 1850440 - RNA, 18 nt, Salmonella typhimurium LT2
ccgccuugcggcgccagg

SEQ ID NO: 1850441 - RNA, 22 nt, Salmonella typhimurium LT2
ccgccugccagauccaacacau

SEQ ID NO: 1850442 - RNA, 21 nt, Salmonella typhimurium LT2
ccgcgagcguucaaaaucaaa

SEQ ID NO: 1850443 - RNA, 24 nt, Salmonella typhimurium LT2
ccgcgcaauaugaaaccgcccugc

SEQ ID NO: 1850444 - RNA, 17 nt, Salmonella typhimurium LT2
ccgcgagaacuuccgcc

SEQ ID NO: 1850445 - RNA, 13 nt, Salmonella typhimurium LT2
ccgccuccgccgc

SEQ ID NO: 1850446 - RNA, 20 nt, Salmonella typhimurium LT2
ccgccucgcgauccgccagc

SEQ ID NO: 1850447 - RNA, 13 nt, Salmonella typhimurium LT2
ccgccucgcgcac

SEQ ID NO: 1850448 - RNA, 19 nt, Salmonella typhimurium LT2
ccgccucgcgcaccccggc

SEQ ID NO: 1850449 - RNA, 21 nt, Salmonella typhimurium LT2
ccgccucgcgcaccccggcca

SEQ ID NO: 1850450 - RNA, 21 nt, Salmonella typhimurium LT2
ccgccuaacagcgccgcgccg

SEQ ID NO: 1850451 - RNA, 15 nt, Salmonella typhimurium LT2
ccgccuaacccaccg

SEQ ID NO: 1850452 - RNA, 12 nt, Salmonella typhimurium LT2
ccgccuccagca

SEQ ID NO: 1850453 - RNA, 14 nt, Salmonella typhimurium LT2
ccgccucaauugcc

SEQ ID NO: 1850454 - RNA, 15 nt, Salmonella typhimurium LT2
ccgccgggcaacacg

SEQ ID NO: 1850455 - RNA, 16 nt, Salmonella typhimurium LT2
ccgccgguaaggccaa

SEQ ID NO: 1850456 - RNA, 21 nt, Salmonella typhimurium LT2
ccgccggguauugugccccgc

SEQ ID NO: 1850457 - RNA, 19 nt, Salmonella typhimurium LT2
ccgcugaaauagccccguc

SEQ ID NO: 1850458 - RNA, 15 nt, Salmonella typhimurium LT2
ccgcugaccaucaac

SEQ ID NO: 1850459 - RNA, 24 nt, Salmonella typhimurium LT2
ccgcugacacgcgcaguacggcgc

SEQ ID NO: 1850460 - RNA, 17 nt, Salmonella typhimurium LT2
ccgcucuucaguaacca

SEQ ID NO: 1850461 - RNA, 22 nt, Salmonella typhimurium LT2
ccgcucacgguuucuacuucca

SEQ ID NO: 1850462 - RNA, 17 nt, Salmonella typhimurium LT2
ccgcucacuaccgccgc

SEQ ID NO: 1850463 - RNA, 20 nt, Salmonella typhimurium LT2
ccgcucacuaccgccgcgag

SEQ ID NO: 1850464 - RNA, 14 nt, Salmonella typhimurium LT2
ccgcucaauaauau

SEQ ID NO: 1850465 - RNA, 15 nt, Salmonella typhimurium LT2
ccgcucacaaugccg

SEQ ID NO: 1850466 - RNA, 21 nt, Salmonella typhimurium LT2
ccgcucagcucgacgacgugg

SEQ ID NO: 1850467 - RNA, 17 nt, Salmonella typhimurium LT2
ccgcuuccagcgcgucg

SEQ ID NO: 1850468 - RNA, 17 nt, Salmonella typhimurium LT2
ccgcuucauuggcgucu

SEQ ID NO: 1850469 - RNA, 19 nt, Salmonella typhimurium LT2
ccgcuggcgccaccgcugc

SEQ ID NO: 1850470 - RNA, 19 nt, Salmonella typhimurium LT2
ccgcuggcgaccagccugc

SEQ ID NO: 1850471 - RNA, 15 nt, Salmonella typhimurium LT2
ccgcuggcgcgggga

SEQ ID NO: 1850472 - RNA, 12 nt, Salmonella typhimurium LT2
ccgcuggcgucu

SEQ ID NO: 1850473 - RNA, 19 nt, Salmonella typhimurium LT2
ccgcguuuaacgcagcgcg

SEQ ID NO: 1850474 - RNA, 24 nt, Salmonella typhimurium LT2
ccgcguugccaaaacgcucgcgcu

SEQ ID NO: 1850475 - RNA, 18 nt, Salmonella typhimurium LT2
ccgcguucugcugugccg

SEQ ID NO: 1850476 - RNA, 16 nt, Salmonella typhimurium LT2
ccgcuaucgccaaacu

SEQ ID NO: 1850477 - RNA, 20 nt, Salmonella typhimurium LT2
ccgcuaucugcuccgccagc

SEQ ID NO: 1850478 - RNA, 20 nt, Salmonella typhimurium LT2
ccgcguagcccagcgccgca

SEQ ID NO: 1850479 - RNA, 20 nt, Salmonella typhimurium LT2
ccgcguaccugugcagguac

SEQ ID NO: 1850480 - RNA, 13 nt, Salmonella typhimurium LT2
ccgcguaaugacu

SEQ ID NO: 1850481 - RNA, 21 nt, Salmonella typhimurium LT2
ccgcgguacgaaucgccgcgc

SEQ ID NO: 1850482 - RNA, 19 nt, Salmonella typhimurium LT2
ccgcgguacgaaucgccgc

SEQ ID NO: 1850483 - RNA, 15 nt, Salmonella typhimurium LT2
ccgcgccuaccagcg

SEQ ID NO: 1850484 - RNA, 13 nt, Salmonella typhimurium LT2
ccgcgcgaagagg

SEQ ID NO: 1850485 - RNA, 18 nt, Salmonella typhimurium LT2
ccgcgccugggcggcaac

SEQ ID NO: 1850486 - RNA, 13 nt, Salmonella typhimurium LT2
ccggcauuucacu

SEQ ID NO: 1850487 - RNA, 16 nt, Salmonella typhimurium LT2
ccggcagcuuuugcgc

SEQ ID NO: 1850488 - RNA, 15 nt, Salmonella typhimurium LT2
ccggcaggcagcgcc

SEQ ID NO: 1850489 - RNA, 11 nt, Salmonella typhimurium LT2
ccggcaggcau

SEQ ID NO: 1850490 - RNA, 18 nt, Salmonella typhimurium LT2
ccggcagcgucguccagc

SEQ ID NO: 1850491 - RNA, 18 nt, Salmonella typhimurium LT2
ccggcagacggcugggcu

SEQ ID NO: 1850492 - RNA, 12 nt, Salmonella typhimurium LT2
ccggcacucacc

SEQ ID NO: 1850493 - RNA, 13 nt, Salmonella typhimurium LT2
ccggcaagcgcug

SEQ ID NO: 1850494 - RNA, 13 nt, Salmonella typhimurium LT2
ccggauagcgcug

SEQ ID NO: 1850495 - RNA, 16 nt, Salmonella typhimurium LT2
ccggauacaagguauc

SEQ ID NO: 1850496 - RNA, 22 nt, Salmonella typhimurium LT2
ccggauaaggcggagccgccau

SEQ ID NO: 1850497 - RNA, 23 nt, Salmonella typhimurium LT2
ccggauaaggcguuucgccgcca

SEQ ID NO: 1850498 - RNA, 21 nt, Salmonella typhimurium LT2
ccggauaaggcguuugcgccg

SEQ ID NO: 1850499 - RNA, 17 nt, Salmonella typhimurium LT2
ccggcaccucguccaga

SEQ ID NO: 1850500 - RNA, 19 nt, Salmonella typhimurium LT2
ccggcaaucauucuuauuc

SEQ ID NO: 1850501 - RNA, 22 nt, Salmonella typhimurium LT2
ccgcuuuuuuuauucagugcca

SEQ ID NO: 1850502 - RNA, 21 nt, Salmonella typhimurium LT2
ccgcuuuugccgugacuuccg

SEQ ID NO: 1850503 - RNA, 23 nt, Salmonella typhimurium LT2
ccggaaaccuguucccggcagac

SEQ ID NO: 1850504 - RNA, 20 nt, Salmonella typhimurium LT2
ccggaaauaaacgccagugg

SEQ ID NO: 1850505 - RNA, 12 nt, Salmonella typhimurium LT2
ccggaaaucaca

SEQ ID NO: 1850506 - RNA, 16 nt, Salmonella typhimurium LT2
ccggaaauagagaggg

SEQ ID NO: 1850507 - RNA, 13 nt, Salmonella typhimurium LT2
ccggaaaucugca

SEQ ID NO: 1850508 - RNA, 22 nt, Salmonella typhimurium LT2
ccgcuuuaugcgcuuccagcau

SEQ ID NO: 1850509 - RNA, 15 nt, Salmonella typhimurium LT2
ccgcuuucaccaucg

SEQ ID NO: 1850510 - RNA, 17 nt, Salmonella typhimurium LT2
ccggaacgggcaugacu

SEQ ID NO: 1850511 - RNA, 19 nt, Salmonella typhimurium LT2
ccggaaauuugcagcgcug

SEQ ID NO: 1850512 - RNA, 17 nt, Salmonella typhimurium LT2
ccggauaaccgcccgcg

SEQ ID NO: 1850513 - RNA, 22 nt, Salmonella typhimurium LT2
ccggauaagcgcagcgccauca

SEQ ID NO: 1850514 - RNA, 19 nt, Salmonella typhimurium LT2
ccggauaagcgucagcgcc

SEQ ID NO: 1850515 - RNA, 20 nt, Salmonella typhimurium LT2
ccggaauggucgcgccaggg

SEQ ID NO: 1850516 - RNA, 20 nt, Salmonella typhimurium LT2
ccggaaugguauaaaucccg

SEQ ID NO: 1850517 - RNA, 21 nt, Salmonella typhimurium LT2
ccggaaucgccugcgucgccc

SEQ ID NO: 1850518 - RNA, 15 nt, Salmonella typhimurium LT2
ccggaauuugcuucu

SEQ ID NO: 1850519 - RNA, 14 nt, Salmonella typhimurium LT2
ccggacggcgcagc

SEQ ID NO: 1850520 - RNA, 15 nt, Salmonella typhimurium LT2
ccggacggcggcugc

SEQ ID NO: 1850521 - RNA, 23 nt, Salmonella typhimurium LT2
ccgagccgcccuucacaaccauc

SEQ ID NO: 1850522 - RNA, 22 nt, Salmonella typhimurium LT2
ccgagugcuuauguaggccuga

SEQ ID NO: 1850523 - RNA, 21 nt, Salmonella typhimurium LT2
ccgauaaccagcgcgccgcca

SEQ ID NO: 1850524 - RNA, 13 nt, Salmonella typhimurium LT2
ccgaucucccagc

SEQ ID NO: 1850525 - RNA, 19 nt, Salmonella typhimurium LT2
ccgacuaccggcaccagca

SEQ ID NO: 1850526 - RNA, 15 nt, Salmonella typhimurium LT2
ccgacuacgccuccu

SEQ ID NO: 1850527 - RNA, 22 nt, Salmonella typhimurium LT2
ccgacuuuuuugccuuucagau

SEQ ID NO: 1850528 - RNA, 14 nt, Salmonella typhimurium LT2
ccgagaccaggcgg

SEQ ID NO: 1850529 - RNA, 13 nt, Salmonella typhimurium LT2
ccgacuuucaaau

SEQ ID NO: 1850530 - RNA, 15 nt, Salmonella typhimurium LT2
ccgagaaacaccaga

SEQ ID NO: 1850531 - RNA, 16 nt, Salmonella typhimurium LT2
ccgacgauaaccggaa

SEQ ID NO: 1850532 - RNA, 19 nt, Salmonella typhimurium LT2
ccgcagccagaaucagccg

SEQ ID NO: 1850533 - RNA, 21 nt, Salmonella typhimurium LT2
ccgcagcauuuccgccgccuu

SEQ ID NO: 1850534 - RNA, 11 nt, Salmonella typhimurium LT2
ccgcagccacu

SEQ ID NO: 1850535 - RNA, 12 nt, Salmonella typhimurium LT2
ccgcagcccgcc

SEQ ID NO: 1850536 - RNA, 21 nt, Salmonella typhimurium LT2
ccgcagcccgcccacaggcug

SEQ ID NO: 1850537 - RNA, 22 nt, Salmonella typhimurium LT2
ccgcaggacagcgacauccucu

SEQ ID NO: 1850538 - RNA, 12 nt, Salmonella typhimurium LT2
ccgcagcucaua

SEQ ID NO: 1850539 - RNA, 20 nt, Salmonella typhimurium LT2
ccgcagugaagaauggcgcc

SEQ ID NO: 1850540 - RNA, 19 nt, Salmonella typhimurium LT2
ccgcacccgaaagucaaaa

SEQ ID NO: 1850541 - RNA, 23 nt, Salmonella typhimurium LT2
ccgcacucgcgcuucagcccgaa

SEQ ID NO: 1850542 - RNA, 15 nt, Salmonella typhimurium LT2
ccgcagcaggcgggc

SEQ ID NO: 1850543 - RNA, 16 nt, Salmonella typhimurium LT2
ccgcagcaggcgggcu

SEQ ID NO: 1850544 - RNA, 16 nt, Salmonella typhimurium LT2
ccgcaaacagagcgcc

SEQ ID NO: 1850545 - RNA, 21 nt, Salmonella typhimurium LT2
ccgcaaaaccuucauaaauac

SEQ ID NO: 1850546 - RNA, 12 nt, Salmonella typhimurium LT2
ccgauuuuucgg

SEQ ID NO: 1850547 - RNA, 23 nt, Salmonella typhimurium LT2
ccgauuuuuuaucucgccgucga

SEQ ID NO: 1850548 - RNA, 23 nt, Salmonella typhimurium LT2
ccgcaagaaacaggcugacaaag

SEQ ID NO: 1850549 - RNA, 22 nt, Salmonella typhimurium LT2
ccgcaaacucaggagcuaaaua

SEQ ID NO: 1850550 - RNA, 20 nt, Salmonella typhimurium LT2
ccgcaaauccacuggucguc

SEQ ID NO: 1850551 - RNA, 15 nt, Salmonella typhimurium LT2
ccgauucgcgcguca

SEQ ID NO: 1850552 - RNA, 18 nt, Salmonella typhimurium LT2
ccgauugccgcucagcuc

SEQ ID NO: 1850553 - RNA, 20 nt, Salmonella typhimurium LT2
ccgaugucgccacgccgccc

SEQ ID NO: 1850554 - RNA, 14 nt, Salmonella typhimurium LT2
ccgaugacgcuccu

SEQ ID NO: 1850555 - RNA, 14 nt, Salmonella typhimurium LT2
ccgaugaucccggc

SEQ ID NO: 1850556 - RNA, 17 nt, Salmonella typhimurium LT2
ccgaugccgccgcaaca

SEQ ID NO: 1850557 - RNA, 15 nt, Salmonella typhimurium LT2
cccuggcugguuaau

SEQ ID NO: 1850558 - RNA, 22 nt, Salmonella typhimurium LT2
cccuggugggguucccgagcgg

SEQ ID NO: 1850559 - RNA, 18 nt, Salmonella typhimurium LT2
cccuguauacauacauac

SEQ ID NO: 1850560 - RNA, 18 nt, Salmonella typhimurium LT2
cccuguauuuuuuccauu

SEQ ID NO: 1850561 - RNA, 14 nt, Salmonella typhimurium LT2
cccuguucaaaagc

SEQ ID NO: 1850562 - RNA, 17 nt, Salmonella typhimurium LT2
cccuguucagcacccag

SEQ ID NO: 1850563 - RNA, 21 nt, Salmonella typhimurium LT2
cccuguucgccacccgccugc

SEQ ID NO: 1850564 - RNA, 16 nt, Salmonella typhimurium LT2
cccuuaaauccggccu

SEQ ID NO: 1850565 - RNA, 13 nt, Salmonella typhimurium LT2
cccuuacaaaaau

SEQ ID NO: 1850566 - RNA, 13 nt, Salmonella typhimurium LT2
cccuucaggaaua

SEQ ID NO: 1850567 - RNA, 12 nt, Salmonella typhimurium LT2
cccuucaccacu

SEQ ID NO: 1850568 - RNA, 23 nt, Salmonella typhimurium LT2
cccuucgcuauccaucgccgcgc

SEQ ID NO: 1850569 - RNA, 23 nt, Salmonella typhimurium LT2
cccuucgcggaauuucaggaagc

SEQ ID NO: 1850570 - RNA, 18 nt, Salmonella typhimurium LT2
cccuucgccuucgccggc

SEQ ID NO: 1850571 - RNA, 12 nt, Salmonella typhimurium LT2
cccuucccagcc

SEQ ID NO: 1850572 - RNA, 23 nt, Salmonella typhimurium LT2
cccuucccccaaaaugccgccca

SEQ ID NO: 1850573 - RNA, 14 nt, Salmonella typhimurium LT2
cccuuccagcucuu

SEQ ID NO: 1850574 - RNA, 18 nt, Salmonella typhimurium LT2
cccuucaucagccagcau

SEQ ID NO: 1850575 - RNA, 19 nt, Salmonella typhimurium LT2
cccuucaugcagcccgcac

SEQ ID NO: 1850576 - RNA, 18 nt, Salmonella typhimurium LT2
ccgaagaacagauucauu

SEQ ID NO: 1850577 - RNA, 16 nt, Salmonella typhimurium LT2
ccgaacuuacaguaac

SEQ ID NO: 1850578 - RNA, 20 nt, Salmonella typhimurium LT2
ccgaauagcgacaaaugaag

SEQ ID NO: 1850579 - RNA, 13 nt, Salmonella typhimurium LT2
ccgaagcaggcgg

SEQ ID NO: 1850580 - RNA, 11 nt, Salmonella typhimurium LT2
ccgaagccaac

SEQ ID NO: 1850581 - RNA, 20 nt, Salmonella typhimurium LT2
ccgaacagaacagugaguua

SEQ ID NO: 1850582 - RNA, 10 nt, Salmonella typhimurium LT2
ccgaaaccca

SEQ ID NO: 1850583 - RNA, 21 nt, Salmonella typhimurium LT2
cccuucuuuuacugccccgcc

SEQ ID NO: 1850584 - RNA, 19 nt, Salmonella typhimurium LT2
cccuucuuuaucuucugcu

SEQ ID NO: 1850585 - RNA, 18 nt, Salmonella typhimurium LT2
cccuucuucuggcucaga

SEQ ID NO: 1850586 - RNA, 23 nt, Salmonella typhimurium LT2
cccuucuccggucaucaccagau

SEQ ID NO: 1850587 - RNA, 18 nt, Salmonella typhimurium LT2
cccuucguuuuauuugau

SEQ ID NO: 1850588 - RNA, 21 nt, Salmonella typhimurium LT2
cccuucucauggacacacuau

SEQ ID NO: 1850589 - RNA, 16 nt, Salmonella typhimurium LT2
cccuucuaccgucagc

SEQ ID NO: 1850590 - RNA, 16 nt, Salmonella typhimurium LT2
cccugacgggcucguu

SEQ ID NO: 1850591 - RNA, 14 nt, Salmonella typhimurium LT2
cccugacaauacug

SEQ ID NO: 1850592 - RNA, 14 nt, Salmonella typhimurium LT2
cccugauggcgcgc

SEQ ID NO: 1850593 - RNA, 21 nt, Salmonella typhimurium LT2
cccugauauacaaaacccaua

SEQ ID NO: 1850594 - RNA, 23 nt, Salmonella typhimurium LT2
cccugauauacaaaacccauauc

SEQ ID NO: 1850595 - RNA, 17 nt, Salmonella typhimurium LT2
cccugauaaugugagau

SEQ ID NO: 1850596 - RNA, 13 nt, Salmonella typhimurium LT2
cccugaucccaca

SEQ ID NO: 1850597 - RNA, 16 nt, Salmonella typhimurium LT2
cccugaucccacagcg

SEQ ID NO: 1850598 - RNA, 15 nt, Salmonella typhimurium LT2
cccugcaacgccugc

SEQ ID NO: 1850599 - RNA, 14 nt, Salmonella typhimurium LT2
cccugcaacgccug

SEQ ID NO: 1850600 - RNA, 22 nt, Salmonella typhimurium LT2
ccccuggguagaguaacccuuc

SEQ ID NO: 1850601 - RNA, 15 nt, Salmonella typhimurium LT2
ccccuggcgcgccag

SEQ ID NO: 1850602 - RNA, 17 nt, Salmonella typhimurium LT2
ccccuggcugaaagcaa

SEQ ID NO: 1850603 - RNA, 17 nt, Salmonella typhimurium LT2
ccccuguucaaaagccu

SEQ ID NO: 1850604 - RNA, 20 nt, Salmonella typhimurium LT2
ccccuguuccagggcuucca

SEQ ID NO: 1850605 - RNA, 13 nt, Salmonella typhimurium LT2
ccccuucaucagu

SEQ ID NO: 1850606 - RNA, 12 nt, Salmonella typhimurium LT2
ccccuucccccg

SEQ ID NO: 1850607 - RNA, 15 nt, Salmonella typhimurium LT2
cccucuuccggcgcu

SEQ ID NO: 1850608 - RNA, 22 nt, Salmonella typhimurium LT2
cccucugaagcgcuucaccggc

SEQ ID NO: 1850609 - RNA, 18 nt, Salmonella typhimurium LT2
cccugcgaacagcgcucc

SEQ ID NO: 1850610 - RNA, 16 nt, Salmonella typhimurium LT2
cccugcgaggccuuuu

SEQ ID NO: 1850611 - RNA, 19 nt, Salmonella typhimurium LT2
cccugcgaacagcgcucca

SEQ ID NO: 1850612 - RNA, 19 nt, Salmonella typhimurium LT2
cccugcgccucaagcgcuu

SEQ ID NO: 1850613 - RNA, 21 nt, Salmonella typhimurium LT2
cccugcgcuucuauccacugg

SEQ ID NO: 1850614 - RNA, 13 nt, Salmonella typhimurium LT2
cccugccaccagc

SEQ ID NO: 1850615 - RNA, 17 nt, Salmonella typhimurium LT2
cccugccacaaccgccc

SEQ ID NO: 1850616 - RNA, 14 nt, Salmonella typhimurium LT2
cccugccaauucaa

SEQ ID NO: 1850617 - RNA, 20 nt, Salmonella typhimurium LT2
cccugccagcguaagcgccc

SEQ ID NO: 1850618 - RNA, 14 nt, Salmonella typhimurium LT2
cccugcccgccagg

SEQ ID NO: 1850619 - RNA, 13 nt, Salmonella typhimurium LT2
cccugcccgccag

SEQ ID NO: 1850620 - RNA, 13 nt, Salmonella typhimurium LT2
cccugcccaugaa

SEQ ID NO: 1850621 - RNA, 19 nt, Salmonella typhimurium LT2
cccugccgaaaugaaagcu

SEQ ID NO: 1850622 - RNA, 22 nt, Salmonella typhimurium LT2
cccuggccggaauacguaauac

SEQ ID NO: 1850623 - RNA, 13 nt, Salmonella typhimurium LT2
cccugcucccaca

SEQ ID NO: 1850624 - RNA, 21 nt, Salmonella typhimurium LT2
cccugcuggcgaaccaccagc

SEQ ID NO: 1850625 - RNA, 22 nt, Salmonella typhimurium LT2
cggcgcaggggcauuuuccggc

SEQ ID NO: 1850626 - RNA, 18 nt, Salmonella typhimurium LT2
cggcgccaaucaccgcca

SEQ ID NO: 1850627 - RNA, 20 nt, Salmonella typhimurium LT2
cggcgccaaucaccgccagc

SEQ ID NO: 1850628 - RNA, 14 nt, Salmonella typhimurium LT2
cggcgcagacacug

SEQ ID NO: 1850629 - RNA, 17 nt, Salmonella typhimurium LT2
cggcgcaaauggcugcg

SEQ ID NO: 1850630 - RNA, 20 nt, Salmonella typhimurium LT2
cggcgcaaacacggcugucg

SEQ ID NO: 1850631 - RNA, 22 nt, Salmonella typhimurium LT2
cggcgcaaacaguacgcccgcu

SEQ ID NO: 1850632 - RNA, 19 nt, Salmonella typhimurium LT2
cggcgcacacccugcagac

SEQ ID NO: 1850633 - RNA, 15 nt, Salmonella typhimurium LT2
cggcgccgaagcagg

SEQ ID NO: 1850634 - RNA, 20 nt, Salmonella typhimurium LT2
cggcgccgcaaugccgccug

SEQ ID NO: 1850635 - RNA, 14 nt, Salmonella typhimurium LT2
cggcgcccggaggg

SEQ ID NO: 1850636 - RNA, 22 nt, Salmonella typhimurium LT2
cggcgccaugauccagcggaac

SEQ ID NO: 1850637 - RNA, 19 nt, Salmonella typhimurium LT2
cggcgccauuccugccgcc

SEQ ID NO: 1850638 - RNA, 23 nt, Salmonella typhimurium LT2
cggcgcgggugaugacgcgcagg

SEQ ID NO: 1850639 - RNA, 16 nt, Salmonella typhimurium LT2
cggcgcggggaacaca

SEQ ID NO: 1850640 - RNA, 18 nt, Salmonella typhimurium LT2
cggcgcggggaacacaau

SEQ ID NO: 1850641 - RNA, 24 nt, Salmonella typhimurium LT2
cggcgcgccgcuggcgaccagccu

SEQ ID NO: 1850642 - RNA, 20 nt, Salmonella typhimurium LT2
cggcgcgccuuccagcaauu

SEQ ID NO: 1850643 - RNA, 13 nt, Salmonella typhimurium LT2
cggcgcgcguggc

SEQ ID NO: 1850644 - RNA, 14 nt, Salmonella typhimurium LT2
cggcgccuuccggc

SEQ ID NO: 1850645 - RNA, 17 nt, Salmonella typhimurium LT2
cggcgcgauauccacca

SEQ ID NO: 1850646 - RNA, 14 nt, Salmonella typhimurium LT2
cggcgcgaaucccg

SEQ ID NO: 1850647 - RNA, 13 nt, Salmonella typhimurium LT2
cggcgaucaccac

SEQ ID NO: 1850648 - RNA, 15 nt, Salmonella typhimurium LT2
cggcgagucgcgccc

SEQ ID NO: 1850649 - RNA, 16 nt, Salmonella typhimurium LT2
cggcgagucgcgccca

SEQ ID NO: 1850650 - RNA, 20 nt, Salmonella typhimurium LT2
cggcgaccuucacgccgcca

SEQ ID NO: 1850651 - RNA, 20 nt, Salmonella typhimurium LT2
cggcgacggacucgcgcaga

SEQ ID NO: 1850652 - RNA, 20 nt, Salmonella typhimurium LT2
cggcgacgugacgcgccagc

SEQ ID NO: 1850653 - RNA, 14 nt, Salmonella typhimurium LT2
cggcgacuggaaca

SEQ ID NO: 1850654 - RNA, 15 nt, Salmonella typhimurium LT2
cggcgagaucggcgc

SEQ ID NO: 1850655 - RNA, 18 nt, Salmonella typhimurium LT2
cggcgaauuaaucgucga

SEQ ID NO: 1850656 - RNA, 17 nt, Salmonella typhimurium LT2
cggcgaauagucgccgc

SEQ ID NO: 1850657 - RNA, 21 nt, Salmonella typhimurium LT2
cggcgaaccggcaucggcagc

SEQ ID NO: 1850658 - RNA, 22 nt, Salmonella typhimurium LT2
cggccaucuggcguugccugcu

SEQ ID NO: 1850659 - RNA, 14 nt, Salmonella typhimurium LT2
cggcgaaacgccuu

SEQ ID NO: 1850660 - RNA, 23 nt, Salmonella typhimurium LT2
cggcgaaacgccuuauccggccu

SEQ ID NO: 1850661 - RNA, 22 nt, Salmonella typhimurium LT2
cggcugacgauacucagcccca

SEQ ID NO: 1850662 - RNA, 18 nt, Salmonella typhimurium LT2
cggcugacgcccaucagc

SEQ ID NO: 1850663 - RNA, 15 nt, Salmonella typhimurium LT2
cggcucgguuuaucc

SEQ ID NO: 1850664 - RNA, 19 nt, Salmonella typhimurium LT2
cggcucgguuuauccccgc

SEQ ID NO: 1850665 - RNA, 14 nt, Salmonella typhimurium LT2
cggcuccagcgccu

SEQ ID NO: 1850666 - RNA, 17 nt, Salmonella typhimurium LT2
cggcgugaccaccgccu

SEQ ID NO: 1850667 - RNA, 17 nt, Salmonella typhimurium LT2
cggcguuuugccgggcg

SEQ ID NO: 1850668 - RNA, 17 nt, Salmonella typhimurium LT2
cggcguuuugcgcgcca

SEQ ID NO: 1850669 - RNA, 11 nt, Salmonella typhimurium LT2
cggcuccagau

SEQ ID NO: 1850670 - RNA, 22 nt, Salmonella typhimurium LT2
cggcuccagauugcucagguua

SEQ ID NO: 1850671 - RNA, 19 nt, Salmonella typhimurium LT2
cggcguuggcgauuuccag

SEQ ID NO: 1850672 - RNA, 15 nt, Salmonella typhimurium LT2
cggcguuggcugcuc

SEQ ID NO: 1850673 - RNA, 17 nt, Salmonella typhimurium LT2
cggcggaaagggccggg

SEQ ID NO: 1850674 - RNA, 16 nt, Salmonella typhimurium LT2
cggcggaaaagcgccc

SEQ ID NO: 1850675 - RNA, 16 nt, Salmonella typhimurium LT2
cggcgcuuuuaaaaua

SEQ ID NO: 1850676 - RNA, 17 nt, Salmonella typhimurium LT2
cggcggguauggcaaug

SEQ ID NO: 1850677 - RNA, 13 nt, Salmonella typhimurium LT2
cggcggcaguccc

SEQ ID NO: 1850678 - RNA, 19 nt, Salmonella typhimurium LT2
cggcgucaaauccaccgcc

SEQ ID NO: 1850679 - RNA, 22 nt, Salmonella typhimurium LT2
cggcgucaaauccaccgccagc

SEQ ID NO: 1850680 - RNA, 23 nt, Salmonella typhimurium LT2
cggcgucaaauccaccgccagca

SEQ ID NO: 1850681 - RNA, 12 nt, Salmonella typhimurium LT2
cggcgucauccc

SEQ ID NO: 1850682 - RNA, 22 nt, Salmonella typhimurium LT2
cggcgucauaguuuuccagccc

SEQ ID NO: 1850683 - RNA, 21 nt, Salmonella typhimurium LT2
cggcgucaccaccgcaggcag

SEQ ID NO: 1850684 - RNA, 15 nt, Salmonella typhimurium LT2
cggcgucgccugucc

SEQ ID NO: 1850685 - RNA, 19 nt, Salmonella typhimurium LT2
cggcuugaguuuuccgcca

SEQ ID NO: 1850686 - RNA, 22 nt, Salmonella typhimurium LT2
cggcuggacgucaugccgccac

SEQ ID NO: 1850687 - RNA, 19 nt, Salmonella typhimurium LT2
cggcuggacaugcuccgcc

SEQ ID NO: 1850688 - RNA, 19 nt, Salmonella typhimurium LT2
cggcuggacgucaugccgc

SEQ ID NO: 1850689 - RNA, 21 nt, Salmonella typhimurium LT2
cggcugcuuuuggcggcaaca

SEQ ID NO: 1850690 - RNA, 19 nt, Salmonella typhimurium LT2
cggcugcgccuuauccggc

SEQ ID NO: 1850691 - RNA, 21 nt, Salmonella typhimurium LT2
cggcugcgccuuauccggccu

SEQ ID NO: 1850692 - RNA, 17 nt, Salmonella typhimurium LT2
cgggacaaacccccagc

SEQ ID NO: 1850693 - RNA, 19 nt, Salmonella typhimurium LT2
cgggacaaacccccagcca

SEQ ID NO: 1850694 - RNA, 21 nt, Salmonella typhimurium LT2
cgggacaaacccccagccauu

SEQ ID NO: 1850695 - RNA, 12 nt, Salmonella typhimurium LT2
cgggaacagaau

SEQ ID NO: 1850696 - RNA, 13 nt, Salmonella typhimurium LT2
cgggaacagccac

SEQ ID NO: 1850697 - RNA, 15 nt, Salmonella typhimurium LT2
cgggaacagauaaau

SEQ ID NO: 1850698 - RNA, 14 nt, Salmonella typhimurium LT2
cgggaacugacagc

SEQ ID NO: 1850699 - RNA, 12 nt, Salmonella typhimurium LT2
cgggagcuugcc

SEQ ID NO: 1850700 - RNA, 20 nt, Salmonella typhimurium LT2
cgggagcaugaucggccaga

SEQ ID NO: 1850701 - RNA, 19 nt, Salmonella typhimurium LT2
cgggagauuuccggcacca

SEQ ID NO: 1850702 - RNA, 23 nt, Salmonella typhimurium LT2
cgggacugguggcaagauaagcc

SEQ ID NO: 1850703 - RNA, 16 nt, Salmonella typhimurium LT2
cgggacggcggucgcu

SEQ ID NO: 1850704 - RNA, 16 nt, Salmonella typhimurium LT2
cgggaucagcgcgcuc

SEQ ID NO: 1850705 - RNA, 17 nt, Salmonella typhimurium LT2
cgggauccccugcuccu

SEQ ID NO: 1850706 - RNA, 16 nt, Salmonella typhimurium LT2
cgggaucgaaccgccg

SEQ ID NO: 1850707 - RNA, 16 nt, Salmonella typhimurium LT2
cgggauccugcaaaau

SEQ ID NO: 1850708 - RNA, 22 nt, Salmonella typhimurium LT2
cgggaucgccagaucgaacagc

SEQ ID NO: 1850709 - RNA, 15 nt, Salmonella typhimurium LT2
cgggaucgccaucac

SEQ ID NO: 1850710 - RNA, 14 nt, Salmonella typhimurium LT2
cgggauauaaaauu

SEQ ID NO: 1850711 - RNA, 18 nt, Salmonella typhimurium LT2
cgggaggcggucuggauu

SEQ ID NO: 1850712 - RNA, 18 nt, Salmonella typhimurium LT2
cgggagguucaccaccac

SEQ ID NO: 1850713 - RNA, 15 nt, Salmonella typhimurium LT2
cgggauaaccaccgc

SEQ ID NO: 1850714 - RNA, 23 nt, Salmonella typhimurium LT2
cgggauaaaacaccacaaagucg

SEQ ID NO: 1850715 - RNA, 20 nt, Salmonella typhimurium LT2
cgggaugguuaaauucauau

SEQ ID NO: 1850716 - RNA, 13 nt, Salmonella typhimurium LT2
cgggcagacgacc

SEQ ID NO: 1850717 - RNA, 17 nt, Salmonella typhimurium LT2
cgggcaaugccaccagc

SEQ ID NO: 1850718 - RNA, 21 nt, Salmonella typhimurium LT2
cgggcagcagcagcagcagac

SEQ ID NO: 1850719 - RNA, 19 nt, Salmonella typhimurium LT2
cgggauuguauaccgcuuu

SEQ ID NO: 1850720 - RNA, 15 nt, Salmonella typhimurium LT2
cggguuuugagcagc

SEQ ID NO: 1850721 - RNA, 21 nt, Salmonella typhimurium LT2
cggguuguuguucauggucag

SEQ ID NO: 1850722 - RNA, 22 nt, Salmonella typhimurium LT2
cgguaaucgaucccgccgcauc

SEQ ID NO: 1850723 - RNA, 16 nt, Salmonella typhimurium LT2
cgguaagucugauaac

SEQ ID NO: 1850724 - RNA, 22 nt, Salmonella typhimurium LT2
cgguaacggcccguagggugag

SEQ ID NO: 1850725 - RNA, 16 nt, Salmonella typhimurium LT2
cgguaaaccaggccag

SEQ ID NO: 1850726 - RNA, 15 nt, Salmonella typhimurium LT2
cgguaaacgggcuua

SEQ ID NO: 1850727 - RNA, 18 nt, Salmonella typhimurium LT2
cgguaaacgugccacagu

SEQ ID NO: 1850728 - RNA, 18 nt, Salmonella typhimurium LT2
cgguaaaaauaucugaau

SEQ ID NO: 1850729 - RNA, 15 nt, Salmonella typhimurium LT2
cgguaaaggcgaccg

SEQ ID NO: 1850730 - RNA, 21 nt, Salmonella typhimurium LT2
cgguaaauuucuugaucaauc

SEQ ID NO: 1850731 - RNA, 23 nt, Salmonella typhimurium LT2
cgguaaaucaacaaccggcuggc

SEQ ID NO: 1850732 - RNA, 18 nt, Salmonella typhimurium LT2
cgguauuuauccagcagg

SEQ ID NO: 1850733 - RNA, 16 nt, Salmonella typhimurium LT2
cggucaacgcgccgcc

SEQ ID NO: 1850734 - RNA, 22 nt, Salmonella typhimurium LT2
cggucaaacagauccagcgccg

SEQ ID NO: 1850735 - RNA, 18 nt, Salmonella typhimurium LT2
cgguauuaacccgcagcc

SEQ ID NO: 1850736 - RNA, 22 nt, Salmonella typhimurium LT2
cgguauuaagccuuuuuaaaua

SEQ ID NO: 1850737 - RNA, 19 nt, Salmonella typhimurium LT2
cgguaugcguugcaaauau

SEQ ID NO: 1850738 - RNA, 19 nt, Salmonella typhimurium LT2
cgguauuccaucaaaagcu

SEQ ID NO: 1850739 - RNA, 18 nt, Salmonella typhimurium LT2
cgguauccgcuauaugaa

SEQ ID NO: 1850740 - RNA, 22 nt, Salmonella typhimurium LT2
cgguaucgacaaccgccugcgu

SEQ ID NO: 1850741 - RNA, 14 nt, Salmonella typhimurium LT2
cgguauaacugccu

SEQ ID NO: 1850742 - RNA, 13 nt, Salmonella typhimurium LT2
cgguagguuuaaa

SEQ ID NO: 1850743 - RNA, 18 nt, Salmonella typhimurium LT2
cgguagcaugcguaaauu

SEQ ID NO: 1850744 - RNA, 16 nt, Salmonella typhimurium LT2
cgguacggaacgucca

SEQ ID NO: 1850745 - RNA, 14 nt, Salmonella typhimurium LT2
cgguaccaccagcg

SEQ ID NO: 1850746 - RNA, 13 nt, Salmonella typhimurium LT2
cgguaccggcauu

SEQ ID NO: 1850747 - RNA, 14 nt, Salmonella typhimurium LT2
cgguacgacgccgu

SEQ ID NO: 1850748 - RNA, 21 nt, Salmonella typhimurium LT2
cgguacgacuuauucaaucaa

SEQ ID NO: 1850749 - RNA, 20 nt, Salmonella typhimurium LT2
cgggucuacaucggaagcgg

SEQ ID NO: 1850750 - RNA, 17 nt, Salmonella typhimurium LT2
cgggggcgaucagcagg

SEQ ID NO: 1850751 - RNA, 15 nt, Salmonella typhimurium LT2
cgggggccggccgcg

SEQ ID NO: 1850752 - RNA, 24 nt, Salmonella typhimurium LT2
cggggcuuuugagucgcauccagu

SEQ ID NO: 1850753 - RNA, 14 nt, Salmonella typhimurium LT2
cgggucagcggggu

SEQ ID NO: 1850754 - RNA, 23 nt, Salmonella typhimurium LT2
cggguaacagcauugaggcuacc

SEQ ID NO: 1850755 - RNA, 17 nt, Salmonella typhimurium LT2
cggguaauucaaucuca

SEQ ID NO: 1850756 - RNA, 23 nt, Salmonella typhimurium LT2
cggguaauuuugccaucgcgcac

SEQ ID NO: 1850757 - RNA, 20 nt, Salmonella typhimurium LT2
cggggaacacaauuaaagcc

SEQ ID NO: 1850758 - RNA, 21 nt, Salmonella typhimurium LT2
cgggcauucccagaaaggcgc

SEQ ID NO: 1850759 - RNA, 18 nt, Salmonella typhimurium LT2
cgggcugcaagggaaucu

SEQ ID NO: 1850760 - RNA, 15 nt, Salmonella typhimurium LT2
cggggcaucaugaug

SEQ ID NO: 1850761 - RNA, 19 nt, Salmonella typhimurium LT2
cggggccagcgccaguacu

SEQ ID NO: 1850762 - RNA, 16 nt, Salmonella typhimurium LT2
cggggauaaucagcag

SEQ ID NO: 1850763 - RNA, 16 nt, Salmonella typhimurium LT2
cggggagacgggcgga

SEQ ID NO: 1850764 - RNA, 22 nt, Salmonella typhimurium LT2
cggggaucaaaauuaagcgacc

SEQ ID NO: 1850765 - RNA, 20 nt, Salmonella typhimurium LT2
cggucuuaucaaauuugccc

SEQ ID NO: 1850766 - RNA, 22 nt, Salmonella typhimurium LT2
cggucugcuucagccacuggcu

SEQ ID NO: 1850767 - RNA, 12 nt, Salmonella typhimurium LT2
cggucagccagc

SEQ ID NO: 1850768 - RNA, 14 nt, Salmonella typhimurium LT2
cggucagauaaaua

SEQ ID NO: 1850769 - RNA, 22 nt, Salmonella typhimurium LT2
cggucagcggcgcgccgcucga

SEQ ID NO: 1850770 - RNA, 14 nt, Salmonella typhimurium LT2
cggugagcgccgcg

SEQ ID NO: 1850771 - RNA, 14 nt, Salmonella typhimurium LT2
cggugaucccacca

SEQ ID NO: 1850772 - RNA, 13 nt, Salmonella typhimurium LT2
cggugaucccagg

SEQ ID NO: 1850773 - RNA, 21 nt, Salmonella typhimurium LT2
cggugaucccaggccggcaua

SEQ ID NO: 1850774 - RNA, 14 nt, Salmonella typhimurium LT2
cggugccugccgcc

SEQ ID NO: 1850775 - RNA, 16 nt, Salmonella typhimurium LT2
cggugccugccgccuc

SEQ ID NO: 1850776 - RNA, 23 nt, Salmonella typhimurium LT2
cggugccguuaauuuucacgcac

SEQ ID NO: 1850777 - RNA, 13 nt, Salmonella typhimurium LT2
cggugaucuccuc

SEQ ID NO: 1850778 - RNA, 15 nt, Salmonella typhimurium LT2
cggugaucuccucgc

SEQ ID NO: 1850779 - RNA, 16 nt, Salmonella typhimurium LT2
cgguguggcccagcgc

SEQ ID NO: 1850780 - RNA, 16 nt, Salmonella typhimurium LT2
cgguguuaaccagaua

SEQ ID NO: 1850781 - RNA, 15 nt, Salmonella typhimurium LT2
cgguguaccccgccu

SEQ ID NO: 1850782 - RNA, 14 nt, Salmonella typhimurium LT2
cgguguaccccgcc

SEQ ID NO: 1850783 - RNA, 15 nt, Salmonella typhimurium LT2
cgguguaaacaggcu

SEQ ID NO: 1850784 - RNA, 17 nt, Salmonella typhimurium LT2
cgguguaaacaggcuuc

SEQ ID NO: 1850785 - RNA, 17 nt, Salmonella typhimurium LT2
cggugcguuuaaagaga

SEQ ID NO: 1850786 - RNA, 17 nt, Salmonella typhimurium LT2
cggugcguuucaucuac

SEQ ID NO: 1850787 - RNA, 13 nt, Salmonella typhimurium LT2
cgguggcgcuggc

SEQ ID NO: 1850788 - RNA, 18 nt, Salmonella typhimurium LT2
cgguggcgcuccagccgu

SEQ ID NO: 1850789 - RNA, 22 nt, Salmonella typhimurium LT2
cgguucuucccacuccgcccag

SEQ ID NO: 1850790 - RNA, 15 nt, Salmonella typhimurium LT2
cgguucuucccacuc

SEQ ID NO: 1850791 - RNA, 20 nt, Salmonella typhimurium LT2
cgguugacggcuacuccggc

SEQ ID NO: 1850792 - RNA, 15 nt, Salmonella typhimurium LT2
cgguucucugccauc

SEQ ID NO: 1850793 - RNA, 14 nt, Salmonella typhimurium LT2
cgguucggcugccc

SEQ ID NO: 1850794 - RNA, 19 nt, Salmonella typhimurium LT2
cgguuccggcauaaauaau

SEQ ID NO: 1850795 - RNA, 13 nt, Salmonella typhimurium LT2
cgguuccagcggc

SEQ ID NO: 1850796 - RNA, 16 nt, Salmonella typhimurium LT2
cgguuuuuauggaagg

SEQ ID NO: 1850797 - RNA, 17 nt, Salmonella typhimurium LT2
cgguugccacucuucca

SEQ ID NO: 1850798 - RNA, 15 nt, Salmonella typhimurium LT2
cgguugcaauuccgc

SEQ ID NO: 1850799 - RNA, 23 nt, Salmonella typhimurium LT2
cgguuuuuuuguggccugcuuaa

SEQ ID NO: 1850800 - RNA, 21 nt, Salmonella typhimurium LT2
cgguuuuuuuguggccugcuu

SEQ ID NO: 1850801 - RNA, 22 nt, Salmonella typhimurium LT2
cguaaaaauuguuccuguaaag

SEQ ID NO: 1850802 - RNA, 15 nt, Salmonella typhimurium LT2
cguaaaacaacagcg

SEQ ID NO: 1850803 - RNA, 22 nt, Salmonella typhimurium LT2
cguaagcgcccguccaugagua

SEQ ID NO: 1850804 - RNA, 22 nt, Salmonella typhimurium LT2
cguaagccacugcccagagaau

SEQ ID NO: 1850805 - RNA, 17 nt, Salmonella typhimurium LT2
cguaaggaauccagcgc

SEQ ID NO: 1850806 - RNA, 21 nt, Salmonella typhimurium LT2
cguaauacgauccucgccauu

SEQ ID NO: 1850807 - RNA, 18 nt, Salmonella typhimurium LT2
cguaacuggauuccuggc

SEQ ID NO: 1850808 - RNA, 20 nt, Salmonella typhimurium LT2
cguaacuguugccccgcuuu

SEQ ID NO: 1850809 - RNA, 20 nt, Salmonella typhimurium LT2
cguaaauuccuuguuuuaac

SEQ ID NO: 1850810 - RNA, 17 nt, Salmonella typhimurium LT2
cguaaauucccuccaga

SEQ ID NO: 1850811 - RNA, 22 nt, Salmonella typhimurium LT2
cguaaaucugaaauaaaagcaa

SEQ ID NO: 1850812 - RNA, 23 nt, Salmonella typhimurium LT2
cguaacagacgcaucuuuuuccc

SEQ ID NO: 1850813 - RNA, 16 nt, Salmonella typhimurium LT2
cguaaaaucagcagcg

SEQ ID NO: 1850814 - RNA, 15 nt, Salmonella typhimurium LT2
cguaaagggaagguc

SEQ ID NO: 1850815 - RNA, 18 nt, Salmonella typhimurium LT2
cguaaaacaacagcggcg

SEQ ID NO: 1850816 - RNA, 15 nt, Salmonella typhimurium LT2
cguaaaacuuuucug

SEQ ID NO: 1850817 - RNA, 15 nt, Salmonella typhimurium LT2
cguaaaguucccagc

SEQ ID NO: 1850818 - RNA, 18 nt, Salmonella typhimurium LT2
cguaauuugcgacauggc

SEQ ID NO: 1850819 - RNA, 19 nt, Salmonella typhimurium LT2
cguaauuugcgacauggcg

SEQ ID NO: 1850820 - RNA, 14 nt, Salmonella typhimurium LT2
cguaauaugcacac

SEQ ID NO: 1850821 - RNA, 22 nt, Salmonella typhimurium LT2
cguaauaugggcacaacccuaa

SEQ ID NO: 1850822 - RNA, 14 nt, Salmonella typhimurium LT2
cguaaucggccugu

SEQ ID NO: 1850823 - RNA, 15 nt, Salmonella typhimurium LT2
cguaauccggccugg

SEQ ID NO: 1850824 - RNA, 16 nt, Salmonella typhimurium LT2
cguaauggccaccagc

SEQ ID NO: 1850825 - RNA, 19 nt, Salmonella typhimurium LT2
cguaauuaaccgcgccgcu

SEQ ID NO: 1850826 - RNA, 22 nt, Salmonella typhimurium LT2
cguaaucuuuucauauuauuug

SEQ ID NO: 1850827 - RNA, 21 nt, Salmonella typhimurium LT2
cguaaugaucaugcugcaccg

SEQ ID NO: 1850828 - RNA, 15 nt, Salmonella typhimurium LT2
cguacggcugccuuu

SEQ ID NO: 1850829 - RNA, 13 nt, Salmonella typhimurium LT2
cguacggaaggua

SEQ ID NO: 1850830 - RNA, 22 nt, Salmonella typhimurium LT2
cguacucagaucggcagacagu

SEQ ID NO: 1850831 - RNA, 15 nt, Salmonella typhimurium LT2
cguacucagcagacc

SEQ ID NO: 1850832 - RNA, 14 nt, Salmonella typhimurium LT2
cguaccgcgcgccc

SEQ ID NO: 1850833 - RNA, 18 nt, Salmonella typhimurium LT2
cguaccgcggcgcugcag

SEQ ID NO: 1850834 - RNA, 18 nt, Salmonella typhimurium LT2
cguaccgcguuuaacgca

SEQ ID NO: 1850835 - RNA, 20 nt, Salmonella typhimurium LT2
cguaccggcgcucagccaga

SEQ ID NO: 1850836 - RNA, 20 nt, Salmonella typhimurium LT2
cguaccgucuggcgaggcgc

SEQ ID NO: 1850837 - RNA, 18 nt, Salmonella typhimurium LT2
cguaccuguaggccuggu

SEQ ID NO: 1850838 - RNA, 17 nt, Salmonella typhimurium LT2
cguacauaacagcagca

SEQ ID NO: 1850839 - RNA, 21 nt, Salmonella typhimurium LT2
cguaccacgccgcacacagcg

SEQ ID NO: 1850840 - RNA, 23 nt, Salmonella typhimurium LT2
cguaccaauacccagcgccaacg

SEQ ID NO: 1850841 - RNA, 13 nt, Salmonella typhimurium LT2
cguaccagcgccc

SEQ ID NO: 1850842 - RNA, 16 nt, Salmonella typhimurium LT2
cguaccauauucaacu

SEQ ID NO: 1850843 - RNA, 20 nt, Salmonella typhimurium LT2
cggacgaaccuggcgguaaa

SEQ ID NO: 1850844 - RNA, 15 nt, Salmonella typhimurium LT2
cggacgccgggugau

SEQ ID NO: 1850845 - RNA, 20 nt, Salmonella typhimurium LT2
cggacggcgcagcgcgcgac

SEQ ID NO: 1850846 - RNA, 21 nt, Salmonella typhimurium LT2
cggacggcgcagcgcgcgacc

SEQ ID NO: 1850847 - RNA, 16 nt, Salmonella typhimurium LT2
cggaccgguauuacca

SEQ ID NO: 1850848 - RNA, 17 nt, Salmonella typhimurium LT2
cggaccccucuucuuuu

SEQ ID NO: 1850849 - RNA, 21 nt, Salmonella typhimurium LT2
cggacauuuauuucacuggcc

SEQ ID NO: 1850850 - RNA, 12 nt, Salmonella typhimurium LT2
cggacagcagca

SEQ ID NO: 1850851 - RNA, 20 nt, Salmonella typhimurium LT2
cggacacggcgucaaaucca

SEQ ID NO: 1850852 - RNA, 12 nt, Salmonella typhimurium LT2
cggacacuaauu

SEQ ID NO: 1850853 - RNA, 15 nt, Salmonella typhimurium LT2
cggacagaaaaaaua

SEQ ID NO: 1850854 - RNA, 20 nt, Salmonella typhimurium LT2
cggacacgcugguaaucauu

SEQ ID NO: 1850855 - RNA, 15 nt, Salmonella typhimurium LT2
cggacacccgcagcc

SEQ ID NO: 1850856 - RNA, 17 nt, Salmonella typhimurium LT2
cggacaacgcuccagca

SEQ ID NO: 1850857 - RNA, 17 nt, Salmonella typhimurium LT2
cggaaugaugugcuauu

SEQ ID NO: 1850858 - RNA, 15 nt, Salmonella typhimurium LT2
cggaaugagagaagg

SEQ ID NO: 1850859 - RNA, 12 nt, Salmonella typhimurium LT2
cggacuccagca

SEQ ID NO: 1850860 - RNA, 22 nt, Salmonella typhimurium LT2
cggacuccagcaacgccgcauc

SEQ ID NO: 1850861 - RNA, 12 nt, Salmonella typhimurium LT2
cggacucagggu

SEQ ID NO: 1850862 - RNA, 13 nt, Salmonella typhimurium LT2
cggacucagggug

SEQ ID NO: 1850863 - RNA, 16 nt, Salmonella typhimurium LT2
cggacucagggugaca

SEQ ID NO: 1850864 - RNA, 16 nt, Salmonella typhimurium LT2
cggacuagacagccuc

SEQ ID NO: 1850865 - RNA, 16 nt, Salmonella typhimurium LT2
cggacguggggguuca

SEQ ID NO: 1850866 - RNA, 11 nt, Salmonella typhimurium LT2
cggacugcugg

SEQ ID NO: 1850867 - RNA, 23 nt, Salmonella typhimurium LT2
cggagaaauagacgagcgaaaaa

SEQ ID NO: 1850868 - RNA, 22 nt, Salmonella typhimurium LT2
cggagaacggcacaauagcgcu

SEQ ID NO: 1850869 - RNA, 17 nt, Salmonella typhimurium LT2
cggagaagacgccgccg

SEQ ID NO: 1850870 - RNA, 20 nt, Salmonella typhimurium LT2
cggagaaaagcgaaaauaaa

SEQ ID NO: 1850871 - RNA, 16 nt, Salmonella typhimurium LT2
cggagagaugccgcca

SEQ ID NO: 1850872 - RNA, 14 nt, Salmonella typhimurium LT2
cggaggcacugccu

SEQ ID NO: 1850873 - RNA, 19 nt, Salmonella typhimurium LT2
cggaggccagauucaccac

SEQ ID NO: 1850874 - RNA, 16 nt, Salmonella typhimurium LT2
cggaggccuucuuguu

SEQ ID NO: 1850875 - RNA, 22 nt, Salmonella typhimurium LT2
cggaguaaguguagcgccgccu

SEQ ID NO: 1850876 - RNA, 21 nt, Salmonella typhimurium LT2
cggagggggaggcaggcaaca

SEQ ID NO: 1850877 - RNA, 16 nt, Salmonella typhimurium LT2
cggaggggaccuaaug

SEQ ID NO: 1850878 - RNA, 22 nt, Salmonella typhimurium LT2
cggaguggccgcaaaugauaau

SEQ ID NO: 1850879 - RNA, 15 nt, Salmonella typhimurium LT2
cggaaguauccugga

SEQ ID NO: 1850880 - RNA, 20 nt, Salmonella typhimurium LT2
cggaaucacggcaacgccuu

SEQ ID NO: 1850881 - RNA, 18 nt, Salmonella typhimurium LT2
cggaaucggacacuugca

SEQ ID NO: 1850882 - RNA, 14 nt, Salmonella typhimurium LT2
cggaauccaccaua

SEQ ID NO: 1850883 - RNA, 16 nt, Salmonella typhimurium LT2
cggaauaauguaaaaa

SEQ ID NO: 1850884 - RNA, 20 nt, Salmonella typhimurium LT2
cggaauagacggccugcaaa

SEQ ID NO: 1850885 - RNA, 15 nt, Salmonella typhimurium LT2
cggaauaccgucaaa

SEQ ID NO: 1850886 - RNA, 19 nt, Salmonella typhimurium LT2
cggaagaguuguugaccaa

SEQ ID NO: 1850887 - RNA, 21 nt, Salmonella typhimurium LT2
cggaagacuggcgcagcaaac

SEQ ID NO: 1850888 - RNA, 19 nt, Salmonella typhimurium LT2
cggaagacuggcgcagcaa

SEQ ID NO: 1850889 - RNA, 16 nt, Salmonella typhimurium LT2
cggaacccagcaaauc

SEQ ID NO: 1850890 - RNA, 14 nt, Salmonella typhimurium LT2
cggaacccagcaaa

SEQ ID NO: 1850891 - RNA, 19 nt, Salmonella typhimurium LT2
cggaaccaaaauagauaau

SEQ ID NO: 1850892 - RNA, 17 nt, Salmonella typhimurium LT2
cggaaccaaaugcccag

SEQ ID NO: 1850893 - RNA, 15 nt, Salmonella typhimurium LT2
cggaacaguccagga

SEQ ID NO: 1850894 - RNA, 20 nt, Salmonella typhimurium LT2
cgcuuucgccacgcucacuu

SEQ ID NO: 1850895 - RNA, 13 nt, Salmonella typhimurium LT2
cgcuuucgccugg

SEQ ID NO: 1850896 - RNA, 19 nt, Salmonella typhimurium LT2
cgcuuugacauugucauaa

SEQ ID NO: 1850897 - RNA, 17 nt, Salmonella typhimurium LT2
cgcuuugagcugcugcu

SEQ ID NO: 1850898 - RNA, 15 nt, Salmonella typhimurium LT2
cgcuuugacaacaaa

SEQ ID NO: 1850899 - RNA, 9 nt, Salmonella typhimurium LT2
cgcuuugcc

SEQ ID NO: 1850900 - RNA, 15 nt, Salmonella typhimurium LT2
cgcuuuggaggucau

SEQ ID NO: 1850901 - RNA, 19 nt, Salmonella typhimurium LT2
cgcuuugugcuccaccagc

SEQ ID NO: 1850902 - RNA, 21 nt, Salmonella typhimurium LT2
cgcugccuuccgggcggcugu

SEQ ID NO: 1850903 - RNA, 20 nt, Salmonella typhimurium LT2
cgcugccacacucucuccag

SEQ ID NO: 1850904 - RNA, 16 nt, Salmonella typhimurium LT2
cgcugccgcccuuucc

SEQ ID NO: 1850905 - RNA, 19 nt, Salmonella typhimurium LT2
cgcugccggaaagccccag

SEQ ID NO: 1850906 - RNA, 11 nt, Salmonella typhimurium LT2
cgcuucccagu

SEQ ID NO: 1850907 - RNA, 23 nt, Salmonella typhimurium LT2
cgcuucgcagcgauauuucuccg

SEQ ID NO: 1850908 - RNA, 11 nt, Salmonella typhimurium LT2
cgcuuccuggg

SEQ ID NO: 1850909 - RNA, 20 nt, Salmonella typhimurium LT2
cgcuucaccggcgugcgcuu

SEQ ID NO: 1850910 - RNA, 18 nt, Salmonella typhimurium LT2
cgcuucuucuaccaccuu

SEQ ID NO: 1850911 - RNA, 14 nt, Salmonella typhimurium LT2
cgcuucgcgcgcca

SEQ ID NO: 1850912 - RNA, 15 nt, Salmonella typhimurium LT2
cgcuucguauuucuu

SEQ ID NO: 1850913 - RNA, 21 nt, Salmonella typhimurium LT2
cgcuucggugaucuccucgcc

SEQ ID NO: 1850914 - RNA, 18 nt, Salmonella typhimurium LT2
cgcuucuauuucuuuauu

SEQ ID NO: 1850915 - RNA, 23 nt, Salmonella typhimurium LT2
cgcuucugguugucacggaucuu

SEQ ID NO: 1850916 - RNA, 16 nt, Salmonella typhimurium LT2
cgcuucuacagccacc

SEQ ID NO: 1850917 - RNA, 16 nt, Salmonella typhimurium LT2
cgcuucgugaaaaccu

SEQ ID NO: 1850918 - RNA, 17 nt, Salmonella typhimurium LT2
cggcagauuaccggcaa

SEQ ID NO: 1850919 - RNA, 18 nt, Salmonella typhimurium LT2
cggcagauuaccggcaau

SEQ ID NO: 1850920 - RNA, 17 nt, Salmonella typhimurium LT2
cggcacguuuuccaggu

SEQ ID NO: 1850921 - RNA, 17 nt, Salmonella typhimurium LT2
cggcagauccuggcgcu

SEQ ID NO: 1850922 - RNA, 13 nt, Salmonella typhimurium LT2
cggcagccgccac

SEQ ID NO: 1850923 - RNA, 13 nt, Salmonella typhimurium LT2
cggcagccagacc

SEQ ID NO: 1850924 - RNA, 14 nt, Salmonella typhimurium LT2
cggcagcagcuuca

SEQ ID NO: 1850925 - RNA, 13 nt, Salmonella typhimurium LT2
cggcagcagcgcg

SEQ ID NO: 1850926 - RNA, 15 nt, Salmonella typhimurium LT2
cggcacacgcggcgc

SEQ ID NO: 1850927 - RNA, 13 nt, Salmonella typhimurium LT2
cggcacagccagu

SEQ ID NO: 1850928 - RNA, 20 nt, Salmonella typhimurium LT2
cggcacguugucccaggcca

SEQ ID NO: 1850929 - RNA, 21 nt, Salmonella typhimurium LT2
cggcacguugucccaggccag

SEQ ID NO: 1850930 - RNA, 18 nt, Salmonella typhimurium LT2
cggcacgguuaaugaaau

SEQ ID NO: 1850931 - RNA, 17 nt, Salmonella typhimurium LT2
cggcaaggaaaaccagu

SEQ ID NO: 1850932 - RNA, 18 nt, Salmonella typhimurium LT2
cggcaagcgcgccauaac

SEQ ID NO: 1850933 - RNA, 17 nt, Salmonella typhimurium LT2
cggcaagucagaccagu

SEQ ID NO: 1850934 - RNA, 15 nt, Salmonella typhimurium LT2
cggcaaucaauacag

SEQ ID NO: 1850935 - RNA, 12 nt, Salmonella typhimurium LT2
cggcaauauccc

SEQ ID NO: 1850936 - RNA, 14 nt, Salmonella typhimurium LT2
cggcaauccaucac

SEQ ID NO: 1850937 - RNA, 21 nt, Salmonella typhimurium LT2
cggcaaucgcgugcaacaguu

SEQ ID NO: 1850938 - RNA, 13 nt, Salmonella typhimurium LT2
cggcaaucucacu

SEQ ID NO: 1850939 - RNA, 12 nt, Salmonella typhimurium LT2
cggcaacugcgc

SEQ ID NO: 1850940 - RNA, 17 nt, Salmonella typhimurium LT2
cggaucaugguugaaaa

SEQ ID NO: 1850941 - RNA, 13 nt, Salmonella typhimurium LT2
cggauccagaacu

SEQ ID NO: 1850942 - RNA, 18 nt, Salmonella typhimurium LT2
cggauaccguccaccagc

SEQ ID NO: 1850943 - RNA, 13 nt, Salmonella typhimurium LT2
cggauacuccugc

SEQ ID NO: 1850944 - RNA, 14 nt, Salmonella typhimurium LT2
cggauagcaacgcg

SEQ ID NO: 1850945 - RNA, 12 nt, Salmonella typhimurium LT2
cggauauucugc

SEQ ID NO: 1850946 - RNA, 20 nt, Salmonella typhimurium LT2
cggcauggguaaagcccauc

SEQ ID NO: 1850947 - RNA, 17 nt, Salmonella typhimurium LT2
cggcauggggucaggug

SEQ ID NO: 1850948 - RNA, 18 nt, Salmonella typhimurium LT2
cggcauguccggcgacuc

SEQ ID NO: 1850949 - RNA, 18 nt, Salmonella typhimurium LT2
cggcaugucgccagccag

SEQ ID NO: 1850950 - RNA, 20 nt, Salmonella typhimurium LT2
cggcaucuuuaaccgccugc

SEQ ID NO: 1850951 - RNA, 22 nt, Salmonella typhimurium LT2
cggcaucuuuaaccgccugcuc

SEQ ID NO: 1850952 - RNA, 20 nt, Salmonella typhimurium LT2
cggcaugauagggcgccugu

SEQ ID NO: 1850953 - RNA, 23 nt, Salmonella typhimurium LT2
cggcauggacguguuccgcgucu

SEQ ID NO: 1850954 - RNA, 15 nt, Salmonella typhimurium LT2
cggcaucucuucguu

SEQ ID NO: 1850955 - RNA, 19 nt, Salmonella typhimurium LT2
cggcaucucuucguucagg

SEQ ID NO: 1850956 - RNA, 14 nt, Salmonella typhimurium LT2
cggcaucucaucuu

SEQ ID NO: 1850957 - RNA, 19 nt, Salmonella typhimurium LT2
cggcaucguagucaggcag

SEQ ID NO: 1850958 - RNA, 15 nt, Salmonella typhimurium LT2
cggcagcucgugcag

SEQ ID NO: 1850959 - RNA, 16 nt, Salmonella typhimurium LT2
cggcagcucgagggug

SEQ ID NO: 1850960 - RNA, 22 nt, Salmonella typhimurium LT2
cggcagcgucguccagcccggc

SEQ ID NO: 1850961 - RNA, 14 nt, Salmonella typhimurium LT2
cggccaaagcgcga

SEQ ID NO: 1850962 - RNA, 22 nt, Salmonella typhimurium LT2
cggcauuuuuaaugauguaguc

SEQ ID NO: 1850963 - RNA, 17 nt, Salmonella typhimurium LT2
cggcauucacgucgcgc

SEQ ID NO: 1850964 - RNA, 14 nt, Salmonella typhimurium LT2
cggccacagcgcca

SEQ ID NO: 1850965 - RNA, 15 nt, Salmonella typhimurium LT2
cggccaccaggccug

SEQ ID NO: 1850966 - RNA, 21 nt, Salmonella typhimurium LT2
cggccagauaguggcugaggc

SEQ ID NO: 1850967 - RNA, 16 nt, Salmonella typhimurium LT2
cggccagaaccugcuc

SEQ ID NO: 1850968 - RNA, 19 nt, Salmonella typhimurium LT2
cgcguauaacgccgccccc

SEQ ID NO: 1850969 - RNA, 17 nt, Salmonella typhimurium LT2
cgcguauaacgccgccc

SEQ ID NO: 1850970 - RNA, 21 nt, Salmonella typhimurium LT2
cgcguagguguuacgcggguc

SEQ ID NO: 1850971 - RNA, 17 nt, Salmonella typhimurium LT2
cgcgucagcgccuccgc

SEQ ID NO: 1850972 - RNA, 23 nt, Salmonella typhimurium LT2
cgcgucacaaaaacacccgcagc

SEQ ID NO: 1850973 - RNA, 17 nt, Salmonella typhimurium LT2
cgcgucacaacagccgg

SEQ ID NO: 1850974 - RNA, 23 nt, Salmonella typhimurium LT2
cgcgucacaaucgcgccugccag

SEQ ID NO: 1850975 - RNA, 19 nt, Salmonella typhimurium LT2
cgcgucguugaugcaacag

SEQ ID NO: 1850976 - RNA, 21 nt, Salmonella typhimurium LT2
cgcgucguucacgucgcgaag

SEQ ID NO: 1850977 - RNA, 19 nt, Salmonella typhimurium LT2
cgcguggaaauaaucugua

SEQ ID NO: 1850978 - RNA, 12 nt, Salmonella typhimurium LT2
cgcggggaacau

SEQ ID NO: 1850979 - RNA, 12 nt, Salmonella typhimurium LT2
cgcgggcuggcu

SEQ ID NO: 1850980 - RNA, 15 nt, Salmonella typhimurium LT2
cgcgggcuggcuggc

SEQ ID NO: 1850981 - RNA, 22 nt, Salmonella typhimurium LT2
cgcgggcgguauuauccgccgc

SEQ ID NO: 1850982 - RNA, 22 nt, Salmonella typhimurium LT2
cgcguacccugcgugaacgacc

SEQ ID NO: 1850983 - RNA, 20 nt, Salmonella typhimurium LT2
cgcguaaucucccacccgcg

SEQ ID NO: 1850984 - RNA, 23 nt, Salmonella typhimurium LT2
cgcguaaguuugcguacucagca

SEQ ID NO: 1850985 - RNA, 19 nt, Salmonella typhimurium LT2
cgcguaaccccugcccgcg

SEQ ID NO: 1850986 - RNA, 14 nt, Salmonella typhimurium LT2
cgcuauccagcagu

SEQ ID NO: 1850987 - RNA, 13 nt, Salmonella typhimurium LT2
cgcuaucaaaaug

SEQ ID NO: 1850988 - RNA, 15 nt, Salmonella typhimurium LT2
cgcucaauaauaucc

SEQ ID NO: 1850989 - RNA, 14 nt, Salmonella typhimurium LT2
cgcucaauguggcu

SEQ ID NO: 1850990 - RNA, 16 nt, Salmonella typhimurium LT2
cgcuagugccgccagg

SEQ ID NO: 1850991 - RNA, 15 nt, Salmonella typhimurium LT2
cgcuagcuggcaggg

SEQ ID NO: 1850992 - RNA, 14 nt, Salmonella typhimurium LT2
cgcuagcuucaggu

SEQ ID NO: 1850993 - RNA, 20 nt, Salmonella typhimurium LT2
cgcucaucacaucgcgcagc

SEQ ID NO: 1850994 - RNA, 18 nt, Salmonella typhimurium LT2
cgcucagguuguccagca

SEQ ID NO: 1850995 - RNA, 23 nt, Salmonella typhimurium LT2
cgcucagguuguccagcagcagc

SEQ ID NO: 1850996 - RNA, 16 nt, Salmonella typhimurium LT2
cgcucaccuccgccac

SEQ ID NO: 1850997 - RNA, 20 nt, Salmonella typhimurium LT2
cgcucaccuccgccaccagc

SEQ ID NO: 1850998 - RNA, 15 nt, Salmonella typhimurium LT2
cgcucaccgggcagg

SEQ ID NO: 1850999 - RNA, 14 nt, Salmonella typhimurium LT2
cgcucaccggcccc

SEQ ID NO: 1851000 - RNA, 15 nt, Salmonella typhimurium LT2
cgcucaccgacuccu

SEQ ID NO: 1851001 - RNA, 19 nt, Salmonella typhimurium LT2
cgcguucgccgucacgccg

SEQ ID NO: 1851002 - RNA, 14 nt, Salmonella typhimurium LT2
cgcguucagcgccg

SEQ ID NO: 1851003 - RNA, 15 nt, Salmonella typhimurium LT2
cgcguucauccagcg

SEQ ID NO: 1851004 - RNA, 17 nt, Salmonella typhimurium LT2
cgcguucauccagcgcg

SEQ ID NO: 1851005 - RNA, 17 nt, Salmonella typhimurium LT2
cgcguuuagcgccagca

SEQ ID NO: 1851006 - RNA, 21 nt, Salmonella typhimurium LT2
cgcuaaugcccggcgcggcau

SEQ ID NO: 1851007 - RNA, 14 nt, Salmonella typhimurium LT2
cgcuaaugcccggc

SEQ ID NO: 1851008 - RNA, 12 nt, Salmonella typhimurium LT2
cgcuaaucccgc

SEQ ID NO: 1851009 - RNA, 21 nt, Salmonella typhimurium LT2
cgcuaaucccgcucgccaggu

SEQ ID NO: 1851010 - RNA, 14 nt, Salmonella typhimurium LT2
cgcuaaucaucagc

SEQ ID NO: 1851011 - RNA, 14 nt, Salmonella typhimurium LT2
cgcugcaguuuauu

SEQ ID NO: 1851012 - RNA, 18 nt, Salmonella typhimurium LT2
cgcugcauaaaacugagu

SEQ ID NO: 1851013 - RNA, 11 nt, Salmonella typhimurium LT2
cgcugagaaaa

SEQ ID NO: 1851014 - RNA, 16 nt, Salmonella typhimurium LT2
cgcugauuuguuaucu

SEQ ID NO: 1851015 - RNA, 15 nt, Salmonella typhimurium LT2
cgcugcaacccgccg

SEQ ID NO: 1851016 - RNA, 16 nt, Salmonella typhimurium LT2
cgcugcaacccgccgc

SEQ ID NO: 1851017 - RNA, 23 nt, Salmonella typhimurium LT2
cgcucgcucaucacaucgcgcag

SEQ ID NO: 1851018 - RNA, 16 nt, Salmonella typhimurium LT2
cgcucggccagauaac

SEQ ID NO: 1851019 - RNA, 20 nt, Salmonella typhimurium LT2
cgcucggcauacaccgccag

SEQ ID NO: 1851020 - RNA, 20 nt, Salmonella typhimurium LT2
cgcucuuuuucuugucucca

SEQ ID NO: 1851021 - RNA, 19 nt, Salmonella typhimurium LT2
cgcucuuccgccagcgcca

SEQ ID NO: 1851022 - RNA, 13 nt, Salmonella typhimurium LT2
cgcucuuccgcca

SEQ ID NO: 1851023 - RNA, 16 nt, Salmonella typhimurium LT2
cgcucgccgccucccc

SEQ ID NO: 1851024 - RNA, 16 nt, Salmonella typhimurium LT2
cgcucgcccuucgggc

SEQ ID NO: 1851025 - RNA, 13 nt, Salmonella typhimurium LT2
cgcucgccgccuc

SEQ ID NO: 1851026 - RNA, 14 nt, Salmonella typhimurium LT2
cgcucgccauugcg

SEQ ID NO: 1851027 - RNA, 14 nt, Salmonella typhimurium LT2
cgcucgcccgcagc

SEQ ID NO: 1851028 - RNA, 15 nt, Salmonella typhimurium LT2
cgcuccgacaaacuu

SEQ ID NO: 1851029 - RNA, 23 nt, Salmonella typhimurium LT2
cgcuccgacaaacuucaucgcca

SEQ ID NO: 1851030 - RNA, 21 nt, Salmonella typhimurium LT2
cgcuccggcacuggcgcuggc

SEQ ID NO: 1851031 - RNA, 21 nt, Salmonella typhimurium LT2
cgcuccugcgguacggccagc

SEQ ID NO: 1851032 - RNA, 14 nt, Salmonella typhimurium LT2
cgcuccugcuccca

SEQ ID NO: 1851033 - RNA, 16 nt, Salmonella typhimurium LT2
cgcuccugcucccaga

SEQ ID NO: 1851034 - RNA, 19 nt, Salmonella typhimurium LT2
cgcuccuugagcgccugga

SEQ ID NO: 1851035 - RNA, 20 nt, Salmonella typhimurium LT2
cgcucauuaaaccgcgcggc

SEQ ID NO: 1851036 - RNA, 22 nt, Salmonella typhimurium LT2
cgcucauuaaaccgcgcggcau

SEQ ID NO: 1851037 - RNA, 14 nt, Salmonella typhimurium LT2
cgcucaucggcggc

SEQ ID NO: 1851038 - RNA, 14 nt, Salmonella typhimurium LT2
cgcucaugccacgc

SEQ ID NO: 1851039 - RNA, 17 nt, Salmonella typhimurium LT2
cgcuccagaccaccagc

SEQ ID NO: 1851040 - RNA, 11 nt, Salmonella typhimurium LT2
cgcuccagaag

SEQ ID NO: 1851041 - RNA, 15 nt, Salmonella typhimurium LT2
cgcuccacgcguccu

SEQ ID NO: 1851042 - RNA, 15 nt, Salmonella typhimurium LT2
cgcuccacuggcccc

SEQ ID NO: 1851043 - RNA, 19 nt, Salmonella typhimurium LT2
cgcuccacuggcccccugu

SEQ ID NO: 1851044 - RNA, 14 nt, Salmonella typhimurium LT2
cgcuccagcuggcu

SEQ ID NO: 1851045 - RNA, 12 nt, Salmonella typhimurium LT2
cgcucccgccca

SEQ ID NO: 1851046 - RNA, 22 nt, Salmonella typhimurium LT2
cgcucccggaaccgaccgcgau

SEQ ID NO: 1851047 - RNA, 15 nt, Salmonella typhimurium LT2
cgccagcaacgccca

SEQ ID NO: 1851048 - RNA, 18 nt, Salmonella typhimurium LT2
cgccagauuaucggccag

SEQ ID NO: 1851049 - RNA, 17 nt, Salmonella typhimurium LT2
cgccagauucaugauuu

SEQ ID NO: 1851050 - RNA, 13 nt, Salmonella typhimurium LT2
cgccagaggcggc

SEQ ID NO: 1851051 - RNA, 18 nt, Salmonella typhimurium LT2
cgccagauaaucacgcca

SEQ ID NO: 1851052 - RNA, 23 nt, Salmonella typhimurium LT2
cgccagauaaccaaucacuaacg

SEQ ID NO: 1851053 - RNA, 20 nt, Salmonella typhimurium LT2
cgccagauaaucgccgccag

SEQ ID NO: 1851054 - RNA, 13 nt, Salmonella typhimurium LT2
cgccagauccugg

SEQ ID NO: 1851055 - RNA, 22 nt, Salmonella typhimurium LT2
cgccagaucgaacagcggcaga

SEQ ID NO: 1851056 - RNA, 17 nt, Salmonella typhimurium LT2
cgcgccuagcgcgcgca

SEQ ID NO: 1851057 - RNA, 23 nt, Salmonella typhimurium LT2
cgcgccggggcggggaaaccguc

SEQ ID NO: 1851058 - RNA, 16 nt, Salmonella typhimurium LT2
cgcgccggucgccagc

SEQ ID NO: 1851059 - RNA, 17 nt, Salmonella typhimurium LT2
cgcgccgucgccugccu

SEQ ID NO: 1851060 - RNA, 13 nt, Salmonella typhimurium LT2
cgcgcgccgccuc

SEQ ID NO: 1851061 - RNA, 21 nt, Salmonella typhimurium LT2
cgcgcgccagucaucgccgcu

SEQ ID NO: 1851062 - RNA, 20 nt, Salmonella typhimurium LT2
cgcgcgaaacgcacccgcgc

SEQ ID NO: 1851063 - RNA, 12 nt, Salmonella typhimurium LT2
cgcgcgaaggcg

SEQ ID NO: 1851064 - RNA, 19 nt, Salmonella typhimurium LT2
cgcgcgacuuaucuuccac

SEQ ID NO: 1851065 - RNA, 11 nt, Salmonella typhimurium LT2
cgcgcgaccca

SEQ ID NO: 1851066 - RNA, 12 nt, Salmonella typhimurium LT2
cgcgccugccaa

SEQ ID NO: 1851067 - RNA, 13 nt, Salmonella typhimurium LT2
cgcgcggcugccg

SEQ ID NO: 1851068 - RNA, 20 nt, Salmonella typhimurium LT2
cgcgcggauauggcggcggc

SEQ ID NO: 1851069 - RNA, 15 nt, Salmonella typhimurium LT2
cgcgcggcaggccuu

SEQ ID NO: 1851070 - RNA, 20 nt, Salmonella typhimurium LT2
cgcgcggcauuucccuuccc

SEQ ID NO: 1851071 - RNA, 17 nt, Salmonella typhimurium LT2
cgcgcggauucuccagg

SEQ ID NO: 1851072 - RNA, 16 nt, Salmonella typhimurium LT2
cgcgcggauuccgccg

SEQ ID NO: 1851073 - RNA, 14 nt, Salmonella typhimurium LT2
cgcgcugaucgcca

SEQ ID NO: 1851074 - RNA, 23 nt, Salmonella typhimurium LT2
cgcgcugaccuucagccagaguu

SEQ ID NO: 1851075 - RNA, 16 nt, Salmonella typhimurium LT2
cgcgcucuuccgccag

SEQ ID NO: 1851076 - RNA, 17 nt, Salmonella typhimurium LT2
cgcgcucggcagcagcg

SEQ ID NO: 1851077 - RNA, 12 nt, Salmonella typhimurium LT2
cgcgcucgccag

SEQ ID NO: 1851078 - RNA, 11 nt, Salmonella typhimurium LT2
cgcgcucgcca

SEQ ID NO: 1851079 - RNA, 19 nt, Salmonella typhimurium LT2
cgcgcucaaauggucccug

SEQ ID NO: 1851080 - RNA, 15 nt, Salmonella typhimurium LT2
cgcgcucaagcuggg

SEQ ID NO: 1851081 - RNA, 21 nt, Salmonella typhimurium LT2
cgcgcgugguaucgcggcagc

SEQ ID NO: 1851082 - RNA, 15 nt, Salmonella typhimurium LT2
cgcgcuaucaacgcc

SEQ ID NO: 1851083 - RNA, 22 nt, Salmonella typhimurium LT2
cgcgcuaucaacgccuccaggc

SEQ ID NO: 1851084 - RNA, 21 nt, Salmonella typhimurium LT2
cgcgcuagugccgccaggcaa

SEQ ID NO: 1851085 - RNA, 17 nt, Salmonella typhimurium LT2
cgcgcuuucuggcgcag

SEQ ID NO: 1851086 - RNA, 15 nt, Salmonella typhimurium LT2
cgcgcuuuucgccag

SEQ ID NO: 1851087 - RNA, 16 nt, Salmonella typhimurium LT2
cgcgcuuuucgccagc

SEQ ID NO: 1851088 - RNA, 24 nt, Salmonella typhimurium LT2
cgcgcuuuagggcuuccucgccac

SEQ ID NO: 1851089 - RNA, 18 nt, Salmonella typhimurium LT2
cgcggaaagccuucauca

SEQ ID NO: 1851090 - RNA, 21 nt, Salmonella typhimurium LT2
cgcggaaagccuucaucauca

SEQ ID NO: 1851091 - RNA, 13 nt, Salmonella typhimurium LT2
cgcggaaggcgcc

SEQ ID NO: 1851092 - RNA, 24 nt, Salmonella typhimurium LT2
cgcggaaguuaccgcgccaggcgg

SEQ ID NO: 1851093 - RNA, 19 nt, Salmonella typhimurium LT2
cgcggaacuggugaaacag

SEQ ID NO: 1851094 - RNA, 23 nt, Salmonella typhimurium LT2
cgcggaaucgucacagaccccgc

SEQ ID NO: 1851095 - RNA, 20 nt, Salmonella typhimurium LT2
cgcgcuggugggacuguuca

SEQ ID NO: 1851096 - RNA, 16 nt, Salmonella typhimurium LT2
cgcgcugucugccggc

SEQ ID NO: 1851097 - RNA, 19 nt, Salmonella typhimurium LT2
cgcgcuggcaagcgccagc

SEQ ID NO: 1851098 - RNA, 12 nt, Salmonella typhimurium LT2
cgcgcuggcaau

SEQ ID NO: 1851099 - RNA, 12 nt, Salmonella typhimurium LT2
cgcgcuggcaag

SEQ ID NO: 1851100 - RNA, 22 nt, Salmonella typhimurium LT2
cgcggcacacaacacggcggcu

SEQ ID NO: 1851101 - RNA, 15 nt, Salmonella typhimurium LT2
cgcggcaauggcuua

SEQ ID NO: 1851102 - RNA, 19 nt, Salmonella typhimurium LT2
cgcggauauggcggcggcu

SEQ ID NO: 1851103 - RNA, 18 nt, Salmonella typhimurium LT2
cgcggauaugcagcagcc

SEQ ID NO: 1851104 - RNA, 13 nt, Salmonella typhimurium LT2
cgcggcacacagc

SEQ ID NO: 1851105 - RNA, 13 nt, Salmonella typhimurium LT2
cgcggcagcgcug

SEQ ID NO: 1851106 - RNA, 13 nt, Salmonella typhimurium LT2
cgcgggaaacacu

SEQ ID NO: 1851107 - RNA, 14 nt, Salmonella typhimurium LT2
cgcggcgucgccgc

SEQ ID NO: 1851108 - RNA, 19 nt, Salmonella typhimurium LT2
cgcggcguaccgcgcgccc

SEQ ID NO: 1851109 - RNA, 19 nt, Salmonella typhimurium LT2
cgcggccuuugccuucgcc

SEQ ID NO: 1851110 - RNA, 21 nt, Salmonella typhimurium LT2
cgcggcgacggacucgcgcag

SEQ ID NO: 1851111 - RNA, 15 nt, Salmonella typhimurium LT2
cguccagacuccuuu

SEQ ID NO: 1851112 - RNA, 17 nt, Salmonella typhimurium LT2
cguacugcaacgcgcau

SEQ ID NO: 1851113 - RNA, 12 nt, Salmonella typhimurium LT2
cguccaggccug

SEQ ID NO: 1851114 - RNA, 19 nt, Salmonella typhimurium LT2
cguccaguccugccccugc

SEQ ID NO: 1851115 - RNA, 22 nt, Salmonella typhimurium LT2
cgucccacaugaacucgacuuu

SEQ ID NO: 1851116 - RNA, 16 nt, Salmonella typhimurium LT2
cgucccagcggauguc

SEQ ID NO: 1851117 - RNA, 15 nt, Salmonella typhimurium LT2
cgucccacgcgccgc

SEQ ID NO: 1851118 - RNA, 13 nt, Salmonella typhimurium LT2
cgucccacgucag

SEQ ID NO: 1851119 - RNA, 18 nt, Salmonella typhimurium LT2
cguccccuggacgcgagc

SEQ ID NO: 1851120 - RNA, 14 nt, Salmonella typhimurium LT2
cguccccagccaga

SEQ ID NO: 1851121 - RNA, 23 nt, Salmonella typhimurium LT2
cgucccgacgaauaacaaaauga

SEQ ID NO: 1851122 - RNA, 16 nt, Salmonella typhimurium LT2
cgucccggucggcgca

SEQ ID NO: 1851123 - RNA, 16 nt, Salmonella typhimurium LT2
cgucccggcauuauaa

SEQ ID NO: 1851124 - RNA, 14 nt, Salmonella typhimurium LT2
cgucccuuucccuu

SEQ ID NO: 1851125 - RNA, 21 nt, Salmonella typhimurium LT2
cgucccuuucccuuccagcga

SEQ ID NO: 1851126 - RNA, 15 nt, Salmonella typhimurium LT2
cgucccuuccgccac

SEQ ID NO: 1851127 - RNA, 13 nt, Salmonella typhimurium LT2
cgucccugcuggc

SEQ ID NO: 1851128 - RNA, 14 nt, Salmonella typhimurium LT2
cguccgccaggccc

SEQ ID NO: 1851129 - RNA, 12 nt, Salmonella typhimurium LT2
cguccgccaggc

SEQ ID NO: 1851130 - RNA, 12 nt, Salmonella typhimurium LT2
cguccgccuccg

SEQ ID NO: 1851131 - RNA, 17 nt, Salmonella typhimurium LT2
cguccgguagagaacga

SEQ ID NO: 1851132 - RNA, 18 nt, Salmonella typhimurium LT2
cguccggggccagcgcca

SEQ ID NO: 1851133 - RNA, 15 nt, Salmonella typhimurium LT2
cguccuaggacgaaa

SEQ ID NO: 1851134 - RNA, 14 nt, Salmonella typhimurium LT2
cgucggcaccauuc

SEQ ID NO: 1851135 - RNA, 11 nt, Salmonella typhimurium LT2
cgucggacagg

SEQ ID NO: 1851136 - RNA, 17 nt, Salmonella typhimurium LT2
cgucggcgccagccaca

SEQ ID NO: 1851137 - RNA, 23 nt, Salmonella typhimurium LT2
cgucgccggugcuguagcugccc

SEQ ID NO: 1851138 - RNA, 17 nt, Salmonella typhimurium LT2
cgucgcgaucgcgccag

SEQ ID NO: 1851139 - RNA, 14 nt, Salmonella typhimurium LT2
cgucgcgcgcugug

SEQ ID NO: 1851140 - RNA, 16 nt, Salmonella typhimurium LT2
cgucgcgcgccgccug

SEQ ID NO: 1851141 - RNA, 20 nt, Salmonella typhimurium LT2
cgucgcgcgccgccugcgcu

SEQ ID NO: 1851142 - RNA, 23 nt, Salmonella typhimurium LT2
cgucgcgcucguaggccagcgcu

SEQ ID NO: 1851143 - RNA, 15 nt, Salmonella typhimurium LT2
cgucgcuacaggcaa

SEQ ID NO: 1851144 - RNA, 12 nt, Salmonella typhimurium LT2
cgucgagcgcgg

SEQ ID NO: 1851145 - RNA, 16 nt, Salmonella typhimurium LT2
cgucgacguuuuucag

SEQ ID NO: 1851146 - RNA, 22 nt, Salmonella typhimurium LT2
cgucgaggaagcugcgcagcac

SEQ ID NO: 1851147 - RNA, 20 nt, Salmonella typhimurium LT2
cgucgaggaucaucuccgac

SEQ ID NO: 1851148 - RNA, 16 nt, Salmonella typhimurium LT2
cgucgccauccggcga

SEQ ID NO: 1851149 - RNA, 19 nt, Salmonella typhimurium LT2
cgucgccagacccagcgcu

SEQ ID NO: 1851150 - RNA, 14 nt, Salmonella typhimurium LT2
cgucgccaaagcag

SEQ ID NO: 1851151 - RNA, 18 nt, Salmonella typhimurium LT2
cgugccuuccaucggccc

SEQ ID NO: 1851152 - RNA, 13 nt, Salmonella typhimurium LT2
cgugccuuccgca

SEQ ID NO: 1851153 - RNA, 14 nt, Salmonella typhimurium LT2
cgugccgaccagcg

SEQ ID NO: 1851154 - RNA, 16 nt, Salmonella typhimurium LT2
cgugccgaccagcggu

SEQ ID NO: 1851155 - RNA, 20 nt, Salmonella typhimurium LT2
cgugccaugaccauucgcac

SEQ ID NO: 1851156 - RNA, 20 nt, Salmonella typhimurium LT2
cgugcccgguaagaaugcgc

SEQ ID NO: 1851157 - RNA, 20 nt, Salmonella typhimurium LT2
cgugccagaaacaagaagca

SEQ ID NO: 1851158 - RNA, 20 nt, Salmonella typhimurium LT2
cgugcaugggauacgccagc

SEQ ID NO: 1851159 - RNA, 22 nt, Salmonella typhimurium LT2
cgugcaguuuugcuucaugcac

SEQ ID NO: 1851160 - RNA, 15 nt, Salmonella typhimurium LT2
cgugcaggcgccgcc

SEQ ID NO: 1851161 - RNA, 16 nt, Salmonella typhimurium LT2
cgugcagcgccgccug

SEQ ID NO: 1851162 - RNA, 15 nt, Salmonella typhimurium LT2
cgugcagcgccgccu

SEQ ID NO: 1851163 - RNA, 19 nt, Salmonella typhimurium LT2
cgugcaaaaucacgcggcg

SEQ ID NO: 1851164 - RNA, 20 nt, Salmonella typhimurium LT2
cgugauugauucgcgccagc

SEQ ID NO: 1851165 - RNA, 22 nt, Salmonella typhimurium LT2
cgugagaucguuauuaaacaga

SEQ ID NO: 1851166 - RNA, 23 nt, Salmonella typhimurium LT2
cgugacguucaucauuuucccac

SEQ ID NO: 1851167 - RNA, 14 nt, Salmonella typhimurium LT2
cgugacgcgccagc

SEQ ID NO: 1851168 - RNA, 17 nt, Salmonella typhimurium LT2
cgugacgcgccagcgga

SEQ ID NO: 1851169 - RNA, 18 nt, Salmonella typhimurium LT2
cgugaccuucaccugaau

SEQ ID NO: 1851170 - RNA, 18 nt, Salmonella typhimurium LT2
cgugaauuaauggucaga

SEQ ID NO: 1851171 - RNA, 19 nt, Salmonella typhimurium LT2
cgugaauguccugcggcac

SEQ ID NO: 1851172 - RNA, 14 nt, Salmonella typhimurium LT2
cgugagcgcgccgc

SEQ ID NO: 1851173 - RNA, 17 nt, Salmonella typhimurium LT2
cgugagcgcgucaucau

SEQ ID NO: 1851174 - RNA, 21 nt, Salmonella typhimurium LT2
cgugagugguagaaacuggca

SEQ ID NO: 1851175 - RNA, 17 nt, Salmonella typhimurium LT2
cgugaguggcggcacgc

SEQ ID NO: 1851176 - RNA, 13 nt, Salmonella typhimurium LT2
cgugaguuuuaac

SEQ ID NO: 1851177 - RNA, 22 nt, Salmonella typhimurium LT2
cgugauaaacgguucagucagc

SEQ ID NO: 1851178 - RNA, 23 nt, Salmonella typhimurium LT2
cgugauaaacgguucagucagcg

SEQ ID NO: 1851179 - RNA, 16 nt, Salmonella typhimurium LT2
cgugaucgccaaagcg

SEQ ID NO: 1851180 - RNA, 21 nt, Salmonella typhimurium LT2
cgugauugagcagaucagcac

SEQ ID NO: 1851181 - RNA, 19 nt, Salmonella typhimurium LT2
cgugaugggcgaucgccgc

SEQ ID NO: 1851182 - RNA, 14 nt, Salmonella typhimurium LT2
cgugaugugguugu

SEQ ID NO: 1851183 - RNA, 15 nt, Salmonella typhimurium LT2
cgugaugcuuuuuac

SEQ ID NO: 1851184 - RNA, 13 nt, Salmonella typhimurium LT2
cgugauggaacau

SEQ ID NO: 1851185 - RNA, 21 nt, Salmonella typhimurium LT2
cgucuccggcgcgccgcuggc

SEQ ID NO: 1851186 - RNA, 15 nt, Salmonella typhimurium LT2
cgucucgcacucgcc

SEQ ID NO: 1851187 - RNA, 16 nt, Salmonella typhimurium LT2
cgucuaccagcucucc

SEQ ID NO: 1851188 - RNA, 17 nt, Salmonella typhimurium LT2
cgucuacgccaucauug

SEQ ID NO: 1851189 - RNA, 17 nt, Salmonella typhimurium LT2
cgucgugaguggcggca

SEQ ID NO: 1851190 - RNA, 22 nt, Salmonella typhimurium LT2
cgucguucgcguaugggcgcga

SEQ ID NO: 1851191 - RNA, 18 nt, Salmonella typhimurium LT2
cgucgggaaguccuucuc

SEQ ID NO: 1851192 - RNA, 20 nt, Salmonella typhimurium LT2
cgucgucauucauggcgcgc

SEQ ID NO: 1851193 - RNA, 15 nt, Salmonella typhimurium LT2
cgucguaaaaccugc

SEQ ID NO: 1851194 - RNA, 14 nt, Salmonella typhimurium LT2
cgucguaaaaccug

SEQ ID NO: 1851195 - RNA, 14 nt, Salmonella typhimurium LT2
cgucggucgcguag

SEQ ID NO: 1851196 - RNA, 19 nt, Salmonella typhimurium LT2
cgucggguucgcgcgccgc

SEQ ID NO: 1851197 - RNA, 13 nt, Salmonella typhimurium LT2
cgucgguaaaaau

SEQ ID NO: 1851198 - RNA, 18 nt, Salmonella typhimurium LT2
cgucggugccuggcuggc

SEQ ID NO: 1851199 - RNA, 23 nt, Salmonella typhimurium LT2
cgucuuuauucaucaucuugucc

SEQ ID NO: 1851200 - RNA, 22 nt, Salmonella typhimurium LT2
cgugaaaaugcguccagaggau

SEQ ID NO: 1851201 - RNA, 21 nt, Salmonella typhimurium LT2
cgugaaccagcaucccacgaa

SEQ ID NO: 1851202 - RNA, 18 nt, Salmonella typhimurium LT2
cgugaaauuuccuccgcc

SEQ ID NO: 1851203 - RNA, 16 nt, Salmonella typhimurium LT2
cgugaacaaugccauu

SEQ ID NO: 1851204 - RNA, 22 nt, Salmonella typhimurium LT2
cgugaacaaugccauuuuugca

SEQ ID NO: 1851205 - RNA, 13 nt, Salmonella typhimurium LT2
cgugaacacaccc

SEQ ID NO: 1851206 - RNA, 19 nt, Salmonella typhimurium LT2
cgugaacacacccuucuca

SEQ ID NO: 1851207 - RNA, 13 nt, Salmonella typhimurium LT2
cgucuucauccau

SEQ ID NO: 1851208 - RNA, 13 nt, Salmonella typhimurium LT2
cgucuucauccca

SEQ ID NO: 1851209 - RNA, 14 nt, Salmonella typhimurium LT2
cgucuucaucccag

SEQ ID NO: 1851210 - RNA, 17 nt, Salmonella typhimurium LT2
cgucuucaucuucgucu

SEQ ID NO: 1851211 - RNA, 23 nt, Salmonella typhimurium LT2
cgucuucuuccacuucagccagc

SEQ ID NO: 1851212 - RNA, 15 nt, Salmonella typhimurium LT2
cgucuggguuucagc

SEQ ID NO: 1851213 - RNA, 17 nt, Salmonella typhimurium LT2
cgucuuaaugcucucca

SEQ ID NO: 1851214 - RNA, 16 nt, Salmonella typhimurium LT2
cgucugcccuccugaa

SEQ ID NO: 1851215 - RNA, 21 nt, Salmonella typhimurium LT2
cgucugauugcgcccuccggc

SEQ ID NO: 1851216 - RNA, 22 nt, Salmonella typhimurium LT2
cgucugaauggacucgaaccau

SEQ ID NO: 1851217 - RNA, 20 nt, Salmonella typhimurium LT2
cgucugaagaaguucuucug

SEQ ID NO: 1851218 - RNA, 21 nt, Salmonella typhimurium LT2
cgucucgccgcggugauccuc

SEQ ID NO: 1851219 - RNA, 19 nt, Salmonella typhimurium LT2
cuaaccgaugcccggcaau

SEQ ID NO: 1851220 - RNA, 22 nt, Salmonella typhimurium LT2
cuaacccaccgauaaaguuaaa

SEQ ID NO: 1851221 - RNA, 13 nt, Salmonella typhimurium LT2
cuaaccaggaccc

SEQ ID NO: 1851222 - RNA, 20 nt, Salmonella typhimurium LT2
cuaacugguacguccauccg

SEQ ID NO: 1851223 - RNA, 16 nt, Salmonella typhimurium LT2
cuaacugggucaaaaa

SEQ ID NO: 1851224 - RNA, 14 nt, Salmonella typhimurium LT2
cuaacgggcugacc

SEQ ID NO: 1851225 - RNA, 23 nt, Salmonella typhimurium LT2
cuaacgcaacggaaggaaauaac

SEQ ID NO: 1851226 - RNA, 21 nt, Salmonella typhimurium LT2
cuaacgcgucuuaucuggccu

SEQ ID NO: 1851227 - RNA, 14 nt, Salmonella typhimurium LT2
cuaagaccagcauc

SEQ ID NO: 1851228 - RNA, 17 nt, Salmonella typhimurium LT2
cuaagccaguucucaau

SEQ ID NO: 1851229 - RNA, 21 nt, Salmonella typhimurium LT2
cuaaauggcauagccugauau

SEQ ID NO: 1851230 - RNA, 15 nt, Salmonella typhimurium LT2
cuaaauuaaaaauaa

SEQ ID NO: 1851231 - RNA, 22 nt, Salmonella typhimurium LT2
cuaacaucauucccguaucuuc

SEQ ID NO: 1851232 - RNA, 12 nt, Salmonella typhimurium LT2
cuaacagcagca

SEQ ID NO: 1851233 - RNA, 19 nt, Salmonella typhimurium LT2
cuaacacaugcaagucgaa

SEQ ID NO: 1851234 - RNA, 19 nt, Salmonella typhimurium LT2
cuaaauugggaugaugcca

SEQ ID NO: 1851235 - RNA, 21 nt, Salmonella typhimurium LT2
cuaaauugggaugaugccaca

SEQ ID NO: 1851236 - RNA, 13 nt, Salmonella typhimurium LT2
cuaaaccacggaa

SEQ ID NO: 1851237 - RNA, 16 nt, Salmonella typhimurium LT2
cguuucgccaguuuac

SEQ ID NO: 1851238 - RNA, 19 nt, Salmonella typhimurium LT2
cguuuccgccaguuuugca

SEQ ID NO: 1851239 - RNA, 16 nt, Salmonella typhimurium LT2
cguuuccugcgccagc

SEQ ID NO: 1851240 - RNA, 14 nt, Salmonella typhimurium LT2
cguuugcgccgcca

SEQ ID NO: 1851241 - RNA, 19 nt, Salmonella typhimurium LT2
cguuugcauaggccccggu

SEQ ID NO: 1851242 - RNA, 14 nt, Salmonella typhimurium LT2
cguuucgccgccau

SEQ ID NO: 1851243 - RNA, 20 nt, Salmonella typhimurium LT2
cguuuguuugucgauuuccg

SEQ ID NO: 1851244 - RNA, 21 nt, Salmonella typhimurium LT2
cguuugucuucugccagcagc

SEQ ID NO: 1851245 - RNA, 21 nt, Salmonella typhimurium LT2
cguuugcugagcagccagccc

SEQ ID NO: 1851246 - RNA, 22 nt, Salmonella typhimurium LT2
cguuugcgcgaggucgagcuca

SEQ ID NO: 1851247 - RNA, 15 nt, Salmonella typhimurium LT2
cguuuguaacagcag

SEQ ID NO: 1851248 - RNA, 14 nt, Salmonella typhimurium LT2
cuaaaaaaaugccc

SEQ ID NO: 1851249 - RNA, 18 nt, Salmonella typhimurium LT2
cguuuuuuacgucagcaa

SEQ ID NO: 1851250 - RNA, 15 nt, Salmonella typhimurium LT2
cguuuuacaccagcu

SEQ ID NO: 1851251 - RNA, 19 nt, Salmonella typhimurium LT2
cguuuuacaccagcuuuua

SEQ ID NO: 1851252 - RNA, 19 nt, Salmonella typhimurium LT2
cguuggaaagcugcugcuu

SEQ ID NO: 1851253 - RNA, 11 nt, Salmonella typhimurium LT2
cguugaaaacg

SEQ ID NO: 1851254 - RNA, 14 nt, Salmonella typhimurium LT2
cguugaaaaccugc

SEQ ID NO: 1851255 - RNA, 22 nt, Salmonella typhimurium LT2
cguucggaaucggacacuugca

SEQ ID NO: 1851256 - RNA, 19 nt, Salmonella typhimurium LT2
cguucgcggggguuguuca

SEQ ID NO: 1851257 - RNA, 16 nt, Salmonella typhimurium LT2
cguuuaacgacggaaa

SEQ ID NO: 1851258 - RNA, 20 nt, Salmonella typhimurium LT2
cguuuaaugcgaaaaauaac

SEQ ID NO: 1851259 - RNA, 20 nt, Salmonella typhimurium LT2
cguuucccggauaaauguuu

SEQ ID NO: 1851260 - RNA, 22 nt, Salmonella typhimurium LT2
cguuucauuuuucccaucaauc

SEQ ID NO: 1851261 - RNA, 12 nt, Salmonella typhimurium LT2
cguuuccagacu

SEQ ID NO: 1851262 - RNA, 16 nt, Salmonella typhimurium LT2
cguuuauaccccacca

SEQ ID NO: 1851263 - RNA, 14 nt, Salmonella typhimurium LT2
cguuuagcgccagc

SEQ ID NO: 1851264 - RNA, 16 nt, Salmonella typhimurium LT2
cguuuaaaaagcugca

SEQ ID NO: 1851265 - RNA, 13 nt, Salmonella typhimurium LT2
cguuguauaaaca

SEQ ID NO: 1851266 - RNA, 18 nt, Salmonella typhimurium LT2
cguugguagacccggcau

SEQ ID NO: 1851267 - RNA, 19 nt, Salmonella typhimurium LT2
cguuggcgucaucgacauu

SEQ ID NO: 1851268 - RNA, 13 nt, Salmonella typhimurium LT2
cguuacgcauuuc

SEQ ID NO: 1851269 - RNA, 17 nt, Salmonella typhimurium LT2
cguuaccguucaggcaa

SEQ ID NO: 1851270 - RNA, 22 nt, Salmonella typhimurium LT2
cguuacgcgccacgccauugcu

SEQ ID NO: 1851271 - RNA, 14 nt, Salmonella typhimurium LT2
cguuacuccgcgau

SEQ ID NO: 1851272 - RNA, 18 nt, Salmonella typhimurium LT2
cguuacgggaacagaauu

SEQ ID NO: 1851273 - RNA, 16 nt, Salmonella typhimurium LT2
cguuagccuaaaugcu

SEQ ID NO: 1851274 - RNA, 21 nt, Salmonella typhimurium LT2
cguuagcgagguucccgccgc

SEQ ID NO: 1851275 - RNA, 22 nt, Salmonella typhimurium LT2
cguuagcgccaccgggcauuuc

SEQ ID NO: 1851276 - RNA, 21 nt, Salmonella typhimurium LT2
cguucaagacagguguuaaug

SEQ ID NO: 1851277 - RNA, 18 nt, Salmonella typhimurium LT2
cguucaaaaucaaacaga

SEQ ID NO: 1851278 - RNA, 20 nt, Salmonella typhimurium LT2
cguuagugauuucgaacucu

SEQ ID NO: 1851279 - RNA, 14 nt, Salmonella typhimurium LT2
cguuagcuggcugu

SEQ ID NO: 1851280 - RNA, 23 nt, Salmonella typhimurium LT2
cguucaauaaaacggcuuuucuu

SEQ ID NO: 1851281 - RNA, 15 nt, Salmonella typhimurium LT2
cguucagcucagcgc

SEQ ID NO: 1851282 - RNA, 23 nt, Salmonella typhimurium LT2
cguucagcucagcgccccagcca

SEQ ID NO: 1851283 - RNA, 21 nt, Salmonella typhimurium LT2
cguucagauaggcgcgaaaug

SEQ ID NO: 1851284 - RNA, 12 nt, Salmonella typhimurium LT2
cguucagccagc

SEQ ID NO: 1851285 - RNA, 17 nt, Salmonella typhimurium LT2
cguucagcauauccagc

SEQ ID NO: 1851286 - RNA, 21 nt, Salmonella typhimurium LT2
cguucgcauauucugcgaaag

SEQ ID NO: 1851287 - RNA, 16 nt, Salmonella typhimurium LT2
cguucgcgacaaagcu

SEQ ID NO: 1851288 - RNA, 13 nt, Salmonella typhimurium LT2
cguuccagcagcg

SEQ ID NO: 1851289 - RNA, 14 nt, Salmonella typhimurium LT2
cguucccgcaggcc

SEQ ID NO: 1851290 - RNA, 18 nt, Salmonella typhimurium LT2
cguuaaauaccagcaccu

SEQ ID NO: 1851291 - RNA, 16 nt, Salmonella typhimurium LT2
cguuaaauaccagcac

SEQ ID NO: 1851292 - RNA, 15 nt, Salmonella typhimurium LT2
cguuacccggccagc

SEQ ID NO: 1851293 - RNA, 12 nt, Salmonella typhimurium LT2
cguuacccuccu

SEQ ID NO: 1851294 - RNA, 12 nt, Salmonella typhimurium LT2
cguuaauuauuc

SEQ ID NO: 1851295 - RNA, 17 nt, Salmonella typhimurium LT2
cguuaauucauggccau

SEQ ID NO: 1851296 - RNA, 15 nt, Salmonella typhimurium LT2
cguuaacccggcauu

SEQ ID NO: 1851297 - RNA, 21 nt, Salmonella typhimurium LT2
cguuaacgcgggcguaauaca

SEQ ID NO: 1851298 - RNA, 19 nt, Salmonella typhimurium LT2
cguuaacugccggguuaaa

SEQ ID NO: 1851299 - RNA, 21 nt, Salmonella typhimurium LT2
cguguggucgcggcucaccag

SEQ ID NO: 1851300 - RNA, 16 nt, Salmonella typhimurium LT2
cguguccucugcugcg

SEQ ID NO: 1851301 - RNA, 15 nt, Salmonella typhimurium LT2
cgugucugaaugagu

SEQ ID NO: 1851302 - RNA, 22 nt, Salmonella typhimurium LT2
cguguauuccagucgcuccacc

SEQ ID NO: 1851303 - RNA, 21 nt, Salmonella typhimurium LT2
cguguacauuaucaaacguca

SEQ ID NO: 1851304 - RNA, 13 nt, Salmonella typhimurium LT2
cguguaaaugacg

SEQ ID NO: 1851305 - RNA, 19 nt, Salmonella typhimurium LT2
cguguaaccaccuggguca

SEQ ID NO: 1851306 - RNA, 13 nt, Salmonella typhimurium LT2
cgugguuuccggc

SEQ ID NO: 1851307 - RNA, 19 nt, Salmonella typhimurium LT2
cgugcggcuguguucaucc

SEQ ID NO: 1851308 - RNA, 21 nt, Salmonella typhimurium LT2
cgugcggcgaagcaucuuucc

SEQ ID NO: 1851309 - RNA, 19 nt, Salmonella typhimurium LT2
cgugcgcucagggucagaa

SEQ ID NO: 1851310 - RNA, 20 nt, Salmonella typhimurium LT2
cgugcgcuacggcuuccggc

SEQ ID NO: 1851311 - RNA, 13 nt, Salmonella typhimurium LT2
cgugcgcuuccac

SEQ ID NO: 1851312 - RNA, 18 nt, Salmonella typhimurium LT2
cguggacgcuuuuauccg

SEQ ID NO: 1851313 - RNA, 20 nt, Salmonella typhimurium LT2
cguggaaaacagcgccggca

SEQ ID NO: 1851314 - RNA, 15 nt, Salmonella typhimurium LT2
cguggcaaucagcaa

SEQ ID NO: 1851315 - RNA, 17 nt, Salmonella typhimurium LT2
cguggcauucgcuugcc

SEQ ID NO: 1851316 - RNA, 11 nt, Salmonella typhimurium LT2
cguggcaucuu

SEQ ID NO: 1851317 - RNA, 12 nt, Salmonella typhimurium LT2
cguggcaucuua

SEQ ID NO: 1851318 - RNA, 15 nt, Salmonella typhimurium LT2
cgugcucucaacaua

SEQ ID NO: 1851319 - RNA, 18 nt, Salmonella typhimurium LT2
cgugcucuucguggaacu

SEQ ID NO: 1851320 - RNA, 15 nt, Salmonella typhimurium LT2
cgugguaucgcggca

SEQ ID NO: 1851321 - RNA, 14 nt, Salmonella typhimurium LT2
cguggugggguucc

SEQ ID NO: 1851322 - RNA, 18 nt, Salmonella typhimurium LT2
cgugguaaauacgcugcg

SEQ ID NO: 1851323 - RNA, 22 nt, Salmonella typhimurium LT2
cguggcgcguagguuggcugag

SEQ ID NO: 1851324 - RNA, 11 nt, Salmonella typhimurium LT2
cgugggaacag

SEQ ID NO: 1851325 - RNA, 22 nt, Salmonella typhimurium LT2
cguggccagcaugcccgccagc

SEQ ID NO: 1851326 - RNA, 21 nt, Salmonella typhimurium LT2
cguggccgauauugccuucac

SEQ ID NO: 1851327 - RNA, 14 nt, Salmonella typhimurium LT2
cuccauagggcagg

SEQ ID NO: 1851328 - RNA, 23 nt, Salmonella typhimurium LT2
cuccaucagacguuuauacccca

SEQ ID NO: 1851329 - RNA, 13 nt, Salmonella typhimurium LT2
cuccauaauuuga

SEQ ID NO: 1851330 - RNA, 16 nt, Salmonella typhimurium LT2
cuccaucauuuccggc

SEQ ID NO: 1851331 - RNA, 22 nt, Salmonella typhimurium LT2
cuccaguugauacaggaauaac

SEQ ID NO: 1851332 - RNA, 22 nt, Salmonella typhimurium LT2
cuccaguuguuccagcagcuca

SEQ ID NO: 1851333 - RNA, 15 nt, Salmonella typhimurium LT2
cuccaguuugcguuc

SEQ ID NO: 1851334 - RNA, 18 nt, Salmonella typhimurium LT2
cuccaguucccgacaggc

SEQ ID NO: 1851335 - RNA, 15 nt, Salmonella typhimurium LT2
cuccagcgaggccuc

SEQ ID NO: 1851336 - RNA, 20 nt, Salmonella typhimurium LT2
cuccagccgucuuucccggc

SEQ ID NO: 1851337 - RNA, 18 nt, Salmonella typhimurium LT2
cuccagcgccagcuccau

SEQ ID NO: 1851338 - RNA, 17 nt, Salmonella typhimurium LT2
cuccagcgccagcucca

SEQ ID NO: 1851339 - RNA, 13 nt, Salmonella typhimurium LT2
cuccagcgccugc

SEQ ID NO: 1851340 - RNA, 16 nt, Salmonella typhimurium LT2
cuccaggcgaaucccc

SEQ ID NO: 1851341 - RNA, 16 nt, Salmonella typhimurium LT2
cuccaggcguuuauga

SEQ ID NO: 1851342 - RNA, 18 nt, Salmonella typhimurium LT2
cuccaggaugugaggcag

SEQ ID NO: 1851343 - RNA, 20 nt, Salmonella typhimurium LT2
cuccaggaacaggcccgcca

SEQ ID NO: 1851344 - RNA, 21 nt, Salmonella typhimurium LT2
cuccaggaacaggcccgccag

SEQ ID NO: 1851345 - RNA, 22 nt, Salmonella typhimurium LT2
cuccaggaacaggcccgccaga

SEQ ID NO: 1851346 - RNA, 16 nt, Salmonella typhimurium LT2
cuccagcucagggucc

SEQ ID NO: 1851347 - RNA, 22 nt, Salmonella typhimurium LT2
cuccagcgggcuggcauucauu

SEQ ID NO: 1851348 - RNA, 17 nt, Salmonella typhimurium LT2
cuccagcuucaucauca

SEQ ID NO: 1851349 - RNA, 18 nt, Salmonella typhimurium LT2
cuccaccgugucauagcc

SEQ ID NO: 1851350 - RNA, 20 nt, Salmonella typhimurium LT2
cucauuuuguugcuccagca

SEQ ID NO: 1851351 - RNA, 22 nt, Salmonella typhimurium LT2
cucauuuugccguugcuguucc

SEQ ID NO: 1851352 - RNA, 16 nt, Salmonella typhimurium LT2
cuccacguauaauaau

SEQ ID NO: 1851353 - RNA, 17 nt, Salmonella typhimurium LT2
cuccacgcccagcgccg

SEQ ID NO: 1851354 - RNA, 21 nt, Salmonella typhimurium LT2
cuccacgccauagcgcaguaa

SEQ ID NO: 1851355 - RNA, 20 nt, Salmonella typhimurium LT2
cuccagcacgcgcugcgccg

SEQ ID NO: 1851356 - RNA, 14 nt, Salmonella typhimurium LT2
cuccagcauccugc

SEQ ID NO: 1851357 - RNA, 17 nt, Salmonella typhimurium LT2
cuccagcaucauuuuuu

SEQ ID NO: 1851358 - RNA, 19 nt, Salmonella typhimurium LT2
cuccagagcgccguggaaa

SEQ ID NO: 1851359 - RNA, 22 nt, Salmonella typhimurium LT2
cuccagaauauugacaucgccg

SEQ ID NO: 1851360 - RNA, 15 nt, Salmonella typhimurium LT2
cuccagaccaccagc

SEQ ID NO: 1851361 - RNA, 19 nt, Salmonella typhimurium LT2
cuccagaagcacuucucca

SEQ ID NO: 1851362 - RNA, 20 nt, Salmonella typhimurium LT2
cuccagcaacagcgcgucca

SEQ ID NO: 1851363 - RNA, 21 nt, Salmonella typhimurium LT2
cuccuauuaucggcaccaucu

SEQ ID NO: 1851364 - RNA, 15 nt, Salmonella typhimurium LT2
cuccugacugccgcc

SEQ ID NO: 1851365 - RNA, 17 nt, Salmonella typhimurium LT2
cuccugacugccgccgg

SEQ ID NO: 1851366 - RNA, 15 nt, Salmonella typhimurium LT2
cuccggcgcugcgcu

SEQ ID NO: 1851367 - RNA, 18 nt, Salmonella typhimurium LT2
cuccggccugccugguaa

SEQ ID NO: 1851368 - RNA, 16 nt, Salmonella typhimurium LT2
cuccgggcgguucggc

SEQ ID NO: 1851369 - RNA, 18 nt, Salmonella typhimurium LT2
cuccgggcucauauuauc

SEQ ID NO: 1851370 - RNA, 21 nt, Salmonella typhimurium LT2
cuccgccgcuuuaucguaacc

SEQ ID NO: 1851371 - RNA, 19 nt, Salmonella typhimurium LT2
cuccgccggagcaucauuu

SEQ ID NO: 1851372 - RNA, 21 nt, Salmonella typhimurium LT2
cuccgccagcaaugccgccgc

SEQ ID NO: 1851373 - RNA, 18 nt, Salmonella typhimurium LT2
cuccgcaccuucaucauu

SEQ ID NO: 1851374 - RNA, 21 nt, Salmonella typhimurium LT2
cucccaggcgcgcagcugcca

SEQ ID NO: 1851375 - RNA, 17 nt, Salmonella typhimurium LT2
cucccaggcgcgcagcu

SEQ ID NO: 1851376 - RNA, 18 nt, Salmonella typhimurium LT2
cucccaggccgccaccgc

SEQ ID NO: 1851377 - RNA, 13 nt, Salmonella typhimurium LT2
cucccagcugagc

SEQ ID NO: 1851378 - RNA, 21 nt, Salmonella typhimurium LT2
cucccagaaaccgccccuggc

SEQ ID NO: 1851379 - RNA, 14 nt, Salmonella typhimurium LT2
cucccacucuucca

SEQ ID NO: 1851380 - RNA, 14 nt, Salmonella typhimurium LT2
cucccagaugaaaa

SEQ ID NO: 1851381 - RNA, 19 nt, Salmonella typhimurium LT2
cucccagccgggcaggaaa

SEQ ID NO: 1851382 - RNA, 20 nt, Salmonella typhimurium LT2
cuccccacaaucccgccaga

SEQ ID NO: 1851383 - RNA, 16 nt, Salmonella typhimurium LT2
cuccccacgaaagucu

SEQ ID NO: 1851384 - RNA, 22 nt, Salmonella typhimurium LT2
cuccccaggcgcuauucccagg

SEQ ID NO: 1851385 - RNA, 23 nt, Salmonella typhimurium LT2
cuccccaggcgcuauucccaggc

SEQ ID NO: 1851386 - RNA, 19 nt, Salmonella typhimurium LT2
cuccauuuuggggaaaaua

SEQ ID NO: 1851387 - RNA, 19 nt, Salmonella typhimurium LT2
cucccaaauuuuuuuagca

SEQ ID NO: 1851388 - RNA, 16 nt, Salmonella typhimurium LT2
cucccacccgcgcgcu

SEQ ID NO: 1851389 - RNA, 21 nt, Salmonella typhimurium LT2
cucccacccgcgcgcuuucca

SEQ ID NO: 1851390 - RNA, 20 nt, Salmonella typhimurium LT2
cucccuugccagcgcaucca

SEQ ID NO: 1851391 - RNA, 21 nt, Salmonella typhimurium LT2
cucccuuaagggugacggugu

SEQ ID NO: 1851392 - RNA, 15 nt, Salmonella typhimurium LT2
cucccugccaggcca

SEQ ID NO: 1851393 - RNA, 12 nt, Salmonella typhimurium LT2
cucccuggcagu

SEQ ID NO: 1851394 - RNA, 16 nt, Salmonella typhimurium LT2
cucccggaaccgaccg

SEQ ID NO: 1851395 - RNA, 16 nt, Salmonella typhimurium LT2
cucccgaauggcuuca

SEQ ID NO: 1851396 - RNA, 22 nt, Salmonella typhimurium LT2
cucccgccagaugcagcggcag

SEQ ID NO: 1851397 - RNA, 19 nt, Salmonella typhimurium LT2
cucgcuuaaugaggccacc

SEQ ID NO: 1851398 - RNA, 21 nt, Salmonella typhimurium LT2
cucgcuggugccaaucuccag

SEQ ID NO: 1851399 - RNA, 19 nt, Salmonella typhimurium LT2
cucgcuguacuucccucuc

SEQ ID NO: 1851400 - RNA, 22 nt, Salmonella typhimurium LT2
cucguacacgcgcccgccgcca

SEQ ID NO: 1851401 - RNA, 15 nt, Salmonella typhimurium LT2
cucguccugcaauuu

SEQ ID NO: 1851402 - RNA, 13 nt, Salmonella typhimurium LT2
cucgugcaaauca

SEQ ID NO: 1851403 - RNA, 12 nt, Salmonella typhimurium LT2
cucuacauuucg

SEQ ID NO: 1851404 - RNA, 17 nt, Salmonella typhimurium LT2
cucuacgcgcugaccuu

SEQ ID NO: 1851405 - RNA, 16 nt, Salmonella typhimurium LT2
cucuaccccuucugcc

SEQ ID NO: 1851406 - RNA, 13 nt, Salmonella typhimurium LT2
cucuaaaaaggaa

SEQ ID NO: 1851407 - RNA, 23 nt, Salmonella typhimurium LT2
cuccugauaucgauauaaugccu

SEQ ID NO: 1851408 - RNA, 17 nt, Salmonella typhimurium LT2
cucgaccaguuuuuccg

SEQ ID NO: 1851409 - RNA, 20 nt, Salmonella typhimurium LT2
cucgacuuuucacuuauaaa

SEQ ID NO: 1851410 - RNA, 20 nt, Salmonella typhimurium LT2
cucgacuaaaggcagcgcgc

SEQ ID NO: 1851411 - RNA, 20 nt, Salmonella typhimurium LT2
cucgccacgguuggcccagc

SEQ ID NO: 1851412 - RNA, 18 nt, Salmonella typhimurium LT2
cucgccaauauccccagc

SEQ ID NO: 1851413 - RNA, 20 nt, Salmonella typhimurium LT2
cucgauggcauuguccuuua

SEQ ID NO: 1851414 - RNA, 19 nt, Salmonella typhimurium LT2
cucgauagcguuuuccagc

SEQ ID NO: 1851415 - RNA, 23 nt, Salmonella typhimurium LT2
cucgcugauacgcuggcacagga

SEQ ID NO: 1851416 - RNA, 20 nt, Salmonella typhimurium LT2
cucgcugauacgcaccagcu

SEQ ID NO: 1851417 - RNA, 22 nt, Salmonella typhimurium LT2
cucgcugauacgcuggcacagg

SEQ ID NO: 1851418 - RNA, 23 nt, Salmonella typhimurium LT2
cucgcucaucacaucgcgcagca

SEQ ID NO: 1851419 - RNA, 19 nt, Salmonella typhimurium LT2
cucgcuauauacccccugc

SEQ ID NO: 1851420 - RNA, 16 nt, Salmonella typhimurium LT2
cucgcuacgcucgccc

SEQ ID NO: 1851421 - RNA, 23 nt, Salmonella typhimurium LT2
cucgcguugagggguuucaauuc

SEQ ID NO: 1851422 - RNA, 13 nt, Salmonella typhimurium LT2
cucgcuaaugccc

SEQ ID NO: 1851423 - RNA, 16 nt, Salmonella typhimurium LT2
cucgcuaaugcccggc

SEQ ID NO: 1851424 - RNA, 23 nt, Salmonella typhimurium LT2
cucgcguccccagccgaugaccc

SEQ ID NO: 1851425 - RNA, 14 nt, Salmonella typhimurium LT2
cucgcguccccagc

SEQ ID NO: 1851426 - RNA, 18 nt, Salmonella typhimurium LT2
cucgcguaccagaaacag

SEQ ID NO: 1851427 - RNA, 22 nt, Salmonella typhimurium LT2
cucgcggcaguaagccagcggg

SEQ ID NO: 1851428 - RNA, 23 nt, Salmonella typhimurium LT2
cucgccggauggcgacgcguagc

SEQ ID NO: 1851429 - RNA, 17 nt, Salmonella typhimurium LT2
cucgccggaaagaaacg

SEQ ID NO: 1851430 - RNA, 11 nt, Salmonella typhimurium LT2
cucgccagcgc

SEQ ID NO: 1851431 - RNA, 13 nt, Salmonella typhimurium LT2
cucgccauaaaga

SEQ ID NO: 1851432 - RNA, 12 nt, Salmonella typhimurium LT2
cucgcccagcac

SEQ ID NO: 1851433 - RNA, 22 nt, Salmonella typhimurium LT2
cucgcgcaucaggaucuucauc

SEQ ID NO: 1851434 - RNA, 17 nt, Salmonella typhimurium LT2
cucgcgcucaaaaaagg

SEQ ID NO: 1851435 - RNA, 19 nt, Salmonella typhimurium LT2
cucgcgcucaagcgaaaaa

SEQ ID NO: 1851436 - RNA, 11 nt, Salmonella typhimurium LT2
cuauuuuucac

SEQ ID NO: 1851437 - RNA, 13 nt, Salmonella typhimurium LT2
cuauuuuuuuaua

SEQ ID NO: 1851438 - RNA, 23 nt, Salmonella typhimurium LT2
cuauuuggccugcagaauuucua

SEQ ID NO: 1851439 - RNA, 15 nt, Salmonella typhimurium LT2
cucaaccgcgcggcg

SEQ ID NO: 1851440 - RNA, 21 nt, Salmonella typhimurium LT2
cucaagcuguagcguuuccac

SEQ ID NO: 1851441 - RNA, 14 nt, Salmonella typhimurium LT2
cucaaccagcaaug

SEQ ID NO: 1851442 - RNA, 12 nt, Salmonella typhimurium LT2
cucaaccagccg

SEQ ID NO: 1851443 - RNA, 21 nt, Salmonella typhimurium LT2
cucaaccaccaccgauaaacg

SEQ ID NO: 1851444 - RNA, 21 nt, Salmonella typhimurium LT2
cucaacauugccggcaucauu

SEQ ID NO: 1851445 - RNA, 22 nt, Salmonella typhimurium LT2
cucaacauugccggcaucauuc

SEQ ID NO: 1851446 - RNA, 13 nt, Salmonella typhimurium LT2
cucaacaucauua

SEQ ID NO: 1851447 - RNA, 14 nt, Salmonella typhimurium LT2
cucaacaucauuaa

SEQ ID NO: 1851448 - RNA, 22 nt, Salmonella typhimurium LT2
cucaagugucgauaaccuggau

SEQ ID NO: 1851449 - RNA, 22 nt, Salmonella typhimurium LT2
cucaauccuucuaccuucaccc

SEQ ID NO: 1851450 - RNA, 21 nt, Salmonella typhimurium LT2
cucaaggcuauuagccaaagc

SEQ ID NO: 1851451 - RNA, 13 nt, Salmonella typhimurium LT2
cucaauguccuga

SEQ ID NO: 1851452 - RNA, 14 nt, Salmonella typhimurium LT2
cucaaucugaugau

SEQ ID NO: 1851453 - RNA, 15 nt, Salmonella typhimurium LT2
cucaaugauuuccgc

SEQ ID NO: 1851454 - RNA, 17 nt, Salmonella typhimurium LT2
cucaaugguuucacgcu

SEQ ID NO: 1851455 - RNA, 19 nt, Salmonella typhimurium LT2
cucacauucauaaaagauc

SEQ ID NO: 1851456 - RNA, 18 nt, Salmonella typhimurium LT2
cucaggcaagacacagcg

SEQ ID NO: 1851457 - RNA, 23 nt, Salmonella typhimurium LT2
cucagcauagcgcugaaacggga

SEQ ID NO: 1851458 - RNA, 18 nt, Salmonella typhimurium LT2
cucagcauuggugagaga

SEQ ID NO: 1851459 - RNA, 23 nt, Salmonella typhimurium LT2
cucagcaguuuguccauuucuug

SEQ ID NO: 1851460 - RNA, 16 nt, Salmonella typhimurium LT2
cucagccagaaacggu

SEQ ID NO: 1851461 - RNA, 14 nt, Salmonella typhimurium LT2
cucagccccaggcc

SEQ ID NO: 1851462 - RNA, 20 nt, Salmonella typhimurium LT2
cucagcaaaacggauaauau

SEQ ID NO: 1851463 - RNA, 22 nt, Salmonella typhimurium LT2
cucagaccgaucucaugcaacu

SEQ ID NO: 1851464 - RNA, 19 nt, Salmonella typhimurium LT2
cucagaccauauucacgca

SEQ ID NO: 1851465 - RNA, 22 nt, Salmonella typhimurium LT2
cucagacaguagcggcgaggca

SEQ ID NO: 1851466 - RNA, 18 nt, Salmonella typhimurium LT2
cucaccguagcuccagac

SEQ ID NO: 1851467 - RNA, 15 nt, Salmonella typhimurium LT2
cucaccggccccgga

SEQ ID NO: 1851468 - RNA, 21 nt, Salmonella typhimurium LT2
cucaccgcuaaucccagcgcg

SEQ ID NO: 1851469 - RNA, 14 nt, Salmonella typhimurium LT2
cucauuaaaaaaac

SEQ ID NO: 1851470 - RNA, 15 nt, Salmonella typhimurium LT2
cucauguucaagcug

SEQ ID NO: 1851471 - RNA, 17 nt, Salmonella typhimurium LT2
cucauguucaagcuggu

SEQ ID NO: 1851472 - RNA, 18 nt, Salmonella typhimurium LT2
cucaucugcuucaacagc

SEQ ID NO: 1851473 - RNA, 17 nt, Salmonella typhimurium LT2
cucaucacagccacacu

SEQ ID NO: 1851474 - RNA, 22 nt, Salmonella typhimurium LT2
cucaucaauucuuuaauuugug

SEQ ID NO: 1851475 - RNA, 16 nt, Salmonella typhimurium LT2
cucaucaaacagcggc

SEQ ID NO: 1851476 - RNA, 13 nt, Salmonella typhimurium LT2
cucaucaauaaua

SEQ ID NO: 1851477 - RNA, 19 nt, Salmonella typhimurium LT2
cucagucacuucaaccuuu

SEQ ID NO: 1851478 - RNA, 16 nt, Salmonella typhimurium LT2
cucaguccagccgccg

SEQ ID NO: 1851479 - RNA, 15 nt, Salmonella typhimurium LT2
cucagguucgggcca

SEQ ID NO: 1851480 - RNA, 23 nt, Salmonella typhimurium LT2
cucagguucgggccaccuuccag

SEQ ID NO: 1851481 - RNA, 15 nt, Salmonella typhimurium LT2
cuacgguaaaccagg

SEQ ID NO: 1851482 - RNA, 13 nt, Salmonella typhimurium LT2
cuacggcgcacag

SEQ ID NO: 1851483 - RNA, 15 nt, Salmonella typhimurium LT2
cuacggucaguuguc

SEQ ID NO: 1851484 - RNA, 14 nt, Salmonella typhimurium LT2
cuacggugugccug

SEQ ID NO: 1851485 - RNA, 21 nt, Salmonella typhimurium LT2
cuacgcugccauccucauuuu

SEQ ID NO: 1851486 - RNA, 19 nt, Salmonella typhimurium LT2
cuacgcucauaaaaaagaa

SEQ ID NO: 1851487 - RNA, 20 nt, Salmonella typhimurium LT2
cuacgcucauaaaaaagaau

SEQ ID NO: 1851488 - RNA, 16 nt, Salmonella typhimurium LT2
cuaccuucuucccaua

SEQ ID NO: 1851489 - RNA, 17 nt, Salmonella typhimurium LT2
cuacgaacgcgaaggcc

SEQ ID NO: 1851490 - RNA, 15 nt, Salmonella typhimurium LT2
cuacgccuccugccg

SEQ ID NO: 1851491 - RNA, 13 nt, Salmonella typhimurium LT2
cuacgccauggca

SEQ ID NO: 1851492 - RNA, 16 nt, Salmonella typhimurium LT2
cuaccugcgagcugua

SEQ ID NO: 1851493 - RNA, 18 nt, Salmonella typhimurium LT2
cuaccugcagggugaaga

SEQ ID NO: 1851494 - RNA, 17 nt, Salmonella typhimurium LT2
cuaccggggcgcucgcc

SEQ ID NO: 1851495 - RNA, 16 nt, Salmonella typhimurium LT2
cuaccgggcagcaucu

SEQ ID NO: 1851496 - RNA, 15 nt, Salmonella typhimurium LT2
cuaccgucagcagca

SEQ ID NO: 1851497 - RNA, 14 nt, Salmonella typhimurium LT2
cuaccggauaaauu

SEQ ID NO: 1851498 - RNA, 20 nt, Salmonella typhimurium LT2
cuaauacgagcgggucagga

SEQ ID NO: 1851499 - RNA, 17 nt, Salmonella typhimurium LT2
cuaccgcuucgcgcgcc

SEQ ID NO: 1851500 - RNA, 23 nt, Salmonella typhimurium LT2
cuacuacauagcuauauuuuuua

SEQ ID NO: 1851501 - RNA, 15 nt, Salmonella typhimurium LT2
cuacuaucaucugac

SEQ ID NO: 1851502 - RNA, 24 nt, Salmonella typhimurium LT2
cuacuaucaucugacuaacacgua

SEQ ID NO: 1851503 - RNA, 13 nt, Salmonella typhimurium LT2
cuacguucaucag

SEQ ID NO: 1851504 - RNA, 19 nt, Salmonella typhimurium LT2
cuacguugaccucaucacc

SEQ ID NO: 1851505 - RNA, 20 nt, Salmonella typhimurium LT2
cuacguuggagaggaauugu

SEQ ID NO: 1851506 - RNA, 15 nt, Salmonella typhimurium LT2
cuagcauaagcacag

SEQ ID NO: 1851507 - RNA, 18 nt, Salmonella typhimurium LT2
cuauccguccucuuuccc

SEQ ID NO: 1851508 - RNA, 14 nt, Salmonella typhimurium LT2
cuauccucaacuug

SEQ ID NO: 1851509 - RNA, 12 nt, Salmonella typhimurium LT2
cuauauaaaauc

SEQ ID NO: 1851510 - RNA, 15 nt, Salmonella typhimurium LT2
cuauauauucuucuu

SEQ ID NO: 1851511 - RNA, 22 nt, Salmonella typhimurium LT2
cuaucgcccaaauaguccagca

SEQ ID NO: 1851512 - RNA, 15 nt, Salmonella typhimurium LT2
cuaucgcaucagaua

SEQ ID NO: 1851513 - RNA, 16 nt, Salmonella typhimurium LT2
cuaucgaccagcaccu

SEQ ID NO: 1851514 - RNA, 15 nt, Salmonella typhimurium LT2
cuaucugcccuggcu

SEQ ID NO: 1851515 - RNA, 22 nt, Salmonella typhimurium LT2
cuaucugacagccaaacugcug

SEQ ID NO: 1851516 - RNA, 14 nt, Salmonella typhimurium LT2
cuaucuucgauaaa

SEQ ID NO: 1851517 - RNA, 23 nt, Salmonella typhimurium LT2
cuaucuguauaucuuucuuaucc

SEQ ID NO: 1851518 - RNA, 13 nt, Salmonella typhimurium LT2
cuaucuuuuuaag

SEQ ID NO: 1851519 - RNA, 15 nt, Salmonella typhimurium LT2
cuaucuuucagaccu

SEQ ID NO: 1851520 - RNA, 16 nt, Salmonella typhimurium LT2
cuauaauugcuuuuuu

SEQ ID NO: 1851521 - RNA, 23 nt, Salmonella typhimurium LT2
cuauaauugcuuuuuuccacaga

SEQ ID NO: 1851522 - RNA, 18 nt, Salmonella typhimurium LT2
cuauacgguaaaucauuu

SEQ ID NO: 1851523 - RNA, 18 nt, Salmonella typhimurium LT2
cuauacccgcguuuucuc

SEQ ID NO: 1851524 - RNA, 14 nt, Salmonella typhimurium LT2
cuauaccgcuuuau

SEQ ID NO: 1851525 - RNA, 12 nt, Salmonella typhimurium LT2
cuauacaguaaa

SEQ ID NO: 1851526 - RNA, 17 nt, Salmonella typhimurium LT2
cuaggacgaaaaaugaa

SEQ ID NO: 1851527 - RNA, 13 nt, Salmonella typhimurium LT2
cugauagcgggua

SEQ ID NO: 1851528 - RNA, 20 nt, Salmonella typhimurium LT2
cugauagcuaaccagcgagc

SEQ ID NO: 1851529 - RNA, 12 nt, Salmonella typhimurium LT2
cugauaauaaga

SEQ ID NO: 1851530 - RNA, 20 nt, Salmonella typhimurium LT2
cugauaccgucuuccuucca

SEQ ID NO: 1851531 - RNA, 21 nt, Salmonella typhimurium LT2
cugauaccgucuuccuuccac

SEQ ID NO: 1851532 - RNA, 13 nt, Salmonella typhimurium LT2
cugauaaaagccc

SEQ ID NO: 1851533 - RNA, 19 nt, Salmonella typhimurium LT2
cugauaaaaacucagcagu

SEQ ID NO: 1851534 - RNA, 18 nt, Salmonella typhimurium LT2
cugauaaaacgcaggcag

SEQ ID NO: 1851535 - RNA, 19 nt, Salmonella typhimurium LT2
cugauaaagagcaggccaa

SEQ ID NO: 1851536 - RNA, 22 nt, Salmonella typhimurium LT2
cugauaaagagcaggccaaaaa

SEQ ID NO: 1851537 - RNA, 14 nt, Salmonella typhimurium LT2
cugauaagcacagg

SEQ ID NO: 1851538 - RNA, 19 nt, Salmonella typhimurium LT2
cugauaagguaaagccgcc

SEQ ID NO: 1851539 - RNA, 19 nt, Salmonella typhimurium LT2
cugauaagggccggaaaaa

SEQ ID NO: 1851540 - RNA, 18 nt, Salmonella typhimurium LT2
cugaucgagaucgccaaa

SEQ ID NO: 1851541 - RNA, 16 nt, Salmonella typhimurium LT2
cugaucgcgcagacag

SEQ ID NO: 1851542 - RNA, 22 nt, Salmonella typhimurium LT2
cugaucgcgcagacaguggcca

SEQ ID NO: 1851543 - RNA, 19 nt, Salmonella typhimurium LT2
cugaucgccgacgaccggc

SEQ ID NO: 1851544 - RNA, 16 nt, Salmonella typhimurium LT2
cugaucgauucucuuc

SEQ ID NO: 1851545 - RNA, 21 nt, Salmonella typhimurium LT2
cugauauucccguuccagcuu

SEQ ID NO: 1851546 - RNA, 21 nt, Salmonella typhimurium LT2
cugauaucggcugcuguaaca

SEQ ID NO: 1851547 - RNA, 21 nt, Salmonella typhimurium LT2
cugauaucuaugguaauuuaa

SEQ ID NO: 1851548 - RNA, 15 nt, Salmonella typhimurium LT2
cugauauaacccuca

SEQ ID NO: 1851549 - RNA, 14 nt, Salmonella typhimurium LT2
cugauaguuuaaau

SEQ ID NO: 1851550 - RNA, 15 nt, Salmonella typhimurium LT2
cugauaguggcguuu

SEQ ID NO: 1851551 - RNA, 14 nt, Salmonella typhimurium LT2
cucuauuaaaauaa

SEQ ID NO: 1851552 - RNA, 20 nt, Salmonella typhimurium LT2
cucuaucaagggugcuggca

SEQ ID NO: 1851553 - RNA, 20 nt, Salmonella typhimurium LT2
cucuauccggaggccuucuu

SEQ ID NO: 1851554 - RNA, 20 nt, Salmonella typhimurium LT2
cugaggcguugcuccagcag

SEQ ID NO: 1851555 - RNA, 16 nt, Salmonella typhimurium LT2
cugagcuuuccugaca

SEQ ID NO: 1851556 - RNA, 19 nt, Salmonella typhimurium LT2
cugaggaccacacagcgga

SEQ ID NO: 1851557 - RNA, 17 nt, Salmonella typhimurium LT2
cugagugacgggcuggc

SEQ ID NO: 1851558 - RNA, 17 nt, Salmonella typhimurium LT2
cugagugugucuuuuac

SEQ ID NO: 1851559 - RNA, 23 nt, Salmonella typhimurium LT2
cugaguuucucccgccagaugca

SEQ ID NO: 1851560 - RNA, 15 nt, Salmonella typhimurium LT2
cugaguuucucccgc

SEQ ID NO: 1851561 - RNA, 22 nt, Salmonella typhimurium LT2
cugaguuucaccgccagagcac

SEQ ID NO: 1851562 - RNA, 17 nt, Salmonella typhimurium LT2
cugaguuuagccagcag

SEQ ID NO: 1851563 - RNA, 22 nt, Salmonella typhimurium LT2
cugaguuacgaucguuugccca

SEQ ID NO: 1851564 - RNA, 22 nt, Salmonella typhimurium LT2
cugcaggguuugcgcagacugc

SEQ ID NO: 1851565 - RNA, 23 nt, Salmonella typhimurium LT2
cugcaguuuugcauucugcaacu

SEQ ID NO: 1851566 - RNA, 23 nt, Salmonella typhimurium LT2
cugcagacccacuuucagcuccg

SEQ ID NO: 1851567 - RNA, 18 nt, Salmonella typhimurium LT2
cugcagacugccggcaaa

SEQ ID NO: 1851568 - RNA, 14 nt, Salmonella typhimurium LT2
cugcagauuauuuc

SEQ ID NO: 1851569 - RNA, 23 nt, Salmonella typhimurium LT2
cugcagaugcugcugcgcggcca

SEQ ID NO: 1851570 - RNA, 23 nt, Salmonella typhimurium LT2
cugcaggcgggugcgcagcccca

SEQ ID NO: 1851571 - RNA, 14 nt, Salmonella typhimurium LT2
cugcacucgauggc

SEQ ID NO: 1851572 - RNA, 20 nt, Salmonella typhimurium LT2
cugcagacccacuuucagcu

SEQ ID NO: 1851573 - RNA, 22 nt, Salmonella typhimurium LT2
cugcagaaucccgauaaucaau

SEQ ID NO: 1851574 - RNA, 22 nt, Salmonella typhimurium LT2
cugcacuuuaaaccacaccuga

SEQ ID NO: 1851575 - RNA, 17 nt, Salmonella typhimurium LT2
cugcacuuccagccacg

SEQ ID NO: 1851576 - RNA, 18 nt, Salmonella typhimurium LT2
cugcaaucgcucuugcac

SEQ ID NO: 1851577 - RNA, 15 nt, Salmonella typhimurium LT2
cugcacggcauacuc

SEQ ID NO: 1851578 - RNA, 22 nt, Salmonella typhimurium LT2
cugcaaugguaaaacgcuggcc

SEQ ID NO: 1851579 - RNA, 23 nt, Salmonella typhimurium LT2
cugcaaugugcaggcuuuuucau

SEQ ID NO: 1851580 - RNA, 22 nt, Salmonella typhimurium LT2
cugcaauguuuucagcaaauaa

SEQ ID NO: 1851581 - RNA, 20 nt, Salmonella typhimurium LT2
cugcaaugguaaaacgcugg

SEQ ID NO: 1851582 - RNA, 13 nt, Salmonella typhimurium LT2
cugcaaaaugaug

SEQ ID NO: 1851583 - RNA, 17 nt, Salmonella typhimurium LT2
cugcaaagcaucugccg

SEQ ID NO: 1851584 - RNA, 16 nt, Salmonella typhimurium LT2
cugcaacgucgcgccc

SEQ ID NO: 1851585 - RNA, 14 nt, Salmonella typhimurium LT2
cugcaacucuccca

SEQ ID NO: 1851586 - RNA, 14 nt, Salmonella typhimurium LT2
cugcaacgccagau

SEQ ID NO: 1851587 - RNA, 19 nt, Salmonella typhimurium LT2
cugcaaauaccacaucaga

SEQ ID NO: 1851588 - RNA, 16 nt, Salmonella typhimurium LT2
cugcaaauacugcuuu

SEQ ID NO: 1851589 - RNA, 21 nt, Salmonella typhimurium LT2
cugauugcgcccuccggcaag

SEQ ID NO: 1851590 - RNA, 14 nt, Salmonella typhimurium LT2
cugaugugcuccau

SEQ ID NO: 1851591 - RNA, 17 nt, Salmonella typhimurium LT2
cugauuaaucagcucag

SEQ ID NO: 1851592 - RNA, 16 nt, Salmonella typhimurium LT2
cugauguccgcagccg

SEQ ID NO: 1851593 - RNA, 17 nt, Salmonella typhimurium LT2
cugaugaaaaguauaua

SEQ ID NO: 1851594 - RNA, 22 nt, Salmonella typhimurium LT2
cugaucuggcugcguaaaauca

SEQ ID NO: 1851595 - RNA, 18 nt, Salmonella typhimurium LT2
cugaucgucggugaaaac

SEQ ID NO: 1851596 - RNA, 15 nt, Salmonella typhimurium LT2
cugaucgcugagcgc

SEQ ID NO: 1851597 - RNA, 22 nt, Salmonella typhimurium LT2
cugccgacgcccucaauaucuu

SEQ ID NO: 1851598 - RNA, 19 nt, Salmonella typhimurium LT2
cugccgacaaagagcuccc

SEQ ID NO: 1851599 - RNA, 17 nt, Salmonella typhimurium LT2
cugcccuuuuagcacuu

SEQ ID NO: 1851600 - RNA, 13 nt, Salmonella typhimurium LT2
cugccggcaaaac

SEQ ID NO: 1851601 - RNA, 17 nt, Salmonella typhimurium LT2
cugccggauggagcggc

SEQ ID NO: 1851602 - RNA, 20 nt, Salmonella typhimurium LT2
cugccggauggagcggcgcu

SEQ ID NO: 1851603 - RNA, 18 nt, Salmonella typhimurium LT2
cugccggauggcggcgcu

SEQ ID NO: 1851604 - RNA, 16 nt, Salmonella typhimurium LT2
cugccggaaaacguga

SEQ ID NO: 1851605 - RNA, 22 nt, Salmonella typhimurium LT2
cugccggaaaccuguucccggc

SEQ ID NO: 1851606 - RNA, 19 nt, Salmonella typhimurium LT2
cugccgucaaugccgggca

SEQ ID NO: 1851607 - RNA, 22 nt, Salmonella typhimurium LT2
cugccgucaaugccgggcagac

SEQ ID NO: 1851608 - RNA, 16 nt, Salmonella typhimurium LT2
cugccuaaauugacgc

SEQ ID NO: 1851609 - RNA, 14 nt, Salmonella typhimurium LT2
cugccggucggcgu

SEQ ID NO: 1851610 - RNA, 12 nt, Salmonella typhimurium LT2
cugccguaaaca

SEQ ID NO: 1851611 - RNA, 18 nt, Salmonella typhimurium LT2
cugccaguagauggcgcu

SEQ ID NO: 1851612 - RNA, 16 nt, Salmonella typhimurium LT2
cugccagucugcccgg

SEQ ID NO: 1851613 - RNA, 12 nt, Salmonella typhimurium LT2
cugccagucgcu

SEQ ID NO: 1851614 - RNA, 21 nt, Salmonella typhimurium LT2
cugccaguucacgccgccgcc

SEQ ID NO: 1851615 - RNA, 20 nt, Salmonella typhimurium LT2
cugccagggccaaucagaau

SEQ ID NO: 1851616 - RNA, 22 nt, Salmonella typhimurium LT2
cugccagguuauuucgcgcagu

SEQ ID NO: 1851617 - RNA, 20 nt, Salmonella typhimurium LT2
cugccaggcauaccuccucu

SEQ ID NO: 1851618 - RNA, 21 nt, Salmonella typhimurium LT2
cugccaggcauaccuccucuc

SEQ ID NO: 1851619 - RNA, 18 nt, Salmonella typhimurium LT2
cugccauagcaucaccag

SEQ ID NO: 1851620 - RNA, 13 nt, Salmonella typhimurium LT2
cugccaucaucca

SEQ ID NO: 1851621 - RNA, 15 nt, Salmonella typhimurium LT2
cugccaucauccagu

SEQ ID NO: 1851622 - RNA, 12 nt, Salmonella typhimurium LT2
cugccaucaucc

SEQ ID NO: 1851623 - RNA, 16 nt, Salmonella typhimurium LT2
cugcccagagaauauu

SEQ ID NO: 1851624 - RNA, 15 nt, Salmonella typhimurium LT2
cugcccgccgccagc

SEQ ID NO: 1851625 - RNA, 17 nt, Salmonella typhimurium LT2
cugcccgccgccagccu

SEQ ID NO: 1851626 - RNA, 17 nt, Salmonella typhimurium LT2
cugcgcgucccucucca

SEQ ID NO: 1851627 - RNA, 22 nt, Salmonella typhimurium LT2
cugcgcguagcggucacccggc

SEQ ID NO: 1851628 - RNA, 22 nt, Salmonella typhimurium LT2
cugcgcgucccucuccagggca

SEQ ID NO: 1851629 - RNA, 13 nt, Salmonella typhimurium LT2
cugcgcguggcuc

SEQ ID NO: 1851630 - RNA, 18 nt, Salmonella typhimurium LT2
cugcgcgccgggcuucau

SEQ ID NO: 1851631 - RNA, 15 nt, Salmonella typhimurium LT2
cugcgcgccugcgcu

SEQ ID NO: 1851632 - RNA, 15 nt, Salmonella typhimurium LT2
cugcgccgcaaagcg

SEQ ID NO: 1851633 - RNA, 19 nt, Salmonella typhimurium LT2
cugcgccgcaaagcgggcg

SEQ ID NO: 1851634 - RNA, 17 nt, Salmonella typhimurium LT2
cugcgccgccagcgaca

SEQ ID NO: 1851635 - RNA, 19 nt, Salmonella typhimurium LT2
cugcgccuuacccggccua

SEQ ID NO: 1851636 - RNA, 14 nt, Salmonella typhimurium LT2
cugcgccugcgcga

SEQ ID NO: 1851637 - RNA, 16 nt, Salmonella typhimurium LT2
cugcgccugcgcgagc

SEQ ID NO: 1851638 - RNA, 13 nt, Salmonella typhimurium LT2
cugccugucuuuu

SEQ ID NO: 1851639 - RNA, 15 nt, Salmonella typhimurium LT2
cugccugucuuuucu

SEQ ID NO: 1851640 - RNA, 18 nt, Salmonella typhimurium LT2
cugccuguuuacggcagg

SEQ ID NO: 1851641 - RNA, 13 nt, Salmonella typhimurium LT2
cugccugcagacc

SEQ ID NO: 1851642 - RNA, 17 nt, Salmonella typhimurium LT2
cugccugauggcgcuuc

SEQ ID NO: 1851643 - RNA, 16 nt, Salmonella typhimurium LT2
cugcgcccgcaagcug

SEQ ID NO: 1851644 - RNA, 14 nt, Salmonella typhimurium LT2
cugcgccaaaucgg

SEQ ID NO: 1851645 - RNA, 15 nt, Salmonella typhimurium LT2
cugcgcauccucuuu

SEQ ID NO: 1851646 - RNA, 23 nt, Salmonella typhimurium LT2
cugcgcaggucgccagaagccgu

SEQ ID NO: 1851647 - RNA, 12 nt, Salmonella typhimurium LT2
cugcgcagcacu

SEQ ID NO: 1851648 - RNA, 20 nt, Salmonella typhimurium LT2
cugcgcauacgucaugccuu

SEQ ID NO: 1851649 - RNA, 13 nt, Salmonella typhimurium LT2
cugcggaauuuua

SEQ ID NO: 1851650 - RNA, 14 nt, Salmonella typhimurium LT2
cugcggcuuuuuca

SEQ ID NO: 1851651 - RNA, 18 nt, Salmonella typhimurium LT2
cugcggaacgccccucgg

SEQ ID NO: 1851652 - RNA, 16 nt, Salmonella typhimurium LT2
cugcgcuuuggguuaa

SEQ ID NO: 1851653 - RNA, 11 nt, Salmonella typhimurium LT2
cugcgcuuugu

SEQ ID NO: 1851654 - RNA, 19 nt, Salmonella typhimurium LT2
cugcgcuuuuucaucaucu

SEQ ID NO: 1851655 - RNA, 21 nt, Salmonella typhimurium LT2
cugcgcguucggguuuuccug

SEQ ID NO: 1851656 - RNA, 18 nt, Salmonella typhimurium LT2
cugcgcuucuauccacug

SEQ ID NO: 1851657 - RNA, 14 nt, Salmonella typhimurium LT2
cugcgcuuucagcu

SEQ ID NO: 1851658 - RNA, 16 nt, Salmonella typhimurium LT2
cugcgcuuuccaggcc

SEQ ID NO: 1851659 - RNA, 23 nt, Salmonella typhimurium LT2
cugcgguauuaacccgcagccgg

SEQ ID NO: 1851660 - RNA, 17 nt, Salmonella typhimurium LT2
cugcgggaguucuaaca

SEQ ID NO: 1851661 - RNA, 23 nt, Salmonella typhimurium LT2
cugcggggcgggauagccuucca

SEQ ID NO: 1851662 - RNA, 21 nt, Salmonella typhimurium LT2
cugcguuugaaauaccaggcg

SEQ ID NO: 1851663 - RNA, 15 nt, Salmonella typhimurium LT2
cugcguuugccgccu

SEQ ID NO: 1851664 - RNA, 20 nt, Salmonella typhimurium LT2
cugcguugcucgccagccug

SEQ ID NO: 1851665 - RNA, 15 nt, Salmonella typhimurium LT2
cugcguugcgcgcgu

SEQ ID NO: 1851666 - RNA, 20 nt, Salmonella typhimurium LT2
cugcuaaacgaaccgucauc

SEQ ID NO: 1851667 - RNA, 23 nt, Salmonella typhimurium LT2
cugcguaaaccauuucuccugca

SEQ ID NO: 1851668 - RNA, 21 nt, Salmonella typhimurium LT2
cugcguaaaccauuucuccug

SEQ ID NO: 1851669 - RNA, 17 nt, Salmonella typhimurium LT2
cugcguaaaaucagcau

SEQ ID NO: 1851670 - RNA, 18 nt, Salmonella typhimurium LT2
cugcguaccgcuuccgcu

SEQ ID NO: 1851671 - RNA, 15 nt, Salmonella typhimurium LT2
cugguauaaaaacug

SEQ ID NO: 1851672 - RNA, 23 nt, Salmonella typhimurium LT2
cugguaggucaacccuauugcca

SEQ ID NO: 1851673 - RNA, 12 nt, Salmonella typhimurium LT2
cugguaguccuc

SEQ ID NO: 1851674 - RNA, 21 nt, Salmonella typhimurium LT2
cugguacguccauccgccggg

SEQ ID NO: 1851675 - RNA, 14 nt, Salmonella typhimurium LT2
cugguacguccauc

SEQ ID NO: 1851676 - RNA, 18 nt, Salmonella typhimurium LT2
cuggucagguaagcccuu

SEQ ID NO: 1851677 - RNA, 18 nt, Salmonella typhimurium LT2
cuggucggugauugucca

SEQ ID NO: 1851678 - RNA, 13 nt, Salmonella typhimurium LT2
cuggucgggcagg

SEQ ID NO: 1851679 - RNA, 15 nt, Salmonella typhimurium LT2
cuggucgggcaggcu

SEQ ID NO: 1851680 - RNA, 21 nt, Salmonella typhimurium LT2
cuggucgaggacggccugacg

SEQ ID NO: 1851681 - RNA, 18 nt, Salmonella typhimurium LT2
cuggugcagcaagcggcu

SEQ ID NO: 1851682 - RNA, 18 nt, Salmonella typhimurium LT2
cuggugaagacgcugcaa

SEQ ID NO: 1851683 - RNA, 20 nt, Salmonella typhimurium LT2
cuggugaaacguguuuaucc

SEQ ID NO: 1851684 - RNA, 21 nt, Salmonella typhimurium LT2
cuggcguaugcuuucagcaug

SEQ ID NO: 1851685 - RNA, 20 nt, Salmonella typhimurium LT2
cuggcggucgggaacgcugu

SEQ ID NO: 1851686 - RNA, 18 nt, Salmonella typhimurium LT2
cugggcgaagguggcgga

SEQ ID NO: 1851687 - RNA, 14 nt, Salmonella typhimurium LT2
cugggccucgcccc

SEQ ID NO: 1851688 - RNA, 14 nt, Salmonella typhimurium LT2
cuggcgucgccaaa

SEQ ID NO: 1851689 - RNA, 18 nt, Salmonella typhimurium LT2
cugguaagcgcagcgcca

SEQ ID NO: 1851690 - RNA, 18 nt, Salmonella typhimurium LT2
cugguaagcugcggcaga

SEQ ID NO: 1851691 - RNA, 18 nt, Salmonella typhimurium LT2
cugggucugcugggcgau

SEQ ID NO: 1851692 - RNA, 17 nt, Salmonella typhimurium LT2
cuggggcuggcggcgau

SEQ ID NO: 1851693 - RNA, 13 nt, Salmonella typhimurium LT2
cuguacauaucca

SEQ ID NO: 1851694 - RNA, 14 nt, Salmonella typhimurium LT2
cuguacauaacauc

SEQ ID NO: 1851695 - RNA, 16 nt, Salmonella typhimurium LT2
cuguacauaacaucuc

SEQ ID NO: 1851696 - RNA, 19 nt, Salmonella typhimurium LT2
cuguacauaacaucucacu

SEQ ID NO: 1851697 - RNA, 14 nt, Salmonella typhimurium LT2
cuguaccaccacgc

SEQ ID NO: 1851698 - RNA, 13 nt, Salmonella typhimurium LT2
cuguauaaauaaa

SEQ ID NO: 1851699 - RNA, 14 nt, Salmonella typhimurium LT2
cuguacgccucuuu

SEQ ID NO: 1851700 - RNA, 19 nt, Salmonella typhimurium LT2
cuguacgcgggaaauaccu

SEQ ID NO: 1851701 - RNA, 16 nt, Salmonella typhimurium LT2
cuguacggaauaagcg

SEQ ID NO: 1851702 - RNA, 20 nt, Salmonella typhimurium LT2
cuguagguucgguaugccuu

SEQ ID NO: 1851703 - RNA, 15 nt, Salmonella typhimurium LT2
cuguacgcccagccg

SEQ ID NO: 1851704 - RNA, 13 nt, Salmonella typhimurium LT2
cuguacgccucuu

SEQ ID NO: 1851705 - RNA, 13 nt, Salmonella typhimurium LT2
cuguacgacugga

SEQ ID NO: 1851706 - RNA, 17 nt, Salmonella typhimurium LT2
cuguacgacuggauaca

SEQ ID NO: 1851707 - RNA, 14 nt, Salmonella typhimurium LT2
cuguaacaggggau

SEQ ID NO: 1851708 - RNA, 17 nt, Salmonella typhimurium LT2
cuguaaugucuggugca

SEQ ID NO: 1851709 - RNA, 23 nt, Salmonella typhimurium LT2
cuguaauucucccaaauuuuuuu

SEQ ID NO: 1851710 - RNA, 17 nt, Salmonella typhimurium LT2
cuguaaauagugcgcua

SEQ ID NO: 1851711 - RNA, 14 nt, Salmonella typhimurium LT2
cuguaaaucugccg

SEQ ID NO: 1851712 - RNA, 18 nt, Salmonella typhimurium LT2
cuguaacaacuguuuuuc

SEQ ID NO: 1851713 - RNA, 15 nt, Salmonella typhimurium LT2
cuguaacacacuggu

SEQ ID NO: 1851714 - RNA, 19 nt, Salmonella typhimurium LT2
cuggugcgacaccacgcag

SEQ ID NO: 1851715 - RNA, 12 nt, Salmonella typhimurium LT2
cuggugcccggu

SEQ ID NO: 1851716 - RNA, 20 nt, Salmonella typhimurium LT2
cuguaaaccgccuccaggcc

SEQ ID NO: 1851717 - RNA, 14 nt, Salmonella typhimurium LT2
cuguaaaccgccuc

SEQ ID NO: 1851718 - RNA, 15 nt, Salmonella typhimurium LT2
cuguaaacagaugcu

SEQ ID NO: 1851719 - RNA, 14 nt, Salmonella typhimurium LT2
cugucaccagcagc

SEQ ID NO: 1851720 - RNA, 17 nt, Salmonella typhimurium LT2
cugucggcgguaaaccg

SEQ ID NO: 1851721 - RNA, 14 nt, Salmonella typhimurium LT2
cugucguacuccag

SEQ ID NO: 1851722 - RNA, 22 nt, Salmonella typhimurium LT2
cugucggcgagguacugcauaa

SEQ ID NO: 1851723 - RNA, 14 nt, Salmonella typhimurium LT2
cugucgcuuauucg

SEQ ID NO: 1851724 - RNA, 23 nt, Salmonella typhimurium LT2
cugucgccugcugcuggacagga

SEQ ID NO: 1851725 - RNA, 15 nt, Salmonella typhimurium LT2
cugucccagcgcacg

SEQ ID NO: 1851726 - RNA, 21 nt, Salmonella typhimurium LT2
cuguccgcaaagacaacgacc

SEQ ID NO: 1851727 - RNA, 13 nt, Salmonella typhimurium LT2
cugucgccaccac

SEQ ID NO: 1851728 - RNA, 14 nt, Salmonella typhimurium LT2
cugucgccaggcca

SEQ ID NO: 1851729 - RNA, 20 nt, Salmonella typhimurium LT2
cugcuuguuuaauggcagaa

SEQ ID NO: 1851730 - RNA, 19 nt, Salmonella typhimurium LT2
cugcuuucuaccagccugg

SEQ ID NO: 1851731 - RNA, 21 nt, Salmonella typhimurium LT2
cugcucacgguuuagcucugu

SEQ ID NO: 1851732 - RNA, 13 nt, Salmonella typhimurium LT2
cugcuucuggcuu

SEQ ID NO: 1851733 - RNA, 22 nt, Salmonella typhimurium LT2
cugcuucuggagaguauuuccu

SEQ ID NO: 1851734 - RNA, 19 nt, Salmonella typhimurium LT2
cuggagagcagcgccagcg

SEQ ID NO: 1851735 - RNA, 20 nt, Salmonella typhimurium LT2
cuggacauauuccagaagcg

SEQ ID NO: 1851736 - RNA, 20 nt, Salmonella typhimurium LT2
cuggacaugcuccgccccgc

SEQ ID NO: 1851737 - RNA, 22 nt, Salmonella typhimurium LT2
cuggacaugcuccgccccgccu

SEQ ID NO: 1851738 - RNA, 20 nt, Salmonella typhimurium LT2
cuggaacaaaccgacuuuca

SEQ ID NO: 1851739 - RNA, 22 nt, Salmonella typhimurium LT2
cuggaagaaaucguugccuuug

SEQ ID NO: 1851740 - RNA, 14 nt, Salmonella typhimurium LT2
cuggaacugucccg

SEQ ID NO: 1851741 - RNA, 15 nt, Salmonella typhimurium LT2
cuggaacuggcucca

SEQ ID NO: 1851742 - RNA, 18 nt, Salmonella typhimurium LT2
cuggaacaggccaaaccc

SEQ ID NO: 1851743 - RNA, 22 nt, Salmonella typhimurium LT2
cuggaacaguaaucgcacggcu

SEQ ID NO: 1851744 - RNA, 19 nt, Salmonella typhimurium LT2
cuggaaggcuucggucaga

SEQ ID NO: 1851745 - RNA, 23 nt, Salmonella typhimurium LT2
cuggaaggcuucggucagauccu

SEQ ID NO: 1851746 - RNA, 19 nt, Salmonella typhimurium LT2
cuggaagccccucuuauug

SEQ ID NO: 1851747 - RNA, 20 nt, Salmonella typhimurium LT2
cuggaauagcgugggcagac

SEQ ID NO: 1851748 - RNA, 17 nt, Salmonella typhimurium LT2
cuggaaucuaccgccau

SEQ ID NO: 1851749 - RNA, 21 nt, Salmonella typhimurium LT2
cuggcaagcgccagcauggcg

SEQ ID NO: 1851750 - RNA, 13 nt, Salmonella typhimurium LT2
cuggcacaggaug

SEQ ID NO: 1851751 - RNA, 16 nt, Salmonella typhimurium LT2
cuggagggguuucccc

SEQ ID NO: 1851752 - RNA, 19 nt, Salmonella typhimurium LT2
cuggagggguuucccccuc

SEQ ID NO: 1851753 - RNA, 18 nt, Salmonella typhimurium LT2
cuggauaagcgcagcgcc

SEQ ID NO: 1851754 - RNA, 19 nt, Salmonella typhimurium LT2
cuggauaagcgcagcgcca

SEQ ID NO: 1851755 - RNA, 18 nt, Salmonella typhimurium LT2
cuggccaauuuuucacau

SEQ ID NO: 1851756 - RNA, 14 nt, Salmonella typhimurium LT2
cuggcauaacauug

SEQ ID NO: 1851757 - RNA, 17 nt, Salmonella typhimurium LT2
cuggcaggccaucucug

SEQ ID NO: 1851758 - RNA, 19 nt, Salmonella typhimurium LT2
cuggcauaaccgcagcgcg

SEQ ID NO: 1851759 - RNA, 15 nt, Salmonella typhimurium LT2
cuggcgcuggcugcc

SEQ ID NO: 1851760 - RNA, 17 nt, Salmonella typhimurium LT2
cuggcgcggggaacacu

SEQ ID NO: 1851761 - RNA, 16 nt, Salmonella typhimurium LT2
cuggcgcggggaacau

SEQ ID NO: 1851762 - RNA, 17 nt, Salmonella typhimurium LT2
cuggcgcggggaacaca

SEQ ID NO: 1851763 - RNA, 18 nt, Salmonella typhimurium LT2
cuggcgcggggaacacaa

SEQ ID NO: 1851764 - RNA, 16 nt, Salmonella typhimurium LT2
cuggcgcggggaacac

SEQ ID NO: 1851765 - RNA, 17 nt, Salmonella typhimurium LT2
cuggcgcgcggguaggu

SEQ ID NO: 1851766 - RNA, 19 nt, Salmonella typhimurium LT2
cuggcggaauggcgggcgc

SEQ ID NO: 1851767 - RNA, 20 nt, Salmonella typhimurium LT2
cuggcggaauggcgggcgca

SEQ ID NO: 1851768 - RNA, 13 nt, Salmonella typhimurium LT2
cuggcggccccuc

SEQ ID NO: 1851769 - RNA, 18 nt, Salmonella typhimurium LT2
cuggcggccccucuucca

SEQ ID NO: 1851770 - RNA, 22 nt, Salmonella typhimurium LT2
cuggcggcgcucaauguggcuu

SEQ ID NO: 1851771 - RNA, 17 nt, Salmonella typhimurium LT2
cuggccguuuucccggc

SEQ ID NO: 1851772 - RNA, 16 nt, Salmonella typhimurium LT2
cuggccguuugcugcu

SEQ ID NO: 1851773 - RNA, 20 nt, Salmonella typhimurium LT2
cuggccguuuucccggcaau

SEQ ID NO: 1851774 - RNA, 23 nt, Salmonella typhimurium LT2
cuggccuagaugaaugacugucc

SEQ ID NO: 1851775 - RNA, 13 nt, Salmonella typhimurium LT2
cuggccugcugug

SEQ ID NO: 1851776 - RNA, 15 nt, Salmonella typhimurium LT2
cuggccugcugugag

SEQ ID NO: 1851777 - RNA, 23 nt, Salmonella typhimurium LT2
cuggccugauaagcgcagcgcca

SEQ ID NO: 1851778 - RNA, 20 nt, Salmonella typhimurium LT2
cuggcgcaaccggcguggug

SEQ ID NO: 1851779 - RNA, 14 nt, Salmonella typhimurium LT2
cuggcgcgccugcu

SEQ ID NO: 1851780 - RNA, 18 nt, Salmonella typhimurium LT2
cuggcgagaaaguggugg

SEQ ID NO: 1851781 - RNA, 18 nt, Salmonella typhimurium LT2
cuggccuuccagauaggu

SEQ ID NO: 1851782 - RNA, 20 nt, Salmonella typhimurium LT2
cuucugucugcgugaagaca

SEQ ID NO: 1851783 - RNA, 16 nt, Salmonella typhimurium LT2
cuucugguugucacgg

SEQ ID NO: 1851784 - RNA, 18 nt, Salmonella typhimurium LT2
cuucugguagccagacau

SEQ ID NO: 1851785 - RNA, 18 nt, Salmonella typhimurium LT2
cuucuucaguuccgccag

SEQ ID NO: 1851786 - RNA, 14 nt, Salmonella typhimurium LT2
cuucuucaggcuug

SEQ ID NO: 1851787 - RNA, 15 nt, Salmonella typhimurium LT2
cuucuucacuaaaaa

SEQ ID NO: 1851788 - RNA, 11 nt, Salmonella typhimurium LT2
cuucuuagaau

SEQ ID NO: 1851789 - RNA, 15 nt, Salmonella typhimurium LT2
cuucuucuaccaccu

SEQ ID NO: 1851790 - RNA, 19 nt, Salmonella typhimurium LT2
cuucuucgucgucuucauc

SEQ ID NO: 1851791 - RNA, 15 nt, Salmonella typhimurium LT2
cuucuucgcggccgc

SEQ ID NO: 1851792 - RNA, 17 nt, Salmonella typhimurium LT2
cuucuucgcguuuuucg

SEQ ID NO: 1851793 - RNA, 16 nt, Salmonella typhimurium LT2
cuucuuccggcugcca

SEQ ID NO: 1851794 - RNA, 13 nt, Salmonella typhimurium LT2
cuucuucaucuuc

SEQ ID NO: 1851795 - RNA, 14 nt, Salmonella typhimurium LT2
cuucuucaucuuca

SEQ ID NO: 1851796 - RNA, 13 nt, Salmonella typhimurium LT2
cuucuucauauuu

SEQ ID NO: 1851797 - RNA, 24 nt, Salmonella typhimurium LT2
cuucuucaucggucagagcauaaa

SEQ ID NO: 1851798 - RNA, 12 nt, Salmonella typhimurium LT2
cuucuuccagcg

SEQ ID NO: 1851799 - RNA, 16 nt, Salmonella typhimurium LT2
cuucuuccagcgugug

SEQ ID NO: 1851800 - RNA, 23 nt, Salmonella typhimurium LT2
cuucuugcggugagaaacgcgcc

SEQ ID NO: 1851801 - RNA, 14 nt, Salmonella typhimurium LT2
cuucugcugacauu

SEQ ID NO: 1851802 - RNA, 16 nt, Salmonella typhimurium LT2
cuucugcugacauucc

SEQ ID NO: 1851803 - RNA, 18 nt, Salmonella typhimurium LT2
cuucucgaaguucucaau

SEQ ID NO: 1851804 - RNA, 21 nt, Salmonella typhimurium LT2
cuucucugucgagcaucucca

SEQ ID NO: 1851805 - RNA, 23 nt, Salmonella typhimurium LT2
cuugauacgcuucggcuccagcg

SEQ ID NO: 1851806 - RNA, 19 nt, Salmonella typhimurium LT2
cuugcacgccaaaaaguga

SEQ ID NO: 1851807 - RNA, 18 nt, Salmonella typhimurium LT2
cuugcacaauacuuuuug

SEQ ID NO: 1851808 - RNA, 18 nt, Salmonella typhimurium LT2
cuugauucugcagcgagc

SEQ ID NO: 1851809 - RNA, 18 nt, Salmonella typhimurium LT2
cuugauggaaaacgcauc

SEQ ID NO: 1851810 - RNA, 17 nt, Salmonella typhimurium LT2
cuucuuuaucuucugcu

SEQ ID NO: 1851811 - RNA, 14 nt, Salmonella typhimurium LT2
cuucuuuagauaau

SEQ ID NO: 1851812 - RNA, 21 nt, Salmonella typhimurium LT2
cuucuuucagguuccacgucu

SEQ ID NO: 1851813 - RNA, 23 nt, Salmonella typhimurium LT2
cuucuuuaaccgcgccagagggg

SEQ ID NO: 1851814 - RNA, 17 nt, Salmonella typhimurium LT2
cuucuuuaccagugaca

SEQ ID NO: 1851815 - RNA, 22 nt, Salmonella typhimurium LT2
cuugagcaggcuuacgauauuu

SEQ ID NO: 1851816 - RNA, 19 nt, Salmonella typhimurium LT2
cuugccguuuuucucauca

SEQ ID NO: 1851817 - RNA, 17 nt, Salmonella typhimurium LT2
cuugcgccgcaaacuca

SEQ ID NO: 1851818 - RNA, 13 nt, Salmonella typhimurium LT2
cuugcgccgccau

SEQ ID NO: 1851819 - RNA, 18 nt, Salmonella typhimurium LT2
cuugcuuuucaucaccau

SEQ ID NO: 1851820 - RNA, 22 nt, Salmonella typhimurium LT2
cuugcucguaccaggccccugc

SEQ ID NO: 1851821 - RNA, 22 nt, Salmonella typhimurium LT2
cuugcucaaaaagcucaagcgc

SEQ ID NO: 1851822 - RNA, 18 nt, Salmonella typhimurium LT2
cuugcggcgccaggacaa

SEQ ID NO: 1851823 - RNA, 13 nt, Salmonella typhimurium LT2
cuugcggcugcau

SEQ ID NO: 1851824 - RNA, 14 nt, Salmonella typhimurium LT2
cuugcggcugccag

SEQ ID NO: 1851825 - RNA, 21 nt, Salmonella typhimurium LT2
cuugcggaaagaagaauaagc

SEQ ID NO: 1851826 - RNA, 15 nt, Salmonella typhimurium LT2
cuuuaaccgccugcu

SEQ ID NO: 1851827 - RNA, 19 nt, Salmonella typhimurium LT2
cuuuaaccggacgcuuaau

SEQ ID NO: 1851828 - RNA, 14 nt, Salmonella typhimurium LT2
cuuuaaccgccugc

SEQ ID NO: 1851829 - RNA, 16 nt, Salmonella typhimurium LT2
cuuuaaaugccuguuu

SEQ ID NO: 1851830 - RNA, 14 nt, Salmonella typhimurium LT2
cuuuaaacuuuuuu

SEQ ID NO: 1851831 - RNA, 16 nt, Salmonella typhimurium LT2
cuuuaaaguaucaaca

SEQ ID NO: 1851832 - RNA, 15 nt, Salmonella typhimurium LT2
cuuguucuuccauug

SEQ ID NO: 1851833 - RNA, 16 nt, Salmonella typhimurium LT2
cuuguucgcaggucaa

SEQ ID NO: 1851834 - RNA, 24 nt, Salmonella typhimurium LT2
cuuguuauccuaaaucugccauca

SEQ ID NO: 1851835 - RNA, 20 nt, Salmonella typhimurium LT2
cuuguuaaccggguuuuucg

SEQ ID NO: 1851836 - RNA, 22 nt, Salmonella typhimurium LT2
cuugugauaucugacuuauucg

SEQ ID NO: 1851837 - RNA, 22 nt, Salmonella typhimurium LT2
cuugugcuuccagcuccaucca

SEQ ID NO: 1851838 - RNA, 16 nt, Salmonella typhimurium LT2
cuugugcuuccagcuc

SEQ ID NO: 1851839 - RNA, 24 nt, Salmonella typhimurium LT2
cuugugcuuccagcuccauccacc

SEQ ID NO: 1851840 - RNA, 20 nt, Salmonella typhimurium LT2
cuugucaggcucuaauaacu

SEQ ID NO: 1851841 - RNA, 22 nt, Salmonella typhimurium LT2
cuuguaaguuacuaaaaguaaa

SEQ ID NO: 1851842 - RNA, 14 nt, Salmonella typhimurium LT2
cuuguaagggaggu

SEQ ID NO: 1851843 - RNA, 21 nt, Salmonella typhimurium LT2
cuuggagagcaucaucugcca

SEQ ID NO: 1851844 - RNA, 16 nt, Salmonella typhimurium LT2
cuuucacccccagcug

SEQ ID NO: 1851845 - RNA, 18 nt, Salmonella typhimurium LT2
cuuucacccccagcugac

SEQ ID NO: 1851846 - RNA, 14 nt, Salmonella typhimurium LT2
cuuucacccgcgcu

SEQ ID NO: 1851847 - RNA, 21 nt, Salmonella typhimurium LT2
cuuuauccagcggugcgcggu

SEQ ID NO: 1851848 - RNA, 19 nt, Salmonella typhimurium LT2
cuuuauucauuucaaugua

SEQ ID NO: 1851849 - RNA, 14 nt, Salmonella typhimurium LT2
cuuuacccagcggg

SEQ ID NO: 1851850 - RNA, 14 nt, Salmonella typhimurium LT2
cuuuaccgugaaug

SEQ ID NO: 1851851 - RNA, 20 nt, Salmonella typhimurium LT2
cuuuaaucacccgcgccagc

SEQ ID NO: 1851852 - RNA, 19 nt, Salmonella typhimurium LT2
cuuuaaucaccauggcgcc

SEQ ID NO: 1851853 - RNA, 12 nt, Salmonella typhimurium LT2
cuuuaucagaug

SEQ ID NO: 1851854 - RNA, 20 nt, Salmonella typhimurium LT2
cuuuaucaaacaaaccaaac

SEQ ID NO: 1851855 - RNA, 23 nt, Salmonella typhimurium LT2
cuuuacgcagauaacuuccuuug

SEQ ID NO: 1851856 - RNA, 15 nt, Salmonella typhimurium LT2
cuuuacgaugagcaa

SEQ ID NO: 1851857 - RNA, 17 nt, Salmonella typhimurium LT2
cuuuacccuuacggcca

SEQ ID NO: 1851858 - RNA, 14 nt, Salmonella typhimurium LT2
cuuucucacuugca

SEQ ID NO: 1851859 - RNA, 19 nt, Salmonella typhimurium LT2
cuuucuccgcuuuuuuaau

SEQ ID NO: 1851860 - RNA, 19 nt, Salmonella typhimurium LT2
cuuucucggcgaggacccg

SEQ ID NO: 1851861 - RNA, 15 nt, Salmonella typhimurium LT2
cuuucgcuguaggcc

SEQ ID NO: 1851862 - RNA, 12 nt, Salmonella typhimurium LT2
cuuucgacugga

SEQ ID NO: 1851863 - RNA, 15 nt, Salmonella typhimurium LT2
cuuucgccagcggcg

SEQ ID NO: 1851864 - RNA, 21 nt, Salmonella typhimurium LT2
cuuucgcaaucugauaaacaa

SEQ ID NO: 1851865 - RNA, 15 nt, Salmonella typhimurium LT2
cuuuccgcaccgcuu

SEQ ID NO: 1851866 - RNA, 18 nt, Salmonella typhimurium LT2
cuuucccuuuuuaaaaug

SEQ ID NO: 1851867 - RNA, 19 nt, Salmonella typhimurium LT2
cuuuccgccaugaaaaaaa

SEQ ID NO: 1851868 - RNA, 17 nt, Salmonella typhimurium LT2
cuuuccgccaugaaaaa

SEQ ID NO: 1851869 - RNA, 17 nt, Salmonella typhimurium LT2
cuuucauuccuuuagcu

SEQ ID NO: 1851870 - RNA, 12 nt, Salmonella typhimurium LT2
cuuucaucuuua

SEQ ID NO: 1851871 - RNA, 13 nt, Salmonella typhimurium LT2
cuuccaguugcuu

SEQ ID NO: 1851872 - RNA, 22 nt, Salmonella typhimurium LT2
cuuccaguucgcugaggcguug

SEQ ID NO: 1851873 - RNA, 10 nt, Salmonella typhimurium LT2
cuuccaguac

SEQ ID NO: 1851874 - RNA, 22 nt, Salmonella typhimurium LT2
cuuccgccauacccggcuccca

SEQ ID NO: 1851875 - RNA, 20 nt, Salmonella typhimurium LT2
cuuccgccgcaaacuggaag

SEQ ID NO: 1851876 - RNA, 16 nt, Salmonella typhimurium LT2
cuuccgccuucucgau

SEQ ID NO: 1851877 - RNA, 22 nt, Salmonella typhimurium LT2
cuuccgcaauacagcccgccag

SEQ ID NO: 1851878 - RNA, 15 nt, Salmonella typhimurium LT2
cuuccgcaccgccag

SEQ ID NO: 1851879 - RNA, 20 nt, Salmonella typhimurium LT2
cuuccgcacgcgcgcccugc

SEQ ID NO: 1851880 - RNA, 17 nt, Salmonella typhimurium LT2
cuuccgccaccacgccc

SEQ ID NO: 1851881 - RNA, 17 nt, Salmonella typhimurium LT2
cuuccgaccgcagcgaa

SEQ ID NO: 1851882 - RNA, 17 nt, Salmonella typhimurium LT2
cuuccaugccuucauaa

SEQ ID NO: 1851883 - RNA, 16 nt, Salmonella typhimurium LT2
cuucccacuguaaauu

SEQ ID NO: 1851884 - RNA, 12 nt, Salmonella typhimurium LT2
cuucgaucgccu

SEQ ID NO: 1851885 - RNA, 15 nt, Salmonella typhimurium LT2
cuucgaucgccuggc

SEQ ID NO: 1851886 - RNA, 16 nt, Salmonella typhimurium LT2
cuuccugagcagacau

SEQ ID NO: 1851887 - RNA, 15 nt, Salmonella typhimurium LT2
cuuccgggcgggcgc

SEQ ID NO: 1851888 - RNA, 21 nt, Salmonella typhimurium LT2
cuuccuccccaggcgcuauuc

SEQ ID NO: 1851889 - RNA, 18 nt, Salmonella typhimurium LT2
cuuccggcacucuucuuc

SEQ ID NO: 1851890 - RNA, 20 nt, Salmonella typhimurium LT2
cuuccggcacugcgccuugc

SEQ ID NO: 1851891 - RNA, 19 nt, Salmonella typhimurium LT2
cuucgcgcagccagcgccc

SEQ ID NO: 1851892 - RNA, 16 nt, Salmonella typhimurium LT2
cuucgcggaauuucag

SEQ ID NO: 1851893 - RNA, 13 nt, Salmonella typhimurium LT2
cuucgcggccgcu

SEQ ID NO: 1851894 - RNA, 15 nt, Salmonella typhimurium LT2
cuucgccuucgccgg

SEQ ID NO: 1851895 - RNA, 16 nt, Salmonella typhimurium LT2
cuucgccucagccaac

SEQ ID NO: 1851896 - RNA, 20 nt, Salmonella typhimurium LT2
cuucgccguuaucggccugc

SEQ ID NO: 1851897 - RNA, 13 nt, Salmonella typhimurium LT2
cuucgccacugug

SEQ ID NO: 1851898 - RNA, 19 nt, Salmonella typhimurium LT2
cuucgcagcgauauuucuc

SEQ ID NO: 1851899 - RNA, 13 nt, Salmonella typhimurium LT2
cuucgcacugccc

SEQ ID NO: 1851900 - RNA, 15 nt, Salmonella typhimurium LT2
cuucgcagaucgccu

SEQ ID NO: 1851901 - RNA, 19 nt, Salmonella typhimurium LT2
cuucgcagaucgccuggau

SEQ ID NO: 1851902 - RNA, 20 nt, Salmonella typhimurium LT2
cuucagcggcgcguugccgc

SEQ ID NO: 1851903 - RNA, 19 nt, Salmonella typhimurium LT2
cuucagcuucacgaagucu

SEQ ID NO: 1851904 - RNA, 19 nt, Salmonella typhimurium LT2
cuucagucuacuacacacu

SEQ ID NO: 1851905 - RNA, 13 nt, Salmonella typhimurium LT2
cuucagucuacua

SEQ ID NO: 1851906 - RNA, 18 nt, Salmonella typhimurium LT2
cuucagugugcucguuuu

SEQ ID NO: 1851907 - RNA, 18 nt, Salmonella typhimurium LT2
cuucagguuuuuaagcug

SEQ ID NO: 1851908 - RNA, 18 nt, Salmonella typhimurium LT2
cuucauccggauaaagcc

SEQ ID NO: 1851909 - RNA, 16 nt, Salmonella typhimurium LT2
cuucaucauucaucca

SEQ ID NO: 1851910 - RNA, 13 nt, Salmonella typhimurium LT2
cuucaucaucagc

SEQ ID NO: 1851911 - RNA, 17 nt, Salmonella typhimurium LT2
cuucaucagccagcauc

SEQ ID NO: 1851912 - RNA, 17 nt, Salmonella typhimurium LT2
cuucauauuccgaaugu

SEQ ID NO: 1851913 - RNA, 22 nt, Salmonella typhimurium LT2
cuucauauuguagguuuuccuc

SEQ ID NO: 1851914 - RNA, 14 nt, Salmonella typhimurium LT2
cuucagcaucaucu

SEQ ID NO: 1851915 - RNA, 13 nt, Salmonella typhimurium LT2
cuucagcgcgccc

SEQ ID NO: 1851916 - RNA, 20 nt, Salmonella typhimurium LT2
cuucacgccauuccagcugg

SEQ ID NO: 1851917 - RNA, 13 nt, Salmonella typhimurium LT2
cuucacgcuggug

SEQ ID NO: 1851918 - RNA, 16 nt, Salmonella typhimurium LT2
cuucagcaacguuuug

SEQ ID NO: 1851919 - RNA, 21 nt, Salmonella typhimurium LT2
cuucacguugacgcaaacugc

SEQ ID NO: 1851920 - RNA, 18 nt, Salmonella typhimurium LT2
cuucacaaacaauuuccc

SEQ ID NO: 1851921 - RNA, 18 nt, Salmonella typhimurium LT2
cuuauuauuuuuucuuua

SEQ ID NO: 1851922 - RNA, 14 nt, Salmonella typhimurium LT2
cuucaccacgccau

SEQ ID NO: 1851923 - RNA, 20 nt, Salmonella typhimurium LT2
cuucacaaaaaguauuguuu

SEQ ID NO: 1851924 - RNA, 17 nt, Salmonella typhimurium LT2
cuuagcagcauaaacau

SEQ ID NO: 1851925 - RNA, 17 nt, Salmonella typhimurium LT2
cuuauauauguucaaua

SEQ ID NO: 1851926 - RNA, 15 nt, Salmonella typhimurium LT2
cuuauccgacguggc

SEQ ID NO: 1851927 - RNA, 19 nt, Salmonella typhimurium LT2
cuuauccggccuauagcua

SEQ ID NO: 1851928 - RNA, 17 nt, Salmonella typhimurium LT2
cuuauccggccuccaaa

SEQ ID NO: 1851929 - RNA, 13 nt, Salmonella typhimurium LT2
cuuaucccagccg

SEQ ID NO: 1851930 - RNA, 18 nt, Salmonella typhimurium LT2
cuuaucgggccuacaaga

SEQ ID NO: 1851931 - RNA, 20 nt, Salmonella typhimurium LT2
cuuaucgggccuacaagaau

SEQ ID NO: 1851932 - RNA, 23 nt, Salmonella typhimurium LT2
cuuauccggccuacaagccgccu

SEQ ID NO: 1851933 - RNA, 15 nt, Salmonella typhimurium LT2
cuuaucgccccagcc

SEQ ID NO: 1851934 - RNA, 17 nt, Salmonella typhimurium LT2
cuuaucgccaaagauau

SEQ ID NO: 1851935 - RNA, 18 nt, Salmonella typhimurium LT2
cuuaucaacuucuucauc

SEQ ID NO: 1851936 - RNA, 12 nt, Salmonella typhimurium LT2
cuuaucaggccu

SEQ ID NO: 1851937 - RNA, 22 nt, Salmonella typhimurium LT2
cuuaucagcguguuucaucuca

SEQ ID NO: 1851938 - RNA, 12 nt, Salmonella typhimurium LT2
cuuaauccagcc

SEQ ID NO: 1851939 - RNA, 13 nt, Salmonella typhimurium LT2
cuuaaauaugaaa

SEQ ID NO: 1851940 - RNA, 18 nt, Salmonella typhimurium LT2
cuuaauacucgccccguu

SEQ ID NO: 1851941 - RNA, 15 nt, Salmonella typhimurium LT2
cuuacgauauuuuuc

SEQ ID NO: 1851942 - RNA, 18 nt, Salmonella typhimurium LT2
cuuacgaauuuuaucuuc

SEQ ID NO: 1851943 - RNA, 15 nt, Salmonella typhimurium LT2
cuuacgcggcgcgcu

SEQ ID NO: 1851944 - RNA, 23 nt, Salmonella typhimurium LT2
cuuaccuauuuuaaauucccagc

SEQ ID NO: 1851945 - RNA, 19 nt, Salmonella typhimurium LT2
cuuaccuuguucuuccauu

SEQ ID NO: 1851946 - RNA, 14 nt, Salmonella typhimurium LT2
cuuacgcuccugcg

SEQ ID NO: 1851947 - RNA, 15 nt, Salmonella typhimurium LT2
cuuacacauuuuauc

SEQ ID NO: 1851948 - RNA, 14 nt, Salmonella typhimurium LT2
cuguuuaauccggu

SEQ ID NO: 1851949 - RNA, 22 nt, Salmonella typhimurium LT2
cuguuuaaugcuuucaauacuc

SEQ ID NO: 1851950 - RNA, 21 nt, Salmonella typhimurium LT2
cuguuuacaggcgauuuuuua

SEQ ID NO: 1851951 - RNA, 13 nt, Salmonella typhimurium LT2
cuguuggcauccu

SEQ ID NO: 1851952 - RNA, 17 nt, Salmonella typhimurium LT2
cuguugcgccagcacgc

SEQ ID NO: 1851953 - RNA, 18 nt, Salmonella typhimurium LT2
cuguugcugugcauaucu

SEQ ID NO: 1851954 - RNA, 19 nt, Salmonella typhimurium LT2
cugucugaaucaaugcauc

SEQ ID NO: 1851955 - RNA, 21 nt, Salmonella typhimurium LT2
cugucucauuguguacaucca

SEQ ID NO: 1851956 - RNA, 18 nt, Salmonella typhimurium LT2
cugucugucgcgggcgaa

SEQ ID NO: 1851957 - RNA, 15 nt, Salmonella typhimurium LT2
cuguucgcuuauucc

SEQ ID NO: 1851958 - RNA, 14 nt, Salmonella typhimurium LT2
cugucguuuguagg

SEQ ID NO: 1851959 - RNA, 16 nt, Salmonella typhimurium LT2
cuguucuucuuucauc

SEQ ID NO: 1851960 - RNA, 16 nt, Salmonella typhimurium LT2
cuguugaaagccccgg

SEQ ID NO: 1851961 - RNA, 15 nt, Salmonella typhimurium LT2
cuguucuuucucuau

SEQ ID NO: 1851962 - RNA, 23 nt, Salmonella typhimurium LT2
cuguucuggauagucuucaagcc

SEQ ID NO: 1851963 - RNA, 22 nt, Salmonella typhimurium LT2
cugucuuacacugauaccccag

SEQ ID NO: 1851964 - RNA, 13 nt, Salmonella typhimurium LT2
cuguuuuaauucc

SEQ ID NO: 1851965 - RNA, 23 nt, Salmonella typhimurium LT2
cuguuucuccguuguugcaccac

SEQ ID NO: 1851966 - RNA, 22 nt, Salmonella typhimurium LT2
cuguuucuccguuguugcacca

SEQ ID NO: 1851967 - RNA, 14 nt, Salmonella typhimurium LT2
cuguuuccaguuac

SEQ ID NO: 1851968 - RNA, 22 nt, Salmonella typhimurium LT2
cuguuucaccguagcaucauca

SEQ ID NO: 1851969 - RNA, 18 nt, Salmonella typhimurium LT2
cuguuucacgccuuuuga

SEQ ID NO: 1851970 - RNA, 23 nt, Salmonella typhimurium LT2
cuguuuuuggaaacuaugcaaaa

SEQ ID NO: 1851971 - RNA, 23 nt, Salmonella typhimurium LT2
cuuaaaaaauccugcacuuccag

SEQ ID NO: 1851972 - RNA, 11 nt, Salmonella typhimurium LT2
cuuaaaaacaa

SEQ ID NO: 1851973 - RNA, 21 nt, Salmonella typhimurium LT2
cuuaaacaucgcccuccagcu

SEQ ID NO: 1851974 - RNA, 21 nt, Salmonella typhimurium LT2
cuuaaacgccggauuccagaa

SEQ ID NO: 1851975 - RNA, 20 nt, Salmonella typhimurium LT2
cuuaaacgccggauuccaga

SEQ ID NO: 1851976 - RNA, 20 nt, Salmonella typhimurium LT2
cuuaaacagcgaucacgccg

SEQ ID NO: 1851977 - RNA, 11 nt, Salmonella typhimurium LT2
cuuaaacagaa

SEQ ID NO: 1851978 - RNA, 17 nt, Salmonella typhimurium LT2
cuuaaacagaauuuaug

SEQ ID NO: 1851979 - RNA, 15 nt, Salmonella typhimurium LT2
gaauagccagccccc

SEQ ID NO: 1851980 - RNA, 17 nt, Salmonella typhimurium LT2
gaauagcaggcaaaaaa

SEQ ID NO: 1851981 - RNA, 20 nt, Salmonella typhimurium LT2
gaauagcggcuaaucaccac

SEQ ID NO: 1851982 - RNA, 15 nt, Salmonella typhimurium LT2
gaauagcguauuuuu

SEQ ID NO: 1851983 - RNA, 22 nt, Salmonella typhimurium LT2
gaauagcguauuuuuguacuuu

SEQ ID NO: 1851984 - RNA, 19 nt, Salmonella typhimurium LT2
gaauagaguaauacaucca

SEQ ID NO: 1851985 - RNA, 16 nt, Salmonella typhimurium LT2
gaauagaggcgcuggc

SEQ ID NO: 1851986 - RNA, 22 nt, Salmonella typhimurium LT2
gaauagacggccugcaaacgaa

SEQ ID NO: 1851987 - RNA, 13 nt, Salmonella typhimurium LT2
gaauauaccauca

SEQ ID NO: 1851988 - RNA, 18 nt, Salmonella typhimurium LT2
gaauauucggcuccagau

SEQ ID NO: 1851989 - RNA, 17 nt, Salmonella typhimurium LT2
gaauauguucuggcggu

SEQ ID NO: 1851990 - RNA, 16 nt, Salmonella typhimurium LT2
gaauauggcggugagg

SEQ ID NO: 1851991 - RNA, 21 nt, Salmonella typhimurium LT2
gaauauauucuuuguuuaaaa

SEQ ID NO: 1851992 - RNA, 17 nt, Salmonella typhimurium LT2
gaauaauguaaaaaaau

SEQ ID NO: 1851993 - RNA, 22 nt, Salmonella typhimurium LT2
gaauaaugcccaccgauuucag

SEQ ID NO: 1851994 - RNA, 16 nt, Salmonella typhimurium LT2
gaauaauuucggcggc

SEQ ID NO: 1851995 - RNA, 23 nt, Salmonella typhimurium LT2
gaauaauccuuccuccaccacca

SEQ ID NO: 1851996 - RNA, 19 nt, Salmonella typhimurium LT2
gaauacaaacccaggcaau

SEQ ID NO: 1851997 - RNA, 14 nt, Salmonella typhimurium LT2
gaauacccuccgcc

SEQ ID NO: 1851998 - RNA, 15 nt, Salmonella typhimurium LT2
gaauacccaacugua

SEQ ID NO: 1851999 - RNA, 19 nt, Salmonella typhimurium LT2
gaauacccagcucagcuuu

SEQ ID NO: 1852000 - RNA, 17 nt, Salmonella typhimurium LT2
gaauaccuugauaacug

SEQ ID NO: 1852001 - RNA, 13 nt, Salmonella typhimurium LT2
gaauaccuucuuc

SEQ ID NO: 1852002 - RNA, 15 nt, Salmonella typhimurium LT2
gaauacgcaagccaa

SEQ ID NO: 1852003 - RNA, 14 nt, Salmonella typhimurium LT2
gaauaaccaucgga

SEQ ID NO: 1852004 - RNA, 14 nt, Salmonella typhimurium LT2
gaauaacaaaauga

SEQ ID NO: 1852005 - RNA, 19 nt, Salmonella typhimurium LT2
gaauaacaucguaaaucaa

SEQ ID NO: 1852006 - RNA, 17 nt, Salmonella typhimurium LT2
gaauaacaucguaaauc

SEQ ID NO: 1852007 - RNA, 15 nt, Salmonella typhimurium LT2
gaauaaucgccgccg

SEQ ID NO: 1852008 - RNA, 12 nt, Salmonella typhimurium LT2
gaauaaggcacc

SEQ ID NO: 1852009 - RNA, 19 nt, Salmonella typhimurium LT2
gaauaaggcaccgaugaca

SEQ ID NO: 1852010 - RNA, 14 nt, Salmonella typhimurium LT2
gaagguaaaaguag

SEQ ID NO: 1852011 - RNA, 15 nt, Salmonella typhimurium LT2
gaaggggauuuuccg

SEQ ID NO: 1852012 - RNA, 15 nt, Salmonella typhimurium LT2
gaagggauucccauc

SEQ ID NO: 1852013 - RNA, 16 nt, Salmonella typhimurium LT2
gaaggcgcccgggaga

SEQ ID NO: 1852014 - RNA, 12 nt, Salmonella typhimurium LT2
gaaggccugugg

SEQ ID NO: 1852015 - RNA, 20 nt, Salmonella typhimurium LT2
gaaggcgaaaacauugcgcc

SEQ ID NO: 1852016 - RNA, 23 nt, Salmonella typhimurium LT2
gaaggucauuaucaauggcuuca

SEQ ID NO: 1852017 - RNA, 12 nt, Salmonella typhimurium LT2
gaaguaaaaaaa

SEQ ID NO: 1852018 - RNA, 19 nt, Salmonella typhimurium LT2
gaagugcagcguuuccagc

SEQ ID NO: 1852019 - RNA, 23 nt, Salmonella typhimurium LT2
gaagucuggcugcggccuccgca

SEQ ID NO: 1852020 - RNA, 18 nt, Salmonella typhimurium LT2
gaagucugugaggaaagc

SEQ ID NO: 1852021 - RNA, 17 nt, Salmonella typhimurium LT2
gaagucuaucuguaacu

SEQ ID NO: 1852022 - RNA, 20 nt, Salmonella typhimurium LT2
gaaguggugggugaugacgg

SEQ ID NO: 1852023 - RNA, 19 nt, Salmonella typhimurium LT2
gaagucgaaacccaacauc

SEQ ID NO: 1852024 - RNA, 14 nt, Salmonella typhimurium LT2
gaauaaaacugcca

SEQ ID NO: 1852025 - RNA, 16 nt, Salmonella typhimurium LT2
gaaguuuugcuggaau

SEQ ID NO: 1852026 - RNA, 22 nt, Salmonella typhimurium LT2
gaaguugccgccauaggucagc

SEQ ID NO: 1852027 - RNA, 19 nt, Salmonella typhimurium LT2
gaaguuaccgcgccaggcg

SEQ ID NO: 1852028 - RNA, 18 nt, Salmonella typhimurium LT2
gaauccucccggaugcac

SEQ ID NO: 1852029 - RNA, 17 nt, Salmonella typhimurium LT2
gaaucgacaauccgcca

SEQ ID NO: 1852030 - RNA, 11 nt, Salmonella typhimurium LT2
gaauccuuccc

SEQ ID NO: 1852031 - RNA, 20 nt, Salmonella typhimurium LT2
gaauccuucccccaccacca

SEQ ID NO: 1852032 - RNA, 19 nt, Salmonella typhimurium LT2
gaauccagacuuuuuugcc

SEQ ID NO: 1852033 - RNA, 14 nt, Salmonella typhimurium LT2
gaauccccaucucc

SEQ ID NO: 1852034 - RNA, 14 nt, Salmonella typhimurium LT2
gaaucaucacaauu

SEQ ID NO: 1852035 - RNA, 18 nt, Salmonella typhimurium LT2
gaaucagcaacacaauca

SEQ ID NO: 1852036 - RNA, 20 nt, Salmonella typhimurium LT2
gaaucacauccgccagcgcc

SEQ ID NO: 1852037 - RNA, 14 nt, Salmonella typhimurium LT2
gaaucaauuucuac

SEQ ID NO: 1852038 - RNA, 18 nt, Salmonella typhimurium LT2
gaaucgcuuccuggguua

SEQ ID NO: 1852039 - RNA, 14 nt, Salmonella typhimurium LT2
gaaucgcugcgcca

SEQ ID NO: 1852040 - RNA, 19 nt, Salmonella typhimurium LT2
gaaucguucgccagugaca

SEQ ID NO: 1852041 - RNA, 15 nt, Salmonella typhimurium LT2
gaaucgccgucagug

SEQ ID NO: 1852042 - RNA, 19 nt, Salmonella typhimurium LT2
gaaucgccaggcgcagcaa

SEQ ID NO: 1852043 - RNA, 18 nt, Salmonella typhimurium LT2
gaaucuauuauuaaucug

SEQ ID NO: 1852044 - RNA, 22 nt, Salmonella typhimurium LT2
gaaucucgaaacaauagcugug

SEQ ID NO: 1852045 - RNA, 23 nt, Salmonella typhimurium LT2
gaaucuggucggugauauauuca

SEQ ID NO: 1852046 - RNA, 14 nt, Salmonella typhimurium LT2
gaaugaagccuuag

SEQ ID NO: 1852047 - RNA, 15 nt, Salmonella typhimurium LT2
gaaugaugugcuauu

SEQ ID NO: 1852048 - RNA, 20 nt, Salmonella typhimurium LT2
gaaugagggcgcgaauacuc

SEQ ID NO: 1852049 - RNA, 21 nt, Salmonella typhimurium LT2
gaaugagcaaugagauccacu

SEQ ID NO: 1852050 - RNA, 14 nt, Salmonella typhimurium LT2
gaauguagcgaccu

SEQ ID NO: 1852051 - RNA, 20 nt, Salmonella typhimurium LT2
gaauguuccccguugagaau

SEQ ID NO: 1852052 - RNA, 22 nt, Salmonella typhimurium LT2
gaauuaacuuauucguauugac

SEQ ID NO: 1852053 - RNA, 11 nt, Salmonella typhimurium LT2
gaaugcgaaua

SEQ ID NO: 1852054 - RNA, 24 nt, Salmonella typhimurium LT2
gaaugcgaauaaucgccggacggc

SEQ ID NO: 1852055 - RNA, 20 nt, Salmonella typhimurium LT2
gaaugcccacgcuucccagc

SEQ ID NO: 1852056 - RNA, 23 nt, Salmonella typhimurium LT2
gaaugcccacgcuucccagcguc

SEQ ID NO: 1852057 - RNA, 17 nt, Salmonella typhimurium LT2
gaaugcagaccucugcu

SEQ ID NO: 1852058 - RNA, 23 nt, Salmonella typhimurium LT2
gaaugccauacuuuuccagcgcc

SEQ ID NO: 1852059 - RNA, 23 nt, Salmonella typhimurium LT2
gaaugcgcgcgugaccccaggca

SEQ ID NO: 1852060 - RNA, 23 nt, Salmonella typhimurium LT2
gaaugcugacggauucuuccucu

SEQ ID NO: 1852061 - RNA, 21 nt, Salmonella typhimurium LT2
gaauugacgauaucaucuugc

SEQ ID NO: 1852062 - RNA, 13 nt, Salmonella typhimurium LT2
gaauugauaaaga

SEQ ID NO: 1852063 - RNA, 13 nt, Salmonella typhimurium LT2
gaauugguagacg

SEQ ID NO: 1852064 - RNA, 15 nt, Salmonella typhimurium LT2
gaauuguuugaaaag

SEQ ID NO: 1852065 - RNA, 20 nt, Salmonella typhimurium LT2
gaauuguuugaaaaggaaaa

SEQ ID NO: 1852066 - RNA, 17 nt, Salmonella typhimurium LT2
gaauuucaaucaucaua

SEQ ID NO: 1852067 - RNA, 16 nt, Salmonella typhimurium LT2
gaauuccaguccuuuc

SEQ ID NO: 1852068 - RNA, 15 nt, Salmonella typhimurium LT2
gaauuccaguccuuu

SEQ ID NO: 1852069 - RNA, 17 nt, Salmonella typhimurium LT2
gaauuaauggucagauc

SEQ ID NO: 1852070 - RNA, 23 nt, Salmonella typhimurium LT2
gaauuacggacgauacaccuuca

SEQ ID NO: 1852071 - RNA, 18 nt, Salmonella typhimurium LT2
gaaccgccgacccccucc

SEQ ID NO: 1852072 - RNA, 22 nt, Salmonella typhimurium LT2
gaaccggguugcggaagcuuuu

SEQ ID NO: 1852073 - RNA, 15 nt, Salmonella typhimurium LT2
gaaccggcaucggca

SEQ ID NO: 1852074 - RNA, 16 nt, Salmonella typhimurium LT2
gaaccaucauuaauau

SEQ ID NO: 1852075 - RNA, 12 nt, Salmonella typhimurium LT2
gaacccaggcac

SEQ ID NO: 1852076 - RNA, 15 nt, Salmonella typhimurium LT2
gaaccagcaucccac

SEQ ID NO: 1852077 - RNA, 21 nt, Salmonella typhimurium LT2
gaaccagcggcaccagcacga

SEQ ID NO: 1852078 - RNA, 14 nt, Salmonella typhimurium LT2
gaacgccagcggcg

SEQ ID NO: 1852079 - RNA, 20 nt, Salmonella typhimurium LT2
gaacgaguacguaaugcgaa

SEQ ID NO: 1852080 - RNA, 15 nt, Salmonella typhimurium LT2
gaacgcgagaagccc

SEQ ID NO: 1852081 - RNA, 15 nt, Salmonella typhimurium LT2
gaacgcgaaggccag

SEQ ID NO: 1852082 - RNA, 17 nt, Salmonella typhimurium LT2
gaacgccuuauccggcc

SEQ ID NO: 1852083 - RNA, 12 nt, Salmonella typhimurium LT2
gaacgccaggcc

SEQ ID NO: 1852084 - RNA, 14 nt, Salmonella typhimurium LT2
gaacgccaggccaa

SEQ ID NO: 1852085 - RNA, 18 nt, Salmonella typhimurium LT2
gaaccucacggagaaaag

SEQ ID NO: 1852086 - RNA, 22 nt, Salmonella typhimurium LT2
gaaccguugcgcccaucaucau

SEQ ID NO: 1852087 - RNA, 20 nt, Salmonella typhimurium LT2
gaaccguaaacgccugcacc

SEQ ID NO: 1852088 - RNA, 15 nt, Salmonella typhimurium LT2
gaaccugcgccgguu

SEQ ID NO: 1852089 - RNA, 14 nt, Salmonella typhimurium LT2
gaacguaauggcau

SEQ ID NO: 1852090 - RNA, 22 nt, Salmonella typhimurium LT2
gaacguccagcggccaguguac

SEQ ID NO: 1852091 - RNA, 17 nt, Salmonella typhimurium LT2
gaacgucuuuuuccagc

SEQ ID NO: 1852092 - RNA, 22 nt, Salmonella typhimurium LT2
gaacuacaugucuccucagaug

SEQ ID NO: 1852093 - RNA, 16 nt, Salmonella typhimurium LT2
gaacuauaggaaaaua

SEQ ID NO: 1852094 - RNA, 14 nt, Salmonella typhimurium LT2
gaacgggugguuuc

SEQ ID NO: 1852095 - RNA, 20 nt, Salmonella typhimurium LT2
gaacgguaacaggaagcagc

SEQ ID NO: 1852096 - RNA, 14 nt, Salmonella typhimurium LT2
gaacggcggauugc

SEQ ID NO: 1852097 - RNA, 18 nt, Salmonella typhimurium LT2
gaacggcgucauccggcg

SEQ ID NO: 1852098 - RNA, 22 nt, Salmonella typhimurium LT2
gaacggcuccacgccggagagc

SEQ ID NO: 1852099 - RNA, 18 nt, Salmonella typhimurium LT2
gaacgcuggcggcaggcc

SEQ ID NO: 1852100 - RNA, 15 nt, Salmonella typhimurium LT2
gaacgcuggcugggu

SEQ ID NO: 1852101 - RNA, 18 nt, Salmonella typhimurium LT2
gaacgcuggcacuuuccg

SEQ ID NO: 1852102 - RNA, 15 nt, Salmonella typhimurium LT2
gaacgcuuccgggcu

SEQ ID NO: 1852103 - RNA, 18 nt, Salmonella typhimurium LT2
gaacggauaaacggcgca

SEQ ID NO: 1852104 - RNA, 22 nt, Salmonella typhimurium LT2
gaacgcuaucggcauaggcuau

SEQ ID NO: 1852105 - RNA, 11 nt, Salmonella typhimurium LT2
gaacugcagcg

SEQ ID NO: 1852106 - RNA, 19 nt, Salmonella typhimurium LT2
gaacuggcgcgaugacuca

SEQ ID NO: 1852107 - RNA, 16 nt, Salmonella typhimurium LT2
gaacuguucagccagc

SEQ ID NO: 1852108 - RNA, 14 nt, Salmonella typhimurium LT2
gaacuguucagcca

SEQ ID NO: 1852109 - RNA, 14 nt, Salmonella typhimurium LT2
gaacuggugaaaca

SEQ ID NO: 1852110 - RNA, 23 nt, Salmonella typhimurium LT2
gaacugucugaaucaaugcaucu

SEQ ID NO: 1852111 - RNA, 22 nt, Salmonella typhimurium LT2
gaacugauggcgcuaagccagc

SEQ ID NO: 1852112 - RNA, 20 nt, Salmonella typhimurium LT2
gaacugacguuagucauauu

SEQ ID NO: 1852113 - RNA, 13 nt, Salmonella typhimurium LT2
gaacucuuucaga

SEQ ID NO: 1852114 - RNA, 21 nt, Salmonella typhimurium LT2
gaacucugcuuuuauuuucag

SEQ ID NO: 1852115 - RNA, 13 nt, Salmonella typhimurium LT2
gaacuccagcgcg

SEQ ID NO: 1852116 - RNA, 17 nt, Salmonella typhimurium LT2
gaacucacauauucaau

SEQ ID NO: 1852117 - RNA, 16 nt, Salmonella typhimurium LT2
gaagcgguaaaaccgg

SEQ ID NO: 1852118 - RNA, 14 nt, Salmonella typhimurium LT2
gaagcguaacagcg

SEQ ID NO: 1852119 - RNA, 16 nt, Salmonella typhimurium LT2
gaagcgucauccggca

SEQ ID NO: 1852120 - RNA, 21 nt, Salmonella typhimurium LT2
gaagcuacagggaauaugcug

SEQ ID NO: 1852121 - RNA, 23 nt, Salmonella typhimurium LT2
gaagcucaugugcagcauccagc

SEQ ID NO: 1852122 - RNA, 15 nt, Salmonella typhimurium LT2
gaagcucagccaggc

SEQ ID NO: 1852123 - RNA, 23 nt, Salmonella typhimurium LT2
gaaggccagugguaaaaaaguga

SEQ ID NO: 1852124 - RNA, 13 nt, Salmonella typhimurium LT2
gaaggcaucuuca

SEQ ID NO: 1852125 - RNA, 15 nt, Salmonella typhimurium LT2
gaaggcaacgccgcc

SEQ ID NO: 1852126 - RNA, 18 nt, Salmonella typhimurium LT2
gaaggaaacgccaggcac

SEQ ID NO: 1852127 - RNA, 14 nt, Salmonella typhimurium LT2
gaaggaauaaaaua

SEQ ID NO: 1852128 - RNA, 17 nt, Salmonella typhimurium LT2
gaagcgauuuauccacc

SEQ ID NO: 1852129 - RNA, 18 nt, Salmonella typhimurium LT2
gaagcgcguucgucccac

SEQ ID NO: 1852130 - RNA, 21 nt, Salmonella typhimurium LT2
gaagcggaaaggacguucuuc

SEQ ID NO: 1852131 - RNA, 20 nt, Salmonella typhimurium LT2
gaagcgauguauuuauccac

SEQ ID NO: 1852132 - RNA, 16 nt, Salmonella typhimurium LT2
gaagcgcacuuuccau

SEQ ID NO: 1852133 - RNA, 19 nt, Salmonella typhimurium LT2
gaagcgaccggcgucauca

SEQ ID NO: 1852134 - RNA, 20 nt, Salmonella typhimurium LT2
gaagccgauaaacgccacga

SEQ ID NO: 1852135 - RNA, 17 nt, Salmonella typhimurium LT2
gaagcccggccacagcg

SEQ ID NO: 1852136 - RNA, 19 nt, Salmonella typhimurium LT2
gaagccccgcugcggaugu

SEQ ID NO: 1852137 - RNA, 22 nt, Salmonella typhimurium LT2
gaagcccaugauggugaacaga

SEQ ID NO: 1852138 - RNA, 18 nt, Salmonella typhimurium LT2
gaagcccaugauggugaa

SEQ ID NO: 1852139 - RNA, 21 nt, Salmonella typhimurium LT2
gaagccauccucacgcaacca

SEQ ID NO: 1852140 - RNA, 21 nt, Salmonella typhimurium LT2
gaagccaccggauugccuucu

SEQ ID NO: 1852141 - RNA, 22 nt, Salmonella typhimurium LT2
gaagcauaaaaagacuaucuuc

SEQ ID NO: 1852142 - RNA, 19 nt, Salmonella typhimurium LT2
gaagcauccguuucccucu

SEQ ID NO: 1852143 - RNA, 16 nt, Salmonella typhimurium LT2
gaagcacauccaugua

SEQ ID NO: 1852144 - RNA, 13 nt, Salmonella typhimurium LT2
gaagcaagugcug

SEQ ID NO: 1852145 - RNA, 17 nt, Salmonella typhimurium LT2
gaagcaggcggagaagg

SEQ ID NO: 1852146 - RNA, 12 nt, Salmonella typhimurium LT2
gaagcagcagac

SEQ ID NO: 1852147 - RNA, 13 nt, Salmonella typhimurium LT2
gaagcagcagacu

SEQ ID NO: 1852148 - RNA, 22 nt, Salmonella typhimurium LT2
gaagauuaauccggucauccag

SEQ ID NO: 1852149 - RNA, 22 nt, Salmonella typhimurium LT2
gaagaguuaacuucuccuccau

SEQ ID NO: 1852150 - RNA, 14 nt, Salmonella typhimurium LT2
gaagaguucaacgc

SEQ ID NO: 1852151 - RNA, 14 nt, Salmonella typhimurium LT2
gaagagaccugugu

SEQ ID NO: 1852152 - RNA, 22 nt, Salmonella typhimurium LT2
gaagagaagcuuuuucuuuauu

SEQ ID NO: 1852153 - RNA, 18 nt, Salmonella typhimurium LT2
gaagagagauaguugagc

SEQ ID NO: 1852154 - RNA, 17 nt, Salmonella typhimurium LT2
gaagauaaacagcagcg

SEQ ID NO: 1852155 - RNA, 20 nt, Salmonella typhimurium LT2
gaagaguuguugaccaacaa

SEQ ID NO: 1852156 - RNA, 22 nt, Salmonella typhimurium LT2
gaagaguuguugaccaacaauc

SEQ ID NO: 1852157 - RNA, 13 nt, Salmonella typhimurium LT2
gaagaucagcaga

SEQ ID NO: 1852158 - RNA, 18 nt, Salmonella typhimurium LT2
gaagaucaggaguaaaua

SEQ ID NO: 1852159 - RNA, 17 nt, Salmonella typhimurium LT2
gaagacacaacgugcca

SEQ ID NO: 1852160 - RNA, 21 nt, Salmonella typhimurium LT2
gaagacagcguaguuuauucu

SEQ ID NO: 1852161 - RNA, 17 nt, Salmonella typhimurium LT2
gaagaaggcuccggcac

SEQ ID NO: 1852162 - RNA, 13 nt, Salmonella typhimurium LT2
gaagacuauccag

SEQ ID NO: 1852163 - RNA, 17 nt, Salmonella typhimurium LT2
gaagacuccccugcaga

SEQ ID NO: 1852164 - RNA, 18 nt, Salmonella typhimurium LT2
gaagaacacgccgccuau

SEQ ID NO: 1852165 - RNA, 22 nt, Salmonella typhimurium LT2
gaagaagcgcacuuuccauaau

SEQ ID NO: 1852166 - RNA, 17 nt, Salmonella typhimurium LT2
gaacuuguaaaaaugcc

SEQ ID NO: 1852167 - RNA, 17 nt, Salmonella typhimurium LT2
gaacuuugcgaaaaagu

SEQ ID NO: 1852168 - RNA, 20 nt, Salmonella typhimurium LT2
gaaaucucgcuaaucaucag

SEQ ID NO: 1852169 - RNA, 17 nt, Salmonella typhimurium LT2
gaaaucucccuggcagu

SEQ ID NO: 1852170 - RNA, 22 nt, Salmonella typhimurium LT2
gaaaucgucagacggcuccagc

SEQ ID NO: 1852171 - RNA, 18 nt, Salmonella typhimurium LT2
gaaaucgugcgccccagg

SEQ ID NO: 1852172 - RNA, 21 nt, Salmonella typhimurium LT2
gaaaucgccgggcuauccggc

SEQ ID NO: 1852173 - RNA, 22 nt, Salmonella typhimurium LT2
gaaaucacgcucaucggcggca

SEQ ID NO: 1852174 - RNA, 15 nt, Salmonella typhimurium LT2
gaaaucacgccacag

SEQ ID NO: 1852175 - RNA, 12 nt, Salmonella typhimurium LT2
gaaaucagcaca

SEQ ID NO: 1852176 - RNA, 14 nt, Salmonella typhimurium LT2
gaaauccagcagaa

SEQ ID NO: 1852177 - RNA, 13 nt, Salmonella typhimurium LT2
gaaaucauuucau

SEQ ID NO: 1852178 - RNA, 19 nt, Salmonella typhimurium LT2
gaaaucagagacaaauaca

SEQ ID NO: 1852179 - RNA, 13 nt, Salmonella typhimurium LT2
gaaaucagcaggu

SEQ ID NO: 1852180 - RNA, 19 nt, Salmonella typhimurium LT2
gaaaugcgaauccggcggc

SEQ ID NO: 1852181 - RNA, 17 nt, Salmonella typhimurium LT2
gaaaugcgacaucucag

SEQ ID NO: 1852182 - RNA, 22 nt, Salmonella typhimurium LT2
gaaaugcgacaucucaggcaag

SEQ ID NO: 1852183 - RNA, 17 nt, Salmonella typhimurium LT2
gaaaugccggauggcgu

SEQ ID NO: 1852184 - RNA, 21 nt, Salmonella typhimurium LT2
gaaauggccauccauugcgcc

SEQ ID NO: 1852185 - RNA, 17 nt, Salmonella typhimurium LT2
gaaaugcgaauccggcg

SEQ ID NO: 1852186 - RNA, 19 nt, Salmonella typhimurium LT2
gaaauggaucggcuugccu

SEQ ID NO: 1852187 - RNA, 11 nt, Salmonella typhimurium LT2
gaaaugagaaa

SEQ ID NO: 1852188 - RNA, 16 nt, Salmonella typhimurium LT2
gaaaugauaagugaua

SEQ ID NO: 1852189 - RNA, 15 nt, Salmonella typhimurium LT2
gaaauguucucagcc

SEQ ID NO: 1852190 - RNA, 17 nt, Salmonella typhimurium LT2
gaaauucgcgccagucc

SEQ ID NO: 1852191 - RNA, 13 nt, Salmonella typhimurium LT2
gaacaaaauagug

SEQ ID NO: 1852192 - RNA, 19 nt, Salmonella typhimurium LT2
gaacaaacagaccgccaug

SEQ ID NO: 1852193 - RNA, 13 nt, Salmonella typhimurium LT2
gaaauuuauucau

SEQ ID NO: 1852194 - RNA, 16 nt, Salmonella typhimurium LT2
gaacagaaaaaaugca

SEQ ID NO: 1852195 - RNA, 14 nt, Salmonella typhimurium LT2
gaacagaagcgccg

SEQ ID NO: 1852196 - RNA, 15 nt, Salmonella typhimurium LT2
gaacagacggcggcu

SEQ ID NO: 1852197 - RNA, 17 nt, Salmonella typhimurium LT2
gaacagacggcaaacaa

SEQ ID NO: 1852198 - RNA, 15 nt, Salmonella typhimurium LT2
gaacagauaaauguc

SEQ ID NO: 1852199 - RNA, 17 nt, Salmonella typhimurium LT2
gaacacggcaugaagca

SEQ ID NO: 1852200 - RNA, 16 nt, Salmonella typhimurium LT2
gaacagccagaagccc

SEQ ID NO: 1852201 - RNA, 18 nt, Salmonella typhimurium LT2
gaacacagcaugaauaac

SEQ ID NO: 1852202 - RNA, 15 nt, Salmonella typhimurium LT2
gaacacauuuccaac

SEQ ID NO: 1852203 - RNA, 20 nt, Salmonella typhimurium LT2
gaacaaugccauuuuugcau

SEQ ID NO: 1852204 - RNA, 15 nt, Salmonella typhimurium LT2
gaacaacgcaacaca

SEQ ID NO: 1852205 - RNA, 19 nt, Salmonella typhimurium LT2
gaacaagcugauuuuucgc

SEQ ID NO: 1852206 - RNA, 10 nt, Salmonella typhimurium LT2
gaacaaggcu

SEQ ID NO: 1852207 - RNA, 19 nt, Salmonella typhimurium LT2
gaaccaacgacccccacca

SEQ ID NO: 1852208 - RNA, 19 nt, Salmonella typhimurium LT2
gaaccaaaugcccagcuca

SEQ ID NO: 1852209 - RNA, 10 nt, Salmonella typhimurium LT2
gaacaucggu

SEQ ID NO: 1852210 - RNA, 15 nt, Salmonella typhimurium LT2
gaacaucagccagca

SEQ ID NO: 1852211 - RNA, 20 nt, Salmonella typhimurium LT2
gaacaucagccagcagcuca

SEQ ID NO: 1852212 - RNA, 23 nt, Salmonella typhimurium LT2
gaacauacuuucucuccuucacg

SEQ ID NO: 1852213 - RNA, 23 nt, Salmonella typhimurium LT2
gaacaguguaaacgccagauaau

SEQ ID NO: 1852214 - RNA, 23 nt, Salmonella typhimurium LT2
gaacaguuuugcgccuaaucguu

SEQ ID NO: 1852215 - RNA, 22 nt, Salmonella typhimurium LT2
gaacagucccaccagcgcggca

SEQ ID NO: 1852216 - RNA, 18 nt, Salmonella typhimurium LT2
gaacaggcuucccaauac

SEQ ID NO: 1852217 - RNA, 18 nt, Salmonella typhimurium LT2
gaacaggcuuuucaggcu

SEQ ID NO: 1852218 - RNA, 14 nt, Salmonella typhimurium LT2
gaacagcggcggca

SEQ ID NO: 1852219 - RNA, 19 nt, Salmonella typhimurium LT2
gaacaggccaaacccugcg

SEQ ID NO: 1852220 - RNA, 15 nt, Salmonella typhimurium LT2
gaaauaacgugcccu

SEQ ID NO: 1852221 - RNA, 22 nt, Salmonella typhimurium LT2
gaaagugauuucaugugcuuuu

SEQ ID NO: 1852222 - RNA, 21 nt, Salmonella typhimurium LT2
gaaaguggugggugaugacgg

SEQ ID NO: 1852223 - RNA, 21 nt, Salmonella typhimurium LT2
gaaagugguuuuaagcuucuu

SEQ ID NO: 1852224 - RNA, 16 nt, Salmonella typhimurium LT2
gaaaguggugggugau

SEQ ID NO: 1852225 - RNA, 20 nt, Salmonella typhimurium LT2
gaaagucuuuuguuuuucuc

SEQ ID NO: 1852226 - RNA, 23 nt, Salmonella typhimurium LT2
gaaauaccaggcggcuuuuucau

SEQ ID NO: 1852227 - RNA, 23 nt, Salmonella typhimurium LT2
gaaauagacgagcgaaaaacugu

SEQ ID NO: 1852228 - RNA, 18 nt, Salmonella typhimurium LT2
gaaauauuauuccgguuc

SEQ ID NO: 1852229 - RNA, 12 nt, Salmonella typhimurium LT2
gaaagcugcgcc

SEQ ID NO: 1852230 - RNA, 20 nt, Salmonella typhimurium LT2
gaaagcucaggccuuauuua

SEQ ID NO: 1852231 - RNA, 22 nt, Salmonella typhimurium LT2
gaaagggccgggaaagauaaua

SEQ ID NO: 1852232 - RNA, 16 nt, Salmonella typhimurium LT2
gaaagggaucaaugua

SEQ ID NO: 1852233 - RNA, 17 nt, Salmonella typhimurium LT2
gaaaggcgucagccgcc

SEQ ID NO: 1852234 - RNA, 15 nt, Salmonella typhimurium LT2
gaaaggcgugcagcg

SEQ ID NO: 1852235 - RNA, 22 nt, Salmonella typhimurium LT2
gaaagcgacucauccacauacu

SEQ ID NO: 1852236 - RNA, 17 nt, Salmonella typhimurium LT2
gaaagcggcgaauauag

SEQ ID NO: 1852237 - RNA, 14 nt, Salmonella typhimurium LT2
gaaagcaacagcaa

SEQ ID NO: 1852238 - RNA, 16 nt, Salmonella typhimurium LT2
gaaagauagcaggccc

SEQ ID NO: 1852239 - RNA, 13 nt, Salmonella typhimurium LT2
gaaagcacuucuc

SEQ ID NO: 1852240 - RNA, 12 nt, Salmonella typhimurium LT2
gaaacugauauu

SEQ ID NO: 1852241 - RNA, 21 nt, Salmonella typhimurium LT2
gaaacucgacgggaaucuccg

SEQ ID NO: 1852242 - RNA, 14 nt, Salmonella typhimurium LT2
gaaacucgccgcca

SEQ ID NO: 1852243 - RNA, 18 nt, Salmonella typhimurium LT2
gaaacuccagcggcagga

SEQ ID NO: 1852244 - RNA, 15 nt, Salmonella typhimurium LT2
gaaacuccagcggca

SEQ ID NO: 1852245 - RNA, 16 nt, Salmonella typhimurium LT2
gaaacguguuuauccc

SEQ ID NO: 1852246 - RNA, 19 nt, Salmonella typhimurium LT2
gaaacgugcauuauuuuag

SEQ ID NO: 1852247 - RNA, 23 nt, Salmonella typhimurium LT2
gaaacugauaguuuaaauccagc

SEQ ID NO: 1852248 - RNA, 18 nt, Salmonella typhimurium LT2
gaaacugcugccgcagca

SEQ ID NO: 1852249 - RNA, 15 nt, Salmonella typhimurium LT2
gaaacugcugccgca

SEQ ID NO: 1852250 - RNA, 17 nt, Salmonella typhimurium LT2
gaaacuggcgucauguu

SEQ ID NO: 1852251 - RNA, 20 nt, Salmonella typhimurium LT2
gaaacuuaucauuuuuucua

SEQ ID NO: 1852252 - RNA, 15 nt, Salmonella typhimurium LT2
gaaacugccuaaauu

SEQ ID NO: 1852253 - RNA, 11 nt, Salmonella typhimurium LT2
gaaagaaaauu

SEQ ID NO: 1852254 - RNA, 17 nt, Salmonella typhimurium LT2
gaaacccgcucgcccgc

SEQ ID NO: 1852255 - RNA, 21 nt, Salmonella typhimurium LT2
gaaacccucggcgaacaggcg

SEQ ID NO: 1852256 - RNA, 16 nt, Salmonella typhimurium LT2
gaaaccgcagaaaaag

SEQ ID NO: 1852257 - RNA, 15 nt, Salmonella typhimurium LT2
gaaaccgcagaaaaa

SEQ ID NO: 1852258 - RNA, 16 nt, Salmonella typhimurium LT2
gaaaccgaauccuuug

SEQ ID NO: 1852259 - RNA, 19 nt, Salmonella typhimurium LT2
gaaaccgagguucaccagc

SEQ ID NO: 1852260 - RNA, 18 nt, Salmonella typhimurium LT2
gaaaccgcucgccgccuc

SEQ ID NO: 1852261 - RNA, 14 nt, Salmonella typhimurium LT2
gaaaccgcucgccg

SEQ ID NO: 1852262 - RNA, 21 nt, Salmonella typhimurium LT2
gaaaccggcgucuuuugcugc

SEQ ID NO: 1852263 - RNA, 19 nt, Salmonella typhimurium LT2
gaaacgccgaccacuucaa

SEQ ID NO: 1852264 - RNA, 17 nt, Salmonella typhimurium LT2
gaaacgcgccggaaggc

SEQ ID NO: 1852265 - RNA, 17 nt, Salmonella typhimurium LT2
gaaacgccuuauccggc

SEQ ID NO: 1852266 - RNA, 20 nt, Salmonella typhimurium LT2
gaaacgcauacgcagcacuu

SEQ ID NO: 1852267 - RNA, 12 nt, Salmonella typhimurium LT2
gaaacgccaggc

SEQ ID NO: 1852268 - RNA, 12 nt, Salmonella typhimurium LT2
gaaaccuccgca

SEQ ID NO: 1852269 - RNA, 11 nt, Salmonella typhimurium LT2
gaaaccagcau

SEQ ID NO: 1852270 - RNA, 13 nt, Salmonella typhimurium LT2
gaaacccaaauaa

SEQ ID NO: 1852271 - RNA, 13 nt, Salmonella typhimurium LT2
gaaaccaggcgcg

SEQ ID NO: 1852272 - RNA, 13 nt, Salmonella typhimurium LT2
gaaacagggcaag

SEQ ID NO: 1852273 - RNA, 13 nt, Salmonella typhimurium LT2
gaaacagaauaaa

SEQ ID NO: 1852274 - RNA, 15 nt, Salmonella typhimurium LT2
cuuuuuuauugccug

SEQ ID NO: 1852275 - RNA, 20 nt, Salmonella typhimurium LT2
gaaaaaaacgcauugcagca

SEQ ID NO: 1852276 - RNA, 14 nt, Salmonella typhimurium LT2
gaaaaaaauccagu

SEQ ID NO: 1852277 - RNA, 11 nt, Salmonella typhimurium LT2
cuuuuuuucaa

SEQ ID NO: 1852278 - RNA, 16 nt, Salmonella typhimurium LT2
cuuuuuuuccagcguc

SEQ ID NO: 1852279 - RNA, 13 nt, Salmonella typhimurium LT2
gaaaaaauuacag

SEQ ID NO: 1852280 - RNA, 18 nt, Salmonella typhimurium LT2
gaaaaaauuacagccgcg

SEQ ID NO: 1852281 - RNA, 21 nt, Salmonella typhimurium LT2
gaaaaacauauuaugcucaug

SEQ ID NO: 1852282 - RNA, 13 nt, Salmonella typhimurium LT2
gaaaaaauacuga

SEQ ID NO: 1852283 - RNA, 23 nt, Salmonella typhimurium LT2
gaaaaaauacugauaaaaaacag

SEQ ID NO: 1852284 - RNA, 20 nt, Salmonella typhimurium LT2
gaaaaaauaguaaaguuuau

SEQ ID NO: 1852285 - RNA, 16 nt, Salmonella typhimurium LT2
gaaaacagcgccggca

SEQ ID NO: 1852286 - RNA, 15 nt, Salmonella typhimurium LT2
gaaaacagcgccggc

SEQ ID NO: 1852287 - RNA, 13 nt, Salmonella typhimurium LT2
gaaaaauguguug

SEQ ID NO: 1852288 - RNA, 15 nt, Salmonella typhimurium LT2
gaaaaauuccgcaga

SEQ ID NO: 1852289 - RNA, 13 nt, Salmonella typhimurium LT2
gaaaaauuugauc

SEQ ID NO: 1852290 - RNA, 13 nt, Salmonella typhimurium LT2
gaaaaauuuuccu

SEQ ID NO: 1852291 - RNA, 21 nt, Salmonella typhimurium LT2
gaaaacgcaucugggcugaca

SEQ ID NO: 1852292 - RNA, 19 nt, Salmonella typhimurium LT2
gaaaaccugcaaaaaaaga

SEQ ID NO: 1852293 - RNA, 23 nt, Salmonella typhimurium LT2
gaaaaccugcaaaaaaagaaaaa

SEQ ID NO: 1852294 - RNA, 18 nt, Salmonella typhimurium LT2
gaaaacgccugcgucuaa

SEQ ID NO: 1852295 - RNA, 22 nt, Salmonella typhimurium LT2
gaaaacgccugcgucuaaccag

SEQ ID NO: 1852296 - RNA, 17 nt, Salmonella typhimurium LT2
gaaaaccauaauaaugc

SEQ ID NO: 1852297 - RNA, 18 nt, Salmonella typhimurium LT2
gaaaaccacaaucacagc

SEQ ID NO: 1852298 - RNA, 19 nt, Salmonella typhimurium LT2
gaaaaacgggagauuguua

SEQ ID NO: 1852299 - RNA, 14 nt, Salmonella typhimurium LT2
gaaaaagggaaaag

SEQ ID NO: 1852300 - RNA, 16 nt, Salmonella typhimurium LT2
gaaaaaugaauaccaa

SEQ ID NO: 1852301 - RNA, 23 nt, Salmonella typhimurium LT2
gaaaaaugaauaccaaaucucaa

SEQ ID NO: 1852302 - RNA, 23 nt, Salmonella typhimurium LT2
gaaaaaugaauaccaagucucaa

SEQ ID NO: 1852303 - RNA, 13 nt, Salmonella typhimurium LT2
gaaaaaucagcau

SEQ ID NO: 1852304 - RNA, 21 nt, Salmonella typhimurium LT2
gaaaaauccggcaggcagccg

SEQ ID NO: 1852305 - RNA, 19 nt, Salmonella typhimurium LT2
gaaaaauagacacaaaugc

SEQ ID NO: 1852306 - RNA, 17 nt, Salmonella typhimurium LT2
gaaaaagucauuuucau

SEQ ID NO: 1852307 - RNA, 16 nt, Salmonella typhimurium LT2
gaaaaugguuuugccc

SEQ ID NO: 1852308 - RNA, 17 nt, Salmonella typhimurium LT2
gaaaaugguuuugccca

SEQ ID NO: 1852309 - RNA, 17 nt, Salmonella typhimurium LT2
gaaaauuccuggauuaa

SEQ ID NO: 1852310 - RNA, 13 nt, Salmonella typhimurium LT2
gaaaaucugguuu

SEQ ID NO: 1852311 - RNA, 15 nt, Salmonella typhimurium LT2
gaaaaucuucuucag

SEQ ID NO: 1852312 - RNA, 16 nt, Salmonella typhimurium LT2
gaaaaugaaaaauccg

SEQ ID NO: 1852313 - RNA, 19 nt, Salmonella typhimurium LT2
gaaaaugcguccagaggau

SEQ ID NO: 1852314 - RNA, 21 nt, Salmonella typhimurium LT2
gaaaaucgacuggugauuuuu

SEQ ID NO: 1852315 - RNA, 22 nt, Salmonella typhimurium LT2
gaaaaucagugaacacccugcc

SEQ ID NO: 1852316 - RNA, 13 nt, Salmonella typhimurium LT2
gaaaauauaaucu

SEQ ID NO: 1852317 - RNA, 13 nt, Salmonella typhimurium LT2
gaaaauaucggcc

SEQ ID NO: 1852318 - RNA, 13 nt, Salmonella typhimurium LT2
gaaaauauauucu

SEQ ID NO: 1852319 - RNA, 18 nt, Salmonella typhimurium LT2
gaaaauaugaugcuaucu

SEQ ID NO: 1852320 - RNA, 12 nt, Salmonella typhimurium LT2
gaaaagugaacg

SEQ ID NO: 1852321 - RNA, 23 nt, Salmonella typhimurium LT2
gaaaaggguggugaaucagaagc

SEQ ID NO: 1852322 - RNA, 18 nt, Salmonella typhimurium LT2
gaaaaguauauaucccgc

SEQ ID NO: 1852323 - RNA, 17 nt, Salmonella typhimurium LT2
gaaaauaccgcacauca

SEQ ID NO: 1852324 - RNA, 14 nt, Salmonella typhimurium LT2
gaaaauagaggaaa

SEQ ID NO: 1852325 - RNA, 12 nt, Salmonella typhimurium LT2
gaaaagaaccga

SEQ ID NO: 1852326 - RNA, 20 nt, Salmonella typhimurium LT2
gaaaaggaagaauaaauaac

SEQ ID NO: 1852327 - RNA, 20 nt, Salmonella typhimurium LT2
gaaaagcgcgucgaaugacg

SEQ ID NO: 1852328 - RNA, 14 nt, Salmonella typhimurium LT2
gaaaagcgaccauu

SEQ ID NO: 1852329 - RNA, 14 nt, Salmonella typhimurium LT2
gaaaagcuggcuga

SEQ ID NO: 1852330 - RNA, 16 nt, Salmonella typhimurium LT2
gaaaagcuggcugaca

SEQ ID NO: 1852331 - RNA, 21 nt, Salmonella typhimurium LT2
cuuuuuccgccugaucuuucu

SEQ ID NO: 1852332 - RNA, 16 nt, Salmonella typhimurium LT2
cuuuuucgcucuuauc

SEQ ID NO: 1852333 - RNA, 12 nt, Salmonella typhimurium LT2
cuuuuuccagca

SEQ ID NO: 1852334 - RNA, 16 nt, Salmonella typhimurium LT2
cuuuuucaauuuccag

SEQ ID NO: 1852335 - RNA, 13 nt, Salmonella typhimurium LT2
cuuuuucagaucu

SEQ ID NO: 1852336 - RNA, 12 nt, Salmonella typhimurium LT2
cuuuuucaggca

SEQ ID NO: 1852337 - RNA, 20 nt, Salmonella typhimurium LT2
cuuuuugcauucgcuccuca

SEQ ID NO: 1852338 - RNA, 18 nt, Salmonella typhimurium LT2
cuuuuuaauucacaacug

SEQ ID NO: 1852339 - RNA, 19 nt, Salmonella typhimurium LT2
cuuuuuaauucacaacuga

SEQ ID NO: 1852340 - RNA, 13 nt, Salmonella typhimurium LT2
cuuuuuaaaauga

SEQ ID NO: 1852341 - RNA, 20 nt, Salmonella typhimurium LT2
cuuuuuaccggcgaccacua

SEQ ID NO: 1852342 - RNA, 16 nt, Salmonella typhimurium LT2
cuuuuuauauaagcau

SEQ ID NO: 1852343 - RNA, 13 nt, Salmonella typhimurium LT2
cuuuuuauucaua

SEQ ID NO: 1852344 - RNA, 16 nt, Salmonella typhimurium LT2
cuuuuuauuacuuucu

SEQ ID NO: 1852345 - RNA, 23 nt, Salmonella typhimurium LT2
cuuuucuccccgacggcuucuuc

SEQ ID NO: 1852346 - RNA, 13 nt, Salmonella typhimurium LT2
cuuuucucccggc

SEQ ID NO: 1852347 - RNA, 14 nt, Salmonella typhimurium LT2
cuuuuccugcugcc

SEQ ID NO: 1852348 - RNA, 15 nt, Salmonella typhimurium LT2
cuuuuccugcugcca

SEQ ID NO: 1852349 - RNA, 12 nt, Salmonella typhimurium LT2
cuuuuccuucca

SEQ ID NO: 1852350 - RNA, 14 nt, Salmonella typhimurium LT2
cuuuuccucuucuu

SEQ ID NO: 1852351 - RNA, 18 nt, Salmonella typhimurium LT2
cuuuucggguguccacuc

SEQ ID NO: 1852352 - RNA, 16 nt, Salmonella typhimurium LT2
cuuuucggguaaauca

SEQ ID NO: 1852353 - RNA, 20 nt, Salmonella typhimurium LT2
cuuuuggcguaauggcggga

SEQ ID NO: 1852354 - RNA, 19 nt, Salmonella typhimurium LT2
cuuuugucguccccuggac

SEQ ID NO: 1852355 - RNA, 19 nt, Salmonella typhimurium LT2
cuuuugugcccguuuuaca

SEQ ID NO: 1852356 - RNA, 23 nt, Salmonella typhimurium LT2
cuuuugauacucugcuuuuucac

SEQ ID NO: 1852357 - RNA, 12 nt, Salmonella typhimurium LT2
cuuuugagcagc

SEQ ID NO: 1852358 - RNA, 20 nt, Salmonella typhimurium LT2
cuuuugcgcguuccccaaca

SEQ ID NO: 1852359 - RNA, 13 nt, Salmonella typhimurium LT2
cuuuugccgcgcc

SEQ ID NO: 1852360 - RNA, 18 nt, Salmonella typhimurium LT2
cuuuugccgucaggucau

SEQ ID NO: 1852361 - RNA, 23 nt, Salmonella typhimurium LT2
cuuuugccgugacuuccgucucc

SEQ ID NO: 1852362 - RNA, 19 nt, Salmonella typhimurium LT2
cuuuugcgccuuccaguuc

SEQ ID NO: 1852363 - RNA, 14 nt, Salmonella typhimurium LT2
cuuucuuuuuuugu

SEQ ID NO: 1852364 - RNA, 14 nt, Salmonella typhimurium LT2
cuuucuuuaacacc

SEQ ID NO: 1852365 - RNA, 11 nt, Salmonella typhimurium LT2
cuuucuuucuc

SEQ ID NO: 1852366 - RNA, 18 nt, Salmonella typhimurium LT2
cuuucuugccacuggccu

SEQ ID NO: 1852367 - RNA, 21 nt, Salmonella typhimurium LT2
cuuugucgaaauugccgcccg

SEQ ID NO: 1852368 - RNA, 17 nt, Salmonella typhimurium LT2
cuuuguuggcugcacuc

SEQ ID NO: 1852369 - RNA, 23 nt, Salmonella typhimurium LT2
cuuuuaaccacgcaaucucuucc

SEQ ID NO: 1852370 - RNA, 17 nt, Salmonella typhimurium LT2
cuuuuccaggcgaccag

SEQ ID NO: 1852371 - RNA, 18 nt, Salmonella typhimurium LT2
cuuuucccgccagcugcg

SEQ ID NO: 1852372 - RNA, 13 nt, Salmonella typhimurium LT2
cuuuuccgccucg

SEQ ID NO: 1852373 - RNA, 12 nt, Salmonella typhimurium LT2
cuuuuauuuugg

SEQ ID NO: 1852374 - RNA, 19 nt, Salmonella typhimurium LT2
cuuuucauccacagcgcca

SEQ ID NO: 1852375 - RNA, 21 nt, Salmonella typhimurium LT2
cuuuucagcccaggcuuuagu

SEQ ID NO: 1852376 - RNA, 22 nt, Salmonella typhimurium LT2
cuuuuauccccacuaccgccac

SEQ ID NO: 1852377 - RNA, 22 nt, Salmonella typhimurium LT2
cuuuuauuauuuugauaaucau

SEQ ID NO: 1852378 - RNA, 21 nt, Salmonella typhimurium LT2
cuuuuaugggaaaauuccugg

SEQ ID NO: 1852379 - RNA, 16 nt, Salmonella typhimurium LT2
cuuuuacagggcggca

SEQ ID NO: 1852380 - RNA, 19 nt, Salmonella typhimurium LT2
cuuuuacagggcggcagga

SEQ ID NO: 1852381 - RNA, 14 nt, Salmonella typhimurium LT2
cuuuuagcaccaga

SEQ ID NO: 1852382 - RNA, 12 nt, Salmonella typhimurium LT2
cuuuuacugccc

SEQ ID NO: 1852383 - RNA, 20 nt, Salmonella typhimurium LT2
aaaaaacgcccagaucgacc

SEQ ID NO: 1852384 - RNA, 13 nt, Salmonella typhimurium LT2
aaaaaagagaagc

SEQ ID NO: 1852385 - RNA, 13 nt, Salmonella typhimurium LT2
aaaaaacaucaug

SEQ ID NO: 1852386 - RNA, 11 nt, Salmonella typhimurium LT2
aaaaaagagaa

SEQ ID NO: 1852387 - RNA, 17 nt, Salmonella typhimurium LT2
aaaaaacggaaccaaaa

SEQ ID NO: 1852388 - RNA, 15 nt, Salmonella typhimurium LT2
aaaaaagaaaaauau

SEQ ID NO: 1852389 - RNA, 18 nt, Salmonella typhimurium LT2
aaaaaagcgcccagcgcc

SEQ ID NO: 1852390 - RNA, 20 nt, Salmonella typhimurium LT2
aaaaaauuaaaauucauuau

SEQ ID NO: 1852391 - RNA, 17 nt, Salmonella typhimurium LT2
aaaaaauuaucauguau

SEQ ID NO: 1852392 - RNA, 22 nt, Salmonella typhimurium LT2
aaaaauggguaugcgacugaaa

SEQ ID NO: 1852393 - RNA, 13 nt, Salmonella typhimurium LT2
aaaaaucagcaau

SEQ ID NO: 1852394 - RNA, 18 nt, Salmonella typhimurium LT2
aaaaauaugcaauuaaua

SEQ ID NO: 1852395 - RNA, 18 nt, Salmonella typhimurium LT2
aaaaauaucugaauaacc

SEQ ID NO: 1852396 - RNA, 19 nt, Salmonella typhimurium LT2
aaaaauaucugaauaacca

SEQ ID NO: 1852397 - RNA, 18 nt, Salmonella typhimurium LT2
aaaaagugaaaaaacgga

SEQ ID NO: 1852398 - RNA, 14 nt, Salmonella typhimurium LT2
aaaaccagaacuuc

SEQ ID NO: 1852399 - RNA, 21 nt, Salmonella typhimurium LT2
aaaaccagaauuuguugguuu

SEQ ID NO: 1852400 - RNA, 19 nt, Salmonella typhimurium LT2
aaaacagugauuacaaaau

SEQ ID NO: 1852401 - RNA, 19 nt, Salmonella typhimurium LT2
aaaacagcaugguguuagu

SEQ ID NO: 1852402 - RNA, 23 nt, Salmonella typhimurium LT2
aaaaccggcauacacgccgggca

SEQ ID NO: 1852403 - RNA, 20 nt, Salmonella typhimurium LT2
aaaaccgaucgccuaaaauc

SEQ ID NO: 1852404 - RNA, 16 nt, Salmonella typhimurium LT2
aaaaccugcaaaaaaa

SEQ ID NO: 1852405 - RNA, 14 nt, Salmonella typhimurium LT2
aaaaccugaaagca

SEQ ID NO: 1852406 - RNA, 19 nt, Salmonella typhimurium LT2
aaaaccauaauaaugccaa

SEQ ID NO: 1852407 - RNA, 13 nt, Salmonella typhimurium LT2
aaaaccaggcaac

SEQ ID NO: 1852408 - RNA, 16 nt, Salmonella typhimurium LT2
aaaaccaggcaacaga

SEQ ID NO: 1852409 - RNA, 18 nt, Salmonella typhimurium LT2
aaaaccaggcgaaaauag

SEQ ID NO: 1852410 - RNA, 21 nt, Salmonella typhimurium LT2
aaaaccauugcuaaaaauacg

SEQ ID NO: 1852411 - RNA, 14 nt, Salmonella typhimurium LT2
aaaacccaauaacu

SEQ ID NO: 1852412 - RNA, 18 nt, Salmonella typhimurium LT2
aaaacccguuaaauacca

SEQ ID NO: 1852413 - RNA, 19 nt, Salmonella typhimurium LT2
aaaacccgcagccggauag

SEQ ID NO: 1852414 - RNA, 16 nt, Salmonella typhimurium LT2
aaaaccccaucccggc

SEQ ID NO: 1852415 - RNA, 15 nt, Salmonella typhimurium LT2
aaaaccgaucuccca

SEQ ID NO: 1852416 - RNA, 23 nt, Salmonella typhimurium LT2
aaaaccgaucucccagccgggca

SEQ ID NO: 1852417 - RNA, 20 nt, Salmonella typhimurium LT2
aaaaacgcgcucgccagcgc

SEQ ID NO: 1852418 - RNA, 18 nt, Salmonella typhimurium LT2
aaaaacggcgcuuuuaaa

SEQ ID NO: 1852419 - RNA, 15 nt, Salmonella typhimurium LT2
aaaaacucaggaaau

SEQ ID NO: 1852420 - RNA, 16 nt, Salmonella typhimurium LT2
aaaaacucaaagcguu

SEQ ID NO: 1852421 - RNA, 22 nt, Salmonella typhimurium LT2
aaaaacgcgcucgccagcgcag

SEQ ID NO: 1852422 - RNA, 12 nt, Salmonella typhimurium LT2
aaaaaccuccgg

SEQ ID NO: 1852423 - RNA, 15 nt, Salmonella typhimurium LT2
aaaaaccauuuauaa

SEQ ID NO: 1852424 - RNA, 13 nt, Salmonella typhimurium LT2
aaaaaccccuggu

SEQ ID NO: 1852425 - RNA, 18 nt, Salmonella typhimurium LT2
aaaaacucaggaaaucgu

SEQ ID NO: 1852426 - RNA, 19 nt, Salmonella typhimurium LT2
aaaaacgggagauuguuau

SEQ ID NO: 1852427 - RNA, 22 nt, Salmonella typhimurium LT2
aaaaagccgcucgccagaacau

SEQ ID NO: 1852428 - RNA, 18 nt, Salmonella typhimurium LT2
aaaaagcccguccgucag

SEQ ID NO: 1852429 - RNA, 21 nt, Salmonella typhimurium LT2
aaaaagcgaucaccucuucca

SEQ ID NO: 1852430 - RNA, 21 nt, Salmonella typhimurium LT2
aaaaagcugugccacauuuau

SEQ ID NO: 1852431 - RNA, 20 nt, Salmonella typhimurium LT2
aaaaaggcgaacuccagcgc

SEQ ID NO: 1852432 - RNA, 17 nt, Salmonella typhimurium LT2
aaaaagggaauaauaca

SEQ ID NO: 1852433 - RNA, 15 nt, Salmonella typhimurium LT2
aaaaagaaagcugcc

SEQ ID NO: 1852434 - RNA, 19 nt, Salmonella typhimurium LT2
aaaaagccaagcacaaaaa

SEQ ID NO: 1852435 - RNA, 14 nt, Salmonella typhimurium LT2
aaaaagauugcugu

SEQ ID NO: 1852436 - RNA, 14 nt, Salmonella typhimurium LT2
aaaaagagaaaaaa

SEQ ID NO: 1852437 - RNA, 15 nt, Salmonella typhimurium LT2
aaaaagaagaaaaaa

SEQ ID NO: 1852438 - RNA, 16 nt, Salmonella typhimurium LT2
aaaaucuucuucagcu

SEQ ID NO: 1852439 - RNA, 21 nt, Salmonella typhimurium LT2
aaaauaagcaauuacuauucc

SEQ ID NO: 1852440 - RNA, 13 nt, Salmonella typhimurium LT2
aaaauaucugaau

SEQ ID NO: 1852441 - RNA, 14 nt, Salmonella typhimurium LT2
aaaauaucugaaua

SEQ ID NO: 1852442 - RNA, 15 nt, Salmonella typhimurium LT2
aaaauaucugaauaa

SEQ ID NO: 1852443 - RNA, 21 nt, Salmonella typhimurium LT2
aaaauauuacgccaucagcau

SEQ ID NO: 1852444 - RNA, 12 nt, Salmonella typhimurium LT2
aaaauauguucc

SEQ ID NO: 1852445 - RNA, 13 nt, Salmonella typhimurium LT2
aaaauguucaugu

SEQ ID NO: 1852446 - RNA, 21 nt, Salmonella typhimurium LT2
aaaauuaaacaagauaaugga

SEQ ID NO: 1852447 - RNA, 14 nt, Salmonella typhimurium LT2
aaaaugaauaccaa

SEQ ID NO: 1852448 - RNA, 14 nt, Salmonella typhimurium LT2
aaaaugacacccag

SEQ ID NO: 1852449 - RNA, 23 nt, Salmonella typhimurium LT2
aaaaugagauugauaaucagcaa

SEQ ID NO: 1852450 - RNA, 13 nt, Salmonella typhimurium LT2
aaaaugaccgucg

SEQ ID NO: 1852451 - RNA, 21 nt, Salmonella typhimurium LT2
aaaauggaggcgcccacaaug

SEQ ID NO: 1852452 - RNA, 21 nt, Salmonella typhimurium LT2
aaaaggucgauauuuaaugag

SEQ ID NO: 1852453 - RNA, 21 nt, Salmonella typhimurium LT2
aaaaggguggugaaucagaag

SEQ ID NO: 1852454 - RNA, 18 nt, Salmonella typhimurium LT2
aaaagggaauaauacacg

SEQ ID NO: 1852455 - RNA, 19 nt, Salmonella typhimurium LT2
aaaaggccuggcugagaaa

SEQ ID NO: 1852456 - RNA, 22 nt, Salmonella typhimurium LT2
aaaaggcagauucuucugccuu

SEQ ID NO: 1852457 - RNA, 14 nt, Salmonella typhimurium LT2
aaaaggcagccagg

SEQ ID NO: 1852458 - RNA, 14 nt, Salmonella typhimurium LT2
aaaaggcagccgaa

SEQ ID NO: 1852459 - RNA, 19 nt, Salmonella typhimurium LT2
aaaaguuugaccagcaaua

SEQ ID NO: 1852460 - RNA, 21 nt, Salmonella typhimurium LT2
aaaaguuugaccagcaauaaa

SEQ ID NO: 1852461 - RNA, 18 nt, Salmonella typhimurium LT2
aaaauaacgaaaaugccc

SEQ ID NO: 1852462 - RNA, 14 nt, Salmonella typhimurium LT2
aaaauaaaucggca

SEQ ID NO: 1852463 - RNA, 12 nt, Salmonella typhimurium LT2
aaaauaaauuaa

SEQ ID NO: 1852464 - RNA, 12 nt, Salmonella typhimurium LT2
aaaacgccugcc

SEQ ID NO: 1852465 - RNA, 21 nt, Salmonella typhimurium LT2
aaaacgcuaugccuggaugua

SEQ ID NO: 1852466 - RNA, 19 nt, Salmonella typhimurium LT2
aaaacgcgcucgccagcgc

SEQ ID NO: 1852467 - RNA, 15 nt, Salmonella typhimurium LT2
aaaagcgcccagcgc

SEQ ID NO: 1852468 - RNA, 20 nt, Salmonella typhimurium LT2
aaaagcgccacgcgucaggu

SEQ ID NO: 1852469 - RNA, 13 nt, Salmonella typhimurium LT2
aaaacggaacggc

SEQ ID NO: 1852470 - RNA, 15 nt, Salmonella typhimurium LT2
aaaagcgcgggcugg

SEQ ID NO: 1852471 - RNA, 20 nt, Salmonella typhimurium LT2
aaaagcgcgcccuuucaguu

SEQ ID NO: 1852472 - RNA, 23 nt, Salmonella typhimurium LT2
aaaagcgcgcccuuucaguucaa

SEQ ID NO: 1852473 - RNA, 13 nt, Salmonella typhimurium LT2
aaaacgagaacac

SEQ ID NO: 1852474 - RNA, 15 nt, Salmonella typhimurium LT2
aaaacgauauugccu

SEQ ID NO: 1852475 - RNA, 13 nt, Salmonella typhimurium LT2
aaaaagaaaaaua

SEQ ID NO: 1852476 - RNA, 13 nt, Salmonella typhimurium LT2
aaaagcugauuaa

SEQ ID NO: 1852477 - RNA, 17 nt, Salmonella typhimurium LT2
aaaaagaagaaaaaauu

SEQ ID NO: 1852478 - RNA, 19 nt, Salmonella typhimurium LT2
aaaagcugcgaucaaguuu

SEQ ID NO: 1852479 - RNA, 17 nt, Salmonella typhimurium LT2
aaaagcuucguuaagaa

SEQ ID NO: 1852480 - RNA, 19 nt, Salmonella typhimurium LT2
aaaagcuguagcauaaaug

SEQ ID NO: 1852481 - RNA, 14 nt, Salmonella typhimurium LT2
aaacagcaaaucgg

SEQ ID NO: 1852482 - RNA, 15 nt, Salmonella typhimurium LT2
aaacagcagaacaac

SEQ ID NO: 1852483 - RNA, 22 nt, Salmonella typhimurium LT2
aaacagcacuacagcccuuuca

SEQ ID NO: 1852484 - RNA, 21 nt, Salmonella typhimurium LT2
aaacagcagcgcggcacacag

SEQ ID NO: 1852485 - RNA, 18 nt, Salmonella typhimurium LT2
aaacagcgccaguuuuuc

SEQ ID NO: 1852486 - RNA, 16 nt, Salmonella typhimurium LT2
aaacagcuguaaaucg

SEQ ID NO: 1852487 - RNA, 20 nt, Salmonella typhimurium LT2
aaacagcgugggaagcagca

SEQ ID NO: 1852488 - RNA, 23 nt, Salmonella typhimurium LT2
aaacaguuuaguugccguuuuuc

SEQ ID NO: 1852489 - RNA, 15 nt, Salmonella typhimurium LT2
aaacauaucacgaaa

SEQ ID NO: 1852490 - RNA, 19 nt, Salmonella typhimurium LT2
aaacagguacuuacccaga

SEQ ID NO: 1852491 - RNA, 19 nt, Salmonella typhimurium LT2
aaacagguaaaacaaaaaa

SEQ ID NO: 1852492 - RNA, 15 nt, Salmonella typhimurium LT2
aaacagggcuucuuu

SEQ ID NO: 1852493 - RNA, 21 nt, Salmonella typhimurium LT2
aaacaguccggcgaaaaaaga

SEQ ID NO: 1852494 - RNA, 23 nt, Salmonella typhimurium LT2
aaacaccugucugucaaaaccca

SEQ ID NO: 1852495 - RNA, 20 nt, Salmonella typhimurium LT2
aaacacgauggcaaauaaua

SEQ ID NO: 1852496 - RNA, 17 nt, Salmonella typhimurium LT2
aaacacgccuccauaca

SEQ ID NO: 1852497 - RNA, 15 nt, Salmonella typhimurium LT2
aaacacgucuggaaa

SEQ ID NO: 1852498 - RNA, 15 nt, Salmonella typhimurium LT2
aaacacucuccacca

SEQ ID NO: 1852499 - RNA, 14 nt, Salmonella typhimurium LT2
aaacaccagaaugc

SEQ ID NO: 1852500 - RNA, 19 nt, Salmonella typhimurium LT2
aaacacagcucaauaucau

SEQ ID NO: 1852501 - RNA, 13 nt, Salmonella typhimurium LT2
aaacacaaauuuc

SEQ ID NO: 1852502 - RNA, 15 nt, Salmonella typhimurium LT2
aaacaagucagcguu

SEQ ID NO: 1852503 - RNA, 15 nt, Salmonella typhimurium LT2
aaacaucauuucuac

SEQ ID NO: 1852504 - RNA, 18 nt, Salmonella typhimurium LT2
aaacaucgguaauagcgg

SEQ ID NO: 1852505 - RNA, 16 nt, Salmonella typhimurium LT2
aaacaucugcuccagc

SEQ ID NO: 1852506 - RNA, 22 nt, Salmonella typhimurium LT2
aaaccaccauacccaacagcag

SEQ ID NO: 1852507 - RNA, 14 nt, Salmonella typhimurium LT2
aaaccacaaucaca

SEQ ID NO: 1852508 - RNA, 12 nt, Salmonella typhimurium LT2
aaaccacuccgg

SEQ ID NO: 1852509 - RNA, 15 nt, Salmonella typhimurium LT2
aaaccacuuaacguu

SEQ ID NO: 1852510 - RNA, 18 nt, Salmonella typhimurium LT2
aaaccacuuaacguuacc

SEQ ID NO: 1852511 - RNA, 16 nt, Salmonella typhimurium LT2
aaaccaaacaccagau

SEQ ID NO: 1852512 - RNA, 20 nt, Salmonella typhimurium LT2
aaaccaaccacggggcaugc

SEQ ID NO: 1852513 - RNA, 19 nt, Salmonella typhimurium LT2
aaaccaacguugaagagcu

SEQ ID NO: 1852514 - RNA, 20 nt, Salmonella typhimurium LT2
aaaccgcauaacgcgcuggu

SEQ ID NO: 1852515 - RNA, 14 nt, Salmonella typhimurium LT2
aaaccgcccugcag

SEQ ID NO: 1852516 - RNA, 22 nt, Salmonella typhimurium LT2
aaaccgcucgccgccucccccu

SEQ ID NO: 1852517 - RNA, 19 nt, Salmonella typhimurium LT2
aaaccggcggucaugcugg

SEQ ID NO: 1852518 - RNA, 15 nt, Salmonella typhimurium LT2
aaaccggggagcuau

SEQ ID NO: 1852519 - RNA, 20 nt, Salmonella typhimurium LT2
aaaccggguaacagcauuga

SEQ ID NO: 1852520 - RNA, 20 nt, Salmonella typhimurium LT2
aaaccggucaggcagcagac

SEQ ID NO: 1852521 - RNA, 18 nt, Salmonella typhimurium LT2
aaacccguuaaauaccag

SEQ ID NO: 1852522 - RNA, 15 nt, Salmonella typhimurium LT2
aaaccgaauucgucc

SEQ ID NO: 1852523 - RNA, 22 nt, Salmonella typhimurium LT2
aaaccgaaaggguauacaaaaa

SEQ ID NO: 1852524 - RNA, 15 nt, Salmonella typhimurium LT2
aaaccgcagaaaaag

SEQ ID NO: 1852525 - RNA, 17 nt, Salmonella typhimurium LT2
aaaccgauaaucaccag

SEQ ID NO: 1852526 - RNA, 16 nt, Salmonella typhimurium LT2
aaaccgacccaaaaau

SEQ ID NO: 1852527 - RNA, 14 nt, Salmonella typhimurium LT2
aaaccagcauaaua

SEQ ID NO: 1852528 - RNA, 16 nt, Salmonella typhimurium LT2
aaaccagcauaauauu

SEQ ID NO: 1852529 - RNA, 13 nt, Salmonella typhimurium LT2
aaaccaggcaaca

SEQ ID NO: 1852530 - RNA, 17 nt, Salmonella typhimurium LT2
aaaccaggcgaaaauag

SEQ ID NO: 1852531 - RNA, 17 nt, Salmonella typhimurium LT2
aaaccaguugccagggu

SEQ ID NO: 1852532 - RNA, 17 nt, Salmonella typhimurium LT2
aaaccaggcauuuucuu

SEQ ID NO: 1852533 - RNA, 15 nt, Salmonella typhimurium LT2
aaaccaugaucguca

SEQ ID NO: 1852534 - RNA, 21 nt, Salmonella typhimurium LT2
aaaccauucaaauucaauaaa

SEQ ID NO: 1852535 - RNA, 16 nt, Salmonella typhimurium LT2
aaacccagaaucagca

SEQ ID NO: 1852536 - RNA, 13 nt, Salmonella typhimurium LT2
aaacccgccaccg

SEQ ID NO: 1852537 - RNA, 14 nt, Salmonella typhimurium LT2
aacaacaggccaga

SEQ ID NO: 1852538 - RNA, 14 nt, Salmonella typhimurium LT2
aacaaauaaaucca

SEQ ID NO: 1852539 - RNA, 17 nt, Salmonella typhimurium LT2
aacaaauaaauccauga

SEQ ID NO: 1852540 - RNA, 18 nt, Salmonella typhimurium LT2
aacaaauaaauccaugag

SEQ ID NO: 1852541 - RNA, 19 nt, Salmonella typhimurium LT2
aacaaaucgcaacagauca

SEQ ID NO: 1852542 - RNA, 14 nt, Salmonella typhimurium LT2
aacaaccggcuggc

SEQ ID NO: 1852543 - RNA, 17 nt, Salmonella typhimurium LT2
aacaaccggcuggcuau

SEQ ID NO: 1852544 - RNA, 21 nt, Salmonella typhimurium LT2
aacaacuccagcaaaucaauu

SEQ ID NO: 1852545 - RNA, 17 nt, Salmonella typhimurium LT2
aacaagauuaauuuaau

SEQ ID NO: 1852546 - RNA, 22 nt, Salmonella typhimurium LT2
aacaagauuaauuuaauugaua

SEQ ID NO: 1852547 - RNA, 15 nt, Salmonella typhimurium LT2
aacaaaauuguauca

SEQ ID NO: 1852548 - RNA, 16 nt, Salmonella typhimurium LT2
aacaaacuuaauuauu

SEQ ID NO: 1852549 - RNA, 20 nt, Salmonella typhimurium LT2
aacaaaggguaccugggcaa

SEQ ID NO: 1852550 - RNA, 10 nt, Salmonella typhimurium LT2
aaauuuucau

SEQ ID NO: 1852551 - RNA, 20 nt, Salmonella typhimurium LT2
aaauuuucauuauaaaacuu

SEQ ID NO: 1852552 - RNA, 19 nt, Salmonella typhimurium LT2
aaauucaacguauuaacau

SEQ ID NO: 1852553 - RNA, 22 nt, Salmonella typhimurium LT2
aaauugcgucaucauccgguaa

SEQ ID NO: 1852554 - RNA, 20 nt, Salmonella typhimurium LT2
aaauugcuauaccgcuuuau

SEQ ID NO: 1852555 - RNA, 19 nt, Salmonella typhimurium LT2
aaauugcgcgcggcccacu

SEQ ID NO: 1852556 - RNA, 19 nt, Salmonella typhimurium LT2
aaauuggugauauaaacgg

SEQ ID NO: 1852557 - RNA, 15 nt, Salmonella typhimurium LT2
aaauuggugauauaa

SEQ ID NO: 1852558 - RNA, 12 nt, Salmonella typhimurium LT2
aaauugcuuucu

SEQ ID NO: 1852559 - RNA, 14 nt, Salmonella typhimurium LT2
aaauugcuuucuag

SEQ ID NO: 1852560 - RNA, 20 nt, Salmonella typhimurium LT2
aaauuuucaaccacggauaa

SEQ ID NO: 1852561 - RNA, 19 nt, Salmonella typhimurium LT2
aaauuucaguggucaggcg

SEQ ID NO: 1852562 - RNA, 12 nt, Salmonella typhimurium LT2
aaauuuccucuu

SEQ ID NO: 1852563 - RNA, 16 nt, Salmonella typhimurium LT2
aaauuuaauauaugaa

SEQ ID NO: 1852564 - RNA, 18 nt, Salmonella typhimurium LT2
aaauuguuuaaaaacagg

SEQ ID NO: 1852565 - RNA, 14 nt, Salmonella typhimurium LT2
aaauccggccucca

SEQ ID NO: 1852566 - RNA, 19 nt, Salmonella typhimurium LT2
aaauccggcugccugccgg

SEQ ID NO: 1852567 - RNA, 18 nt, Salmonella typhimurium LT2
aaauccucccaucgagcc

SEQ ID NO: 1852568 - RNA, 18 nt, Salmonella typhimurium LT2
aaauccgccggaaacugg

SEQ ID NO: 1852569 - RNA, 20 nt, Salmonella typhimurium LT2
aaauccuuccagcgccauaa

SEQ ID NO: 1852570 - RNA, 15 nt, Salmonella typhimurium LT2
aaaucggcuccggca

SEQ ID NO: 1852571 - RNA, 18 nt, Salmonella typhimurium LT2
aaaucgacuggugauuuu

SEQ ID NO: 1852572 - RNA, 20 nt, Salmonella typhimurium LT2
aaauccaaucugacacagag

SEQ ID NO: 1852573 - RNA, 22 nt, Salmonella typhimurium LT2
aaauccaacauagcuaaauuaa

SEQ ID NO: 1852574 - RNA, 13 nt, Salmonella typhimurium LT2
aaaucccauugcc

SEQ ID NO: 1852575 - RNA, 22 nt, Salmonella typhimurium LT2
aaaucccauugcccgcugcgca

SEQ ID NO: 1852576 - RNA, 17 nt, Salmonella typhimurium LT2
aaauccagggaaaccau

SEQ ID NO: 1852577 - RNA, 19 nt, Salmonella typhimurium LT2
aaauccagggaaaccaugu

SEQ ID NO: 1852578 - RNA, 22 nt, Salmonella typhimurium LT2
aaaugagauugauaaucagcaa

SEQ ID NO: 1852579 - RNA, 18 nt, Salmonella typhimurium LT2
aaaugacgcccugcgcca

SEQ ID NO: 1852580 - RNA, 16 nt, Salmonella typhimurium LT2
aaaugacgccggguaa

SEQ ID NO: 1852581 - RNA, 13 nt, Salmonella typhimurium LT2
aaaugaauaccaa

SEQ ID NO: 1852582 - RNA, 16 nt, Salmonella typhimurium LT2
aaaucgggccuccgcg

SEQ ID NO: 1852583 - RNA, 23 nt, Salmonella typhimurium LT2
aaaucggugcuuccggcacugcg

SEQ ID NO: 1852584 - RNA, 10 nt, Salmonella typhimurium LT2
aaaugauaag

SEQ ID NO: 1852585 - RNA, 15 nt, Salmonella typhimurium LT2
aaaugaucacuuccg

SEQ ID NO: 1852586 - RNA, 21 nt, Salmonella typhimurium LT2
aaaugggccggauagcgcugu

SEQ ID NO: 1852587 - RNA, 16 nt, Salmonella typhimurium LT2
aaauggguaucgccuu

SEQ ID NO: 1852588 - RNA, 21 nt, Salmonella typhimurium LT2
aaauguuguuugaaaagugaa

SEQ ID NO: 1852589 - RNA, 18 nt, Salmonella typhimurium LT2
aaauguuugcuuuagcuu

SEQ ID NO: 1852590 - RNA, 19 nt, Salmonella typhimurium LT2
aaauggucccugauauaca

SEQ ID NO: 1852591 - RNA, 17 nt, Salmonella typhimurium LT2
aaauguaggccggauaa

SEQ ID NO: 1852592 - RNA, 11 nt, Salmonella typhimurium LT2
aaaaagagaag

SEQ ID NO: 1852593 - RNA, 15 nt, Salmonella typhimurium LT2
aaaaagagaaaaaau

SEQ ID NO: 1852594 - RNA, 16 nt, Salmonella typhimurium LT2
aaaaagagaaaaaauu

SEQ ID NO: 1852595 - RNA, 14 nt, Salmonella typhimurium LT2
aaaaagaggaaagc

SEQ ID NO: 1852596 - RNA, 17 nt, Salmonella typhimurium LT2
aaauuacuuaugauaua

SEQ ID NO: 1852597 - RNA, 19 nt, Salmonella typhimurium LT2
aaagucgucaauagaggcc

SEQ ID NO: 1852598 - RNA, 18 nt, Salmonella typhimurium LT2
aaagugaaggccagacuu

SEQ ID NO: 1852599 - RNA, 18 nt, Salmonella typhimurium LT2
aaagugauucacuuucuu

SEQ ID NO: 1852600 - RNA, 20 nt, Salmonella typhimurium LT2
aaagugauaaauaucgcguu

SEQ ID NO: 1852601 - RNA, 23 nt, Salmonella typhimurium LT2
aaagugaccgaucugguugucca

SEQ ID NO: 1852602 - RNA, 20 nt, Salmonella typhimurium LT2
aaagugaccguaauagaguu

SEQ ID NO: 1852603 - RNA, 21 nt, Salmonella typhimurium LT2
aaagugaccguaauagaguuu

SEQ ID NO: 1852604 - RNA, 23 nt, Salmonella typhimurium LT2
aaagugccagggcggaagcagau

SEQ ID NO: 1852605 - RNA, 19 nt, Salmonella typhimurium LT2
aaaguggcauccgaagaac

SEQ ID NO: 1852606 - RNA, 11 nt, Salmonella typhimurium LT2
aaauaaaaacc

SEQ ID NO: 1852607 - RNA, 19 nt, Salmonella typhimurium LT2
aaauaaaaaccauuuauaa

SEQ ID NO: 1852608 - RNA, 13 nt, Salmonella typhimurium LT2
aaaguuauucacg

SEQ ID NO: 1852609 - RNA, 14 nt, Salmonella typhimurium LT2
aaaguuaaucagcg

SEQ ID NO: 1852610 - RNA, 16 nt, Salmonella typhimurium LT2
aaaguuaaucagcgcu

SEQ ID NO: 1852611 - RNA, 19 nt, Salmonella typhimurium LT2
aaaguuagccccuuaucaa

SEQ ID NO: 1852612 - RNA, 15 nt, Salmonella typhimurium LT2
aaaguugcaucaaga

SEQ ID NO: 1852613 - RNA, 19 nt, Salmonella typhimurium LT2
aaauaaugccucauuaaaa

SEQ ID NO: 1852614 - RNA, 23 nt, Salmonella typhimurium LT2
aaauaaugccucauuaaaaaaac

SEQ ID NO: 1852615 - RNA, 13 nt, Salmonella typhimurium LT2
aaauacagaugcu

SEQ ID NO: 1852616 - RNA, 17 nt, Salmonella typhimurium LT2
aaauaauuuuguuaaag

SEQ ID NO: 1852617 - RNA, 16 nt, Salmonella typhimurium LT2
aaauaccagcaccuga

SEQ ID NO: 1852618 - RNA, 20 nt, Salmonella typhimurium LT2
aaauacccuuaugauagccg

SEQ ID NO: 1852619 - RNA, 9 nt, Salmonella typhimurium LT2
aaauaccag

SEQ ID NO: 1852620 - RNA, 12 nt, Salmonella typhimurium LT2
aaauaccacauc

SEQ ID NO: 1852621 - RNA, 13 nt, Salmonella typhimurium LT2
aaauaccacauca

SEQ ID NO: 1852622 - RNA, 13 nt, Salmonella typhimurium LT2
aaauacaucgcca

SEQ ID NO: 1852623 - RNA, 21 nt, Salmonella typhimurium LT2
aaauaccugccgaccucacug

SEQ ID NO: 1852624 - RNA, 17 nt, Salmonella typhimurium LT2
aaauaucgcugcccaga

SEQ ID NO: 1852625 - RNA, 17 nt, Salmonella typhimurium LT2
aaauaucgcguuaauuu

SEQ ID NO: 1852626 - RNA, 21 nt, Salmonella typhimurium LT2
aaauaucgcguuaauuuuuag

SEQ ID NO: 1852627 - RNA, 19 nt, Salmonella typhimurium LT2
aaauaucgaugcuuauuau

SEQ ID NO: 1852628 - RNA, 21 nt, Salmonella typhimurium LT2
aaauaucauuagcgucauacu

SEQ ID NO: 1852629 - RNA, 16 nt, Salmonella typhimurium LT2
aaauauauaauuuaua

SEQ ID NO: 1852630 - RNA, 20 nt, Salmonella typhimurium LT2
aaauauagccauuuaaugau

SEQ ID NO: 1852631 - RNA, 21 nt, Salmonella typhimurium LT2
aaauagacgagcgaaaaacug

SEQ ID NO: 1852632 - RNA, 19 nt, Salmonella typhimurium LT2
aaagaccauccgguuuuaa

SEQ ID NO: 1852633 - RNA, 18 nt, Salmonella typhimurium LT2
aaagagggugaaccaaag

SEQ ID NO: 1852634 - RNA, 17 nt, Salmonella typhimurium LT2
aaagcaaucgccagcgc

SEQ ID NO: 1852635 - RNA, 12 nt, Salmonella typhimurium LT2
aaagcaauguaa

SEQ ID NO: 1852636 - RNA, 14 nt, Salmonella typhimurium LT2
aaagcagcugcugg

SEQ ID NO: 1852637 - RNA, 16 nt, Salmonella typhimurium LT2
aaagcaaucgccagcg

SEQ ID NO: 1852638 - RNA, 18 nt, Salmonella typhimurium LT2
aaagauugcuguccaggu

SEQ ID NO: 1852639 - RNA, 17 nt, Salmonella typhimurium LT2
aaagauuacaccacuuu

SEQ ID NO: 1852640 - RNA, 18 nt, Salmonella typhimurium LT2
aaagaaaguagaucacca

SEQ ID NO: 1852641 - RNA, 14 nt, Salmonella typhimurium LT2
aaagaaaacaucag

SEQ ID NO: 1852642 - RNA, 21 nt, Salmonella typhimurium LT2
aaagaacacaggcagccaggu

SEQ ID NO: 1852643 - RNA, 21 nt, Salmonella typhimurium LT2
aaagaagaaaccgcagaaaaa

SEQ ID NO: 1852644 - RNA, 23 nt, Salmonella typhimurium LT2
aaagaagaaaccgcagaaaaagc

SEQ ID NO: 1852645 - RNA, 19 nt, Salmonella typhimurium LT2
aaagaagaaaaaauuaaaa

SEQ ID NO: 1852646 - RNA, 22 nt, Salmonella typhimurium LT2
aaagaacgacgaauaagcugaa

SEQ ID NO: 1852647 - RNA, 16 nt, Salmonella typhimurium LT2
aaagaaccaacaccag

SEQ ID NO: 1852648 - RNA, 12 nt, Salmonella typhimurium LT2
aaagaagaauaa

SEQ ID NO: 1852649 - RNA, 16 nt, Salmonella typhimurium LT2
aaagaaucgccaggcg

SEQ ID NO: 1852650 - RNA, 17 nt, Salmonella typhimurium LT2
aaagaaugaaaaaaaau

SEQ ID NO: 1852651 - RNA, 17 nt, Salmonella typhimurium LT2
aaaguaaauaagaaaau

SEQ ID NO: 1852652 - RNA, 20 nt, Salmonella typhimurium LT2
aaaguaaggcugauuauaua

SEQ ID NO: 1852653 - RNA, 21 nt, Salmonella typhimurium LT2
aaaguaaggcugauuauauaa

SEQ ID NO: 1852654 - RNA, 14 nt, Salmonella typhimurium LT2
aaaggcuaccgguu

SEQ ID NO: 1852655 - RNA, 16 nt, Salmonella typhimurium LT2
aaaggcuugacucaaa

SEQ ID NO: 1852656 - RNA, 12 nt, Salmonella typhimurium LT2
aaaggcuuuaaa

SEQ ID NO: 1852657 - RNA, 20 nt, Salmonella typhimurium LT2
aaaggcuuuuuaaucaaaau

SEQ ID NO: 1852658 - RNA, 20 nt, Salmonella typhimurium LT2
aaagcugcaccaggagcaaa

SEQ ID NO: 1852659 - RNA, 15 nt, Salmonella typhimurium LT2
aaaggaaagggacga

SEQ ID NO: 1852660 - RNA, 23 nt, Salmonella typhimurium LT2
aaaggccuggcugagaaaaauac

SEQ ID NO: 1852661 - RNA, 12 nt, Salmonella typhimurium LT2
aaaggaucgauu

SEQ ID NO: 1852662 - RNA, 17 nt, Salmonella typhimurium LT2
aaaggagguucaucaug

SEQ ID NO: 1852663 - RNA, 22 nt, Salmonella typhimurium LT2
aaaggaggaaaagcgaccauuc

SEQ ID NO: 1852664 - RNA, 19 nt, Salmonella typhimurium LT2
aaaggacguucuucuccca

SEQ ID NO: 1852665 - RNA, 19 nt, Salmonella typhimurium LT2
aaagcgacucauccacaua

SEQ ID NO: 1852666 - RNA, 14 nt, Salmonella typhimurium LT2
aaagcgaaaauaaa

SEQ ID NO: 1852667 - RNA, 19 nt, Salmonella typhimurium LT2
aaagccuguuuaccaagca

SEQ ID NO: 1852668 - RNA, 16 nt, Salmonella typhimurium LT2
aaagcaucugccggca

SEQ ID NO: 1852669 - RNA, 16 nt, Salmonella typhimurium LT2
aaagcucgucuguugu

SEQ ID NO: 1852670 - RNA, 18 nt, Salmonella typhimurium LT2
aaagcucaccugcucgcc

SEQ ID NO: 1852671 - RNA, 22 nt, Salmonella typhimurium LT2
aaagcgucgcgucagcaaaaug

SEQ ID NO: 1852672 - RNA, 23 nt, Salmonella typhimurium LT2
aaagcguaugcugauaaagagca

SEQ ID NO: 1852673 - RNA, 17 nt, Salmonella typhimurium LT2
aaagcgguaauaacuga

SEQ ID NO: 1852674 - RNA, 20 nt, Salmonella typhimurium LT2
aaagcggauggccugcucga

SEQ ID NO: 1852675 - RNA, 18 nt, Salmonella typhimurium LT2
aaagcgcugagucaggcg

SEQ ID NO: 1852676 - RNA, 22 nt, Salmonella typhimurium LT2
aaagcgcucguuauaauugccc

SEQ ID NO: 1852677 - RNA, 21 nt, Salmonella typhimurium LT2
aaagcgcgccgaaaauauaca

SEQ ID NO: 1852678 - RNA, 15 nt, Salmonella typhimurium LT2
aacaggccagaauaa

SEQ ID NO: 1852679 - RNA, 20 nt, Salmonella typhimurium LT2
aacaggcuauaacgcaccac

SEQ ID NO: 1852680 - RNA, 16 nt, Salmonella typhimurium LT2
aacaggcuuuucaggc

SEQ ID NO: 1852681 - RNA, 21 nt, Salmonella typhimurium LT2
aacagggugacucauuucaac

SEQ ID NO: 1852682 - RNA, 21 nt, Salmonella typhimurium LT2
aacagcguaccuuuaucuuga

SEQ ID NO: 1852683 - RNA, 14 nt, Salmonella typhimurium LT2
aacaaggcaucuau

SEQ ID NO: 1852684 - RNA, 16 nt, Salmonella typhimurium LT2
aacagcgcgaccagga

SEQ ID NO: 1852685 - RNA, 16 nt, Salmonella typhimurium LT2
aacagcgcggcaggcc

SEQ ID NO: 1852686 - RNA, 20 nt, Salmonella typhimurium LT2
aacagcgcguccagcggcaa

SEQ ID NO: 1852687 - RNA, 12 nt, Salmonella typhimurium LT2
aacaucauaaua

SEQ ID NO: 1852688 - RNA, 22 nt, Salmonella typhimurium LT2
aacaucagaaaaaagccaagca

SEQ ID NO: 1852689 - RNA, 16 nt, Salmonella typhimurium LT2
aacaucagccagcagc

SEQ ID NO: 1852690 - RNA, 18 nt, Salmonella typhimurium LT2
aacauagcuuacuuuuag

SEQ ID NO: 1852691 - RNA, 15 nt, Salmonella typhimurium LT2
aacauauaaaucagu

SEQ ID NO: 1852692 - RNA, 12 nt, Salmonella typhimurium LT2
aacauauauauc

SEQ ID NO: 1852693 - RNA, 19 nt, Salmonella typhimurium LT2
aacauagcggcaaggaaaa

SEQ ID NO: 1852694 - RNA, 23 nt, Salmonella typhimurium LT2
aacauagcggcaaggaaaaccag

SEQ ID NO: 1852695 - RNA, 16 nt, Salmonella typhimurium LT2
aacauagagaucacgc

SEQ ID NO: 1852696 - RNA, 23 nt, Salmonella typhimurium LT2
aacagucccaccagcgcggcaca

SEQ ID NO: 1852697 - RNA, 22 nt, Salmonella typhimurium LT2
aacaguccaggaaagagggcag

SEQ ID NO: 1852698 - RNA, 17 nt, Salmonella typhimurium LT2
aacagucgcgccgugcc

SEQ ID NO: 1852699 - RNA, 17 nt, Salmonella typhimurium LT2
aacaguguaaacgccag

SEQ ID NO: 1852700 - RNA, 22 nt, Salmonella typhimurium LT2
aacaguucauuucaggcaaagg

SEQ ID NO: 1852701 - RNA, 13 nt, Salmonella typhimurium LT2
aaccacuucugac

SEQ ID NO: 1852702 - RNA, 22 nt, Salmonella typhimurium LT2
aaccagaaaaccgacagcaaua

SEQ ID NO: 1852703 - RNA, 19 nt, Salmonella typhimurium LT2
aaccaccagcggaaucccc

SEQ ID NO: 1852704 - RNA, 13 nt, Salmonella typhimurium LT2
aaccaccagcagu

SEQ ID NO: 1852705 - RNA, 22 nt, Salmonella typhimurium LT2
aacaugguggagucuaaaaaua

SEQ ID NO: 1852706 - RNA, 14 nt, Salmonella typhimurium LT2
aacauggggagcag

SEQ ID NO: 1852707 - RNA, 16 nt, Salmonella typhimurium LT2
aacauggguuucuugc

SEQ ID NO: 1852708 - RNA, 21 nt, Salmonella typhimurium LT2
aacaugcccaccggaccuaau

SEQ ID NO: 1852709 - RNA, 22 nt, Salmonella typhimurium LT2
aacaugcccggacgaugucuga

SEQ ID NO: 1852710 - RNA, 15 nt, Salmonella typhimurium LT2
aacaucguaaaucaa

SEQ ID NO: 1852711 - RNA, 19 nt, Salmonella typhimurium LT2
aacaucguaaaucaaauga

SEQ ID NO: 1852712 - RNA, 20 nt, Salmonella typhimurium LT2
aacaucuaccgcauacugaa

SEQ ID NO: 1852713 - RNA, 14 nt, Salmonella typhimurium LT2
aacaucucacuagc

SEQ ID NO: 1852714 - RNA, 21 nt, Salmonella typhimurium LT2
aacaucucacuagcauaagca

SEQ ID NO: 1852715 - RNA, 15 nt, Salmonella typhimurium LT2
aaccaguuuuucauu

SEQ ID NO: 1852716 - RNA, 18 nt, Salmonella typhimurium LT2
aaccaguugccaggguuc

SEQ ID NO: 1852717 - RNA, 18 nt, Salmonella typhimurium LT2
aaccagugaauacugcgc

SEQ ID NO: 1852718 - RNA, 19 nt, Salmonella typhimurium LT2
aaccagugaauacugcgcg

SEQ ID NO: 1852719 - RNA, 14 nt, Salmonella typhimurium LT2
aaccccaaacacca

SEQ ID NO: 1852720 - RNA, 15 nt, Salmonella typhimurium LT2
aaccccaaacaccaa

SEQ ID NO: 1852721 - RNA, 19 nt, Salmonella typhimurium LT2
aaccccacccgcugauaaa

SEQ ID NO: 1852722 - RNA, 12 nt, Salmonella typhimurium LT2
aaccauacauug

SEQ ID NO: 1852723 - RNA, 23 nt, Salmonella typhimurium LT2
aaccauacauugaguaaauaaau

SEQ ID NO: 1852724 - RNA, 17 nt, Salmonella typhimurium LT2
aaccccuuuagcggcau

SEQ ID NO: 1852725 - RNA, 14 nt, Salmonella typhimurium LT2
aacccgauacccug

SEQ ID NO: 1852726 - RNA, 16 nt, Salmonella typhimurium LT2
aacccgaucgccaucc

SEQ ID NO: 1852727 - RNA, 16 nt, Salmonella typhimurium LT2
aaccccgauaaaccag

SEQ ID NO: 1852728 - RNA, 22 nt, Salmonella typhimurium LT2
aaccccggcaaaccuaccggca

SEQ ID NO: 1852729 - RNA, 22 nt, Salmonella typhimurium LT2
aaccccaggucagcaguuuuuc

SEQ ID NO: 1852730 - RNA, 16 nt, Salmonella typhimurium LT2
aaccccagcugcggca

SEQ ID NO: 1852731 - RNA, 23 nt, Salmonella typhimurium LT2
aaccaggauucaacgcgugaucc

SEQ ID NO: 1852732 - RNA, 16 nt, Salmonella typhimurium LT2
aaccagguuuccagau

SEQ ID NO: 1852733 - RNA, 16 nt, Salmonella typhimurium LT2
aaccaguaacggcagu

SEQ ID NO: 1852734 - RNA, 18 nt, Salmonella typhimurium LT2
aaccaggcaaaccagcac

SEQ ID NO: 1852735 - RNA, 13 nt, Salmonella typhimurium LT2
aaccaggcaacag

SEQ ID NO: 1852736 - RNA, 11 nt, Salmonella typhimurium LT2
aaccaggcaaa

SEQ ID NO: 1852737 - RNA, 16 nt, Salmonella typhimurium LT2
aaccaggcgaaaauag

SEQ ID NO: 1852738 - RNA, 18 nt, Salmonella typhimurium LT2
aaccaggcgaaaauaggc

SEQ ID NO: 1852739 - RNA, 21 nt, Salmonella typhimurium LT2
aaccagacccgcugcgucacg

SEQ ID NO: 1852740 - RNA, 14 nt, Salmonella typhimurium LT2
aaccagauuuuuca

SEQ ID NO: 1852741 - RNA, 21 nt, Salmonella typhimurium LT2
aaccagauuuuucaccaucug

SEQ ID NO: 1852742 - RNA, 17 nt, Salmonella typhimurium LT2
aaccagcaaugagacaa

SEQ ID NO: 1852743 - RNA, 17 nt, Salmonella typhimurium LT2
aaccagcauaauauuca

SEQ ID NO: 1852744 - RNA, 18 nt, Salmonella typhimurium LT2
aaccagcccaugaaugag

SEQ ID NO: 1852745 - RNA, 16 nt, Salmonella typhimurium LT2
aaccagcgaaaugaca

SEQ ID NO: 1852746 - RNA, 24 nt, Salmonella typhimurium LT2
aaccagcgaaaugacagccaccag

SEQ ID NO: 1852747 - RNA, 18 nt, Salmonella typhimurium LT2
aaccagccccagaaaauu

SEQ ID NO: 1852748 - RNA, 19 nt, Salmonella typhimurium LT2
aaccagccccagaaaauua

SEQ ID NO: 1852749 - RNA, 17 nt, Salmonella typhimurium LT2
aaccuucauaaauacgu

SEQ ID NO: 1852750 - RNA, 16 nt, Salmonella typhimurium LT2
aaccuucaaguuuuag

SEQ ID NO: 1852751 - RNA, 17 nt, Salmonella typhimurium LT2
aaccuucaagaaucaau

SEQ ID NO: 1852752 - RNA, 14 nt, Salmonella typhimurium LT2
aaccuuauauaugu

SEQ ID NO: 1852753 - RNA, 21 nt, Salmonella typhimurium LT2
aaccugagcgcgaacgcucca

SEQ ID NO: 1852754 - RNA, 14 nt, Salmonella typhimurium LT2
aaccugagaauauu

SEQ ID NO: 1852755 - RNA, 15 nt, Salmonella typhimurium LT2
aaccugagaauauua

SEQ ID NO: 1852756 - RNA, 18 nt, Salmonella typhimurium LT2
aaccugaugcgucagaua

SEQ ID NO: 1852757 - RNA, 13 nt, Salmonella typhimurium LT2
aaccugcgaaaag

SEQ ID NO: 1852758 - RNA, 16 nt, Salmonella typhimurium LT2
aaccugccguuuucca

SEQ ID NO: 1852759 - RNA, 21 nt, Salmonella typhimurium LT2
aaccugcccuuucuucaacgg

SEQ ID NO: 1852760 - RNA, 16 nt, Salmonella typhimurium LT2
aaccucacggagaaaa

SEQ ID NO: 1852761 - RNA, 19 nt, Salmonella typhimurium LT2
aaccucaauagguguaucc

SEQ ID NO: 1852762 - RNA, 20 nt, Salmonella typhimurium LT2
aaccucaucccggcuuaaau

SEQ ID NO: 1852763 - RNA, 20 nt, Salmonella typhimurium LT2
aaccucauuucucaaaaaca

SEQ ID NO: 1852764 - RNA, 13 nt, Salmonella typhimurium LT2
aaccucccgccgg

SEQ ID NO: 1852765 - RNA, 12 nt, Salmonella typhimurium LT2
aaccuaaaaacc

SEQ ID NO: 1852766 - RNA, 17 nt, Salmonella typhimurium LT2
aaccguuggggaaaaua

SEQ ID NO: 1852767 - RNA, 18 nt, Salmonella typhimurium LT2
aaccggucaggcagcaga

SEQ ID NO: 1852768 - RNA, 20 nt, Salmonella typhimurium LT2
aaccguaaacgccugcacca

SEQ ID NO: 1852769 - RNA, 16 nt, Salmonella typhimurium LT2
aaccggguugcggaag

SEQ ID NO: 1852770 - RNA, 15 nt, Salmonella typhimurium LT2
aacccgccuucaguc

SEQ ID NO: 1852771 - RNA, 18 nt, Salmonella typhimurium LT2
aacccgcauuaacugccu

SEQ ID NO: 1852772 - RNA, 16 nt, Salmonella typhimurium LT2
aacccgauucugccag

SEQ ID NO: 1852773 - RNA, 18 nt, Salmonella typhimurium LT2
aaccgucucaccaggcgu

SEQ ID NO: 1852774 - RNA, 22 nt, Salmonella typhimurium LT2
aacgcaucaaauaccuuuucau

SEQ ID NO: 1852775 - RNA, 13 nt, Salmonella typhimurium LT2
aacgcaucacaug

SEQ ID NO: 1852776 - RNA, 21 nt, Salmonella typhimurium LT2
aacgcaggcgauagccccagu

SEQ ID NO: 1852777 - RNA, 18 nt, Salmonella typhimurium LT2
aacgcauacgcagcacuu

SEQ ID NO: 1852778 - RNA, 13 nt, Salmonella typhimurium LT2
aacgcaggcugga

SEQ ID NO: 1852779 - RNA, 17 nt, Salmonella typhimurium LT2
aacgaggccaccaucac

SEQ ID NO: 1852780 - RNA, 21 nt, Salmonella typhimurium LT2
aacgagccgucgcuaucaaua

SEQ ID NO: 1852781 - RNA, 21 nt, Salmonella typhimurium LT2
aacgaguugcggcaacgugaa

SEQ ID NO: 1852782 - RNA, 19 nt, Salmonella typhimurium LT2
aacgcacguacggaaggua

SEQ ID NO: 1852783 - RNA, 14 nt, Salmonella typhimurium LT2
aacgaccagguaau

SEQ ID NO: 1852784 - RNA, 15 nt, Salmonella typhimurium LT2
aacgacccaucaaua

SEQ ID NO: 1852785 - RNA, 17 nt, Salmonella typhimurium LT2
aacgacaaaaauaccac

SEQ ID NO: 1852786 - RNA, 18 nt, Salmonella typhimurium LT2
aacgcgcccaacggaugc

SEQ ID NO: 1852787 - RNA, 17 nt, Salmonella typhimurium LT2
aacgcgcgacuuaucuu

SEQ ID NO: 1852788 - RNA, 15 nt, Salmonella typhimurium LT2
aacgcgccacgaaca

SEQ ID NO: 1852789 - RNA, 23 nt, Salmonella typhimurium LT2
aacgcgucggcgcggggaacaca

SEQ ID NO: 1852790 - RNA, 18 nt, Salmonella typhimurium LT2
aacgcgggcguaauacau

SEQ ID NO: 1852791 - RNA, 15 nt, Salmonella typhimurium LT2
aacgcgcucgccagc

SEQ ID NO: 1852792 - RNA, 17 nt, Salmonella typhimurium LT2
aacgcgcucgccagcgc

SEQ ID NO: 1852793 - RNA, 21 nt, Salmonella typhimurium LT2
aacgcgaaaauaccccagcgc

SEQ ID NO: 1852794 - RNA, 17 nt, Salmonella typhimurium LT2
aacgcgaaggccagcac

SEQ ID NO: 1852795 - RNA, 14 nt, Salmonella typhimurium LT2
aacgcgaccagcgc

SEQ ID NO: 1852796 - RNA, 13 nt, Salmonella typhimurium LT2
aacgcgaaaauac

SEQ ID NO: 1852797 - RNA, 16 nt, Salmonella typhimurium LT2
aacgccuuauccggcc

SEQ ID NO: 1852798 - RNA, 15 nt, Salmonella typhimurium LT2
aacgccaacgcccgg

SEQ ID NO: 1852799 - RNA, 13 nt, Salmonella typhimurium LT2
aacgccugggaua

SEQ ID NO: 1852800 - RNA, 19 nt, Salmonella typhimurium LT2
aacgccugccgcgcccagu

SEQ ID NO: 1852801 - RNA, 23 nt, Salmonella typhimurium LT2
aacggcaaaacgugguaaaaagc

SEQ ID NO: 1852802 - RNA, 17 nt, Salmonella typhimurium LT2
aacggcgacaagaauau

SEQ ID NO: 1852803 - RNA, 18 nt, Salmonella typhimurium LT2
aacggcgagcuuuaauga

SEQ ID NO: 1852804 - RNA, 19 nt, Salmonella typhimurium LT2
aacggccagugaaauaaau

SEQ ID NO: 1852805 - RNA, 16 nt, Salmonella typhimurium LT2
aacggcauggacgugu

SEQ ID NO: 1852806 - RNA, 13 nt, Salmonella typhimurium LT2
aacgcuccagcag

SEQ ID NO: 1852807 - RNA, 16 nt, Salmonella typhimurium LT2
aacgcgugcaagggaa

SEQ ID NO: 1852808 - RNA, 14 nt, Salmonella typhimurium LT2
aacgcgugcucuuu

SEQ ID NO: 1852809 - RNA, 20 nt, Salmonella typhimurium LT2
aacgcucuuaccgcuaaaau

SEQ ID NO: 1852810 - RNA, 23 nt, Salmonella typhimurium LT2
aacgcucuuaccgcuaaaauacc

SEQ ID NO: 1852811 - RNA, 22 nt, Salmonella typhimurium LT2
aacggaucaugguugaaaaaag

SEQ ID NO: 1852812 - RNA, 15 nt, Salmonella typhimurium LT2
aacuucgauaauaaa

SEQ ID NO: 1852813 - RNA, 18 nt, Salmonella typhimurium LT2
aacuucgauaauaaaaua

SEQ ID NO: 1852814 - RNA, 20 nt, Salmonella typhimurium LT2
aacuucaugguacagaucca

SEQ ID NO: 1852815 - RNA, 18 nt, Salmonella typhimurium LT2
aacuguuaucauagacug

SEQ ID NO: 1852816 - RNA, 15 nt, Salmonella typhimurium LT2
aacuguucagccagc

SEQ ID NO: 1852817 - RNA, 16 nt, Salmonella typhimurium LT2
aacuguucagccagca

SEQ ID NO: 1852818 - RNA, 13 nt, Salmonella typhimurium LT2
aacuguuaucaua

SEQ ID NO: 1852819 - RNA, 14 nt, Salmonella typhimurium LT2
aacuguuuuucacu

SEQ ID NO: 1852820 - RNA, 22 nt, Salmonella typhimurium LT2
aacuucacgccaucgacaaagg

SEQ ID NO: 1852821 - RNA, 11 nt, Salmonella typhimurium LT2
aacuguugcgc

SEQ ID NO: 1852822 - RNA, 21 nt, Salmonella typhimurium LT2
aacugauaacgauaagugaag

SEQ ID NO: 1852823 - RNA, 20 nt, Salmonella typhimurium LT2
aacugauaguuuaaauccag

SEQ ID NO: 1852824 - RNA, 22 nt, Salmonella typhimurium LT2
aacugauccugcguuaacgacc

SEQ ID NO: 1852825 - RNA, 19 nt, Salmonella typhimurium LT2
aacugccccuugucguaau

SEQ ID NO: 1852826 - RNA, 21 nt, Salmonella typhimurium LT2
aacugcccggagccaauguug

SEQ ID NO: 1852827 - RNA, 13 nt, Salmonella typhimurium LT2
aacugccggggaa

SEQ ID NO: 1852828 - RNA, 17 nt, Salmonella typhimurium LT2
aacugccggggaaguac

SEQ ID NO: 1852829 - RNA, 21 nt, Salmonella typhimurium LT2
aacuguagaaugcuauaugca

SEQ ID NO: 1852830 - RNA, 14 nt, Salmonella typhimurium LT2
aacugucgccgcua

SEQ ID NO: 1852831 - RNA, 14 nt, Salmonella typhimurium LT2
aacugucugaauca

SEQ ID NO: 1852832 - RNA, 17 nt, Salmonella typhimurium LT2
aacuucucgcaggccaa

SEQ ID NO: 1852833 - RNA, 13 nt, Salmonella typhimurium LT2
aacuucuccucca

SEQ ID NO: 1852834 - RNA, 16 nt, Salmonella typhimurium LT2
aacuuguguucccacu

SEQ ID NO: 1852835 - RNA, 12 nt, Salmonella typhimurium LT2
aacuuucagaau

SEQ ID NO: 1852836 - RNA, 14 nt, Salmonella typhimurium LT2
aacuuugcgaaaaa

SEQ ID NO: 1852837 - RNA, 20 nt, Salmonella typhimurium LT2
aacuuugcgccauuucaaua

SEQ ID NO: 1852838 - RNA, 20 nt, Salmonella typhimurium LT2
aacucacauauucaauaaua

SEQ ID NO: 1852839 - RNA, 12 nt, Salmonella typhimurium LT2
aacucagcaaua

SEQ ID NO: 1852840 - RNA, 12 nt, Salmonella typhimurium LT2
aacucaucauca

SEQ ID NO: 1852841 - RNA, 17 nt, Salmonella typhimurium LT2
aacgggcuuuugaauaa

SEQ ID NO: 1852842 - RNA, 15 nt, Salmonella typhimurium LT2
aacuaugcaaaacgu

SEQ ID NO: 1852843 - RNA, 14 nt, Salmonella typhimurium LT2
aacgggccacugcu

SEQ ID NO: 1852844 - RNA, 18 nt, Salmonella typhimurium LT2
aacggcuuuccagcagcc

SEQ ID NO: 1852845 - RNA, 22 nt, Salmonella typhimurium LT2
aacggcucggguggcgcaguuu

SEQ ID NO: 1852846 - RNA, 17 nt, Salmonella typhimurium LT2
aacggcuuuccagcagc

SEQ ID NO: 1852847 - RNA, 23 nt, Salmonella typhimurium LT2
aacggcggaaccauuuuccccag

SEQ ID NO: 1852848 - RNA, 19 nt, Salmonella typhimurium LT2
aacggcgcuuuuaaaauaa

SEQ ID NO: 1852849 - RNA, 17 nt, Salmonella typhimurium LT2
aacggcgauacucugcc

SEQ ID NO: 1852850 - RNA, 23 nt, Salmonella typhimurium LT2
aacggcgguuuuuuuauccauuu

SEQ ID NO: 1852851 - RNA, 19 nt, Salmonella typhimurium LT2
aacggcgugaaucccccug

SEQ ID NO: 1852852 - RNA, 17 nt, Salmonella typhimurium LT2
aacucuauuaaaauaaa

SEQ ID NO: 1852853 - RNA, 18 nt, Salmonella typhimurium LT2
aacucuauuaaaauaaau

SEQ ID NO: 1852854 - RNA, 16 nt, Salmonella typhimurium LT2
aacugacgaucguggc

SEQ ID NO: 1852855 - RNA, 16 nt, Salmonella typhimurium LT2
aacugacagcagugac

SEQ ID NO: 1852856 - RNA, 18 nt, Salmonella typhimurium LT2
aacugacccgccagugcu

SEQ ID NO: 1852857 - RNA, 23 nt, Salmonella typhimurium LT2
aacucugugagcgucauauugcc

SEQ ID NO: 1852858 - RNA, 13 nt, Salmonella typhimurium LT2
aacucuucaacgg

SEQ ID NO: 1852859 - RNA, 22 nt, Salmonella typhimurium LT2
aacucuucaacggucucaggcu

SEQ ID NO: 1852860 - RNA, 14 nt, Salmonella typhimurium LT2
aacucugcuuuuau

SEQ ID NO: 1852861 - RNA, 12 nt, Salmonella typhimurium LT2
aacucugaaaac

SEQ ID NO: 1852862 - RNA, 20 nt, Salmonella typhimurium LT2
aacucuccaugccaucggcc

SEQ ID NO: 1852863 - RNA, 16 nt, Salmonella typhimurium LT2
aacuccugggcaaaau

SEQ ID NO: 1852864 - RNA, 16 nt, Salmonella typhimurium LT2
aacuccagcaaaucaa

SEQ ID NO: 1852865 - RNA, 14 nt, Salmonella typhimurium LT2
aacuccagcggcag

SEQ ID NO: 1852866 - RNA, 11 nt, Salmonella typhimurium LT2
aagagaaaaaa

SEQ ID NO: 1852867 - RNA, 14 nt, Salmonella typhimurium LT2
aagagaaaauaccg

SEQ ID NO: 1852868 - RNA, 13 nt, Salmonella typhimurium LT2
aagagaaaauacc

SEQ ID NO: 1852869 - RNA, 11 nt, Salmonella typhimurium LT2
aagagaaaacc

SEQ ID NO: 1852870 - RNA, 18 nt, Salmonella typhimurium LT2
aagacuggcccugccgga

SEQ ID NO: 1852871 - RNA, 20 nt, Salmonella typhimurium LT2
aagacgguuucagugauaaa

SEQ ID NO: 1852872 - RNA, 22 nt, Salmonella typhimurium LT2
aagacgucucuuucgacuggac

SEQ ID NO: 1852873 - RNA, 15 nt, Salmonella typhimurium LT2
aagacuccccugcag

SEQ ID NO: 1852874 - RNA, 18 nt, Salmonella typhimurium LT2
aagacgaaggggacaaaa

SEQ ID NO: 1852875 - RNA, 20 nt, Salmonella typhimurium LT2
aagacgguuguuuuucagau

SEQ ID NO: 1852876 - RNA, 21 nt, Salmonella typhimurium LT2
aagacgcgcucggcagcagcg

SEQ ID NO: 1852877 - RNA, 17 nt, Salmonella typhimurium LT2
aagaccgauagagacug

SEQ ID NO: 1852878 - RNA, 16 nt, Salmonella typhimurium LT2
aagaccccgccaggcg

SEQ ID NO: 1852879 - RNA, 14 nt, Salmonella typhimurium LT2
aagacccgaaccug

SEQ ID NO: 1852880 - RNA, 16 nt, Salmonella typhimurium LT2
aagacauggaguucca

SEQ ID NO: 1852881 - RNA, 23 nt, Salmonella typhimurium LT2
aagacaucguugauauuauuaaa

SEQ ID NO: 1852882 - RNA, 23 nt, Salmonella typhimurium LT2
aagacauucgggacaaaccccca

SEQ ID NO: 1852883 - RNA, 15 nt, Salmonella typhimurium LT2
aagacagcuuauacu

SEQ ID NO: 1852884 - RNA, 20 nt, Salmonella typhimurium LT2
aagacagcguaguuuauucu

SEQ ID NO: 1852885 - RNA, 24 nt, Salmonella typhimurium LT2
aagacauccgggccaacggcaucc

SEQ ID NO: 1852886 - RNA, 16 nt, Salmonella typhimurium LT2
aagaauuugaacucuu

SEQ ID NO: 1852887 - RNA, 16 nt, Salmonella typhimurium LT2
aagacaacguaaacgg

SEQ ID NO: 1852888 - RNA, 22 nt, Salmonella typhimurium LT2
aagacacagauuccagauguca

SEQ ID NO: 1852889 - RNA, 14 nt, Salmonella typhimurium LT2
aagaaugaaaaaaa

SEQ ID NO: 1852890 - RNA, 17 nt, Salmonella typhimurium LT2
aagauacggauucuuaa

SEQ ID NO: 1852891 - RNA, 16 nt, Salmonella typhimurium LT2
aagagugccagaaaca

SEQ ID NO: 1852892 - RNA, 17 nt, Salmonella typhimurium LT2
aagagucgauacgcuga

SEQ ID NO: 1852893 - RNA, 20 nt, Salmonella typhimurium LT2
aagaguccauucggccugcg

SEQ ID NO: 1852894 - RNA, 20 nt, Salmonella typhimurium LT2
aagauaagccgucauaaaau

SEQ ID NO: 1852895 - RNA, 23 nt, Salmonella typhimurium LT2
aagauaagccgucauaaaaucaa

SEQ ID NO: 1852896 - RNA, 20 nt, Salmonella typhimurium LT2
aagauaaacgacagcgccau

SEQ ID NO: 1852897 - RNA, 13 nt, Salmonella typhimurium LT2
aagauaaauaaaa

SEQ ID NO: 1852898 - RNA, 17 nt, Salmonella typhimurium LT2
aagauaaauaaaaaauu

SEQ ID NO: 1852899 - RNA, 14 nt, Salmonella typhimurium LT2
aagagauuagaacg

SEQ ID NO: 1852900 - RNA, 18 nt, Salmonella typhimurium LT2
aagagauuaacgaccagg

SEQ ID NO: 1852901 - RNA, 12 nt, Salmonella typhimurium LT2
aagagagcaaca

SEQ ID NO: 1852902 - RNA, 17 nt, Salmonella typhimurium LT2
aagagacacgcugaccu

SEQ ID NO: 1852903 - RNA, 17 nt, Salmonella typhimurium LT2
aagagaauggccagcac

SEQ ID NO: 1852904 - RNA, 18 nt, Salmonella typhimurium LT2
aauaaaucguguggcuga

SEQ ID NO: 1852905 - RNA, 20 nt, Salmonella typhimurium LT2
aauaaauccaugagaagaaa

SEQ ID NO: 1852906 - RNA, 22 nt, Salmonella typhimurium LT2
aauaaauccgcgcucagucacu

SEQ ID NO: 1852907 - RNA, 15 nt, Salmonella typhimurium LT2
aaguugaucauccuu

SEQ ID NO: 1852908 - RNA, 16 nt, Salmonella typhimurium LT2
aauaagaacuuuauca

SEQ ID NO: 1852909 - RNA, 14 nt, Salmonella typhimurium LT2
aauaagaaacugcu

SEQ ID NO: 1852910 - RNA, 14 nt, Salmonella typhimurium LT2
aauaaccccagcug

SEQ ID NO: 1852911 - RNA, 15 nt, Salmonella typhimurium LT2
aauaaccaccuguuc

SEQ ID NO: 1852912 - RNA, 13 nt, Salmonella typhimurium LT2
aauaaccagagua

SEQ ID NO: 1852913 - RNA, 15 nt, Salmonella typhimurium LT2
aauaacugacagacu

SEQ ID NO: 1852914 - RNA, 19 nt, Salmonella typhimurium LT2
aauaaccccagcugcggca

SEQ ID NO: 1852915 - RNA, 20 nt, Salmonella typhimurium LT2
aauaauaaaacggcucauca

SEQ ID NO: 1852916 - RNA, 16 nt, Salmonella typhimurium LT2
aauaauaaauuuucau

SEQ ID NO: 1852917 - RNA, 12 nt, Salmonella typhimurium LT2
aauaaggcuggc

SEQ ID NO: 1852918 - RNA, 12 nt, Salmonella typhimurium LT2
aauaaggcaccg

SEQ ID NO: 1852919 - RNA, 16 nt, Salmonella typhimurium LT2
aauaaggccugagcuu

SEQ ID NO: 1852920 - RNA, 15 nt, Salmonella typhimurium LT2
aauaagcgcucaggc

SEQ ID NO: 1852921 - RNA, 13 nt, Salmonella typhimurium LT2
aaaaauaaaaaaa

SEQ ID NO: 1852922 - RNA, 11 nt, Salmonella typhimurium LT2
aaaaauaaaaa

SEQ ID NO: 1852923 - RNA, 14 nt, Salmonella typhimurium LT2
aauaauuuuguuaa

SEQ ID NO: 1852924 - RNA, 14 nt, Salmonella typhimurium LT2
aaaaauccggauca

SEQ ID NO: 1852925 - RNA, 15 nt, Salmonella typhimurium LT2
aaaaauccccccucc

SEQ ID NO: 1852926 - RNA, 12 nt, Salmonella typhimurium LT2
aaaaauccagua

SEQ ID NO: 1852927 - RNA, 23 nt, Salmonella typhimurium LT2
aaaaaucccccauugccccaugu

SEQ ID NO: 1852928 - RNA, 19 nt, Salmonella typhimurium LT2
aauaaugccaaaauggaca

SEQ ID NO: 1852929 - RNA, 21 nt, Salmonella typhimurium LT2
aauaaugccucauuaaaaaaa

SEQ ID NO: 1852930 - RNA, 14 nt, Salmonella typhimurium LT2
aauaauguaaaaaa

SEQ ID NO: 1852931 - RNA, 16 nt, Salmonella typhimurium LT2
aauaauguaaaaaaau

SEQ ID NO: 1852932 - RNA, 12 nt, Salmonella typhimurium LT2
aauaaugcccac

SEQ ID NO: 1852933 - RNA, 19 nt, Salmonella typhimurium LT2
aauaaugaagacguugaau

SEQ ID NO: 1852934 - RNA, 18 nt, Salmonella typhimurium LT2
aaaaauagccgguugagu

SEQ ID NO: 1852935 - RNA, 14 nt, Salmonella typhimurium LT2
aauaccagcggcaa

SEQ ID NO: 1852936 - RNA, 17 nt, Salmonella typhimurium LT2
aauaccaaauauuucuu

SEQ ID NO: 1852937 - RNA, 20 nt, Salmonella typhimurium LT2
aauaccaauauuaaagaugc

SEQ ID NO: 1852938 - RNA, 19 nt, Salmonella typhimurium LT2
aauacacgcgacaaugcca

SEQ ID NO: 1852939 - RNA, 16 nt, Salmonella typhimurium LT2
aauaccaggcacuuga

SEQ ID NO: 1852940 - RNA, 20 nt, Salmonella typhimurium LT2
aauaccaggcacuugagaaa

SEQ ID NO: 1852941 - RNA, 15 nt, Salmonella typhimurium LT2
aaaaaugauguguuu

SEQ ID NO: 1852942 - RNA, 14 nt, Salmonella typhimurium LT2
aaaaaugauaagca

SEQ ID NO: 1852943 - RNA, 23 nt, Salmonella typhimurium LT2
aaaaaugauaagcacuauuauau

SEQ ID NO: 1852944 - RNA, 18 nt, Salmonella typhimurium LT2
aauacccauuucuucuuc

SEQ ID NO: 1852945 - RNA, 14 nt, Salmonella typhimurium LT2
aauaccgugcagga

SEQ ID NO: 1852946 - RNA, 21 nt, Salmonella typhimurium LT2
aauaccguggucuccgccugg

SEQ ID NO: 1852947 - RNA, 14 nt, Salmonella typhimurium LT2
aauagcgccagaca

SEQ ID NO: 1852948 - RNA, 13 nt, Salmonella typhimurium LT2
aauagccugggca

SEQ ID NO: 1852949 - RNA, 17 nt, Salmonella typhimurium LT2
aauagcuggcugucuuc

SEQ ID NO: 1852950 - RNA, 16 nt, Salmonella typhimurium LT2
aauagcuuacuuucag

SEQ ID NO: 1852951 - RNA, 16 nt, Salmonella typhimurium LT2
aauaccuucacaaaaa

SEQ ID NO: 1852952 - RNA, 17 nt, Salmonella typhimurium LT2
aauaccuucacaaaaag

SEQ ID NO: 1852953 - RNA, 18 nt, Salmonella typhimurium LT2
aauaccuucacaaaaagu

SEQ ID NO: 1852954 - RNA, 21 nt, Salmonella typhimurium LT2
aauaccugccgaccucacugg

SEQ ID NO: 1852955 - RNA, 22 nt, Salmonella typhimurium LT2
aauaggccggagaaaagaccag

SEQ ID NO: 1852956 - RNA, 17 nt, Salmonella typhimurium LT2
aauagugauaccagcca

SEQ ID NO: 1852957 - RNA, 20 nt, Salmonella typhimurium LT2
aauaguccguuuaaagacau

SEQ ID NO: 1852958 - RNA, 15 nt, Salmonella typhimurium LT2
aauagugaauggcgc

SEQ ID NO: 1852959 - RNA, 14 nt, Salmonella typhimurium LT2
aauaguccagcagc

SEQ ID NO: 1852960 - RNA, 17 nt, Salmonella typhimurium LT2
aauaguuagccugauag

SEQ ID NO: 1852961 - RNA, 23 nt, Salmonella typhimurium LT2
aauaguuuauugagauaauuuau

SEQ ID NO: 1852962 - RNA, 22 nt, Salmonella typhimurium LT2
aauaguugauaauauuaucagc

SEQ ID NO: 1852963 - RNA, 14 nt, Salmonella typhimurium LT2
aauauauuacgacu

SEQ ID NO: 1852964 - RNA, 17 nt, Salmonella typhimurium LT2
aauauauuucacuucau

SEQ ID NO: 1852965 - RNA, 17 nt, Salmonella typhimurium LT2
aauaucaaaccacgcug

SEQ ID NO: 1852966 - RNA, 17 nt, Salmonella typhimurium LT2
aauauaucaggcugagc

SEQ ID NO: 1852967 - RNA, 22 nt, Salmonella typhimurium LT2
aauauacuagccaguaaccaua

SEQ ID NO: 1852968 - RNA, 13 nt, Salmonella typhimurium LT2
aauauacuuauca

SEQ ID NO: 1852969 - RNA, 20 nt, Salmonella typhimurium LT2
aauauacaccugacggcagc

SEQ ID NO: 1852970 - RNA, 19 nt, Salmonella typhimurium LT2
aauauaauccuuguccaug

SEQ ID NO: 1852971 - RNA, 11 nt, Salmonella typhimurium LT2
aauauaauccg

SEQ ID NO: 1852972 - RNA, 14 nt, Salmonella typhimurium LT2
aauauaaccaauuu

SEQ ID NO: 1852973 - RNA, 17 nt, Salmonella typhimurium LT2
aauauaaccaauuuaaa

SEQ ID NO: 1852974 - RNA, 11 nt, Salmonella typhimurium LT2
aauaugaaauu

SEQ ID NO: 1852975 - RNA, 15 nt, Salmonella typhimurium LT2
aauaugaaagagaaa

SEQ ID NO: 1852976 - RNA, 16 nt, Salmonella typhimurium LT2
aauaucuuccuggcgc

SEQ ID NO: 1852977 - RNA, 18 nt, Salmonella typhimurium LT2
aauaucugaauaaccauu

SEQ ID NO: 1852978 - RNA, 15 nt, Salmonella typhimurium LT2
aauaucgcugccggu

SEQ ID NO: 1852979 - RNA, 17 nt, Salmonella typhimurium LT2
aauaucggguauccauu

SEQ ID NO: 1852980 - RNA, 21 nt, Salmonella typhimurium LT2
aauaucgcggguuuuaucaau

SEQ ID NO: 1852981 - RNA, 21 nt, Salmonella typhimurium LT2
aauaucauccgguaucaugcu

SEQ ID NO: 1852982 - RNA, 13 nt, Salmonella typhimurium LT2
aauaucaaucagc

SEQ ID NO: 1852983 - RNA, 23 nt, Salmonella typhimurium LT2
aauaucaauucaacacuuagaac

SEQ ID NO: 1852984 - RNA, 20 nt, Salmonella typhimurium LT2
aauaucagccauuaaccaga

SEQ ID NO: 1852985 - RNA, 11 nt, Salmonella typhimurium LT2
aauauccauuu

SEQ ID NO: 1852986 - RNA, 22 nt, Salmonella typhimurium LT2
aauaucaucgucauuaaugccu

SEQ ID NO: 1852987 - RNA, 20 nt, Salmonella typhimurium LT2
aauaucauuagcgucauacu

SEQ ID NO: 1852988 - RNA, 18 nt, Salmonella typhimurium LT2
aauaucauuaauuauacu

SEQ ID NO: 1852989 - RNA, 15 nt, Salmonella typhimurium LT2
aauauccgcugcggu

SEQ ID NO: 1852990 - RNA, 15 nt, Salmonella typhimurium LT2
aaguagcagagaaaa

SEQ ID NO: 1852991 - RNA, 18 nt, Salmonella typhimurium LT2
aaguacgccuuucaccau

SEQ ID NO: 1852992 - RNA, 23 nt, Salmonella typhimurium LT2
aaguacgccuuucaccaucagca

SEQ ID NO: 1852993 - RNA, 22 nt, Salmonella typhimurium LT2
aaggggcaggcgucaaaacagg

SEQ ID NO: 1852994 - RNA, 22 nt, Salmonella typhimurium LT2
aagggaaaagccauugccgcga

SEQ ID NO: 1852995 - RNA, 20 nt, Salmonella typhimurium LT2
aaggcuuuuuaaucaaaaug

SEQ ID NO: 1852996 - RNA, 20 nt, Salmonella typhimurium LT2
aaggcuuuggccucagcaaa

SEQ ID NO: 1852997 - RNA, 13 nt, Salmonella typhimurium LT2
aagguuuuucccg

SEQ ID NO: 1852998 - RNA, 16 nt, Salmonella typhimurium LT2
aaguaaagauuuuuau

SEQ ID NO: 1852999 - RNA, 21 nt, Salmonella typhimurium LT2
aaguaaagauuuuuauuaaaa

SEQ ID NO: 1853000 - RNA, 22 nt, Salmonella typhimurium LT2
aaguaaagauuuuuauuaaaau

SEQ ID NO: 1853001 - RNA, 23 nt, Salmonella typhimurium LT2
aaguaaagauuuuuauuaaaauu

SEQ ID NO: 1853002 - RNA, 12 nt, Salmonella typhimurium LT2
aaguaaaauaac

SEQ ID NO: 1853003 - RNA, 16 nt, Salmonella typhimurium LT2
aagucaaaauaaaauu

SEQ ID NO: 1853004 - RNA, 21 nt, Salmonella typhimurium LT2
aagucaacugcucuaccaacu

SEQ ID NO: 1853005 - RNA, 16 nt, Salmonella typhimurium LT2
aagucagcuuuuagca

SEQ ID NO: 1853006 - RNA, 23 nt, Salmonella typhimurium LT2
aaguaguuggugggugaugacgg

SEQ ID NO: 1853007 - RNA, 16 nt, Salmonella typhimurium LT2
aaguaucccuuccuca

SEQ ID NO: 1853008 - RNA, 17 nt, Salmonella typhimurium LT2
aaguauaguggcgacaa

SEQ ID NO: 1853009 - RNA, 21 nt, Salmonella typhimurium LT2
aaguccccagccgccacuagc

SEQ ID NO: 1853010 - RNA, 22 nt, Salmonella typhimurium LT2
aaguccccagccgccacuagcu

SEQ ID NO: 1853011 - RNA, 18 nt, Salmonella typhimurium LT2
aaguccaaguauguuaac

SEQ ID NO: 1853012 - RNA, 17 nt, Salmonella typhimurium LT2
aagucauccagacuaac

SEQ ID NO: 1853013 - RNA, 17 nt, Salmonella typhimurium LT2
aagucaguuuucaauau

SEQ ID NO: 1853014 - RNA, 18 nt, Salmonella typhimurium LT2
aagucucaagagugaaca

SEQ ID NO: 1853015 - RNA, 23 nt, Salmonella typhimurium LT2
aagugaaaaaacggaaccaaaau

SEQ ID NO: 1853016 - RNA, 20 nt, Salmonella typhimurium LT2
aagucucgaaacgaaucuca

SEQ ID NO: 1853017 - RNA, 18 nt, Salmonella typhimurium LT2
aagugcgcugucagcaca

SEQ ID NO: 1853018 - RNA, 18 nt, Salmonella typhimurium LT2
aagugcgaaauuuaauau

SEQ ID NO: 1853019 - RNA, 17 nt, Salmonella typhimurium LT2
aagugccgcucacuggu

SEQ ID NO: 1853020 - RNA, 15 nt, Salmonella typhimurium LT2
aagugugggaagggc

SEQ ID NO: 1853021 - RNA, 15 nt, Salmonella typhimurium LT2
aaguucauaaaugua

SEQ ID NO: 1853022 - RNA, 15 nt, Salmonella typhimurium LT2
aaguugaaaggaaag

SEQ ID NO: 1853023 - RNA, 19 nt, Salmonella typhimurium LT2
aaguucccagcgguggaua

SEQ ID NO: 1853024 - RNA, 22 nt, Salmonella typhimurium LT2
aaguugacuuuuacgccacggu

SEQ ID NO: 1853025 - RNA, 14 nt, Salmonella typhimurium LT2
aaguugaccacacc

SEQ ID NO: 1853026 - RNA, 18 nt, Salmonella typhimurium LT2
aaguuaccgcgccaggcg

SEQ ID NO: 1853027 - RNA, 12 nt, Salmonella typhimurium LT2
aaguuaugcauc

SEQ ID NO: 1853028 - RNA, 13 nt, Salmonella typhimurium LT2
aaggcagccagga

SEQ ID NO: 1853029 - RNA, 16 nt, Salmonella typhimurium LT2
aaggcagccaggaacg

SEQ ID NO: 1853030 - RNA, 20 nt, Salmonella typhimurium LT2
aaggauuauuggcaucauaa

SEQ ID NO: 1853031 - RNA, 23 nt, Salmonella typhimurium LT2
aaggccagcaccagcgaguagcc

SEQ ID NO: 1853032 - RNA, 14 nt, Salmonella typhimurium LT2
aaggcaucuucaga

SEQ ID NO: 1853033 - RNA, 17 nt, Salmonella typhimurium LT2
aaggcaguguaauucuc

SEQ ID NO: 1853034 - RNA, 19 nt, Salmonella typhimurium LT2
aaggcauaaugccacgaga

SEQ ID NO: 1853035 - RNA, 14 nt, Salmonella typhimurium LT2
aaggcuccauauca

SEQ ID NO: 1853036 - RNA, 20 nt, Salmonella typhimurium LT2
aaggccggcagccgcugaua

SEQ ID NO: 1853037 - RNA, 22 nt, Salmonella typhimurium LT2
aaggccgcgaaccggaccagca

SEQ ID NO: 1853038 - RNA, 19 nt, Salmonella typhimurium LT2
aaggcuaccggacaaacau

SEQ ID NO: 1853039 - RNA, 20 nt, Salmonella typhimurium LT2
aaggcuaccggacaaacauu

SEQ ID NO: 1853040 - RNA, 23 nt, Salmonella typhimurium LT2
aaggcuauugacgcaccgcccgg

SEQ ID NO: 1853041 - RNA, 22 nt, Salmonella typhimurium LT2
aaggccucaucgggacggcggu

SEQ ID NO: 1853042 - RNA, 16 nt, Salmonella typhimurium LT2
aaggacauucagcacg

SEQ ID NO: 1853043 - RNA, 18 nt, Salmonella typhimurium LT2
aaggacauucagcacgcu

SEQ ID NO: 1853044 - RNA, 12 nt, Salmonella typhimurium LT2
aaggaugaccgg

SEQ ID NO: 1853045 - RNA, 23 nt, Salmonella typhimurium LT2
aagcugguuaaugaccugccgcg

SEQ ID NO: 1853046 - RNA, 16 nt, Salmonella typhimurium LT2
aagcugggucaggaca

SEQ ID NO: 1853047 - RNA, 20 nt, Salmonella typhimurium LT2
aagcugggcgucaacgugaa

SEQ ID NO: 1853048 - RNA, 18 nt, Salmonella typhimurium LT2
aagcuggccuucagguuu

SEQ ID NO: 1853049 - RNA, 22 nt, Salmonella typhimurium LT2
aagcucauuucccaauaguuua

SEQ ID NO: 1853050 - RNA, 23 nt, Salmonella typhimurium LT2
aagcucauuucccaauaguuuau

SEQ ID NO: 1853051 - RNA, 13 nt, Salmonella typhimurium LT2
aagcucauuuccc

SEQ ID NO: 1853052 - RNA, 13 nt, Salmonella typhimurium LT2
aagcuuguagaaa

SEQ ID NO: 1853053 - RNA, 14 nt, Salmonella typhimurium LT2
aagcuuguagaaaa

SEQ ID NO: 1853054 - RNA, 18 nt, Salmonella typhimurium LT2
aagcuuucaucuuuaaaa

SEQ ID NO: 1853055 - RNA, 19 nt, Salmonella typhimurium LT2
aagcgguaaggcaccgguu

SEQ ID NO: 1853056 - RNA, 16 nt, Salmonella typhimurium LT2
aagcgguaauaacuga

SEQ ID NO: 1853057 - RNA, 17 nt, Salmonella typhimurium LT2
aagcggugcaggaaggc

SEQ ID NO: 1853058 - RNA, 13 nt, Salmonella typhimurium LT2
aagcuacagggaa

SEQ ID NO: 1853059 - RNA, 18 nt, Salmonella typhimurium LT2
aagcucaacgcaggcugg

SEQ ID NO: 1853060 - RNA, 14 nt, Salmonella typhimurium LT2
aagcgcggcagcag

SEQ ID NO: 1853061 - RNA, 23 nt, Salmonella typhimurium LT2
aagcgccagauaugaucgaaaau

SEQ ID NO: 1853062 - RNA, 12 nt, Salmonella typhimurium LT2
aagcgccgcgau

SEQ ID NO: 1853063 - RNA, 17 nt, Salmonella typhimurium LT2
aagcgcaaacuuccaca

SEQ ID NO: 1853064 - RNA, 22 nt, Salmonella typhimurium LT2
aagccguagaccuggcucucgg

SEQ ID NO: 1853065 - RNA, 17 nt, Salmonella typhimurium LT2
aagccguagcagaagac

SEQ ID NO: 1853066 - RNA, 22 nt, Salmonella typhimurium LT2
aagccggcaggcagcgccagcg

SEQ ID NO: 1853067 - RNA, 19 nt, Salmonella typhimurium LT2
aagaucguuauccagcagc

SEQ ID NO: 1853068 - RNA, 14 nt, Salmonella typhimurium LT2
aagaucgcgaggca

SEQ ID NO: 1853069 - RNA, 12 nt, Salmonella typhimurium LT2
aagaucccaggg

SEQ ID NO: 1853070 - RNA, 15 nt, Salmonella typhimurium LT2
aagccuuuaugcagu

SEQ ID NO: 1853071 - RNA, 12 nt, Salmonella typhimurium LT2
aagccuuucugu

SEQ ID NO: 1853072 - RNA, 12 nt, Salmonella typhimurium LT2
aagcgaaaauaa

SEQ ID NO: 1853073 - RNA, 22 nt, Salmonella typhimurium LT2
aagcgaagcgucauccggcaau

SEQ ID NO: 1853074 - RNA, 20 nt, Salmonella typhimurium LT2
aagcgaauaauuaacccaca

SEQ ID NO: 1853075 - RNA, 21 nt, Salmonella typhimurium LT2
aagccuuuuuaaauauuaaga

SEQ ID NO: 1853076 - RNA, 22 nt, Salmonella typhimurium LT2
aagccugauggcgcuucgcuua

SEQ ID NO: 1853077 - RNA, 22 nt, Salmonella typhimurium LT2
aagccucuuccgccugauaaaa

SEQ ID NO: 1853078 - RNA, 13 nt, Salmonella typhimurium LT2
aauuuuuugauug

SEQ ID NO: 1853079 - RNA, 14 nt, Salmonella typhimurium LT2
acaacguuacgcca

SEQ ID NO: 1853080 - RNA, 21 nt, Salmonella typhimurium LT2
acaacgucaguggaaaacagc

SEQ ID NO: 1853081 - RNA, 16 nt, Salmonella typhimurium LT2
acaacuguuuuucacu

SEQ ID NO: 1853082 - RNA, 13 nt, Salmonella typhimurium LT2
acaacuucuuugc

SEQ ID NO: 1853083 - RNA, 19 nt, Salmonella typhimurium LT2
acaagccccccgcacagca

SEQ ID NO: 1853084 - RNA, 22 nt, Salmonella typhimurium LT2
acaagccccccgcacagcacau

SEQ ID NO: 1853085 - RNA, 15 nt, Salmonella typhimurium LT2
acaagauuaauuuaa

SEQ ID NO: 1853086 - RNA, 23 nt, Salmonella typhimurium LT2
acaagaucgcaacgugcaggcgc

SEQ ID NO: 1853087 - RNA, 22 nt, Salmonella typhimurium LT2
acaauaacgcgccggauauguu

SEQ ID NO: 1853088 - RNA, 23 nt, Salmonella typhimurium LT2
acaauagcgcuaaacagcgccgc

SEQ ID NO: 1853089 - RNA, 18 nt, Salmonella typhimurium LT2
acaauagcaaucuguaac

SEQ ID NO: 1853090 - RNA, 20 nt, Salmonella typhimurium LT2
acaaguagccugccagcaac

SEQ ID NO: 1853091 - RNA, 18 nt, Salmonella typhimurium LT2
acaaguagccugccagca

SEQ ID NO: 1853092 - RNA, 12 nt, Salmonella typhimurium LT2
acaauaaaguua

SEQ ID NO: 1853093 - RNA, 14 nt, Salmonella typhimurium LT2
acaauguacagaau

SEQ ID NO: 1853094 - RNA, 18 nt, Salmonella typhimurium LT2
acaaugggauaaaaugga

SEQ ID NO: 1853095 - RNA, 19 nt, Salmonella typhimurium LT2
acaaugaagcauaaaaaga

SEQ ID NO: 1853096 - RNA, 13 nt, Salmonella typhimurium LT2
acaaugaauauua

SEQ ID NO: 1853097 - RNA, 21 nt, Salmonella typhimurium LT2
acaaugaauauuauucuguuu

SEQ ID NO: 1853098 - RNA, 14 nt, Salmonella typhimurium LT2
acaaugcugacacu

SEQ ID NO: 1853099 - RNA, 20 nt, Salmonella typhimurium LT2
acaaucucaaugccacgccg

SEQ ID NO: 1853100 - RNA, 21 nt, Salmonella typhimurium LT2
acaaucugugugggcacucga

SEQ ID NO: 1853101 - RNA, 20 nt, Salmonella typhimurium LT2
acaauaugguuauccagcag

SEQ ID NO: 1853102 - RNA, 14 nt, Salmonella typhimurium LT2
acaauaucaucguc

SEQ ID NO: 1853103 - RNA, 22 nt, Salmonella typhimurium LT2
acaaugugccggauggcgcuaa

SEQ ID NO: 1853104 - RNA, 16 nt, Salmonella typhimurium LT2
acaauguugauggcgc

SEQ ID NO: 1853105 - RNA, 15 nt, Salmonella typhimurium LT2
acaauuacgcaagag

SEQ ID NO: 1853106 - RNA, 13 nt, Salmonella typhimurium LT2
acaauuauauacg

SEQ ID NO: 1853107 - RNA, 18 nt, Salmonella typhimurium LT2
acaauugcugcguaaccg

SEQ ID NO: 1853108 - RNA, 16 nt, Salmonella typhimurium LT2
acacaaucacacccag

SEQ ID NO: 1853109 - RNA, 15 nt, Salmonella typhimurium LT2
acacaauaucaauau

SEQ ID NO: 1853110 - RNA, 21 nt, Salmonella typhimurium LT2
acacaagucaccguuuuucau

SEQ ID NO: 1853111 - RNA, 17 nt, Salmonella typhimurium LT2
acacagaggaauauuau

SEQ ID NO: 1853112 - RNA, 20 nt, Salmonella typhimurium LT2
acacagacugcuuguuuaau

SEQ ID NO: 1853113 - RNA, 22 nt, Salmonella typhimurium LT2
acacagggucgucaaacuuuua

SEQ ID NO: 1853114 - RNA, 22 nt, Salmonella typhimurium LT2
acacaggcgugguggauaucca

SEQ ID NO: 1853115 - RNA, 19 nt, Salmonella typhimurium LT2
acacaggcgugguggauau

SEQ ID NO: 1853116 - RNA, 23 nt, Salmonella typhimurium LT2
acacagcggaaagcaacagcaag

SEQ ID NO: 1853117 - RNA, 14 nt, Salmonella typhimurium LT2
acacagcucaauau

SEQ ID NO: 1853118 - RNA, 13 nt, Salmonella typhimurium LT2
acaccagaaugcu

SEQ ID NO: 1853119 - RNA, 13 nt, Salmonella typhimurium LT2
acacaucaucuuu

SEQ ID NO: 1853120 - RNA, 13 nt, Salmonella typhimurium LT2
acacaguugccuu

SEQ ID NO: 1853121 - RNA, 13 nt, Salmonella typhimurium LT2
acaccagcacuga

SEQ ID NO: 1853122 - RNA, 14 nt, Salmonella typhimurium LT2
acaccagcgauaaa

SEQ ID NO: 1853123 - RNA, 15 nt, Salmonella typhimurium LT2
acaccaucccgcucu

SEQ ID NO: 1853124 - RNA, 20 nt, Salmonella typhimurium LT2
acaccagggauuuugcuuuu

SEQ ID NO: 1853125 - RNA, 14 nt, Salmonella typhimurium LT2
acagcggcgcgcca

SEQ ID NO: 1853126 - RNA, 23 nt, Salmonella typhimurium LT2
acagcgggguaaagccuuuaugc

SEQ ID NO: 1853127 - RNA, 20 nt, Salmonella typhimurium LT2
acagcggcucgaacuguucu

SEQ ID NO: 1853128 - RNA, 19 nt, Salmonella typhimurium LT2
acagcgcgaccaggaaacc

SEQ ID NO: 1853129 - RNA, 18 nt, Salmonella typhimurium LT2
acagcgcguccagcggca

SEQ ID NO: 1853130 - RNA, 20 nt, Salmonella typhimurium LT2
acagcgcgccaauccaugcc

SEQ ID NO: 1853131 - RNA, 17 nt, Salmonella typhimurium LT2
acagcgcgcccagcagg

SEQ ID NO: 1853132 - RNA, 13 nt, Salmonella typhimurium LT2
acagcgcgcguca

SEQ ID NO: 1853133 - RNA, 17 nt, Salmonella typhimurium LT2
acagcccauaccagcgc

SEQ ID NO: 1853134 - RNA, 14 nt, Salmonella typhimurium LT2
acagcauugaggcu

SEQ ID NO: 1853135 - RNA, 17 nt, Salmonella typhimurium LT2
acagcauugaggcuacc

SEQ ID NO: 1853136 - RNA, 22 nt, Salmonella typhimurium LT2
acagcuucaugugccgcgacaa

SEQ ID NO: 1853137 - RNA, 15 nt, Salmonella typhimurium LT2
acagcguauuaagcc

SEQ ID NO: 1853138 - RNA, 17 nt, Salmonella typhimurium LT2
acagcguaggccaggca

SEQ ID NO: 1853139 - RNA, 20 nt, Salmonella typhimurium LT2
acagcguacaauggcaggca

SEQ ID NO: 1853140 - RNA, 20 nt, Salmonella typhimurium LT2
acagcguaagaauucgucca

SEQ ID NO: 1853141 - RNA, 22 nt, Salmonella typhimurium LT2
acagcgugggaagcagcagacu

SEQ ID NO: 1853142 - RNA, 19 nt, Salmonella typhimurium LT2
acagcgugggcaaaucauc

SEQ ID NO: 1853143 - RNA, 16 nt, Salmonella typhimurium LT2
acagagaagcugcgcc

SEQ ID NO: 1853144 - RNA, 18 nt, Salmonella typhimurium LT2
acagaggaaugaaaacga

SEQ ID NO: 1853145 - RNA, 17 nt, Salmonella typhimurium LT2
acagauaagcgucugca

SEQ ID NO: 1853146 - RNA, 17 nt, Salmonella typhimurium LT2
acagauaagcaccugca

SEQ ID NO: 1853147 - RNA, 14 nt, Salmonella typhimurium LT2
acagauaacaccag

SEQ ID NO: 1853148 - RNA, 23 nt, Salmonella typhimurium LT2
acagagucgcuuaucugcugcug

SEQ ID NO: 1853149 - RNA, 18 nt, Salmonella typhimurium LT2
acagagucguuagcagaa

SEQ ID NO: 1853150 - RNA, 16 nt, Salmonella typhimurium LT2
acagauaugaaaugag

SEQ ID NO: 1853151 - RNA, 23 nt, Salmonella typhimurium LT2
acagauccagcgccguugcguca

SEQ ID NO: 1853152 - RNA, 16 nt, Salmonella typhimurium LT2
acagauaagcgucugc

SEQ ID NO: 1853153 - RNA, 14 nt, Salmonella typhimurium LT2
acagcaccagcagg

SEQ ID NO: 1853154 - RNA, 22 nt, Salmonella typhimurium LT2
acagauuuuguacuuuugccag

SEQ ID NO: 1853155 - RNA, 22 nt, Salmonella typhimurium LT2
acagauugaugcccucuuccag

SEQ ID NO: 1853156 - RNA, 14 nt, Salmonella typhimurium LT2
acacuucagccaga

SEQ ID NO: 1853157 - RNA, 14 nt, Salmonella typhimurium LT2
acacuucagccgga

SEQ ID NO: 1853158 - RNA, 21 nt, Salmonella typhimurium LT2
acacuucauccuuuacgcugc

SEQ ID NO: 1853159 - RNA, 20 nt, Salmonella typhimurium LT2
acacuuaccgaaugccaugu

SEQ ID NO: 1853160 - RNA, 23 nt, Salmonella typhimurium LT2
acacucgcggguaauguuuacuc

SEQ ID NO: 1853161 - RNA, 14 nt, Salmonella typhimurium LT2
acacuauuuuucag

SEQ ID NO: 1853162 - RNA, 22 nt, Salmonella typhimurium LT2
acaccauuucacaaauuaaaaa

SEQ ID NO: 1853163 - RNA, 15 nt, Salmonella typhimurium LT2
acaccauuucacaaa

SEQ ID NO: 1853164 - RNA, 14 nt, Salmonella typhimurium LT2
acacguugcgacaa

SEQ ID NO: 1853165 - RNA, 15 nt, Salmonella typhimurium LT2
acacguuaauuauuc

SEQ ID NO: 1853166 - RNA, 12 nt, Salmonella typhimurium LT2
acagacaucggu

SEQ ID NO: 1853167 - RNA, 13 nt, Salmonella typhimurium LT2
acagacaauacca

SEQ ID NO: 1853168 - RNA, 19 nt, Salmonella typhimurium LT2
acagacgccuuucagacuu

SEQ ID NO: 1853169 - RNA, 15 nt, Salmonella typhimurium LT2
acagacggcaaacaa

SEQ ID NO: 1853170 - RNA, 11 nt, Salmonella typhimurium LT2
acagacgcauc

SEQ ID NO: 1853171 - RNA, 13 nt, Salmonella typhimurium LT2
acagaaucaucag

SEQ ID NO: 1853172 - RNA, 22 nt, Salmonella typhimurium LT2
acagaaucaacgccacaccgag

SEQ ID NO: 1853173 - RNA, 13 nt, Salmonella typhimurium LT2
acagaacugauuu

SEQ ID NO: 1853174 - RNA, 18 nt, Salmonella typhimurium LT2
acagaagcgcugguaaau

SEQ ID NO: 1853175 - RNA, 21 nt, Salmonella typhimurium LT2
acagaaugccguugaccauau

SEQ ID NO: 1853176 - RNA, 20 nt, Salmonella typhimurium LT2
acagaaaaaaugcaccgccu

SEQ ID NO: 1853177 - RNA, 13 nt, Salmonella typhimurium LT2
acagaaaaaauag

SEQ ID NO: 1853178 - RNA, 17 nt, Salmonella typhimurium LT2
acacuuguaaguuacua

SEQ ID NO: 1853179 - RNA, 16 nt, Salmonella typhimurium LT2
acacuuucgcccggcg

SEQ ID NO: 1853180 - RNA, 14 nt, Salmonella typhimurium LT2
acagaaacuucugc

SEQ ID NO: 1853181 - RNA, 15 nt, Salmonella typhimurium LT2
acagaacagugaguu

SEQ ID NO: 1853182 - RNA, 12 nt, Salmonella typhimurium LT2
acauccagcugu

SEQ ID NO: 1853183 - RNA, 11 nt, Salmonella typhimurium LT2
acauccauaau

SEQ ID NO: 1853184 - RNA, 18 nt, Salmonella typhimurium LT2
acaucagccagcagcuca

SEQ ID NO: 1853185 - RNA, 16 nt, Salmonella typhimurium LT2
acauauuuuucacaca

SEQ ID NO: 1853186 - RNA, 22 nt, Salmonella typhimurium LT2
acauauuuuucacacauaagca

SEQ ID NO: 1853187 - RNA, 13 nt, Salmonella typhimurium LT2
acauauuuuuguu

SEQ ID NO: 1853188 - RNA, 18 nt, Salmonella typhimurium LT2
acauauuuuuaugcacgc

SEQ ID NO: 1853189 - RNA, 19 nt, Salmonella typhimurium LT2
acaucagaaaaaagccaag

SEQ ID NO: 1853190 - RNA, 15 nt, Salmonella typhimurium LT2
acauauucaauaaua

SEQ ID NO: 1853191 - RNA, 14 nt, Salmonella typhimurium LT2
acauauuccagaag

SEQ ID NO: 1853192 - RNA, 16 nt, Salmonella typhimurium LT2
acauauuccagaagcg

SEQ ID NO: 1853193 - RNA, 17 nt, Salmonella typhimurium LT2
acauauugagcugauaa

SEQ ID NO: 1853194 - RNA, 18 nt, Salmonella typhimurium LT2
acauauugagcugauaac

SEQ ID NO: 1853195 - RNA, 19 nt, Salmonella typhimurium LT2
acauauuuucgaugcacgc

SEQ ID NO: 1853196 - RNA, 22 nt, Salmonella typhimurium LT2
acauaucgcaguugauacauuu

SEQ ID NO: 1853197 - RNA, 16 nt, Salmonella typhimurium LT2
acauaugaguuaugua

SEQ ID NO: 1853198 - RNA, 18 nt, Salmonella typhimurium LT2
acauagcuaaauuaaaaa

SEQ ID NO: 1853199 - RNA, 21 nt, Salmonella typhimurium LT2
acauagcuaaauuaaaaauaa

SEQ ID NO: 1853200 - RNA, 15 nt, Salmonella typhimurium LT2
acauagcuauauuua

SEQ ID NO: 1853201 - RNA, 19 nt, Salmonella typhimurium LT2
acauagcuauauuuuuuau

SEQ ID NO: 1853202 - RNA, 15 nt, Salmonella typhimurium LT2
acauagcugaacaau

SEQ ID NO: 1853203 - RNA, 19 nt, Salmonella typhimurium LT2
acauacguuuaaagcgcuc

SEQ ID NO: 1853204 - RNA, 21 nt, Salmonella typhimurium LT2
acauacguuuaaagcgcucgu

SEQ ID NO: 1853205 - RNA, 19 nt, Salmonella typhimurium LT2
acauacgggaauuccaguc

SEQ ID NO: 1853206 - RNA, 20 nt, Salmonella typhimurium LT2
acauacugcaauuucuuuuc

SEQ ID NO: 1853207 - RNA, 22 nt, Salmonella typhimurium LT2
acauacugcaauuucuuuucca

SEQ ID NO: 1853208 - RNA, 23 nt, Salmonella typhimurium LT2
acauacugcaauuucuuuuccag

SEQ ID NO: 1853209 - RNA, 17 nt, Salmonella typhimurium LT2
acaggauguaagacagc

SEQ ID NO: 1853210 - RNA, 23 nt, Salmonella typhimurium LT2
acaggauguaagacagcgcgccc

SEQ ID NO: 1853211 - RNA, 13 nt, Salmonella typhimurium LT2
acaggcagcguca

SEQ ID NO: 1853212 - RNA, 18 nt, Salmonella typhimurium LT2
acaggccauuaagcuucg

SEQ ID NO: 1853213 - RNA, 20 nt, Salmonella typhimurium LT2
acaggcauccgugaccugcu

SEQ ID NO: 1853214 - RNA, 22 nt, Salmonella typhimurium LT2
acaggccgcucuauuugcauag

SEQ ID NO: 1853215 - RNA, 19 nt, Salmonella typhimurium LT2
acaggccgauauauugucg

SEQ ID NO: 1853216 - RNA, 20 nt, Salmonella typhimurium LT2
acaggccgccauaagaaugu

SEQ ID NO: 1853217 - RNA, 17 nt, Salmonella typhimurium LT2
acauacaaagagaaaau

SEQ ID NO: 1853218 - RNA, 23 nt, Salmonella typhimurium LT2
acauacaccggcgccagcucugc

SEQ ID NO: 1853219 - RNA, 20 nt, Salmonella typhimurium LT2
acauuggguaauuuuuugau

SEQ ID NO: 1853220 - RNA, 20 nt, Salmonella typhimurium LT2
acauugguuaucaaaaaccu

SEQ ID NO: 1853221 - RNA, 18 nt, Salmonella typhimurium LT2
acauugcuguggaaaauc

SEQ ID NO: 1853222 - RNA, 20 nt, Salmonella typhimurium LT2
acauugcucauaccgccgcc

SEQ ID NO: 1853223 - RNA, 15 nt, Salmonella typhimurium LT2
acauugcgaacaguu

SEQ ID NO: 1853224 - RNA, 19 nt, Salmonella typhimurium LT2
acauucccgccgagaaaau

SEQ ID NO: 1853225 - RNA, 21 nt, Salmonella typhimurium LT2
acauucccgccgagaaaauac

SEQ ID NO: 1853226 - RNA, 18 nt, Salmonella typhimurium LT2
acauucauugccgccagu

SEQ ID NO: 1853227 - RNA, 16 nt, Salmonella typhimurium LT2
acauuccaucauguua

SEQ ID NO: 1853228 - RNA, 21 nt, Salmonella typhimurium LT2
acauucaggcuggcaaagcag

SEQ ID NO: 1853229 - RNA, 20 nt, Salmonella typhimurium LT2
acauucaaaccuucaagaau

SEQ ID NO: 1853230 - RNA, 15 nt, Salmonella typhimurium LT2
acauuauugucuuug

SEQ ID NO: 1853231 - RNA, 16 nt, Salmonella typhimurium LT2
acauuauugcacauaa

SEQ ID NO: 1853232 - RNA, 23 nt, Salmonella typhimurium LT2
acauguucagcgcagaagcagac

SEQ ID NO: 1853233 - RNA, 15 nt, Salmonella typhimurium LT2
acaucuuccaugccu

SEQ ID NO: 1853234 - RNA, 18 nt, Salmonella typhimurium LT2
acaucuuauuucaccgga

SEQ ID NO: 1853235 - RNA, 18 nt, Salmonella typhimurium LT2
acaucgcacgccuuuaag

SEQ ID NO: 1853236 - RNA, 21 nt, Salmonella typhimurium LT2
acauccccgcguuaagccccu

SEQ ID NO: 1853237 - RNA, 22 nt, Salmonella typhimurium LT2
accaacgucgugccagugaugc

SEQ ID NO: 1853238 - RNA, 18 nt, Salmonella typhimurium LT2
accaacgacccccaccau

SEQ ID NO: 1853239 - RNA, 17 nt, Salmonella typhimurium LT2
acauuucgcacccuguc

SEQ ID NO: 1853240 - RNA, 22 nt, Salmonella typhimurium LT2
acauuucgugcaguccuguagg

SEQ ID NO: 1853241 - RNA, 17 nt, Salmonella typhimurium LT2
accaacguugaagagcu

SEQ ID NO: 1853242 - RNA, 18 nt, Salmonella typhimurium LT2
accaacguugaagagcua

SEQ ID NO: 1853243 - RNA, 13 nt, Salmonella typhimurium LT2
accaauagccuug

SEQ ID NO: 1853244 - RNA, 14 nt, Salmonella typhimurium LT2
accaauaaugcagg

SEQ ID NO: 1853245 - RNA, 18 nt, Salmonella typhimurium LT2
accaauauuaaagaugcc

SEQ ID NO: 1853246 - RNA, 17 nt, Salmonella typhimurium LT2
accaauucccagacccg

SEQ ID NO: 1853247 - RNA, 20 nt, Salmonella typhimurium LT2
accaauguuaauaagcagaa

SEQ ID NO: 1853248 - RNA, 13 nt, Salmonella typhimurium LT2
accaaugugcaaa

SEQ ID NO: 1853249 - RNA, 15 nt, Salmonella typhimurium LT2
accaaugugcaaaga

SEQ ID NO: 1853250 - RNA, 14 nt, Salmonella typhimurium LT2
accaauuaaauuau

SEQ ID NO: 1853251 - RNA, 22 nt, Salmonella typhimurium LT2
accacaaacgccgucacaaagc

SEQ ID NO: 1853252 - RNA, 15 nt, Salmonella typhimurium LT2
accacaaauuuugau

SEQ ID NO: 1853253 - RNA, 20 nt, Salmonella typhimurium LT2
accacauuggguaauuuuuu

SEQ ID NO: 1853254 - RNA, 16 nt, Salmonella typhimurium LT2
accacaugaccagcgc

SEQ ID NO: 1853255 - RNA, 12 nt, Salmonella typhimurium LT2
accaccacgccu

SEQ ID NO: 1853256 - RNA, 22 nt, Salmonella typhimurium LT2
accacagcggacacccgcagcc

SEQ ID NO: 1853257 - RNA, 19 nt, Salmonella typhimurium LT2
accacgguguaccccgccu

SEQ ID NO: 1853258 - RNA, 21 nt, Salmonella typhimurium LT2
accacgguguccggguucagc

SEQ ID NO: 1853259 - RNA, 17 nt, Salmonella typhimurium LT2
accacguuaucuucuuu

SEQ ID NO: 1853260 - RNA, 16 nt, Salmonella typhimurium LT2
accacgucauccggca

SEQ ID NO: 1853261 - RNA, 19 nt, Salmonella typhimurium LT2
accacgcccggaucaaaca

SEQ ID NO: 1853262 - RNA, 22 nt, Salmonella typhimurium LT2
accacgccaucaacagcggaga

SEQ ID NO: 1853263 - RNA, 13 nt, Salmonella typhimurium LT2
accacgccagcca

SEQ ID NO: 1853264 - RNA, 14 nt, Salmonella typhimurium LT2
accacgccagccag

SEQ ID NO: 1853265 - RNA, 22 nt, Salmonella typhimurium LT2
accacgaucuugucacaauaac

SEQ ID NO: 1853266 - RNA, 15 nt, Salmonella typhimurium LT2
accacgcacaugggc

SEQ ID NO: 1853267 - RNA, 23 nt, Salmonella typhimurium LT2
accacuccccaacguaauaacca

SEQ ID NO: 1853268 - RNA, 16 nt, Salmonella typhimurium LT2
accacuagcgccgcca

SEQ ID NO: 1853269 - RNA, 20 nt, Salmonella typhimurium LT2
accacuccggugcccauucc

SEQ ID NO: 1853270 - RNA, 20 nt, Salmonella typhimurium LT2
accacugauuccagagcgaa

SEQ ID NO: 1853271 - RNA, 13 nt, Salmonella typhimurium LT2
accaccccacagc

SEQ ID NO: 1853272 - RNA, 17 nt, Salmonella typhimurium LT2
accaccccacagcaaug

SEQ ID NO: 1853273 - RNA, 14 nt, Salmonella typhimurium LT2
accaccaguacaug

SEQ ID NO: 1853274 - RNA, 20 nt, Salmonella typhimurium LT2
accaccauacccaacagcag

SEQ ID NO: 1853275 - RNA, 13 nt, Salmonella typhimurium LT2
accaccuggguca

SEQ ID NO: 1853276 - RNA, 19 nt, Salmonella typhimurium LT2
accacgaaggaaacgccag

SEQ ID NO: 1853277 - RNA, 16 nt, Salmonella typhimurium LT2
accacgauaaagacac

SEQ ID NO: 1853278 - RNA, 17 nt, Salmonella typhimurium LT2
accacgacgaccgccag

SEQ ID NO: 1853279 - RNA, 14 nt, Salmonella typhimurium LT2
accaccgcccgcuc

SEQ ID NO: 1853280 - RNA, 19 nt, Salmonella typhimurium LT2
accaccggcaaagcguaug

SEQ ID NO: 1853281 - RNA, 20 nt, Salmonella typhimurium LT2
accaccggcgcgccagcgca

SEQ ID NO: 1853282 - RNA, 16 nt, Salmonella typhimurium LT2
accaccguuauuucca

SEQ ID NO: 1853283 - RNA, 18 nt, Salmonella typhimurium LT2
aauuucagggcuuauuca

SEQ ID NO: 1853284 - RNA, 21 nt, Salmonella typhimurium LT2
aauuucacgcugcaguuuauu

SEQ ID NO: 1853285 - RNA, 18 nt, Salmonella typhimurium LT2
aauuucaguauuacuaua

SEQ ID NO: 1853286 - RNA, 14 nt, Salmonella typhimurium LT2
aauuuccaguucaa

SEQ ID NO: 1853287 - RNA, 17 nt, Salmonella typhimurium LT2
aauuucuacugauuuaa

SEQ ID NO: 1853288 - RNA, 18 nt, Salmonella typhimurium LT2
aauuucugguaccagauc

SEQ ID NO: 1853289 - RNA, 15 nt, Salmonella typhimurium LT2
aauuucggcaaugac

SEQ ID NO: 1853290 - RNA, 16 nt, Salmonella typhimurium LT2
aauuucgcucagaugc

SEQ ID NO: 1853291 - RNA, 20 nt, Salmonella typhimurium LT2
aauuucccccacuucugaca

SEQ ID NO: 1853292 - RNA, 17 nt, Salmonella typhimurium LT2
aauuuccccccagacga

SEQ ID NO: 1853293 - RNA, 19 nt, Salmonella typhimurium LT2
aauuucccccacuucugac

SEQ ID NO: 1853294 - RNA, 20 nt, Salmonella typhimurium LT2
aauuuccucgacuucauucg

SEQ ID NO: 1853295 - RNA, 23 nt, Salmonella typhimurium LT2
aauuuacccggcgggaaguuguu

SEQ ID NO: 1853296 - RNA, 15 nt, Salmonella typhimurium LT2
aauuuaaaguaaggc

SEQ ID NO: 1853297 - RNA, 14 nt, Salmonella typhimurium LT2
aauuuaucaacaaa

SEQ ID NO: 1853298 - RNA, 22 nt, Salmonella typhimurium LT2
aauuuaucaacaaauuccggca

SEQ ID NO: 1853299 - RNA, 14 nt, Salmonella typhimurium LT2
aauuuaucagacaa

SEQ ID NO: 1853300 - RNA, 14 nt, Salmonella typhimurium LT2
aauuuauccaguaa

SEQ ID NO: 1853301 - RNA, 21 nt, Salmonella typhimurium LT2
aauuucaaucgccaguuuuug

SEQ ID NO: 1853302 - RNA, 12 nt, Salmonella typhimurium LT2
aauuuaugauuu

SEQ ID NO: 1853303 - RNA, 20 nt, Salmonella typhimurium LT2
aauuuugauaagagaaaaua

SEQ ID NO: 1853304 - RNA, 17 nt, Salmonella typhimurium LT2
aauuuugauaaaaacac

SEQ ID NO: 1853305 - RNA, 22 nt, Salmonella typhimurium LT2
aauuugcgggaacauaugcaca

SEQ ID NO: 1853306 - RNA, 11 nt, Salmonella typhimurium LT2
aauuugacgac

SEQ ID NO: 1853307 - RNA, 15 nt, Salmonella typhimurium LT2
aauuugugagacaaa

SEQ ID NO: 1853308 - RNA, 21 nt, Salmonella typhimurium LT2
aauuugugaucgucgcugcgu

SEQ ID NO: 1853309 - RNA, 22 nt, Salmonella typhimurium LT2
aauuuggucguaagaauuauua

SEQ ID NO: 1853310 - RNA, 16 nt, Salmonella typhimurium LT2
aauuaugaccaauguu

SEQ ID NO: 1853311 - RNA, 18 nt, Salmonella typhimurium LT2
aauuaugccugucaucau

SEQ ID NO: 1853312 - RNA, 17 nt, Salmonella typhimurium LT2
aauuauguauuucucgc

SEQ ID NO: 1853313 - RNA, 21 nt, Salmonella typhimurium LT2
aauuacucauuccugcuuuua

SEQ ID NO: 1853314 - RNA, 18 nt, Salmonella typhimurium LT2
aauuacggacagaaaaaa

SEQ ID NO: 1853315 - RNA, 21 nt, Salmonella typhimurium LT2
aauuacggacagaaaaaauag

SEQ ID NO: 1853316 - RNA, 22 nt, Salmonella typhimurium LT2
aauuacggacgauacaccuuca

SEQ ID NO: 1853317 - RNA, 16 nt, Salmonella typhimurium LT2
aauuacuuaugauaua

SEQ ID NO: 1853318 - RNA, 13 nt, Salmonella typhimurium LT2
aauuacuuaugau

SEQ ID NO: 1853319 - RNA, 14 nt, Salmonella typhimurium LT2
aauuagcgcgaaau

SEQ ID NO: 1853320 - RNA, 21 nt, Salmonella typhimurium LT2
aauguaguaccaggcagaagg

SEQ ID NO: 1853321 - RNA, 23 nt, Salmonella typhimurium LT2
aauggugucuuuuacuuuaagcg

SEQ ID NO: 1853322 - RNA, 21 nt, Salmonella typhimurium LT2
aauggucuuaaaugccgccgg

SEQ ID NO: 1853323 - RNA, 14 nt, Salmonella typhimurium LT2
aauggguaaaaaua

SEQ ID NO: 1853324 - RNA, 16 nt, Salmonella typhimurium LT2
aauuacagcucauaaa

SEQ ID NO: 1853325 - RNA, 13 nt, Salmonella typhimurium LT2
aauuacagcucau

SEQ ID NO: 1853326 - RNA, 18 nt, Salmonella typhimurium LT2
aauuaccuuuacaugaaa

SEQ ID NO: 1853327 - RNA, 17 nt, Salmonella typhimurium LT2
aauuaaucccaacccga

SEQ ID NO: 1853328 - RNA, 14 nt, Salmonella typhimurium LT2
aauuaaucacaaug

SEQ ID NO: 1853329 - RNA, 18 nt, Salmonella typhimurium LT2
aauuaaucgccagcagcg

SEQ ID NO: 1853330 - RNA, 22 nt, Salmonella typhimurium LT2
aauugaggccguuauugucaug

SEQ ID NO: 1853331 - RNA, 12 nt, Salmonella typhimurium LT2
aauugaggccgu

SEQ ID NO: 1853332 - RNA, 14 nt, Salmonella typhimurium LT2
aauugacuggauuu

SEQ ID NO: 1853333 - RNA, 20 nt, Salmonella typhimurium LT2
aauugacuggauuuuugacu

SEQ ID NO: 1853334 - RNA, 20 nt, Salmonella typhimurium LT2
aauugacgcuugacucugug

SEQ ID NO: 1853335 - RNA, 14 nt, Salmonella typhimurium LT2
aauugacgcugccu

SEQ ID NO: 1853336 - RNA, 20 nt, Salmonella typhimurium LT2
aauucuugcccgcugagugg

SEQ ID NO: 1853337 - RNA, 17 nt, Salmonella typhimurium LT2
aauucguuaccugcgca

SEQ ID NO: 1853338 - RNA, 14 nt, Salmonella typhimurium LT2
aauucguccacacg

SEQ ID NO: 1853339 - RNA, 17 nt, Salmonella typhimurium LT2
aauucggcgaauguuuu

SEQ ID NO: 1853340 - RNA, 19 nt, Salmonella typhimurium LT2
aauucaacguauuaacaua

SEQ ID NO: 1853341 - RNA, 16 nt, Salmonella typhimurium LT2
aauuccgcaucauuca

SEQ ID NO: 1853342 - RNA, 17 nt, Salmonella typhimurium LT2
aauuccgcaucauucau

SEQ ID NO: 1853343 - RNA, 20 nt, Salmonella typhimurium LT2
aauuccgcagagcugacggg

SEQ ID NO: 1853344 - RNA, 19 nt, Salmonella typhimurium LT2
aauuccggcgaaaaaccag

SEQ ID NO: 1853345 - RNA, 12 nt, Salmonella typhimurium LT2
aaugaaaucguc

SEQ ID NO: 1853346 - RNA, 19 nt, Salmonella typhimurium LT2
aaugaacggaggucaugga

SEQ ID NO: 1853347 - RNA, 12 nt, Salmonella typhimurium LT2
aaugaaccacac

SEQ ID NO: 1853348 - RNA, 13 nt, Salmonella typhimurium LT2
aaugaagcauaaa

SEQ ID NO: 1853349 - RNA, 15 nt, Salmonella typhimurium LT2
aaugaagcauaaaaa

SEQ ID NO: 1853350 - RNA, 18 nt, Salmonella typhimurium LT2
aaugaagcauaaaaagac

SEQ ID NO: 1853351 - RNA, 15 nt, Salmonella typhimurium LT2
aaugaauguaggccg

SEQ ID NO: 1853352 - RNA, 21 nt, Salmonella typhimurium LT2
aaugaauaccaagucucaaga

SEQ ID NO: 1853353 - RNA, 16 nt, Salmonella typhimurium LT2
aaucucuacgccggcg

SEQ ID NO: 1853354 - RNA, 23 nt, Salmonella typhimurium LT2
aaucuuucuguaagagacugaca

SEQ ID NO: 1853355 - RNA, 17 nt, Salmonella typhimurium LT2
aaugagaaaaggaagaa

SEQ ID NO: 1853356 - RNA, 13 nt, Salmonella typhimurium LT2
aaugacuuuuuau

SEQ ID NO: 1853357 - RNA, 22 nt, Salmonella typhimurium LT2
aaugacuuuuuugccaauauau

SEQ ID NO: 1853358 - RNA, 13 nt, Salmonella typhimurium LT2
aaugacuguccac

SEQ ID NO: 1853359 - RNA, 17 nt, Salmonella typhimurium LT2
aaugaguacggaacaaa

SEQ ID NO: 1853360 - RNA, 19 nt, Salmonella typhimurium LT2
aaugauaaugccgcugaua

SEQ ID NO: 1853361 - RNA, 13 nt, Salmonella typhimurium LT2
aaugacgcccugc

SEQ ID NO: 1853362 - RNA, 16 nt, Salmonella typhimurium LT2
aaugaccucaagaaua

SEQ ID NO: 1853363 - RNA, 19 nt, Salmonella typhimurium LT2
aaugaccugagcgugcaac

SEQ ID NO: 1853364 - RNA, 13 nt, Salmonella typhimurium LT2
aaugaccucaaga

SEQ ID NO: 1853365 - RNA, 19 nt, Salmonella typhimurium LT2
aaugaucguaugcagccag

SEQ ID NO: 1853366 - RNA, 15 nt, Salmonella typhimurium LT2
aaugauccacggcgu

SEQ ID NO: 1853367 - RNA, 19 nt, Salmonella typhimurium LT2
aaugaucagaacucacaua

SEQ ID NO: 1853368 - RNA, 18 nt, Salmonella typhimurium LT2
aaugaucagaacucacau

SEQ ID NO: 1853369 - RNA, 19 nt, Salmonella typhimurium LT2
aaugauggggucacagguu

SEQ ID NO: 1853370 - RNA, 12 nt, Salmonella typhimurium LT2
aaugaugggguc

SEQ ID NO: 1853371 - RNA, 15 nt, Salmonella typhimurium LT2
aaugauguccacacu

SEQ ID NO: 1853372 - RNA, 21 nt, Salmonella typhimurium LT2
aaugccccagguuauagaccu

SEQ ID NO: 1853373 - RNA, 24 nt, Salmonella typhimurium LT2
aaugccccagguuauagaccuguu

SEQ ID NO: 1853374 - RNA, 20 nt, Salmonella typhimurium LT2
aaugcccagcucaucgaacc

SEQ ID NO: 1853375 - RNA, 18 nt, Salmonella typhimurium LT2
aaugcccucaacgcccug

SEQ ID NO: 1853376 - RNA, 20 nt, Salmonella typhimurium LT2
aaugccgcgagaaauaccaa

SEQ ID NO: 1853377 - RNA, 21 nt, Salmonella typhimurium LT2
aaugccgcccauccagagcag

SEQ ID NO: 1853378 - RNA, 19 nt, Salmonella typhimurium LT2
aaugauuccgucucagagc

SEQ ID NO: 1853379 - RNA, 21 nt, Salmonella typhimurium LT2
aaugcauggcagauaaaccac

SEQ ID NO: 1853380 - RNA, 19 nt, Salmonella typhimurium LT2
aaugcaucucguaaaucaa

SEQ ID NO: 1853381 - RNA, 20 nt, Salmonella typhimurium LT2
aaugcaucucguaaaucaau

SEQ ID NO: 1853382 - RNA, 19 nt, Salmonella typhimurium LT2
aaugcauagccccagcgca

SEQ ID NO: 1853383 - RNA, 18 nt, Salmonella typhimurium LT2
aaugcauagccccagcgc

SEQ ID NO: 1853384 - RNA, 16 nt, Salmonella typhimurium LT2
aaugcauguggagaug

SEQ ID NO: 1853385 - RNA, 19 nt, Salmonella typhimurium LT2
aauggcagaauaaaacagc

SEQ ID NO: 1853386 - RNA, 16 nt, Salmonella typhimurium LT2
aaugggcaggagauga

SEQ ID NO: 1853387 - RNA, 14 nt, Salmonella typhimurium LT2
aauggcagggacaa

SEQ ID NO: 1853388 - RNA, 19 nt, Salmonella typhimurium LT2
aauggcucaacuccgccgg

SEQ ID NO: 1853389 - RNA, 23 nt, Salmonella typhimurium LT2
aaugcugacgcguuuuuucauga

SEQ ID NO: 1853390 - RNA, 15 nt, Salmonella typhimurium LT2
aaugcuccaauaaau

SEQ ID NO: 1853391 - RNA, 18 nt, Salmonella typhimurium LT2
aaugcuccaauaaauauu

SEQ ID NO: 1853392 - RNA, 16 nt, Salmonella typhimurium LT2
aaugcgucggcaccau

SEQ ID NO: 1853393 - RNA, 17 nt, Salmonella typhimurium LT2
aaugccgucaucagcaa

SEQ ID NO: 1853394 - RNA, 18 nt, Salmonella typhimurium LT2
aaugccguaccugcugac

SEQ ID NO: 1853395 - RNA, 22 nt, Salmonella typhimurium LT2
aaugccguucgcgacaaagcuc

SEQ ID NO: 1853396 - RNA, 18 nt, Salmonella typhimurium LT2
aauccaccauaguuucga

SEQ ID NO: 1853397 - RNA, 16 nt, Salmonella typhimurium LT2
aauccacauuccagac

SEQ ID NO: 1853398 - RNA, 13 nt, Salmonella typhimurium LT2
aauccaauguuua

SEQ ID NO: 1853399 - RNA, 13 nt, Salmonella typhimurium LT2
aauccagguggau

SEQ ID NO: 1853400 - RNA, 12 nt, Salmonella typhimurium LT2
aauccaggugga

SEQ ID NO: 1853401 - RNA, 16 nt, Salmonella typhimurium LT2
aauccaggaauuuucc

SEQ ID NO: 1853402 - RNA, 17 nt, Salmonella typhimurium LT2
aauccaggaauuuuccc

SEQ ID NO: 1853403 - RNA, 23 nt, Salmonella typhimurium LT2
aauccaguaaugccauaauuuau

SEQ ID NO: 1853404 - RNA, 19 nt, Salmonella typhimurium LT2
aaucauucgagaugcauaa

SEQ ID NO: 1853405 - RNA, 12 nt, Salmonella typhimurium LT2
aaucaucaccac

SEQ ID NO: 1853406 - RNA, 14 nt, Salmonella typhimurium LT2
aaucaucaaucgcu

SEQ ID NO: 1853407 - RNA, 22 nt, Salmonella typhimurium LT2
aaucaucagaccgauaaauacc

SEQ ID NO: 1853408 - RNA, 14 nt, Salmonella typhimurium LT2
aaucaucauauccc

SEQ ID NO: 1853409 - RNA, 12 nt, Salmonella typhimurium LT2
aaucaucaucgu

SEQ ID NO: 1853410 - RNA, 20 nt, Salmonella typhimurium LT2
aaaaauuacaacaggaugga

SEQ ID NO: 1853411 - RNA, 12 nt, Salmonella typhimurium LT2
aaucagcgcugu

SEQ ID NO: 1853412 - RNA, 22 nt, Salmonella typhimurium LT2
aaucagcgcugucgccaucacc

SEQ ID NO: 1853413 - RNA, 13 nt, Salmonella typhimurium LT2
aaucagcaucacc

SEQ ID NO: 1853414 - RNA, 23 nt, Salmonella typhimurium LT2
aaucaggcacaacccaaaggcca

SEQ ID NO: 1853415 - RNA, 20 nt, Salmonella typhimurium LT2
aaucagcugcugcgcuuucc

SEQ ID NO: 1853416 - RNA, 13 nt, Salmonella typhimurium LT2
aaucaggaaaaag

SEQ ID NO: 1853417 - RNA, 18 nt, Salmonella typhimurium LT2
aaucaguggcggcaaaaa

SEQ ID NO: 1853418 - RNA, 22 nt, Salmonella typhimurium LT2
aaucaguggcggcaaaaaauau

SEQ ID NO: 1853419 - RNA, 17 nt, Salmonella typhimurium LT2
aaucaggugaauaccaa

SEQ ID NO: 1853420 - RNA, 21 nt, Salmonella typhimurium LT2
aaucagguaaguguaaguuca

SEQ ID NO: 1853421 - RNA, 14 nt, Salmonella typhimurium LT2
aaucauacagcgca

SEQ ID NO: 1853422 - RNA, 13 nt, Salmonella typhimurium LT2
aaucaguucagga

SEQ ID NO: 1853423 - RNA, 16 nt, Salmonella typhimurium LT2
aaucaguucaggaaca

SEQ ID NO: 1853424 - RNA, 17 nt, Salmonella typhimurium LT2
aaucaguucaggaacau

SEQ ID NO: 1853425 - RNA, 23 nt, Salmonella typhimurium LT2
aaucaguucaggaacaucagcau

SEQ ID NO: 1853426 - RNA, 14 nt, Salmonella typhimurium LT2
aaucaguuguacuu

SEQ ID NO: 1853427 - RNA, 18 nt, Salmonella typhimurium LT2
aaaaauuaaaacaaguca

SEQ ID NO: 1853428 - RNA, 22 nt, Salmonella typhimurium LT2
aaucuccuccggcuucagcaac

SEQ ID NO: 1853429 - RNA, 18 nt, Salmonella typhimurium LT2
aaucucccccggcaccac

SEQ ID NO: 1853430 - RNA, 16 nt, Salmonella typhimurium LT2
aaucucgaaacaauag

SEQ ID NO: 1853431 - RNA, 12 nt, Salmonella typhimurium LT2
aaucggugcuuc

SEQ ID NO: 1853432 - RNA, 20 nt, Salmonella typhimurium LT2
aaucgcucuugcacaauacu

SEQ ID NO: 1853433 - RNA, 19 nt, Salmonella typhimurium LT2
aaucgcuaaacauauaccg

SEQ ID NO: 1853434 - RNA, 14 nt, Salmonella typhimurium LT2
aaucgcuaaacaua

SEQ ID NO: 1853435 - RNA, 20 nt, Salmonella typhimurium LT2
aauccccggcgaaagaaaau

SEQ ID NO: 1853436 - RNA, 17 nt, Salmonella typhimurium LT2
aauccccuacggugugc

SEQ ID NO: 1853437 - RNA, 19 nt, Salmonella typhimurium LT2
aauccccagcgcuccacca

SEQ ID NO: 1853438 - RNA, 16 nt, Salmonella typhimurium LT2
aauccuccagcggcau

SEQ ID NO: 1853439 - RNA, 18 nt, Salmonella typhimurium LT2
aauccugcacuuccagcc

SEQ ID NO: 1853440 - RNA, 19 nt, Salmonella typhimurium LT2
aauccugauuaaguuuuuu

SEQ ID NO: 1853441 - RNA, 21 nt, Salmonella typhimurium LT2
aaucgccaucagcgcgaaaau

SEQ ID NO: 1853442 - RNA, 14 nt, Salmonella typhimurium LT2
aaucgccucaacca

SEQ ID NO: 1853443 - RNA, 16 nt, Salmonella typhimurium LT2
aaucgccucaaccaac

SEQ ID NO: 1853444 - RNA, 23 nt, Salmonella typhimurium LT2
aaucgccucaacgcucauaccug

SEQ ID NO: 1853445 - RNA, 18 nt, Salmonella typhimurium LT2
aaucgcuaaacauauacc

SEQ ID NO: 1853446 - RNA, 15 nt, Salmonella typhimurium LT2
aaucgcgugcaacag

SEQ ID NO: 1853447 - RNA, 14 nt, Salmonella typhimurium LT2
aaaaauuuuuauag

SEQ ID NO: 1853448 - RNA, 16 nt, Salmonella typhimurium LT2
acugagcgccaauuga

SEQ ID NO: 1853449 - RNA, 14 nt, Salmonella typhimurium LT2
acugaaauaacucu

SEQ ID NO: 1853450 - RNA, 15 nt, Salmonella typhimurium LT2
acugaaaaucaaaua

SEQ ID NO: 1853451 - RNA, 16 nt, Salmonella typhimurium LT2
acucuuucggcgccug

SEQ ID NO: 1853452 - RNA, 19 nt, Salmonella typhimurium LT2
acucuuuacccagcgggug

SEQ ID NO: 1853453 - RNA, 16 nt, Salmonella typhimurium LT2
acugcaaauaccacau

SEQ ID NO: 1853454 - RNA, 13 nt, Salmonella typhimurium LT2
acugcaaauacca

SEQ ID NO: 1853455 - RNA, 18 nt, Salmonella typhimurium LT2
acugcaaccgacgaacaa

SEQ ID NO: 1853456 - RNA, 17 nt, Salmonella typhimurium LT2
acugauaucuaugguaa

SEQ ID NO: 1853457 - RNA, 19 nt, Salmonella typhimurium LT2
acugauaguccaucaccuc

SEQ ID NO: 1853458 - RNA, 23 nt, Salmonella typhimurium LT2
acugauaguccaucaccucuucg

SEQ ID NO: 1853459 - RNA, 18 nt, Salmonella typhimurium LT2
acugaguuucaccgccag

SEQ ID NO: 1853460 - RNA, 22 nt, Salmonella typhimurium LT2
acugagugugucuuuuacgcca

SEQ ID NO: 1853461 - RNA, 13 nt, Salmonella typhimurium LT2
acugccaaaccac

SEQ ID NO: 1853462 - RNA, 15 nt, Salmonella typhimurium LT2
acugcaucucuucca

SEQ ID NO: 1853463 - RNA, 13 nt, Salmonella typhimurium LT2
acugcgaauuucc

SEQ ID NO: 1853464 - RNA, 22 nt, Salmonella typhimurium LT2
acugcgaauuuccugccagacc

SEQ ID NO: 1853465 - RNA, 16 nt, Salmonella typhimurium LT2
acugcgccauguucau

SEQ ID NO: 1853466 - RNA, 16 nt, Salmonella typhimurium LT2
acuggaaaaagaccaa

SEQ ID NO: 1853467 - RNA, 17 nt, Salmonella typhimurium LT2
acugcugcccuggaacc

SEQ ID NO: 1853468 - RNA, 15 nt, Salmonella typhimurium LT2
acuggaucacuuuug

SEQ ID NO: 1853469 - RNA, 20 nt, Salmonella typhimurium LT2
acugcggaacgccccucggu

SEQ ID NO: 1853470 - RNA, 16 nt, Salmonella typhimurium LT2
acugcguaaucuuuuc

SEQ ID NO: 1853471 - RNA, 13 nt, Salmonella typhimurium LT2
acugcguaagcau

SEQ ID NO: 1853472 - RNA, 20 nt, Salmonella typhimurium LT2
acugcuuuuccggcagcgca

SEQ ID NO: 1853473 - RNA, 23 nt, Salmonella typhimurium LT2
acuauuuuuccggcgucaaaaau

SEQ ID NO: 1853474 - RNA, 18 nt, Salmonella typhimurium LT2
acuauuugccugaacggu

SEQ ID NO: 1853475 - RNA, 22 nt, Salmonella typhimurium LT2
acucccaggcgcgcagcugcca

SEQ ID NO: 1853476 - RNA, 18 nt, Salmonella typhimurium LT2
acucccccagauucugau

SEQ ID NO: 1853477 - RNA, 17 nt, Salmonella typhimurium LT2
acucccccuuuuuacua

SEQ ID NO: 1853478 - RNA, 13 nt, Salmonella typhimurium LT2
acuccccugcaga

SEQ ID NO: 1853479 - RNA, 20 nt, Salmonella typhimurium LT2
acuccccugcagaugcugcu

SEQ ID NO: 1853480 - RNA, 18 nt, Salmonella typhimurium LT2
acucccgucgccuguuuc

SEQ ID NO: 1853481 - RNA, 15 nt, Salmonella typhimurium LT2
acuccuaagagaaaa

SEQ ID NO: 1853482 - RNA, 17 nt, Salmonella typhimurium LT2
acuccggcgcggcgcgc

SEQ ID NO: 1853483 - RNA, 19 nt, Salmonella typhimurium LT2
acucgaagcggucagugau

SEQ ID NO: 1853484 - RNA, 19 nt, Salmonella typhimurium LT2
acucgcuguacuucccucu

SEQ ID NO: 1853485 - RNA, 16 nt, Salmonella typhimurium LT2
acucgcuacgcucgcc

SEQ ID NO: 1853486 - RNA, 14 nt, Salmonella typhimurium LT2
acucuccaccaaau

SEQ ID NO: 1853487 - RNA, 12 nt, Salmonella typhimurium LT2
acucuccagcau

SEQ ID NO: 1853488 - RNA, 19 nt, Salmonella typhimurium LT2
acucuccucccccagcacg

SEQ ID NO: 1853489 - RNA, 20 nt, Salmonella typhimurium LT2
acucucucuguaauaauuaa

SEQ ID NO: 1853490 - RNA, 16 nt, Salmonella typhimurium LT2
acucucgcagcgaaua

SEQ ID NO: 1853491 - RNA, 18 nt, Salmonella typhimurium LT2
acucucgcgaauagugau

SEQ ID NO: 1853492 - RNA, 19 nt, Salmonella typhimurium LT2
acucugaaaaauuuuccug

SEQ ID NO: 1853493 - RNA, 19 nt, Salmonella typhimurium LT2
acucucuuuaaucacccgu

SEQ ID NO: 1853494 - RNA, 16 nt, Salmonella typhimurium LT2
acucugagcauacaca

SEQ ID NO: 1853495 - RNA, 17 nt, Salmonella typhimurium LT2
acucugauccuacccgc

SEQ ID NO: 1853496 - RNA, 13 nt, Salmonella typhimurium LT2
acucugaaaacgg

SEQ ID NO: 1853497 - RNA, 19 nt, Salmonella typhimurium LT2
acucugcuuuuauuuucag

SEQ ID NO: 1853498 - RNA, 22 nt, Salmonella typhimurium LT2
acucuuccagcugcucuucuug

SEQ ID NO: 1853499 - RNA, 13 nt, Salmonella typhimurium LT2
acucuuccaccac

SEQ ID NO: 1853500 - RNA, 16 nt, Salmonella typhimurium LT2
acucuuccgcaaucac

SEQ ID NO: 1853501 - RNA, 16 nt, Salmonella typhimurium LT2
acuucgccucagccaa

SEQ ID NO: 1853502 - RNA, 15 nt, Salmonella typhimurium LT2
acuucgcuuccugca

SEQ ID NO: 1853503 - RNA, 20 nt, Salmonella typhimurium LT2
acuucgcgguugcgcccuuc

SEQ ID NO: 1853504 - RNA, 15 nt, Salmonella typhimurium LT2
acuucgcugaaaaug

SEQ ID NO: 1853505 - RNA, 17 nt, Salmonella typhimurium LT2
acuucgcugaaaaugac

SEQ ID NO: 1853506 - RNA, 19 nt, Salmonella typhimurium LT2
acuuccuggaugcuuaaaa

SEQ ID NO: 1853507 - RNA, 19 nt, Salmonella typhimurium LT2
acuucgagaagccagccau

SEQ ID NO: 1853508 - RNA, 20 nt, Salmonella typhimurium LT2
acuuccauucccgccgcaau

SEQ ID NO: 1853509 - RNA, 15 nt, Salmonella typhimurium LT2
acuucauccggauaa

SEQ ID NO: 1853510 - RNA, 16 nt, Salmonella typhimurium LT2
acuucauuuuccacaa

SEQ ID NO: 1853511 - RNA, 18 nt, Salmonella typhimurium LT2
acuuccaacuaaagcgaa

SEQ ID NO: 1853512 - RNA, 20 nt, Salmonella typhimurium LT2
acuuccaacuaaagcgaauu

SEQ ID NO: 1853513 - RNA, 17 nt, Salmonella typhimurium LT2
acuucuccugccaguau

SEQ ID NO: 1853514 - RNA, 14 nt, Salmonella typhimurium LT2
acuugaccagcacu

SEQ ID NO: 1853515 - RNA, 20 nt, Salmonella typhimurium LT2
acuugagaaauuauuuuaaa

SEQ ID NO: 1853516 - RNA, 17 nt, Salmonella typhimurium LT2
acuugacgcuuugcauu

SEQ ID NO: 1853517 - RNA, 22 nt, Salmonella typhimurium LT2
acuucuugguaccaaacagcag

SEQ ID NO: 1853518 - RNA, 21 nt, Salmonella typhimurium LT2
acuucuugguaccaaacagca

SEQ ID NO: 1853519 - RNA, 17 nt, Salmonella typhimurium LT2
acuucaauuuuccagau

SEQ ID NO: 1853520 - RNA, 13 nt, Salmonella typhimurium LT2
acuucacaaacaa

SEQ ID NO: 1853521 - RNA, 20 nt, Salmonella typhimurium LT2
acuucacaaacaauuucccc

SEQ ID NO: 1853522 - RNA, 17 nt, Salmonella typhimurium LT2
acuucaaugggaaaaau

SEQ ID NO: 1853523 - RNA, 15 nt, Salmonella typhimurium LT2
acuucaaucgccaaa

SEQ ID NO: 1853524 - RNA, 12 nt, Salmonella typhimurium LT2
acuucagauacc

SEQ ID NO: 1853525 - RNA, 16 nt, Salmonella typhimurium LT2
acuucacuuucaagcc

SEQ ID NO: 1853526 - RNA, 14 nt, Salmonella typhimurium LT2
acuucacgcugcau

SEQ ID NO: 1853527 - RNA, 15 nt, Salmonella typhimurium LT2
acuucacgcugcaua

SEQ ID NO: 1853528 - RNA, 17 nt, Salmonella typhimurium LT2
acuuauuaccacaguca

SEQ ID NO: 1853529 - RNA, 13 nt, Salmonella typhimurium LT2
acuuauguaagcu

SEQ ID NO: 1853530 - RNA, 16 nt, Salmonella typhimurium LT2
acuuauugauccacgg

SEQ ID NO: 1853531 - RNA, 17 nt, Salmonella typhimurium LT2
acuucaaaaauggcuuc

SEQ ID NO: 1853532 - RNA, 18 nt, Salmonella typhimurium LT2
acuuauuuggguaauaaa

SEQ ID NO: 1853533 - RNA, 13 nt, Salmonella typhimurium LT2
acuuacugcuguc

SEQ ID NO: 1853534 - RNA, 16 nt, Salmonella typhimurium LT2
acuuaucauuuuuucu

SEQ ID NO: 1853535 - RNA, 20 nt, Salmonella typhimurium LT2
acuguugaaagccccggcuc

SEQ ID NO: 1853536 - RNA, 15 nt, Salmonella typhimurium LT2
acuguucggggauua

SEQ ID NO: 1853537 - RNA, 18 nt, Salmonella typhimurium LT2
acugugacgacaguuuug

SEQ ID NO: 1853538 - RNA, 14 nt, Salmonella typhimurium LT2
acuguucagcugac

SEQ ID NO: 1853539 - RNA, 12 nt, Salmonella typhimurium LT2
acuggauuaucg

SEQ ID NO: 1853540 - RNA, 18 nt, Salmonella typhimurium LT2
acuggcaguaaaaagaaa

SEQ ID NO: 1853541 - RNA, 22 nt, Salmonella typhimurium LT2
acuuaaacgccggauuccagaa

SEQ ID NO: 1853542 - RNA, 20 nt, Salmonella typhimurium LT2
acuuaaaguacuucacaauc

SEQ ID NO: 1853543 - RNA, 15 nt, Salmonella typhimurium LT2
acuuaaauaaaaaug

SEQ ID NO: 1853544 - RNA, 19 nt, Salmonella typhimurium LT2
acuuaauuauuaauccaau

SEQ ID NO: 1853545 - RNA, 11 nt, Salmonella typhimurium LT2
acuaacugccg

SEQ ID NO: 1853546 - RNA, 21 nt, Salmonella typhimurium LT2
acuaacgugaaccuccuguga

SEQ ID NO: 1853547 - RNA, 19 nt, Salmonella typhimurium LT2
acuaacuccagcaucauuu

SEQ ID NO: 1853548 - RNA, 15 nt, Salmonella typhimurium LT2
acuaacgaggccacc

SEQ ID NO: 1853549 - RNA, 19 nt, Salmonella typhimurium LT2
acuaacgaggccaccauca

SEQ ID NO: 1853550 - RNA, 20 nt, Salmonella typhimurium LT2
acuaagaccagcaucagaau

SEQ ID NO: 1853551 - RNA, 11 nt, Salmonella typhimurium LT2
acuacagcccu

SEQ ID NO: 1853552 - RNA, 20 nt, Salmonella typhimurium LT2
acuaauuaaacggaauacca

SEQ ID NO: 1853553 - RNA, 21 nt, Salmonella typhimurium LT2
acuaagguugaaagaccuaaa

SEQ ID NO: 1853554 - RNA, 21 nt, Salmonella typhimurium LT2
acuacaugccaacuuuacuua

SEQ ID NO: 1853555 - RNA, 15 nt, Salmonella typhimurium LT2
acuacaucauucgag

SEQ ID NO: 1853556 - RNA, 18 nt, Salmonella typhimurium LT2
acuacauacgcgcaugaa

SEQ ID NO: 1853557 - RNA, 20 nt, Salmonella typhimurium LT2
acuaccagcguaccgauaau

SEQ ID NO: 1853558 - RNA, 16 nt, Salmonella typhimurium LT2
acuaccggcaccagca

SEQ ID NO: 1853559 - RNA, 20 nt, Salmonella typhimurium LT2
acuauaaaaauaccggcauc

SEQ ID NO: 1853560 - RNA, 22 nt, Salmonella typhimurium LT2
acuagcgaaucacauccgccag

SEQ ID NO: 1853561 - RNA, 15 nt, Salmonella typhimurium LT2
acuagccauauauga

SEQ ID NO: 1853562 - RNA, 14 nt, Salmonella typhimurium LT2
acuagcauaagcac

SEQ ID NO: 1853563 - RNA, 16 nt, Salmonella typhimurium LT2
acuagcauaagcacag

SEQ ID NO: 1853564 - RNA, 13 nt, Salmonella typhimurium LT2
acuagcaaaacau

SEQ ID NO: 1853565 - RNA, 20 nt, Salmonella typhimurium LT2
acuauaauugcuuuuuucca

SEQ ID NO: 1853566 - RNA, 16 nt, Salmonella typhimurium LT2
acuauucuuaucauuu

SEQ ID NO: 1853567 - RNA, 21 nt, Salmonella typhimurium LT2
acguagcuuauaaaucagcuu

SEQ ID NO: 1853568 - RNA, 18 nt, Salmonella typhimurium LT2
acguagucguuguaggcc

SEQ ID NO: 1853569 - RNA, 18 nt, Salmonella typhimurium LT2
acguagccgcaaaugcca

SEQ ID NO: 1853570 - RNA, 16 nt, Salmonella typhimurium LT2
acguagcccauuguca

SEQ ID NO: 1853571 - RNA, 18 nt, Salmonella typhimurium LT2
acguagcucgcccagcac

SEQ ID NO: 1853572 - RNA, 17 nt, Salmonella typhimurium LT2
acgucugucagaacccu

SEQ ID NO: 1853573 - RNA, 21 nt, Salmonella typhimurium LT2
acgugaaacugauaguuuaaa

SEQ ID NO: 1853574 - RNA, 17 nt, Salmonella typhimurium LT2
acgugacgcgccagcgg

SEQ ID NO: 1853575 - RNA, 14 nt, Salmonella typhimurium LT2
acguucuucuccca

SEQ ID NO: 1853576 - RNA, 17 nt, Salmonella typhimurium LT2
acguuacuugauggaaa

SEQ ID NO: 1853577 - RNA, 20 nt, Salmonella typhimurium LT2
acgugcuguggaaaaucagc

SEQ ID NO: 1853578 - RNA, 21 nt, Salmonella typhimurium LT2
acgugcucaaucgccugccgu

SEQ ID NO: 1853579 - RNA, 19 nt, Salmonella typhimurium LT2
acguuguucgcuucuucua

SEQ ID NO: 1853580 - RNA, 19 nt, Salmonella typhimurium LT2
acguuugccggugccauuc

SEQ ID NO: 1853581 - RNA, 16 nt, Salmonella typhimurium LT2
acguuuguaacagcag

SEQ ID NO: 1853582 - RNA, 11 nt, Salmonella typhimurium LT2
acguuuccccg

SEQ ID NO: 1853583 - RNA, 23 nt, Salmonella typhimurium LT2
acguugcggacuucggggauuuc

SEQ ID NO: 1853584 - RNA, 17 nt, Salmonella typhimurium LT2
acguugaugauaaauug

SEQ ID NO: 1853585 - RNA, 19 nt, Salmonella typhimurium LT2
acguuggggauaaccagaa

SEQ ID NO: 1853586 - RNA, 17 nt, Salmonella typhimurium LT2
acguugugauaaaucgu

SEQ ID NO: 1853587 - RNA, 14 nt, Salmonella typhimurium LT2
acguugugaugaac

SEQ ID NO: 1853588 - RNA, 22 nt, Salmonella typhimurium LT2
acguugucggcucauccagcag

SEQ ID NO: 1853589 - RNA, 21 nt, Salmonella typhimurium LT2
acuaaacuaaugccuggcagu

SEQ ID NO: 1853590 - RNA, 22 nt, Salmonella typhimurium LT2
acuaaagcgaauuguuugaaaa

SEQ ID NO: 1853591 - RNA, 19 nt, Salmonella typhimurium LT2
acguuuuuuacgucagcaa

SEQ ID NO: 1853592 - RNA, 22 nt, Salmonella typhimurium LT2
acuaaaauacucacuaucacac

SEQ ID NO: 1853593 - RNA, 23 nt, Salmonella typhimurium LT2
acuaaaauacucacuaucacacu

SEQ ID NO: 1853594 - RNA, 14 nt, Salmonella typhimurium LT2
acgccaucgacaaa

SEQ ID NO: 1853595 - RNA, 16 nt, Salmonella typhimurium LT2
acgccauaauccacaa

SEQ ID NO: 1853596 - RNA, 18 nt, Salmonella typhimurium LT2
acgccauaauccacaacg

SEQ ID NO: 1853597 - RNA, 23 nt, Salmonella typhimurium LT2
acgcuaugccuggauguauaagu

SEQ ID NO: 1853598 - RNA, 20 nt, Salmonella typhimurium LT2
acgcucaacgcguucaucca

SEQ ID NO: 1853599 - RNA, 23 nt, Salmonella typhimurium LT2
acgcucaacgcguucauccagcg

SEQ ID NO: 1853600 - RNA, 15 nt, Salmonella typhimurium LT2
acgcuauuuaaaaac

SEQ ID NO: 1853601 - RNA, 14 nt, Salmonella typhimurium LT2
acgcucauaaaaaa

SEQ ID NO: 1853602 - RNA, 17 nt, Salmonella typhimurium LT2
acgcugaaaaccgcauc

SEQ ID NO: 1853603 - RNA, 17 nt, Salmonella typhimurium LT2
acgcugaugaaaaguau

SEQ ID NO: 1853604 - RNA, 11 nt, Salmonella typhimurium LT2
acgcugcaguu

SEQ ID NO: 1853605 - RNA, 23 nt, Salmonella typhimurium LT2
acgcugaauaucgucaguaugca

SEQ ID NO: 1853606 - RNA, 15 nt, Salmonella typhimurium LT2
acgcugaccacgccg

SEQ ID NO: 1853607 - RNA, 16 nt, Salmonella typhimurium LT2
acgcugagucagaaac

SEQ ID NO: 1853608 - RNA, 19 nt, Salmonella typhimurium LT2
acgcugaccacgccgccgc

SEQ ID NO: 1853609 - RNA, 14 nt, Salmonella typhimurium LT2
acgcuuauccggcu

SEQ ID NO: 1853610 - RNA, 15 nt, Salmonella typhimurium LT2
acgcuucuucgauuu

SEQ ID NO: 1853611 - RNA, 21 nt, Salmonella typhimurium LT2
acgcuuaaucaguugcaggaa

SEQ ID NO: 1853612 - RNA, 16 nt, Salmonella typhimurium LT2
acgcuuaucccagccg

SEQ ID NO: 1853613 - RNA, 19 nt, Salmonella typhimurium LT2
acgcuuaucaguccccaca

SEQ ID NO: 1853614 - RNA, 19 nt, Salmonella typhimurium LT2
acggcaaaacgugguaaaa

SEQ ID NO: 1853615 - RNA, 20 nt, Salmonella typhimurium LT2
acggcaaaacgugguaaaaa

SEQ ID NO: 1853616 - RNA, 13 nt, Salmonella typhimurium LT2
acggauccagaac

SEQ ID NO: 1853617 - RNA, 19 nt, Salmonella typhimurium LT2
acggagcauaauuuuccug

SEQ ID NO: 1853618 - RNA, 16 nt, Salmonella typhimurium LT2
acggaggcgccagaga

SEQ ID NO: 1853619 - RNA, 17 nt, Salmonella typhimurium LT2
acggagagacaguucag

SEQ ID NO: 1853620 - RNA, 21 nt, Salmonella typhimurium LT2
acggagauuaacagcgcgacc

SEQ ID NO: 1853621 - RNA, 15 nt, Salmonella typhimurium LT2
acggagaaaagcgaa

SEQ ID NO: 1853622 - RNA, 16 nt, Salmonella typhimurium LT2
acggacaucagaggua

SEQ ID NO: 1853623 - RNA, 11 nt, Salmonella typhimurium LT2
acggacguggg

SEQ ID NO: 1853624 - RNA, 15 nt, Salmonella typhimurium LT2
acggaacaaaacgga

SEQ ID NO: 1853625 - RNA, 19 nt, Salmonella typhimurium LT2
acggaacaaaacggaaugu

SEQ ID NO: 1853626 - RNA, 22 nt, Salmonella typhimurium LT2
acggaacaacgcaacacaggcc

SEQ ID NO: 1853627 - RNA, 14 nt, Salmonella typhimurium LT2
acggaaaaaauacu

SEQ ID NO: 1853628 - RNA, 15 nt, Salmonella typhimurium LT2
acgcuuuuccuucca

SEQ ID NO: 1853629 - RNA, 14 nt, Salmonella typhimurium LT2
acggaaaccagcau

SEQ ID NO: 1853630 - RNA, 22 nt, Salmonella typhimurium LT2
acggaaccauuccgacagugaa

SEQ ID NO: 1853631 - RNA, 14 nt, Salmonella typhimurium LT2
acggaacccagcaa

SEQ ID NO: 1853632 - RNA, 19 nt, Salmonella typhimurium LT2
acggaauaucccgcaagaa

SEQ ID NO: 1853633 - RNA, 15 nt, Salmonella typhimurium LT2
acgcuugcccggauc

SEQ ID NO: 1853634 - RNA, 13 nt, Salmonella typhimurium LT2
acgcuugcgccag

SEQ ID NO: 1853635 - RNA, 23 nt, Salmonella typhimurium LT2
acgcuuuauucugucgccaccac

SEQ ID NO: 1853636 - RNA, 21 nt, Salmonella typhimurium LT2
acgcuuuccaguugcggcauc

SEQ ID NO: 1853637 - RNA, 22 nt, Salmonella typhimurium LT2
acgguuucuacuuccaccaccu

SEQ ID NO: 1853638 - RNA, 17 nt, Salmonella typhimurium LT2
acgguuuuaacaacccg

SEQ ID NO: 1853639 - RNA, 22 nt, Salmonella typhimurium LT2
acgguuuacgauacguuugaaa

SEQ ID NO: 1853640 - RNA, 17 nt, Salmonella typhimurium LT2
acguaaauacccaggcc

SEQ ID NO: 1853641 - RNA, 21 nt, Salmonella typhimurium LT2
acguaaauuacuuaugauaua

SEQ ID NO: 1853642 - RNA, 22 nt, Salmonella typhimurium LT2
acguaaagcuggccuucagguu

SEQ ID NO: 1853643 - RNA, 16 nt, Salmonella typhimurium LT2
acguaacaugaccugc

SEQ ID NO: 1853644 - RNA, 20 nt, Salmonella typhimurium LT2
acguaacgguguuucaucuu

SEQ ID NO: 1853645 - RNA, 12 nt, Salmonella typhimurium LT2
acguacugcacc

SEQ ID NO: 1853646 - RNA, 22 nt, Salmonella typhimurium LT2
acguacagguugugcaucuccu

SEQ ID NO: 1853647 - RNA, 16 nt, Salmonella typhimurium LT2
acguaaugcgaaaaac

SEQ ID NO: 1853648 - RNA, 20 nt, Salmonella typhimurium LT2
acguaacugcgguaaauaau

SEQ ID NO: 1853649 - RNA, 23 nt, Salmonella typhimurium LT2
acgguuguguauccauagucagc

SEQ ID NO: 1853650 - RNA, 17 nt, Salmonella typhimurium LT2
acgguuggccagcaugg

SEQ ID NO: 1853651 - RNA, 20 nt, Salmonella typhimurium LT2
acgguacgcaucaccaggca

SEQ ID NO: 1853652 - RNA, 20 nt, Salmonella typhimurium LT2
acgguaauugccgggaaaac

SEQ ID NO: 1853653 - RNA, 16 nt, Salmonella typhimurium LT2
acgguaauauugagca

SEQ ID NO: 1853654 - RNA, 20 nt, Salmonella typhimurium LT2
acgguaaccauuuccggauc

SEQ ID NO: 1853655 - RNA, 14 nt, Salmonella typhimurium LT2
acgguaaaccucuu

SEQ ID NO: 1853656 - RNA, 16 nt, Salmonella typhimurium LT2
acgggcggaggggagg

SEQ ID NO: 1853657 - RNA, 16 nt, Salmonella typhimurium LT2
acgggucugaauagcg

SEQ ID NO: 1853658 - RNA, 22 nt, Salmonella typhimurium LT2
acgggucgcuucggcgacccgu

SEQ ID NO: 1853659 - RNA, 12 nt, Salmonella typhimurium LT2
acgggccaggcg

SEQ ID NO: 1853660 - RNA, 13 nt, Salmonella typhimurium LT2
acgggaacagaau

SEQ ID NO: 1853661 - RNA, 20 nt, Salmonella typhimurium LT2
acggcuuuccagcagccaga

SEQ ID NO: 1853662 - RNA, 22 nt, Salmonella typhimurium LT2
acggcucgguuuauccccgcug

SEQ ID NO: 1853663 - RNA, 15 nt, Salmonella typhimurium LT2
acggcuccagcgcca

SEQ ID NO: 1853664 - RNA, 13 nt, Salmonella typhimurium LT2
acggcuccuuuuu

SEQ ID NO: 1853665 - RNA, 18 nt, Salmonella typhimurium LT2
acggcuggcaaugcgcug

SEQ ID NO: 1853666 - RNA, 22 nt, Salmonella typhimurium LT2
acggcugccuuuguacagcuug

SEQ ID NO: 1853667 - RNA, 16 nt, Salmonella typhimurium LT2
acggcaacgccuuccu

SEQ ID NO: 1853668 - RNA, 19 nt, Salmonella typhimurium LT2
acggcaaguauacuuauug

SEQ ID NO: 1853669 - RNA, 11 nt, Salmonella typhimurium LT2
acggcgcgcca

SEQ ID NO: 1853670 - RNA, 21 nt, Salmonella typhimurium LT2
acggcgcgaaucccgcguucg

SEQ ID NO: 1853671 - RNA, 14 nt, Salmonella typhimurium LT2
acggcgcgaaaggg

SEQ ID NO: 1853672 - RNA, 20 nt, Salmonella typhimurium LT2
acggcguguugaaguccucu

SEQ ID NO: 1853673 - RNA, 14 nt, Salmonella typhimurium LT2
acggcuacccauga

SEQ ID NO: 1853674 - RNA, 21 nt, Salmonella typhimurium LT2
acggcgucgccugugccguug

SEQ ID NO: 1853675 - RNA, 19 nt, Salmonella typhimurium LT2
acggcgugaccaccgccuu

SEQ ID NO: 1853676 - RNA, 15 nt, Salmonella typhimurium LT2
accucgcauacuucc

SEQ ID NO: 1853677 - RNA, 23 nt, Salmonella typhimurium LT2
accucgcuucccugacgcgcagc

SEQ ID NO: 1853678 - RNA, 18 nt, Salmonella typhimurium LT2
accucgguauguccugcc

SEQ ID NO: 1853679 - RNA, 16 nt, Salmonella typhimurium LT2
accucucaccgcccag

SEQ ID NO: 1853680 - RNA, 18 nt, Salmonella typhimurium LT2
accugaaaccaggcgcga

SEQ ID NO: 1853681 - RNA, 23 nt, Salmonella typhimurium LT2
accucuuugcggccuuuauccag

SEQ ID NO: 1853682 - RNA, 13 nt, Salmonella typhimurium LT2
accucuuuuuccg

SEQ ID NO: 1853683 - RNA, 18 nt, Salmonella typhimurium LT2
accucuucguucauccgu

SEQ ID NO: 1853684 - RNA, 17 nt, Salmonella typhimurium LT2
accucuuccgccagguc

SEQ ID NO: 1853685 - RNA, 14 nt, Salmonella typhimurium LT2
accucugcuuuuau

SEQ ID NO: 1853686 - RNA, 13 nt, Salmonella typhimurium LT2
accggugcgcccc

SEQ ID NO: 1853687 - RNA, 19 nt, Salmonella typhimurium LT2
accggugcgccccagcaug

SEQ ID NO: 1853688 - RNA, 16 nt, Salmonella typhimurium LT2
accuccucucuuccuc

SEQ ID NO: 1853689 - RNA, 18 nt, Salmonella typhimurium LT2
accuccucucuuccuccu

SEQ ID NO: 1853690 - RNA, 22 nt, Salmonella typhimurium LT2
accuccgcccggugcucaauaa

SEQ ID NO: 1853691 - RNA, 14 nt, Salmonella typhimurium LT2
accuccgccaccag

SEQ ID NO: 1853692 - RNA, 11 nt, Salmonella typhimurium LT2
accuccgggug

SEQ ID NO: 1853693 - RNA, 16 nt, Salmonella typhimurium LT2
accucaaggcucagca

SEQ ID NO: 1853694 - RNA, 11 nt, Salmonella typhimurium LT2
accucaauaug

SEQ ID NO: 1853695 - RNA, 18 nt, Salmonella typhimurium LT2
accucaaugauuuccgca

SEQ ID NO: 1853696 - RNA, 20 nt, Salmonella typhimurium LT2
accucacggagaaaagcgaa

SEQ ID NO: 1853697 - RNA, 23 nt, Salmonella typhimurium LT2
accucacggagaaaagcgaaaau

SEQ ID NO: 1853698 - RNA, 19 nt, Salmonella typhimurium LT2
accucccgccggggcuccc

SEQ ID NO: 1853699 - RNA, 13 nt, Salmonella typhimurium LT2
accucaucaaaca

SEQ ID NO: 1853700 - RNA, 20 nt, Salmonella typhimurium LT2
accuuuuuuuccagcgucug

SEQ ID NO: 1853701 - RNA, 22 nt, Salmonella typhimurium LT2
accuuuccaggauuaauuuucu

SEQ ID NO: 1853702 - RNA, 17 nt, Salmonella typhimurium LT2
accuuuuucaucacgcu

SEQ ID NO: 1853703 - RNA, 21 nt, Salmonella typhimurium LT2
acgaaauggugugcauggugu

SEQ ID NO: 1853704 - RNA, 18 nt, Salmonella typhimurium LT2
accuugccgggccuggca

SEQ ID NO: 1853705 - RNA, 22 nt, Salmonella typhimurium LT2
accuucgcguaaugcaaucaaa

SEQ ID NO: 1853706 - RNA, 18 nt, Salmonella typhimurium LT2
accuugauucccuuuugc

SEQ ID NO: 1853707 - RNA, 19 nt, Salmonella typhimurium LT2
accuuccauuaugaugagu

SEQ ID NO: 1853708 - RNA, 17 nt, Salmonella typhimurium LT2
accuuaucgagaauacu

SEQ ID NO: 1853709 - RNA, 20 nt, Salmonella typhimurium LT2
accuuaaaaggcgcucgccu

SEQ ID NO: 1853710 - RNA, 18 nt, Salmonella typhimurium LT2
accuuaagcgcgaaauuu

SEQ ID NO: 1853711 - RNA, 16 nt, Salmonella typhimurium LT2
accuguugcggggcuu

SEQ ID NO: 1853712 - RNA, 18 nt, Salmonella typhimurium LT2
accuguugcacgcauggc

SEQ ID NO: 1853713 - RNA, 20 nt, Salmonella typhimurium LT2
accuguugcacgcauggcac

SEQ ID NO: 1853714 - RNA, 14 nt, Salmonella typhimurium LT2
accuguuaucagga

SEQ ID NO: 1853715 - RNA, 20 nt, Salmonella typhimurium LT2
accuggguagcuucugucug

SEQ ID NO: 1853716 - RNA, 21 nt, Salmonella typhimurium LT2
accuggguagcuucugucugc

SEQ ID NO: 1853717 - RNA, 17 nt, Salmonella typhimurium LT2
accugggagucgugcaa

SEQ ID NO: 1853718 - RNA, 19 nt, Salmonella typhimurium LT2
accugggagacgucaaaga

SEQ ID NO: 1853719 - RNA, 20 nt, Salmonella typhimurium LT2
acgcaaaggcguugugcugc

SEQ ID NO: 1853720 - RNA, 12 nt, Salmonella typhimurium LT2
acgcaacaacag

SEQ ID NO: 1853721 - RNA, 17 nt, Salmonella typhimurium LT2
acgauguucgucccugc

SEQ ID NO: 1853722 - RNA, 15 nt, Salmonella typhimurium LT2
acgauugaucucauc

SEQ ID NO: 1853723 - RNA, 17 nt, Salmonella typhimurium LT2
acgauggcaaauaauac

SEQ ID NO: 1853724 - RNA, 16 nt, Salmonella typhimurium LT2
acgacuuauucaauca

SEQ ID NO: 1853725 - RNA, 17 nt, Salmonella typhimurium LT2
acgacuuauucaaucaa

SEQ ID NO: 1853726 - RNA, 12 nt, Salmonella typhimurium LT2
acgaaguuuaau

SEQ ID NO: 1853727 - RNA, 19 nt, Salmonella typhimurium LT2
acgagaacccacuuugcuu

SEQ ID NO: 1853728 - RNA, 19 nt, Salmonella typhimurium LT2
acgagaacucagaggcggc

SEQ ID NO: 1853729 - RNA, 18 nt, Salmonella typhimurium LT2
acgagaacccacuuugcu

SEQ ID NO: 1853730 - RNA, 13 nt, Salmonella typhimurium LT2
acgacuuuuccuu

SEQ ID NO: 1853731 - RNA, 13 nt, Salmonella typhimurium LT2
acgaacugcggcu

SEQ ID NO: 1853732 - RNA, 13 nt, Salmonella typhimurium LT2
acgaacugcugcc

SEQ ID NO: 1853733 - RNA, 17 nt, Salmonella typhimurium LT2
acgaacugcugcccugg

SEQ ID NO: 1853734 - RNA, 17 nt, Salmonella typhimurium LT2
acgaagagaccugugua

SEQ ID NO: 1853735 - RNA, 18 nt, Salmonella typhimurium LT2
acgaagauuaucgucuau

SEQ ID NO: 1853736 - RNA, 16 nt, Salmonella typhimurium LT2
acgagagacugauaau

SEQ ID NO: 1853737 - RNA, 19 nt, Salmonella typhimurium LT2
acgaguacguaaugcgaaa

SEQ ID NO: 1853738 - RNA, 13 nt, Salmonella typhimurium LT2
acgauacccacca

SEQ ID NO: 1853739 - RNA, 16 nt, Salmonella typhimurium LT2
acgauacucagcccca

SEQ ID NO: 1853740 - RNA, 19 nt, Salmonella typhimurium LT2
acgauacucaaaccugcgc

SEQ ID NO: 1853741 - RNA, 20 nt, Salmonella typhimurium LT2
acgauacggcccagacccca

SEQ ID NO: 1853742 - RNA, 21 nt, Salmonella typhimurium LT2
acgauacggcccagaccccag

SEQ ID NO: 1853743 - RNA, 18 nt, Salmonella typhimurium LT2
acgcagaaccgccgcgau

SEQ ID NO: 1853744 - RNA, 14 nt, Salmonella typhimurium LT2
acgcacuguuggcg

SEQ ID NO: 1853745 - RNA, 22 nt, Salmonella typhimurium LT2
acgcacucucaaacuauuuuua

SEQ ID NO: 1853746 - RNA, 18 nt, Salmonella typhimurium LT2
acgcagcaucucaauauc

SEQ ID NO: 1853747 - RNA, 12 nt, Salmonella typhimurium LT2
acgcagcaagaa

SEQ ID NO: 1853748 - RNA, 17 nt, Salmonella typhimurium LT2
acgcagccgaggcuuaa

SEQ ID NO: 1853749 - RNA, 23 nt, Salmonella typhimurium LT2
acgcagccgaggcuuaauacagc

SEQ ID NO: 1853750 - RNA, 16 nt, Salmonella typhimurium LT2
acgcaggcauccgguu

SEQ ID NO: 1853751 - RNA, 16 nt, Salmonella typhimurium LT2
acgcaggcuugcccau

SEQ ID NO: 1853752 - RNA, 12 nt, Salmonella typhimurium LT2
acgcagccgguc

SEQ ID NO: 1853753 - RNA, 18 nt, Salmonella typhimurium LT2
acgcagcucauacccuuc

SEQ ID NO: 1853754 - RNA, 14 nt, Salmonella typhimurium LT2
acgcaacaccaucc

SEQ ID NO: 1853755 - RNA, 17 nt, Salmonella typhimurium LT2
acgcaacaggccgcauc

SEQ ID NO: 1853756 - RNA, 13 nt, Salmonella typhimurium LT2
acgcaacaacagu

SEQ ID NO: 1853757 - RNA, 17 nt, Salmonella typhimurium LT2
acgcaagagagcaacau

SEQ ID NO: 1853758 - RNA, 22 nt, Salmonella typhimurium LT2
acgcaauacuguaagccucgcu

SEQ ID NO: 1853759 - RNA, 19 nt, Salmonella typhimurium LT2
acgcaagguagccacgccc

SEQ ID NO: 1853760 - RNA, 22 nt, Salmonella typhimurium LT2
acgcaauuagguuauagcgggg

SEQ ID NO: 1853761 - RNA, 22 nt, Salmonella typhimurium LT2
acgcacgcguaaggaauccagc

SEQ ID NO: 1853762 - RNA, 15 nt, Salmonella typhimurium LT2
acgcaguacgcgcaa

SEQ ID NO: 1853763 - RNA, 17 nt, Salmonella typhimurium LT2
acgcaguuuaaagccaa

SEQ ID NO: 1853764 - RNA, 17 nt, Salmonella typhimurium LT2
acgcaguuuaucagaag

SEQ ID NO: 1853765 - RNA, 20 nt, Salmonella typhimurium LT2
acgcauaucccacugcacgc

SEQ ID NO: 1853766 - RNA, 24 nt, Salmonella typhimurium LT2
acgcauaucccacugcacgccagg

SEQ ID NO: 1853767 - RNA, 15 nt, Salmonella typhimurium LT2
acgcauacgcagcac

SEQ ID NO: 1853768 - RNA, 18 nt, Salmonella typhimurium LT2
acgcauacgcagcacuuu

SEQ ID NO: 1853769 - RNA, 16 nt, Salmonella typhimurium LT2
acgcauccugcacuuu

SEQ ID NO: 1853770 - RNA, 22 nt, Salmonella typhimurium LT2
acgcaucauauucgcagcucug

SEQ ID NO: 1853771 - RNA, 23 nt, Salmonella typhimurium LT2
acgcaucugggcugacaaaaauu

SEQ ID NO: 1853772 - RNA, 18 nt, Salmonella typhimurium LT2
acgcaugacccaggcauc

SEQ ID NO: 1853773 - RNA, 16 nt, Salmonella typhimurium LT2
acgcaucuuuuucccg

SEQ ID NO: 1853774 - RNA, 14 nt, Salmonella typhimurium LT2
acgcauugcagcau

SEQ ID NO: 1853775 - RNA, 18 nt, Salmonella typhimurium LT2
acgcauuaaaaugauggu

SEQ ID NO: 1853776 - RNA, 17 nt, Salmonella typhimurium LT2
acgccagauuaucggcc

SEQ ID NO: 1853777 - RNA, 11 nt, Salmonella typhimurium LT2
acgccagcaga

SEQ ID NO: 1853778 - RNA, 12 nt, Salmonella typhimurium LT2
acgccagccagc

SEQ ID NO: 1853779 - RNA, 13 nt, Salmonella typhimurium LT2
acgccagccagcc

SEQ ID NO: 1853780 - RNA, 20 nt, Salmonella typhimurium LT2
acgccagaucguuaauaauc

SEQ ID NO: 1853781 - RNA, 19 nt, Salmonella typhimurium LT2
acgccagcuuggguauaga

SEQ ID NO: 1853782 - RNA, 13 nt, Salmonella typhimurium LT2
acgccagucacca

SEQ ID NO: 1853783 - RNA, 22 nt, Salmonella typhimurium LT2
acgccaccgccgccaccaaaaa

SEQ ID NO: 1853784 - RNA, 14 nt, Salmonella typhimurium LT2
acgccaccacgccg

SEQ ID NO: 1853785 - RNA, 19 nt, Salmonella typhimurium LT2
acgccaccuuugaaaauca

SEQ ID NO: 1853786 - RNA, 17 nt, Salmonella typhimurium LT2
acgccacggucgagcau

SEQ ID NO: 1853787 - RNA, 21 nt, Salmonella typhimurium LT2
acgccaagcgcggcagcagcu

SEQ ID NO: 1853788 - RNA, 23 nt, Salmonella typhimurium LT2
accgcccgcgcuuuagggcuucc

SEQ ID NO: 1853789 - RNA, 16 nt, Salmonella typhimurium LT2
accgccgacaaucguc

SEQ ID NO: 1853790 - RNA, 14 nt, Salmonella typhimurium LT2
accgccgagcccga

SEQ ID NO: 1853791 - RNA, 13 nt, Salmonella typhimurium LT2
accgcccugcagg

SEQ ID NO: 1853792 - RNA, 16 nt, Salmonella typhimurium LT2
accgccgccaaacugc

SEQ ID NO: 1853793 - RNA, 20 nt, Salmonella typhimurium LT2
accgccacggcaagaaaaau

SEQ ID NO: 1853794 - RNA, 17 nt, Salmonella typhimurium LT2
accgccaugcggcgcca

SEQ ID NO: 1853795 - RNA, 22 nt, Salmonella typhimurium LT2
accgccagcggcguuuuuuccu

SEQ ID NO: 1853796 - RNA, 14 nt, Salmonella typhimurium LT2
accgcacugcaucg

SEQ ID NO: 1853797 - RNA, 20 nt, Salmonella typhimurium LT2
accgccaaucaacgccgcca

SEQ ID NO: 1853798 - RNA, 14 nt, Salmonella typhimurium LT2
accgcauacugaac

SEQ ID NO: 1853799 - RNA, 16 nt, Salmonella typhimurium LT2
accgcaucaaacucgc

SEQ ID NO: 1853800 - RNA, 16 nt, Salmonella typhimurium LT2
accgcaucaagcccau

SEQ ID NO: 1853801 - RNA, 15 nt, Salmonella typhimurium LT2
accgcauggaaucga

SEQ ID NO: 1853802 - RNA, 12 nt, Salmonella typhimurium LT2
accgaucaucau

SEQ ID NO: 1853803 - RNA, 13 nt, Salmonella typhimurium LT2
accgaucaucauc

SEQ ID NO: 1853804 - RNA, 14 nt, Salmonella typhimurium LT2
accgaucugguugu

SEQ ID NO: 1853805 - RNA, 13 nt, Salmonella typhimurium LT2
accgagcagccug

SEQ ID NO: 1853806 - RNA, 14 nt, Salmonella typhimurium LT2
accgagauacgcug

SEQ ID NO: 1853807 - RNA, 19 nt, Salmonella typhimurium LT2
acccguugguuaacuucaa

SEQ ID NO: 1853808 - RNA, 18 nt, Salmonella typhimurium LT2
acccguggcugcgccugc

SEQ ID NO: 1853809 - RNA, 20 nt, Salmonella typhimurium LT2
acccguuaaauaccagcacc

SEQ ID NO: 1853810 - RNA, 15 nt, Salmonella typhimurium LT2
acccguucgcugcau

SEQ ID NO: 1853811 - RNA, 22 nt, Salmonella typhimurium LT2
accggcaaauaccgucauaauc

SEQ ID NO: 1853812 - RNA, 15 nt, Salmonella typhimurium LT2
accggcccuuccgua

SEQ ID NO: 1853813 - RNA, 17 nt, Salmonella typhimurium LT2
accggauauggcaaaaa

SEQ ID NO: 1853814 - RNA, 23 nt, Salmonella typhimurium LT2
accgggccugaugcgcguuuagc

SEQ ID NO: 1853815 - RNA, 17 nt, Salmonella typhimurium LT2
accgggcgcaaucauca

SEQ ID NO: 1853816 - RNA, 19 nt, Salmonella typhimurium LT2
accggcuauccaugcgucg

SEQ ID NO: 1853817 - RNA, 12 nt, Salmonella typhimurium LT2
accggcgcgccu

SEQ ID NO: 1853818 - RNA, 20 nt, Salmonella typhimurium LT2
accggcgcgccuuccagcaa

SEQ ID NO: 1853819 - RNA, 22 nt, Salmonella typhimurium LT2
accggcgccagaagcuggcggu

SEQ ID NO: 1853820 - RNA, 17 nt, Salmonella typhimurium LT2
accggcgaacgcuggcu

SEQ ID NO: 1853821 - RNA, 22 nt, Salmonella typhimurium LT2
accggcgaaaucgugcgcccca

SEQ ID NO: 1853822 - RNA, 13 nt, Salmonella typhimurium LT2
accgcgccaggcg

SEQ ID NO: 1853823 - RNA, 15 nt, Salmonella typhimurium LT2
accgcgccaggcggc

SEQ ID NO: 1853824 - RNA, 16 nt, Salmonella typhimurium LT2
accgcgaugaccauca

SEQ ID NO: 1853825 - RNA, 16 nt, Salmonella typhimurium LT2
accgcgaugugcuggg

SEQ ID NO: 1853826 - RNA, 17 nt, Salmonella typhimurium LT2
accgcgaugugcugggg

SEQ ID NO: 1853827 - RNA, 20 nt, Salmonella typhimurium LT2
accgcgcggcguucugcgcc

SEQ ID NO: 1853828 - RNA, 21 nt, Salmonella typhimurium LT2
accgcgcggcauaaauccggu

SEQ ID NO: 1853829 - RNA, 17 nt, Salmonella typhimurium LT2
accgccuuccugcugcg

SEQ ID NO: 1853830 - RNA, 12 nt, Salmonella typhimurium LT2
accgccuucgca

SEQ ID NO: 1853831 - RNA, 23 nt, Salmonella typhimurium LT2
accgccugcacugguagaaaaac

SEQ ID NO: 1853832 - RNA, 16 nt, Salmonella typhimurium LT2
accgcgaacauuggaa

SEQ ID NO: 1853833 - RNA, 19 nt, Salmonella typhimurium LT2
accgccucgccaaagcgcu

SEQ ID NO: 1853834 - RNA, 21 nt, Salmonella typhimurium LT2
accgccguuucguugccagag

SEQ ID NO: 1853835 - RNA, 17 nt, Salmonella typhimurium LT2
accgccguuuugauuug

SEQ ID NO: 1853836 - RNA, 22 nt, Salmonella typhimurium LT2
accgccuaacagcgccgcgccg

SEQ ID NO: 1853837 - RNA, 22 nt, Salmonella typhimurium LT2
accgccggaaauuugcagcgcu

SEQ ID NO: 1853838 - RNA, 19 nt, Salmonella typhimurium LT2
accauaccggugcgcccca

SEQ ID NO: 1853839 - RNA, 16 nt, Salmonella typhimurium LT2
accauacugacuuaau

SEQ ID NO: 1853840 - RNA, 17 nt, Salmonella typhimurium LT2
accauacugacuuaaua

SEQ ID NO: 1853841 - RNA, 22 nt, Salmonella typhimurium LT2
accagaaccucacggagaaaag

SEQ ID NO: 1853842 - RNA, 22 nt, Salmonella typhimurium LT2
accagaaaaccgacagcaauau

SEQ ID NO: 1853843 - RNA, 19 nt, Salmonella typhimurium LT2
accacuuugcgcuccugcu

SEQ ID NO: 1853844 - RNA, 13 nt, Salmonella typhimurium LT2
accauaaugaucg

SEQ ID NO: 1853845 - RNA, 14 nt, Salmonella typhimurium LT2
accaugcaccacac

SEQ ID NO: 1853846 - RNA, 16 nt, Salmonella typhimurium LT2
accaugauucauacgc

SEQ ID NO: 1853847 - RNA, 12 nt, Salmonella typhimurium LT2
accaugcccggg

SEQ ID NO: 1853848 - RNA, 19 nt, Salmonella typhimurium LT2
accaugguucccgccacug

SEQ ID NO: 1853849 - RNA, 19 nt, Salmonella typhimurium LT2
accaucagcgucagcacca

SEQ ID NO: 1853850 - RNA, 15 nt, Salmonella typhimurium LT2
accauccaugaaaua

SEQ ID NO: 1853851 - RNA, 17 nt, Salmonella typhimurium LT2
accauuggcgcuggggu

SEQ ID NO: 1853852 - RNA, 17 nt, Salmonella typhimurium LT2
accauugcguauuucac

SEQ ID NO: 1853853 - RNA, 18 nt, Salmonella typhimurium LT2
accauugcguauuucacc

SEQ ID NO: 1853854 - RNA, 14 nt, Salmonella typhimurium LT2
accauugauaccaa

SEQ ID NO: 1853855 - RNA, 18 nt, Salmonella typhimurium LT2
accauuccgauagcgaaa

SEQ ID NO: 1853856 - RNA, 18 nt, Salmonella typhimurium LT2
accauuaccgccaacauc

SEQ ID NO: 1853857 - RNA, 16 nt, Salmonella typhimurium LT2
acccaaauaucaaaua

SEQ ID NO: 1853858 - RNA, 13 nt, Salmonella typhimurium LT2
acccaaauaacca

SEQ ID NO: 1853859 - RNA, 10 nt, Salmonella typhimurium LT2
acccaaaaau

SEQ ID NO: 1853860 - RNA, 15 nt, Salmonella typhimurium LT2
acccaacgcaaugcg

SEQ ID NO: 1853861 - RNA, 17 nt, Salmonella typhimurium LT2
acccacaccacagccac

SEQ ID NO: 1853862 - RNA, 17 nt, Salmonella typhimurium LT2
acccacaucagcggcac

SEQ ID NO: 1853863 - RNA, 19 nt, Salmonella typhimurium LT2
accccagguaaauccgcca

SEQ ID NO: 1853864 - RNA, 15 nt, Salmonella typhimurium LT2
accccaguagcccug

SEQ ID NO: 1853865 - RNA, 12 nt, Salmonella typhimurium LT2
accccagcugcg

SEQ ID NO: 1853866 - RNA, 22 nt, Salmonella typhimurium LT2
acccccaccaugucaagguggu

SEQ ID NO: 1853867 - RNA, 17 nt, Salmonella typhimurium LT2
acccccagcacauuaca

SEQ ID NO: 1853868 - RNA, 12 nt, Salmonella typhimurium LT2
acccccagccau

SEQ ID NO: 1853869 - RNA, 11 nt, Salmonella typhimurium LT2
accccaucccg

SEQ ID NO: 1853870 - RNA, 16 nt, Salmonella typhimurium LT2
accccgccaccgccgc

SEQ ID NO: 1853871 - RNA, 16 nt, Salmonella typhimurium LT2
accccgccaucagaca

SEQ ID NO: 1853872 - RNA, 17 nt, Salmonella typhimurium LT2
accccgcaucgcccgcc

SEQ ID NO: 1853873 - RNA, 22 nt, Salmonella typhimurium LT2
accccgccagcagguaaacaga

SEQ ID NO: 1853874 - RNA, 19 nt, Salmonella typhimurium LT2
acccaucagggaaaaaugu

SEQ ID NO: 1853875 - RNA, 15 nt, Salmonella typhimurium LT2
accccacccgcugau

SEQ ID NO: 1853876 - RNA, 14 nt, Salmonella typhimurium LT2
acccaucaauaacg

SEQ ID NO: 1853877 - RNA, 19 nt, Salmonella typhimurium LT2
acccaucaccuggcaacau

SEQ ID NO: 1853878 - RNA, 18 nt, Salmonella typhimurium LT2
acccauauucgucuucau

SEQ ID NO: 1853879 - RNA, 20 nt, Salmonella typhimurium LT2
accccuguucaaaagccugu

SEQ ID NO: 1853880 - RNA, 23 nt, Salmonella typhimurium LT2
accccuggcuuugcaacagggcu

SEQ ID NO: 1853881 - RNA, 18 nt, Salmonella typhimurium LT2
accccucuuucacagcuc

SEQ ID NO: 1853882 - RNA, 21 nt, Salmonella typhimurium LT2
accccugacgggcgauagcuc

SEQ ID NO: 1853883 - RNA, 20 nt, Salmonella typhimurium LT2
accccuucuggagaauaucc

SEQ ID NO: 1853884 - RNA, 14 nt, Salmonella typhimurium LT2
acccgccugcgccu

SEQ ID NO: 1853885 - RNA, 19 nt, Salmonella typhimurium LT2
acccgcgacgacaacgccu

SEQ ID NO: 1853886 - RNA, 16 nt, Salmonella typhimurium LT2
acccgcuccagaagca

SEQ ID NO: 1853887 - RNA, 14 nt, Salmonella typhimurium LT2
acccgcuuaacgau

SEQ ID NO: 1853888 - RNA, 22 nt, Salmonella typhimurium LT2
acccggcugccauuaucaccau

SEQ ID NO: 1853889 - RNA, 19 nt, Salmonella typhimurium LT2
acccggcguauccaguaac

SEQ ID NO: 1853890 - RNA, 14 nt, Salmonella typhimurium LT2
acccggcguuuuca

SEQ ID NO: 1853891 - RNA, 16 nt, Salmonella typhimurium LT2
agaaaccgcagaaaaa

SEQ ID NO: 1853892 - RNA, 14 nt, Salmonella typhimurium LT2
agaaacugcuguag

SEQ ID NO: 1853893 - RNA, 23 nt, Salmonella typhimurium LT2
agaaacuucugcacuuugccaga

SEQ ID NO: 1853894 - RNA, 18 nt, Salmonella typhimurium LT2
agaaaggggagggcaaca

SEQ ID NO: 1853895 - RNA, 14 nt, Salmonella typhimurium LT2
agaaauaaaauacg

SEQ ID NO: 1853896 - RNA, 22 nt, Salmonella typhimurium LT2
acuuuugccaggcggauaaaac

SEQ ID NO: 1853897 - RNA, 21 nt, Salmonella typhimurium LT2
acuuuuggcacgacuuuuccu

SEQ ID NO: 1853898 - RNA, 20 nt, Salmonella typhimurium LT2
acuuuuguagagauccagaa

SEQ ID NO: 1853899 - RNA, 23 nt, Salmonella typhimurium LT2
agaaaacagugauuacaaaaugu

SEQ ID NO: 1853900 - RNA, 18 nt, Salmonella typhimurium LT2
agaaaaccgacagcaaua

SEQ ID NO: 1853901 - RNA, 19 nt, Salmonella typhimurium LT2
agaaaaccgacagcaauau

SEQ ID NO: 1853902 - RNA, 18 nt, Salmonella typhimurium LT2
agaaaacgcaauaaccgu

SEQ ID NO: 1853903 - RNA, 13 nt, Salmonella typhimurium LT2
agaaaacugccag

SEQ ID NO: 1853904 - RNA, 16 nt, Salmonella typhimurium LT2
agaaaagcgaaaauaa

SEQ ID NO: 1853905 - RNA, 16 nt, Salmonella typhimurium LT2
agaagaucgccggaau

SEQ ID NO: 1853906 - RNA, 23 nt, Salmonella typhimurium LT2
agaagaucgccggaauagcaggc

SEQ ID NO: 1853907 - RNA, 16 nt, Salmonella typhimurium LT2
agaaggcgaguuucgc

SEQ ID NO: 1853908 - RNA, 23 nt, Salmonella typhimurium LT2
agaagcgucauaaguguuuuaag

SEQ ID NO: 1853909 - RNA, 22 nt, Salmonella typhimurium LT2
agaagcucaugugcagcaucca

SEQ ID NO: 1853910 - RNA, 12 nt, Salmonella typhimurium LT2
agaacucaucuu

SEQ ID NO: 1853911 - RNA, 14 nt, Salmonella typhimurium LT2
agaacucaggcaaa

SEQ ID NO: 1853912 - RNA, 14 nt, Salmonella typhimurium LT2
agaacuauuugccu

SEQ ID NO: 1853913 - RNA, 13 nt, Salmonella typhimurium LT2
agaacuaucugaa

SEQ ID NO: 1853914 - RNA, 19 nt, Salmonella typhimurium LT2
agaaccguugcgcccauca

SEQ ID NO: 1853915 - RNA, 22 nt, Salmonella typhimurium LT2
agaaccguugcgcccaucauca

SEQ ID NO: 1853916 - RNA, 22 nt, Salmonella typhimurium LT2
agaacugcguaagcauccccac

SEQ ID NO: 1853917 - RNA, 18 nt, Salmonella typhimurium LT2
agaacugcaaauaccaca

SEQ ID NO: 1853918 - RNA, 22 nt, Salmonella typhimurium LT2
agaaccgacugucgaaaccagc

SEQ ID NO: 1853919 - RNA, 21 nt, Salmonella typhimurium LT2
agaaauuauuuuaaauuuccu

SEQ ID NO: 1853920 - RNA, 16 nt, Salmonella typhimurium LT2
agaaauuauuuuaaau

SEQ ID NO: 1853921 - RNA, 19 nt, Salmonella typhimurium LT2
agacacuggaaacagccaa

SEQ ID NO: 1853922 - RNA, 18 nt, Salmonella typhimurium LT2
agacagaacaggaugcuu

SEQ ID NO: 1853923 - RNA, 17 nt, Salmonella typhimurium LT2
agacagacaaccagcag

SEQ ID NO: 1853924 - RNA, 16 nt, Salmonella typhimurium LT2
agacagauaacaccag

SEQ ID NO: 1853925 - RNA, 22 nt, Salmonella typhimurium LT2
agacagagaaccugaacaauaa

SEQ ID NO: 1853926 - RNA, 19 nt, Salmonella typhimurium LT2
agacagcccuauaacagcg

SEQ ID NO: 1853927 - RNA, 21 nt, Salmonella typhimurium LT2
agacacaacgugccagaaaca

SEQ ID NO: 1853928 - RNA, 17 nt, Salmonella typhimurium LT2
agacaaguauaugucug

SEQ ID NO: 1853929 - RNA, 21 nt, Salmonella typhimurium LT2
agacaaugcugacacugauau

SEQ ID NO: 1853930 - RNA, 22 nt, Salmonella typhimurium LT2
agacaaucugugugggcacucg

SEQ ID NO: 1853931 - RNA, 17 nt, Salmonella typhimurium LT2
agacaaccagcagggca

SEQ ID NO: 1853932 - RNA, 15 nt, Salmonella typhimurium LT2
agacaaaauucagac

SEQ ID NO: 1853933 - RNA, 18 nt, Salmonella typhimurium LT2
agacaaaauucagacuca

SEQ ID NO: 1853934 - RNA, 11 nt, Salmonella typhimurium LT2
agacaaacagc

SEQ ID NO: 1853935 - RNA, 15 nt, Salmonella typhimurium LT2
agacaaaguugacuu

SEQ ID NO: 1853936 - RNA, 14 nt, Salmonella typhimurium LT2
agaauuucaaucau

SEQ ID NO: 1853937 - RNA, 15 nt, Salmonella typhimurium LT2
agacaaaaaagcugc

SEQ ID NO: 1853938 - RNA, 23 nt, Salmonella typhimurium LT2
agaauguccuggguaucaauggu

SEQ ID NO: 1853939 - RNA, 18 nt, Salmonella typhimurium LT2
agaauucuugucagucug

SEQ ID NO: 1853940 - RNA, 15 nt, Salmonella typhimurium LT2
agaaugaaaaaaaau

SEQ ID NO: 1853941 - RNA, 17 nt, Salmonella typhimurium LT2
agaaugaaaaaaaauua

SEQ ID NO: 1853942 - RNA, 14 nt, Salmonella typhimurium LT2
agaaugauaaugcc

SEQ ID NO: 1853943 - RNA, 14 nt, Salmonella typhimurium LT2
agaaucccgauaau

SEQ ID NO: 1853944 - RNA, 17 nt, Salmonella typhimurium LT2
agaaucgaucagcuuaa

SEQ ID NO: 1853945 - RNA, 19 nt, Salmonella typhimurium LT2
agaauccagucaggcucaa

SEQ ID NO: 1853946 - RNA, 23 nt, Salmonella typhimurium LT2
agaauccacucggcgcugucguu

SEQ ID NO: 1853947 - RNA, 23 nt, Salmonella typhimurium LT2
agaaggucagguuaugcgcgcca

SEQ ID NO: 1853948 - RNA, 12 nt, Salmonella typhimurium LT2
agaaggguuuug

SEQ ID NO: 1853949 - RNA, 13 nt, Salmonella typhimurium LT2
agaaggguuuugc

SEQ ID NO: 1853950 - RNA, 16 nt, Salmonella typhimurium LT2
agaaguagcagagaaa

SEQ ID NO: 1853951 - RNA, 14 nt, Salmonella typhimurium LT2
agaccgacgccaac

SEQ ID NO: 1853952 - RNA, 13 nt, Salmonella typhimurium LT2
agaccgauaaaua

SEQ ID NO: 1853953 - RNA, 23 nt, Salmonella typhimurium LT2
agacccaaaggaggaaaagcgac

SEQ ID NO: 1853954 - RNA, 18 nt, Salmonella typhimurium LT2
agaccgccuaacagcgcc

SEQ ID NO: 1853955 - RNA, 13 nt, Salmonella typhimurium LT2
aaaacagcauaau

SEQ ID NO: 1853956 - RNA, 18 nt, Salmonella typhimurium LT2
aaaacagccgccauggcg

SEQ ID NO: 1853957 - RNA, 11 nt, Salmonella typhimurium LT2
aaaacagccau

SEQ ID NO: 1853958 - RNA, 18 nt, Salmonella typhimurium LT2
aaaacagcauaauaaagc

SEQ ID NO: 1853959 - RNA, 13 nt, Salmonella typhimurium LT2
aaaacagcauggu

SEQ ID NO: 1853960 - RNA, 20 nt, Salmonella typhimurium LT2
agaccuggggguaacacaaa

SEQ ID NO: 1853961 - RNA, 21 nt, Salmonella typhimurium LT2
agaccuggcucucggcaacaa

SEQ ID NO: 1853962 - RNA, 18 nt, Salmonella typhimurium LT2
agaccggcaaucaauaca

SEQ ID NO: 1853963 - RNA, 19 nt, Salmonella typhimurium LT2
agacgguuguuuuucagau

SEQ ID NO: 1853964 - RNA, 20 nt, Salmonella typhimurium LT2
agacgcaucuuuuucccggu

SEQ ID NO: 1853965 - RNA, 21 nt, Salmonella typhimurium LT2
agacgcaguagcgcuuugaca

SEQ ID NO: 1853966 - RNA, 23 nt, Salmonella typhimurium LT2
aaaacauaaagauaaauaaaaaa

SEQ ID NO: 1853967 - RNA, 21 nt, Salmonella typhimurium LT2
agacaucggagauuucauccu

SEQ ID NO: 1853968 - RNA, 15 nt, Salmonella typhimurium LT2
agacauuauugucuu

SEQ ID NO: 1853969 - RNA, 21 nt, Salmonella typhimurium LT2
agacauucccgccgagaaaau

SEQ ID NO: 1853970 - RNA, 19 nt, Salmonella typhimurium LT2
agacauugguuucaugcau

SEQ ID NO: 1853971 - RNA, 23 nt, Salmonella typhimurium LT2
agacauuugauuccagccuugcu

SEQ ID NO: 1853972 - RNA, 11 nt, Salmonella typhimurium LT2
agacaucaaaa

SEQ ID NO: 1853973 - RNA, 14 nt, Salmonella typhimurium LT2
agacaguggccauc

SEQ ID NO: 1853974 - RNA, 19 nt, Salmonella typhimurium LT2
agacagucucauugaucag

SEQ ID NO: 1853975 - RNA, 20 nt, Salmonella typhimurium LT2
agacaggcaugguuaacaau

SEQ ID NO: 1853976 - RNA, 20 nt, Salmonella typhimurium LT2
agacaggccuucuucauauu

SEQ ID NO: 1853977 - RNA, 21 nt, Salmonella typhimurium LT2
agaccagauuaaucagcagau

SEQ ID NO: 1853978 - RNA, 15 nt, Salmonella typhimurium LT2
agaccauccaugaaa

SEQ ID NO: 1853979 - RNA, 15 nt, Salmonella typhimurium LT2
agaccaccagcgaca

SEQ ID NO: 1853980 - RNA, 18 nt, Salmonella typhimurium LT2
agaccaccguuauuucca

SEQ ID NO: 1853981 - RNA, 20 nt, Salmonella typhimurium LT2
agaccacgccaucaacagcg

SEQ ID NO: 1853982 - RNA, 15 nt, Salmonella typhimurium LT2
agagcgcaccgcgcg

SEQ ID NO: 1853983 - RNA, 17 nt, Salmonella typhimurium LT2
agagcgaaugcgcgcca

SEQ ID NO: 1853984 - RNA, 14 nt, Salmonella typhimurium LT2
agagcaucaucugc

SEQ ID NO: 1853985 - RNA, 16 nt, Salmonella typhimurium LT2
agagccuuauaggcgc

SEQ ID NO: 1853986 - RNA, 19 nt, Salmonella typhimurium LT2
agagcaguacgccaaaaaa

SEQ ID NO: 1853987 - RNA, 13 nt, Salmonella typhimurium LT2
agagcaggccaaa

SEQ ID NO: 1853988 - RNA, 19 nt, Salmonella typhimurium LT2
agagaucgaacaauuaccg

SEQ ID NO: 1853989 - RNA, 19 nt, Salmonella typhimurium LT2
agacgucaaagaguuccug

SEQ ID NO: 1853990 - RNA, 13 nt, Salmonella typhimurium LT2
agacgucauaccu

SEQ ID NO: 1853991 - RNA, 19 nt, Salmonella typhimurium LT2
agacguuuauaccccacca

SEQ ID NO: 1853992 - RNA, 18 nt, Salmonella typhimurium LT2
agacguuuaucggccagc

SEQ ID NO: 1853993 - RNA, 13 nt, Salmonella typhimurium LT2
agacguuuaagca

SEQ ID NO: 1853994 - RNA, 20 nt, Salmonella typhimurium LT2
agacguuuacgccgccaucc

SEQ ID NO: 1853995 - RNA, 18 nt, Salmonella typhimurium LT2
agagguuagcgcaggggg

SEQ ID NO: 1853996 - RNA, 13 nt, Salmonella typhimurium LT2
agagguuccaggc

SEQ ID NO: 1853997 - RNA, 18 nt, Salmonella typhimurium LT2
agagguuccaggcacuca

SEQ ID NO: 1853998 - RNA, 15 nt, Salmonella typhimurium LT2
agagguguuaccggu

SEQ ID NO: 1853999 - RNA, 23 nt, Salmonella typhimurium LT2
agagguguuaccgguucaacugg

SEQ ID NO: 1854000 - RNA, 19 nt, Salmonella typhimurium LT2
agaguaaccacgauaaaga

SEQ ID NO: 1854001 - RNA, 21 nt, Salmonella typhimurium LT2
agaguaaccacgauaaagaca

SEQ ID NO: 1854002 - RNA, 18 nt, Salmonella typhimurium LT2
agaguaacccuucagcuu

SEQ ID NO: 1854003 - RNA, 16 nt, Salmonella typhimurium LT2
agaggcugcgcgaauu

SEQ ID NO: 1854004 - RNA, 19 nt, Salmonella typhimurium LT2
agagguauccugaaccagc

SEQ ID NO: 1854005 - RNA, 11 nt, Salmonella typhimurium LT2
agaggaaagcg

SEQ ID NO: 1854006 - RNA, 11 nt, Salmonella typhimurium LT2
agaggcagcaa

SEQ ID NO: 1854007 - RNA, 19 nt, Salmonella typhimurium LT2
agaggaggagaugucccac

SEQ ID NO: 1854008 - RNA, 23 nt, Salmonella typhimurium LT2
agaggaucuggacgccaauuccu

SEQ ID NO: 1854009 - RNA, 20 nt, Salmonella typhimurium LT2
agauaugaaaugagaccaau

SEQ ID NO: 1854010 - RNA, 15 nt, Salmonella typhimurium LT2
agauauuauaaaaua

SEQ ID NO: 1854011 - RNA, 21 nt, Salmonella typhimurium LT2
agauaucccaucgacuuaaaa

SEQ ID NO: 1854012 - RNA, 17 nt, Salmonella typhimurium LT2
agauaucaccaucuuuu

SEQ ID NO: 1854013 - RNA, 23 nt, Salmonella typhimurium LT2
agauagccugccagcaccagcag

SEQ ID NO: 1854014 - RNA, 14 nt, Salmonella typhimurium LT2
agauauaguuuuuc

SEQ ID NO: 1854015 - RNA, 14 nt, Salmonella typhimurium LT2
agaucagcauggua

SEQ ID NO: 1854016 - RNA, 18 nt, Salmonella typhimurium LT2
agaucaggcgaccaucca

SEQ ID NO: 1854017 - RNA, 17 nt, Salmonella typhimurium LT2
agaucaggaguaaauaa

SEQ ID NO: 1854018 - RNA, 24 nt, Salmonella typhimurium LT2
agaucaggaguaaauaacaaaagc

SEQ ID NO: 1854019 - RNA, 22 nt, Salmonella typhimurium LT2
agauccugcgagcuuuccacca

SEQ ID NO: 1854020 - RNA, 19 nt, Salmonella typhimurium LT2
aaaaccaggcgaaaauagg

SEQ ID NO: 1854021 - RNA, 15 nt, Salmonella typhimurium LT2
agauccugacucacc

SEQ ID NO: 1854022 - RNA, 16 nt, Salmonella typhimurium LT2
agauccugagaaauca

SEQ ID NO: 1854023 - RNA, 14 nt, Salmonella typhimurium LT2
agauccaacacggc

SEQ ID NO: 1854024 - RNA, 16 nt, Salmonella typhimurium LT2
agauacggcuccagca

SEQ ID NO: 1854025 - RNA, 18 nt, Salmonella typhimurium LT2
agauacggcuccagcaca

SEQ ID NO: 1854026 - RNA, 19 nt, Salmonella typhimurium LT2
agauacggcuccagcacau

SEQ ID NO: 1854027 - RNA, 16 nt, Salmonella typhimurium LT2
agauagagcauaauaa

SEQ ID NO: 1854028 - RNA, 20 nt, Salmonella typhimurium LT2
agauaccuacuuuauuuuuc

SEQ ID NO: 1854029 - RNA, 17 nt, Salmonella typhimurium LT2
agauaccuaucggaaga

SEQ ID NO: 1854030 - RNA, 12 nt, Salmonella typhimurium LT2
agauaagcgcca

SEQ ID NO: 1854031 - RNA, 19 nt, Salmonella typhimurium LT2
agauaagcaccugcauuua

SEQ ID NO: 1854032 - RNA, 23 nt, Salmonella typhimurium LT2
agauaagcaccugcauuuaucuu

SEQ ID NO: 1854033 - RNA, 20 nt, Salmonella typhimurium LT2
agaguucaacgccgaacagg

SEQ ID NO: 1854034 - RNA, 14 nt, Salmonella typhimurium LT2
agauaaacacacac

SEQ ID NO: 1854035 - RNA, 13 nt, Salmonella typhimurium LT2
agauaaaucagcc

SEQ ID NO: 1854036 - RNA, 14 nt, Salmonella typhimurium LT2
agauaaauaaaaaa

SEQ ID NO: 1854037 - RNA, 15 nt, Salmonella typhimurium LT2
agauaaauaaaaaau

SEQ ID NO: 1854038 - RNA, 16 nt, Salmonella typhimurium LT2
agauaaauaaaaaauu

SEQ ID NO: 1854039 - RNA, 17 nt, Salmonella typhimurium LT2
agaugaccgaguuccag

SEQ ID NO: 1854040 - RNA, 15 nt, Salmonella typhimurium LT2
agaugcaggccaagc

SEQ ID NO: 1854041 - RNA, 21 nt, Salmonella typhimurium LT2
agaugagcaaaccgcaaauaa

SEQ ID NO: 1854042 - RNA, 12 nt, Salmonella typhimurium LT2
agaugagccaca

SEQ ID NO: 1854043 - RNA, 16 nt, Salmonella typhimurium LT2
aaaaccgacagcaaua

SEQ ID NO: 1854044 - RNA, 15 nt, Salmonella typhimurium LT2
aaaacccaauaacug

SEQ ID NO: 1854045 - RNA, 19 nt, Salmonella typhimurium LT2
aaaaccauugcuaaaaaua

SEQ ID NO: 1854046 - RNA, 13 nt, Salmonella typhimurium LT2
agaugcgaaucuu

SEQ ID NO: 1854047 - RNA, 19 nt, Salmonella typhimurium LT2
agaugccugaaaauagcgc

SEQ ID NO: 1854048 - RNA, 15 nt, Salmonella typhimurium LT2
agaugcauaaaaaaa

SEQ ID NO: 1854049 - RNA, 17 nt, Salmonella typhimurium LT2
agaugcauaaaaaaacg

SEQ ID NO: 1854050 - RNA, 21 nt, Salmonella typhimurium LT2
agauuacucccuugccagcgc

SEQ ID NO: 1854051 - RNA, 23 nt, Salmonella typhimurium LT2
agauuacucccuugccagcgcau

SEQ ID NO: 1854052 - RNA, 18 nt, Salmonella typhimurium LT2
agaugugguauuuucuau

SEQ ID NO: 1854053 - RNA, 19 nt, Salmonella typhimurium LT2
agauguucagguaaaugag

SEQ ID NO: 1854054 - RNA, 15 nt, Salmonella typhimurium LT2
agauuccccaauccc

SEQ ID NO: 1854055 - RNA, 21 nt, Salmonella typhimurium LT2
agauugauuuauucacuggca

SEQ ID NO: 1854056 - RNA, 14 nt, Salmonella typhimurium LT2
agauugaacgcugg

SEQ ID NO: 1854057 - RNA, 15 nt, Salmonella typhimurium LT2
agauugacagaauaa

SEQ ID NO: 1854058 - RNA, 19 nt, Salmonella typhimurium LT2
agauugacagaauaaugcc

SEQ ID NO: 1854059 - RNA, 18 nt, Salmonella typhimurium LT2
agauugaaacgaaaacug

SEQ ID NO: 1854060 - RNA, 14 nt, Salmonella typhimurium LT2
agauucuucugccu

SEQ ID NO: 1854061 - RNA, 19 nt, Salmonella typhimurium LT2
agauuccgcgauccaacaa

SEQ ID NO: 1854062 - RNA, 16 nt, Salmonella typhimurium LT2
agauugguaucugcaa

SEQ ID NO: 1854063 - RNA, 14 nt, Salmonella typhimurium LT2
agauuggucagcag

SEQ ID NO: 1854064 - RNA, 16 nt, Salmonella typhimurium LT2
agauuggucagcagcc

SEQ ID NO: 1854065 - RNA, 23 nt, Salmonella typhimurium LT2
agauuggugaugcgcaacguuuc

SEQ ID NO: 1854066 - RNA, 19 nt, Salmonella typhimurium LT2
agauugucaccguaauaua

SEQ ID NO: 1854067 - RNA, 21 nt, Salmonella typhimurium LT2
agauugugcuuuagcuuuacu

SEQ ID NO: 1854068 - RNA, 15 nt, Salmonella typhimurium LT2
agauugucaccguaa

SEQ ID NO: 1854069 - RNA, 16 nt, Salmonella typhimurium LT2
agauuucuuaauuccu

SEQ ID NO: 1854070 - RNA, 17 nt, Salmonella typhimurium LT2
agauuucgcaacagcau

SEQ ID NO: 1854071 - RNA, 16 nt, Salmonella typhimurium LT2
agauuucggcauuuuu

SEQ ID NO: 1854072 - RNA, 19 nt, Salmonella typhimurium LT2
agauuucggcauuuuuaau

SEQ ID NO: 1854073 - RNA, 18 nt, Salmonella typhimurium LT2
agauuucuuaauuccuca

SEQ ID NO: 1854074 - RNA, 12 nt, Salmonella typhimurium LT2
agauuugggaug

SEQ ID NO: 1854075 - RNA, 13 nt, Salmonella typhimurium LT2
agauuuucaucau

SEQ ID NO: 1854076 - RNA, 19 nt, Salmonella typhimurium LT2
agauuuuguacuuuugcca

SEQ ID NO: 1854077 - RNA, 21 nt, Salmonella typhimurium LT2
agcaaaucgcccaucacaugu

SEQ ID NO: 1854078 - RNA, 17 nt, Salmonella typhimurium LT2
agcaaaugcgcuuugau

SEQ ID NO: 1854079 - RNA, 15 nt, Salmonella typhimurium LT2
agcaaaguaaaacaa

SEQ ID NO: 1854080 - RNA, 14 nt, Salmonella typhimurium LT2
agcaaauugcugau

SEQ ID NO: 1854081 - RNA, 17 nt, Salmonella typhimurium LT2
agcaacaaaccgauaau

SEQ ID NO: 1854082 - RNA, 22 nt, Salmonella typhimurium LT2
agcaaaggcuaccggacaaaca

SEQ ID NO: 1854083 - RNA, 16 nt, Salmonella typhimurium LT2
agcaaaaucacgcaca

SEQ ID NO: 1854084 - RNA, 12 nt, Salmonella typhimurium LT2
agcaaaacacag

SEQ ID NO: 1854085 - RNA, 22 nt, Salmonella typhimurium LT2
agcaaaauaauaucgcgcucuu

SEQ ID NO: 1854086 - RNA, 20 nt, Salmonella typhimurium LT2
agcaaaaauuucgcucagau

SEQ ID NO: 1854087 - RNA, 15 nt, Salmonella typhimurium LT2
agcaaaaacauuacc

SEQ ID NO: 1854088 - RNA, 12 nt, Salmonella typhimurium LT2
agcaaaaaauac

SEQ ID NO: 1854089 - RNA, 22 nt, Salmonella typhimurium LT2
agcaaaaaauaccccgaugccu

SEQ ID NO: 1854090 - RNA, 14 nt, Salmonella typhimurium LT2
agcccgccagcaua

SEQ ID NO: 1854091 - RNA, 14 nt, Salmonella typhimurium LT2
agcccgucccuucc

SEQ ID NO: 1854092 - RNA, 16 nt, Salmonella typhimurium LT2
agcccgucccuuccgc

SEQ ID NO: 1854093 - RNA, 17 nt, Salmonella typhimurium LT2
agcccggcgcacacccu

SEQ ID NO: 1854094 - RNA, 21 nt, Salmonella typhimurium LT2
agcccggcgcacacccugcag

SEQ ID NO: 1854095 - RNA, 23 nt, Salmonella typhimurium LT2
agcccggcggcgcaucgcucacc

SEQ ID NO: 1854096 - RNA, 16 nt, Salmonella typhimurium LT2
agcccgcccacaggcu

SEQ ID NO: 1854097 - RNA, 22 nt, Salmonella typhimurium LT2
agcccgcgaacgccaggccaaa

SEQ ID NO: 1854098 - RNA, 13 nt, Salmonella typhimurium LT2
agccgaccgccga

SEQ ID NO: 1854099 - RNA, 18 nt, Salmonella typhimurium LT2
agcccuugucgacugcgg

SEQ ID NO: 1854100 - RNA, 17 nt, Salmonella typhimurium LT2
agcccugugccgcuggu

SEQ ID NO: 1854101 - RNA, 20 nt, Salmonella typhimurium LT2
agcccuuaggggcucuuuuu

SEQ ID NO: 1854102 - RNA, 16 nt, Salmonella typhimurium LT2
agcccuggaaucgaaa

SEQ ID NO: 1854103 - RNA, 14 nt, Salmonella typhimurium LT2
agccgaccuggcgg

SEQ ID NO: 1854104 - RNA, 18 nt, Salmonella typhimurium LT2
agcccagguagaauccca

SEQ ID NO: 1854105 - RNA, 20 nt, Salmonella typhimurium LT2
agcccagcgugccugccgca

SEQ ID NO: 1854106 - RNA, 14 nt, Salmonella typhimurium LT2
agcccagcgccgca

SEQ ID NO: 1854107 - RNA, 12 nt, Salmonella typhimurium LT2
agcccagcgccg

SEQ ID NO: 1854108 - RNA, 18 nt, Salmonella typhimurium LT2
agcccacgcccugcaaug

SEQ ID NO: 1854109 - RNA, 23 nt, Salmonella typhimurium LT2
agcccacuggcaaguaugaaaag

SEQ ID NO: 1854110 - RNA, 21 nt, Salmonella typhimurium LT2
agcccauggcaggcagcacaa

SEQ ID NO: 1854111 - RNA, 17 nt, Salmonella typhimurium LT2
agcccaugauggugaac

SEQ ID NO: 1854112 - RNA, 20 nt, Salmonella typhimurium LT2
agcccaugauggugaacaga

SEQ ID NO: 1854113 - RNA, 14 nt, Salmonella typhimurium LT2
agcccauggcaggc

SEQ ID NO: 1854114 - RNA, 17 nt, Salmonella typhimurium LT2
agcccauggcaggcagc

SEQ ID NO: 1854115 - RNA, 23 nt, Salmonella typhimurium LT2
agcccaugauggugaacagaauc

SEQ ID NO: 1854116 - RNA, 20 nt, Salmonella typhimurium LT2
agcccaguaauauccccauc

SEQ ID NO: 1854117 - RNA, 14 nt, Salmonella typhimurium LT2
agcccaucagcgcc

SEQ ID NO: 1854118 - RNA, 20 nt, Salmonella typhimurium LT2
agcccaucagcgccagcccu

SEQ ID NO: 1854119 - RNA, 21 nt, Salmonella typhimurium LT2
agccccauaaccgaugcacau

SEQ ID NO: 1854120 - RNA, 12 nt, Salmonella typhimurium LT2
agccccacgccc

SEQ ID NO: 1854121 - RNA, 13 nt, Salmonella typhimurium LT2
agccccccgcaca

SEQ ID NO: 1854122 - RNA, 23 nt, Salmonella typhimurium LT2
agccccccgcacagcacauagaa

SEQ ID NO: 1854123 - RNA, 18 nt, Salmonella typhimurium LT2
agcccccguaauguugcc

SEQ ID NO: 1854124 - RNA, 22 nt, Salmonella typhimurium LT2
agccccucgcuaaugcccggcg

SEQ ID NO: 1854125 - RNA, 13 nt, Salmonella typhimurium LT2
agcccgaagaagc

SEQ ID NO: 1854126 - RNA, 21 nt, Salmonella typhimurium LT2
agccccuggcgcgccagcucu

SEQ ID NO: 1854127 - RNA, 19 nt, Salmonella typhimurium LT2
agccacgcccgccgccuga

SEQ ID NO: 1854128 - RNA, 19 nt, Salmonella typhimurium LT2
agccacggaauaucuuuuu

SEQ ID NO: 1854129 - RNA, 17 nt, Salmonella typhimurium LT2
agccagaaugacauggu

SEQ ID NO: 1854130 - RNA, 15 nt, Salmonella typhimurium LT2
agccagcgugaaccu

SEQ ID NO: 1854131 - RNA, 20 nt, Salmonella typhimurium LT2
agccagcgugaaccuguuau

SEQ ID NO: 1854132 - RNA, 15 nt, Salmonella typhimurium LT2
agccagcgccccugc

SEQ ID NO: 1854133 - RNA, 22 nt, Salmonella typhimurium LT2
agccagacgcuccgcaguaauc

SEQ ID NO: 1854134 - RNA, 16 nt, Salmonella typhimurium LT2
agccagacgcgcagca

SEQ ID NO: 1854135 - RNA, 23 nt, Salmonella typhimurium LT2
agccagacggcgcccagccugcc

SEQ ID NO: 1854136 - RNA, 22 nt, Salmonella typhimurium LT2
agccagaggcuaaucaggaaga

SEQ ID NO: 1854137 - RNA, 14 nt, Salmonella typhimurium LT2
agcaugcccgccag

SEQ ID NO: 1854138 - RNA, 15 nt, Salmonella typhimurium LT2
agccaccaucuuuuu

SEQ ID NO: 1854139 - RNA, 20 nt, Salmonella typhimurium LT2
agccaacguauaaaauggca

SEQ ID NO: 1854140 - RNA, 14 nt, Salmonella typhimurium LT2
agccaacgcaguca

SEQ ID NO: 1854141 - RNA, 19 nt, Salmonella typhimurium LT2
agcauggcgccugcggaau

SEQ ID NO: 1854142 - RNA, 14 nt, Salmonella typhimurium LT2
agccauuucugccu

SEQ ID NO: 1854143 - RNA, 20 nt, Salmonella typhimurium LT2
agccauuucugccugauggc

SEQ ID NO: 1854144 - RNA, 23 nt, Salmonella typhimurium LT2
agccauugcugcuauauaacaua

SEQ ID NO: 1854145 - RNA, 22 nt, Salmonella typhimurium LT2
agccaugcuauucagcaguuca

SEQ ID NO: 1854146 - RNA, 15 nt, Salmonella typhimurium LT2
agccaugcccggcgg

SEQ ID NO: 1854147 - RNA, 14 nt, Salmonella typhimurium LT2
agccauuaaccaga

SEQ ID NO: 1854148 - RNA, 14 nt, Salmonella typhimurium LT2
agccaugucuuuuu

SEQ ID NO: 1854149 - RNA, 22 nt, Salmonella typhimurium LT2
agccaugucuuuuucagucauc

SEQ ID NO: 1854150 - RNA, 14 nt, Salmonella typhimurium LT2
agccauucggcugc

SEQ ID NO: 1854151 - RNA, 20 nt, Salmonella typhimurium LT2
agccauucccgauaaugacc

SEQ ID NO: 1854152 - RNA, 16 nt, Salmonella typhimurium LT2
agccauuaaugcaggc

SEQ ID NO: 1854153 - RNA, 15 nt, Salmonella typhimurium LT2
agccauacgccacgg

SEQ ID NO: 1854154 - RNA, 14 nt, Salmonella typhimurium LT2
agccauaaugcugc

SEQ ID NO: 1854155 - RNA, 15 nt, Salmonella typhimurium LT2
agccaucauuaccaa

SEQ ID NO: 1854156 - RNA, 14 nt, Salmonella typhimurium LT2
agccaucaauccau

SEQ ID NO: 1854157 - RNA, 16 nt, Salmonella typhimurium LT2
agccaucggcaaacgc

SEQ ID NO: 1854158 - RNA, 22 nt, Salmonella typhimurium LT2
agccaucggcauaacccgccgc

SEQ ID NO: 1854159 - RNA, 14 nt, Salmonella typhimurium LT2
agccagucgccagg

SEQ ID NO: 1854160 - RNA, 16 nt, Salmonella typhimurium LT2
agccaggaauauacca

SEQ ID NO: 1854161 - RNA, 21 nt, Salmonella typhimurium LT2
agccaggaauauaccaucacc

SEQ ID NO: 1854162 - RNA, 19 nt, Salmonella typhimurium LT2
agccaguuuggacacggac

SEQ ID NO: 1854163 - RNA, 22 nt, Salmonella typhimurium LT2
agccaguucgccuucuucaucu

SEQ ID NO: 1854164 - RNA, 20 nt, Salmonella typhimurium LT2
agcaccucaucgcuaccuuc

SEQ ID NO: 1854165 - RNA, 20 nt, Salmonella typhimurium LT2
agcaccucaucccccagccg

SEQ ID NO: 1854166 - RNA, 12 nt, Salmonella typhimurium LT2
agcaacccuuuu

SEQ ID NO: 1854167 - RNA, 20 nt, Salmonella typhimurium LT2
agcaccuggcggagcugcgc

SEQ ID NO: 1854168 - RNA, 15 nt, Salmonella typhimurium LT2
agcaccugcucaggc

SEQ ID NO: 1854169 - RNA, 20 nt, Salmonella typhimurium LT2
agcaccugcucaggcugacc

SEQ ID NO: 1854170 - RNA, 17 nt, Salmonella typhimurium LT2
agcaccuuauccggccu

SEQ ID NO: 1854171 - RNA, 22 nt, Salmonella typhimurium LT2
agcaccuuugaacgucgcugau

SEQ ID NO: 1854172 - RNA, 22 nt, Salmonella typhimurium LT2
agcaccuuuuuugcgccuggca

SEQ ID NO: 1854173 - RNA, 13 nt, Salmonella typhimurium LT2
agcacgacacaaa

SEQ ID NO: 1854174 - RNA, 24 nt, Salmonella typhimurium LT2
agcacguagcuuauaaaucagcuu

SEQ ID NO: 1854175 - RNA, 19 nt, Salmonella typhimurium LT2
agcacguaggccagaugau

SEQ ID NO: 1854176 - RNA, 15 nt, Salmonella typhimurium LT2
agcacgugcauggga

SEQ ID NO: 1854177 - RNA, 16 nt, Salmonella typhimurium LT2
agcacuaacagcagca

SEQ ID NO: 1854178 - RNA, 15 nt, Salmonella typhimurium LT2
agcagauacugcgcg

SEQ ID NO: 1854179 - RNA, 14 nt, Salmonella typhimurium LT2
agcagagaucuuuc

SEQ ID NO: 1854180 - RNA, 19 nt, Salmonella typhimurium LT2
agcagauuuucauccgucg

SEQ ID NO: 1854181 - RNA, 20 nt, Salmonella typhimurium LT2
agcagauagccugccagcac

SEQ ID NO: 1854182 - RNA, 22 nt, Salmonella typhimurium LT2
agcagaucgcggcaauggcuua

SEQ ID NO: 1854183 - RNA, 12 nt, Salmonella typhimurium LT2
agcagaaacugg

SEQ ID NO: 1854184 - RNA, 13 nt, Salmonella typhimurium LT2
agcagaaacuggc

SEQ ID NO: 1854185 - RNA, 18 nt, Salmonella typhimurium LT2
agcagcauaaaaccgccg

SEQ ID NO: 1854186 - RNA, 15 nt, Salmonella typhimurium LT2
agcagccacagaaug

SEQ ID NO: 1854187 - RNA, 15 nt, Salmonella typhimurium LT2
agcagccagguaauc

SEQ ID NO: 1854188 - RNA, 15 nt, Salmonella typhimurium LT2
agcagcaacccugcc

SEQ ID NO: 1854189 - RNA, 10 nt, Salmonella typhimurium LT2
agcagcagaa

SEQ ID NO: 1854190 - RNA, 14 nt, Salmonella typhimurium LT2
agcagcagacucaa

SEQ ID NO: 1854191 - RNA, 12 nt, Salmonella typhimurium LT2
agcaggcggaga

SEQ ID NO: 1854192 - RNA, 14 nt, Salmonella typhimurium LT2
agcaguacgccaaa

SEQ ID NO: 1854193 - RNA, 14 nt, Salmonella typhimurium LT2
agcaggcaaaaaag

SEQ ID NO: 1854194 - RNA, 16 nt, Salmonella typhimurium LT2
agcaggccauaaugca

SEQ ID NO: 1854195 - RNA, 22 nt, Salmonella typhimurium LT2
agcaggaucuccagaucgccac

SEQ ID NO: 1854196 - RNA, 23 nt, Salmonella typhimurium LT2
agcaggaaucccauuaagcggga

SEQ ID NO: 1854197 - RNA, 16 nt, Salmonella typhimurium LT2
agcagcucaacggcag

SEQ ID NO: 1854198 - RNA, 23 nt, Salmonella typhimurium LT2
agcagcggcgguuauccgccagc

SEQ ID NO: 1854199 - RNA, 15 nt, Salmonella typhimurium LT2
agcaugacaauaacg

SEQ ID NO: 1854200 - RNA, 14 nt, Salmonella typhimurium LT2
agcaugaauaaccu

SEQ ID NO: 1854201 - RNA, 15 nt, Salmonella typhimurium LT2
agcaucgggaaucau

SEQ ID NO: 1854202 - RNA, 21 nt, Salmonella typhimurium LT2
agcaucgcuuuuaggcugaaa

SEQ ID NO: 1854203 - RNA, 20 nt, Salmonella typhimurium LT2
agcaucgccgguagcuucag

SEQ ID NO: 1854204 - RNA, 18 nt, Salmonella typhimurium LT2
agcaucgccgguagcuuc

SEQ ID NO: 1854205 - RNA, 12 nt, Salmonella typhimurium LT2
agcaucgccggu

SEQ ID NO: 1854206 - RNA, 17 nt, Salmonella typhimurium LT2
agcaucaguggaaaaac

SEQ ID NO: 1854207 - RNA, 21 nt, Salmonella typhimurium LT2
agcauaguaaauuguuugguu

SEQ ID NO: 1854208 - RNA, 15 nt, Salmonella typhimurium LT2
agcauagacgaucag

SEQ ID NO: 1854209 - RNA, 14 nt, Salmonella typhimurium LT2
agcauacugauguc

SEQ ID NO: 1854210 - RNA, 21 nt, Salmonella typhimurium LT2
agcauaccgugugcagugaca

SEQ ID NO: 1854211 - RNA, 14 nt, Salmonella typhimurium LT2
agcauacaaagcag

SEQ ID NO: 1854212 - RNA, 15 nt, Salmonella typhimurium LT2
agcauacaaagcaga

SEQ ID NO: 1854213 - RNA, 18 nt, Salmonella typhimurium LT2
agcagugcaaugcgcuuu

SEQ ID NO: 1854214 - RNA, 18 nt, Salmonella typhimurium LT2
agcaguccugcgggaaca

SEQ ID NO: 1854215 - RNA, 21 nt, Salmonella typhimurium LT2
agcaguacgccugucgcaacc

SEQ ID NO: 1854216 - RNA, 15 nt, Salmonella typhimurium LT2
agccuuuuuaaauau

SEQ ID NO: 1854217 - RNA, 15 nt, Salmonella typhimurium LT2
agccuuuugagcagc

SEQ ID NO: 1854218 - RNA, 20 nt, Salmonella typhimurium LT2
agcgaauaaucccggcgcca

SEQ ID NO: 1854219 - RNA, 19 nt, Salmonella typhimurium LT2
agcgaauccagaucgcccu

SEQ ID NO: 1854220 - RNA, 21 nt, Salmonella typhimurium LT2
agccugucgccgucaauguca

SEQ ID NO: 1854221 - RNA, 17 nt, Salmonella typhimurium LT2
agccuggcugaaccagg

SEQ ID NO: 1854222 - RNA, 16 nt, Salmonella typhimurium LT2
agccuggcauaacauu

SEQ ID NO: 1854223 - RNA, 17 nt, Salmonella typhimurium LT2
agccuguuccagcugcg

SEQ ID NO: 1854224 - RNA, 15 nt, Salmonella typhimurium LT2
agccugcgcgccugc

SEQ ID NO: 1854225 - RNA, 14 nt, Salmonella typhimurium LT2
agccugcgccagcg

SEQ ID NO: 1854226 - RNA, 22 nt, Salmonella typhimurium LT2
agccugccagcaacccaccugc

SEQ ID NO: 1854227 - RNA, 14 nt, Salmonella typhimurium LT2
agccugccagcacc

SEQ ID NO: 1854228 - RNA, 17 nt, Salmonella typhimurium LT2
agccugcaaugugcagg

SEQ ID NO: 1854229 - RNA, 18 nt, Salmonella typhimurium LT2
agccugauacuuuuacuc

SEQ ID NO: 1854230 - RNA, 15 nt, Salmonella typhimurium LT2
agccgccaccacaaa

SEQ ID NO: 1854231 - RNA, 17 nt, Salmonella typhimurium LT2
agccgccagaggaaaca

SEQ ID NO: 1854232 - RNA, 18 nt, Salmonella typhimurium LT2
agccgccagaggaaacac

SEQ ID NO: 1854233 - RNA, 18 nt, Salmonella typhimurium LT2
agccgcaguugccaggcc

SEQ ID NO: 1854234 - RNA, 17 nt, Salmonella typhimurium LT2
agccgcaucuuauauuu

SEQ ID NO: 1854235 - RNA, 14 nt, Salmonella typhimurium LT2
agcgagccuuccau

SEQ ID NO: 1854236 - RNA, 19 nt, Salmonella typhimurium LT2
agcgagcgccugaugccgc

SEQ ID NO: 1854237 - RNA, 13 nt, Salmonella typhimurium LT2
agcgagcgccuga

SEQ ID NO: 1854238 - RNA, 17 nt, Salmonella typhimurium LT2
agcgagcugguuucaau

SEQ ID NO: 1854239 - RNA, 15 nt, Salmonella typhimurium LT2
agcgagacuuuugcc

SEQ ID NO: 1854240 - RNA, 13 nt, Salmonella typhimurium LT2
agcgacuggucau

SEQ ID NO: 1854241 - RNA, 13 nt, Salmonella typhimurium LT2
agcgacaaaugaa

SEQ ID NO: 1854242 - RNA, 15 nt, Salmonella typhimurium LT2
agcgacggcgcgcca

SEQ ID NO: 1854243 - RNA, 19 nt, Salmonella typhimurium LT2
agcgacucauucagcaacu

SEQ ID NO: 1854244 - RNA, 20 nt, Salmonella typhimurium LT2
agcgacucauccacauacug

SEQ ID NO: 1854245 - RNA, 22 nt, Salmonella typhimurium LT2
agcgacgguuuuauccccuuca

SEQ ID NO: 1854246 - RNA, 22 nt, Salmonella typhimurium LT2
agcgaauugccgucgccggaau

SEQ ID NO: 1854247 - RNA, 20 nt, Salmonella typhimurium LT2
agcgaauuccggccaucaga

SEQ ID NO: 1854248 - RNA, 15 nt, Salmonella typhimurium LT2
agcgacaaaucugcc

SEQ ID NO: 1854249 - RNA, 23 nt, Salmonella typhimurium LT2
agcgaauguauuaacgcuuugcc

SEQ ID NO: 1854250 - RNA, 15 nt, Salmonella typhimurium LT2
agcgaaugcgcgcca

SEQ ID NO: 1854251 - RNA, 18 nt, Salmonella typhimurium LT2
agcgauagucguugcgcc

SEQ ID NO: 1854252 - RNA, 19 nt, Salmonella typhimurium LT2
agcgauaagucuccuguuu

SEQ ID NO: 1854253 - RNA, 22 nt, Salmonella typhimurium LT2
agcgauaaacucagcgccagcg

SEQ ID NO: 1854254 - RNA, 22 nt, Salmonella typhimurium LT2
agcgagguucugguuuucaaau

SEQ ID NO: 1854255 - RNA, 14 nt, Salmonella typhimurium LT2
agcgauccagaccg

SEQ ID NO: 1854256 - RNA, 19 nt, Salmonella typhimurium LT2
agcgauccagaccggcaug

SEQ ID NO: 1854257 - RNA, 15 nt, Salmonella typhimurium LT2
agcgaucgagauaag

SEQ ID NO: 1854258 - RNA, 15 nt, Salmonella typhimurium LT2
agcgauauuucuccg

SEQ ID NO: 1854259 - RNA, 14 nt, Salmonella typhimurium LT2
agcgaucaccucuu

SEQ ID NO: 1854260 - RNA, 22 nt, Salmonella typhimurium LT2
agcgaugagcgccagcaacagc

SEQ ID NO: 1854261 - RNA, 16 nt, Salmonella typhimurium LT2
agcgaugacagcagga

SEQ ID NO: 1854262 - RNA, 17 nt, Salmonella typhimurium LT2
agcgaugagcgccagca

SEQ ID NO: 1854263 - RNA, 23 nt, Salmonella typhimurium LT2
agcgaugcgguucaacgcgcugc

SEQ ID NO: 1854264 - RNA, 20 nt, Salmonella typhimurium LT2
agcgauuuuugaucucuuua

SEQ ID NO: 1854265 - RNA, 17 nt, Salmonella typhimurium LT2
agcgauugcgccagacc

SEQ ID NO: 1854266 - RNA, 15 nt, Salmonella typhimurium LT2
agcgcaaacaacccg

SEQ ID NO: 1854267 - RNA, 13 nt, Salmonella typhimurium LT2
agcgcaaacgcgc

SEQ ID NO: 1854268 - RNA, 17 nt, Salmonella typhimurium LT2
agcgcaaacucagagag

SEQ ID NO: 1854269 - RNA, 19 nt, Salmonella typhimurium LT2
agcgcaaauauccuaccac

SEQ ID NO: 1854270 - RNA, 11 nt, Salmonella typhimurium LT2
agcgcaaugcu

SEQ ID NO: 1854271 - RNA, 20 nt, Salmonella typhimurium LT2
agcgcaaucaagcucaccac

SEQ ID NO: 1854272 - RNA, 17 nt, Salmonella typhimurium LT2
agcgcauccggccagcg

SEQ ID NO: 1854273 - RNA, 16 nt, Salmonella typhimurium LT2
agcgcaucgagauaau

SEQ ID NO: 1854274 - RNA, 16 nt, Salmonella typhimurium LT2
agcgcauccagcucuu

SEQ ID NO: 1854275 - RNA, 20 nt, Salmonella typhimurium LT2
agcgcauaggcuuugcugag

SEQ ID NO: 1854276 - RNA, 19 nt, Salmonella typhimurium LT2
agcgcaccagccggugcuc

SEQ ID NO: 1854277 - RNA, 17 nt, Salmonella typhimurium LT2
agcgcaucauaaaaccc

SEQ ID NO: 1854278 - RNA, 22 nt, Salmonella typhimurium LT2
agcgcaucauccccaccacuga

SEQ ID NO: 1854279 - RNA, 23 nt, Salmonella typhimurium LT2
agcgcaucauccccaccacugau

SEQ ID NO: 1854280 - RNA, 16 nt, Salmonella typhimurium LT2
agcgccagacacugga

SEQ ID NO: 1854281 - RNA, 17 nt, Salmonella typhimurium LT2
agcgccagacagauaac

SEQ ID NO: 1854282 - RNA, 16 nt, Salmonella typhimurium LT2
agcgcaucgcucccca

SEQ ID NO: 1854283 - RNA, 16 nt, Salmonella typhimurium LT2
agcgcaugagcaaaau

SEQ ID NO: 1854284 - RNA, 20 nt, Salmonella typhimurium LT2
agcgccauccggcacacaga

SEQ ID NO: 1854285 - RNA, 18 nt, Salmonella typhimurium LT2
agcgccaucgggcauuua

SEQ ID NO: 1854286 - RNA, 16 nt, Salmonella typhimurium LT2
agcgccauauugcugu

SEQ ID NO: 1854287 - RNA, 17 nt, Salmonella typhimurium LT2
agcgccaucagcaucau

SEQ ID NO: 1854288 - RNA, 22 nt, Salmonella typhimurium LT2
agcgccauaaaaaacaccuguc

SEQ ID NO: 1854289 - RNA, 14 nt, Salmonella typhimurium LT2
agcgccaguuuuuc

SEQ ID NO: 1854290 - RNA, 20 nt, Salmonella typhimurium LT2
agcgccaguuuuuccuguuc

SEQ ID NO: 1854291 - RNA, 14 nt, Salmonella typhimurium LT2
agcgccagcuccau

SEQ ID NO: 1854292 - RNA, 23 nt, Salmonella typhimurium LT2
agcgccagcgguguuugccagac

SEQ ID NO: 1854293 - RNA, 16 nt, Salmonella typhimurium LT2
agcgccagcgguuuca

SEQ ID NO: 1854294 - RNA, 22 nt, Salmonella typhimurium LT2
agcgccagcgguuucauauggg

SEQ ID NO: 1854295 - RNA, 13 nt, Salmonella typhimurium LT2
agcgccagcucca

SEQ ID NO: 1854296 - RNA, 19 nt, Salmonella typhimurium LT2
agcgcgccgccgcccauaa

SEQ ID NO: 1854297 - RNA, 18 nt, Salmonella typhimurium LT2
agcgcgcccgccaccagc

SEQ ID NO: 1854298 - RNA, 15 nt, Salmonella typhimurium LT2
agcgcggccagaaug

SEQ ID NO: 1854299 - RNA, 22 nt, Salmonella typhimurium LT2
agcgcgucggccggcaccagcc

SEQ ID NO: 1854300 - RNA, 23 nt, Salmonella typhimurium LT2
agcgcggcgcccauuccgccugc

SEQ ID NO: 1854301 - RNA, 16 nt, Salmonella typhimurium LT2
agcgccuuuucaaaag

SEQ ID NO: 1854302 - RNA, 20 nt, Salmonella typhimurium LT2
agcgccuuuucaaaagagag

SEQ ID NO: 1854303 - RNA, 14 nt, Salmonella typhimurium LT2
agcgccuucaggca

SEQ ID NO: 1854304 - RNA, 14 nt, Salmonella typhimurium LT2
agcgccuguagcgu

SEQ ID NO: 1854305 - RNA, 17 nt, Salmonella typhimurium LT2
agcgccucguccagggu

SEQ ID NO: 1854306 - RNA, 21 nt, Salmonella typhimurium LT2
agcgccucggcgcccagcgug

SEQ ID NO: 1854307 - RNA, 22 nt, Salmonella typhimurium LT2
agcgccucgcugacgccagcca

SEQ ID NO: 1854308 - RNA, 22 nt, Salmonella typhimurium LT2
agcgccugcgccaguucaucca

SEQ ID NO: 1854309 - RNA, 14 nt, Salmonella typhimurium LT2
agcgccuacgggca

SEQ ID NO: 1854310 - RNA, 23 nt, Salmonella typhimurium LT2
agcgccuccgcguagcccagcgc

SEQ ID NO: 1854311 - RNA, 14 nt, Salmonella typhimurium LT2
agcgccucgcaaaa

SEQ ID NO: 1854312 - RNA, 14 nt, Salmonella typhimurium LT2
agcgccgcagggcg

SEQ ID NO: 1854313 - RNA, 12 nt, Salmonella typhimurium LT2
agcgugauaauu

SEQ ID NO: 1854314 - RNA, 23 nt, Salmonella typhimurium LT2
agcgugcuguugcuaaauccaua

SEQ ID NO: 1854315 - RNA, 19 nt, Salmonella typhimurium LT2
agcguggaaaacagcgccg

SEQ ID NO: 1854316 - RNA, 19 nt, Salmonella typhimurium LT2
agcguuacgggaacagaau

SEQ ID NO: 1854317 - RNA, 13 nt, Salmonella typhimurium LT2
agcguguuucauc

SEQ ID NO: 1854318 - RNA, 23 nt, Salmonella typhimurium LT2
agcguuaacgacgcuccagaauc

SEQ ID NO: 1854319 - RNA, 15 nt, Salmonella typhimurium LT2
agcguuaaucaccuc

SEQ ID NO: 1854320 - RNA, 16 nt, Salmonella typhimurium LT2
agcguguagcaggaga

SEQ ID NO: 1854321 - RNA, 21 nt, Salmonella typhimurium LT2
agcguucauucccgccaauaa

SEQ ID NO: 1854322 - RNA, 19 nt, Salmonella typhimurium LT2
agcguuaucuguaauugac

SEQ ID NO: 1854323 - RNA, 19 nt, Salmonella typhimurium LT2
agcguuaaaucaacggcau

SEQ ID NO: 1854324 - RNA, 15 nt, Salmonella typhimurium LT2
agcgucaucacaggu

SEQ ID NO: 1854325 - RNA, 23 nt, Salmonella typhimurium LT2
agcguccaguccugccccugcca

SEQ ID NO: 1854326 - RNA, 22 nt, Salmonella typhimurium LT2
agcgguuuuuuuguggccugcu

SEQ ID NO: 1854327 - RNA, 19 nt, Salmonella typhimurium LT2
agcguaaauagcccggauc

SEQ ID NO: 1854328 - RNA, 19 nt, Salmonella typhimurium LT2
agcgguuggaucucaccac

SEQ ID NO: 1854329 - RNA, 15 nt, Salmonella typhimurium LT2
agcgugacccagaca

SEQ ID NO: 1854330 - RNA, 20 nt, Salmonella typhimurium LT2
agcgucuuuuauccccacua

SEQ ID NO: 1854331 - RNA, 19 nt, Salmonella typhimurium LT2
agcguccguucugauacuc

SEQ ID NO: 1854332 - RNA, 20 nt, Salmonella typhimurium LT2
agcgcgucguugucuuugcg

SEQ ID NO: 1854333 - RNA, 15 nt, Salmonella typhimurium LT2
agcgcuaacgcgaag

SEQ ID NO: 1854334 - RNA, 16 nt, Salmonella typhimurium LT2
agcgcuaagcaacagu

SEQ ID NO: 1854335 - RNA, 15 nt, Salmonella typhimurium LT2
agcggcguucaaaac

SEQ ID NO: 1854336 - RNA, 17 nt, Salmonella typhimurium LT2
agcggcguucaaaacgc

SEQ ID NO: 1854337 - RNA, 23 nt, Salmonella typhimurium LT2
agcggcgggauuuuaagcaucca

SEQ ID NO: 1854338 - RNA, 18 nt, Salmonella typhimurium LT2
agcggcgggcgugaugga

SEQ ID NO: 1854339 - RNA, 15 nt, Salmonella typhimurium LT2
agcggcccgcgcuga

SEQ ID NO: 1854340 - RNA, 14 nt, Salmonella typhimurium LT2
agcgggcuauuuua

SEQ ID NO: 1854341 - RNA, 13 nt, Salmonella typhimurium LT2
agcgggccgguaa

SEQ ID NO: 1854342 - RNA, 15 nt, Salmonella typhimurium LT2
agcggcugcgccugu

SEQ ID NO: 1854343 - RNA, 13 nt, Salmonella typhimurium LT2
agcggcuggaaga

SEQ ID NO: 1854344 - RNA, 17 nt, Salmonella typhimurium LT2
agcggcuuauaaaacgc

SEQ ID NO: 1854345 - RNA, 22 nt, Salmonella typhimurium LT2
agcggcguuuuuuccugcuggu

SEQ ID NO: 1854346 - RNA, 18 nt, Salmonella typhimurium LT2
agcggcucauccagcaac

SEQ ID NO: 1854347 - RNA, 18 nt, Salmonella typhimurium LT2
agcggcugacacucaucc

SEQ ID NO: 1854348 - RNA, 13 nt, Salmonella typhimurium LT2
agcggcugcaaag

SEQ ID NO: 1854349 - RNA, 16 nt, Salmonella typhimurium LT2
agcggcugcaaagcau

SEQ ID NO: 1854350 - RNA, 20 nt, Salmonella typhimurium LT2
agcggcugcaaagcaucugc

SEQ ID NO: 1854351 - RNA, 13 nt, Salmonella typhimurium LT2
agcucauuuuuac

SEQ ID NO: 1854352 - RNA, 21 nt, Salmonella typhimurium LT2
agcucauuaauaacccagguu

SEQ ID NO: 1854353 - RNA, 17 nt, Salmonella typhimurium LT2
agcucaccgagacugcc

SEQ ID NO: 1854354 - RNA, 22 nt, Salmonella typhimurium LT2
agcucagcuggauagagcauca

SEQ ID NO: 1854355 - RNA, 21 nt, Salmonella typhimurium LT2
agcucacggauauugcccggc

SEQ ID NO: 1854356 - RNA, 19 nt, Salmonella typhimurium LT2
agcucagcuggauagagua

SEQ ID NO: 1854357 - RNA, 17 nt, Salmonella typhimurium LT2
agcucagccaggcgcgg

SEQ ID NO: 1854358 - RNA, 17 nt, Salmonella typhimurium LT2
agcucagcgccccagcc

SEQ ID NO: 1854359 - RNA, 22 nt, Salmonella typhimurium LT2
agcucaggguccccauaucccg

SEQ ID NO: 1854360 - RNA, 20 nt, Salmonella typhimurium LT2
agcucaggccuuauuuauag

SEQ ID NO: 1854361 - RNA, 22 nt, Salmonella typhimurium LT2
agcucaggccuuauuuauagca

SEQ ID NO: 1854362 - RNA, 18 nt, Salmonella typhimurium LT2
agcuauguuuaagccaga

SEQ ID NO: 1854363 - RNA, 13 nt, Salmonella typhimurium LT2
agcuauuucugua

SEQ ID NO: 1854364 - RNA, 18 nt, Salmonella typhimurium LT2
agcucaagcccgcgucgu

SEQ ID NO: 1854365 - RNA, 22 nt, Salmonella typhimurium LT2
agcuaucgccaucaacgccaua

SEQ ID NO: 1854366 - RNA, 21 nt, Salmonella typhimurium LT2
agcuaucuggccugacgacgg

SEQ ID NO: 1854367 - RNA, 19 nt, Salmonella typhimurium LT2
agcguuugacggauuuuuu

SEQ ID NO: 1854368 - RNA, 22 nt, Salmonella typhimurium LT2
agcguuuguuugucgauuuccg

SEQ ID NO: 1854369 - RNA, 19 nt, Salmonella typhimurium LT2
agcguuuaaaaagcugcau

SEQ ID NO: 1854370 - RNA, 21 nt, Salmonella typhimurium LT2
agcguugccaauagcaaugaa

SEQ ID NO: 1854371 - RNA, 19 nt, Salmonella typhimurium LT2
agcguugcagccacguugc

SEQ ID NO: 1854372 - RNA, 17 nt, Salmonella typhimurium LT2
agcguucucuccaguuc

SEQ ID NO: 1854373 - RNA, 20 nt, Salmonella typhimurium LT2
agcguucucacggucuccug

SEQ ID NO: 1854374 - RNA, 18 nt, Salmonella typhimurium LT2
agcguucggccugcugca

SEQ ID NO: 1854375 - RNA, 13 nt, Salmonella typhimurium LT2
agcuaaaaacagc

SEQ ID NO: 1854376 - RNA, 20 nt, Salmonella typhimurium LT2
agcguuuugauguccagaug

SEQ ID NO: 1854377 - RNA, 17 nt, Salmonella typhimurium LT2
agcguuuugauguccag

SEQ ID NO: 1854378 - RNA, 17 nt, Salmonella typhimurium LT2
agcuaaagauagccacc

SEQ ID NO: 1854379 - RNA, 20 nt, Salmonella typhimurium LT2
agcuaaauuaaaaauaauca

SEQ ID NO: 1854380 - RNA, 16 nt, Salmonella typhimurium LT2
agcuaauccccagcgc

SEQ ID NO: 1854381 - RNA, 15 nt, Salmonella typhimurium LT2
agcuaaucacccacu

SEQ ID NO: 1854382 - RNA, 22 nt, Salmonella typhimurium LT2
agcuaaugauuaucuuuuuuag

SEQ ID NO: 1854383 - RNA, 23 nt, Salmonella typhimurium LT2
agcuacguuugaacagcagcucg

SEQ ID NO: 1854384 - RNA, 20 nt, Salmonella typhimurium LT2
agcuacagggaauaugcuga

SEQ ID NO: 1854385 - RNA, 21 nt, Salmonella typhimurium LT2
agguuuaauguugccguggca

SEQ ID NO: 1854386 - RNA, 15 nt, Salmonella typhimurium LT2
agguuuaaaccacuc

SEQ ID NO: 1854387 - RNA, 20 nt, Salmonella typhimurium LT2
agguuugaccagauaaucaa

SEQ ID NO: 1854388 - RNA, 15 nt, Salmonella typhimurium LT2
agguuucuucaucaa

SEQ ID NO: 1854389 - RNA, 17 nt, Salmonella typhimurium LT2
aguaaacggcgcugaaa

SEQ ID NO: 1854390 - RNA, 15 nt, Salmonella typhimurium LT2
aguaaacagaaucaa

SEQ ID NO: 1854391 - RNA, 18 nt, Salmonella typhimurium LT2
aguaaaacuuagggggcu

SEQ ID NO: 1854392 - RNA, 21 nt, Salmonella typhimurium LT2
agguugcucagguaggugaua

SEQ ID NO: 1854393 - RNA, 16 nt, Salmonella typhimurium LT2
agguuguuuuauuacc

SEQ ID NO: 1854394 - RNA, 15 nt, Salmonella typhimurium LT2
agguugcgcccggcg

SEQ ID NO: 1854395 - RNA, 16 nt, Salmonella typhimurium LT2
agguugcgcccggcgc

SEQ ID NO: 1854396 - RNA, 17 nt, Salmonella typhimurium LT2
agguugcgccaacguca

SEQ ID NO: 1854397 - RNA, 21 nt, Salmonella typhimurium LT2
agguggcccauuuuggccgcu

SEQ ID NO: 1854398 - RNA, 17 nt, Salmonella typhimurium LT2
agguggccgagaggcug

SEQ ID NO: 1854399 - RNA, 23 nt, Salmonella typhimurium LT2
agguggcgaagcucagccaggcg

SEQ ID NO: 1854400 - RNA, 21 nt, Salmonella typhimurium LT2
aguaaauuauuuacaguaucu

SEQ ID NO: 1854401 - RNA, 14 nt, Salmonella typhimurium LT2
aguaaagauuuguu

SEQ ID NO: 1854402 - RNA, 19 nt, Salmonella typhimurium LT2
aguaaagauuuuuauuaaa

SEQ ID NO: 1854403 - RNA, 14 nt, Salmonella typhimurium LT2
aguaacauaaugcc

SEQ ID NO: 1854404 - RNA, 22 nt, Salmonella typhimurium LT2
aguaaauugacgcuugacucug

SEQ ID NO: 1854405 - RNA, 18 nt, Salmonella typhimurium LT2
aguaaggcugauuauaua

SEQ ID NO: 1854406 - RNA, 15 nt, Salmonella typhimurium LT2
aguaaccaccacuga

SEQ ID NO: 1854407 - RNA, 15 nt, Salmonella typhimurium LT2
aguacaaacaaauaa

SEQ ID NO: 1854408 - RNA, 13 nt, Salmonella typhimurium LT2
aguaauuugugau

SEQ ID NO: 1854409 - RNA, 12 nt, Salmonella typhimurium LT2
aguaauuuuucu

SEQ ID NO: 1854410 - RNA, 21 nt, Salmonella typhimurium LT2
aguaauuuuucucccagcaga

SEQ ID NO: 1854411 - RNA, 12 nt, Salmonella typhimurium LT2
aguaauauuaaa

SEQ ID NO: 1854412 - RNA, 13 nt, Salmonella typhimurium LT2
aguaauauaacca

SEQ ID NO: 1854413 - RNA, 14 nt, Salmonella typhimurium LT2
aguauugcaccagg

SEQ ID NO: 1854414 - RNA, 20 nt, Salmonella typhimurium LT2
aguauuucgacuuucuucgg

SEQ ID NO: 1854415 - RNA, 15 nt, Salmonella typhimurium LT2
aguauuucccuuccc

SEQ ID NO: 1854416 - RNA, 21 nt, Salmonella typhimurium LT2
aguauuuccuuccgaaucaau

SEQ ID NO: 1854417 - RNA, 14 nt, Salmonella typhimurium LT2
aguauuggcaagaa

SEQ ID NO: 1854418 - RNA, 14 nt, Salmonella typhimurium LT2
aguauuauccauug

SEQ ID NO: 1854419 - RNA, 16 nt, Salmonella typhimurium LT2
aguauggccagaugcg

SEQ ID NO: 1854420 - RNA, 17 nt, Salmonella typhimurium LT2
aguaucuuuuauuauua

SEQ ID NO: 1854421 - RNA, 15 nt, Salmonella typhimurium LT2
aguaugacccgcccc

SEQ ID NO: 1854422 - RNA, 21 nt, Salmonella typhimurium LT2
aguauaaauaccuuauucagc

SEQ ID NO: 1854423 - RNA, 11 nt, Salmonella typhimurium LT2
aguauauauga

SEQ ID NO: 1854424 - RNA, 22 nt, Salmonella typhimurium LT2
aguauagcgacgcuuugcucug

SEQ ID NO: 1854425 - RNA, 18 nt, Salmonella typhimurium LT2
aguaccgaacagccaggc

SEQ ID NO: 1854426 - RNA, 18 nt, Salmonella typhimurium LT2
aguaccgaaaucaucaau

SEQ ID NO: 1854427 - RNA, 19 nt, Salmonella typhimurium LT2
aguaccgaaaucaucaauc

SEQ ID NO: 1854428 - RNA, 20 nt, Salmonella typhimurium LT2
aguagcguucucuccaguuc

SEQ ID NO: 1854429 - RNA, 15 nt, Salmonella typhimurium LT2
aguagcgcgcccaug

SEQ ID NO: 1854430 - RNA, 16 nt, Salmonella typhimurium LT2
aguagcgcgcccaugc

SEQ ID NO: 1854431 - RNA, 17 nt, Salmonella typhimurium LT2
aguagccaugcauaaug

SEQ ID NO: 1854432 - RNA, 22 nt, Salmonella typhimurium LT2
aguagccaugcauaaugcagcc

SEQ ID NO: 1854433 - RNA, 14 nt, Salmonella typhimurium LT2
aguagcuaaugauu

SEQ ID NO: 1854434 - RNA, 16 nt, Salmonella typhimurium LT2
aguagguauccagcag

SEQ ID NO: 1854435 - RNA, 16 nt, Salmonella typhimurium LT2
aguaguugguggguga

SEQ ID NO: 1854436 - RNA, 15 nt, Salmonella typhimurium LT2
aguaguuccuggaga

SEQ ID NO: 1854437 - RNA, 22 nt, Salmonella typhimurium LT2
aguaguauccccggcaaccuua

SEQ ID NO: 1854438 - RNA, 15 nt, Salmonella typhimurium LT2
aggcggauaaggcgc

SEQ ID NO: 1854439 - RNA, 20 nt, Salmonella typhimurium LT2
aggcggauaccccucgccuu

SEQ ID NO: 1854440 - RNA, 19 nt, Salmonella typhimurium LT2
aggcuugccgcgccagacg

SEQ ID NO: 1854441 - RNA, 15 nt, Salmonella typhimurium LT2
aggcggcaaaaaacg

SEQ ID NO: 1854442 - RNA, 13 nt, Salmonella typhimurium LT2
agggaacacggca

SEQ ID NO: 1854443 - RNA, 22 nt, Salmonella typhimurium LT2
agggaacacggcaugaagcagc

SEQ ID NO: 1854444 - RNA, 13 nt, Salmonella typhimurium LT2
agggaacuccagc

SEQ ID NO: 1854445 - RNA, 18 nt, Salmonella typhimurium LT2
agggaauaagcacccaug

SEQ ID NO: 1854446 - RNA, 21 nt, Salmonella typhimurium LT2
agggaaugcgccgucaggcuu

SEQ ID NO: 1854447 - RNA, 18 nt, Salmonella typhimurium LT2
agggacgcauccugcacu

SEQ ID NO: 1854448 - RNA, 20 nt, Salmonella typhimurium LT2
agggacacauuucuuuugau

SEQ ID NO: 1854449 - RNA, 20 nt, Salmonella typhimurium LT2
agggacuccugcgccggacg

SEQ ID NO: 1854450 - RNA, 14 nt, Salmonella typhimurium LT2
agggagcagacugu

SEQ ID NO: 1854451 - RNA, 18 nt, Salmonella typhimurium LT2
agggagguucgccucccu

SEQ ID NO: 1854452 - RNA, 19 nt, Salmonella typhimurium LT2
agggaggugcucucccagc

SEQ ID NO: 1854453 - RNA, 18 nt, Salmonella typhimurium LT2
agggcugaaucggcaccu

SEQ ID NO: 1854454 - RNA, 21 nt, Salmonella typhimurium LT2
agggcuucuuuaccagugaca

SEQ ID NO: 1854455 - RNA, 16 nt, Salmonella typhimurium LT2
agggguguuacgccau

SEQ ID NO: 1854456 - RNA, 18 nt, Salmonella typhimurium LT2
aggggccacaggcggcau

SEQ ID NO: 1854457 - RNA, 18 nt, Salmonella typhimurium LT2
agggcauuuuuuccagua

SEQ ID NO: 1854458 - RNA, 18 nt, Salmonella typhimurium LT2
agggccacaacggagaua

SEQ ID NO: 1854459 - RNA, 16 nt, Salmonella typhimurium LT2
agggcaacaaacauaa

SEQ ID NO: 1854460 - RNA, 12 nt, Salmonella typhimurium LT2
agggcaagggca

SEQ ID NO: 1854461 - RNA, 15 nt, Salmonella typhimurium LT2
agggccagagaaagu

SEQ ID NO: 1854462 - RNA, 16 nt, Salmonella typhimurium LT2
agggcguuuuauaagc

SEQ ID NO: 1854463 - RNA, 17 nt, Salmonella typhimurium LT2
agggcgggcgauagaga

SEQ ID NO: 1854464 - RNA, 14 nt, Salmonella typhimurium LT2
aggugaucuguuca

SEQ ID NO: 1854465 - RNA, 20 nt, Salmonella typhimurium LT2
aggucgcuauccagcaguaa

SEQ ID NO: 1854466 - RNA, 22 nt, Salmonella typhimurium LT2
aggucauaacccuucagcaacg

SEQ ID NO: 1854467 - RNA, 16 nt, Salmonella typhimurium LT2
aggucauuauucaggc

SEQ ID NO: 1854468 - RNA, 17 nt, Salmonella typhimurium LT2
aggucauuauucaggcc

SEQ ID NO: 1854469 - RNA, 18 nt, Salmonella typhimurium LT2
aggucaucaccuccagca

SEQ ID NO: 1854470 - RNA, 18 nt, Salmonella typhimurium LT2
agguauccgccauauccc

SEQ ID NO: 1854471 - RNA, 18 nt, Salmonella typhimurium LT2
agguauacauccacuggu

SEQ ID NO: 1854472 - RNA, 17 nt, Salmonella typhimurium LT2
agguauaaucagcauca

SEQ ID NO: 1854473 - RNA, 22 nt, Salmonella typhimurium LT2
agguagcugcacaagccccacg

SEQ ID NO: 1854474 - RNA, 14 nt, Salmonella typhimurium LT2
agguacgcguuuca

SEQ ID NO: 1854475 - RNA, 21 nt, Salmonella typhimurium LT2
agguacuuucccccagauugu

SEQ ID NO: 1854476 - RNA, 22 nt, Salmonella typhimurium LT2
agggugacucauuucaacauau

SEQ ID NO: 1854477 - RNA, 20 nt, Salmonella typhimurium LT2
aggguaccugggcaauaacg

SEQ ID NO: 1854478 - RNA, 19 nt, Salmonella typhimurium LT2
agggugaaccaaagcaaaa

SEQ ID NO: 1854479 - RNA, 22 nt, Salmonella typhimurium LT2
agggugaaccaaagcaaaaaau

SEQ ID NO: 1854480 - RNA, 20 nt, Salmonella typhimurium LT2
agguaacgcgaaaaaaagau

SEQ ID NO: 1854481 - RNA, 23 nt, Salmonella typhimurium LT2
agggugccguucauuugcaaugg

SEQ ID NO: 1854482 - RNA, 12 nt, Salmonella typhimurium LT2
agguaagcccuu

SEQ ID NO: 1854483 - RNA, 13 nt, Salmonella typhimurium LT2
agguaagcccuua

SEQ ID NO: 1854484 - RNA, 23 nt, Salmonella typhimurium LT2
agguaagcccuuacaaaaaucau

SEQ ID NO: 1854485 - RNA, 23 nt, Salmonella typhimurium LT2
aggccguuauugucaugcuaaaa

SEQ ID NO: 1854486 - RNA, 16 nt, Salmonella typhimurium LT2
aggccgucgacagacg

SEQ ID NO: 1854487 - RNA, 14 nt, Salmonella typhimurium LT2
aggccgggaaaucu

SEQ ID NO: 1854488 - RNA, 18 nt, Salmonella typhimurium LT2
aggccgccaccgccucgc

SEQ ID NO: 1854489 - RNA, 23 nt, Salmonella typhimurium LT2
aggccggguaggacauagccgcc

SEQ ID NO: 1854490 - RNA, 18 nt, Salmonella typhimurium LT2
aggcgaaaauaggcuuuu

SEQ ID NO: 1854491 - RNA, 21 nt, Salmonella typhimurium LT2
aggcgaaccgagauacgcuga

SEQ ID NO: 1854492 - RNA, 21 nt, Salmonella typhimurium LT2
aggcgaacauaagagauggaa

SEQ ID NO: 1854493 - RNA, 17 nt, Salmonella typhimurium LT2
aggccuuuucguacaug

SEQ ID NO: 1854494 - RNA, 18 nt, Salmonella typhimurium LT2
aggccuuuugcagcagcg

SEQ ID NO: 1854495 - RNA, 16 nt, Salmonella typhimurium LT2
aggccuuuuaugaagg

SEQ ID NO: 1854496 - RNA, 23 nt, Salmonella typhimurium LT2
aggccuuuuauuuuggcauuucg

SEQ ID NO: 1854497 - RNA, 22 nt, Salmonella typhimurium LT2
aggccugccggguuuaaugcgc

SEQ ID NO: 1854498 - RNA, 15 nt, Salmonella typhimurium LT2
aggccuggccuucaa

SEQ ID NO: 1854499 - RNA, 19 nt, Salmonella typhimurium LT2
aggccuggccuucaaucag

SEQ ID NO: 1854500 - RNA, 24 nt, Salmonella typhimurium LT2
aggccuuauugugccgcggcuuca

SEQ ID NO: 1854501 - RNA, 13 nt, Salmonella typhimurium LT2
aggccucuaucuu

SEQ ID NO: 1854502 - RNA, 12 nt, Salmonella typhimurium LT2
aggccucuccuc

SEQ ID NO: 1854503 - RNA, 22 nt, Salmonella typhimurium LT2
aggccugauaagcgcagcgcca

SEQ ID NO: 1854504 - RNA, 19 nt, Salmonella typhimurium LT2
aggccucgaccaguuuuuc

SEQ ID NO: 1854505 - RNA, 21 nt, Salmonella typhimurium LT2
aggccucgaccaguuuuuccg

SEQ ID NO: 1854506 - RNA, 22 nt, Salmonella typhimurium LT2
aggccguuggcuuuaugcacgc

SEQ ID NO: 1854507 - RNA, 15 nt, Salmonella typhimurium LT2
aggccuacgacagcg

SEQ ID NO: 1854508 - RNA, 14 nt, Salmonella typhimurium LT2
aggccuacgcucga

SEQ ID NO: 1854509 - RNA, 13 nt, Salmonella typhimurium LT2
aggcgaaucccca

SEQ ID NO: 1854510 - RNA, 19 nt, Salmonella typhimurium LT2
aggcgaagccgccacccgg

SEQ ID NO: 1854511 - RNA, 17 nt, Salmonella typhimurium LT2
aggcgacgaugugcaua

SEQ ID NO: 1854512 - RNA, 22 nt, Salmonella typhimurium LT2
aggcgaccauccaccagaaccu

SEQ ID NO: 1854513 - RNA, 15 nt, Salmonella typhimurium LT2
aggcgacaaucucac

SEQ ID NO: 1854514 - RNA, 15 nt, Salmonella typhimurium LT2
aggcgauaccgcgcu

SEQ ID NO: 1854515 - RNA, 23 nt, Salmonella typhimurium LT2
aggcgauaccuaaucccuggcga

SEQ ID NO: 1854516 - RNA, 17 nt, Salmonella typhimurium LT2
aggcgcaguugaaaaca

SEQ ID NO: 1854517 - RNA, 13 nt, Salmonella typhimurium LT2
aggcgcagccgcc

SEQ ID NO: 1854518 - RNA, 11 nt, Salmonella typhimurium LT2
aggcgcagcaa

SEQ ID NO: 1854519 - RNA, 18 nt, Salmonella typhimurium LT2
aggcgcagaaccauacug

SEQ ID NO: 1854520 - RNA, 21 nt, Salmonella typhimurium LT2
aggcgauccuguucaaacauc

SEQ ID NO: 1854521 - RNA, 16 nt, Salmonella typhimurium LT2
aggcgauagucauauu

SEQ ID NO: 1854522 - RNA, 18 nt, Salmonella typhimurium LT2
aggcgcguaguuggccuu

SEQ ID NO: 1854523 - RNA, 12 nt, Salmonella typhimurium LT2
aggcgcuaccag

SEQ ID NO: 1854524 - RNA, 13 nt, Salmonella typhimurium LT2
aggcgcuaugcug

SEQ ID NO: 1854525 - RNA, 21 nt, Salmonella typhimurium LT2
aggcgcuaugcugaucaucug

SEQ ID NO: 1854526 - RNA, 14 nt, Salmonella typhimurium LT2
aggcgcccacaaug

SEQ ID NO: 1854527 - RNA, 18 nt, Salmonella typhimurium LT2
aggcgcgaccucaucaaa

SEQ ID NO: 1854528 - RNA, 22 nt, Salmonella typhimurium LT2
aggcgccucgcgcggcgguuca

SEQ ID NO: 1854529 - RNA, 14 nt, Salmonella typhimurium LT2
aggcgcgcagcugc

SEQ ID NO: 1854530 - RNA, 17 nt, Salmonella typhimurium LT2
aggcgcgcagcugccac

SEQ ID NO: 1854531 - RNA, 18 nt, Salmonella typhimurium LT2
aggcgccguuuacagccg

SEQ ID NO: 1854532 - RNA, 20 nt, Salmonella typhimurium LT2
aggccagaaggcgaacauaa

SEQ ID NO: 1854533 - RNA, 20 nt, Salmonella typhimurium LT2
aggccaaacccugcgccaca

SEQ ID NO: 1854534 - RNA, 20 nt, Salmonella typhimurium LT2
aggcauugauaaagcgcuca

SEQ ID NO: 1854535 - RNA, 23 nt, Salmonella typhimurium LT2
aggcauugcccuguaaggggcau

SEQ ID NO: 1854536 - RNA, 21 nt, Salmonella typhimurium LT2
aggcaccuguaaccuuaaaag

SEQ ID NO: 1854537 - RNA, 22 nt, Salmonella typhimurium LT2
aggcaccguuucuuugcugccg

SEQ ID NO: 1854538 - RNA, 14 nt, Salmonella typhimurium LT2
aggcacuugagaaa

SEQ ID NO: 1854539 - RNA, 14 nt, Salmonella typhimurium LT2
aggcauuaaaaaaa

SEQ ID NO: 1854540 - RNA, 16 nt, Salmonella typhimurium LT2
aggcauuaaaaaaacg

SEQ ID NO: 1854541 - RNA, 20 nt, Salmonella typhimurium LT2
aggcaugccaaaccagacuc

SEQ ID NO: 1854542 - RNA, 18 nt, Salmonella typhimurium LT2
aggcaucgguucugcgac

SEQ ID NO: 1854543 - RNA, 22 nt, Salmonella typhimurium LT2
aggcaucuaucagaggggaugg

SEQ ID NO: 1854544 - RNA, 13 nt, Salmonella typhimurium LT2
aggagcggaagag

SEQ ID NO: 1854545 - RNA, 22 nt, Salmonella typhimurium LT2
aggauucgacggccagcgcgcg

SEQ ID NO: 1854546 - RNA, 20 nt, Salmonella typhimurium LT2
aggauugugguaagcaauca

SEQ ID NO: 1854547 - RNA, 19 nt, Salmonella typhimurium LT2
aggcaaguucgugagcgaa

SEQ ID NO: 1854548 - RNA, 15 nt, Salmonella typhimurium LT2
aggcaaaaugccagc

SEQ ID NO: 1854549 - RNA, 18 nt, Salmonella typhimurium LT2
aggauuugucucaucuga

SEQ ID NO: 1854550 - RNA, 20 nt, Salmonella typhimurium LT2
aggauuuucgcgucggacag

SEQ ID NO: 1854551 - RNA, 12 nt, Salmonella typhimurium LT2
aggcaaaaaaaa

SEQ ID NO: 1854552 - RNA, 13 nt, Salmonella typhimurium LT2
aggcaaaaauaac

SEQ ID NO: 1854553 - RNA, 23 nt, Salmonella typhimurium LT2
agcugcccgucgcuacaggcaau

SEQ ID NO: 1854554 - RNA, 15 nt, Salmonella typhimurium LT2
agcugccgcccggcg

SEQ ID NO: 1854555 - RNA, 20 nt, Salmonella typhimurium LT2
agcugcuggcgaugauaauc

SEQ ID NO: 1854556 - RNA, 17 nt, Salmonella typhimurium LT2
agcuccagccgcugccu

SEQ ID NO: 1854557 - RNA, 16 nt, Salmonella typhimurium LT2
agcuccagcucagggu

SEQ ID NO: 1854558 - RNA, 19 nt, Salmonella typhimurium LT2
agcuccauagaaaucagca

SEQ ID NO: 1854559 - RNA, 22 nt, Salmonella typhimurium LT2
agcugcauccgggguucgaauc

SEQ ID NO: 1854560 - RNA, 23 nt, Salmonella typhimurium LT2
agcuguaccaucaccugaugucc

SEQ ID NO: 1854561 - RNA, 21 nt, Salmonella typhimurium LT2
agcugguggcgaguccugccg

SEQ ID NO: 1854562 - RNA, 19 nt, Salmonella typhimurium LT2
agcuggucggaucggcggu

SEQ ID NO: 1854563 - RNA, 22 nt, Salmonella typhimurium LT2
agcugcugacguaaauucugau

SEQ ID NO: 1854564 - RNA, 19 nt, Salmonella typhimurium LT2
agcugguauaggccaggcu

SEQ ID NO: 1854565 - RNA, 18 nt, Salmonella typhimurium LT2
agcugguauaggccaggc

SEQ ID NO: 1854566 - RNA, 13 nt, Salmonella typhimurium LT2
agcuguagcauaa

SEQ ID NO: 1854567 - RNA, 23 nt, Salmonella typhimurium LT2
agcugucgccugcugcuggacag

SEQ ID NO: 1854568 - RNA, 12 nt, Salmonella typhimurium LT2
agcugugagaau

SEQ ID NO: 1854569 - RNA, 19 nt, Salmonella typhimurium LT2
agcuuccgucgccaguuuu

SEQ ID NO: 1854570 - RNA, 12 nt, Salmonella typhimurium LT2
agcuucgccaga

SEQ ID NO: 1854571 - RNA, 19 nt, Salmonella typhimurium LT2
agcuucggcggcaucccuu

SEQ ID NO: 1854572 - RNA, 14 nt, Salmonella typhimurium LT2
agcuucaucaucag

SEQ ID NO: 1854573 - RNA, 18 nt, Salmonella typhimurium LT2
agcuuaggauucgccauu

SEQ ID NO: 1854574 - RNA, 16 nt, Salmonella typhimurium LT2
agcuuaauuuuauagc

SEQ ID NO: 1854575 - RNA, 12 nt, Salmonella typhimurium LT2
agcuuaccuggc

SEQ ID NO: 1854576 - RNA, 20 nt, Salmonella typhimurium LT2
agcuucugucugcgugaaga

SEQ ID NO: 1854577 - RNA, 19 nt, Salmonella typhimurium LT2
agcuucucgccggaaagaa

SEQ ID NO: 1854578 - RNA, 22 nt, Salmonella typhimurium LT2
agcuugcauggccggucuuaug

SEQ ID NO: 1854579 - RNA, 17 nt, Salmonella typhimurium LT2
aggacacguuaauuauu

SEQ ID NO: 1854580 - RNA, 15 nt, Salmonella typhimurium LT2
aggaauuuaucaaca

SEQ ID NO: 1854581 - RNA, 21 nt, Salmonella typhimurium LT2
aggaauuguccacccucccag

SEQ ID NO: 1854582 - RNA, 13 nt, Salmonella typhimurium LT2
aggaauuuuccca

SEQ ID NO: 1854583 - RNA, 21 nt, Salmonella typhimurium LT2
aggaauuuucccauaaaagag

SEQ ID NO: 1854584 - RNA, 17 nt, Salmonella typhimurium LT2
aggaagcugcgcagcac

SEQ ID NO: 1854585 - RNA, 20 nt, Salmonella typhimurium LT2
aggaaggucgcauccgcguu

SEQ ID NO: 1854586 - RNA, 18 nt, Salmonella typhimurium LT2
aggacuuuuuccccgcgc

SEQ ID NO: 1854587 - RNA, 17 nt, Salmonella typhimurium LT2
aggacugauacagccaa

SEQ ID NO: 1854588 - RNA, 18 nt, Salmonella typhimurium LT2
aggaccaaaacaauacug

SEQ ID NO: 1854589 - RNA, 16 nt, Salmonella typhimurium LT2
aggacaucaaaggcag

SEQ ID NO: 1854590 - RNA, 17 nt, Salmonella typhimurium LT2
aggagaugaccugccca

SEQ ID NO: 1854591 - RNA, 21 nt, Salmonella typhimurium LT2
aggagaucuuuccauuucagc

SEQ ID NO: 1854592 - RNA, 22 nt, Salmonella typhimurium LT2
aggagcaaacagcgugggaagc

SEQ ID NO: 1854593 - RNA, 14 nt, Salmonella typhimurium LT2
aggagauaucaaaa

SEQ ID NO: 1854594 - RNA, 12 nt, Salmonella typhimurium LT2
aggaaauccagc

SEQ ID NO: 1854595 - RNA, 14 nt, Salmonella typhimurium LT2
aggaaauaacgugc

SEQ ID NO: 1854596 - RNA, 16 nt, Salmonella typhimurium LT2
aggaaauaacaugcca

SEQ ID NO: 1854597 - RNA, 18 nt, Salmonella typhimurium LT2
agcuuugcguaaaaaaac

SEQ ID NO: 1854598 - RNA, 16 nt, Salmonella typhimurium LT2
agcuuugccacuggcu

SEQ ID NO: 1854599 - RNA, 22 nt, Salmonella typhimurium LT2
agcuuuucaugacgcucuccuc

SEQ ID NO: 1854600 - RNA, 12 nt, Salmonella typhimurium LT2
aggaaaggcaga

SEQ ID NO: 1854601 - RNA, 16 nt, Salmonella typhimurium LT2
aggaaagcucaggccu

SEQ ID NO: 1854602 - RNA, 15 nt, Salmonella typhimurium LT2
aggaaagagaaaagc

SEQ ID NO: 1854603 - RNA, 20 nt, Salmonella typhimurium LT2
aggaacuguucagccagcaa

SEQ ID NO: 1854604 - RNA, 17 nt, Salmonella typhimurium LT2
aggaagaguaucucucu

SEQ ID NO: 1854605 - RNA, 15 nt, Salmonella typhimurium LT2
aggaagcagcuugcu

SEQ ID NO: 1854606 - RNA, 17 nt, Salmonella typhimurium LT2
aggaacaucagccagca

SEQ ID NO: 1854607 - RNA, 14 nt, Salmonella typhimurium LT2
aggaacagauacug

SEQ ID NO: 1854608 - RNA, 21 nt, Salmonella typhimurium LT2
aggaaccgguagccaggcgcg

SEQ ID NO: 1854609 - RNA, 12 nt, Salmonella typhimurium LT2
auaaccaauaau

SEQ ID NO: 1854610 - RNA, 14 nt, Salmonella typhimurium LT2
auaacaucuuccau

SEQ ID NO: 1854611 - RNA, 12 nt, Salmonella typhimurium LT2
auaacaucaucc

SEQ ID NO: 1854612 - RNA, 12 nt, Salmonella typhimurium LT2
auaaauuuuuac

SEQ ID NO: 1854613 - RNA, 20 nt, Salmonella typhimurium LT2
auaaaucgucggcaggguuu

SEQ ID NO: 1854614 - RNA, 20 nt, Salmonella typhimurium LT2
auaaaucgccaccguaacua

SEQ ID NO: 1854615 - RNA, 20 nt, Salmonella typhimurium LT2
auaacgcggcccgggagaac

SEQ ID NO: 1854616 - RNA, 20 nt, Salmonella typhimurium LT2
auaaccugccgggguuuuug

SEQ ID NO: 1854617 - RNA, 16 nt, Salmonella typhimurium LT2
auaagaaagauaaaau

SEQ ID NO: 1854618 - RNA, 20 nt, Salmonella typhimurium LT2
auaacguuaccgcagcgaau

SEQ ID NO: 1854619 - RNA, 22 nt, Salmonella typhimurium LT2
auaacucgcauugcagcgcagc

SEQ ID NO: 1854620 - RNA, 16 nt, Salmonella typhimurium LT2
auaaccagaaaaccga

SEQ ID NO: 1854621 - RNA, 22 nt, Salmonella typhimurium LT2
auaaccagaaaaccgacagcaa

SEQ ID NO: 1854622 - RNA, 13 nt, Salmonella typhimurium LT2
auaacccgccugg

SEQ ID NO: 1854623 - RNA, 23 nt, Salmonella typhimurium LT2
auaacccggauugucuuaaauau

SEQ ID NO: 1854624 - RNA, 23 nt, Salmonella typhimurium LT2
auaaccguagauuuucaucauau

SEQ ID NO: 1854625 - RNA, 20 nt, Salmonella typhimurium LT2
auaaccgucgcccguccgcu

SEQ ID NO: 1854626 - RNA, 23 nt, Salmonella typhimurium LT2
auaaccucaacgucgcucagaau

SEQ ID NO: 1854627 - RNA, 19 nt, Salmonella typhimurium LT2
auaaccucaaugauuuccg

SEQ ID NO: 1854628 - RNA, 21 nt, Salmonella typhimurium LT2
auaaaccgccguuuugauuug

SEQ ID NO: 1854629 - RNA, 22 nt, Salmonella typhimurium LT2
auaaaccugauugccgguuguu

SEQ ID NO: 1854630 - RNA, 17 nt, Salmonella typhimurium LT2
auaaagcacagccccag

SEQ ID NO: 1854631 - RNA, 19 nt, Salmonella typhimurium LT2
auaaacgccagcccuucca

SEQ ID NO: 1854632 - RNA, 17 nt, Salmonella typhimurium LT2
auaaagcagcgacaaua

SEQ ID NO: 1854633 - RNA, 23 nt, Salmonella typhimurium LT2
auaaagcagaccaccccacagca

SEQ ID NO: 1854634 - RNA, 17 nt, Salmonella typhimurium LT2
auaaagcgaauaauuaa

SEQ ID NO: 1854635 - RNA, 16 nt, Salmonella typhimurium LT2
auaaagcgguuuucaa

SEQ ID NO: 1854636 - RNA, 14 nt, Salmonella typhimurium LT2
auaaaggucacauc

SEQ ID NO: 1854637 - RNA, 13 nt, Salmonella typhimurium LT2
auaaaguauguuu

SEQ ID NO: 1854638 - RNA, 22 nt, Salmonella typhimurium LT2
auaaaguauguuuugaauggcu

SEQ ID NO: 1854639 - RNA, 19 nt, Salmonella typhimurium LT2
auaaauaucgcguuaauuu

SEQ ID NO: 1854640 - RNA, 18 nt, Salmonella typhimurium LT2
auaaauagccagcaucau

SEQ ID NO: 1854641 - RNA, 16 nt, Salmonella typhimurium LT2
auaaaguagccaaugc

SEQ ID NO: 1854642 - RNA, 16 nt, Salmonella typhimurium LT2
auaaauaccaaagaac

SEQ ID NO: 1854643 - RNA, 17 nt, Salmonella typhimurium LT2
auaaaauuauuggcuuu

SEQ ID NO: 1854644 - RNA, 12 nt, Salmonella typhimurium LT2
auaaaauuauau

SEQ ID NO: 1854645 - RNA, 21 nt, Salmonella typhimurium LT2
auaaaauuuaauauugcugaa

SEQ ID NO: 1854646 - RNA, 13 nt, Salmonella typhimurium LT2
auaaaauuguuau

SEQ ID NO: 1854647 - RNA, 18 nt, Salmonella typhimurium LT2
auaaaauuguuauuuaau

SEQ ID NO: 1854648 - RNA, 20 nt, Salmonella typhimurium LT2
auaaaauguuccauauccag

SEQ ID NO: 1854649 - RNA, 19 nt, Salmonella typhimurium LT2
auaaaauagugaucaucau

SEQ ID NO: 1854650 - RNA, 16 nt, Salmonella typhimurium LT2
auaauaagaucaaagc

SEQ ID NO: 1854651 - RNA, 12 nt, Salmonella typhimurium LT2
auaauaauaucc

SEQ ID NO: 1854652 - RNA, 13 nt, Salmonella typhimurium LT2
auaauaauauccu

SEQ ID NO: 1854653 - RNA, 19 nt, Salmonella typhimurium LT2
auaauaauauccuuuuugc

SEQ ID NO: 1854654 - RNA, 20 nt, Salmonella typhimurium LT2
auaauaauuaccacgcagcc

SEQ ID NO: 1854655 - RNA, 12 nt, Salmonella typhimurium LT2
auaauaaauuuu

SEQ ID NO: 1854656 - RNA, 18 nt, Salmonella typhimurium LT2
auaauaaauuuucauuau

SEQ ID NO: 1854657 - RNA, 12 nt, Salmonella typhimurium LT2
auaauaaaauau

SEQ ID NO: 1854658 - RNA, 13 nt, Salmonella typhimurium LT2
auaauaaaauauu

SEQ ID NO: 1854659 - RNA, 14 nt, Salmonella typhimurium LT2
auaauaaaauauua

SEQ ID NO: 1854660 - RNA, 15 nt, Salmonella typhimurium LT2
auaauaaaauauuau

SEQ ID NO: 1854661 - RNA, 15 nt, Salmonella typhimurium LT2
auaagaacuuuauca

SEQ ID NO: 1854662 - RNA, 16 nt, Salmonella typhimurium LT2
auaagaaguaaacaga

SEQ ID NO: 1854663 - RNA, 17 nt, Salmonella typhimurium LT2
auaagaaguaaacagaa

SEQ ID NO: 1854664 - RNA, 12 nt, Salmonella typhimurium LT2
auaauggcauau

SEQ ID NO: 1854665 - RNA, 22 nt, Salmonella typhimurium LT2
auaaucucugcgacaaucagau

SEQ ID NO: 1854666 - RNA, 17 nt, Salmonella typhimurium LT2
auaaucgauuccuauuu

SEQ ID NO: 1854667 - RNA, 16 nt, Salmonella typhimurium LT2
auaaucgaccguaucc

SEQ ID NO: 1854668 - RNA, 12 nt, Salmonella typhimurium LT2
auaauccuuccu

SEQ ID NO: 1854669 - RNA, 21 nt, Salmonella typhimurium LT2
auaauccuuccuccaccacca

SEQ ID NO: 1854670 - RNA, 20 nt, Salmonella typhimurium LT2
auaauccuuccuuucauuuu

SEQ ID NO: 1854671 - RNA, 20 nt, Salmonella typhimurium LT2
auaauccggaauaagaauau

SEQ ID NO: 1854672 - RNA, 18 nt, Salmonella typhimurium LT2
auaauccuuguccaugua

SEQ ID NO: 1854673 - RNA, 13 nt, Salmonella typhimurium LT2
auaaucagcagcg

SEQ ID NO: 1854674 - RNA, 14 nt, Salmonella typhimurium LT2
auaaucagcaucac

SEQ ID NO: 1854675 - RNA, 12 nt, Salmonella typhimurium LT2
auaaucaccacg

SEQ ID NO: 1854676 - RNA, 19 nt, Salmonella typhimurium LT2
auaauaguuagccugauag

SEQ ID NO: 1854677 - RNA, 14 nt, Salmonella typhimurium LT2
auaauugauaauaa

SEQ ID NO: 1854678 - RNA, 19 nt, Salmonella typhimurium LT2
auaaugguggaaugcccca

SEQ ID NO: 1854679 - RNA, 19 nt, Salmonella typhimurium LT2
auaauguaaaaaaauaaaa

SEQ ID NO: 1854680 - RNA, 12 nt, Salmonella typhimurium LT2
auaauugcugcc

SEQ ID NO: 1854681 - RNA, 13 nt, Salmonella typhimurium LT2
auaauugcgcgcg

SEQ ID NO: 1854682 - RNA, 15 nt, Salmonella typhimurium LT2
auaauugauaauaac

SEQ ID NO: 1854683 - RNA, 15 nt, Salmonella typhimurium LT2
auaauuucaggcugc

SEQ ID NO: 1854684 - RNA, 13 nt, Salmonella typhimurium LT2
auacaaaaaagac

SEQ ID NO: 1854685 - RNA, 15 nt, Salmonella typhimurium LT2
auacaaaaaagacag

SEQ ID NO: 1854686 - RNA, 19 nt, Salmonella typhimurium LT2
auaauuucguuuuacccau

SEQ ID NO: 1854687 - RNA, 14 nt, Salmonella typhimurium LT2
auacacgaacacag

SEQ ID NO: 1854688 - RNA, 21 nt, Salmonella typhimurium LT2
auacacugcauaaauaucugc

SEQ ID NO: 1854689 - RNA, 13 nt, Salmonella typhimurium LT2
auacagacagcag

SEQ ID NO: 1854690 - RNA, 19 nt, Salmonella typhimurium LT2
auacagacagcagaugaaa

SEQ ID NO: 1854691 - RNA, 19 nt, Salmonella typhimurium LT2
auacagaugcugucuuagu

SEQ ID NO: 1854692 - RNA, 16 nt, Salmonella typhimurium LT2
auacagcaauaugacu

SEQ ID NO: 1854693 - RNA, 13 nt, Salmonella typhimurium LT2
auacagcccgcgc

SEQ ID NO: 1854694 - RNA, 15 nt, Salmonella typhimurium LT2
auacaaagcagauag

SEQ ID NO: 1854695 - RNA, 22 nt, Salmonella typhimurium LT2
agucugccauuuccugauuuuu

SEQ ID NO: 1854696 - RNA, 20 nt, Salmonella typhimurium LT2
agugaagaugguaauauuaa

SEQ ID NO: 1854697 - RNA, 15 nt, Salmonella typhimurium LT2
agugaaaaaacggaa

SEQ ID NO: 1854698 - RNA, 19 nt, Salmonella typhimurium LT2
agucuuuuguuuuucucuu

SEQ ID NO: 1854699 - RNA, 16 nt, Salmonella typhimurium LT2
agucgggaucgccaga

SEQ ID NO: 1854700 - RNA, 16 nt, Salmonella typhimurium LT2
agucggguagaaauuc

SEQ ID NO: 1854701 - RNA, 21 nt, Salmonella typhimurium LT2
aguccugcgcuuugacauugu

SEQ ID NO: 1854702 - RNA, 20 nt, Salmonella typhimurium LT2
agucgacagcccgccagcau

SEQ ID NO: 1854703 - RNA, 21 nt, Salmonella typhimurium LT2
agucgacagcccgccagcaua

SEQ ID NO: 1854704 - RNA, 22 nt, Salmonella typhimurium LT2
aguccugccauucgacaagcgg

SEQ ID NO: 1854705 - RNA, 16 nt, Salmonella typhimurium LT2
aguccucgcccacuuc

SEQ ID NO: 1854706 - RNA, 14 nt, Salmonella typhimurium LT2
aguccucuauuuuu

SEQ ID NO: 1854707 - RNA, 20 nt, Salmonella typhimurium LT2
agucgcuuaucugcugcugg

SEQ ID NO: 1854708 - RNA, 16 nt, Salmonella typhimurium LT2
agucgacucaucuuuu

SEQ ID NO: 1854709 - RNA, 21 nt, Salmonella typhimurium LT2
agucaaacacgaccagcgaca

SEQ ID NO: 1854710 - RNA, 13 nt, Salmonella typhimurium LT2
agucaaaauaaaa

SEQ ID NO: 1854711 - RNA, 22 nt, Salmonella typhimurium LT2
agucaaaauaaaauuauauucu

SEQ ID NO: 1854712 - RNA, 17 nt, Salmonella typhimurium LT2
aguccgguggcgaaaac

SEQ ID NO: 1854713 - RNA, 14 nt, Salmonella typhimurium LT2
aguccgucagaaua

SEQ ID NO: 1854714 - RNA, 20 nt, Salmonella typhimurium LT2
aguccgucagaauaucuuuu

SEQ ID NO: 1854715 - RNA, 21 nt, Salmonella typhimurium LT2
aguccgcccgccucaaaccag

SEQ ID NO: 1854716 - RNA, 12 nt, Salmonella typhimurium LT2
agucaaauucca

SEQ ID NO: 1854717 - RNA, 16 nt, Salmonella typhimurium LT2
agucaaauuccagcaa

SEQ ID NO: 1854718 - RNA, 15 nt, Salmonella typhimurium LT2
agucaaauuccagca

SEQ ID NO: 1854719 - RNA, 13 nt, Salmonella typhimurium LT2
agugaucccaaca

SEQ ID NO: 1854720 - RNA, 19 nt, Salmonella typhimurium LT2
agugauaccagccaacagu

SEQ ID NO: 1854721 - RNA, 17 nt, Salmonella typhimurium LT2
agugaaucgacggcaau

SEQ ID NO: 1854722 - RNA, 19 nt, Salmonella typhimurium LT2
agugaauccagcguacuga

SEQ ID NO: 1854723 - RNA, 18 nt, Salmonella typhimurium LT2
agugaagugcaggauaga

SEQ ID NO: 1854724 - RNA, 20 nt, Salmonella typhimurium LT2
agugaagugcaggauagaaa

SEQ ID NO: 1854725 - RNA, 21 nt, Salmonella typhimurium LT2
agugaagugugaacuaugcug

SEQ ID NO: 1854726 - RNA, 17 nt, Salmonella typhimurium LT2
agugauuauaaaucaau

SEQ ID NO: 1854727 - RNA, 13 nt, Salmonella typhimurium LT2
agugauuccuuug

SEQ ID NO: 1854728 - RNA, 15 nt, Salmonella typhimurium LT2
agugauuccuuugaa

SEQ ID NO: 1854729 - RNA, 16 nt, Salmonella typhimurium LT2
agugauggauuucaca

SEQ ID NO: 1854730 - RNA, 18 nt, Salmonella typhimurium LT2
agugccagaaacaucggu

SEQ ID NO: 1854731 - RNA, 19 nt, Salmonella typhimurium LT2
agugcccagcgcgaccugc

SEQ ID NO: 1854732 - RNA, 20 nt, Salmonella typhimurium LT2
agugcccgaacgcaauacug

SEQ ID NO: 1854733 - RNA, 21 nt, Salmonella typhimurium LT2
agugcaaucuuuacccggcgc

SEQ ID NO: 1854734 - RNA, 14 nt, Salmonella typhimurium LT2
aguggaucagcaga

SEQ ID NO: 1854735 - RNA, 16 nt, Salmonella typhimurium LT2
agugcuucuucaaacu

SEQ ID NO: 1854736 - RNA, 14 nt, Salmonella typhimurium LT2
agugcuguuccucg

SEQ ID NO: 1854737 - RNA, 19 nt, Salmonella typhimurium LT2
aguggcauccgaagaacca

SEQ ID NO: 1854738 - RNA, 16 nt, Salmonella typhimurium LT2
agugggucacaucgcc

SEQ ID NO: 1854739 - RNA, 13 nt, Salmonella typhimurium LT2
aguggugggugau

SEQ ID NO: 1854740 - RNA, 12 nt, Salmonella typhimurium LT2
agugguggguga

SEQ ID NO: 1854741 - RNA, 14 nt, Salmonella typhimurium LT2
agugcgcugucagc

SEQ ID NO: 1854742 - RNA, 20 nt, Salmonella typhimurium LT2
agugccgguggcaugaaaau

SEQ ID NO: 1854743 - RNA, 21 nt, Salmonella typhimurium LT2
aguuguugucgagguuauaaa

SEQ ID NO: 1854744 - RNA, 16 nt, Salmonella typhimurium LT2
aguuguccauuuuccu

SEQ ID NO: 1854745 - RNA, 21 nt, Salmonella typhimurium LT2
aguugcauucccuacgcccag

SEQ ID NO: 1854746 - RNA, 21 nt, Salmonella typhimurium LT2
aguugcauauaaggcccauac

SEQ ID NO: 1854747 - RNA, 19 nt, Salmonella typhimurium LT2
aguugcgacuguucaucaa

SEQ ID NO: 1854748 - RNA, 21 nt, Salmonella typhimurium LT2
aguugcgauccuuccggcgcc

SEQ ID NO: 1854749 - RNA, 13 nt, Salmonella typhimurium LT2
aguugcgcagggu

SEQ ID NO: 1854750 - RNA, 16 nt, Salmonella typhimurium LT2
aguugcgcaggguauc

SEQ ID NO: 1854751 - RNA, 13 nt, Salmonella typhimurium LT2
aguuuauucuucu

SEQ ID NO: 1854752 - RNA, 14 nt, Salmonella typhimurium LT2
aguuuauucuucuc

SEQ ID NO: 1854753 - RNA, 15 nt, Salmonella typhimurium LT2
aguuuauugagauaa

SEQ ID NO: 1854754 - RNA, 22 nt, Salmonella typhimurium LT2
aguuuauguaccaguuggcugu

SEQ ID NO: 1854755 - RNA, 16 nt, Salmonella typhimurium LT2
aguuuauugagauaau

SEQ ID NO: 1854756 - RNA, 16 nt, Salmonella typhimurium LT2
aguuuagccagcagcg

SEQ ID NO: 1854757 - RNA, 13 nt, Salmonella typhimurium LT2
aguuguuucaaca

SEQ ID NO: 1854758 - RNA, 22 nt, Salmonella typhimurium LT2
aguuuacgagugcguucuucca

SEQ ID NO: 1854759 - RNA, 13 nt, Salmonella typhimurium LT2
aguuugucaucca

SEQ ID NO: 1854760 - RNA, 21 nt, Salmonella typhimurium LT2
aguuugucaugcgugcgccgc

SEQ ID NO: 1854761 - RNA, 22 nt, Salmonella typhimurium LT2
aguuugucaacgugugccagga

SEQ ID NO: 1854762 - RNA, 10 nt, Salmonella typhimurium LT2
aguuuuaacg

SEQ ID NO: 1854763 - RNA, 16 nt, Salmonella typhimurium LT2
aguuugaccagcaaua

SEQ ID NO: 1854764 - RNA, 16 nt, Salmonella typhimurium LT2
aguuugccuuuauuca

SEQ ID NO: 1854765 - RNA, 22 nt, Salmonella typhimurium LT2
aguuugccuuuauucauuucaa

SEQ ID NO: 1854766 - RNA, 23 nt, Salmonella typhimurium LT2
aguuugccccauuguucuuucau

SEQ ID NO: 1854767 - RNA, 17 nt, Salmonella typhimurium LT2
aguuucaucagcacaaa

SEQ ID NO: 1854768 - RNA, 14 nt, Salmonella typhimurium LT2
aguuuccgguaaau

SEQ ID NO: 1854769 - RNA, 19 nt, Salmonella typhimurium LT2
aguuucucccgccagaugc

SEQ ID NO: 1854770 - RNA, 14 nt, Salmonella typhimurium LT2
aguuucucaaagcu

SEQ ID NO: 1854771 - RNA, 21 nt, Salmonella typhimurium LT2
aguuucuucggcuucaccgau

SEQ ID NO: 1854772 - RNA, 18 nt, Salmonella typhimurium LT2
aguucucgucugcugaaa

SEQ ID NO: 1854773 - RNA, 18 nt, Salmonella typhimurium LT2
aguucucgguauccagcu

SEQ ID NO: 1854774 - RNA, 14 nt, Salmonella typhimurium LT2
aguucuucauuuau

SEQ ID NO: 1854775 - RNA, 20 nt, Salmonella typhimurium LT2
aguugauauuuaaacggggu

SEQ ID NO: 1854776 - RNA, 23 nt, Salmonella typhimurium LT2
aguugauaauauuaucagcaaua

SEQ ID NO: 1854777 - RNA, 16 nt, Salmonella typhimurium LT2
aguucuacgcugccau

SEQ ID NO: 1854778 - RNA, 14 nt, Salmonella typhimurium LT2
aguucguccaccuc

SEQ ID NO: 1854779 - RNA, 16 nt, Salmonella typhimurium LT2
aguucguacuccugca

SEQ ID NO: 1854780 - RNA, 16 nt, Salmonella typhimurium LT2
aguucguagagcucca

SEQ ID NO: 1854781 - RNA, 16 nt, Salmonella typhimurium LT2
aguuacggacaugcga

SEQ ID NO: 1854782 - RNA, 17 nt, Salmonella typhimurium LT2
aguuaccgcgccaggcg

SEQ ID NO: 1854783 - RNA, 24 nt, Salmonella typhimurium LT2
aguuaauucguccccagcgaucca

SEQ ID NO: 1854784 - RNA, 21 nt, Salmonella typhimurium LT2
aguuaucgauucugaauaaua

SEQ ID NO: 1854785 - RNA, 17 nt, Salmonella typhimurium LT2
aguuauuaacaucagcc

SEQ ID NO: 1854786 - RNA, 16 nt, Salmonella typhimurium LT2
aguucaccaguuuuuc

SEQ ID NO: 1854787 - RNA, 18 nt, Salmonella typhimurium LT2
aguucaucuuccacacua

SEQ ID NO: 1854788 - RNA, 18 nt, Salmonella typhimurium LT2
aucuucgucaaugcugcu

SEQ ID NO: 1854789 - RNA, 23 nt, Salmonella typhimurium LT2
aucuucgauuguugacugccagc

SEQ ID NO: 1854790 - RNA, 13 nt, Salmonella typhimurium LT2
aucuuuccuuuuu

SEQ ID NO: 1854791 - RNA, 20 nt, Salmonella typhimurium LT2
aucuuuaugucaguaauaua

SEQ ID NO: 1854792 - RNA, 16 nt, Salmonella typhimurium LT2
aucuuucacccccagc

SEQ ID NO: 1854793 - RNA, 15 nt, Salmonella typhimurium LT2
augaaaauaugaugc

SEQ ID NO: 1854794 - RNA, 19 nt, Salmonella typhimurium LT2
augaaaugagaccaauaag

SEQ ID NO: 1854795 - RNA, 22 nt, Salmonella typhimurium LT2
augaaaucgccuguuaauggua

SEQ ID NO: 1854796 - RNA, 14 nt, Salmonella typhimurium LT2
augaaaucacccag

SEQ ID NO: 1854797 - RNA, 11 nt, Salmonella typhimurium LT2
augaaauaauc

SEQ ID NO: 1854798 - RNA, 16 nt, Salmonella typhimurium LT2
augaagcauaaaaaga

SEQ ID NO: 1854799 - RNA, 21 nt, Salmonella typhimurium LT2
augaagcuacagggaauaugc

SEQ ID NO: 1854800 - RNA, 19 nt, Salmonella typhimurium LT2
augaaggagagcauuuuuu

SEQ ID NO: 1854801 - RNA, 16 nt, Salmonella typhimurium LT2
augaauaaaaaacaag

SEQ ID NO: 1854802 - RNA, 17 nt, Salmonella typhimurium LT2
augaauaaaaaacaaga

SEQ ID NO: 1854803 - RNA, 21 nt, Salmonella typhimurium LT2
augaauaaaaaacaagauuaa

SEQ ID NO: 1854804 - RNA, 11 nt, Salmonella typhimurium LT2
augaaugacug

SEQ ID NO: 1854805 - RNA, 17 nt, Salmonella typhimurium LT2
augaaugaguaaccaga

SEQ ID NO: 1854806 - RNA, 13 nt, Salmonella typhimurium LT2
augaaugacuguc

SEQ ID NO: 1854807 - RNA, 20 nt, Salmonella typhimurium LT2
augacugcgaauuuccugcc

SEQ ID NO: 1854808 - RNA, 13 nt, Salmonella typhimurium LT2
augacuguccacg

SEQ ID NO: 1854809 - RNA, 14 nt, Salmonella typhimurium LT2
augacauccagagg

SEQ ID NO: 1854810 - RNA, 12 nt, Salmonella typhimurium LT2
augaguaaaauu

SEQ ID NO: 1854811 - RNA, 22 nt, Salmonella typhimurium LT2
augacuuuuuauauaagcauau

SEQ ID NO: 1854812 - RNA, 17 nt, Salmonella typhimurium LT2
augagcucaaauaugau

SEQ ID NO: 1854813 - RNA, 23 nt, Salmonella typhimurium LT2
augauaaccgccgccaaacugcg

SEQ ID NO: 1854814 - RNA, 18 nt, Salmonella typhimurium LT2
augaguucagcugauugg

SEQ ID NO: 1854815 - RNA, 15 nt, Salmonella typhimurium LT2
augaguuaacuacag

SEQ ID NO: 1854816 - RNA, 19 nt, Salmonella typhimurium LT2
augaguuggccuaccauuu

SEQ ID NO: 1854817 - RNA, 16 nt, Salmonella typhimurium LT2
augauaauaugcucaa

SEQ ID NO: 1854818 - RNA, 13 nt, Salmonella typhimurium LT2
augauaaugccgc

SEQ ID NO: 1854819 - RNA, 23 nt, Salmonella typhimurium LT2
augauccagcggaacucaucauc

SEQ ID NO: 1854820 - RNA, 22 nt, Salmonella typhimurium LT2
augauaucggccggaugccagu

SEQ ID NO: 1854821 - RNA, 16 nt, Salmonella typhimurium LT2
aucuccuuuaaugaag

SEQ ID NO: 1854822 - RNA, 20 nt, Salmonella typhimurium LT2
aucuccucgccguaaaauuc

SEQ ID NO: 1854823 - RNA, 19 nt, Salmonella typhimurium LT2
aucuccugacauagcucac

SEQ ID NO: 1854824 - RNA, 13 nt, Salmonella typhimurium LT2
aucuccugacugc

SEQ ID NO: 1854825 - RNA, 17 nt, Salmonella typhimurium LT2
aucuccuccggcuucag

SEQ ID NO: 1854826 - RNA, 22 nt, Salmonella typhimurium LT2
aucuccuccucauucagcggcu

SEQ ID NO: 1854827 - RNA, 16 nt, Salmonella typhimurium LT2
aucuccggcagcgaau

SEQ ID NO: 1854828 - RNA, 16 nt, Salmonella typhimurium LT2
aucuccggcgaccaau

SEQ ID NO: 1854829 - RNA, 19 nt, Salmonella typhimurium LT2
aucucaucugcaaaauaua

SEQ ID NO: 1854830 - RNA, 14 nt, Salmonella typhimurium LT2
aucucauggagcug

SEQ ID NO: 1854831 - RNA, 18 nt, Salmonella typhimurium LT2
aucucauggagcugcccg

SEQ ID NO: 1854832 - RNA, 19 nt, Salmonella typhimurium LT2
aucucugucgaccaucgca

SEQ ID NO: 1854833 - RNA, 23 nt, Salmonella typhimurium LT2
aucucgaccuggugcucaaucag

SEQ ID NO: 1854834 - RNA, 21 nt, Salmonella typhimurium LT2
aucucgcacaucaugaugauc

SEQ ID NO: 1854835 - RNA, 19 nt, Salmonella typhimurium LT2
aucucucuggcgcauucca

SEQ ID NO: 1854836 - RNA, 18 nt, Salmonella typhimurium LT2
aucucucgcgggcauacu

SEQ ID NO: 1854837 - RNA, 22 nt, Salmonella typhimurium LT2
aucgucaucggucaguuugccc

SEQ ID NO: 1854838 - RNA, 21 nt, Salmonella typhimurium LT2
aucguauccggucaauacauc

SEQ ID NO: 1854839 - RNA, 18 nt, Salmonella typhimurium LT2
aucguaugcagccaggcc

SEQ ID NO: 1854840 - RNA, 14 nt, Salmonella typhimurium LT2
aucguaugcgccug

SEQ ID NO: 1854841 - RNA, 12 nt, Salmonella typhimurium LT2
aucucacuagca

SEQ ID NO: 1854842 - RNA, 19 nt, Salmonella typhimurium LT2
aucucacaagauucacucu

SEQ ID NO: 1854843 - RNA, 16 nt, Salmonella typhimurium LT2
aucuauccaauaauaa

SEQ ID NO: 1854844 - RNA, 17 nt, Salmonella typhimurium LT2
aucuauauauucuucuu

SEQ ID NO: 1854845 - RNA, 16 nt, Salmonella typhimurium LT2
aucuauagccugcugg

SEQ ID NO: 1854846 - RNA, 17 nt, Salmonella typhimurium LT2
aucuuccacgguaaaac

SEQ ID NO: 1854847 - RNA, 22 nt, Salmonella typhimurium LT2
aucuuccagcgucgggccgcgc

SEQ ID NO: 1854848 - RNA, 19 nt, Salmonella typhimurium LT2
aucuuccggaguaaugaaa

SEQ ID NO: 1854849 - RNA, 15 nt, Salmonella typhimurium LT2
aucuucagcccguuc

SEQ ID NO: 1854850 - RNA, 17 nt, Salmonella typhimurium LT2
aucuucacgcagcguga

SEQ ID NO: 1854851 - RNA, 19 nt, Salmonella typhimurium LT2
aucuucaccgaugcccagc

SEQ ID NO: 1854852 - RNA, 15 nt, Salmonella typhimurium LT2
aucuuagacaucaaa

SEQ ID NO: 1854853 - RNA, 17 nt, Salmonella typhimurium LT2
aucuggccaauuuuuca

SEQ ID NO: 1854854 - RNA, 14 nt, Salmonella typhimurium LT2
aucugcgccgccgg

SEQ ID NO: 1854855 - RNA, 17 nt, Salmonella typhimurium LT2
aucugcggucuccugaa

SEQ ID NO: 1854856 - RNA, 14 nt, Salmonella typhimurium LT2
aucugacagccaaa

SEQ ID NO: 1854857 - RNA, 16 nt, Salmonella typhimurium LT2
aucugacacagaggaa

SEQ ID NO: 1854858 - RNA, 15 nt, Salmonella typhimurium LT2
aucugacagauaucu

SEQ ID NO: 1854859 - RNA, 16 nt, Salmonella typhimurium LT2
aucugacgcggcgccg

SEQ ID NO: 1854860 - RNA, 15 nt, Salmonella typhimurium LT2
aucugacccgggcuu

SEQ ID NO: 1854861 - RNA, 17 nt, Salmonella typhimurium LT2
aucugaaauaaaagcaa

SEQ ID NO: 1854862 - RNA, 19 nt, Salmonella typhimurium LT2
aucugaaauaaaagcaaug

SEQ ID NO: 1854863 - RNA, 13 nt, Salmonella typhimurium LT2
aucugaauaccuu

SEQ ID NO: 1854864 - RNA, 22 nt, Salmonella typhimurium LT2
aucuguauaaauaaaauuguua

SEQ ID NO: 1854865 - RNA, 15 nt, Salmonella typhimurium LT2
aucuguuuuagcaug

SEQ ID NO: 1854866 - RNA, 18 nt, Salmonella typhimurium LT2
aucugucacuuaaguaaa

SEQ ID NO: 1854867 - RNA, 14 nt, Salmonella typhimurium LT2
aaaagaaaaauauc

SEQ ID NO: 1854868 - RNA, 11 nt, Salmonella typhimurium LT2
aaaagaaaaca

SEQ ID NO: 1854869 - RNA, 18 nt, Salmonella typhimurium LT2
aucauucaacgcaucaaa

SEQ ID NO: 1854870 - RNA, 22 nt, Salmonella typhimurium LT2
aucauucccgaauaccacaaau

SEQ ID NO: 1854871 - RNA, 13 nt, Salmonella typhimurium LT2
aucauucccgccc

SEQ ID NO: 1854872 - RNA, 19 nt, Salmonella typhimurium LT2
aucauuguucuguccggaa

SEQ ID NO: 1854873 - RNA, 22 nt, Salmonella typhimurium LT2
aaaacuuauuuuauuuuuauau

SEQ ID NO: 1854874 - RNA, 19 nt, Salmonella typhimurium LT2
aaaacuucgauaauaaaau

SEQ ID NO: 1854875 - RNA, 21 nt, Salmonella typhimurium LT2
aaaacuucgauaauaaaauau

SEQ ID NO: 1854876 - RNA, 13 nt, Salmonella typhimurium LT2
aaaacuacaacaa

SEQ ID NO: 1854877 - RNA, 15 nt, Salmonella typhimurium LT2
auccaccaccagguu

SEQ ID NO: 1854878 - RNA, 13 nt, Salmonella typhimurium LT2
auccaccaggcau

SEQ ID NO: 1854879 - RNA, 16 nt, Salmonella typhimurium LT2
auccaccaggcaugca

SEQ ID NO: 1854880 - RNA, 20 nt, Salmonella typhimurium LT2
auccaccagcccaucuuucg

SEQ ID NO: 1854881 - RNA, 20 nt, Salmonella typhimurium LT2
auccaccacuugauucugca

SEQ ID NO: 1854882 - RNA, 13 nt, Salmonella typhimurium LT2
auccaagccccuc

SEQ ID NO: 1854883 - RNA, 13 nt, Salmonella typhimurium LT2
aucauuuuuuaau

SEQ ID NO: 1854884 - RNA, 21 nt, Salmonella typhimurium LT2
auccaacuuaugaaaaccugu

SEQ ID NO: 1854885 - RNA, 20 nt, Salmonella typhimurium LT2
auccagacaaacaccgccug

SEQ ID NO: 1854886 - RNA, 18 nt, Salmonella typhimurium LT2
auccagaauaccagaauc

SEQ ID NO: 1854887 - RNA, 24 nt, Salmonella typhimurium LT2
auccagaacugcgaaaucaccgac

SEQ ID NO: 1854888 - RNA, 16 nt, Salmonella typhimurium LT2
auccagcgcaaaggga

SEQ ID NO: 1854889 - RNA, 21 nt, Salmonella typhimurium LT2
auccagcgccaggauaucuuc

SEQ ID NO: 1854890 - RNA, 17 nt, Salmonella typhimurium LT2
auccagcgagccuucca

SEQ ID NO: 1854891 - RNA, 15 nt, Salmonella typhimurium LT2
auccagccguugcca

SEQ ID NO: 1854892 - RNA, 16 nt, Salmonella typhimurium LT2
auccagccguugccau

SEQ ID NO: 1854893 - RNA, 20 nt, Salmonella typhimurium LT2
auccacuggucgucugaaag

SEQ ID NO: 1854894 - RNA, 19 nt, Salmonella typhimurium LT2
auccacccuggcgcagugg

SEQ ID NO: 1854895 - RNA, 24 nt, Salmonella typhimurium LT2
auccacuuucgcuacaucggcuac

SEQ ID NO: 1854896 - RNA, 20 nt, Salmonella typhimurium LT2
auccauuugcgacaucagcc

SEQ ID NO: 1854897 - RNA, 22 nt, Salmonella typhimurium LT2
auccauuuaacuaaggggacaa

SEQ ID NO: 1854898 - RNA, 16 nt, Salmonella typhimurium LT2
auccauguugccauga

SEQ ID NO: 1854899 - RNA, 16 nt, Salmonella typhimurium LT2
auccaggaauuuuccc

SEQ ID NO: 1854900 - RNA, 13 nt, Salmonella typhimurium LT2
auccaggcgggca

SEQ ID NO: 1854901 - RNA, 11 nt, Salmonella typhimurium LT2
auccaggugga

SEQ ID NO: 1854902 - RNA, 17 nt, Salmonella typhimurium LT2
auccagguaacauacaa

SEQ ID NO: 1854903 - RNA, 16 nt, Salmonella typhimurium LT2
auccagggcacuguca

SEQ ID NO: 1854904 - RNA, 14 nt, Salmonella typhimurium LT2
aucccgccgcaucc

SEQ ID NO: 1854905 - RNA, 23 nt, Salmonella typhimurium LT2
aucccgccuugcggcgccaggac

SEQ ID NO: 1854906 - RNA, 14 nt, Salmonella typhimurium LT2
aucccgccgcuggc

SEQ ID NO: 1854907 - RNA, 17 nt, Salmonella typhimurium LT2
auccccggcaaccuuaa

SEQ ID NO: 1854908 - RNA, 13 nt, Salmonella typhimurium LT2
auccccggcaacc

SEQ ID NO: 1854909 - RNA, 18 nt, Salmonella typhimurium LT2
auccccuacggugugccu

SEQ ID NO: 1854910 - RNA, 23 nt, Salmonella typhimurium LT2
aucccgcgcugcgccgcaaagcg

SEQ ID NO: 1854911 - RNA, 23 nt, Salmonella typhimurium LT2
aucccgcugugauccauguugcc

SEQ ID NO: 1854912 - RNA, 21 nt, Salmonella typhimurium LT2
aucccgcugaagacuggcaag

SEQ ID NO: 1854913 - RNA, 17 nt, Salmonella typhimurium LT2
aucccggcgcgcguggc

SEQ ID NO: 1854914 - RNA, 15 nt, Salmonella typhimurium LT2
aucccccugccacaa

SEQ ID NO: 1854915 - RNA, 16 nt, Salmonella typhimurium LT2
auccccgccucaccgc

SEQ ID NO: 1854916 - RNA, 12 nt, Salmonella typhimurium LT2
auccccgcuggc

SEQ ID NO: 1854917 - RNA, 21 nt, Salmonella typhimurium LT2
aucccauccgggccacucucc

SEQ ID NO: 1854918 - RNA, 20 nt, Salmonella typhimurium LT2
aucccauccgggccacucuc

SEQ ID NO: 1854919 - RNA, 20 nt, Salmonella typhimurium LT2
aucccagggcggcgucgcca

SEQ ID NO: 1854920 - RNA, 15 nt, Salmonella typhimurium LT2
auccgcgaauaccuu

SEQ ID NO: 1854921 - RNA, 13 nt, Salmonella typhimurium LT2
auccgccgccgca

SEQ ID NO: 1854922 - RNA, 14 nt, Salmonella typhimurium LT2
auccgcauccguca

SEQ ID NO: 1854923 - RNA, 12 nt, Salmonella typhimurium LT2
auccgccagcca

SEQ ID NO: 1854924 - RNA, 20 nt, Salmonella typhimurium LT2
auccgccaccuuaugcucau

SEQ ID NO: 1854925 - RNA, 17 nt, Salmonella typhimurium LT2
auccgauugcugacgaa

SEQ ID NO: 1854926 - RNA, 13 nt, Salmonella typhimurium LT2
auccgagaccagg

SEQ ID NO: 1854927 - RNA, 22 nt, Salmonella typhimurium LT2
auccgcagacuuuagccauucc

SEQ ID NO: 1854928 - RNA, 15 nt, Salmonella typhimurium LT2
auccgacaacaugaa

SEQ ID NO: 1854929 - RNA, 12 nt, Salmonella typhimurium LT2
auccgacaugau

SEQ ID NO: 1854930 - RNA, 18 nt, Salmonella typhimurium LT2
auccgacaugaugccaaa

SEQ ID NO: 1854931 - RNA, 16 nt, Salmonella typhimurium LT2
auccgacgccuguucg

SEQ ID NO: 1854932 - RNA, 14 nt, Salmonella typhimurium LT2
aucccuaauaaaau

SEQ ID NO: 1854933 - RNA, 19 nt, Salmonella typhimurium LT2
aucccgggcgauaaaccag

SEQ ID NO: 1854934 - RNA, 22 nt, Salmonella typhimurium LT2
aucccgggcgauaaaccagccc

SEQ ID NO: 1854935 - RNA, 15 nt, Salmonella typhimurium LT2
aucccguagccgcuu

SEQ ID NO: 1854936 - RNA, 19 nt, Salmonella typhimurium LT2
auccgaaaugaccaccgca

SEQ ID NO: 1854937 - RNA, 21 nt, Salmonella typhimurium LT2
aucccuuucaaaaaagagaag

SEQ ID NO: 1854938 - RNA, 18 nt, Salmonella typhimurium LT2
aucccuuucaaaaaagag

SEQ ID NO: 1854939 - RNA, 16 nt, Salmonella typhimurium LT2
aucccuuccugaccuu

SEQ ID NO: 1854940 - RNA, 13 nt, Salmonella typhimurium LT2
aucccugcggcug

SEQ ID NO: 1854941 - RNA, 13 nt, Salmonella typhimurium LT2
aucgcgcgcgcca

SEQ ID NO: 1854942 - RNA, 11 nt, Salmonella typhimurium LT2
aucgcggcugu

SEQ ID NO: 1854943 - RNA, 18 nt, Salmonella typhimurium LT2
aucgcggaugacuucuuc

SEQ ID NO: 1854944 - RNA, 19 nt, Salmonella typhimurium LT2
aucgccgaaagcgaucaca

SEQ ID NO: 1854945 - RNA, 24 nt, Salmonella typhimurium LT2
aucgcccgguugcaauuccgccau

SEQ ID NO: 1854946 - RNA, 16 nt, Salmonella typhimurium LT2
aucgccgaagcggcag

SEQ ID NO: 1854947 - RNA, 13 nt, Salmonella typhimurium LT2
aucgccgaucaca

SEQ ID NO: 1854948 - RNA, 17 nt, Salmonella typhimurium LT2
aucgccgacgaccggcg

SEQ ID NO: 1854949 - RNA, 15 nt, Salmonella typhimurium LT2
aucgccgccagcuca

SEQ ID NO: 1854950 - RNA, 20 nt, Salmonella typhimurium LT2
aucgccgcaaugaccacaaa

SEQ ID NO: 1854951 - RNA, 20 nt, Salmonella typhimurium LT2
aucggaagacuggcgcagca

SEQ ID NO: 1854952 - RNA, 20 nt, Salmonella typhimurium LT2
aucggcaggacuuaaaaaca

SEQ ID NO: 1854953 - RNA, 21 nt, Salmonella typhimurium LT2
aucgcuaugaugacugguaaa

SEQ ID NO: 1854954 - RNA, 15 nt, Salmonella typhimurium LT2
aucgcuugcccagca

SEQ ID NO: 1854955 - RNA, 18 nt, Salmonella typhimurium LT2
aucgcucuugccuggcga

SEQ ID NO: 1854956 - RNA, 21 nt, Salmonella typhimurium LT2
aucggaaaaauaguggcuggc

SEQ ID NO: 1854957 - RNA, 17 nt, Salmonella typhimurium LT2
aucgcuuugcagaaaau

SEQ ID NO: 1854958 - RNA, 19 nt, Salmonella typhimurium LT2
aucgcuuucgcuuucucuu

SEQ ID NO: 1854959 - RNA, 18 nt, Salmonella typhimurium LT2
aucguaaaucaaaugaga

SEQ ID NO: 1854960 - RNA, 16 nt, Salmonella typhimurium LT2
aucgguucucugccau

SEQ ID NO: 1854961 - RNA, 14 nt, Salmonella typhimurium LT2
aucgguucucugcc

SEQ ID NO: 1854962 - RNA, 23 nt, Salmonella typhimurium LT2
aucguagcaucucuucgacaucu

SEQ ID NO: 1854963 - RNA, 22 nt, Salmonella typhimurium LT2
aucguagcgugcgcaauauggu

SEQ ID NO: 1854964 - RNA, 18 nt, Salmonella typhimurium LT2
aucgguauaacuggucau

SEQ ID NO: 1854965 - RNA, 22 nt, Salmonella typhimurium LT2
aucggucagagcauaaaaauca

SEQ ID NO: 1854966 - RNA, 21 nt, Salmonella typhimurium LT2
aucgguaauugcgccguucac

SEQ ID NO: 1854967 - RNA, 20 nt, Salmonella typhimurium LT2
aucggucugcuucagccacu

SEQ ID NO: 1854968 - RNA, 18 nt, Salmonella typhimurium LT2
aucgggauuccagugaca

SEQ ID NO: 1854969 - RNA, 13 nt, Salmonella typhimurium LT2
aucgggaaucauc

SEQ ID NO: 1854970 - RNA, 12 nt, Salmonella typhimurium LT2
aucggcuugccu

SEQ ID NO: 1854971 - RNA, 19 nt, Salmonella typhimurium LT2
aucggcguuuugcgcgcca

SEQ ID NO: 1854972 - RNA, 14 nt, Salmonella typhimurium LT2
aucggccugaaugc

SEQ ID NO: 1854973 - RNA, 22 nt, Salmonella typhimurium LT2
aucggcgcuacggcguuucacu

SEQ ID NO: 1854974 - RNA, 16 nt, Salmonella typhimurium LT2
aucgaacugugagccu

SEQ ID NO: 1854975 - RNA, 23 nt, Salmonella typhimurium LT2
aucgaacuguuuacccacuucuu

SEQ ID NO: 1854976 - RNA, 21 nt, Salmonella typhimurium LT2
aucgaacgcuuccgggcucau

SEQ ID NO: 1854977 - RNA, 19 nt, Salmonella typhimurium LT2
auccuguagugaagugcag

SEQ ID NO: 1854978 - RNA, 21 nt, Salmonella typhimurium LT2
auccuguagugaagugcagga

SEQ ID NO: 1854979 - RNA, 15 nt, Salmonella typhimurium LT2
auccuguaccaccac

SEQ ID NO: 1854980 - RNA, 19 nt, Salmonella typhimurium LT2
auccuucccccaccaccau

SEQ ID NO: 1854981 - RNA, 21 nt, Salmonella typhimurium LT2
auccuucuaccuucaccccca

SEQ ID NO: 1854982 - RNA, 14 nt, Salmonella typhimurium LT2
auccuucuaccuuc

SEQ ID NO: 1854983 - RNA, 15 nt, Salmonella typhimurium LT2
auccuucuuccauuc

SEQ ID NO: 1854984 - RNA, 14 nt, Salmonella typhimurium LT2
auccgcguggacgc

SEQ ID NO: 1854985 - RNA, 19 nt, Salmonella typhimurium LT2
auccugcaccgccugcggc

SEQ ID NO: 1854986 - RNA, 15 nt, Salmonella typhimurium LT2
auccggauauucugc

SEQ ID NO: 1854987 - RNA, 21 nt, Salmonella typhimurium LT2
auccugcgccauugcgggagc

SEQ ID NO: 1854988 - RNA, 22 nt, Salmonella typhimurium LT2
auccugccuacaggacugcacg

SEQ ID NO: 1854989 - RNA, 13 nt, Salmonella typhimurium LT2
aucgccaaaccag

SEQ ID NO: 1854990 - RNA, 12 nt, Salmonella typhimurium LT2
aucgccaaagcg

SEQ ID NO: 1854991 - RNA, 19 nt, Salmonella typhimurium LT2
aucgcauuuuuaagcuggc

SEQ ID NO: 1854992 - RNA, 20 nt, Salmonella typhimurium LT2
aucgauccaguuaauucguc

SEQ ID NO: 1854993 - RNA, 18 nt, Salmonella typhimurium LT2
aucgauagcgauuuuuga

SEQ ID NO: 1854994 - RNA, 14 nt, Salmonella typhimurium LT2
aucgauauaaugcc

SEQ ID NO: 1854995 - RNA, 21 nt, Salmonella typhimurium LT2
aucgccacggugagccacugc

SEQ ID NO: 1854996 - RNA, 17 nt, Salmonella typhimurium LT2
aucgccaaauccggcuu

SEQ ID NO: 1854997 - RNA, 21 nt, Salmonella typhimurium LT2
aucgccaccguaacuaaaaua

SEQ ID NO: 1854998 - RNA, 18 nt, Salmonella typhimurium LT2
aucgaggccauauuuuac

SEQ ID NO: 1854999 - RNA, 13 nt, Salmonella typhimurium LT2
aucgacgaaaugg

SEQ ID NO: 1855000 - RNA, 21 nt, Salmonella typhimurium LT2
aucgacgauaugcaggggcag

SEQ ID NO: 1855001 - RNA, 15 nt, Salmonella typhimurium LT2
aucgacccccaccau

SEQ ID NO: 1855002 - RNA, 15 nt, Salmonella typhimurium LT2
aucgacauuaugauc

SEQ ID NO: 1855003 - RNA, 22 nt, Salmonella typhimurium LT2
aucgaaucguucgccagugaca

SEQ ID NO: 1855004 - RNA, 15 nt, Salmonella typhimurium LT2
aucgacaaaccacug

SEQ ID NO: 1855005 - RNA, 17 nt, Salmonella typhimurium LT2
auacgcaccagcucuac

SEQ ID NO: 1855006 - RNA, 22 nt, Salmonella typhimurium LT2
auacgcagaucuuuuugcuccu

SEQ ID NO: 1855007 - RNA, 16 nt, Salmonella typhimurium LT2
auacgccuauuuucug

SEQ ID NO: 1855008 - RNA, 13 nt, Salmonella typhimurium LT2
auacgccagcaga

SEQ ID NO: 1855009 - RNA, 15 nt, Salmonella typhimurium LT2
auaccuucacaaaaa

SEQ ID NO: 1855010 - RNA, 22 nt, Salmonella typhimurium LT2
auaccuucuucacuaaaaacag

SEQ ID NO: 1855011 - RNA, 20 nt, Salmonella typhimurium LT2
auaccuucuucacuaaaaac

SEQ ID NO: 1855012 - RNA, 16 nt, Salmonella typhimurium LT2
auaccggcugcuuuug

SEQ ID NO: 1855013 - RNA, 22 nt, Salmonella typhimurium LT2
auaccugcgcuuuggguuaaug

SEQ ID NO: 1855014 - RNA, 22 nt, Salmonella typhimurium LT2
auaccuguugcacgcauggcac

SEQ ID NO: 1855015 - RNA, 22 nt, Salmonella typhimurium LT2
auacaggacugacugcugucau

SEQ ID NO: 1855016 - RNA, 17 nt, Salmonella typhimurium LT2
auacaggcgcaguugaa

SEQ ID NO: 1855017 - RNA, 21 nt, Salmonella typhimurium LT2
auacaggcgcaguugaaaaca

SEQ ID NO: 1855018 - RNA, 16 nt, Salmonella typhimurium LT2
auacagcgccgcgcag

SEQ ID NO: 1855019 - RNA, 16 nt, Salmonella typhimurium LT2
auaccgcuuuguaaaa

SEQ ID NO: 1855020 - RNA, 17 nt, Salmonella typhimurium LT2
auaccgcguuugcgcaa

SEQ ID NO: 1855021 - RNA, 18 nt, Salmonella typhimurium LT2
auaccgccugaugagguu

SEQ ID NO: 1855022 - RNA, 15 nt, Salmonella typhimurium LT2
auaccgccagcccca

SEQ ID NO: 1855023 - RNA, 23 nt, Salmonella typhimurium LT2
auaccgccgcccagcacaaugac

SEQ ID NO: 1855024 - RNA, 22 nt, Salmonella typhimurium LT2
auaccgccgguaaggccaauca

SEQ ID NO: 1855025 - RNA, 18 nt, Salmonella typhimurium LT2
auacuuaucaacuucuuc

SEQ ID NO: 1855026 - RNA, 13 nt, Salmonella typhimurium LT2
auacuucaucagg

SEQ ID NO: 1855027 - RNA, 22 nt, Salmonella typhimurium LT2
auacuucgacaauauuuuucag

SEQ ID NO: 1855028 - RNA, 22 nt, Salmonella typhimurium LT2
auacuggccgguuuuaaaaaua

SEQ ID NO: 1855029 - RNA, 20 nt, Salmonella typhimurium LT2
auacuggcaguaaaaagaaa

SEQ ID NO: 1855030 - RNA, 13 nt, Salmonella typhimurium LT2
auacugccgccgu

SEQ ID NO: 1855031 - RNA, 17 nt, Salmonella typhimurium LT2
auacugcucauaacccu

SEQ ID NO: 1855032 - RNA, 16 nt, Salmonella typhimurium LT2
auacugccgcccaucg

SEQ ID NO: 1855033 - RNA, 20 nt, Salmonella typhimurium LT2
auacuccugcaacagaagag

SEQ ID NO: 1855034 - RNA, 13 nt, Salmonella typhimurium LT2
auacucaaaaaau

SEQ ID NO: 1855035 - RNA, 16 nt, Salmonella typhimurium LT2
auacgcgucagccuac

SEQ ID NO: 1855036 - RNA, 12 nt, Salmonella typhimurium LT2
auacgcugaaga

SEQ ID NO: 1855037 - RNA, 22 nt, Salmonella typhimurium LT2
auacuauccaacagaaggcuuc

SEQ ID NO: 1855038 - RNA, 18 nt, Salmonella typhimurium LT2
auagcaacguccgcagcc

SEQ ID NO: 1855039 - RNA, 15 nt, Salmonella typhimurium LT2
auagcaauaaauacc

SEQ ID NO: 1855040 - RNA, 16 nt, Salmonella typhimurium LT2
auagcaaugaagcaag

SEQ ID NO: 1855041 - RNA, 20 nt, Salmonella typhimurium LT2
auagcaucggucaacugaau

SEQ ID NO: 1855042 - RNA, 17 nt, Salmonella typhimurium LT2
auagcagcgcccuuuca

SEQ ID NO: 1855043 - RNA, 21 nt, Salmonella typhimurium LT2
auagcaggcacuacggugugc

SEQ ID NO: 1855044 - RNA, 12 nt, Salmonella typhimurium LT2
auagcaggcauc

SEQ ID NO: 1855045 - RNA, 13 nt, Salmonella typhimurium LT2
auagcaggcauca

SEQ ID NO: 1855046 - RNA, 14 nt, Salmonella typhimurium LT2
auagcaggcaucaa

SEQ ID NO: 1855047 - RNA, 13 nt, Salmonella typhimurium LT2
auagccugggcaa

SEQ ID NO: 1855048 - RNA, 22 nt, Salmonella typhimurium LT2
auagccuuugucgaaauugccg

SEQ ID NO: 1855049 - RNA, 16 nt, Salmonella typhimurium LT2
auagcguugauaugcu

SEQ ID NO: 1855050 - RNA, 14 nt, Salmonella typhimurium LT2
auagccacaggcug

SEQ ID NO: 1855051 - RNA, 13 nt, Salmonella typhimurium LT2
auagccaaaagcu

SEQ ID NO: 1855052 - RNA, 11 nt, Salmonella typhimurium LT2
auagccaggca

SEQ ID NO: 1855053 - RNA, 21 nt, Salmonella typhimurium LT2
auagccagcgugaaccuguua

SEQ ID NO: 1855054 - RNA, 21 nt, Salmonella typhimurium LT2
auagccguaaauaaucaccac

SEQ ID NO: 1855055 - RNA, 12 nt, Salmonella typhimurium LT2
auagccugggca

SEQ ID NO: 1855056 - RNA, 13 nt, Salmonella typhimurium LT2
auagccuaaucuc

SEQ ID NO: 1855057 - RNA, 13 nt, Salmonella typhimurium LT2
auagaugggaugg

SEQ ID NO: 1855058 - RNA, 12 nt, Salmonella typhimurium LT2
auagauauuaaa

SEQ ID NO: 1855059 - RNA, 23 nt, Salmonella typhimurium LT2
auagaucaggcgaccauccacca

SEQ ID NO: 1855060 - RNA, 15 nt, Salmonella typhimurium LT2
auagaguaaugacaa

SEQ ID NO: 1855061 - RNA, 21 nt, Salmonella typhimurium LT2
auagaguaaugacaaaaauua

SEQ ID NO: 1855062 - RNA, 12 nt, Salmonella typhimurium LT2
auauaaaaauag

SEQ ID NO: 1855063 - RNA, 16 nt, Salmonella typhimurium LT2
auaguuuuucaagaau

SEQ ID NO: 1855064 - RNA, 21 nt, Salmonella typhimurium LT2
auagugcgugacaaucuccuc

SEQ ID NO: 1855065 - RNA, 19 nt, Salmonella typhimurium LT2
auagugccgguggcaugaa

SEQ ID NO: 1855066 - RNA, 15 nt, Salmonella typhimurium LT2
auagugcgcuaucau

SEQ ID NO: 1855067 - RNA, 16 nt, Salmonella typhimurium LT2
auagcuaaccagcgag

SEQ ID NO: 1855068 - RNA, 17 nt, Salmonella typhimurium LT2
auagcuaaccagcgagc

SEQ ID NO: 1855069 - RNA, 15 nt, Salmonella typhimurium LT2
auagcuauauuuuuu

SEQ ID NO: 1855070 - RNA, 23 nt, Salmonella typhimurium LT2
auagcuauauuuuuuaucagacu

SEQ ID NO: 1855071 - RNA, 14 nt, Salmonella typhimurium LT2
auagcugaacauac

SEQ ID NO: 1855072 - RNA, 15 nt, Salmonella typhimurium LT2
auauacccccugcaa

SEQ ID NO: 1855073 - RNA, 14 nt, Salmonella typhimurium LT2
auauaaucuaccau

SEQ ID NO: 1855074 - RNA, 13 nt, Salmonella typhimurium LT2
auauaaucugaaa

SEQ ID NO: 1855075 - RNA, 16 nt, Salmonella typhimurium LT2
auauaauaucaacccu

SEQ ID NO: 1855076 - RNA, 17 nt, Salmonella typhimurium LT2
auauaauccggcgaggc

SEQ ID NO: 1855077 - RNA, 17 nt, Salmonella typhimurium LT2
auauaaucgcccacuug

SEQ ID NO: 1855078 - RNA, 15 nt, Salmonella typhimurium LT2
auauaagcuuuucca

SEQ ID NO: 1855079 - RNA, 20 nt, Salmonella typhimurium LT2
auauaugaaccaagauaaga

SEQ ID NO: 1855080 - RNA, 13 nt, Salmonella typhimurium LT2
auauauagagcag

SEQ ID NO: 1855081 - RNA, 23 nt, Salmonella typhimurium LT2
auauagagcccucuauccacaca

SEQ ID NO: 1855082 - RNA, 18 nt, Salmonella typhimurium LT2
auauacgacggcuaaguu

SEQ ID NO: 1855083 - RNA, 15 nt, Salmonella typhimurium LT2
auauacgccacggcc

SEQ ID NO: 1855084 - RNA, 17 nt, Salmonella typhimurium LT2
auauauugaccuuguga

SEQ ID NO: 1855085 - RNA, 21 nt, Salmonella typhimurium LT2
auauauuucacuucaucauca

SEQ ID NO: 1855086 - RNA, 19 nt, Salmonella typhimurium LT2
auaucaggcaaaaaucguc

SEQ ID NO: 1855087 - RNA, 17 nt, Salmonella typhimurium LT2
auaucaggacuuuuucc

SEQ ID NO: 1855088 - RNA, 13 nt, Salmonella typhimurium LT2
auaucaucaucuc

SEQ ID NO: 1855089 - RNA, 22 nt, Salmonella typhimurium LT2
auaucaucgucauuaaugccua

SEQ ID NO: 1855090 - RNA, 17 nt, Salmonella typhimurium LT2
auaucgauagcauuuuu

SEQ ID NO: 1855091 - RNA, 15 nt, Salmonella typhimurium LT2
auaucccgcauaccg

SEQ ID NO: 1855092 - RNA, 19 nt, Salmonella typhimurium LT2
auaucccggcugacauaau

SEQ ID NO: 1855093 - RNA, 16 nt, Salmonella typhimurium LT2
auaucccuucucaugg

SEQ ID NO: 1855094 - RNA, 18 nt, Salmonella typhimurium LT2
auaucccggcugacauaa

SEQ ID NO: 1855095 - RNA, 13 nt, Salmonella typhimurium LT2
auaucgccauuca

SEQ ID NO: 1855096 - RNA, 13 nt, Salmonella typhimurium LT2
auaucgccauaca

SEQ ID NO: 1855097 - RNA, 23 nt, Salmonella typhimurium LT2
auaucgaugcuuauuauuuuuuc

SEQ ID NO: 1855098 - RNA, 18 nt, Salmonella typhimurium LT2
auaucuguauaaauaaaa

SEQ ID NO: 1855099 - RNA, 13 nt, Salmonella typhimurium LT2
auaucguaaauua

SEQ ID NO: 1855100 - RNA, 20 nt, Salmonella typhimurium LT2
auaucguucaguuucaaaga

SEQ ID NO: 1855101 - RNA, 19 nt, Salmonella typhimurium LT2
auaucuaugguaauuuaaa

SEQ ID NO: 1855102 - RNA, 14 nt, Salmonella typhimurium LT2
auaugaaagagaaa

SEQ ID NO: 1855103 - RNA, 13 nt, Salmonella typhimurium LT2
auaugaaccaaga

SEQ ID NO: 1855104 - RNA, 19 nt, Salmonella typhimurium LT2
auaucuuacggaaaaaugu

SEQ ID NO: 1855105 - RNA, 19 nt, Salmonella typhimurium LT2
auaugauagaaguuaugca

SEQ ID NO: 1855106 - RNA, 21 nt, Salmonella typhimurium LT2
auaugaucgaaaaugcgcaug

SEQ ID NO: 1855107 - RNA, 13 nt, Salmonella typhimurium LT2
auaugaguuaugu

SEQ ID NO: 1855108 - RNA, 15 nt, Salmonella typhimurium LT2
auaugacccgggcgu

SEQ ID NO: 1855109 - RNA, 13 nt, Salmonella typhimurium LT2
aucaucaggaaca

SEQ ID NO: 1855110 - RNA, 17 nt, Salmonella typhimurium LT2
aucaucagaagaagaca

SEQ ID NO: 1855111 - RNA, 15 nt, Salmonella typhimurium LT2
aucaucagcagcagc

SEQ ID NO: 1855112 - RNA, 19 nt, Salmonella typhimurium LT2
aucaucagcaucuuuggcu

SEQ ID NO: 1855113 - RNA, 14 nt, Salmonella typhimurium LT2
aucaucacaauuag
